United States Patent 10,501,513 (MODIFIED POLYNUCLEOTIDES FOR THE PRODUCTION OF ONCOLOGY-RELATED PROTEINS AND PEPTIDES) - sequence listing, part 14

SEQ ID NO: 23766 - DNA, 444 bp, Artificial Sequence
  Description of Artificial Sequence: Synthetic coding sequence
atggaggaggccagccagcggaagtggaacttcgacttccagaaccataagcctctcgaagggaagtacgaatggcaggaggtggaaaagggctccctcccagagttctattaccgcccacctaggccccccaagggagcgtgtaaggtgcccgcacaggaaagccaggacgtaagtggctcccggccggcagctcctctcattggagctcccgccaattcagaagatactcatctcgtcgatccaaagactgatccgtccgactctcagactggccttgcagagcagtgcgcaggtattcgaaagcgtccggcaacagacgattcatccacacagaataaaagagccaacagaaccgaagaaaacgttagtgacggatccccgaacgccggatccgtcgaacagacccccaagaagccaggcctgaggagaagacagacttag

SEQ ID NO: 23767 - DNA, 918 bp, Artificial Sequence
  Description of Artificial Sequence: Synthetic coding sequence
atggagcggctggtggcccggggcaccttccccgtgctggtgcggacctcggcatgcagatctctattcggaccagtcgaccacgaagaactgagtcgcgaactccaggcccgtcttgccgaactgaacgccgaagatcagaaccgatgggactacgatttccagcaggacatgcctctgagaggcccgggacgtctccaatggaccgaggtggattcggatagcgtgcctgccttttaccgggagaccgtccaggtgggtcgatgtcgcttgcttttagccccgaggcctgttgcggtcgcagtggccgtttccccacccttggagcccgccgcagagtcactagatggactggaagaggccccagagcagttaccctccgtgcccgtccccgcacccgcttcaacccccccacctgttcccgttctcgccccggcccctgcccccgccccagcacctgtcgccgcgcccgtcgctgcacccgtggccgttgctgtcctggcacctgcgccagctccagccccagccccagcccctgccccggcacccgtggccgcccccgcacccgcccccgcgccagcacctgcacctgccccggcaccagcgccagcccccgatgcggcaccacaggagagtgcagagcagggcgcaaaccagggccagcgcgggcaggagcctttagccgatcagctgcatagtggcatatctggccggccagccgcaggaactgcggcagctagcgcaaacggagcagcgatcaaaaagctgtcaggaccgttgatctccgactttttcgccaaaaggaagaggagtgctcctgagaagtcgtctggagacgtaccagcaccctgcccatctcccagcgcagcacccggggtggggtccgtcgagcaaacgcctaggaaaagactgcgctag

SEQ ID NO: 23768 - DNA, 951 bp, Artificial Sequence
  Description of Artificial Sequence: Synthetic coding sequence
atgagcgacgccagcctgcggagcaccagcaccatggagcggctggtggctcgcggcacattccccgtgcttgtgagaacttccgcctgccgaagcctctttgggcctgttgatcatgaagaactgagccgtgagctgcaggcccgtctagcagaactaaatgccgaagaccagaatcgatgggactacgacttccagcaggacatgcccttgcggggtcccgggcggctccaatggaccgaggtagacagcgactccgtgcccgcattctaccgggaaactgtgcaagtgggcaggtgtcggctcctcctcgcgcccaggcccgtggcggtggcagtagccgtttccccgccactggagcccgcagcggaaagtctggatggactggaagaggctccagagcagctgccctctgtgcctgtgcctgccccagcctctaccccacccccagtaccagtgctcgctccagcgcctgcccctgccccagcaccggttgccgctcctgtcgccgcaccggtggctgtggccgttctggcacctgcccctgcccccgctcctgcgccggccccggcgcctgcgccagtggctgctccagcccccgctccagctcccgcgcctgcgcctgctccagccccggctcccgctccagatgcagccccacaggagagcgccgaacagggagccaaccaggggcagcgggggcaggaaccactggctgaccagctccatagtgggatctctggcagacccgctgcgggaaccgcggctgcgagtgctaatggtgccgccatcaagaagctcagtggacctctgatttcagacttttttgcaaagcgaaaaaggagcgcccccgagaagagctcaggcgatgtgcctgccccatgtccatcgccatccgccgcccccggggtagggagcgtcgaacaaaccccaaggaagcgattgcgctag

SEQ ID NO: 23769 - DNA, 951 bp, Artificial Sequence
  Description of Artificial Sequence: Synthetic coding sequence
atgagcgacgccagcctgcggagcaccagcaccatggagcggctggttgcccgcggcactttccccgtgctggtaaggacctctgcttgccgaagtcttttcgggcccgttgaccatgaggaactcagtagggagctgcaggcgagacttgcagagctcaacgccgaggatcagaatcgctgggactacgactttcagcaggatatgccattaagaggtccaggacgcctccagtggacagaagtggactccgacagcgtcccggctttttatcgcgaaaccgtgcaagtgggacggtgtcggctgctgctggctcctaggccggtggccgtcgccgtagccgtgtctcccccactggaacccgcagccgagtccctggatggattggaagaggcgcccgagcagttaccttccgtgcctgtgccagcaccagcaagtactcctccgccggtgcctgtcctggcacccgcaccagcccccgcacccgctccggtagcagctcctgtggccgctcccgttgccgtagcagtactcgctccggctcccgctcctgctcccgcaccagcccccgcgccggcacctgtggctgcacctgccccagcccccgcacccgcccctgcccccgccccagctcctgcccccgctccagacgccgcgccacaggaatccgccgaacaaggggcaaaccagggacagagagggcaggaaccactcgcagatcaactgcattccggaattagtggccgccccgccgccggaactgcagccgcaagtgccaatggggccgccattaaaaagctgtccgggccactgatctcagatttcttcgcaaagagaaaacggtctgcacctgagaagtcctctggcgatgtcccggccccctgcccatctcccagtgccgcccctggcgtgggtagcgttgagcaaactcctaggaagcgactacgatag

SEQ ID NO: 23770 - DNA, 918 bp, Artificial Sequence
  Description of Artificial Sequence: Synthetic coding sequence
atggagcggctggtggcccggggcaccttccccgtgctggtgcggacgtcagcctgtagatctctgtttgggcctgtagatcacgaggaactctccagggaattacaagcccggctagctgagttaaatgcggaagatcagaatcggtgggattatgatttccagcaagatatgcccctccgaggcccggggcgacttcagtggaccgaagttgacagtgattccgtgcctgccttttaccgcgaaactgttcaggtgggaaggtgccggcttttgctggcacctaggccggtggcagtggccgtggcagtgtccccacctttggaacctgctgccgagagtctggacgggcttgaagaggctcctgagcaactgccaagcgtaccagttcccgcccctgccagcacacctccgcctgtcccagtcctggccccagctcctgccccggctccagcgcccgtggccgctccagtggctgcacctgttgcagttgctgtgctcgccccggccccagcccccgctcccgcccctgctcctgccccggcacccgtggccgcaccggcccctgccccagcgcctgcccctgctcccgcccccgcgcccgcccctgctccagacgccgcaccacaggagtctgcggagcagggagcgaatcagggacagcgagggcaggaaccgcttgctgaccaactgcatagtggcatctcgggtcgacctgctgctggcacagcagccgcctctgctaatggagctgccatcaagaagctgtctggtcctctgatctctgatttctttgctaaacgaaaacggtctgcccccgaaaagtcatctggggacgtaccggccccgtgcccctccccttctgccgctccgggagtggggtccgtcgagcagactccaagaaagaggctgcgctag

SEQ ID NO: 23771 - DNA, 504 bp, Artificial Sequence
  Description of Artificial Sequence: Synthetic coding sequence
atggagcccgccgccggcagcagcatggagcccagcgccgactggttagctactgctgccgctagaggcagggttgaggaagttagagcactgctggaggccggcgcactgccaaacgccccaaattcttatggtaggcgtcccattcaagtgatgatgatgggttcggcgagagtcgctgaactgcttctgctgcacggagccgaaccaaactgcgctgatccagccacactgaccagaccagtgcatgacgcagcgagagaggggttcctggatactctggtggtgctccaccgagccggcgctcgactagacgtgcgagacgcgtggggccgcctccctgtggatctcgccgaggaactcgggcatcgcgacgtggctagatacctgcgagccgccgcaggtggtacccggggcagtaaccacgcccggatcgacgccgctgaggggccctcagagatgatcgggaaccacctatgggtttgtcggtcaagacatgcatag

SEQ ID NO: 23772 - DNA, 471 bp, Artificial Sequence
  Description of Artificial Sequence: Synthetic coding sequence
atggagcccgccgccggcagcagcatggagcccagcgccgactggttggctaccgctgcagccaggggtagagtcgaagaggtccgggccctgctagaggccggtgctttgccaaacgcaccaaattcctacggtcgaaggcctattcaagtgatgatgatgggttcggccagggtggccgagctgctgcttctacacggcgcagagcccaactgcgccgatccagcaacactgacaagacctgtgcatgatgctgccagggaggggttcctggatacactggtggtcttgcaccgagccggcgctcggctggatgtcagggatgcatggggcagattacccgttgacctggccgaggaactggggcacagggatgtcgcccggtacctaagggcagccgcgggtggcaccagggggagcaaccacgcacgaattgacgcagcagagggaccaagtgatatacccgactag

SEQ ID NO: 23773 - DNA, 522 bp, Artificial Sequence
  Description of Artificial Sequence: Synthetic coding sequence
atgggccggggccggtgcgtgggccccagcctgcagctgcggggccaggaatggcggtgttcccccctggtccccaagggcggtgctgccgctgccgagctgggtcccggagggggcgagaatatggtgaggaggttcttggttaccttaagaatccgccgagcttgtggtccaccgcgagtcagggtgttcgtagtccacatccctcgcttgacgggggagtgggcagctccaggggctcccgccgcggtcgccctggtgcttatgcttctgcgatcgcagagactggggcagcagcctctcccacggcgacctggtcatgacgacgggcaaaggccttcaggaggggcggctgccgctccccgtcgaggagcacagctacggcgtcctcgacattcccaccctacccgcgcccgccgctgccccggcggccttcccgggcacgctggcggcgcagcccccggcagaggggccgctggtcgcgcacgctgccttggtcccagcgcacgcgggcccggctag

SEQ ID NO: 23774 - DNA, 504 bp, Artificial Sequence
  Description of Artificial Sequence: Synthetic coding sequence
atggagcccgccgccggcagcagcatggagcccagcgccgactggctggccactgctgcagctcgaggtcgtgtagaggaagtccgcgccctcctggaggccggagctttgcccaatgctcccaactcctatggcaggcgccctattcaggtgatgatgatgggttcggctagggtagcggagctgcttttgttgcacggcgccgagccaaactgcgctgatccagcaacacttactcgacctgttcacgatgctgcgcgcgagggattcctcgataccctggtggtgctgcatagggccggcgccaggctcgacgtcagggatgcctggggcagactccccgtggatctggctgaggagctgggacatcgggacgtcgcacgctatctaagagcagctgccggtggcacaaggggctcaaaccatgcaagaatcgatgcagctgaaggtccctcggagatgatcggaaaccacctctgggtgtgtaggagtcggcacgcatag

SEQ ID NO: 23775 - DNA, 399 bp, Artificial Sequence
  Description of Artificial Sequence: Synthetic coding sequence
atggtgcggcggttcctggtgaccctgcggatccggcgggcctgcggaccaccccgcgtacgggtatttgtcgtacatatcccccggctcactggcgaatgggccgcccctggcgccccagccgccgtggcacttgtcctcatgctgctgcggagtcagcgcctggggcaacaaccattgcctaggcgtccgggacacgacgacggacagcgaccctcgggcggcgccgcggccgcaccacggagaggggcccaactgcgacggccccggcatagccaccccacgcgtgctaggcggtgcccaggagggctacctggccatgctgggggagccgcccctgggagaggcgccgcgggccgggcacggtgtcttgggccgtccgcaaggggtccaggctag

SEQ ID NO: 23776 - DNA, 417 bp, Artificial Sequence
  Description of Artificial Sequence: Synthetic coding sequence
atgcgggaggagaacaagggcatgcccagcggcggcggcagcgacgagggactggcatctgccgccgcccgcggtcttgtcgaaaaagtccggcaattactggaggccggcgctgacccaaacggagtgaacagattcggtaggagagccatccaagtaatgatgatgggttctgctcgggtggctgagctgttattgctgcacggagccgagccaaattgcgcagatccagctacactgacgcgccctgtgcacgacgctgcaagagaaggctttctcgatactttggtggtgctacacagagctggggcgcggctggatgtgcgcgatgcttggggaagactgccagttgatcttgctgaggagaggggccatagggacgtggctgggtacctgaggactgcaacaggggactag

SEQ ID NO: 23777 - DNA, 237 bp, Artificial Sequence
  Description of Artificial Sequence: Synthetic coding sequence
atgcgggaggagaacaagggcatgcccagcggcggcggcagcgacgagggcttggcctccgcagccgcccgcggcctcgtggagaaggttcgtcagctgctggaagccggcgctgatccaaatggcgttaaccgctttggtagacgcgccatccaggtggcgggcgctccaggccctcggcgccagggcgcccgagagagaggcgcccgtccgagacggattggtgccggcacatag

SEQ ID NO: 23778 - DNA, 237 bp, Artificial Sequence
  Description of Artificial Sequence: Synthetic coding sequence
atgcgggaggagaacaagggcatgcccagcggcggcggcagcgacgaggggttagcttcagcggccgccaggggtctggtcgaaaaagtccgtcaactgctggaggctggtgccgacccaaatggagtgaatcggtttggcaggcgggctattcaggtggcaggagcgcccggccctaggagacagggcgctcgagaacggggggccagacccagacgcatcggtgcaggaacatag

SEQ ID NO: 23779 - DNA, 507 bp, Artificial Sequence
  Description of Artificial Sequence: Synthetic coding sequence
atggccgagccctggggcaacgagctggccagcgccgccgcccggggggacctcgagcagctaacttccctgctgcagaacaacgtcaatgtcaacgctcagaatggtttcggccgcaccgccttgcaggttatgaaactgggtaaccccgagattgcccgacgccttcttctccggggagctaacccagatctaaaagatcgaacaggcttcgccgtgatccacgacgccgccagggcaggattcctcgacactctgcagacccttctcgagttccaagcggatgtcaatatcgaggacaatgaaggaaatttacccctgcacctcgccgccaaagagggccacctgcgagtggtagagtttttagtgaagcatacggcctctaacgtcggccaccgaaatcacaaaggagataccgcatgtgatctagccagactgtatggaagaaacgaggttgtgtccctgatgcaagctaatggtgctggaggggccacgaacctccaatag

SEQ ID NO: 23780 - DNA, 507 bp, Artificial Sequence
  Description of Artificial Sequence: Synthetic coding sequence
atggccgagccctggggcaacgagctggccagcgccgccgcccggggggacttggagcaactgaccagcctgcttcagaacaacgtcaatgttaatgcccagaacggtttcggaaggaccgccctccaagtgatgaaactcggcaacccagaaattgctaggaggctgttgcttagaggagctaatccagatctgaaggacaggactggcttcgccgtcatacacgacgctgctcgtgctggttttctggacaccctgcagacactcctcgaatttcaggccgacgtcaatatcgaggacaacgaaggcaacttaccactgcatttggccgcaaaggaaggccacctgagggtggtggaattccttgtgaaacatactgccagcaacgtgggccaccgcaatcacaaaggcgataccgcctgcgatctagctcgcctctatggcagaaacgaggttgtgtccctgatgcaagccaacggcgctggtggcgccaccaatctgcagtag

SEQ ID NO: 23781 - DNA, 507 bp, Artificial Sequence
  Description of Artificial Sequence: Synthetic coding sequence
atggccgagccctggggcaacgagctggccagcgccgccgcccggggagacctggaacaactgacatctcttcttcaaaacaacgtcaacgtcaatgcacagaatggttttggtcgaacagcactgcaggttatgaagctgggcaatcccgagattgctaggagacttctgctgcgaggagccaatccagacctcaaagatcggaccggctttgcagtcatacatgacgcggcgcgggccggcttcctcgatacccttcagactctcttagagttccaagccgacgtgaatatcgaagacaacgagggcaacttgcctctgcatctggctgctaaggagggccacctgagagtggtggagtttctggtcaagcacactgcgtctaatgtgggccacagaaatcacaaaggcgacactgcttgtgatctggcgcgcctctacggtcgcaatgaggtagtgtccctgatgcaagccaacggcgcaggtggagccactaaccttcaatag

SEQ ID NO: 23782 - DNA, 501 bp, Artificial Sequence
  Description of Artificial Sequence: Synthetic coding sequence
atgctgctggaggaggtgcgggccggcgaccggctgagcggcgccgcagcacgaggtgatgttcaggaagtccggagactgctacacagagaactggttcatcctgacgcattaaaccgcttcggaaagaccgcgctgcaggtgatgatgttcgggagtactgctatcgccctggagctgttgaagcaaggtgctagcccaaacgttcaggacaccagtggcacaagtccggtgcatgacgctgccaggacagggttcctagatacactgaaagttttagtagaacacggggccgacgtcaacgtacctgatgggacaggggcccttcctatccacctggctgttcaagagggccatactgccgtggttagcttcctggctgcagagagtgatctccaccgaagggatgcccgtggactaacacctctcgagttagccctgcagcgcggtgctcaggacttggtggacatcctgcagggccacatggtagctcctctttag

SEQ ID NO: 23783 - DNA, 501 bp, Artificial Sequence
  Description of Artificial Sequence: Synthetic coding sequence
atgctgctggaggaggtgcgggccggcgaccggctgagcggcgccgccgctcgaggggacgtacaggaggtgcgcaggctcctgcatagggagctggtccacccagacgctttaaatcggtttggaaagaccgccctgcaggtgatgatgttcgggtcaacagctatcgccctggaacttctgaaacagggcgccagtccgaatgtacaggacacaagtggtacctcccccgttcatgacgccgctaggacaggcttcctcgacacattaaaggtactggtggagcatggggcggatgtgaacgtgccagatggcaccggagcgttgcctatccaccttgccgtccaggaggggcacactgccgtggtgagcttcctggccgccgagtctgacttgcatagacgagatgcacgtggcctcacccccctcgagttagcgctgcagaggggagctcaagacctcgtcgacatcctgcagggtcacatggtggcacctctttag

SEQ ID NO: 23784 - DNA, 639 bp, Artificial Sequence
  Description of Artificial Sequence: Synthetic coding sequence
atgaagccccccagcagcatccagaccagcgagttcgacagcagcgacgaagaaccaattgaagatgaacagaccccgattcacattagctggctgtctttaagtcgtgtgaattgcagccagtttctgggcttatgcgcactccccggctgcaagtttaaggatgttagacgtaacgtccaaaaggacaccgaagaactaaagtcctgtggtatccaggatattttcgtgttttgtaccaggggagaacttagtaaatatagagtgccgaacctgctcgatctttaccagcagtgtggcattataactcatcatcaccctatagcagacggtggtacgccggacatcgcgtcgtgctgcgaaattatggaggaactcactacatgcctgaagaattaccggaagacactcatccactgctatgggggactggggcggtcttgtctggtggcagcctgtctattgctttacctgtccgacacaatcagcccagagcaagcaatcgatagccttagagacctgaggggctcaggagccatccagacaatcaaacagtataattatctccacgaattccgtgacaaactcgccgcccatctatccagcagagactcacaaagcagatcagtgagtcggtag

SEQ ID NO: 23785 - DNA, 501 bp, Artificial Sequence
  Description of Artificial Sequence: Synthetic coding sequence
atgaacccctgctgcaagttcaaggacgtgcggcggaacgtgcagaaagacacggaggagctgaagtcatgtggcatccaggacatatttgtattctgtaccaggggtgagctgtcaaagtacagggtaccaaacctgttggacctctatcagcagtgtggaatcattacgcatcaccatcccatcgccgatggaggcacccccgatatcgccagttgctgtgagattatggaggagttaactacctgcctcaaaaactatagaaaaacccttattcactgttacggtggcctgggccgaagctgtctagtcgcagcgtgccttctgttatacctgagtgacaccattagtccagaacaggccatcgattctttgcgagacttgaggggcagcggggccatccaaactattaagcaatacaattacctacatgaatttcgagacaagctggcagcccatcttagctcccgggactcccagtctcggagcgtttccaggtag

SEQ ID NO: 23786 - DNA, 210 bp, Artificial Sequence
  Description of Artificial Sequence: Synthetic coding sequence
atgaagccccccagcagcatccagaccagcgagttcgacagcagcgatgaggagcctattgaagacgaacagacccccatacatatcagttggctgtccctctcgcgagtaaactgtagccagttcctgggcctatgcgctctgccaggttgcaagttcaaagatgtccgaaggaacgtgcagaaagaaaagaaaaagaaaaagaaatag

SEQ ID NO: 23787 - DNA, 624 bp, Artificial Sequence
  Description of Artificial Sequence: Synthetic coding sequence
atgaagccccccagcagcatccagaccagcgagttcgacagcagcgacgaagagccgattgaggacgagcagactccaatccatatttcttggctatcgctgagtagggtgaattgctctcagttccttgggctctgtgctcttccaggctgcaaatttaaggacgttcggcggaatgtgcagaaggacactgaggaactaaaatcctgcggcatccaggacatttttgtgttctgcacacgtggggagttgtcaaagtatagagtccccaatctcctggatctgtatcagcagtgcggcattattacccatcaccaccccatcgcagacggtgggactccagatatcgcctcctgttgcgaaataatggaggagttgaccacctgccttaaaaatcttttttgctatgggggcttgggcagaagttgtttggttgctgcctgtctcctgctttatctttccgacaccatttctcccgagcaggctatagactccctccgcgacctgcggggctctggagctatccagacaataaagcagtacaactacctgcacgaatttagggataagctagccgcacatttaagcagtagggatagccagagtcgcagcgttagcagatag

SEQ ID NO: 23788 - DNA, 519 bp, Artificial Sequence
  Description of Artificial Sequence: Synthetic coding sequence
atgaagccccccagcagcatccagaccagctgcaagttcaaggacgtgagacgcaacgtccagaaagatacagaggagctgaagtcatgcggtattcaagatatatttgtgttctgcactagaggcgagctatccaaataccgggttcccaaccttttggacctgtaccaacagtgtggcataatcacacaccatcatccaattgcagacgggggaacccctgatatagcgtcctgctgcgaaatcatggaggaactgaccacatgtctgaaaaattataggaagactctgatccattgctatgggggacttggccgttcctgtctggtggctgcctgcctccttctgtacctaagcgacactatttccccagaacaggccattgactcactccgggatctgcgggggtcgggagccattcagacaatcaaacagtataattaccttcacgaatttcgggacaagttggccgcacatctctctagcagagattctcagtcgcggtctgtctctaggtag

SEQ ID NO: 23789 - DNA, 2871 bp, Artificial Sequence
  Description of Artificial Sequence: Synthetic coding sequence
atgagcagcggcctgtggagccaggagaaggtgaccagcccctactgggaagaaaggattttttacctgctgctgcaagaatgctctgtcacagataagcagactcagaagttgttgaaggtaccaaagggaagcatcggtcagtacattcaggacaggagtgtgggacatagtcgcatcccatcggccaagggcaagaagaatcaaatcggattaaagatcctcgagcagccccacgctgttttgtttgtcgatgagaaggatgtagtagagataaacgaaaagtttacggaactgctgttggcgattacgaactgtgaggagagattctccctcttcaaaaacagaaaccgcctgagtaaagggctgcagattgacgttgggtgtccagtaaaggttcaactgagaagcggcgaggaaaaatttccaggagtggtacggttccggggccctctgctagccgaacggacagtaagcggaatcttctttggcgtggaactacttgaggaaggtaggggccagggatttaccgatggcgtctaccagggtaaacaactgtttcagtgcgatgaagactgcggagtgttcgttgcactggataaacttgagttgattgaggatgacgatactgccttggagtctgattacgcagggccaggggacacaatgcaggtggaactgccccctctcgagattaatagccgcgtgagcctaaaggttggcgaaacgatcgagagtggcacggtgattttttgtgacgtcctgccgggcaaggaatccctgggttattttgttggggtcgatatggataatcctatagggaactgggatggaaggttcgatggcgtgcagctgtgtagtttcgcatgcgtcgaaagcaccatcctgctgcatataaacgacatcattcctgccctgtcggagagtgtgactcaggaaaggcgccctcctaagttggcctttatgagccgaggagtaggtgataaaggaagctcctctcataataaacccaaagccaccggtagcaccagtgatcctggtaataggaatagatcagaactgttctacacactgaacggctcctctgtggattctcagccccagtctaaatctaaaaacacatggtacattgatgaggtggccgaagatcccgccaaaagcctcaccgagatatccactgatttcgatcgctccagcccacccctccagcctccacctgtgaatagcttaactactgaaaatcggtttcactccctgccattctcactgaccaaaatgcccaacactaatggaagcattgggcactcaccactgagtcttagtgcccagtcagtgatggaggagctgaatacagcacctgtgcaggagagcccaccccttgccatgccaccaggaaattcccacggcttagaggtcggcagcctggccgaggtgaaggagaatcctcctttctacggggtaattcgttggatcgggcagcctcctgggctgaatgaagtcctggccggactggaactggaagacgaatgcgcaggctgtaccgatgggacattcaggggaacccggtatttcacttgcgctctaaaaaaggcactcttcgtgaaactgaaaagctgtcggcctgactctaggtttgcctccctgcagcccgtgtcgaatcagattgaacgctgcaattcactggctttcgggggatacctgtctgaagtggttgaggagaatactccacccaagatggagaaagaaggcttggagatcatgattggaaagaagaaaggcatccaagggcactataatagctgttacctggacagcacactcttttgtctcttcgcctttagcagcgtgctggacacggtgctactccgccccaaggaaaaaaatgacgtcgagtactatagcgaaactcaggagcttcttcggacggagatcgtaaatcccctgcgaatctatgggtacgtgtgcgccacaaagattatgaagctgcgaaaaatactggagaaggtcgaggccgccagcgggtttacaagtgaagaaaaggaccccgaggagttcttaaatatcttgttccatcacatcttgagggttgaaccactcctgaagatcagatccgcaggccaaaaagttcaggattgttatttttatcagatcttcatggaaaaaaatgagaaggtgggtgtgccaacaatccagcagctgctcgagtggtcgttcattaactcaaatctaaagttcgcggaggcacctagttgcctgatcatacagatgccccggtttgggaaagattttaagctcttcaagaaaatctttcctagtctggaacttaatatcacagaccttcttgaagacacccctcggcagtgcaggatttgtggtggactggctatgtatgaatgcagggaatgctacgacgatcctgacatcagcgctggtaagataaaacagttttgcaagacctgtaatactcaggtgcaccttcacccgaaacgcctcaaccacaagtataacccagtctccctgccaaaggacttacccgactgggactggcgacatggttgtataccatgccagaatatggaattattcgctgtgttgtgcattgaaacctcccactacgtggcctttgtgaagtatggtaaggacgattccgcttggctgttcttcgattctatggccgatcgcgatggaggacaaaatggattcaacattccgcaggtgaccccgtgtcccgaggtgggcgagtacctcaagatgagcctggaggatctgcactctcttgactctagaagaatccagggctgtgcaagaagactgttgtgcgacgcctacatgtgtatgtaccagtcccccacaatgtctctgtacaagtag

SEQ ID NO: 23790 - DNA, 2862 bp, Artificial Sequence
  Description of Artificial Sequence: Synthetic coding sequence
atgagcagcggcctgtggagccaggagaaggtgaccagcccctactgggaagagcgcatcttttatctactcctgcaggaatgttctgtaacagacaagcagacgcagaagctgctgaaagtacctaagggtagcatcggccagtatatccaggacaggagcgtgggccatagccggatcccctctgccaagggcaaaaaaaatcaaataggtctcaagatacttgagcagccacatgctgtgcttttcgttgacgagaaagatgtggtggagattaacgagaagttcacggaattactgctagcgatcaccaactgcgaagaacgattttctctgttcaagaatcgaaatagactaagcaaaggccttcagatcgacgttgggtgcccggtgaaagttcagctgagatccggcgaggagaagttccccggagtggttcgatttcgtggccctctcctcgccgagaggacggtcagtggcatcttttttggtgttgagctcctggaggagggaagaggccagggctttactgacggtgtgtatcaaggcaagcagttgttccaatgtgacgaggactgcggagtgttcgtcgccctggacaagctggaattaatcgaagatgacgacacagctctggagtcagactatgctgggcccggggacacgatgcaggtagagctgccgcctcttgagatcaattccagagtgtctctcaaagtcggcgagaccatcgagtctggtactgtaatcttttgcgacgtgctgccaggcaaggagtccctcgggtattttgtaggtgtcgacatggacaaccccattgggaactgggatgggcggtttgacggcgttcagctatgctccttcgcctgtgtcgaatcaactattcttctacacatcaatgacattatacccgaaagcgttactcaggagcggaggccccccaagttggcttttatgtcccgaggcgtgggcgataaaggctcctcctctcacaacaagccgaaagcaacaggatctacctccgatcctggtaaccgcaatcggtccgagttgttctacacattgaacgggtcttcggtggattcacagccacagtctaagtcgaaaaatacatggtacatcgacgaagttgccgaggaccctgccaaatctctcactgaaattagcaccgatttcgatcgctcatcacctcctctgcagcccccgcccgtcaactcgctgaccacagaaaacagattccattccctaccgttctcattaactaagatgccaaatacgaatggtagcattgggcacagccccctgtcactttccgcccaatcagttatggaagaactgaacactgctccagtgcaggagagcccaccactcgctatgcctccaggaaattcacacggactggaggttggcagcctcgccgaagtgaaagagaatcctcccttctatggcgttattcggtggatcgggcagcctccaggactgaacgaggtgctggcaggattagaactggaagatgagtgtgcagggtgtactgatggcaccttccgcggaacaaggtacttcacctgtgcactgaaaaaggctctctttgtgaagttgaaaagctgccgaccagactcccgctttgcctcccttcagcccgtgagcaatcagatagagaggtgcaacagcttggcatttggaggttacctctctgaggtggtagaggagaacactccacctaaaatggagaaggagggattagagattatgataggtaagaagaagggaatccaggggcactacaatagttgctatctagattcaacgctcttttgtctgttcgctttttcctctgttctggacacagttcttcttcggcccaaggagaagaacgacgtggagtattactctgagacccaggaactgttgaggaccgagatcgtgaatcctttaaggatatatggttacgtatgcgccaccaagattatgaagctgagaaaaatccttgagaaagtcgaagccgccagcggcttcaccagcgaggaaaaggaccccgaggagtttcttaatatcctattccaccatattcttcgcgtcgagcccctgctgaagatccgctctgccggccagaaggtgcaggattgttatttctaccagatcttcatggaaaagaacgaaaaagtcggggtgcctaccattcagcagctcctagagtggtcatttataaactccaaccttaaatttgccgaagcaccatcatgcctgatcatccagatgccaagattcggaaaagatttcaaacttttcaagaagatcttcccatctctcgaactgaatattactgatcttctggaggatacacccaggcagtgccgcatctgcggcggcctcgccatgtacgaatgccgggagtgttatgacgaccccgatatttccgccgggaagataaagcaattttgtaagacctgcaatacacaggttcacctccatcccaaacggctgaaccataaatacaaccctgtcagcctgcccaaggacttgccagattgggactggagacacggctgcatcccatgtcaaaacatggagctcttcgccgtgctgtgtatcgagacctcccactatgtcgccttcgttaagtacgggaaagacgatagtgcctggctgttttttgacagtatggccgatagagatggggggcagaacggttttaatattcctcaggtgacaccatgtccagaggttggggaatacctgaaaatgtcgctggaggacttgcactccctggattcccggagaatccaggggtgcgcgcggcggttactttgtgatgcctacatgtgcatgtaccagagtccgactatgagcctgtacaagtag

SEQ ID NO: 23791 - DNA, 2862 bp, Artificial Sequence
  Description of Artificial Sequence: Synthetic coding sequence
atgagcagcggcctgtggagccaggagaaggtgaccagcccctactgggaggaaaggatcttttacctcttactgcaggaatgtagcgtgacagataaacagacccagaagctgctgaaagtgcctaaaggcagtataggccaatatattcaggataggtccgtgggccactcccgaataccatctgcaaaaggcaagaagaatcagattggactgaagatacttgaacagcctcacgcagtgttgttcgtggatgaaaaagatgtggtcgagattaacgagaagtttaccgagttgctgcttgcaatcactaattgtgaggagagatttagtttgtttaagaacagaaataggctgagtaagggccttcagatcgatgtcggctgtccagtaaaggtgcaattgcgtagtggtgaggagaagtttcctggcgtggtcaggtttcgaggtcctcttctcgccgagaggactgtgtctggtattttctttggcgtcgagctcctggaagagggacggggacaggggttcaccgacggcgtgtaccaggggaaacagttgttccagtgcgatgaggattgcggcgtcttcgtagctctggataaactggaactgatcgaagacgacgatactgctctcgaatccgattacgcgggccccggggacactatgcaggtagaactcccaccgctcgagattaactcccgagtatccttgaaggttggagagaccattgagtcaggtaccgtgatattttgcgacgtgcttcctggcaaggagtccctcggatacttcgtaggagtggatatggacaatccaatcggcaattgggacggccgtttcgatggcgttcagctttgttcttttgcatgcgtcgaatcaacaattctcctccacattaacgacatcatccccgaatctgtgactcaggagaggaggccaccaaagcttgcctttatgtcacggggcgtaggcgacaaaggaagcagttcacacaacaagcctaaggcaaccggctcaacgtccgatcccgggaatcgaaacaggagcgaactgttttacacattgaatggcagttctgtcgatagccagccacagtccaaaagcaaaaatacttggtatattgacgaggtggccgaggaccccgctaaaagcttaaccgagatcagtaccgacttcgaccgttcgtcacccccactccagcccccaccagtgaatagtctgactactgaaaatcgttttcatagcctccccttcagcctgaccaagatgccgaacacaaacggaagtatcggtcacagtcctttgtctctgtctgctcaaagcgtaatggaagaactcaatacagcccctgttcaagagtctccacctctggcaatgcccccgggaaatagccacgggctggaggtgggttcactggctgaggtcaaagagaatcctcctttctacggagtaatcagatggattggccagccccccgggctaaatgaggtgttagctggtctggagctcgaggacgaatgcgccggctgcacagacggaacttttaggggaactcgatacttcacttgtgcactgaaaaaggccctctttgtaaaactgaaatcttgtaggccagattccagatttgcaagtctgcaaccagtgagcaaccagattgaaagatgtaactcccttgcattcggaggctacctctccgaagtggtagaagagaacacgcctcccaagatggagaaggagggcctggaaattatgattgggaagaaaaaaggaatccaggggcattataattcttgctatctcgacagcaccctgttttgcctgtttgcttttagtagcgttttggatactgtactccttaggccgaaagagaaaaacgatgtggagtattactcagaaacccaagaactgctgaggaccgagatagtgaatccccttaggatttatggatacgtctgcgcaacaaagattatgaagctgagaaaaatcttagagaaggtggaagccgcctcaggatttacctctgaggaaaaggaccccgaggagttccttaatatactgtttcatcatattttgcgtgtggagcctttgctgaagattcggtcagcgggacagaaagtccaggattgttatttttaccagatctttatggaaaagaatgaaaaggtcggggtacccaccatccagcagctcttagaatggtctttcattaactccaacctcaagtttgccgaagcaccatcttgccttatcattcagatgccacgatttgggaaggacttcaagctgttcaagaaaatattcccctcgctcgaactcaacatcacagaccttctggaggacacgccgaggcagtgtcgaatctgtgggggcctggcgatgtacgaatgcagggagtgctacgatgatcccgacatctcagccggtaagatcaagcagttttgtaagacctgtaatacccaagtacacctgcacccaaagcgcctaaaccacaaatacaaccccgtatccctgcctaaggatctgccggactgggattggcgccatggatgcatcccttgccaaaatatggagctcttcgcggtgctctgtattgaaacatcccactacgtcgccttcgttaaatatggcaaggatgattcagcttggctctttttcgactccatggccgaccgggatggaggacagaacgggttcaatatccctcaagtgactccctgccctgaagtgggggagtacttaaagatgagtctcgaggacctacattccttggactcccggagaattcagggttgcgccaggcggctgctgtgcgacgcttatatgtgcatgtaccaatctcctacaatgtcattgtacaagtag

SEQ ID NO: 23792 - DNA, 2871 bp, Artificial Sequence
  Description of Artificial Sequence: Synthetic coding sequence
atgagcagcggcctgtggagccaggagaaggtgaccagcccctactgggaggagcgtatcttctatctactgttacaggagtgttcggttacggacaagcaaacccagaagctcttaaaggtgcctaaagggtcgatcggacaatatatccaagacagaagtgtgggacactctcgcatcccgtctgcaaaggggaaaaagaaccagattggacttaagatcctcgagcagccacacgccgtccttttcgtagatgagaaggacgtggtcgaaataaatgagaagtttactgagttacttctagccatcaccaattgcgaagaacgcttctccctgtttaagaataggaatcgcctaagcaagggacttcaaatcgacgtagggtgcccagtgaaggtccagctcaggagcggcgaggagaagttccctggcgtagtgcgctttcgtggcccactacttgcagagcgtaccgttagtggcatcttctttggagttgaattgctggaggaaggccgtggccaggggtttacagatggcgtgtaccaaggaaagcagctctttcagtgtgacgaggattgcggtgtatttgtggctctcgataaacttgagctcatcgaggacgatgacactgctctagaatcggactacgccggtccaggtgacacaatgcaggttgagctgccacccctggaaattaactctcgtgtctccttaaaggtgggggagaccattgagtctggtaccgttattttttgtgatgtactcccaggcaaggagagtctgggatactttgtcggcgttgatatggacaaccccattgggaattgggatgggagattcgacggagtccagctctgttccttcgcttgtgtcgaaagcaccattctcctgcacattaacgacatcattccagccgtcagtgaatcggtgacgcaggagcgtcgcccccccaaactcgcattcatgtccagaggggttggtgacaaaggcagcagctcccacaacaagcccaaagcaaccggctccacgagtgatccgggcaaccgaaatagatcagagttattctacaccctaaacgggagctcggtggactcccagccgcaatcgaagtctaagaatacatggtatatagatgaagtagcagaagatcctgcaaagagtctcactgaaataagcacagatttcgatcgaagttctcctccactacagccacctcccgttaattcgctgactacagaaaacaggtttcacagcctgccattttctttgacaaaaatgcccaataccaacggcagcattggccatagccctcttagccttagcgcccagtcagtgatggaagaactgaacaccgctcccgtgcaggaatcgccaccgcttgctatgccaccagggaatagccacgggttggaagtgggctcactcgcagaggtcaaggaaaatccgccattttacggagtaatcagatggataggtcagcccccgggtttgaacgaggtactagccggcttggagctcgaggacgaatgcgcaggttgtaccgacggaacatttagaggtacccggtatttcacgtgtgcgctgaagaaagcactgttcgtcaagcttaaaagctgccggcccgacagccgctttgcgagcctccaacctgtcagtaaccagatagaacggtgcaactcactggcgtttggggggtatctctctgaggtggttgaagaaaatacgcctccgaaaatggagaaggaaggcctggaaatcatgataggcaaaaagaaagggatccaaggtcattataactcatgctatcttgactctactctgttttgcttgttcgcctttagctccgtgcttgatacagtgcttctgaggcctaaggaaaagaatgacgtcgaatactactccgaaacgcaggagttgctgcggaccgagatagttaacccccttagaatatatgggtacgtgtgtgcgactaagattatgaagctgcggaaaattctagagaaagttgaggccgcaagtggttttacctccgaagaaaaagacccagaggaatttttgaatatcctatttcaccacatcttgcgggttgaacctttgctgaaaatccggtctgccggccaaaaggtgcaggactgttacttttatcagatttttatggaaaagaatgagaaagttggggtgccgacaatccagcagctcctcgagtggtccttcatcaattctaacttgaagtttgccgaagccccaagctgcctgatcattcagatgccaagattcggcaaagattttaaactgttcaagaagatcttcccctctctggagctaaacatcactgacttattggaagataccccccggcaatgcaggatctgtggcggcttagctatgtatgaatgtcgcgagtgctatgacgacccagacatttccgccggaaagattaaacagttctgtaaaacatgcaacactcaagtgcacctgcatcctaaaaggcttaatcataagtataacccagtatcactaccaaaggatctgccggactgggattggcggcatggttgcattccgtgtcagaacatggagctattcgccgttctttgcattgaaaccagccattatgtggcgttcgtcaagtacggaaaggatgacagcgcctggctgttttttgacagtatggcagatagggacggggggcagaacggttttaatatcccacaggtgaccccttgtcctgaagtcggtgagtatctgaagatgagtctggaagatctgcatagcctcgatagcagaagaatacaaggctgcgctagaagacttctgtgtgacgcttacatgtgtatgtaccagtctcctaccatgagcttatacaaatag

SEQ ID NO: 23793 - DNA, 450 bp, Artificial Sequence
  Description of Artificial Sequence: Synthetic coding sequence
atggcccggagcaacctgcccctggccctgggcctggccctggtggccttctgtctgttggccctccctagagatgctcgagcccggccacaggagagaatggtgggggaacttagggatctgtctccagatgatccccaagtgcagaaggccgcccaggctgccgtagctagctacaatatggggtcaaatagcatttactatttcagagatactcacattatcaaagcccagtcccagctggtcgcgggaattaaatattttttaactatggagatgggatctaccgactgtcggaaaacccgggtaacaggagatcatgtggacctaactacttgccccctggcagctggtgcccagcaggagaagctcagatgcgattttgaggtgctggtagtcccctggcagaattcgtcccagctgctaaagcacaactgcgtccaaatgtag

SEQ ID NO: 23794 - DNA, 504 bp, Artificial Sequence
  Description of Artificial Sequence: Synthetic coding sequence
atgctgcccgagaaggccctgcacggccacccccagctgccccggacagtcccgacccgggccgcaatgcgggcggccggaacgctccttgccttttgctgccttgtgttaagtactactggggggccttcacccgacacatgttctcaggacctgaacagtcgagtcaagcctggattccccaagacaatcaaaacaaatgatccaggagtgcttcaggctgccaggtactcagttgagaaattcaacaactgtacgaatgacatgttcctgttcaaggaatctcgcatcactcgcgctttggtacagattgtgaaaggtctgaagtatatgctcgaagtcgagatcggccgcactacttgcaaaaaaaaccagcacctgcggctggatgattgtgactttcagaccaaccataccttaaagcagacactttcttgttacagcgaagtgtgggtagtgccgtggttacagcacttcgaagttccagtgcttcgctgccactag

SEQ ID NO: 23795 - DNA, 438 bp, Artificial Sequence
  Description of Artificial Sequence: Synthetic coding sequence
atgcgggccgccggcaccctgctggccttctgctgcctggtgctgtccactaccgggggtccatcgccagatacctgcagtcaggatctcaactcccgcgtgaagccgggcttccccaaaaccatcaagacaaatgatccaggcgttttgcaggctgctagatactccgtggagaaatttaacaattgcacaaacgacatgtttctgtttaaagagtctaggattactagggccctagtgcagattgtcaagggcctaaaatacatgctggaggtggaaatcggcaggaccacctgcaaaaaaaaccaacacctgcggctagacgattgtgacttccaaacaaatcacaccttgaaacagactttgtcttgctactccgaagtgtgggtagtgccttggctgcaacacttcgaagtcccagtgctccggtgccactag

SEQ ID NO: 23796 - DNA, 453 bp, Artificial Sequence
  Description of Artificial Sequence: Synthetic coding sequence
atgctgggcgccgccctgcggcggtgcgccgtggccgccaccacccgcgctgatcctagaggcctgttacactccgcaaggacgccggggcccgcagttgctatacagtcagtacggtgctacagccacggatcccaggagacagacgaggagttcgacgcgagatgggtgacctacttcaataagcccgatattgacgcctgggagctccgcaaaggaataaatacactagtcacctatgacatggtgccagaacctaaaatcattgacgctgctcttcgggcttgtagacggctgaatgactttgcaagtacagtcagaatcctggaagttgttaaggacaaggcgggcccacacaaagaaatctatccttatgtgatccaggagcttaggccaactctgaatgagctggggatcagcaccccagaagaattaggtttggataaggtctag

SEQ ID NO: 23797 - DNA, 318 bp, Artificial Sequence
  Description of Artificial Sequence: Synthetic coding sequence
atgggcgacgtggagaagggcaagaagatcttcatcatgaagtgcagccagtgccatacagtggagaaaggcggaaagcacaaaaccgggccaaacttgcatggtctgttcgggcgaaagactgggcaggcccctggttactcctatacagcggctaacaaaaacaaaggaattatatggggcgaggatacgcttatggagtatcttgagaacccgaaaaagtacatcccaggcacaaaaatgatatttgtgggaatcaagaagaaagaggaaagagcggaccttatcgcctatctgaagaaggccacgaacgagtag

SEQ ID NO: 23798 - DNA, 318 bp, Artificial Sequence
  Description of Artificial Sequence: Synthetic coding sequence
atgggcgacgtggagaagggcaagaagatcttcatcatgaagtgctcacagtgtcacacagttgaaaagggcgggaagcataaaaccggcccgaatttgcacggcttgtttggacgtaagacagggcaagccccaggttactcttatacagctgccaacaagaacaaagggattatttggggagaggatacactcatggagtacctcgagaatcccaaaaaatatattcccggaacaaagatgatttttgtagggataaaaaaaaaagaggaaagagcagacctcattgcctacctaaaaaaggccactaacgagtag

SEQ ID NO: 23799 - DNA, 318 bp, Artificial Sequence
  Description of Artificial Sequence: Synthetic coding sequence
atgggcgacgtggagaagggcaagaagatcttcatcatgaagtgcagccagtgtcacacggtggagaagggtggcaagcacaagacaggacccaatctgcacggtttgtttggtagaaaaacaggtcaggcacccggctactcttatacagcagccaataagaataaagggatcatctggggcgaggatactctaatggaatacctagagaatcccaaaaaatatattccagggactaagatgatcttcgtaggtatcaaaaaaaaggaggaacgggccgacctcatcgcttaccttaaaaaggccactaacgagtag

SEQ ID NO: 23800 - DNA, 306 bp, Artificial Sequence
  Description of Artificial Sequence: Synthetic coding sequence
atgggcgacgtggagaagggcaagaagatcttcatcatgaagtgctctcagtgccacaccgtggagaagggaggcaaacacaaaacggggccaaatctgcacggactcttcggcagaaaaacaggccaggctcccggctactcatacactgctgccaacaaaaataaagggattatttggggcgaggatactctgatggagtaccttgaaaatcctaagaaatatatcccgggcactaagatgatattcgttgggataaaaaagaaagaagaaagggcggacctgattgcttacttaaaaaagtag

SEQ ID NO: 23801 - DNA, 1632 bp, Artificial Sequence
  Description of Artificial Sequence: Synthetic coding sequence
atgggcaccagcctgagccccaacgacccctggcccctgaaccccttgtccatccaacagaccacacttctgcttctgctttccgtccttgcaaccgttcatgtggggcagcgtctgttgcggcagagacgccgccagctgcggtccgctcctcctggcccttttgcctggccgctgatcggaaacgcagcagctgtaggtcaggcagcccatctgtctttcgcgagattagcccggagatacggagatgttttccagattcggctcggctcctgcccaatcgtggtgctgaatggcgagcgagccatccatcaagccctggttcagcaaggatccgccttcgccgatagacctgcattcgcctcctttagagtggtgagcggcggtaggtccatggccttcggccactatagcgagcattggaaagtacagcgccgcgccgctcattcgatgatgcgaaattttttcacaaggcagccgcggagcaggcaggtcctggaaggacatgttctgtccgaggcccgcgaattagtggccctgctagttagagggagcgccgacggggcctttctggatccaaggccactgactgtcgtggcagtggcaaatgtgatgtccgctgtgtgtttcgggtgtcgctatagtcacgacgatccagagtttcgggagctgttgtcacacaatgaagaattcggccgtactgtgggagctggtagtctggtggatgtaatgccatggttgcagtacttccctaaccctgttaggaccgttttcagggaattcgagcagcttaacagaaacttttccaattttatcctggacaaatttctgcgccattgtgaatctctgagacccggcgccgcccctcgcgacatgatggacgcatttatactttctgccgaaaaaaaagcagctggcgactcacacggcggaggcgcgcgcctggacttagaaaatgtaccggcgacaattacagacatcttcggcgcgagccaggacaccctcagcaccgctttgcagtggctcttattgctttttactagatacccggacgtacagacccgcgtccaggctgagttagaccaggtcgtgggcagagacagattaccgtgcatgggcgaccagcctaatctgccctacgtgctggctttcctatatgaagcgatgaggttttcctccttcgtgcctgtgaccatccctcatgccactaccgccaacaccagcgtgcttggatatcacatcccaaaggacacggtcgtattcgtgaatcagtggagtgtcaatcatgacccagtgaagtggccgaatccagagaacttcgacccggccaggtttctggacaaggatgggctaataaacaaagacctgacgagtcgcgtgatgatcttttctgtgggcaagcgtcgctgtatcggcgaagagctgagtaagatgcagctgtttctcttcatctccattctggcccaccaatgtgatttccgggcaaatccaaacgaacccgctaagatgaatttttcgtacgggcttactatcaaaccaaagtcgtttaaggtcaacgtgacgttgcgagagagcatggaactactggatagcgctgtccagaaccttcaggcaaaggagacatgccagtag

SEQ ID NO: 23802 - DNA, 1632 bp, Artificial Sequence
  Description of Artificial Sequence: Synthetic coding sequence
atgggcaccagcctgagccccaacgacccctggcccctgaaccccctgagcatccagcagaccaccctgctattgttgctgtccgtcctggctacagtgcacgtgggccagcgcctgttacgccagcggagaaggcagcttaggagcgccccaccaggacccttcgcttggcctctgatcggtaatgcagcagcagtcggacaggctgcccatctgagctttgctaggctggcccgcagatatggcgacgtctttcaaatccgactgggttcatgccccatagttgtgctgaacggagagcgcgccatacatcaagctctcgtgcagcagggcagtgcatttgcagatcgaccagcctttgccagtttcagggttgtgtcaggcggcagatccatggcctttgggcattactccgaacactggaaggtgcagcgtagggccgcccacagcatgatgcgaaactttttcacacgccaaccacggagccgccaggtcttggaaggacatgtgttgagcgaagcacgagagctggttgccctcctggttcgtgggagcgcagatggcgccttcctggaccctcgtccactcacagttgttgctgtcgccaacgtgatgtccgccgtatgtttcggatgtaggtacagtcacgacgacccagagtttcgcgagttgctgtcacacaatgaagaatttggtagaactgttggggccgggtcactggttgatgtgatgccatggctccaatacttccctaacccggtacgtacagttttcagagaatttgagcagttaaacaggaatttctccaatttcatcctcgacaagtttttacgacattgtgagtccctgcgaccaggcgccgcccctagagacatgatggatgctttcattcttagtgcggaaaaaaaagcagccggcgatagtcacgggggtggcgctaggttagaccttgaaaacgtgcccgccacaatcacagacatcttcggcgcctcacaggacacactctccaccgctctacagtggctcctgctcttatttacacggtaccccgacgttcaaactagggtgcaggcagaattagaccaggttgtgggtcgggacaggctgccctgcatgggggaccaacccaatttgccgtatgtgctcgccttcctgtacgaggcgatgcgattttcatctttcgtcccggtgacaatcccacacgcgactaccgctaatacttccgtgttgggatatcatatacctaaggatactgtagtattcgttaaccagtggtcagtgaaccatgatccggtgaagtggccaaaccccgagaattttgacccagcccggtttttggacaaagacgggctgatcaataaggacctgacgtcccgagtaatgatttttagcgtgggcaagagaagatgtatcggtgaagaattgtctaaaatgcagcttttcctctttatcagcatcctggcacaccagtgcgattttcgagctaatcccaatgagcccgccaaaatgaactttagctacggcctgacaataaaaccaaaatcctttaaagtcaatgtgacgctgagagagtccatggagcttcttgactctgccgtccaaaacttgcaggcaaaggaaacatgtcagtag

SEQ ID NO: 23803 - DNA, 3399 bp, Artificial Sequence
  Description of Artificial Sequence: Synthetic coding sequence
atggagcccgacagcctgctggaccaggacgacagctacgagagccctcaggagcggcccggatctcgccgaagcttgcctggaagcctgtctgagaagagcccaagcatggagccctcagcagccacaccctttcgggtgactgggttcctgagcagaaggcttaaggggtctatcaaacgaactaagagtcaaccaaagctagacagaaatcactcattcaggcacatccttccaggcttccgctcggctgctgctgctgcggctgacaacgagcgaagtcacctgatgccacggctgaaggagagtcggagtcacgaaagtttgttatcaccatcttccgcagtggaagcgctggatctcagcatggaagaggaggtggtcatcaaacctgtgcattccagcatcctcgggcaggattattgctttgaagtgaccactagttctggttctaaatgcttctcctgcaggagcgccgcagagcgcgataagtggatggagaacctgcggcgcgctgtgcaccctaataaagacaattcccggcgggtggagcacatcttaaaactgtgggtgatcgaagcaaaagatcttccggccaagaaaaagtacctgtgcgagctctgcctggatgatgtgctatatgcgagaaccaccgggaagctgaaaactgataacgtgttttggggggagcatttcgagttccacaatctaccacctctgcgaacggtgacagtgcatctctaccgggaaaccgacaagaaaaagaagaaggagcgtaatagctacctcggccttgtgtccttgcccgccgccagcgtcgccggacgtcagttcgtggagaagtggtatcccgtcgttacacctaatccgaagggaggcaaaggccccggacctatgataaggataaaagctcgctatcagacaatcaccatcctgccaatggagatgtacaaggagtttgccgaacacataactaaccactacctgggattgtgtgctgcactggaaccgattctgagcgccaaaactaaagaagaaatggcaagtgctctcgttcatatacttcagagtacaggcaaagtgaaagacttccttaccgatctcatgatgagtgaagttgatcgctgcggcgacaacgaacacttgatcttccgtgagaatacacttgcgacgaaggcgattgaggagtacctgaagctggtcggacagaagtacctgcaggatgctctgggggaatttattaaggcgctttatgaatctgacgagaactgcgaagtggacccgagcaaatgttctgccgccgatttacccgaacaccagggtaacctcaaaatgtgttgcgaactcgctttttgtaagatcatcaacagctattgcgtgttcccaagagaactgaaggaagtgttcgcctcttggaggcaagaatgttcaagcagaggacgacccgatatttccgaacggttaatttctgccagcctgttcctgcggttcctgtgccccgcaattatgagtccaagcctgttcaatctgctccaggaatatccagatgacagaaccgcccgcactctcacactgatagcgaaggtaacccagaatctggccaatttcgcgaagtttggctccaaggaagaatacatgtctttcatgaatcagttcctggaacatgagtggacgaatatgcaacggttcctgctggagatttccaatccggagacccttagcaataccgcaggttttgaaggatacatcgatctcggcagggagctctcctcactgcacagcttgctgtgggaggccgtgtcccagctggagcaaagtatcgtcagcaagctcgggccgcttccgagaattttgagagacgtgcatactgcccttagtacccccggaagcggacagctgcctggaacgaatgacctcgcctcaacccccggatctggctcttcctctatcagcgccggcctgcagaagatggtgattgagaatgacctttcaggtctaatagactttacaaggctcccaagccctactcctgagaacaaggatctgtttttcgtgactcgttcttctggggtccaaccttctccagctagaagctcctcttacagtgaggcaaacgaaccagatctacagatggctaatggcggcaaatcactgtccatggtcgacctgcaagatgcgaggactctcgacggggaagccgggtccccagccggaccagatgtcctacctaccgatggacaggccgctgctgctcagctagttgctggttggcccgctcgagcaacccctgtgaaccttgctggacttgccacagtgcgccgcgcaggtcaaacccctactacaccgggcacctctgaaggtgcccctggccggccgcagctgctggcccctctgtctttccagaatccggtgtaccaaatggctgccggactgcctttgagccctagaggcttgggggacagcgggagtgaggggcattctagtctgtcctcacacagcaacagtgaggagctagccgctgctgccaagctcggaagtttctccacagccgcagaggagctcgcgagacgccccggggagctcgcgaggaggcagatgagcctgacagagaagggtggacagcctacagtcccccgtcagaattctgctggccctcagcgcagaatcgaccagccaccccccccaccccccccacctcccccagccccacgcggccggactcccccaaacctgctttccactttgcaataccctcgccccagttccggaacgttagccagcgcctcccccgactgggtagggcccagcacaaggcttagacagcagtcatcttctagtaagggggattctcccgaacttaaacctcgggccgtccataagcaaggcccgtccccggtctcccccaatgccctcgacagaacagctgcctggctgctgaccatgaacgcacagctgcttgaagacgagggtcttggacccgacccacctcaccgcgataggttgcgctctaaggatgagctttcacaggctgagaaagacctggctgttctccaggataagcttcgcattagcaccaagaaactggaggagtatgaaaccctgtttaaatgccaggaggagacaacccagaagttagtcctggagtaccaagccagactcgaagaaggggaggagaggctgcgacggcaacaggaggacaaggatatacagatgaaggggatcatctctcggctgatgtcagttgaggaagagctcaaaaaagatcacgccgagatgcaggccgccgttgattccaaacagaaaattattgatgcacaggagaagcgcatagcctctctggatgccgccaatgcacgacttatgtctgccctcacccagctaaaggaatccatgcactag

SEQ ID NO: 23804 - DNA, 3198 bp, Artificial Sequence
  Description of Artificial Sequence: Synthetic coding sequence
atgccccggctgaaggagagccggagccacgagagcctgctgagccccagcagcgccgttgaggccctcgatctttctatggaagaagaggttgtcattaagcccgtccattcctccatcctaggccaagattattgcttcgaagtgacgacctcttctggaagtaagtgcttctcctgcaggagcgcagccgagcgcgacaagtggatggagaatctaaggagggctgtccacccaaataaggacaattctagacgagttgaacacatcctcaaactctgggtgattgaagccaaggacttgccagccaagaagaaatatctctgcgagctctgtctcgatgacgtcctgtacgctaggactaccggcaaactgaaaactgacaacgtgttttggggggaacatttcgaattccacaatttgccgcccctacgcaccgttacagtgcatttatatagggagacagacaagaagaaaaagaaggagcgcaattcctatctagggttagtgtcactgccagccgccagtgtagctggacgtcaatttgtagaaaagtggtaccccgttgtaaccccgaacccaaaggggggaaagggcccaggccctatgatcagaattaaagcaagataccaaactatcacaattctcccgatggagatgtataaggaattcgctgagcacatcactaaccattatctgggattatgtgccgctcttgagccaatcctctccgctaagaccaaggaggagatggccagcgccttggtccatattctgcagtctacaggaaaggtgaaggacttcctcactgatctgatgatgagtgaagttgatcgatgtggggataatgagcacttgatcttccgcgaaaataccctggcaacaaaggcgatcgaggagtacctaaagctcgttggccagaagtaccttcaggacgcccttggcgaatttatcaaagctctatatgaatcggacgagaactgcgaggtagatccctctaaatgcagcgcagccgatctgcctgaacatcaaggtaatcttaagatgtgctgtgagctcgccttctgcaagattatcaacagttactgcgtctttccacgagagctgaaggaagtcttcgcctcctggcgtcaggagtgtagtagcaggggccggccagatatctctgaacgcctcatttccgcctccctcttcctgcgtttcttgtgccccgccatcatgagcccctctcttttcaacctgttgcaggaatatccagacgaccgcactgctcgcaccttaacactgatcgccaaggtgacccaaaacctcgctaacttcgccaaatttggatccaaggaagaatatatgagtttcatgaaccagttcttggaacacgaatggacgaatatgcagagattcttgttggaaatctccaatccagaaacattgagtaataccgccggtttcgaagggtacattgacttgggccgagagttgagctccttgcactccctgctatgggaagctgtcagccagctcgaacaatccatcgtcagtaagctgggtccgcttccccgaatcctgcgggatgtccatacagccttgtctacacccggctcggggcagcttccagggaccaatgatttagctagtacccccgggtccggcagcagttcaatttctgccgggcttcagaagatggtgattgaaaatgatctctccggcttaattgacttcactcggctgcccagccctactccagagaataaagacctgtttttcgtcaccagatcttcaggagtgcaaccttctcccgctagatcatcgagctactcggaggcgaacgagcccgacctgcagatggcaaatggcggcaagtcactctctatggttgacttgcaggacgcccgcacgctggacggtgaggcggggtcccctgccggacccgatgtgcttcccacagatggccaagccgccgctgcgcagctggtcgccggctggcccgccagggccactcctgtgaacctcgcgggactggcaacggtcaggagggctggacaaacacccacgacccccgggaccagtgagggagcaccagggaggccccaactactggctcctctgtccttccaaaatcccgtgtaccaaatggctgccgggctgcccctgtctcccagaggcctcggtgatagcggctccgagggccacagcagcctatctagtcattccaatagcgaggaacttgctgcagccgcgaaactcggcagtttttccaccgcggccgaggaactagcaagacgcccgggggagctggccaggcggcagatgtctctgactgagaaaggaggtcaacccactgtgcctcgccagaatagcgccggtccccagagacggatagatcagcctccaccgcctcctcctccgccccccccggccccccgcggtcgcacaccccccaatctcctgtctacgctgcagtaccctcgcccgtcctcaggtactctcgcctccgcatcgccagactgggtaggcccatcaacccgcctgagacagcagagtagctcgagcaaaggagactctcctgagttaaaaccccgggccgtgcacaaacagggcccatctccagtgtcacccaacgcgctggacaggaccgccgcgtggctactgaccatgaatgcccaacttctcgaggatgaaggactgggccccgacccaccacaccgggatcgactgaggagtaaggatgagctctcccaggctgagaaggatctggccgtgttacaggacaagctccggatttccacaaaaaaacttgaggagtacgagaccctgttcaaatgtcaggaggagacaacacagaaactagtgctagagtatcaggcgcggctggaggaaggcgaagaacgtcttcgacgacaacaagaagacaaagatatccaaatgaaaggaattattagtagactgatgagcgtcgaggaggagcttaagaaggaccacgcagagatgcaggctgccgtggattcaaaacagaaaattatcgatgctcaagagaaacgaattgcgagcctcgacgcagccaatgcccggcttatgagcgctctcactcagttaaaggagaggtattccatgcaagcgcggaatggtattagccctactaacccaacaaagttgcagataactgagaacggggaattccggaactcgtccaattgctag

SEQ ID NO: 23805 - DNA, 3210 bp, Artificial Sequence
  Description of Artificial Sequence: Synthetic coding sequence
agccagcccaagctggaccggaaccacagcttccggcacatcctgcctggttttcggtcagccgctgctgccgccgcagataacgaaaggagccatctgatgccccgactcaaggagtcccgttcccacgagtccctgttgagcccctcaagcgctgtggaagctctcgacctgtcaatggaggaggaggtggtgattaagcccgttcattctagtatcctcggccaagactactgtttcgaagtgacaacgtccagcggcagcaaatgcttcagttgcaggtccgctgctgaaagggataagtggatggagaacctgcgtagagcggttcatcctaacaaggacaattctcgaagagttgaacatattctaaaactctgggtgattgaggcgaaggacctccccgcaaaaaagaaatatttgtgtgaactctgtctggacgatgtgttgtacgcacggacaacaggaaagcttaagactgataacgtgttctggggagagcacttcgagttccacaacttgcctcccctccgcacggtcaccgtgcacctgtaccgggagactgacaagaaaaagaaaaaggagagaaactcctacctgggcctggtgagtcttcccgccgcttccgtcgctggaagacaattcgtcgagaaatggtaccctgtcgttaccccaaatcccaaaggcggaaaggggccaggccctatgatacggattaaggctcgctaccaaaccattactattctcccaatggaaatgtacaaagagtttgctgaacatattaccaatcactatctgggtctgtgcgccgcattggagccgattcttagcgcaaagacaaaagaggagatggcctcagcgctggttcacatcctacagtctacaggcaaagttaaagatttcctcaccgacctgatgatgtctgaggtggatcggtgcggcgacaacgaacacctgattttccgagaaaacactctggccacgaaggccattgaagagtatctgaagttggtgggacagaaatacctacaggacgctcttggcgagtttattaaagccctgtacgaatctgatgaaaattgcgaagttgatcctagcaagtgttcagccgcagaccttccagaacatcagggcaacctgaagatgtgctgcgagcttgcattctgcaagatcatcaatagttattgcgtgtttccacgcgagcttaaagaggtcttcgccagttggagacaggagtgttcttccaggggccgacccgatataagtgagagactgatctccgccagcctcttccttcgattcctttgccctgccatcatgtccccgtccctgttcaatctccttcaggagtacccggacgaccgcacagccaggacactgactctgatcgccaaggtgactcagaacctcgccaactttgccaagttcggatctaaggaggaatacatgtcgttcatgaaccagtttcttgaacacgagtggactaatatgcagagattccttctggagatatctaaccctgagactctctcaaacaccgcggggttcgaagggtatattgacctcggtagagaactctcctcactgcactcactcctctgggaggcagtttctcaattggagcagtcaatcgtgtcaaagcttggacccctacccagaattctgcgtgacgtccacactgctctctcaacacccggcagcggtcagctgccaggaaccaatgacctagctagcactcctggcagcggcagctcaagcataagcgccggcttacagaagatggtgattgagaacgacctgtcaggtcttattgatttcactaggctgccaagccccacccccgaaaacaaggacctgttttttgtaacaaggagctcaggtgtccaaccatcccctgccagatcctcttcttacagcgaagctaacgaaccagacctgcagatggccaacgggggaaaatccctgtcaatggttgacctccaggatgctcggactctggatggcgaggcagggtcaccagccggacccgatgtactcccaacagacggacaggccgctgctgcacagttagtggccggctggcccgcccgcgcaaccccagtgaatctcgccggtctcgccacagtccgccgggctggccagacccccacaacccctggcacctcagagggcgctcccggccgcccccagctgctagctcccctgtccttccagaaccctgtgtaccaaatggcggctggtctgccactgtccccaaggggcctcggagattcaggctctgaggggcattcctccctctcttctcacagcaacagtgaagagctggcagcggcagctaaactgggcagcttttccaccgctgccgaagagctcgcgcgaagacctggtgaacttgccaggcgacagatgtctctcaccgaaaaaggtgggcagcccactgttccgcggcagaactctgcaggtccccaaagaaggatagaccagcctccccctcccccgccaccccccccaccagctcctcgtggacgcaccccccctaacctgctgagcaccctgcagtaccctcggccttcttcaggtactctcgccagcgcctctccggactgggtaggaccatcaacccgactgcggcagcagtcctcttccagtaagggagactccccagagctgaaacctcgggctgtgcataagcagggcccaagccctgtctcaccaaacgccctcgatagaacagctgcatggttattaacaatgaacgcgcagctgctcgaggatgagggactcggcccagacccacctcaccgagatcgtctgcgaagcaaggacgagctgagtcaggcagaaaaggacctggctgttctgcaggacaaactgaggatctctacgaagaaacttgaggaatatgaaaccctctttaagtgccaagaagaaacaacgcagaaactcgtgctcgagtatcaggcacggctggaagagggagaggaacgactcagaagacagcaggaggataaagacatacagatgaaagggattatcagccggctgatgagcgtggaagaagaactgaagaaggaccatgctgagatgcaggccgcagtggattccaagcagaagataatagatgcccaagagaaaaggatcgcctctctggatgccgccaacgcccgactgatgtccgcactgactcagctgaaggaaagcatgcactag

SEQ ID NO: 23806 - DNA, 876 bp, Artificial Sequence
  Description of Artificial Sequence: Synthetic coding sequence
atggagcccgacagcctgctggaccaggacgacagctacgagagcccccaggagcgccctggatctaggcggagcctgcccggatccctttccgaaaaatcccccagcatggaaccatccgccgccaccccctttagagtcactggattcctgtcccggcggttgaagggctcaatcaaaaggacaaagagccagcccaagctcgatagaaaccactcatttagacacattctccccggattcagatccgccgctgcggccgctgcggacaacgaaagatctcacctgatgcctcggttgaaggaaagtcggtcccatgaaagcctgttgtcaccttctagcgccgtagaagcgctcgacctgagcatggaggaagaggtggtaattaagcctgtgcactctagtattctgggacaggactactgttttgaagttaccacaagttcgggtagcaaatgcttctcatgccgctccgcagcagaacgcgacaagtggatggagaatctgcggagagccgtgcaccccaataaagacaacagcagacgtgttgaacatatcctcaagttgtgggtgatagaggccaaagacctgcctgcaaagaagaaatatttgtgtgagctgtgcctggacgacgtgctgtacgcgcggaccacaggcaagctgaagaccgacaacgtcttctggggcgaacactttgagttccataacctgccacccttgcggacagtgaccgtgcatctgtaccgggaaactgacaaaaaaaaaaagaaggaaagaaacagttatttggggttagtgagccttcctgctgcaagcgtggcaggacgccagtttgtggagaagtggtaccccgtggtcacacccaaccctaaatag

SEQ ID NO: 23807 - DNA, 3570 bp, Artificial Sequence
  Description of Artificial Sequence: Synthetic coding sequence
atgagcgccggcggcagcgcccggaagagcaccggccggagcagctattactaccgcctactgcgcagaccgcgtctccagcggcaacgcagccggagccgttcccgcacacgcccagccagagagtctccccaggagaggccaggaagcaggagaagcctccccggaagtctgtcagaaaaatccccgagcatggaaccttccgccgcaaccccattcagagttacagggttcctctccagaaggctcaaagggtccattaagcggacgaagagccagcctaagctcgatcgaaatcattcctttcgccatattctgccagggtttcgctcagctgcggccgccgccgcagataacgagcgtagccatttgatgcctcgactaaaggaatctcggtcccacgagtcgctcctcagcccctcctcagccgtggaggcgttggatttgagcatggaagaagaggttgtgataaagccagtgcacagcagcattctgggccaagactactgctttgaggtcactaccagctccggcagtaagtgtttctcttgccgttcagcagctgagcgcgacaagtggatggagaatctgagacgtgctgtccacccaaataaagacaactcacgcagggtggaacatattctgaagttatgggtcatcgaagccaaagatctgccagcaaagaagaagtatttgtgtgaactctgcctggatgatgtgctgtacgcccgaactacaggaaagctcaagacggataacgttttctggggagagcacttcgagtttcacaacctcccgccgctccggaccgtcacagtgcatctgtatagggaaacagacaagaaaaaaaaaaaggaacggaatagctacctgggtctcgtttctctgcctgcggcgagcgtggccggacgacaattcgtggagaaatggtaccccgtggtgactccaaaccctaagggcgggaaaggccccggtcctatgatcagaatcaaggcccggtatcagactatcactattctccctatggagatgtacaaggagttcgccgagcatattaccaaccattacttgggtctatgcgccgcgcttgaaccaattttatccgctaagactaaggaagagatggcctccgctttagttcacatcctgcagagcacggggaaggtgaaagatttcctgacagacctcatgatgtccgaagttgaccggtgcggtgataatgagcacctaatttttcgcgagaacacattggctactaaagctatagaagagtacctgaagctcgtgggacaaaagtacctccaagacgcactgggcgagttcataaaagccctgtacgagagtgatgaaaactgcgaagtcgatccctctaaatgctcggcagcagatcttcctgagcaccaggggaaccttaagatgtgttgtgagctcgcattttgtaagatcattaactcctactgtgtgttcccacgcgaactgaaagaggtcttcgccagctggcggcaggagtgctcttcccgagggcggcctgatatatcagagcgactcattagcgcaagtctgtttctgagattcttatgcccagcaatcatgagcccttccctctttaatcttctgcaggagtaccccgatgacaggacagcacgcactctcaccctcattgccaaagttacacagaatctcgccaattttgccaaattcggatccaaggaggaatacatgtcttttatgaatcagttccttgagcatgaatggactaacatgcagcgcttccttctagagatctcgaaccctgaaacgttgagcaataccgctgggtttgaggggtatattgacctgggcagagagctctcgtcgcttcactccctgctttgggaggctgtgtcacaactggagcagtcaatcgtgagcaagttgggcccgctgccccgaattctgagggatgtgcataccgctctgtctacaccggggtcaggccagttacccggcaccaacgacctggcttccacaccaggcagcggatcctctagcatcagtgcaggcttgcagaaaatggtcatcgagaatgatctgtccggtctaatagatttcactagactgccaagcccaacgcccgaaaacaaggatctgttttttgtgactagaagtagtggcgtacaaccatcacctgccaggtccagctcatactccgaggcgaatgaaccagatctccagatggcaaatggaggaaaatctctgagcatggtagatctgcaggacgctcgcaccctggatggagaggccgggtccccagccggccctgatgtgcttcccaccgatgggcaggccgctgccgcacaactggttgccggctggccagccagagctactccagtgaatttggccggcctggctactgtaagaagggctggccaaaccccgaccacccctggtactagcgaaggcgctccaggtcgtccacagttgctggcccctttgtcgtttcaaaaccctgtttatcagatggcagccggactgcctctctcccctcggggactgggcgatagtggatctgaaggccattcaagcctcagctcccattccaacagcgaggaattggcagccgccgccaaattagggtcattttccacagctgctgaggaacttgcccgtagacctggcgaactggctcgcagacaaatgagcctgacagagaagggaggacagcccacagtcccccggcagaattccgctggtcctcagcgcagaatagaccaacctcctcctccccccccccccccccctccagcacctcggggacgcacgcctcctaacttgctgagtaccttgcagtaccccagaccgagtagtggtacccttgccagtgcttctcccgattgggtagggcccagtacaaggcttaggcaacaatcgagctcgagcaagggggatagcccagagctaaaaccacgggccgtgcacaaacagggtcctagtccggtctcacctaacgcactggatcggaccgctgcttggctattaaccatgaatgcacagttgttagaggacgaaggccttgggcctgaccccccgcaccgggatcgcctgagaagcaaggatgagctgtcacaagccgaaaaggatttggctgtcttacaagacaaactccgcatctccactaagaagctggaagagtatgaaactttgttcaagtgtcaagaggaaactacacagaaactggtgttagagtatcaagccagactcgaagagggagaagagaggcttcggcggcagcaggaggataaagacatacagatgaagggcatcatttcacgactgatgagcgtggaggaggaactcaagaaagaccatgcagaaatgcaagccgcagtggacagtaagcagaagatcattgacgcccaagagaaaaggattgccagcttggatgccgcgaatgccaggcttatgagcgcactgacacaactcaaagagaggtattctatgcaagcacgcaatggtattagtcctactaaccccaccaagttgcaaatcacagagaacggcgagttcagaaactccagcaattgctag

SEQ ID NO: 23808 - DNA, 690 bp, Artificial Sequence
  Description of Artificial Sequence: Synthetic coding sequence
atgccccggctgaaggagagccggagccacgagagcctgctgagcccttcgagcgcagttgaagccctggacctgtccatggaggaggaggtggtgatcaagccggtgcactcaagcatcttaggacaggactattgctttgaagttaccacctccagcggaagtaaatgtttctcttgtaggtccgccgcagaaagggacaaatggatggagaacttaagaagagcagtgcacccaaacaaggacaattctcgtagggtcgagcatattctgaaattgtgggtaattgaggccaaagatcttccggcaaaaaagaaatacctctgtgaactgtgtttggatgacgttctgtacgccagaacaaccggtaaactcaaaaccgataatgttttttggggtgaacattttgaatttcataacctcccccctcttcgcactgttacggtccatctgtatagagagacagacaaaaagaagaagaaggagcggaactcctacctcggcctggtctccctgccagccgcctctgttgcggggcgccaatttgtggagaagtggtatcccgtcgtaaccccaaatccaaaagggggaaaaggccctggacctatgatacgaatcaaggcgcgctatcaaacaataaccatcctgcccatggagatgtacaaggagtttgccgagcatattacatag

SEQ ID NO: 23809 - DNA, 3423 bp, Artificial Sequence
  Description of Artificial Sequence: Synthetic coding sequence
atgagctacaactacgtggtgaccgcccagaagcccaccgccgtgaacggctgtgtcactgggcactttacgtcggcagaggacctgaatttactcattgcaaaaaacacccggctggaaatttacgtagttactgccgaagggttgagacctgtaaaggaggtgggcatgtacggaaaaatcgccgtgatggagcttttccgacccaagggcgaaagcaaagacctcctcttcatcctgaccgctaagtacaacgcttgcatcctcgagtacaagcagagtggggagtctatagacataattacgagggcccacggcaacgtacaggacaggattgggaggccttccgagaccgggatcatcggcattatcgatcccgagtgcagaatgattggcctgaggctttacgatggactgttcaaggtgatacctttggacagagacaacaaagagttgaaggcctttaacatccgattagaagaactacacgttatagacgtgaaattcctctacggttgtcaggcaccaactatctgctttgtgtatcaggacccacagggtcgccatgtgaagacctatgaggtttcccttcgtgagaaagaattcaacaaagggccatggaagcaagaaaatgtcgaagctgaggccagcatggtgatcgccgtgcccgaaccttttgggggtgcaataatcattggtcaagagagtatcacatatcacaatggggacaagtacttggcaatcgccccaccaatcatcaaacaatccacgattgtgtgccataaccgggttgaccccaacggcagtaggtacctgttaggtgacatggaggggagactgtttatgctgctgctggagaaggaagaacagatggacggcacggtaaccttgaaagacctgagagttgaacttcttggggagacctcaatcgctgaatgcctgacgtatttggataacggagtcgtattcgttggaagccgcttgggtgactcacaacttgtaaagctcaatgttgactcaaacgaacagggaagctacgtagtagctatggaaacatttacgaatctgggccctattgtagacatgtgcgtggtcgaccttgagaggcaaggacagggacagctcgtcacttgctcgggggcttttaaagaaggctctctgagaatcattagaaatggaatcggaatccacgagcacgcttctatcgacttgcccggaattaaaggcctgtggccactgcgtagtgacccaaaccgcgagaccgacgacaccctggtgctaagtttcgtcggacagacacgggtactgatgctgaatggggaagaggtggaagaaactgagctcatgggctttgttgatgatcaacagacattcttttgcggtaatgtcgcccatcaacagctgatacaaattacctcagcctctgtcagactcgtaagtcaggagccaaaagcgttagtctcagagtggaaagagccccaagcaaagaacatatctgtagctagctgtaatagtagtcaggtggttgttgcagtcgggagggccctgtattaccttcagatccacccccaggaactcaggcagatttcccacaccgagatggagcacgaagtggcttgcctggatatcactccgcttggggactccaacgggctgtccccattgtgcgcaatcggactctggactgatatatctgcacgcatcctcaagctgccttcttttgagttgttgcataaggaaatgctcggcggtgagatcatcccacgctccatattgatgaccacgttcgagtcctcgcactacctcctgtgtgctttgggggacggtgcactgttttatttcggactgaacatcgaaaccggacttctgtccgatcgtaaaaaggtcactctcggtacccagcccactgtgctgcggacattcaggtcactatccacaaccaacgtgttcgcctgctcagataggcctactgtaatctatagttctaaccataagctggtgttcagtaatgttaatttaaaggaggtgaactatatgtgcccgctgaactccgacgggtatccagactcactggccttggcgaacaattcaacacttacaatcggaacaatcgatgaaatccagaaactacacattcggaccgtgcccttgtacgagtctccgcgaaagatctgctaccaggaggtgtctcagtgcttcggagttctctcatctcgcattgaggtccaggatacttctggcgggactacagcactgaggccatcggcaagtactcaggccctcagttcttcggtgagcagctcgaagctgttctccagtagcaccgcccctcatgaaacatctttcggcgaagaggtggaagtgcataatttgctgataatcgatcaacacaccttcgaagtccttcacgctcatcagtttctgcagaacgagtatgccctaagcctcgtgagctgcaaacttgggaaggaccccaatacttacttcattgtcggtacagccatggtgtaccccgaggaggcagaacccaagcaggggagaatagtcgtgttccaatacagcgacggtaaactgcagaccgtggctgagaaagaggtcaagggtgccgtttactccatggtcgagtttaatgggaagctgctcgcatcaatcaatagcacagtacgactgtatgaatggactaccgaaaaggagctgcgaaccgagtgcaatcactacaataatataatggccttgtacctgaagaccaaaggggactttatcctggtgggggatctcatgaggagtgtcttactcctggcttataaaccgatggaaggcaacttcgaagaaattgctagggacttcaacccgaactggatgagtgctgtcgagatcttagacgacgataacttcctaggggctgaaaatgccttcaacctctttgtttgccagaaagattctgccgccactaccgacgaggaacgtcaacacttgcaggaggtgggactgtttcaccttggcgagtttgtgaacgtgttctgtcacggatctctggtaatgcaaaatttgggcgagacctccacacctacccagggaagtgtattgtttggaaccgtgaacggaatgatcggcctcgtgacgagcctgtccgaaagctggtacaacctgctactggacatgcagaatagactgaacaaggttattaagtccgtaggtaagatagagcactccttttggagatctttccatactgagcgcaaaaccgagccagctacgggatttatagatggtgacctcattgaatccttcttggacatcagtagacccaagatgcaagaggttgtggcaaacctgcagtatgatgacggcagtggaatgaaacgtgaggctacagcagatgatctcattaaggtggtagaggaactgacgcggattcactag

SEQ ID NO: 23810 - DNA, 1356 bp, Artificial Sequence
  Description of Artificial Sequence: Synthetic coding sequence
atgagctacaactacgtggtgaccgcccagaagcccaccgccgtgaacggttgcgttactggccattttacaagcgcagaagaccttaacctcttgattgccaaaaatacccgtttagagatttacgtagttaccgccgaaggcctgaggcccgttaaggaggtgggaatgtacggaaagatcgccgtgatggaattattccggcctaaagctctgagttcctcagtcagttctagcaagttgttttcttcctcaacagcaccccacgaaacatcatttggggaggaggtcgaggtgcacaatctcctgataatcgaccagcacacattcgaggttctacatgcccaccagttcctgcagaatgagtacgcactgtccctggttagttgcaagctgggtaaggaccctaacacatacttcatcgtgggtacggccatggtgtatccagaagaggcagagcccaagcaggggcgtattgtggtttttcagtattccgacggcaagctacaaacagtggccgagaaggaggtgaaaggggcggtgtattccatggtggagttcaatgggaaattgctggcctccatcaattctaccgtgaggctatacgagtggaccacagagaaggaattgagaactgagtgtaaccattacaacaatatcatggccctgtacctgaaaactaagggggattttatcctagtcggagacctgatgagatctgttctcctactggcctataaaccaatggaaggcaacttcgaagagatcgcccgcgatttcaaccccaattggatgtccgctgtcgaaatcctggatgacgacaacttcctcggcgccgaaaacgctttcaacctgtttgtctgtcagaaggattccgcagcaaccaccgatgaggagcggcaacacctccaggaagtgggcttgttccacctgggcgaatttgtaaatgtattttgccacggttcactcgtaatgcagaacctgggggagactagcaccccaacccaaggatctgtactattcggcacagtcaacggcatgatcgggttggttactagcttgagtgagtcatggtacaacctcctactagatatgcaaaatagacttaacaaagtcatcaagtccgtgggtaagattgagcactctttttggcggtcattccatacggaaaggaagaccgagcctgccaccggatttattgacggagatctgattgaaagctttctggacatttctcgacccaagatgcaggaggtggtcgctaatctccaatatgacgacgggtccggtatgaagcgtgaggccacggctgatgacctgattaaagtggtggaggaattgacgcgcattcactag

SEQ ID NO: 23811 - DNA, 441 bp, Artificial Sequence
  Description of Artificial Sequence: Synthetic coding sequence
atgagctacaactacgtggtgaccgcccagaagcccaccgccgtgaatgggtgcgtgacaggccatttcacgagcgcagaggatttaaacttgctgattgcaaaaaacacgcgcctagaaatttacgtcgttaccgccgaaggactcagaccagtgaaagaggtgggtatgtacggcaaaatcgccgtgatggagcttttcagacccaagggggaaagcaaagacctgctgttcattctcactgcgaagtataatgcctgtattctggaatacaaacaaagcggcgagagcatcgacataattactcgcgctcatggaaacgtgcaagaccgcattggtcggccatcagagactggcatcattgggatcattgaccctgagtgccggatgatcgggctcaggctctatgatggactgtttaaggttatccctctggattag

SEQ ID NO: 23812 - DNA, 330 bp, Artificial Sequence
  Description of Artificial Sequence: Synthetic coding sequence
atgagctacaactacgtggtgaccgcccagaagcccaccgccgtgaacggctgtgtgaccggccactttacaagcgcagaggacttaaatttgctcattgctaaaaatactcgcctggagatctacgtggttacggcagaaggcctgcgcccggtgaaagaggtcggcatgtacgggaaaatcgcggtgatggaattatttaggcccaaaggagagtcgaaggacctgctttttatccttacggcgaagtacaatgcctgcattctggagtacaagcagtctggcgaatcaatcgacatcattactagggcccacggcaacgtgcaatag

SEQ ID NO: 23813 - DNA, 1284 bp, Artificial Sequence
  Description of Artificial Sequence: Synthetic coding sequence
atggcccccaagaagcggcccgagacccagaagaccagcgagatcgtgttgagacccagaaataagaggtctcgtagcccactagaattggagcccgaagctaaaaaattgtgcgccaaaggatctggcccttcgcggagatgcgactccgattgcttatgggtgggtttagcaggaccccaaattttacctccttgtcgcagcatcgttcgaacgcttcaccagcacaaactcggacgcgccagctggcccagcgtacagcaggggctccagcagtcattcttacacactctcgactcctatcgcattctccagaaggctgcacccttcgatcggcgagctaccagtctcgcgtggcaccccactcacccaagcactgtggcggttggcagcaagggcggcgatataatgctatggaatttcggtataaaggataaacccacgtttatcaaaggaatcggtgcgggcgggagcatcaccggtctcaaatttaatccgctgaatacaaaccagttctatgccagtagcatggaaggtaccacccggcttcaggacttcaagggtaacatcctgagagtgtttgccagttctgacaccataaacatctggttctgtagcctggatgtttcagccagctctcgcatggtggtcaccggtgataacgttgggaatgtgattctgctaaacatggacggcaaggagctctggaatctccgtatgcataagaaaaaagtgacacacgtagctctgaacccctgctgcgattggttcctggccaccgctagcgtggatcaaacagttaaaatttgggatctgaggcaggtgcgcggcaaggcctcctttctgtatagcctccctcatcgacacccggttaacgcggcgtgtttcagtcccgacggagctcgcctcctaaccaccgaccagaagagcgaaattcgggtgtacagcgcctctcagtgggattgtcccttgggactgattccccaccctcaccgacatttccagcacctcacccccatcaaagctgcttggcatccccggtacaacctgattgtggttggcagatatcccgacccaaatttcaaatcctgcaccccttacgaactgcgcaccattgatgtgttcgatggaaactctgggaagatgatgtgccagctctacgatccagaaagctccggtatctccagcttgaacgaattcaaccctatgggagacacactcgcatctgctatgggataccacatcctaatttggtcccaagaggaagcccggactcggaagtag

SEQ ID NO: 23814 - DNA, 717 bp, Artificial Sequence
  Description of Artificial Sequence: Synthetic coding sequence
atggcccccaagaagcggcccgagacccagaagaccagcgagatcgtgttgaggccgcgaaacaaacggtcacgctccccactggaactcgaacccgaggccaagaagctatgtgctaagggctccggaccatctagaagatgtgatagcgattgcctgtgggtgggtctagcggggccccagatcctgccgccatgtcgctccattgtaaggaccttgcatcagcataaactcgggcgtgcatcttggccctcagtgcagcagggcctgcagcagtcttttttacacaccctggactcgtaccgaatactgcagaaggctgccccatttgaccgacgggctacatcactggcctggcacccgactcatccttccaccgttgccgttggatcaaaagggggcgatattatgctttggaactttggaatcaaggacaaacccacgtttatcaagggggcagcatggcatccgcggtacaatcttatcgtggttggcaggtatcctgatcccaactttaaatcatgcactccttatgaattgcgtaccatcgatgtgttcgacggcaatagtggcaaaatgatgtgccagctttacgaccccgaatcctcgggaattagctcactcaatgagtttaaccccatgggtgatacattggcgtcggccatgggctaccacatcctcatttggagtcaagaggaagcacggaccagaaaatag

SEQ ID NO: 23815 - DNA, 735 bp, Artificial Sequence
  Description of Artificial Sequence: Synthetic coding sequence
atggcccccaagaagcggcccgagacccagaagaccagcgagatcgtattgcgtccacgtaataagagaagtaggtctcctcttgagctggagccagaggctaagaagctgtgcgccaaaggatctggcccatctcgtcgatgcgacagcgattgcctatgggttggtctggctggcccacaaattctccctccatgcagatcaatcgtgagaacgcttcaccaacacaagttaggaagagccagttggcctagcgttcaacagggcctccaacagtccttccttcacacactggattcgtataggattctccagaaggcggccccctttgatcgccgtgccacaagtctcgcctggcacccgacccaccccagtacagtggctgtcggatccaagggaggggacattatgctgtggaacttcggcataaaagataagccaaccttcatcaaaggaataggcgccggtggaagcataacagggcttaagttcaaccctttgaacactaaccaattttacgcctcatcaatggagggaacaactaggctgcaggattttaagggcaatatcctgcgcgtgttcgccagttcagatactattaatatatggttctgctcccttgatgtatccgcctcgagtagaatggtggtcacgggtgataacgttggcaacgtgatcttactgaacatggacgggaaggaactagtttctgtccccatggagcctgggtcctag

SEQ ID NO: 23816 - DNA, 1092 bp, Artificial Sequence
  Description of Artificial Sequence: Synthetic coding sequence
atggcccccaagaagcggcccgagacccagaagaccagcgagatcgtgctgagaccacggaacaagaggagccgctctccactggagctggagcccgaagccaaaaaactctgcgcaaaaggcagtggcccttcacggcgctgcgattcggattgtctctgggtcggcttggctggtccacagatcctacctccgtgcaggtccatcgtccgaaccctccaccagcataagctggggagagcttcttggccgagcgttcagcaaatcggagccgggggcagcatcaccggactgaaatttaaccctctcaatacaaatcagttctatgcatcatcaatggaaggcacaaccagacttcaggactttaaggggaatattcttagggttttcgccagcagtgatacaattaacatttggttttgttccctcgacgtgagcgcttcatctagaatggttgtgacaggggacaatgtggggaatgtgatccttctgaacatggacggtaaggagctgtggaaccttcgaatgcacaagaagaaggtgacgcacgttgctctcaatccctgttgcgattggttcttggcaacggccagtgtagaccagaccgtgaaaatatgggacctccggcaagtgagggggaaggctagtttcctgtattcactgccacatcgacatcctgtgaatgcagcctgcttctcccccgatggggcccggcttcttaccactgatcagaagagcgaaattcgggtttattccgccagccagtgggactgccctctgggactcattcctcacccacaccgccacttccagcaccttacacccataaaggccgcatggcacccacgatacaatctgattgtggtaggcaggtaccctgacccaaacttcaagagctgtaccccgtatgagctgcggaccatagatgtttttgatggcaactcagggaagatgatgtgtcagctctacgaccctgaatcgagtggtatttccagtctcaacgaattcaatccaatgggagacaccctagcatctgctatggggtatcatattctgatatggtctcaggaggaagctagaacccgtaagtag

SEQ ID NO: 23817 - DNA, 1119 bp, Artificial Sequence
  Description of Artificial Sequence: Synthetic coding sequence
atgagcgaggccggcgaggccaccaccaccaccaccaccaccctgccccaggcacccaccgaagctgcagccgccgccccccaagatcccgccccaaaaagcccagtagggagcggtgcaccccaggcagctgccccagcccccgccgcccacgtggcaggtaatccagggggggacgctgccccagctgcaacaggcactgcggccgccgccagtctggcaaccgctgctggctccgaagatgcggagaaaaaagtactcgccacgaaggtcttgggcaccgtgaagtggttcaacgtgcgtaatggatatggattcattaacagaaacgataccaaggaagatgtgtttgtccaccaaactgcaatcaaaaagaataaccctcgcaagtatctccgcagcgtgggggacggggaaacagtggaatttgacgtggttgagggtgaaaagggagccgaggctgccaacgtgaccgggcctgatggcgtccctgtagagggcagtaggtatgctgcagaccgtcgaagataccgtagagggtactacggccggcgtaggggtccccctagaaattatgccggcgaagaggaagaagaagggtcgggttcatcggagggttttgatcccccagccacagatcgtcagttcagcggggcgaggaaccagctaaggcggcctcaatacaggccccagtatcgacagcgacgcttcccaccttaccacgtcggccagacttttgataggcggagccgcgtcctgccccaccccaataggattcaagccggagaaatcggagagatgaaggatggggttccagaaggcgcccagctgcaggggccagttcaccgtaatccaacatatcgaccccgttatcgaagtaggggtccaccccgcccaagacccgccccagccgtgggagaggcagaggacaaagagaaccagcaagctaccagtgggccaaaccagcctagtgttaggaggggctaccgtcgaccctacaactacagacgaagacctcggcctcccaacgcaccctcacaggatggcaaagaggccaaagcgggggaagcacccaccgagaaccccgctcctcccacccagcaaagttccgccgaatag

SEQ ID NO: 23818 - DNA, 867 bp, Artificial Sequence
  Description of Artificial Sequence: Synthetic coding sequence
atggccaacgagacccagaaggtgggcgccatccacttccccttccctttcaccccgtacagcattcaggaggacttcatggcggaactttacagagtcttggaggccggaaagataggtatctttgagagccccaccggcacggggaaatctttgtccctgatctgcggcgcgttgagctggctcagagattttgaacagaagaaaagagaggaagaggctcggttgctggaaacgggaactggacccctgcacgatgagaaagacgagtctctctgtttgtcgtcaagttgcgaaggggccgcaggcaccccccgtcccgccggcgagccggcctgggtgacccagttcgtgcaaaaaaaggaggagcgagatctggttgaccgtttgaaagcagagcaagcccgtcgcaagcagagagaggaaagactccaacagcttcagcatagagtgcagcttaagtacgccgccaagagactgaggcaagaggaggaagaaagagaaaatctccttcgactaagtcgagagatgctagaaactggacccgaagccgaacgcctcgaacagctcgaatcaggcgaggaggaacttgtgcttgccgagtacgaatccgacgaagaaaagaaagtggcctcacgggcgcccagcgatgcgacgtcgtctcggcaccctccggacgcgtcttttcctgctgcgcttaatttcctgcagaggaccaggccttcttcagtgctctcagaggacttactgatgcagagggcggttgccaagcaccccgctctgcttccctggcagatgagctcctcacccctgcggcctggctccgaatggatgcgtatgagaatgacctggcggaaaaacacatag

SEQ ID NO: 23819 - DNA, 2571 bp, Artificial Sequence
  Description of Artificial Sequence: Synthetic coding sequence
atggccaacgagacccagaaggtgggcgccatccacttccccttccctttcacaccatactcgatccaggaggactttatggccgagctgtatagggtcctagaagctggaaagattggaatttttgaatcacccaccggaacaggaaagtctctcagcctgatctgcggcgccctctcctggctgagagattttgagcagaaaaagcgcgaagaagaggccaggctgttagagaccggaactggcccactgcacgatgagaaagatgagtctttgtgcctatccagcagctgcgaaggcgctgcagggacccctcggccagcaggggaacccgcctgggttacgcaatttgtgcagaagaaggaggaaagagacctggtggatcggcttaaggcagaacaggctcgtcgcaagcagcgggaggaacgccttcagcaactgcagcatagagtccagctgaaatacgcagccaagaggctgcggcaggaagaagaagagagggagaatctgctgaggctgtctcgggagatgcttgaaaccggacctgaggccgaaagactagagcagttagagagcggagaggaggagcttgttctggctgaatatgaatcagatgaagagaagaaggtggctagtcgtgtggacgaggatgaagacgatctggaagaggaacacattaccaagatctactactgctcgagaacccactcccaattggcccagttcgtacatgaagtgaagaaaagtccttttggaaaggacgtgcgtctggtttcgctgggctcccgccagaacctctgtgtgaacgaggatgtcaaatctctcggctcagtgcagctgataaacgacagatgtgtcgacatgcaacgtagtagacacgagaaaaaaaagggggctgaggaagagaagcccaagaggaggaggcaagagaagcaggccgcttgtcctttttacaaccatgagcagatgggactgctgcgtgacgaggccctcgcggaggtgaaagatatggagcagctccttgccctaggtaaagaggccagagcctgtccgtattacggatcgcggctggccattccagctgcccagctggtcgtcctcccttatcagatgcttctgcatgccgctacccgccaggccgccggcatcaggctgcaggatcaagtggtgattatagacgaggctcacaacctgatagatactattactggcatgcattccgtcgaagtgtctggaagccagctgtgtcaagctcacagccaactcttacagtatgtggagagatatggaaagcggttaaaggctaaaaacctgatgtatttgaaacagatactgtatttgctcgaaaaatttgttgccgttctcggtggcaatatcaaacagaatccaaacacccagtcgttaagccagactggcaccgagctgaaaaccattaatgatttccttttccaatcccagatcgataacatcaatttattcaaagttcagcgatattgcgagaagtctatgatctctcggaagttgttcggatttactgaaagatatggcgccgttttctcatcccgtgaacaacctaagctagctggatttcagcaattcctgcagagtttgcagccccgtacaacagaagcattggcagctccggccgacgaatcccaggctagcactctgcgtcctgccagccccctgatgcatatccagggatttctggccgcactgacaacagctaatcaggatggccgggtgatattgtcccggcaggggagtctttcgcagagcaccttgaagtttttattgctaaatccagctgtgcactttgctcaggtcgttaaagaatgtagggctgtcgtgatcgcaggaggaaccatgcagccagtgtctgattttcgccagcaactgctggcctgtgctggtgttgaagctgaacgagtggtagagttctcctgcggacatgtgatccctcccgacaacattttgcctttggttatctgttcaggaatatctaatcagccactggaatttacctttcaaaagcgggaattgccgcagatgatctttcaggagcccaaaagcgcccatcaggtcgaacaggtcttgctcgcatattccaggtgtattcaggcctgtggccaggaaagagggcaagtaactggcgccctgctgctgtccgtcgtgggtgggaagatgtcagagggcataaacttctccgataatctcggcaggtgtgtggtgatggtcggtatgccctttcccaacattaggtcagccgagcttcaggaaaaaatggcctacctcgatcaaaccctcccgcgggcacccgggcaggcaccaccagggaaagctttggttgagaacctatgcatgaaggctgtcaatcagagtataggacgagcaatccgacatcagaaggacttcgcaagtgttgtcctgttggatcagcggtatgctcggcccccagtgcttgccaaactgccagcctggattcgcgccagagttgaggttaaggcaacttttggccctgctattgccgcagtccagaaattccatcgggagaaatccgcatccagctag

SEQ ID NO: 23820 - DNA, 1671 bp, Artificial Sequence
  Description of Artificial Sequence: Synthetic coding sequence
gaggaggagcccctgtggcagggctgcagcgccggcctgccctggttgccagccgagaaaaagaagggcgcagaagaagagaaaccgaaacggcggcgacaggaaaagcaagcagcttgtccattctacaaccacgagcagatgggtctactgagagatgaggcactcgctgaagtcaaagatatggaacaactcctggcactgggcaaggaagccagggcttgcccatactatggctcgaggctggccatacctgccgcccaactcgtggttctgccctatcagatgctcctgcatgccgctacacgacaggccgcgggaatcagactccaggaccaggtcgtcatcattgacgaagctcataatttgatcgatacgatcaccgggatgcactccgttgaagtgtctggaagccagctatgtcaggcccatagtcagttgctgcaatatgttgagcgctacggcaaaagactgaaagccaagaaccttatgtatttaaagcaaatcctgtacttgttagaaaagtttgtggctgtccttggcggaaacatcaagcagaaccccaatacgcagagcctgagccagactggcacggagctcaagactattaacgacttcctgttccaatcacagatagacaacataaatctctttaaggtacaacgctattgtgagaagagcatgatatctaggaagctgtttggtttcacagaacgatatggtgctgtgttctccagccgggagcagccaaagctcgcaggattccagcagtttctgcagtcactccagcctcgaaccacggaagccctggccgcgcccgctgatgaatctcaggcttccactctcaggccggcctctccattaatgcacattcagggcttcttagccgcgcttaccacagcaaaccaggacgggagagtgatcctctctcgtcaaggttcactgtcccagtcaactctaaaatttttactactgaatccagctgtgcacttcgcacaagtggttaaagagtgtcgggcagttgtgattgccggcggcaccatgcagccagtctctgattttaggcagcagctcctcgcctgcgcaggcgtggaggccgaacgtgttgtggagttctcatgtggacatgtcatccccccagacaacatcctccccctcgtgatttgctcaggcatcagtaatcaaccattggagtttacctttcagaaaagagagctgcctcagatgatggatgaggtagggaggatcctgtgcaacctgtgcggggtggtgcccggcggcgtggtctgttttttcccttcatatgagtatctcaggcaagttcacgctcactgggaaaaaggaggactgctggggagactggcagcccgaaaaaaaatctttcaggaaccaaaatcagcacatcaggtggagcaagtgctgcttgcctacagtcgctgcatccaagcttgcggtcaggagcgaggtcaggttacaggcgcgttactgttgagcgtcgttggcgggaaaatgtcagagggtattaacttctcagataacctggggcgttgcgtggttatggtaggaatgccattcccaaacattagatcagcagagctgcaagaaaagatggcctacctggaccaaactctggctggcccaagtggtacacggcggatccttccggcttag

SEQ ID NO: 23821 - DNA, 2913 bp, Artificial Sequence
  Description of Artificial Sequence: Synthetic coding sequence
atggccaacgagacccagaaggtgggcgccatccacttccccttcccattcaccccgtactcaattcaggaggacttcatggcggaattatacagggtacttgaggcaggaaaaattggaattttcgaatcccccacagggacaggtaaatctctctcattgatttgcggcgctttatcatggttgcgcgattttgagcaaaagaaacgggaagaagaggcccgcctgctggagactggtacaggacctctccatgatgagaaggacgagtccctgtgtctgtctagcagttgtgagggcgcggccgggactccaagacctgctggtgaacctgcctgggtgacccagttcgtacaaaagaaggaagaacgcgatctggtggatcgccttaaagcggagcaagcacgccggaagcagcgagaagaacggctccagcagctccaacacagggtccagctgaagtatgccgctaaacgcctccgccaggaagaggaggaacgtgaaaacttgctgagactttcgcgtgagatgctggaaaccggccccgaagcggagagactggaacagcttgagtccggcgaggaagaattggtcctggcagagtacgaatctgacgaggagaagaaggtggccagcagagtcgacgaggatgaggatgacctggaagaggaacatatcaccaagatatactactgtagtcgcactcactcacagctcgctcagtttgtgcatgaagtgaagaaatcccccttcggcaaggacgtccggcttgtgagtttagggtccagacagaatctgtgtgttaatgaggatgtcaagtctctggggagtgtgcagttgatcaatgataggtgtgtggatatgcagcgctccagacatgaaaagaaaaagggcgccgaggaggagaaacccaagcgacgccgccaggagaagcaggcggcttgcccgttctataaccacgagcagatgggtctgcttagggacgaggcactggctgaggtcaaagatatggagcagctcctggcgttgggcaaggaggccagagcctgtccttattacggatctcggctcgctatcccagccgctcagctcgtcgtgctcccgtaccagatgctcctgcacgcagcaacacgccaggcggccgggatccggcttcaagatcaggttgttatcatagacgaggcgcataatctcatcgacaccattaccggcatgcactccgtggaagtgagtggctctcagctgtgccaggcccactcccagttgcttcagtatgtagagaggtacggtaaaaggcttaaagccaagaatctgatgtacctcaagcaaatactgtaccttttagagaagttcgtggcagtcctcggcggcaacattaagcaaaatcctaacacgcagtcactgtcacagaccggcactgagctgaagaccattaacgacttcctgtttcagagccaaatagacaacatcaacctctttaaggtgcagcggtactgtgagaaatcaatgatcagccgtaagctcttcggatttactgagagatacggagctgtcttctcttcaagggagcaaccgaagctcgctggatttcaacagttcctgcaatcactgcaaccacgcaccactgaggcactggccgcacccgccgacgaaagccaggcgagcacactgagacctgccagcccactcatgcatatccagggctttctggccgcgctcacgactgcaaatcaggatgggcgtgtcattctcagccgccagggctcactgtcacagagcactctaaagttcctgttgcttaaccccgcggtacacttcgctcaggtggtgaaagagtgtcgagcagttgtgatcgccggggggactatgcagcccgtgtctgattttcgacagcagttgcttgcttgtgctggtgtcgaggccgagagggtagtggagttctcttgtgggcacgttatccctccggacaacattctccccctcgtgatttgcagcggaattagtaatcaaccgttggagtttactttccagaaaagggagctgccccaaatgatggacgaggtaggtcggatactctgtaatctctgtggcgtcgtgcccggcggcgtagtttgctttttcccgagttatgagtatcttcggcaggtccacgcccattgggaaaagggcggcctcctcggaagactagctgcacggaagaaaatattccaggaacctaagagtgctcaccaagtggaacaagtcctcctcgcgtattcccggtgcatccaagcctgtggacaggagagagggcaagttactggtgccctgctgctgagtgtggtcgggggcaagatgtctgagggcatcaatttttctgataacttgggcaggtgtgttgtcatggtgggcatgcctttcccaaacattcggtcagcggaacttcaagagaagatggcctacctggatcagaccctcagtccccgccctggcactcctagggaaggctctggaggagagcctgtacatgagggtcgccaacccgtgcacaggcagggccaccaggcccccgagggtttttgccaaagatctgcccccggacccgccatttgccctgccccttgccctggccaggccgccggcctggacccttccccttgcggcgggcagtcgtacctctggccacgccattgttgctgcgctgaagtgtctcctggcgaggtgggcctctttctcatgggaaatcatactacagcgtggcgtcgggctctgcccctgtcgtgtcccttggaaactgtctttgttgttggagtggtgtgcggcgaccccgtgactaaggtgaagccgcggaggagggtctggagcccagagtgctgtcaagaccccggaactggcgtgagcagccgcaggcgaaagtggggcaaccctgagtag

SEQ ID NO: 23822 - DNA, 675 bp, Artificial Sequence
  Description of Artificial Sequence: Synthetic coding sequence
atggccgagctgtaccgggtgctggaggccggcaagatcggcatctttgagtctcccactggaacgggcaaatccctatcacttatctgtggggctctgagttggttacgggacttcgaacagaaaaagagagaagaggaagctcgactgcttgagactggaactggccccttgcatgatgagaaggacgaaagcttatgtctttcatcctcctgtgaaggcgccgcaggcaccccacggcccgcgggcgagccagcctgggtgacccaatttgtccaaaagaaagaggagagagacctcgtggatcgactgaaggcagaacaagccagaagaaagcagcgggaagaacgactacagcaactacagcatcgcgtgcagctgaagtacgccgcgaagcgcttacggcaggaggaggaggaacgggaaaacctgttgcgtctgagcagggagatgctggagaccggacctgaggcagagagactcgagcagctggaatcaggggaagaagagctagtactggcggagtacgagagtgatgaagagaaaaaagtggcatctcgggtggatgaagacgaagatgatctggaggaagagcatatcacaaagatctattactgttccaggactcattctcagctcgcccagttcgtgcatgaggtgaagaaatctccttag

SEQ ID NO: 23823 - DNA, 2721 bp, Artificial Sequence
  Description of Artificial Sequence: Synthetic coding sequence
atggccaacgagacccagaaggtgggcgccatccacttccccttcccattcacaccgtacagcattcaggaggattttatggctgaattgtatagagtgttggaagccggtaaaattgggattttcgaatcacctaccgggaccggaaagagtctttcactgatttgcggggccctgtcttggctaagagacttcgaacaaaagaagcgtgaggaagaggccaggctgttggagaccgggactggaccactacatgatgagaaggatgaatctctttgtctgtcaagcagctgtgagggagccgccggaacccctaggcccgctggggagcctgcatgggtgactcagttcgtgcagaaaaaggaggagcgagatttggtggatcggctgaaggccgagcaggctagacggaagcaacgtgaagagaggctgcagcagctgcaacatcgcgtgcagttaaagtacgccgcaaagcgactgagacaggaagaagaggagcgcgagaacctactgcgactcagcagggagatgctcgaaacagggccggaagcggaacggctcgagcagctggaaagtggagaagaagaactcgtgttagctgaatatgagagcgacgaggaaaagaaggtggctagccgagtggatgaagacgaggacgacctggaggaagaacacatcaccaagatctattactgctctcggacccacagccaactagcccaattcgtgcacgaggttaaaaaatccccctttgggaaggatgtccgacttgtttctctcggttcaagacagaacttatgcgtgaacgaggatgtgaagagtttgggatctgtccaactgatcaacgaccgctgtgtagacatgcagagatcaagacacgagaaaaaaaagggagccgaggaggagaagccgaagcggcggcggcaggagaagcaggcagcttgcccattctacaatcatgagcagatgggcctccttcgagatgaggccctggccgaagtaaaagacatggagcagttactagcactgggtaaagaggcccgggcgtgcccttactatggcagtagactggctatacctgctgcccagctggtagtcctgccctatcagatgctgcttcacgcagcaactcggcaggctgcaggtatccgactccaggatcaggtggtcatcattgacgaggcgcataatcttatagacacaattaccggcatgcactcggtagaagtttctggatcacagctgtgccaggcccattcccagcttctccagtacgttgaacgctacggtaagagactaaaggccaagaacttgatgtatctaaaacagattctctatttgctggaaaagttcgtcgcagtcctgggcggcaatattaagcagaatcccaatacccaatcactgagccaaacaggaaccgaactaaaaaccattaacgactttctgttccaaagccagatcgacaacataaatctgttcaaggtgcaacggtattgcgagaaaagcatgatcagccgaaaactgtttggtttcacagagaggtatggggctgtcttttcatccagggagcagcctaagctcgcgggcttccagcaattcctgcagtctcttcaacctaggaccacagaggctctggcagctccagccgatgaatcccaggccagtactctccggcctgcatctcctctgatgcacattcaaggttttctggccgccctgactactgccaaccaggatggcagagtcattctaagcagacagggaagcctctcacagagcactctaaaatttctgctcctcaatccggccgtgcacttcgcccaggtggttaaggaatgtcgggcagtggttatagcggggggtaccatgcagcccgtctccgacttcagacaacagctgctagcatgcgcaggggtagaagccgagagagtggtggaattcagctgtggccatgtgatcccaccggacaacattctgcctctggtgatatgttctggtatcagtaatcagcccctggaatttactttccaaaagagggaacttccccaaatgatggatgaagtcggccgtattctgtgcaatctctgtggcgtggttccgggaggggttgtttgtttctttccttcatatgaatatctgcggcaggtacacgcacattgggagaaaggaggactgctgggaaggttggctgcgcgcaagaaaatttttcaagaacccaagtccgcccatcaggttgagcaggtgttgctcgcctacagccgatgcatccaagcctgtggccaggagaggggtcaggtgaccggcgccctgctgctctccgtggtgggaggcaaaatgtcagaagggatcaatttctcagataacctggggagatgtgtagtaatggtaggcatgccttttcctaatatcaggtctgcagaacttcaggagaaaatggcctacctcgatcaaactcttccacgggcgcccggccaggcgcctccaggaaaagcgctcgtcgagaatctctgtatgaaggctgtgaaccagagcatcggccgggcgataaggcaccaaaaggatttcgctagcgtggtgctgctggatcaacggtacgccaggcctcctgtgcttgctaagctccccgcttggattcgggcccgggtcgaagtcaaggccacttttggtccagctatagccgccgtgcagaagttccacagggaaaagtccgccagtagttag

SEQ ID NO: 23824 - DNA, 2913 bp, Artificial Sequence
  Description of Artificial Sequence: Synthetic coding sequence
atggccaacgagacccagaaggtgggcgccatccacttccccttcccattcaccccctattcaatccaggaggacttcatggctgaactctacagagtgctggaggcgggaaaaattgggattttcgaatctccaaccgggaccggcaaaagccttagcctgatctgcggagcattaagctggctgcgtgattttgagcagaaaaaacgggaagaagaggcccgcctgctcgagacaggaactgggccacttcacgatgaaaaagatgagagtctttgtctgagcagttcctgcgaaggtgccgccggcaccccgaggccagccggagagcccgcttgggtgacccagtttgtccaaaagaaagaggaaagagatctggtcgataggctcaaagctgagcaggcgagaaggaaacaacgcgaagagcggcttcaacaactgcagcaccgcgtccagttgaagtacgcggccaagaggctccggcaggaggaagaagaaagggagaacctgttgaggttaagtcgggagatgttggaaactggccctgaggccgaaagactagagcagctagaatcaggcgaagaggagctggtcctcgccgagtacgagagtgatgaggagaaaaaggtcgccagccgggtggacgaggatgaggatgacctggaggaagagcacataaccaagatttactactgctctcgtacccactcccaactggctcaatttgtgcacgaagttaagaaaagcccttttggcaaagatgtaagactggtgtcccttggaagccgccagaatctgtgtgtgaatgaggacgtgaaaagtctgggttcagtgcagctgatcaatgatcgctgtgtggacatgcagcggtcgcgccatgagaaaaaaaaaggtgctgaggaggagaaacccaaacggcgccggcaggaaaaacaagccgcatgccccttctataatcacgaacagatggggctgttgagagatgaagctctggctgaggttaaagatatggaacagctactggcactaggaaaggaagcgcgcgcttgcccttattacggctcacgcctggctatccccgctgcacagctggtggtactcccctaccagatgctccttcacgctgccactcggcaggcagcagggatcaggttacaggaccaggtggtcattattgatgaagcacacaaccttatcgatacaatcacggggatgcactctgtcgaggttagcggcagtcagttgtgtcaggcacatagtcagcttttacagtacgtagaacggtacggaaaacggctgaaagctaaaaatctgatgtatctgaagcagattctgtacctcctggagaagttcgttgctgtccttggcggtaacatcaaacagaatcctaatacacagtctctgtcacagactgggacggagctgaagaccatcaacgacttcctgttccagagtcagattgataacatcaacctgttcaaggtgcagaggtactgtgagaaaagtatgatttcacgtaaactgtttggctttaccgaacgatatggtgccgtgttcagctcgcgggaacagcccaagttagccggattccagcagtttttacagtcgctccagcctcgcacaacagaagctctcgccgctcctgctgatgaaagccaggcctccactttgcgccctgcttctcctcttatgcatatccaaggtttcctcgccgccctaacgactgccaatcaggatggccgagtgatattgagccggcaaggctccctgtcacagtctactctgaagttcttactcctgaatccagccgttcatttcgcacaggtcgtgaaggagtgtcgggcagtcgtgatcgccggcggcactatgcagccggtgtccgactttagacagcaacttctggcatgtgccggagtcgaggcggagagagtggtggagttctcttgtggccacgtaattccacctgataatatcctgcctctggtgatctgctctggtatcagtaaccagcccttggagtttactttccagaagcgcgaacttcctcagatgatggacgaagtaggtaggattctctgtaatctgtgcggtgtggtgccaggcggtgtggtctgtttctttccctcttacgagtatctgcgccaagtgcacgcacactgggagaaaggggggctgttggggaggctagctgctaggaaaaagattttccaggaacctaagtcagctcaccaagtggagcaggtactgctcgcctattcccgctgcatccaggcctgtggtcaggagcgaggacaggtaacgggagcactgctcttgagcgtggttggcggaaagatgtctgagggaatcaacttttccgataatctaggtagatgcgttgttatggtgggcatgcccttccccaacatcagatcggctgagctgcaggaaaaaatggcatatctggaccagactctctctccacgacccgggacccctcgcgagggctccgggggcgagcccgtccacgaggggaggcagcctgtccaccggcaaggtcaccaagctcctgagggattttgtcagcggagcgccccgggcccagctatctgtccggctccctgccctggtcaagctgcggggctcgacccgagcccttgtggggggcagtcttatctctggccccgccattgctgttgtgcagaagtgagccccggggaggttggcctcttcctcatggggaaccataccaccgcctggcgccgcgcccttcctctgtcttgtccactggagacagtgtttgtggtgggggttgtgtgcggggacccagtgacaaaggtgaagcctaggcgacgggtctggtcacctgaatgttgtcaggaccctggtactggagtatccagtagacgacgaaagtggggcaacccggagtag

SEQ ID NO: 23825 - DNA, 4293 bp, Artificial Sequence
  Description of Artificial Sequence: Synthetic coding sequence
atgaccgtgttccggcaggagaacgtggacgactactacgacaccggcgaggagctcggaagtgggcaattcgcggtggttaagaagtgtcgcgaaaaatcaactggccttcagtatgctgccaagtttattaaaaaacggaggaccaaatcctcccgcagaggcgtatcgcgggaagatatcgagagggaggtgagcatcctcaaggaaatacagcaccccaatgttataactttacatgaggtgtatgagaacaaaaccgacgtgatccttattcttgagttggtcgctggaggagaactgttcgatttcctggccgagaaagaatccctgaccgaagaagaggcgactgaattcttgaagcaaattctgaatggagtctattatctacatagcctgcagattgcgcatttcgacctgaaaccagaaaacatcatgcttctggaccgtaacgtcccaaagccacgtataaaaatcatagatttcgggctagctcacaaaatcgatttcggaaacgagtttaagaatatcttcggcacccctgaatttgtggctccagagatagtgaattacgaaccgctgggcctagaagccgatatgtggtcaatcggggttatcacatacatcctactgtcaggtgcctcaccttttctgggcgacaccaaacaagagaccctagcaaatgtttcagcggtgaattacgaattcgaggacgagtacttctcaaatacctccgcccttgcaaaagattttattagaaggctgttagtgaaggatccaaagaaaagaatgaccattcaagactctctgcagcacccctggattaagccgaaggatacacagcaggccctgtctagaaaagcaagcgccgtgaacatggagaaattcaagaaattcgctgctagaaaaaaatggaagcagtctgtgcgccttatctctctatgtcagcgcctgagcaggagcttcttatccagatctaatatgtctgtagcccgatccgacgacaccctcgacgaggaggactccttcgttatgaaagcgattatccacgccataaatgatgataatgtgcctgggctgcaacacctcctggggtctctgtccaattacgacgttaaccagccaaataaacatggcacgccacctctgctgatcgcggccgggtgcggcaatatccagattctacagctgttgattaaacggggctcacgcattgacgtgcaggacaagggggggagcaacgctgtttattgggccgcccgacatgggcatgtggataccctgaaattcctgtcagagaataaatgtcctttagatgttaaagacaagtcaggcgaaatggccctgcatgtggcggcgcggtacggccacgcagatgtcgcccaactgctgtgttcctttggctcaaatcctaacatccaggataaggaggaggaaacaccgctgcactgtgcagcctggcacggatactattctgtggccaaagctctttgcgaggctggctgcaacgtgaatattaaaaatagggagggcgagacccctcttcttaccgcaagcgcccgcggctaccacgacatcgtggagtgtctagctgagcatggagctgatctgaatgcctgcgataaagacggtcatattgcactccatctcgctgttcggaggtgtcagatggaggtcattaagactctcttaagccagggttgtttcgtggattaccaagatagacacggcaacacccctttacacgtggcttgtaaggatgggaacatgcctattgtggtagccttgtgcgaggctaactgtaacctcgatatctccaataaatatgggcggacgcctctgcatcttgctgcaaataacggtatcctggacgtggtgcgctacctgtgcctgatgggagccagtgtggaagccctgacaactgacgggaagacagctgaggacttagcgcggagcgagcagcatgagcatgtagccggattgttagctcggctacgaaaggatacccaccgggggctttttattcaacagctgcgacccactcaaaatctgcaaccacgtataaagctcaaactatttggacacagcggcagcggtaagaccactcttgtcgagtcccttaaatgtggcctgctccgcagttttttcagaaggaggcgtcccaggctgtcttctaccaactcttcacgctttccgccctctcccctggctagcaaacccaccgtctccgtcagtatcaataatttataccctggttgtgagaatgtgtctgtgcggtcaagatctatgatgttcgagccggggctgacgaagggtatgctcgaggtgtttgttgcaccaactcaccacccccattgctccgccgacgaccaaagcactaaagccattgatattcagaatgcctaccttaatggcgttggcgacttttccgtttgggagttttccgggaacccagtgtacttctgctgttatgattattttgccgctaatgaccccacctccattcacgtcgtggtgttttccctggaggagccatatgagattcagttgaaccaggtgattttctggctgtctttcctgaagagtctggtgccagtcgaagaaccaatcgccttcggagggaagctcaagaatccactgcaggtcgtcctggttgcaactcatgccgacatcatgaacgttcctcgtcccgccgggggagaattcggatatgataaggacacgagtctgctgaaagagatcaggaacaggttcgggaatgacctccacataagtaataaactcttcgtactggacgccggagcatctggctcaaaggacatgaaggtgctgcggaatcacctgcaggagattaggtcacagattgttagtgtctgccccccaatgacccatttgtgcgaaaagatcattagcaccctgcccagctggcgaaagctgaatggcccgaaccagctgatgagtctccagcaatttgtatatgatgtgcaggatcagcttaacccccttgcctcggaggaagacctcaggagaatagctcagcagctgcactccacaggcgaaatcaatattatgcagagtgagactgtgcaggacgttctgctgctcgaccctcggtggctctgtaccaacgtactcggtaagttgctaagcgttgaaactccccgggccttacaccattatcgaggtcggtatactgtcgaagatatccagagactagtccctgactctgatgtggaagagcttttgcagatcctggacgccatggacatatgcgcacgcgacctgagctctggaaccatggtggatgtacccgccttgatcaaaactgataatttacatcggtcttgggctgacgaggaggatgaggtaatggtctacggaggagttaggatcgtacccgtagagcatctgactccattcccctgcggtatattccacaaggtgcaggtcaacctctgtaggtggatccaccagcaaagtaccgagggtgacgctgacatcagattgtgggtgaatggatgtaagttggccaacagaggcgccgagctattggtgctgctggtgaaccatgggcaaggtatagaggtgcaggtaagaggactggaaactgagaagatcaagtgttgcttacttctcgattctgtatgttcaacaatagagaacgtgatggcaaccacattgccaggtttactcacagttaagcattacctgagcccacagcagcttagagagcaccatgaacccgtcatgatctaccagccccgagattttttccgagcacagactttgaaggagacatctctaactaatactatgggcggatataaggagagcttttcatcaataatgtgctttggctgccacgatgtgtacagtcaagcctcattgggaatggacattcatgctagtgacttaaatctgctcacaagaagaaagctttccaggctactggatcccccagatccccttggaaaagattggtgtctgctcgctatgaacttaggcctccccgacctggtggccaagtacaatacaagtaacggagctcccaaagacttcctcccttctcctctgcacgccctgctgcgagagtggacgacataccctgaatcaacggtggggactctcatgtccaagctccgtgaacttggcaggagagacgccgccgactttctgctgaaggcttcgtcagtttttaaaatcaatctcgacgggaatggccaagaggcttacgcctcaagctgtaattccgggacatcttacaacagtatctcttctgttgtatcgcgctag

SEQ ID NO: 23826 - DNA, 4293 bp, Artificial Sequence
  Description of Artificial Sequence: Synthetic coding sequence
atgaccgtgttccggcaggagaacgtggacgactactacgacaccggggaggaactgggctccgggcaattcgcggtagtcaagaagtgtcgggaaaagtcaacaggtctgcagtacgcagccaagtttattaagaagcgtcgaacgaaatcgtctcggcgcggcgtctctagggaagatattgagagagaggtgtcgatcctcaaagaaatccagcaccctaacgtgattactttgcatgaggtctatgagaacaagactgatgtgatcctcatcctcgagttagtggccggcggtgaactatttgattttttagcagaaaaagagagcttgaccgaggaagaggcaacagaattcttgaagcagatactaaatggggtctattaccttcattcactgcagattgctcacttcgacctgaagccagagaacatcatgctgctggacagaaacgtccctaaaccccgcattaagatcattgattttggactggcccacaaaattgactttggcaatgaatttaaaaatatatttgggacccctgagttcgtggcccccgaaattgtgaattatgagccacttgggctggaggcagatatgtggagcataggagtgattacctatatccttctcagcggggccagtccatttctcggagatacaaaacaggaaacactggccaacgtctctgccgttaattacgagtttgaggacgaatatttctcaaacacttcagctttagcgaaggacttcatcaggaggcttctcgttaaggatccaaagaagaggatgacaatacaagacagtctccagcacccatggattaagccgaaggatacccaacaggccctgagccgtaaggcatctgctgtgaatatggagaagtttaagaagtttgcagctcgtaaaaaatggaagcagtccgtacggctcatttcattatgtcagcgtctctctcgttcgttccttagccgttctaatatgagcgtcgctaggagcgatgatacgctggacgaagaggactccttcgtgatgaaggcaattattcatgctatcaacgatgataacgtccccggattgcagcacctcttggggtcgctgagtaactacgatgtgaatcagccgaacaaacatggaactccaccactgctgatagccgcagggtgcggtaatattcagatcctccagcttttgatcaagcgtggatctcgtatcgacgtacaggacaaaggggggtctaacgccgtatactgggcagcccgacacgggcatgtcgacacactaaaattcctgtcggagaacaaatgcccgttagacgtcaaagacaaaagtggtgaaatggcgttacacgtagctgcacgatacggtcacgctgatgtagcgcagctcttgtgtagctttgggtccaaccctaatattcaagacaaagaagaggaaaccccactgcattgcgctgcgtggcacggctactatagcgttgccaaggccctgtgcgaggccggctgtaatgtgaatatcaagaatcgcgaaggcgagacacctctactcacggcatctgcccgcggctaccatgatattgtcgaatgcctagcggagcacggagccgatttgaatgcatgtgacaaagacggacacattgccttacatcttgccgtcagacgttgtcagatggaggtgataaaaactcttttgtcacagggctgtttcgtggattaccaggaccggcatggcaacactccgcttcatgtcgcctgcaaggacgggaatatgcctatcgtagtcgccctgtgcgaagccaactgcaacctggatatttctaataagtatggccggacccccttgcatttagccgcgaacaacggaatcctggatgtcgtacgctatctctgcttgatgggagcaagcgtggaggcactaactacggacggaaaaaccgccgaagaccttgcgcgctcagaacaacacgaacacgtggccggcctgttggctcggttgagaaaggatacacaccgggggctttttatccagcagctgcgcccaacacagaacttgcaacccaggatcaagctgaagctttttgggcactctggatctggcaagacaacccttgtggaatctctcaagtgcggccttttgagatcattcttcaggcgacgacggccgaggttgagcagcacaaactcgtctagattcccccctagtcctctggcctcaaaaccaacagtgagtgtgtcaattaacaatttgtaccccgggtgtgagaacgtgtctgttcgctctaggtctatgatgttcgagcctggtctcacaaagggcatgctggaagtgttcgtcgctcctacccaccacccacattgttctgccgacgatcaatcaactaaagcaatcgatatccagaacgcctatctcaacggagtgggggacttttccgtgtgggagtttagcggcaaccccgtctacttttgttgttacgattattttgccgcgaacgatccaacctctatccacgtggtcgtgttcagcctagaagagccttatgagatccagctcaatcaggtgattttctggctgagctttctgaagtcccttgtccctgttgaggagcccatcgcttttgggggcaaattgaaaaatccgctgcaggtggtgttggttgccactcatgctgatatcatgaacgtgccgagacccgcaggcggcgagttcggctacgacaaggataccagcttactgaaggagattagaaacaggtttggtaacgacctccatatttctaataaactctttgtcttagatgctggcgcttcaggttccaaagacatgaaggtgctcaggaaccacctgcaggaaatacgctcgcaaattgtctccgtgtgtcctccgatgactcatctgtgcgagaaaattatttccactctgcccagttggcgcaagctgaacggccccaatcaactgatgagtctgcagcaattcgtgtatgacgttcaggaccaactgaatcctctggctagcgaggaagacctccggcggatcgctcagcagttacactccacaggtgaaatcaacatcatgcagagtgagaccgtacaggacgttctgcttctagatcctcggtggttatgcacgaacgtactgggaaagctgctctcagtggaaacgccccgcgcattgcatcattatcgggggagatacacggtggaggacatccaaagactcgtaccggattccgacgttgaggaacttttgcagattttagatgctatggacatttgcgctcgggacctttcctcaggcacgatggtggacgttcccgctcttatcaagaccgacaatctgcaccgctcatgggccgacgaagaggatgaggtgatggtatacggtggagtaaggatagtcccagtggaacacctaacaccattcccatgcggtattttccacaaagtgcaggtcaatttgtgccggtggattcatcagcaatcaacagagggggatgcggatatccggctgtgggtgaatggctgtaagctggctaacagaggtgctgagctactcgtgctgctggtgaatcacgggcagggaatcgaggtgcaggtgcggggtctggaaacggagaaaattaagtgttgtttactcctggactctgtatgctccacaatcgagaatgttatggccactacactgcctgggctgctaaccgtgaaacactatttgagcccgcagcagctgagggaacaccatgagcccgtaatgatctatcaacccagggacttttttagagcacaaactctgaaggaaacatctctgacgaatactatgggagggtataaggagtcattctcctccattatgtgcttcggttgccacgacgtttattcacaggctagtttgggaatggacatccacgcatccgacctcaatctcctaacacggcggaagctttcgcgactactggatcctccagatcccttgggcaaggactggtgcctgctagccatgaacctgggccttcccgacctagttgctaagtacaatacttccaacggcgcgcctaaagacttcctcccttccccgttgcatgccctgctgcgtgagtggactacatatcctgaatcaacagttgggactctcatgtctaagttaagggagctaggcagaagagatgccgctgattttctgctcaaggcatcgtccgtgttcaagatcaacttagacggtaacgggcaggaggcgtatgctagtagctgcaattccgggacctcttacaatagtatttcttctgttgtctcccggtag

SEQ ID NO: 23827 - DNA, 4368 bp, Artificial Sequence
  Description of Artificial Sequence: Synthetic coding sequence
atgaccgtgttccggcaggagaacgtggacgactactacgacaccggtgaggagcttggttcaggccagtttgcggtggttaagaaatgtagggagaagtcgacgggattgcagtatgcagcaaagttcatcaaaaaaaggagaaccaaatccagcaggagaggggtgtcacgcgaggatatagagagggaggtgtctatactgaaggaaattcagcaccctaatgtcatcacactgcatgaagtgtatgagaacaagacagacgtgattttaattcttgaattagtggctggaggggaactgttcgattttcttgccgaaaaggaatctctgaccgaggaagaagcaacggagttcctgaaacagattctcaacggagtgtattatctgcattccctgcagattgcacactttgaccttaagccggagaatatcatgctcctggaccgaaacgtgcccaaaccacgaattaaaatcatagattttggcttggcccacaaaattgattttggcaatgaatttaagaatatatttggaaccccagagttcgtggcaccggagatagtgaattatgagcccctgggcctcgaggcagacatgtggtccattggtgtgatcacctacattctcctctcgggcgcttcgcccttcctgggcgatactaaacaggagacgctcgccaatgtatctgccgtgaactatgaatttgaagatgaatatttctcgaacacttctgcattagctaaagatttcatcaggagattgctggtgaaggatcccaagaaacggatgactatccaagattccttgcaacacccctggattaaacctaaagacactcagcaagcactctccaggaaagcatccgccgtcaacatggagaaatttaagaaattcgctgcaagaaagaagtggaagcagagtgtcagactcatctctttatgccagcgcttatccagatcatttctttcaaggtccaatatgtcagttgccaggtctgatgacaccctggatgaagaggatagctttgtcatgaaggctattattcatgccattaatgacgacaacgtgccgggcttgcagcatctgcttggtagcctcagtaattacgatgtgaaccagcctaacaaacatggcacacctcccctgctgattgcggcaggttgcggaaatattcagatcctgcagctgctcatcaagagagggagcagaatcgatgttcaagacaaagggggctctaacgccgtttactgggccgcacggcatggccacgtggatacacttaagttcctgtctgaaaataagtgtcccttagacgtgaaggataagtcgggggagatggctctgcacgtggctgcccgttacggccacgctgatgtggcacagctgttgtgtagttttggctccaaccctaatatacaggacaaagaagaggagacccccttgcactgcgctgcttggcatggctactattccgtggcgaaagctctatgtgaggcaggatgtaacgtaaatattaaaaatagggagggggagacccccctgctcacagcgtctgcgcggggttaccatgatattgtcgagtgtttggcagaacacggcgccgatttgaacgcctgcgataaggatgggcacatcgctctccatctcgcggtgagaagatgtcaaatggaggtgattaagacattgctgagccaggggtgcttcgtggattaccaggacagacacggaaacacaccgctacatgtcgcctgtaaggacggtaatatgccaatcgtggtggcactatgtgaagctaactgtaatctcgatattagcaacaagtacgggcggacgccactgcatcttgccgctaataacggaattctggacgtggtgagatacctctgtctgatgggtgcctcagtcgaagcccttactacagacggaaagacggctgaagatctcgcgaggtccgagcaacacgagcacgtcgccgggttgcttgccagacttcgcaaggacacacaccggggactgtttatccaacaacttcggcctacccagaacctgcaaccgaggataaaactgaaactctttggtcactctggttccggtaagacaaccctcgtcgagagtctcaaatgtggtctccttaggagcttcttccgacggcggagaccccgactgagttcgacaaatagtagcagatttcctccatctcctctggcatcaaagcccacagttagtgtctcaatcaataatctctacccagggtgtgaaaacgtcagcgtccgttcacggtccatgatgtttgagcctggcctaaccaaggggatgctcgaagtgtttgtggcaccaacccatcatccccactgttccgcggacgatcaaagcaccaaggccatcgacattcaaaatgcttatttgaacggagtgggagatttcagcgtttgggagttctccgggaaccccgtgtatttctgttgttacgactactttgccgctaatgatcctacctccatacatgtcgtggtgtttagtttggaggaaccctatgaaattcagctgaaccaagtgattttttggctttcttttctaaagtcactggtaccagtcgaagaacccatagccttcggcggcaagctgaaaaatccgctgcaggtggttctcgtcgctacccatgccgacattatgaatgtacccaggcctgccgggggcgagttcggctatgacaaagatacgtcactgttgaaggaaattagaaatcgcttcggcaacgatctccatattagcaataagctctttgttttagacgcaggagcgtctggctctaaagacatgaaagtcctcaggaatcacttgcaggagattcgatcgcaaatcgtgtctaagactctacccttcacacctgacattctggtaggagtgccactgtggcatcaccagaagatcggtggctctcccgtatgtcctcctatgacgcatttatgcgagaagatcatcagcaccctgccaagctggagaaaattgaatgggcctaatcaattgatgagcctgcaacagttcgtgtacgatgtgcaagatcagttaaaccctctggcatccgaagaggaccttcgtcgtattgcacaacagttacattcgactggagagataaacatcatgcagtcagaaaccgtacaggacgtacttctattggatccaagatggttgtgcactaacgtccttgggaagttactgtctgtggagacaccacgagccctccaccattatcggggccgatataccgtggaggatatccagcggctggtgcccgactctgacgtggaagagctcttgcagatcctcgatgccatggacatctgtgcacgcgacctttcttccggcacgatggtggacgttcctgctctgatcaaaaccgacaacctacatcggtcatgggccgacgaggaggacgaggttatggtgtacggcggcgtccgcatcgtgcccgtcgagcacttgaccccttttccctgtggaattttccataaagtacaggttaatctgtgcaggtggattcaccaacagagcaccgaaggcgatgccgatatcaggctctgggttaacgggtgtaaactggcgaatagaggcgccgaactgcttgtcttactggtgaaccacggacagggtattgaagtccaagtgcgcggtttggaaactgaaaaaattaagtgttgcttgttactagattctgtgtgtagcacaatagaaaacgtcatggccactacccttcccggcttacttaccgtaaagcattatttatccccccagcaattgcgcgaacaccacgaaccggtgatgatctatcagcctcgtgattttttcagagcacaaacactgaaagaaacgtcactgaccaataccatgggcggctataaggaaagcttctcatctattatgtgttttgggtgtcacgacgtgtactcccaggcctctcttggcatggacatccatgccagcgacctgaaccttcttacccggcggaagctgagtaggctgctggacccgcctgacccgctcggcaaagactggtgcctgctagcgatgaacctggggcttcccgatctcgtggctaagtacaacacaagtaacggtgctccaaaggactttctgcccagtccattacatgctttgttacgtgagtggacgacctaccccgaaagtaccgtaggtaccctcatgagcaaacttcgcgaactgggacggcgcgacgcggcggactttctcctcaaggccagctctgtgtttaaaattaatctggacgggaatggacaggaagcatacgctagtagttgcaactcaggcacttcctacaatagcataagctccgttgtgtcccgctag

SEQ ID NO: 23828 - DNA, 4293 bp, Artificial Sequence
  Description of Artificial Sequence: Synthetic coding sequence
atgaccgtgttccggcaggagaacgtggacgactactacgacaccggtgaggagctggggtctggccaattcgcagttgttaagaagtgcagagagaagagcaccgggttgcagtatgccgcgaagttcatcaaaaagcggcgtacaaagagctctcggaggggggtctcccgggaggatattgaacgagaagtgagcatcctgaaagagattcaacaccccaacgttatcactcttcacgaggtgtatgaaaataaaacagatgttatactgatccttgagctcgtcgcaggcggagaactgttcgacttcctggcagaaaaggagagcctgaccgaggaggaggccacagaattcctgaagcagatcttgaacggagtttactacctacattctctgcagatcgcccattttgacctgaaacctgagaacatcatgctgcttgaccgcaatgtgcctaagcctcggattaaaattatcgacttcggcctagcccacaagatagacttcgggaacgaatttaagaacatctttggcacaccagaatttgtcgcgcctgagattgttaattatgagccacttggactggaggccgatatgtggtcgattggcgtgattacttacattctgttgtccggggcatctccctttctgggagatactaagcaggagactttggcaaacgtctctgccgtcaactacgagtttgaagacgagtatttctcgaacacctccgctctggccaaggatttcattaggaggctgctcgtgaaagatcctaagaagcgcatgaccatccaagatagcctgcagcatccttggattaaaccgaaagacacccaacaggccctgagtcgaaaagcctccgccgtcaatatggagaagttcaagaaatttgcagctaggaagaagtggaagcagtcagtcagattaatttctctgtgtcagcgtctgagtaggtcatttctatcaaggagtaatatgtcagtcgctagaagcgatgatacccttgatgaggaggattcctttgtgatgaaagccattattcacgctattaatgacgataacgttccggggctgcagcacttattggggtcgttgtcaaactacgacgtgaatcagccaaacaagcatggcacccctccactgcttatcgcagccgggtgcggcaacattcaaatccttcaactgctcattaagaggggatccagaatcgatgtgcaggacaaagggggcagcaacgcggtgtactgggctgcccggcacgggcatgtcgacactctcaaattcttgagtgagaataaatgccctctcgatgtgaaggataaatccggagagatggccctgcatgtggctgcaagatatggccatgccgacgtagctcaactgctctgctcctttggatccaacccaaacatacaggataaagaggaggaaacccccctgcactgcgcagcgtggcatggttactattccgtggctaaagcgttgtgcgaggccggatgcaatgtaaatatcaaaaatcgcgaaggcgagacccccctactgacggccagcgcaagggggtaccatgatatcgtagaatgcttagccgagcatggggctgatcttaatgcatgtgataaagacggacacatagctctgcatctcgcagtgagaagatgccagatggaagttattaaaactctgttatcccagggttgtttcgtcgattaccaggatcggcatggaaacaccccattacacgttgcgtgtaaggatggaaacatgcctattgtggtggcactgtgcgaggccaattgcaacttggatatctcaaataagtatgggcgaacacctctacatctcgccgctaataacggtatccttgatgttgtgcgttacctctgtttgatgggcgcctctgtggaggcactgactaccgatggtaagactgctgaagatctcgctagaagtgagcagcatgagcatgttgccggacttttggctcgtctgcgaaaggacactcatcgcgggctgtttattcagcagctacgtccaacacagaacctgcagcctcgaatcaagctgaaactgttcggtcacagtggtagtggaaaaaccacacttgtggaatctcttaaatgcggtctgctgcgtagttttttcaggcgccgcagaccacgactgtcctccacaaactccagtaggttccctcctagcccattggcctccaagcctacagtgagcgtgtcgatcaacaacttgtaccccggctgtgagaacgtcagcgtccggtccaggtccatgatgttcgagcccgggttaactaaagggatgctggaggtatttgttgctcccacacaccatccacactgctctgccgatgaccagtctacaaaagcaatcgacattcaaaacgcgtatctgaacggcgtaggggactttagcgtttgggaattttctggcaacccggtttacttttgttgctacgattatttcgcagccaatgaccctacctcaatacacgttgtcgtcttctcactcgaagaaccttatgagatacagctgaatcaggtgattttttggctttcgttcttaaagtccctagtgcccgttgaggaacctatcgcctttggaggtaagctcaaaaatcccctgcaagtggtcttggtcgcaacgcatgcggacatcatgaacgtgcctcgcccagctggaggtgaattcggatacgataaagacacctctttattgaaagagatccgcaacagatttggcaatgatcttcacatctcaaacaaattgttcgttctggatgccggcgcgtcagggtcgaaggatatgaaggtgttgcgaaatcatctgcaagaaatcaggagccagatcgtctcagtgtgtccaccgatgacgcacctctgtgaaaaaattatctccaccctgccgagctggcgtaagttaaacggccctaatcagctcatgtctctgcagcaatttgtgtacgacgtgcaagaccaacttaatcctctggcatcagaagaggatctgagacgcatcgcgcagcagcttcactcaaccggcgaaatcaatatcatgcaatctgaaaccgtccaggacgtgttgctgctggatcctcgatggctgtgtaccaatgtgctgggtaagctgcttagcgtggagactccaagagctttgcaccactatcggggccgatacacggtggaagacatccagagacttgttccggattctgatgtggaagagcttctgcagatcctggacgctatggatatatgcgccagagatctgtcatctggaacaatggtggacgttcctgccctaataaaaacggataacctccaccggtcgtgggcagacgaggaggatgaagttatggtgtacggcggcgtgcggattgtgccagtagagcaccttacaccgttcccctgcggcatttttcacaaagttcaagttaacctgtgtcgctggattcaccagcagagcaccgaaggcgacgccgacattagactgtgggtcaatggctgcaagctggcaaaccgcggagctgagctcttagttcttctcgtgaaccatggtcaaggcattgaggtacaggtccgcggcctggagaccgaaaagatcaaatgctgtctcttgctcgacagcgtgtgcagtactattgaaaacgtaatggccaccacgctgcctggactgctgaccgtcaaacactacctgagtccacagcagctcagagaacatcatgagcccgtcatgatttaccagcctcgcgacttcttccgcgcacagacgctgaaagagacctcattaacaaacacaatgggaggatataaagaatccttcagttctatcatgtgcttcggctgtcacgacgtctactctcaggcctctctcggcatggatatccacgccagtgacctaaatctactgactagacgaaaacttagcagactgctggacccgcccgacccgctgggaaaagactggtgtctgctggctatgaatctcggcttgccggacttggtagctaaatataacacttctaatggtgcccccaaggatttcctgccctcaccccttcatgctttacttagggagtggacaacatacccagaaagcacggtgggaaccctgatgtccaagctgagagagttaggtaggcgggacgctgcagatttcttactgaaagcttcctcggtgttcaagatcaatctggatggaaatggtcaggaggcgtacgcgtcgtcatgcaactctggcacctcctataactcgatctctagtgtggtttcaagatag

SEQ ID NO: 23829 - DNA, 4095 bp, Artificial Sequence
  Description of Artificial Sequence: Synthetic coding sequence
atgaccgtgttccggcaggagaacgtggacgactactacgacaccggggaggaactcggatctgggcagtttgcagtggtgaagaagtgcagagagaagtccacagggttacagtatgcggcaaagttcatcaaaaaaaggcggacgaaaagctcacgccggggtgttagccgtgaggatatcgaaagggaggtgagcattttaaaagagatccagcaccccaacgtaatcacccttcacgaggtatatgagaataaaacagatgtgatcctgattctggagttggtcgctgggggtgagctgttcgattttctggcagagaaagaaagcttgacggaggaagaggccaccgagtttctgaagcaaattctcaatggagtatattatctgcacagcctccagattgcacacttcgacctaaagcccgaaaatatcatgcttctagacaggaacgtccctaaacctaggattaagatcatcgacttcggcctggcacacaaaatcgatttcgggaacgagttcaagaatatctttggcactcccgaattcgtggcaccagagattgtgaactacgagcctctgggtttggaggccgacatgtggtcaattggcgtgattacatatattctcctctctggcgcatctccattcctgggggatacaaagcaagagaccctggcgaacgtctcagcagtgaactatgagtttgaggacgagtacttttcaaatacgtctgcactggccaaagatttcatcaggagactgctcgtgaaggatcccaagaagcgtatgaccatccaggactctctgcagcacccatggattaagcccaaggacactcaacaggcgctttcccgcaaagcctccgctgtcaacatggagaagttcaagaagtttgctgctaggaagaagtggaagcaatcagttcgacttattagcctgtgtcagagactgagcagaagctttctctcacggtccaatatgtccgtcgctcgcagcgacgacacacttgacgaggaagattcttttgtgatgaaagctatcattcacgccataaacgatgacaatgttcctggcttgcagcatctcctgggtagcctgtccaactatgacgttaatcagccgaacaagcatggaacaccaccgctcctcattgcagctgggtgcggcaatatacagatattgcagctcctcataaaaaggggaagccgaatcgatgtgcaggataaaggaggcagtaatgcagtctactgggccgctaggcatggacatgtcgatactctcaagttcctctccgagaataaatgcccattggatgtcaaagataaaagcggcgaaatggccctgcacgtggcagctcgctatggtcacgcagacgtggctcagctactatgcagctttggctctaacccaaatatccaggacaaagaggaggagactcccctccactgcgcagcttggcacggctactatagcgtagccaaggctttgtgcgaggctggctgcaatgtcaacatcaaaaacagagagggcgagacacccttgctcactgcttctgccagaggctaccacgatatcgtcgaatgcttggccgaacacggggctgacctgaatgcctgtgacaaagatggccacatcgcactgcatctcgccgtccgacgctgtcagatggaagtgatcaagacgttactgagtcaagggtgctttgtggattatcaggacaggcacggcaacactcccctccacgttgcatgcaaagatggcaacatgcccatcgtcgtggcactctgtgaagcaaattgcaacctcgatattagtaataagtacgggcgcacacctctccacttggccgccaacaacggcatcctggacgtggtacgctatctgtgtcttatgggtgcatcggtcgaggcactcaccactgatgggaaaaccgcagaggatttggcccggtcagagcagcatgaacacgtggcagggcttctagcgaggctccggaaggatacccatcgcggacttttcattcagcagctgcgaccgacccaaaatctgcagcctcgaataaagctgaaattgtttggtcactcaggaagtgggaagacaacattggtggaatctctcaaatgcggcctcctgcggtcgtttttccgccgacgtcggccccgcctctctagcaccaactcctcaagattccctccgagccctcttgcctctaaaccgactgtgtcagtaagtattaacaacctgtacccaggctgtgagaacgtatccgtgaggtcgaggtccatgatgtttgagcccgggctgacgaagggaatgctggaggttttcgttgcacctacccaccatccacactgttcagccgacgaccagtcgacaaaagccatagatatccaaaatgcctatttgaatgccttcgggggaaaactcaaaaacccactgcaggtggtactggtggctactcacgccgacataatgaatgttccgaggcctgccggcggggagttcgggtacgacaaggacaccagtctgctgaaggagatccggaatagattcggcaacgaccttcatataagcaacaagctctttgtgctcgatgcgggcgccagcggctcaaaggatatgaaagtgctcaggaaccacctgcaggagatacggtctcagatagttagcgtttgtccccctatgactcatctgtgtgagaaaatcattagtactcttcccagttggcggaaactaaatggtcccaatcaactcatgtccctccaacagtttgtttacgacgtgcaggatcagctcaacccgctggccagcgaggaagacctgagaagaatagcccagcagctgcactctacaggggaaattaacatcatgcagtccgaaaccgtgcaggatgtcctgctgctggaccctaggtggctctgcacgaacgtcctgggtaagcttctctctgtcgagacccccagggcacttcaccactatagaggacgatacacagtggaggatattcagcgcctggtgccagacagcgacgtggaggaactgctgcaaatcttagacgcgatggatatttgtgcccgggatctgtcttctggtacaatggtggatgtcccagccctcattaagaccgataatctgcatcgatcatgggcagatgaagaggacgaggttatggtgtatggcggtgttcggattgtacctgtggagcacttgaccccctttccttgcggcattttccacaaggtccaagtgaatttgtgtcgttggattcaccagcagtctacggagggggacgccgatattcgcctgtgggtcaacggctgcaagcttgccaaccgaggcgctgaactattagtgttgctggtcaaccacggacagggtattgaagttcaggtgcgaggcttggaaaccgaaaagataaagtgttgtctactgctggattccgtgtgtagcaccattgagaacgtgatggccaccacactgccaggtcttctgactgttaagcactatctgagcccccagcaactgagagagcatcacgaacccgtgatgatttaccagccccgggattttttcagagcccagaccctgaaggaaacgagcctgaccaacaccatgggaggatacaaggagagcttttcttccattatgtgctttgggtgtcatgacgtctacagccaagcttcactgggcatggatattcacgcatccgacctcaaccttttgacccgcagaaagctgtctcggctgttagatcctcccgatccgctggggaaggactggtgtctattggccatgaatttaggtctcccggacctagtggctaaatacaatacttccaacggcgctcctaaagatttcctgccatccccgttgcacgctttgctccgtgagtggaccacctatccggagagcacggtgggaacactaatgagcaaactaagagaactgggccggcgagacgcagcggacttcctccttaaggcctcatctgtgtttaagatcaacttggacggaaatggacaagaagcctacgcctctagctgcaattccgggacatcatacaactctatttcctcggtggtatctcgctag

SEQ ID NO: 23830 - DNA, 2223 bp, Artificial Sequence
  Description of Artificial Sequence: Synthetic coding sequence
atggccaccgccaacagcatcatcgtgctggacgacgacgacgaggatgaagctgccgcgcagccgggcccttcgcacccgcttccaaacgccgccagccccggagccgaggcaccttctagttcggagccacacggcgctagagggtcctcgtcctcaggcgggaagaaatgctataagctggagaacgagaagttgttcgaggagttcctggaactgtgcaaaatgcagactgcagatcaccctgaggttgtaccatttctgtataaccggcagcagcgggcccactctctgttcttggcaagcgctgagttttgcaacattctgagcagggtgctatcccgcgccaggtctcgccccgctaagctttacgtctacatcaacgaactgtgtacggtgctcaaggcccactctgcaaagaagaagctcaatctggccccagccgccaccacaagtaatgagccatctgggaacaacccccccacccatctgagcctcgaccctaccaatgctgagaacactgccagccagagccctcgcaccagaggctctcgtcgccaaatacaacgccttgagcagctcctggccctctacgtggcagaaattcgcagactgcaggagaaggagctggatctgagtgagctcgatgatcccgatagcgcttatctgcaggaggcgcggctcaaacgaaagttgattcgcctctttgggcggctatgtgagctcaaagattgctcttctctcacaggcagggttatcgaacaacggatcccatacaggggtacgcggtaccccgaagtgaacaggcgtatcgaaagactcatcaacaaacctggtccagacaccttcccagattacggtgatgtccttcgagccgtggagaaggccgcagcccggcactcgctaggtctgccacgtcagcagttacagctcatggcacaagacgcttttagagatgtaggaatcagacttcaggagaggagacacctggatttaatttataatttcggatgtcacctaacagacgattatcggcctggcgtcgacccggcgctgtctgacccggtcctggcccgacgcctcagggagaataggagcctcgctatgagtcggctggacgaagtcataagcaagtacgccatgctccaggataagagtgaagaaggtgagcgcaaaaagcggagagccagactccagggcacctcctcccactctgctgatacacctgaagcgtccctggactccggtgaggggcccagcggcatggcttctcaaggctgtccttctgcatcacgcgcggagacggatgacgaggacgatgaggaatccgatgaagaggaggaggaggaggaagaagaggaggaggaagaggcaaccgactccgaggaggaggaagacctggagcagatgcaggaaggacaagaagacgacgaggaggaggacgaagaggaggaagccgcggctgggaaggatggggacaaatctcctatgagttctctgcaaatcagcaatgaaaaaaatctggaaccaggaaagcaaatcagtcggagctcgggggaacaacagaataaaggccgcatagtctctccttcgctgctgagtgaggaacctcttgctccttcgagtatcgacgctgagagtaatggggagcagcctgaagagctgacgctggaggaggagtctccagtgtcacagctgttcgagctggagatcgaagctctcccattagatactccgagctctgtcgaaaccgatatcagttcttcgagaaaacagtctgaagagccgttcaccaccgttttagaaaacggcgccggcatggtgtcttctacatcgttcaacggaggcgtaagcccccacaactggggagatagcgggcccccatgtaaaaaatcccgtaaagagaaaaaacaaaccggcagcggacctttgggcaattcctacgtcgagagacagaggtccgttcacgagaagaatggcaaaaagatctgcaccctccccagcccaccgagtcctctggcctcactggcaccagtggcagactcaagcactagagtcgatagcccttcacacgggttagtgacctcaagcctgtgtattccctccccagcccgcctgagtcaaacccctcactcacagccccctagacccggcacatgtaaaactagcgtagccactcagtgcgaccccgaggagatcatcgtgctgtccgatagcgattag

SEQ ID NO: 23831 - DNA, 2223 bp, Artificial Sequence
  Description of Artificial Sequence: Synthetic coding sequence
atggccaccgccaacagcatcatcgtgctggacgacgacgacgaggacgaagccgctgctcaacccggcccttctcaccccctacctaatgctgcttctcctggtgctgaggcaccttcatcctcagaaccacacggggccaggggatcatctagctctggcgggaagaagtgctacaaattagaaaatgagaagctgtttgaggagtttctggagctttgtaagatgcagactgcggaccacccagaggttgtgcccttcttgtacaataggcaacagcgggcgcactccttatttctggcctccgccgaattctgcaatatcctatcccgcgtgctatccagagccagaagcaggccagcaaagttgtatgtgtatattaacgaactctgcacggtattgaaggctcacagcgctaagaagaagcttaatctggccccagccgctactacctctaatgagccaagtggtaacaatccccccacccatttaagcctggatcctacaaacgccgagaatactgcctcacagtcccctcggacacggggctccaggcgccagattcagcgactggaacagcttctggcactctatgtggccgagattcggcggcttcaggaaaaggaactggatttgtctgaactggacgacccagactccgcataccttcaggaagctcgattgaagaggaaactgatcagactgtttggccggctgtgcgagctaaaggattgtagtagtctgactggacgcgtgattgagcaaaggatcccataccgagggacgagatatcctgaggttaaccgcagaatagagcggctgatcaataaacccggaccggacacgttcccagactatggcgacgtgctccgcgctgtcgagaaggccgctgcaagacactccctaggcctgccgagacagcagctgcagctaatggcccaggacgcattccgagatgtagggattagattgcaagaacgaagacacctggatttgatctataactttgggtgtcacttgactgatgattaccgaccgggcgttgaccctgctctctccgacccagtcctagcgcggaggttgcgagagaatagatccctggctatgagtcgtttagacgaggtcatatccaaatatgctatgctgcaggacaagtctgaggaaggggaacggaagaaacggagggccaggctgcagggcacttcttctcactcggcagacacccccgaggcgagtctggactcgggagaaggtccctctgggatggcttctcaggggtgtcctagcgccagccgggcagaaacggacgatgaggatgacgaagagtcggacgaagaagaggaagaggaagaggaggaagaagaggaggaagcaactgactctgaggaagaagaggacttggagcaaatgcaggaaggtcaagaagacgatgaggaagaggatgaggaggaggaggccgctgcaggcaaggacggcgataaatcgccgatgtcttcgcttcagatctcgaatgaaaaaaatctagaaccagggaagcagatttcaaggtcatccggtgagcagcagaataaaggacggatcgtcagcccctctctactcagtgaggagcccctcgccccgagcagcatcgatgccgaaagtaacggtgaacagcctgaagagctaacactcgaagaagaatctcctgtaagtcagctgttcgaacttgaaatcgaagccctgccgctagacactcctagcagcgtcgaaacagatatcagctcatctagaaaacaaagcgaagagccgttcactactgtgctggagaacggagccgggatggtgtctagcacctcattcaacggtggtgtttctccccacaattggggcgatagtggcccaccatgtaaaaagagccggaaagagaaaaaacagaccgggagcggcccccttgggaactcatacgtagagcgccagcggtccgttcacgaaaagaacggaaaaaagatatgtacgctgccttcgcctccgtcccctcttgcctccctagcccccgtggccgattcatctacacgggtggactccccttcccacggcttagtgacgagcagtctgtgcattcccagcccggcgcgcctttctcagaccccacactcccaaccgccacgacctggaacatgcaagaccagcgtcgctactcagtgtgaccctgaagagattatagtgctgtctgattcggattag

SEQ ID NO: 23832 - DNA, 1998 bp, Artificial Sequence
  Description of Artificial Sequence: Synthetic coding sequence
atgcagaccgccgaccaccccgaggtggtgcccttcctgtacaaccgtcagcaaagagcacatagtctgttcctggcaagtgccgaattttgcaacattctgtcccgagtgctaagcagggctaggtctcggcccgccaagctctacgtctatatcaacgaactctgtacggtgctcaaggcccatagcgccaagaaaaaacttaatctggcccctgcggctaccacaagtaacgagccctctggcaataaccctccaacacatctatcactggacccaactaacgcagaaaacactgcctcgcagtccccaagaacacgagggtctcggcgacaaatacagagactggagcagttattggctttgtatgtggccgaaatccgacgactacaggagaaggagttagacctttccgagttagacgaccccgattctgcctatctgcaggaagcacgattgaaaagaaaactgatcaggctgtttgggaggctatgcgagcttaaggattgttcctcgttaactgggagagtcatcgaacagagaattccctataggggcacaaggtaccccgaggtgaatcgcagaatcgagcggctgattaataagcccggccctgatacatttcccgattatggcgatgttttgcgcgcagtggagaaggccgcagctagacactcccttggcttgccacgtcaacagttgcaactgatggcccaagatgcctttcgcgacgtgggcatccgccttcaagaacgtcgacatctcgatcttatctacaacttcggatgccaccttacagatgactatcgtcctggcgtggatcctgcactttctgaccccgttctggcgcgtaggctacgggaaaataggtccctggccatgtctcgactcgacgaggttatttccaagtacgccatgctgcaggataaatcagaagaaggggagcgcaaaaaacgacgggctcgcctgcaagggacaagttctcattccgcagatacgcctgaagcttccttggactccggggagggaccatccggcatggcctctcaaggctgtccaagcgccagtcgagctgaaaccgatgacgaagacgacgaagaaagtgatgaggaggaggaggaagaggaagaggaggaggaagaggaagccaccgactctgaagaagaagaagatttagaacagatgcaagagggccaagaggatgatgaggaggaggacgaggaggaggaggccgctgccggcaaagacggggataaatcacctatgtcctcactgcaaatcagcaatgaaaaaaacttggaaccaggaaagcaaatatctaggtctagtggggagcagcagaataagggacggatagttagcccaagtcttttgtccgaggagccactggccccgtccagtattgacgccgagagcaatggggaacagcccgaggagctcacccttgaagaggagtccccggtgtcgcaactgttcgaacttgagatagaggccttgcccctggatactcccagcagtgtcgagaccgacatatcctccagtaggaaacaatccgaggagccctttacaaccgtgctcgagaatggggcgggcatggtttcttctacctctttcaacggcggggtgagtccacacaactggggtgacagcgggccaccttgtaaaaaaagccggaaggagaagaagcaaactggaagcggccctttaggcaactcatatgtggagcgtcagagatccgtccatgaaaaaaacggcaagaaaatctgcaccctcccctccccacccagccctctcgcctctctggcacccgtcgctgatagcagcacccgggtggatagcccatcacacggtctggtcacatcatctttatgcattccctcgcctgccaggctatcacagactcctcactcccagccgccccgcccgggcacctgcaagacatccgtcgcaacacaatgcgacccagaggagattatcgtactgagcgactctgactag

SEQ ID NO: 23833 - DNA, 537 bp, Artificial Sequence
  Description of Artificial Sequence: Synthetic coding sequence
atggccaccgccaacagcatcatcgtgctggacgacgacgacgaggatgaagctgcagcccagcctgggccaagccatcctctgcctaacgcagcctcacctggtgccgaggccccgtccagcagcgagcctcacggggctcgcggatcaagtagctctgggggcaaaaaatgttataaactggagaacgaaaaactcttcgaggagttcctggagttgtgtaaaatgcaaaccgcagatcacccagaggtggtcccattcctgtacaaccggcagcagcgggctcattctctattcctggcctctgcagagttttgtaacatcctcagtagggttctgagccgcgcccggtcccggcccgctaaattgtacgtgtacatcaatgaattatgcacagtgctgaaagcccactccgccaagaagaaactcaatctcgccccagcggctaccacttccaatgagccctcaggaaacaatccaccgactcatctgtccctggacccaacgaatgcagaaaacacagcgagccaatcgtag

SEQ ID NO: 23834 - DNA, 147 bp, Artificial Sequence
  Description of Artificial Sequence: Synthetic coding sequence
atggccaccgccaacagcatcatcgtgctggacgacgacgacgaggacgaagcagctgcccagcctggacccagccaccccctccccaacgccgctagccccggcgccgaagctccctcttcttctgagccccacggagcaagatag

SEQ ID NO: 23835 - DNA, 393 bp, Artificial Sequence
  Description of Artificial Sequence: Synthetic coding sequence
atggccaccgccaacagcatcatcgtgctggacgacgacgacgaggacgaggctgccgctcaaccaggcccctctcacccgcttcccaacgcagcctcgcccggagccgaagccccgtcgagttctgaaccccacggggcccggggatcttcctcaagtggaggaaaaaaatgctacaaacttgaaaacgagaagctgtttgaagaattccttgagctatgcaaaatgcagacagccgaccaccccgaggtggtgcctttcctgtacaaccgccagcaacgtgcccactctctatttctggcctccgccgaattttgcaatattctgagtagagtcctgtctcgcgcacgcagccgtccagccaagttgtatgtgtatatcaatgaactttag

SEQ ID NO: 23836 - DNA, 2316 bp, Artificial Sequence
  Description of Artificial Sequence: Synthetic coding sequence
ggcgtgcccgtgatcaagtggaagaaggacggcatccacctggccctgggcatggatgagcgcaagcaacagctctctaacggcagcctgctcatacaaaatatattacactcgcgccaccataaacccgacgagggtctctatcagtgtgaagcttccttgggagactctggatctatcatcagccgaaccgccaaggtggcggtggccggccccttgaggtttctatcacagacagagagcgtgactgccttcatgggagacaccgtactcttgaagtgtgaggttatcggcgagcctatgccgactattcactggcagaagaaccagcaagacttgacacctattcctggagatagtcgcgttgtggtccttccttccggcgcccttcagatttctcgcttgcaacctggagacattggcatttatcggtgcagcgcccgcaatcctgcttcttcaagaacggggaatgaggccgaggtgcggatattgtctgatccaggtctgcataggcagctgtactttctgcaacgcccatctaatgttgtggctatagaggggaaggacgcagtgttggaatgctgcgttagcgggtatccccctcccagcttcacgtggctgcgcggtgaagaggtaattcagctcagaagcaagaaatacagcctcctgggaggctcaaacctgctcatttccaacgtgacagatgacgattccggcatgtacacatgtgtggttacctacaaaaacgagaatatatccgcttctgccgagctgaccgttttggtgccaccttggtttctcaatcaccccagcaacttatatgcctacgaatctatggatatcgaattcgagtgcactgtgagtggcaagcccgtgcccacagtaaattggatgaagaatggcgacgtcgtaatccctagtgactattttcagatcgtcggtggctccaatctacgcattctgggagttgtgaaatccgacgagggattctaccagtgtgtcgcggaaaatgaggccggcaacgcacagaccagtgctcagctcattgtgccaaagcctgcgatcccctcctcttccgtcttgccgagcgccccccgtgacgtcgtgcccgtgctggtctcgtcccggtttgtcaggctcagttggcggccgccggcggaagccaaaggcaatatccaaaccttcactgtatttttttctagggaaggtgacaacagagagcgcgcgctcaatacgacacagccgggcagcctgcagctgaccgtgggcaacttaaagccggaggcgatgtacaccttccgcgtggtcgcttacaacgaatgggggcccggagagtcatctcagcctattaaggtggccacccagcctgaactgcaagtgcctggacccgtagagaatctgcaggccgtgtctaccagcccgacttcaattttgatcacttgggaaccccccgcctacgccaacggccccgtacagggctaccgactgttctgcactgaggtctcaactggcaaagagcagaacatcgaagtggatggactgagttacaaactggagggcctgaaaaagtttacggagtacagcctgcggtttctggcatacaatagatacgggcccggcgttagtaccgatgacatcaccgtggttacactcagcgatgtccccagcgctccacctcagaatgtctcgcttgaggtggtcaactcccggagcataaaagtgtcttggctgcctcctcccagtgggacgcagaatgggtttattacagggtataagatccgccacaggaagacaacacgccgcggtgaaatggaaacattggaacctaacaacctgtggtacttgttcaccggactcgagaagggatcacagtacagtttccaggttagcgccatgactgtcaacggaacagggccgccctctaactggtacacagcggagacgcccgagaatgacttagatgaaagccaggtgccagatcagccatctagtctgcacgtgcgccctcagacgaattgtattattatgagctggaccccccccttgaacccaaacattgtggtgaggggctacattatcgggtacggggtcggctctccatacgctgaaaccgtgcgtgtggatagtaagcagcggtattacagtatcgagcgcctcgagtcttcgtcccattacgtaattagcttgaaagcttttaacaacgctggtgagggcgtcccactatacgagagcgcaactaccagaagcattacggtcaggcgtcataacatctctaagctgcacagcaaccggccccaaactaagcacaacgtctag

SEQ ID NO: 23837 - DNA, 2694 bp, Artificial Sequence
  Description of Artificial Sequence: Synthetic coding sequence
atgggcgacaccgtgctgctgaagtgcgaggtgatcggcgagcccatgccaaccattcattggcagaagaatcagcaggacctgactccaatccccggcgacagcagagtggtcgtgttgccatccggggctctgcagattagtcggctgcagcctggtgatattggcatttatagatgtagtgcacggaatccggcctcttcacgtacgggaaatgaagcggaggtgagaatcctgtctgatccagggctccacagacagctttattttttgcagaggccaagcaatgtcgtggccatagagggcaaagacgccgtactagagtgttgtgtgtccggataccccccaccctcatttacttggctgcgaggtgaggaggtaatccaactgagatccaaaaagtattccttgctcggaggttccaatctgctcatttccaacgtgaccgacgatgattcagggatgtatacttgtgttgtaacatacaagaatgagaacatctcagcttcagctgaattgactgtacttgtcccaccctggtttctaaaccaccccagtaatctgtatgcttatgagtcaatggacattgagttcgagtgcacagtttccggaaaaccagtgcccacagtgaactggatgaagaatggtgatgtcgtgattccttctgactacttccagatcgtggggggatccaatctcaggatccttggtgtagttaagtccgatgagggattctaccagtgcgtcgcggagaacgaagccggcaatgctcagacatctgctcagctcatcgttccgaagcccgcaattccttccagctccgtgctgccaagcgcaccgagagatgttgtccccgtcttagtcagctcccgcttcgttaggctgagctggcgtccccccgccgaagccaagggaaacatccagacctttactgtgttttttagcagggaaggagacaatagagagcgggctcttaatacgacacagccaggcagcttgcagctgactgtcgggaacctgaaaccagaggccatgtacaccttccgggtggtagcctataacgaatggggccccggcgagtcgagccagcccataaaggtggctactcagccagagctgcaggtgccagggcctgtagagaaccttcaggcagtgtccaccagcccaactagcattctgatcacctgggagccaccagcttacgccaatggaccagtacagggatatcgcctgttttgcactgaggtatctactggcaaagaacaaaacatcgaggtcgacggcctgagctacaaactcgaaggcttgaagaaattcactgagtattcacttagatttctggcctacaatcggtacggccccggcgtctctacagatgatattacggttgtgaccctatccgatgtgccctcagcccctccgcaaaacgtgtcactcgaggttgtgaatagccggtcaatcaaggtctcttggctgcctcctccttctggtacccaaaacggcttcatcactggatacaagattcggcatcggaaaacaacacgacgaggggagatggaaacactggagcctaataatctatggtatctcttcactgggttagagaaggggagtcagtactctttccaggtgtcagcaatgacggtcaacgggacaggccctccaagcaattggtacaccgctgagacccctgagaacgacctcgatgagtctcaggtacccgatcagcccagctccctccacgtgcggccacagaccaattgtattattatgtcctggacacctcctctgaaccccaacatagtcgtccgggggtacattataggatacggggtggggtctccgtatgccgaaacagtccgagtggacagtaaacagcggtactacagcattgagagattggagtcaagctcccattacgtgatctctcttaaagcctttaataatgcaggtgagggagtcccgctttacgagtcagcaaccacaagatcaatcacggacttaagcacaccaatgctacctccagtcggggtccaggctgtggccctgacacacgacgcagtaagagtgagctgggctgacaacagcgtgcctaagaaccagaagacctcagaggtgcgattgtacacagtccggtggaggaccagtttctctgcatctgcgaagtacaaatccgaggacactaccagtttgtcatatactgccaccgggctgaagccaaatacaatgtatgagtttagtgtgatggtgactaagaatcggaggtcgtcaacatggtcgatgacagctcatgccaccacatatgaagctgcgccaaccagtgctccaaaggacctgacggtgatcacaagagaagggaagccccgggccgttatcgttagttggcagcccccccttgaagcgaacggcaaaatcactgcctatatcctgttttacaccctggataaaaatatccccatcgatgattggatcatggagacgatcagcggagatcggctcacccaccaaataatggacctcaatcttgataccatgtattattttcgcattcaagcccgcaattcaaaaggggtcggcccattgagcgacccaatcctgtttcgcacacttaaagtcgagcatcctgataaaatggctaatgatcaggataccggtgttactatcaacctggtaaatgaggtgctgttagggtag

SEQ ID NO: 23838 - DNA, 4344 bp, Artificial Sequence
  Description of Artificial Sequence: Synthetic coding sequence
atggagaacagcctgcggtgcgtgtgggtgcccaagctggccttcgtgctgtttggagcgtcactgttcagcgcccacttgcaagtgaccggcttccagatcaaggcttttaccgccctgcgattcctctcagaaccatccgacgcggttacaatgcggggtggcaacgtcctccttgactgttctgcagagtctgaccgaggagtgccggtgattaaatggaagaaggatggtattcatctggccttgggaatggatgaacgcaaacagcagctgtccaacggatcattgctcatccagaacattcttcattctcggcaccacaagcccgatgagggcttgtaccaatgtgaggccagtctgggggatagcggcagcatcatctccaggacggccaaagtggccgttgctggaccattacgattcctcagccagactgagagtgtcactgctttcatgggggataccgtgttgctcaagtgcgaggtgattggggagccaatgcccaccatccactggcagaaaaatcagcaagatctaacgccaattcccggggactcccgggttgtcgtgcttccaagtggggccctgcagataagcagactgcagccaggcgatattgggatttatcggtgctctgcccggaacccggcaagctccaggaccgggaacgaagccgaagtgcgcatcctgtctgatcccggattgcatagacaactttattttttacaacggcccagcaacgtcgtcgcgattgaaggaaaggatgccgtgttagagtgctgtgtgtccggatacccccccccctcattcacgtggctccgtggggaagaggtcattcaactgcgctctaaaaagtactctttactggggggaagtaacttattgatcagcaacgtgacagacgacgacagcggaatgtacacctgtgtcgtaacttataaaaacgaaaacatctcggcatctgcggagctgacggtgctggtgccgccttggttcttaaatcacccttcaaacttgtatgcatatgaatccatggacatcgagttcgagtgtaccgtttccgggaagccggtccctactgtgaactggatgaaaaatggagatgtagtgatcccgagcgactactttcagatcgtgggcgggtctaacctgcggatcttgggtgttgtcaagtcagacgagggtttttatcagtgcgtggcggaaaacgaggccggcaacgcacagacctctgctcagctgattgtccccaagcctgccattccatcgagcagtgtgctgccatccgcgccccgcgatgtagtgccggtcttggtctccagcagattcgtgagactcagctggcgaccgcccgccgaggctaagggcaatatacagacattcacagtcttcttcagtagggagggagacaaccgagaacgggcactgaacacaacacagccgggtagcttacagcttactgtggggaacttgaaacccgaagctatgtacacctttcgggtcgtcgcctacaacgagtgggggcccggcgagtcttcacagcccatcaaagtggcaactcagccagagctgcaagtccccggtccagtggaaaacctgcaggccgtgtccacatcacctacttctatcctgatcacttgggaacctcccgcttatgccaatggaccagtccagggctaccgtcttttttgcactgaggtcagcacaggcaaggaacagaatatagaggtcgacggcctgagctacaagctggaaggcttgaagaaatttacggagtactctctccggttcctcgcttacaatcgctacggccctggcgtctctaccgacgacatcaccgttgtgacactgtccgacgtaccgtcagctccacctcaaaacgtgtccctcgaagtggtgaactccagatctatcaaggtcagttggctccccccgccctcgggaactcaaaacggctttatcacaggttacaagattcgtcataggaagacgacacgtaggggcgaaatggagactctcgagccaaacaatctctggtatctcttcacgggcctcgaaaagggatcacagtattcgttccaagtgagtgcgatgactgttaacgggactggcccgcctagcaactggtacaccgcagaaacaccagagaatgacctcgacgaatcacaggtgccagatcagccctcatcattgcatgtacggcctcagaccaattgtattatcatgtcttggactccccccctgaatccgaacatcgtcgtcagaggttacattatcgggtatggggttggctcaccctacgcggaaacagtgagagttgactctaaacagcgctattactctatcgaacgactggagagcagcagtcactatgtgattagcctgaaagcatttaacaatgctggcgaaggagtgccactgtacgaatccgcaacgacccgttctataacggacccaaccgaccccgtggactattacccactcctagacgattttcctacaagtgtgcccgacctgagtacccccatgctaccccctgtgggcgtgcaagcagtggcacttacacatgacgctgttagggtcagctgggccgacaactctgtccccaaaaatcaaaagacctctgaggtgagactgtacacagtgcgttggagaactagcttctctgctagcgctaagtacaagtccgaggacaccaccagtctaagttatacggccactggactcaaaccgaacaccatgtacgagttctccgtgatggtgaccaagaataggcggtcttcgacctggtctatgactgcacacgccacaacatatgaggcagcccctacaagcgcccccaaggatctgacggtgataactagggagggaaagcctcgtgcagtgattgttagctggcagccccccttagaagcaaatggtaagatcactgcatacattcttttttacaccctggacaagaacatcccgatagatgattggatcatggagactatctccggagatcggttgacacatcagatcatggatctgaatcttgatacaatgtattacttcagaattcaggctaggaattctaagggtgtgggaccattatctgaccccatcttattccgcactctgaaagttgagcatcccgataagatggccaacgatcagggtagacacggagatggagggtattggcccgtggacacaaatctgatcgaccgatcaacactgaacgaacccccaattggacaaatgcaccccccccacgggtccgtgaccccgcagaaaaactcgaacctgctggtcataatagtagtcaccgtgggcgttattactgtcttggttgtggtgatcgtggcagtgatttgcacaaggaggagctccgcccagcagcgcaaaaagcgcgccactcacagtgccgggaagcggaagggaagccagaaggacctcagacctccagatctctggatccaccacgaggagatggagatgaagaacattgaaaaaccatccggaaccgatccagccgggcgcgattctccaattcagagttgtcaggacctgactcccgtttcacactctcagtctgagacccagttgggaagtaagtccacatcccacagtggtcaagacactgaggaggcaggttcgagtatgagcactctggagcgtagcctggcggctcgccgagcccctcgggccaagttgatgatccccatggatgctcaaagtaacaatcccgcagtggtttctgccattccggtgccaacactagagagtgcacaatacccaggcattctgccttccccaacctgtggctatccccacccacagttcacactgagacccgtcccgtttcccactctgtcagttgaccggggctttggagctgggcggtcccagtcagtttccgagggcccaaccactcagcagcccccaatgttaccccctagccagcctgagcacagctcctccgaggaagctccatcacggactatccctacagcgtgtgtaagacccacccacccattgagatccttcgccaaccctctgcttcctcccccgatgtccgctatcgagcccaaggtaccttataccccccttttatcccaacctggaccgaccctaccaaaaacccacgtaaagacagctagtctcggactcgccggaaaagcccgaagccctttgttgcccgtcagtgtccctactgcccccgaggtctctgaagagagccataaacccacagaggactctgccaatgtgtatgagcaggatgacctgtcggagcaaatggcttccctggaaggcctgatgaagcagctgaacgctatcactggttctgccttctag

SEQ ID NO: 23839 - DNA, 213 bp, Artificial Sequence
  Description of Artificial Sequence: Synthetic coding sequence
atgaccatgaacgtgctggaggccggcaagtggaagagcatcgtgcctgcgccaggagagggcctgctggccgtcctgcacatgatggtgtttacagatgctttgcaccgggaacgtagcgtcaagtggcaggctggtgtgtgctacaacgggggcaaagacttcgccgtctcactggcacgacccaaagcggcggagggaatagccgattag

SEQ ID NO: 23840 - DNA, 1392 bp, Artificial Sequence
  Description of Artificial Sequence: Synthetic coding sequence
atgagcgtggccatccggaagcggagctgggaggagcacgtgacccactggatgggccagccattcaacagcgatgataggaacacggcttgccaccatgggcttgtggcagactccctgcaggcgagtatggagaaagacgctaccctcaatgtggaccgcaaagagaagtgtgtctctctgccagactgctgccacggatcagaactcagggactttccaggtcgtcccatgggacacctgtcaaaggatgtggacgaaaacgattcgcacgagggggaggaccagtttctgagtttggaagcttctacagaaacacttgtgcacgtgagcgacgaggataacaacgccgatctctgcttgaccgacgataagcaggtgctgaatacccagggacaaaagacatcggggcaacatatgattcaaggggccggttctctggaaaaggccctgcctatcatccagagcaatcaggtcagctctaattcctggggcatcgccggggagacagaactagctcttgtcaaggaatccggcgagaggaaagttaccgactccatttccaaatctctagaactgtgtaatgagatatccctgagcgaaatcaaggatgcccctaaagtgaatgcagtggacaccctcaacgtgaaagacatagcacctgaaaagcagttactgaacagcgctgtcattgcgcagcagcgcaggaaaccggacccaccaaaagatgagaacgagaggagcacttgcaacgtagtccagaacgagtttctcgacacaccttgtaccaataggggcctccccctccttaagacggatttcggctcctgtcttcttcagccaccatcgtgtcccaacggaatgagcgcagagaacggcctagagaaatccggtttttcacagcaccagaacaaatctcctcccaaggtcaaggccgaggacggtatgcagtgtctgcagttaaaagaaacactggccactcaggagcctaccgataatcaggtgagactccgtaagaggaaggagatccgggaagatagagaccgggcaagactggatagtatggtgctgctcattatgaagctggatcagttggaccaggacatcgagaacgcgctcagtaccagtagctccccttcagggactccaaccaacctgcgtcgtcatgtaccagacctggagagtgggagcgagagcggggccgatactatcagcgtgaaccaaacaagggtgaatctgtcttcagatactgaatccacagacctgcctagttccacgcccgtcgctaactccggcaccaaacccaaaactacagcaatacagggaatatccgaaaaggagaaagccgggaaacttaccttctggttctgtttcctggccaacttattctag

SEQ ID NO: 23841 - DNA, 5268 bp, Artificial Sequence
  Description of Artificial Sequence: Synthetic coding sequence
atggagacccggagcagcaagacccggcggagcctggccagccggacaaacgaatgtcaaggaaccatgtgggcgcccaccagccctcctgcagggagcagcagtccttcgcagcccacttggaagtcgagcctgtatagcagtctcgcttacagcgaggcttttcactatagttttgccgcacgccctcgccggctgactcaactggctctggctcaaaggcctgagccacaacttttgcgtctgcgccccagctctttacgtacacaagacatcagccacttacttacaggcgtctttcgaaatctgtacagcgcagaagtaatcggagacgaggtgtcagcctccctgatcaaggcacgaggttccgaaaacgagaggcacgaggaatttgtggatcaattacagcaaatcagggagctgtacaagcagcgcctcgacgagtttgagatgctggaacgacacattacacaggctcaggccagagctattgcagagaacgagcgcgtcatgagccaggccggagttcaggatctcgaatccttagttaggctgcccccagtgaaaagcgtgagtcgctggtgtatcgattcagaactgttacgcaagcatcacttaatcagccccgaagattactacaccgacaccgtgccgttccattccgctcccaagggcatttccctgccaggatgttcaaaactgacttttagttgtgaaaaacgctccgtgcagaagaaggagcttaacaagaaattagaggattcctgtcggaagaagttggccgagtttgaagatgagctcgaccacacagtggactcgttgacatggaatctgactccgaaagctaaagaacgaacccgggagcccctgaagaaggcttcgcagcctaggaacaagaattggatgaatcatctacgggtgccccagagggagctggataggttacttctagccagaatggagtcccgaaatcattttctgaaaaatccgcgttttttccctcccaatacccgttacggcggcaaatcactcgtgttccctccaaaaaagcccgcccccataggggaattccaatccactgagcctgagcagtcctgcgccgataccccggtctttctggccaaacctccaatcggcttctttaccgactatgagattggaccagtgtacgaaatggtgattgcgcttcagaacaccaccacaacttctcggtaccttcgcgtactaccaccttcaactccatattttgctctgggtctcggtatgtttccaggcaagggcgggatggtagcacctggcatgacctgccagtatatagtgcagttttttccagattgcttaggcgacttcgatgactttattctggtcgagacccagtcagcgcatacacttctaatccctctgcaagctcgacggccaccccccgtgctcacactgtcaccggtgttggactgtggatactgcttgatcgggggggtcaagatgacccgatttatctgtaaaaatgtcggcttcagtgttggcagattttgcatcatgccaaaaacctcctggccaccactgtcgttcaaggccatcgccaccgtcggcttcgtcgagcagccaccttttgggattctgccttctgtgttcgaactggcccctgggcatgctatcctggtggaagtactgttttcccctaagtccctgggaaaagccgaacaaaccttcatcataatgtgcgataattgccagatcaaagagctcgtgacgattggcataggccagctgatagctctggacctcatttatatcagcggagaaaagagtcagccagacccgggcgagttgaccgacctaactgcacaacactttatccggttcgaacctgaaaacctgcgcagcaccgcccgtaaacaactgattataagaaacgccacgcacgtggagctcgcattttattggcagatcatgaagcctaacttacaacctctgatgccaggggaaacattctccatggattcaatcaaatgttatccagataaagagacggcattctcgataatgcccaggaagggagtgctctcgccccatacagaccatgaattcatattgtccttctcgccccacgaattacgcgatttccattctgtccttcaaatggtgctggaggaagttccagagcccgtgagtagtgaagctgaatccctcgggcactcctcatacagcgtggatgatgtgatagtgctcgagattgaggtgaaaggctcggtggagccctttcaggtcctgctcgaaccatacgctctgatcatccccggtgagaactatatcgggataaacgtcaagaaggctttcaaaatgtggaacaatagtaagtcacccatcaggtatctgtggggtaaaattagcgactgccatattatcgaagtggagcctggaaccggagtgattgagccgagcgaggtgggagactttgagctgaactttacaggcggcgtgccaggtcctaccagccaggacctgctatgcgaaatcgaggactccccctctcctgtcgtgctgcacatcgaagcggtgtttaaaggccccgcactgatcatcaatgtctcagctctccagtttggccttcttaggctgggtcagaaagctaccaactccatacagatacggaacgtgagccagctgcccgcgacttggcggatgaaggaaagtccagtgagccttcaggagcgaccagaagacgtgtctcctttcgatattgagccaagcagtggccagttgcattccctcggagagtgtagggtcgacatcactctggaagcactccactgtcaacacctcgaaaccgtacttgagttagaggtcgaaaacggagcttggtcatacttgccagtgtacgctgaggttcagaagccccacgtgtatctgcagtcatcacaggtcgaggtcagaaacctttacctgggggtgccaacaaaaactaccatcactttgatcaatgggacgctgctgcctacccaattccactggggcaaactgctcgggcaccaggccgagttctgtatggttacagtatctccaaaacacgggctgctcggcccctccgaggagtgtcagctcaaattggaactgaccgctcacacccaggaagagctgacccacctggccttaccctgccacgtgtcgggtatgaagaaaccactggtcctgggaatcagcggcaagccccagggcttgcaggtggccattacgataagcaaagaatcctcagattgctctacagaacagtggccagggcatcctaaggaactgcgcctggactttgggagcgccgtacctcttcggacgagggttacacgccagcttatcctcactaatcgatccccaatacgtacgcggttcagtctgaaatttgaatattttggttctccacaaaactccttgtcaaagaagaccagtctcccaaacatgcccccagccctgctcaagacagtccggatgcaagagcaccttgctaaacgggagcaactggattttatggagtctatgcttagccacggaaagggcgccgccttttttccccatttcagccaggggatgttgggtccttatcagcagctgtgcatagacatcactggctgcgctaatatgtggggtgagtactgggacaaccttatatgcacagtcggggaccttctgccagaagtgatcccagtccacatggcagctgttggctgcccaatttcatccctgagaactacaagctacacaattgatcaggcccagaaagagcccgctatgcgcttcggcacacaggtctctggaggcgataccgtaacccgaacgctgagactgaataacagctcgccttgcgacattaggctggactgggagacctatgttcctgaggataaggaggatcggctggtcgaacttctagttttttacggccccccattcccattgagagaccaagctggcaacgagttggtgtgtccagacacacctgaggggggatgcctcttatggtctcctgggccaagttcaagtagtgaattctcacacgaaacagacagctcagtggaaggctcttcttcagcttccaacagggttgctcaaaagctgatatcagtgatcctccaggcacatgagggcgtaccctccggacacttatactgcatctcaccaaaacaggtggtggtgcctgctggaggctcctccaccatctatattagctttactcctatggtgttgagcccagagattctccataaagttgagtgcacaggttatgccctgggattcatgtcattagacagtaaagtcgaaagggaaatcccaggcaagcgtcaccggctgcaggatttcgctgttggcccactcaaactcgacttgcactcctatgtgagacctgcccagctgtctgtggagcttgattacggaggaagcatggaatttcagtgccaggcgagtgacctgattcccgaacaaccctgtagtggtgtccttagtgagctcgtgactacccaccaccttaaactcactaatacgactgagataccacattacttccggctaatggtgtcaaggcctttttctgtgagtcaggatggggcgagccaggatcaccgggcgcctggccccggccagaagcaggaatgcgaggaggaaacggcatccgcagacaaacagctggtgctgcaagcccaggagaatatgttagtcaatgtgtctttctcattgagcctggagttgttgtcttaccagaagctgccagcagatcaaactctgcccggcgtcgacatacagcaaagcgcctctggggagcgggagatggtgtttactcagaatctactactggaatatacaaaccagacaactcaggtggttccactgagggccgtggttgcagtcccggaactgcaactgtccacgtcatgggtcgacttcggaacctgcttcgtgagccaacagagggtgagggaggtctatctcatgaatttgagcggctgccgctcttactggacaatgctgatgggacaacaggagcccgcgaaggccgccgttgccttccgcgtttcgccaaacagcggactgctggaggcaagatctgctaatgcaccacccacgtcaatagcgctccaggtgtttttcaccgccaggagctctgagctttatgagtctaccatggttgtggagggggtgttgggggaaaagtcttgcaccctgcggctgagaggacaagggtcctacgacgagcggtatatgctgcctcaccagccttag

SEQ ID NO: 23842 - DNA, 5337 bp, Artificial Sequence
  Description of Artificial Sequence: Synthetic coding sequence
atggagacccggagcagcaagacccggcggagcctggccagccggacgaatgagtgtcaaggcacaatgtgggctccaaccagtccccctgccggatcctcttcaccctcacagcccacctggaagtcttctctgtactcatcactggcatactcagaggcttttcattacagtttcgcagccaggccaaggagactcacccaattagccctggcgcaaagaccagaaccccagttgttacggctgcggcctagttccttgcggacacaggatatttcccacctgcttactggagttttccgcaatctttattctgccgaggttataggcgatgaagtctcagcgagcctaatcaaggcccgcggcagcgaaaatgaaagacacgaggagttcgtggatcagcttcagcagattcgagaactctacaaacaaagattagatgagtttgagatgttggagaggcatatcacacaggctcaggccagagccattgccgaaaatgaacgtgtgatgtctcaggcaggggtacaggacctcgaatccctggttcgactgcctcccgtgaagagcgtgtcccgttggtgtatcgactcagagcttctcaggaaacatcacttgatatcccctgaagattattacactgacactgtgccctttcacagcgccccaaagggcatctcactgcccggttgctccaaattaaccttctcctgtgaaaaacgatcagtgcagaaaaaggaactcaacaaaaagctggaggactcctgtcggaaaaagttagccgagttcgaagatgaactggatcataccgtggactctcttacttggaatctgacgcctaaggccaaggagagaacgagggagccactcaaaaaggcctcccagcctcgaaacaagaactggatgaaccacctgagggttccccagcgtgagttggaccggctgctgcttgcacgtatggagtcacggaatcattttcttaaaaatcctcggtttttcccgccgaatacccggtatgggggcaagtctcttgtgttcccaccaaagaagcctgcccctataggcgagttccaatcaacagaaccagaacagtcttgtgctgacaccccagtctttctggcaaagccccctattggcttttttaccgactacgagatcgggcccgtgtatgaaatggtaattgcattgcagaataccaccaccacaagccggtaccttcgagtgttgccacctagtactccttatttcgcgctgggcctcggtatgtttccaggcaagggcggtatggtcgccccaggaatgacttgccagtatattgttcagttttttcccgactgtttgggggacttcgatgatttcattttggtagaaactcaaagcgcgcacacgcttcttattccccttcaggcgcggcgaccacccccggtgctaactctctcaccagtgttggactgcggctattgtctgatcggtggggtgaaaatgaccagattcatctgtaagaacgtgggttttagcgttggccggttttgcatcatgcctaaaactagctggcctcccttgtctttcaaagcaatagctaccgtgggcttcgtggaacagcccccctttggcattctgccctcagtttttgaacttgcccctggccatgccatcctggtcgaagtccttttttcccccaagtcactggggaaggccgagcagacttttatcatcatgtgtgacaactgtcagattaaggagctagtgactatcggtattgggcaactgatagccctggaccttatttacatctccggcgagaagagtcagccggatccaggcgagctgacagacttgactgcccagcactttatccgcttcgaacctgagaatctcagaagtactgcacggaaacaacttattatccggaacgcgactcatgtggaactggccttctactggcagatcatgaaaccaaatctccagccattaatgccgggagagaccttctccatggacagtattaagtgttatcctgataaggagactgccttctccataatgccccgcaaaggagtcttgtccccacacactgatcatgagtttatcctgtccttctccccacacgaattgagagattttcacagcgtgctgcagatggtcctggaggaggttccggagccagtgagctcagaagccgaaagcctaggccacagctcatacagtgtcgacgatgtgattgtgctcgaaattgaagtcaagggatcagtggagccgtttcaggtgcttctggaaccctatgctctcattattcccggagagaactacatcggcatcaatgtaaagaaagccttcaaaatgtggaataatagtaagtcacccatacgctatctttggggaaaaatttctgattgccacattattgaagtggaacctggaaccggggttattgagccaagcgaagtgggggattttgagctcaacttcacaggaggggtcccaggtccaacctcacaggatctgctatgtgaaatagaggattctccaagccccgtcgttctgcacatcgaggccgtgttcaaggggccagccctgattatcaacgtgtcggccctgcaatttggtctcttacgactcgggcagaaggcaacgaattcaatccagattcgcaacgtgtcccagttgcctgctacttggagaatgaaggagagtccagtgtccttgcaggaacggcctgaagatgtgagcccatttgacattgagccctcaagcggacagctgcactctctgggtgaatgcagagtagacataactctggaggccctgcattgtcagcacctggaaaccgtgctcgaactggaggtcgaaaatggagcctggtcttacctgcctgtgtatgctgaggtgcaaaagcctcacgtgtacctacagtcatcacaagtggaggtaaggaacctgtatttgggggttcccacgaagaccacaatcacactaataaatggtaccctgctgccaacccagttccactggggtaagctcctcggtcaccaggccgagttctgcatggtgacagtgtccccaaagcatggcttgttaggaccaagcgaagagtgtcagctgaagcttgagctgacagcccacacccaggaggagctcacacacttggcccttccctgtcacgtgtccggcatgaaaaaaccccttgtgcttggaatatccggtaagccacagggtctgcaggtggctattaccatatcgaaggaaagcagcgattgctctactgagcagtggccgggccaccccaaggagctccgccttgattttggaagcgccgtgccacttcggactcgcgtgactaggcagctcattctgactaataggtcaccaatccggacacggtttagcctgaagtttgagtacttcggatccccccagaattcgctcagtaagaagaccagcctacccaatatgccccctgcgcttctgaagactgtgcggatgcaggagcatctggcaaaaagggagcagcttgatttcatggagtcgatgctatctcacggaaaaggggctgccttcttcccgcatttcagccagggaatgttaggcccatatcagcaactgtgcatcgatatcactggatgtgctaacatgtggggagagtactgggacaacctgatctgcaccgtaggcgacctgctgccagaagtcatacctgttcatatggccgctgttggctgcccaatttcttccctcaggacaacaagctacacaatcgaccaggctcagaaggaacctgccatgcgcttcggcacgcaggtcagcggcggcgataccgttactaggacattacgccttaacaattcttccccttgtgacattagattagattgggagacttatgttcctgaagataaagaagataggctggtggagctcttagtgttctacggtccacctttcccccttcgagaccaggccgggaatgaactggtttgccccgacacgcccgagggaggttgcctattatggtcacctggccccagcagctcaagcgagttttcccatgaaacggacagctcagtcgagggctcttcatccgcttcaaaccgggtggctcaaaagctgattagtgtgatactccaggctcacgagggagtcccatccggtcacctgtactgcatctcacctaagcaagtggtcgttcctgcaggtggctccagcaccatttacatcagttttacaccaatggtgttaagccctgaaatccttcacaaagtggaatgtacaggctacgcactggggtttatgtcgctcgattctaaagtagaaagggagattcctggcaaacggcatcggttgcaggacttcgcagttggccccctgaagctagatctgcattcttacgtaagacccgcccagctctctgtggagctcgattatgggggaagcatggagttccagtgtcaagcttccgatcttatccccgaacagccttgtagcggcgttctttctgagttagtgactacccaccatctgaaattgaccaataccacagagatccctcactacttccgtcttatggtaagccgcccattcagcgtcagccaggatggggcctcccaggaccatagggccccgggcccggggcagaagcaggagtgcgaagaggagacagcaagcgctgataagcagctcgtgctccaggcccaggagaatatgttagtgaacgtcagctttagtctgtctctcgagctgctgtcatatcagaaacttcctgcagaccaaaccttgcccggagtggacattcagcagtccgcaagtggcgaaagagagatggtctttacccaaaacctactgctggaatacactaatcagacgactcaggtcgtacccttgcgtgccgtggttgctgtcccggagctgcagctctccacctcatgggtggattttggcacctgcttcgtgtctcagcagcgcgtgcgggaggtctacctcatgaatctcagtggatgccgctcctactggactatgctcatgggggtagtgagttgcacctcacctcgttggtggtggaaggtgtgtagtgtgcgttcacccgcaccctgtggaagcggcgccaaggctcccatgatgcgggatacttgctgtttgacatcccctgaggctcccccccagccttctgcacccggtcctagctggcgcaaaaatatcgcccaagggcttggtgccgctctgcaacacaaagataccgaccttggtacttggggaccactgggcagtagttggaacggacggacgccttttcataatggcctctctctcggacctcatgacatgagctcagagctgacctag

SEQ ID NO: 23843 - DNA, 5277 bp, Artificial Sequence
  Description of Artificial Sequence: Synthetic coding sequence
atggagacccggagcagcaagacccggcggagcctggccagccggacaaacgagtgccaggggaccatgtgggcccctacctctccaccagcgggatcatcgtctcctagtcagcctacctggaagtcttctctctattcctccctggcctattcagaggctttccactacagcttcgcggccaggccccggcggctcacccaactggctctggctcaacggcccgagcctcagctccttcgactaagaccatcttctcttcggactcaagacatcagccacttgctgaccggggtcttcagaaacttgtactcagccgaagtgatcggcgatgaagtctcagctagcttgatcaaggcaagaggtagcgagaatgaacggcacgaggaattcgtggaccaactgcagcagattcgggagctttacaagcagaggctggacgaattcgaaatgttagagcggcatattacccaggcccaggcccgagccatcgctgagaacgagagagtcatgagtcaagccggagtgcaggatctggagtctctggtgcgcttaccaccggtaaagtctgtgtctaggtggtgtatcgactccgagctgctgagaaagcaccatctcattagtcccgaggattactataccgacactgtaccttttcatagcgccccaaaggggatttcactgcctggatgtagtaagctgacgtttagttgtgagaaaagatctgtccagaaaaaagaactcaacaaaaagctggaagattcatgtaggaagaaactggcagaatttgaagatgaattggatcacaccgttgattccctaacctggaacttgactcccaaggctaaagagagaacaagagaacccctaaagaaagcctctcagccccgcaacaaaaattggatgaatcacctaagagtgccacagcgcgagctcgatcgcctcttgttggcgagaatggagtccagaaaccatttcctgaaaaatccccgattctttccacccaacacgcgctacggaggcaagagcctggtttttccccccaaaaaacccgcccccatcggcgaattccaatcaacagagccagaacaaagttgcgcggatacacccgtcttcctggctaaaccaccaatagggtttttcacggactacgagatcgggcctgtgtacgaaatggtgatcgcactccagaacacaaccaccacttcccggtaccttagagtccttcccccgagtactccgtactttgcactcggcttgggaatgtttcctggaaagggtggcatggttgctcctggcatgacctgtcagtatattgtgcagtttttccccgactgtttgggggactttgacgatttcatcttggtcgagactcagtcagcccacaccctgttgatccctttacaagctagacgacctccgcccgtcctgacactttcgcctgtgctggactgcggctactgtctgatcggtggagtgaaaatgactaggtttatttgtaagaacgtgggatttagcgtcggacggttctgcattatgccgaagacaagctggccccctctgagcttcaaggcaatcgcaaccgtgggctttgtcgaacagcctccttttggcatcctgcctagtgtgttcgaattggcgcctggccacgcaattctagtggaggttctattcagcccgaaatcattaggtaaggcagagcagacttttatcataatgtgtgacaattgccaaatcaaagagctggtgacgattggcatcggacagctgatagccctggatttgatctatatctctggagagaaatcgcaaccagacccaggcgaactgacggacctgactgcgcaacactttatcaggttcgagcctgagaatctgagatctacagctaggaagcagctgatcatacgcaatgcaactcatgtggaactggccttttactggcagatcatgaagcccaacctccagcctctgatgcccggcgagacatttagtatggactccataaagtgctatcctgacaaagagaccgcattcagtataatgcctaggaagggcgttctctctccccataccgatcatgagtttatcttatctttctcccctcacgaactgcgggatttccactcagtcctgcaaatggttcttgaggaagtgccagaaccagtgtcctcggaggccgaaagcctcggacattcctcctactctgtggatgacgttatcgtgctggaaatcgaggtgaagggatctgtggagccctttcaggtcctgttggagccatacgccctgatcattccaggtgaaaactacatcggcatcaatgtcaaaaaagcctttaagatgtggaataactcaaagtcccccatccggtacctttggggtaagatttcagattgtcacataatcgaggttgaacccgggacgggtgtcatagagccatctgaggtgggagacttcgaacttaactttacaggcggggtccctgggcctacttcacaggacttactctgtgagattgaagatagcccatctcctgtggtcctacacattgaagcagtgttcaaaggacccgctctgatcatcaacgtttctgccctgcagtttggtctactgcgccttggccaaaaggccaccaatagtatacagattcgaaacgtctcccagctccctgcaacatggcggatgaaggaaagccctgtgagcctccaggaacgacctgaggatgtttccccctttgatatcgaacctagctctggacaactgcactccctgggggagtgccgcgtggatattactcttgaagcattacattgtcagcacctggaaacagtcttagaacttgaggtggagaatggagcttggagttacctccccgtgtatgcagaggtgcagaaaccccacgtataccttcagtcaagccaagtggaggtgaggaacctttacctgggggtaccgacaaaaacaacaataactctcatcaatggcactctgctccctacacagttccactggggaaagctgttaggacatcaggcagagttctgcatggtgaccgtgagccccaagcacggcctgttgggccccagcgaggaatgtcaattaaaattagagcttactgcccacacccaggaggagctcacccaccttgccttgccctgccacgtctcggggatgaaaaagccgttggtacttgggatttctgggaagccccagggtctacaggtggccatcactattagtaaagaaagctccgattgctcagtgttttcgaccgagcagtggccgggccatcctaaagaattgagacttgatttcggcagcgcagttccactccgcaccagagtgacacggcagctgatactgacaaaccgcagcccaattagaaccagattttcactaaaatttgagtactttgggagcccacagaactccctctctaagaaaacatctctccccaacatgcctcccgcccttctgaagacagttcgtatgcaggaacacctggcaaaacgcgagcagcttgatttcatggaaagtatgctcagtcatggcaagggggctgcctttttcccccatttctctcagggaatgctggggccataccagcagttatgtattgacattacagggtgtgccaacatgtggggagagtattgggacaatttgatctgcactgtgggtgacctactcccagaggtgatacctgtgcacatggccgccgtgggatgccccatttcctctctcaggaccacttcctacaccatcgaccaagcccaaaaagagcccgccatgaggtttggcacacaggtttctgggggcgatacagtcactcgcacactccgcttgaataattcatctccctgtgacattcggctggactgggagacatatgtcccagaggacaaggaagatagactcgtcgagttactagtattttatggacccccctttcctctgagagaccaggctgggaacgaactggtgtgcccagacacgcccgaaggcgggtgcctgctctggtcacctggacccagtagtagcagcgagttcagccacgaaactgacagctcggtcgaaggctcctcaagcgctagtaatcgtgtggctcagaaactcatttctgtgattctccaagcccatgagggggtgcctagcggacacctgtattgcatttctcccaaacaggtggttgtacctgcagggggcagtagcaccatttacatctccttcacaccgatggtgctgtccccagagatactccacaaggtagagtgtactggctacgctctgggatttatgagcctcgacagcaaggtcgagcgggagattcccggcaaacgtcacagactgcaggatttcgcagtcgggcccctgaaactggatttgcattcctacgtgaggcccgcccagttgtccgtggaactggattacggggggagtatggagtttcaatgccaagcaagtgatctgattccagagcagccctgcagtggcgtgctttccgagctggtgaccacacaccatctgaagctgactaatactaccgagatcccccattattttcggctcatggtgagtcgtcccttttcagtatcccaggacggggcatcgcaggaccaccgcgccccagggccgggtcagaagcaagagtgcgaggaagagactgctagcgccgacaagcagttagtacttcaggctcaagagaatatgctggtgaatgtctccttcagcctgagcctggagctgctgagctaccagaagcttcctgctgaccagacactcccaggcgtcgatatccagcagagtgcttcgggagagagggaaatggtgttcactcagaacctgctgcttgagtacactaatcagaccactcaggtcgtaccactgagagctgtggtggccgtccccgaactgcagctgtcgacttcctgggtggatttcggcacttgcttcgtgtctcagcagagggttcgggaagtgtacctgatgaatctaagcggatgtagatcatactggactatgctaatgggccagcaggagccggccaaagccgccgttgcgtttcgcgtttcaccaaatagcggcctgctggaggcacgcagtgccaatgctcccccaactagtattgctctgcaggtattttttacggccaggtccagcgaattatatgaatccaccatggtggtggagggtgtgctgggcgaaaaaagctgcactcttagactccggggacagggcagttatgacgagcggtacatgctgccccatcagccttag

SEQ ID NO: 23844 - DNA, 237 bp, Artificial Sequence
  Description of Artificial Sequence: Synthetic coding sequence
atgcggccctgcatctggatccacgtgcacctgaagcccccctgccgccttgttgaattactgccatttagctcagccctgcaaggcctatctcatctgtctctaggaaccaccctgccggtcattttacccgaaaggaacgaggaacaaaacctgcaggaactgtcccataatgccgacaaataccagatgggagactgttgcaaagaagaaatcgacgacagcatcttctattag

SEQ ID NO: 23845 - DNA, 2940 bp, Artificial Sequence
  Description of Artificial Sequence: Synthetic coding sequence
atgcggggctaccacggcgaccggggcagccacccccggcccgccagattcgccgaccagcagcacatggacgtagggcctgctgccagagctccatacctcctgggaagccgggaagcatttagcaccgagccacgcttttgtgctccccgcgctggcctggggcacatcagtcctgagggtcccctgtccttaagtgagggacccagcgtgggacctgaaggcggacctgctggcgccggcgtggggggaggctcttcgaccttcccccggatgtacccaggtcagggtcccttcgacacatgcgaagactgcgtaggacacccacaggggaagggggccccaaggttgccacccaccctgctggaccagttcgaaaagcagctaccagtgcagcaggacggtttccacacacttccatatcaaaggggtcccgctggagccggccccggaccagccccaggaaccggcacagcccctgagcctcgttcggagtcccctagtcgcatccgccatctggtgcactcggtccagaagctatttgccaaaagccactcactcgaagcccctggaaagagagattataatggaccaaaggccgaaggccggggggggtccggtggagacagctaccccggccccggctcaggagggccacatacatcccaccaccaccatcaccatcaccatcaccatcaccatcagagtaggcatggcaagcggtcaaagagcaaagaccgtaaaggcgatggccggcaccaggctaagtccaccggctggtggtcttccgacgataaccttgattctgattctgggtttctggcagggggtaggccaccgggggaacccggaggccctttctgcctcgaggggcccgacgggagctacagggacctgagcttcaaaggccgtagcgggggatcagaagggcggtgcctggcctgcactggtatgtccatgtcactagacggtcaaagtgttaaaagatcggcttggcatacaatgatggtttcccagggacgcgacggctaccctggggctgggccaggaaagggtctcctggggcccgaaaccaaagcaaaagcaaggacataccactatctccaggtgccacaggatgactggggtgggtatcccaccggagggaaagacggcgagataccatgtcgccggatgcggagtgggagttacattaaggctatgggcgatgaagagagtggagacagtgatgggagccccaagacatctccaaaagctgtggcgagacgatttaccactaggcggagctcatcagtagatcaagcccgcatcaactgctgtgtgccccctagaatccacccacggtcctcgatccccggttattcccgcagcctcaccacaggccagcttagtgacgaactcaatcaacagctggaagccgtgtgcgggagtgtgttcggagagttggagtcccaggctgtggatgctctcgatctgcctggctgtttcagaatgcggtcccacagctacctgagggccatacaggcgggatgtagccaggatgacgactgcttgccactattggcgacacccgccgctgtgagcggacgcccaggttccagttttaactttagaaaggctccccctcctatcccacccggatcccaggccccaccacgcatatccataactgcgcagtcttcaaccgattccgcccacgagtccttcaccgcggctgaaggaccagctaggcgctgtagtagcgcggatggtctggacgggccggcaatgggagcacgaacactcgaattggcacctgtaccaccccgcgcatctccaaagccaccaacattaatcatcaaaacgatccccggccgcgaggaactcaggtctctcgccagacagcgaaagtggcgcccctcgatcggtgtccaggtagaaacaatctcagatagtgatacagaaaaccgatccagacgggaatttcacagtataggcgttcaagtggaagaagataagcgcagggcccggtttaaacgcagtaacagcgtgacagctggcgttcaagcagatttggaactggaaggtttagcaggactagccaccgtggccacagaagacaaggccttgcaattcggtagaagctttcagcggcacgcatctgagccccagcctggcccgagggcacctacctattccgtattccgcacggtgcacacccaaggccaatgggcctaccgggagggctatcctctcccatatgagccacccgcaacagatggtagcccgggaccggctcctgcacccacccctgggccgggtgctggccgcagggactcttggattgaaagaggctcaaggagcctgccagattccggtagggccagcccgtgtccaagggatggcgaatggttcatcaagatgcttcgagcggaggtagagaaactggaacattggtgtcagcaaatggagcgagaagcagaggattacgagctaccagaagagatcctggaaaaaatccgcagtgccgtgggctctactcagctgctgctatcccagaaagtgcagcaattctttcgcctgtgccaacagagcatggaccccactgccttccccgtgccaacttttcaggatctcgctggcttctgggatctgctgcaattgtctatcgaagacgtcaccttgaaatttctggagctacaacagctgaaagcgaatagctggaaactcctcgagccgaaagaggaaaagaaagtcccgccccccattccaaagaagcctttacgaggaagaggggtccctgttaaggaacgaagcctggacagcgtggaccgccagcgccaggaagcacggaaaagactgctggctgctaagagggcagccagtttcagacactcttctgcgactgaatcagcggactctatagagatttacattccagaggctcagacgcggctctag

SEQ ID NO: 23846 - DNA, 5358 bp, Artificial Sequence
  Description of Artificial Sequence: Synthetic coding sequence
atgggcatcagcaccgtgatcctggagatgtgcctgctgtggggccaggttctttccactggaggctggatcccgcgaaccaccgactatgcaagtctcatcccctccgaagtcccattggacccaacagtcgccgaaggtagtccctttccatctgaaagcaccctggagagcaccgtggcggagggttctcccatttcactggagtccaccttggaaagcactgttgccgaaggctcattaatcccctcagagtccacactggagagcacagtcgctgagggatcagactcagggctggctctcagactggttaacggtgatggtcgctgtcaaggtcgtgtcgaaatattgtacagaggatcttggggaactgtttgcgacgactcttgggacaccaacgacgccaacgtggtgtgtaggcaactgggctgtgggtgggctatgagcgccccagggaacgcctggttcggccagggctcaggaccaatcgccctcgacgatgtgaggtgctccggtcacgagtcttacttgtggtcctgtccgcacaatggatggctaagccataattgcggacacggcgaagatgccggcgtgatatgttccgcagcgcagccgcagagcacgttgcgccctgagtcctggccagtgaggatttctccgcccgtgcccaccgaagggtcggaatctagcctggccctgaggcttgtcaatggcggagatagatgtcgcggccgggtggaggtgttgtacaggggtagctggggcacagtttgcgatgactactgggatacaaacgatgctaacgttgtgtgccgccaactggggtgtggctgggccatgtcggctcctgggaatgcccaattcgggcagggctctggccctatcgtgctggatgacgtccgctgcagtggacacgagtcctatctatggagctgtccccacaatggatggctgacccataattgcggacacagcgaagatgccggtgtgatatgctctgcgccccagtcaaggcctacccccagtccagacacgtggcccacctcgcatgctagcaccgctggaccagagagctcactggctctcaggctcgttaatggcggcgaccgctgtcaaggccgcgtggaagtactctatcgcggatcttggggaacggtgtgcgatgacagctgggacacctctgacgccaacgttgtctgccgacagcttggatgcggttgggccacatccgctccaggtaatgcacgcttcgggcagggttcgggccccattgtgctggacgatgtgcgctgctccggctatgagagctacctatggtcctgcccccacaacggttggttatctcacaactgtcaacacagcgaggacgctggggtgatctgttctgccgctcacagttggtccaccccctcacctgatacactgcccacaatcacgctaccggccagcaccgtaggctctgaatcttccctggcactaaggctcgtcaacgggggcgatcgctgccaaggaagggtagaggttctataccaggggtcttgggggactgtgtgtgatgattcttgggacactaatgacgccaatgtggtttgtcgccaattgggctgtggctgggctatgtcggcccccggaaatgcacgattcggccagggcagtggacccatcgtcttggatgacgtgaggtgtagcggacacgagagctacctgtggtcttgtccacataacggatggttgtcccataactgcggtcacagcgaggacgctggcgtgatctgtagcgcaagccaatctcgcccaacccctagccccgatacctggcctacttcccatgcctccactgcagggagcgagtcaagccttgccctgcgcctggtgaatggtggcgatcgctgtcaggggagggtagaggtactgtaccgaggtagttggggcaccgtgtgtgatgactactgggatactaatgatgctaatgttgtttgcaggcagctcggttgtggatgggctatgagcgctccagggaatgcacgcttcgggcagggctcagggccgatagtcctggatgatgtcaggtgctccggtcacgaatcatacctgtggtcgtgtccgcataacggatggctatcacacaattgcggacaccacgaagacgccggagtaatttgctcggccagccagtctcagcctactccatccccagacacttggcccacttctcatgcctcgacggccgggagcgaatcctctcttgccctgagattggtgaatggcggggacagatgtcaggggcgggtcgaagtgctgtataggggtagctgggggactgtgtgcgatgattactgggacaccaatgatgccaatgttgtgtgccgccaattaggatgcggatgggctactagtgctcctggtaacgcccgcttcgggcaggggagcggccctatagtcctggacgacgtgaggtgcagcggacacgagagctacctttggtcttgcccccataacggctggttatctcataattgtggacaccatgaagatgccggcgtgatttgttctgcctctcagtctcagcctacgccttcccccgacacgtggcctacctctcgggctagcacggcaggcagtgaatctaccctcgctctgagactggtgaatgggggagacagatgccgcggtcgggtggaagtgctctatcaaggctcgtggggcactgtatgtgatgattactgggacacaaatgatgccaacgtggtgtgcaggcagctgggatgtgggtgggcgatgtccgccccagggaatgctcagttcgggcagggctccggtcccatcgtcctggacgatgtgcgctgcagtggacacgaatcatatctgtggagctgtcctcataatggttggctgtcgcacaactgcggccaccatgaggatgccggcgtgatttgctctgccgcccagagtcagtcaaccccaagacctgatacatggctgacaaccaacctgccagccctcaccgttggctctgaatcaagtctggccctgcggttggtaaatggtggggatcgatgccgaggcagagtcgaggtgctctacagaggctcatggggtacagtgtgtgatgatagttgggatactaacgatgctaatgtcgtctgcaggcagttggggtgcggctgggcaatgtctgccccaggaaatgctagattcggtcaaggaagcggccccatcgtgctggatgatgttagatgcagtgggaatgaaagctatctgtggtcttgtcctcataaagggtggctcactcacaactgtgggcaccacgaggatgccggggtgatctgtagcgcaacacagattaacagcacaaccaccgattggtggcatcccaccactacaacaaccgccaggcccagctcgaactgtggcggatttctgttctacgcaagtggcacgtttagttcaccctcctatccagcctattatcctaataatgccaagtgcgtgtgggagatcgaagtgaattctggatacaggattaacctcggattttcaaacctgaagctggaagctcaccacaactgcagcttcgattacgtagagatctttgacggatctctgaacagtagcctcctcctgggcaagatctgtaacgacacgcgccagattttcaccagttcatataacaggatgactatccactttagaagcgatatctccttccagaacacaggatttctcgcctggtacaatagcttcccttctgacgctactctcagacttgtcaatttaaattcctcatatgggctctgtgccggtcgggtggagatctatcacggagggacatggggcacagtatgtgacgatagttggaccattcaagaggctgaagttgtctgccgccaactgggctgtggacgggccgtgtcagctctcgggaatgcttactttgggagtggtagcggtcccattacattggatgacgtggagtgctccggtaccgaatctaccctttggcaatgccgaaatagaggatggtttagccataactgtaatcaccgggaggatgcaggagtcatatgctcaggcaatcatctgagcacacctgcccccttcctgaatatcacaagaccaaatacagactatagctgcggtggcttcctctcacagccatctggtgatttctccagccctttctacccaggtaactacccaaataatgctaagtgtgtttgggacattgaagtacaaaacaactatcgagtgaccgtgatcttccgcgatgtacaattagagggggggtgcaattacgattatatcgaggtgttcgacggaccatacaggtcttcccctcttatcgcccgcgtgtgcgacggcgctagaggtagctttaccagttcgagtaacttcatgagcattcgcttcatcagtgaccactccatcacacggcggggctttcgagccgaatattactctagtccttctaacgatagcactaatctcctgtgcctgcccaaccacatgcaggcttccgtctcaagatcctatcttcagtcactcggtttctctgcatccgacctggttatcagtacttggaatggctattacgagtgccgcccacagatcaccccaaatcttgtgatcttcaccatcccatactccgggtgcgggacatttaagcaggccgacaacgacacaatcgattattccaactttctcacagccgccgtttctggggggattataaagcgtcgcacggatttgcggattcatgtctcgtgccggatgctgcagaacacctgggtcgacacgatgtacatagccaacgacaccatccatgtggccaacaacacaattcaggtcgaagaggtccaatatggaaatttcgatgtcaacattagcttttacacaagcagtagttttctctaccccgtgacttcgcgaccctactacgtcgacctcaatcaggacctgtatgtccaggctgagatcctacactccgacgcggtcctcaccctctttgtcgacacctgtgtggcatctccgtattctaatgattttacctccctgacttatgatcttattaggtcaggctgtgtgcgggacgacacctacggcccttattcctctccatccctcaggatcgctaggtttcgcttccgggcattccattttctgaaccgttttccatccgtttatttaaggtgtaagatggtggtctgccgcgcatacgacccgagctctcgatgttaccgtggctgtgttctgagatccaagcgcgacgtgggttcctatcaagaaaaggtcgatgtagtgctcgggcctatccagctccagacgcctcctaggcgcgaagaagaaccaaggtag

SEQ ID NO: 23847 - DNA, 5358 bp, Artificial Sequence
  Description of Artificial Sequence: Synthetic coding sequence
atgggcatcagcaccgtgatcctggagatgtgcctgctgtggggccaggtcctcagcactggcggctggatccctcggacaaccgactacgccagtctcattccatctgaggtgccacttgatcccaccgtggccgaggggtcgcctttcccatccgagagcaccttggagagtactgtggcagaggggtcaccaatttctctggagagcacattagaaagtactgttgccgaagggagcctgatcccttccgagtccacactggagagcactgtggccgaaggaagcgattcgggcctggccctgcggctggtgaacggggatggacgatgccaggggcgggtagagatcttgtacagaggtagttggggcaccgtgtgcgatgactcatgggacaccaatgacgcgaatgtggtgtgcaggcagttgggctgcggatgggcaatgtccgcccccgggaatgcttggtttggacaggggtctggacccattgcgttagacgatgtgcggtgttccggccacgagagttacctctggtcatgcccccacaacgggtggctttctcataactgtggacacggtgaagacgccggtgtcatttgcagcgcggctcagccccagtccacacttcggcctgaatcctggcccgttagaatttcaccccccgttccgaccgagggttccgagagtagtctcgccctcagactggtcaacggaggagatcgctgcagaggtcgagttgaggttttatataggggcagttggggaaccgtttgtgatgactactgggatactaatgatgcaaatgtggtgtgtagacaattaggctgcggctgggctatgagcgcccctggcaacgctcagtttgggcaggggagcggaccgatcgttctggacgatgtaaggtgctctggtcatgagagttacttatggagctgcccccacaacggctggttgactcataactgtggccactctgaggatgcaggagtcatatgttctgcacctcaatcacgcccaacccccagcccagacacgtggcctaccagtcacgcttccactgctgggcctgagtcaagtctggccctgcgcctggtgaatgggggtgaccgttgtcaagggcgagttgaggtgctgtatcgcggttcctggggcaccgtttgcgatgatagctgggatacaagtgacgcaaacgtggtctgccggcaattgggatgtgggtgggccacatctgcacccgggaatgcccggtttggccagggctctggccccatagtcctggatgatgtgagatgctcaggatacgagtcatatctctggagctgccctcacaatggctggctgagtcacaactgccaacactccgaggacgctggggtgatatgctctgccgcccactcttggtctacaccgtcccctgacaccctcccgaccatcacactcccagcctctaccgtgggcagcgaatcctccctcgctctaaggcttgtgaacggcggtgatagatgtcaagggagagtggaggtcctttatcagggatcgtggggtacagtttgcgatgattcctgggatacaaacgatgcaaatgtggtgtgtcgccagctgggttgtgggtgggccatgtctgcgcccggaaacgctcgctttggccagggttccgggcccattgtcctggacgacgtgcgatgctctggtcacgagtcctacctttggtcgtgtccccacaacggatggctgtcacacaactgcggccactctgaggatgccggcgtgatttgttcagcgagtcagagtcgccccactccatcaccagacacctggcccacgagccacgcgagtacggccggctccgaatcatccttggccctccgacttgtgaatgggggcgatcggtgccagggaagggtcgaagtcctgtaccgcggcagctggggcacggtttgcgatgactactgggatacgaacgacgctaacgtggtgtgccgccagctaggatgtggatgggctatgtctgcacccggtaacgcccggttcggtcaagggtctggacctattgtcttagatgatgtgcgctgttcaggccatgagtcttatctttggtcgtgccctcacaacggttggttgagtcacaattgcggccaccacgaagatgcaggcgtgatatgtagcgcctctcagagccagcctacacctagcccagacacatggcctactagtcacgcctcaacggctggaagcgaaagcagcctggcgctgcgtcttgtaaatggaggcgaccggtgccagggccgagtggaggttctttacaggggctcctggggcaccgtctgcgacgattactgggacacgaatgacgcaaacgtggtttgcagacagttgggctgtgggtgggccacaagtgctcccggaaatgcccgctttggtcagggcagcggacccattgtgctggacgatgttcgctgcagcggtcacgaaagttacctttggtcctgcccacacaacgggtggctttctcacaattgtggccatcacgaggatgcaggcgtgatctgcagtgcatcacaaagccagcccacacccagccccgacacgtggcccacctcccgcgcatcgactgccggcagtgaatctaccctcgcactacgcctggtgaacggaggagatagatgtcgggggagggtagaagttctgtatcagggctcttgggggaccgtgtgtgatgactactgggacacaaacgatgctaatgtggtgtgccgccagctggggtgtggttgggccatgagcgccccagggaatgcccaattcgggcagggatccgggccgattgtgttggacgacgtccgctgctcagggcacgaatcctacttgtggagttgtccccataatgggtggcttagccacaattgtgggcaccacgaagatgctggggtgatttgctcggctgcgcagtcccaatctacaccccgcccggacacttggctgacaactaatctcccagccttgacagttggatctgaatcttccctggccctgcggttagtaaacggaggcgaccgctgcagaggccgagtcgaggtcctgtaccggggcagttggggcacagtttgtgatgacagttgggacactaatgacgccaacgtggtttgccggcaactcggctgcggctgggccatgtcagccccaggtaatgccaggttcggccaaggaagcggcccgatcgttctggatgacgtacgctgcagtggcaatgagtcttacctgtggtcatgtccccacaagggatggctgacacacaactgtgggcatcacgaggatgcgggagtaatctgttcagccacccagatcaacagcacgaccactgattggtggcaccctaccacgacaaccactgcgcgccctagctccaattgcggggggtttctcttctatgccagcggaactttctcttcaccttcctaccctgcgtactatccaaacaatgcaaaatgtgtgtgggaaattgaggtgaactccgggtacaggatcaacctgggcttctccaatctcaaactggaggctcaccataactgctcgttcgattacgtggagatttttgatggcagtctgaatagtagcctcttgctcggcaaaatctgcaatgacacccgccagattttcacaagttcttataataggatgaccatacactttcgcagcgacatatcattccagaacaccggtttcttggcctggtataactcatttccctcagatgccacactcaggctcgttaacttgaactcctcgtatgggttgtgcgcgggcagggtggagatctaccatggggggacatgggggaccgtttgtgatgactcctggacaatacaagaggctgaggtggtttgccgccagctcgggtgtgggagggccgtttcagctttaggcaacgcgtatttcggatcaggctcaggtcccatcaccctcgacgacgtggagtgttccggcaccgaaagcacattgtggcagtgtagaaatagaggatggttcagccataactgcaatcaccgtgaagatgctggagtcatctgctctggcaaccacttgtcaacaccggccccctttctgaacattactcgtccaaatactgactactcctgcggcgggtttttgtctcagccaagtggcgattttagctcaccattttatcctggcaactatcccaacaacgccaaatgcgtgtgggatatcgaggtccagaacaactacagggttacagttatctttagggacgtgcaattggaggggggctgcaactatgattatattgaggtgttcgacgggccctatcggtctagcccgctgattgcccgagtctgtgacggcgccagagggtcgtttacaagcagctctaacttcatgagcatccggttcatttccgaccactcaataacacggagaggcttccgcgccgagtattactccagcccgtcaaatgacagcacaaatttattgtgcctgcccaatcacatgcaggccagtgtgagtaggtcttacctccagagcttaggatttagcgcttccgacctcgtgatttcaacatggaatggttactatgaatgccgtccccagataacgccgaatctggtgatatttactattccttactccggctgtgggactttcaaacaagccgataacgacacaatcgattattctaactttcttaccgctgcagtctctggaggaatcatcaaacggcggaccgatcttcgaatccatgtgtcgtgccgcatgctgcagaacacatgggtggacactatgtatatagccaatgacacaatccatgtggccaataacaccatccaggtggaagaagtgcagtatgggaattttgacgtcaatataagtttttacacctctagtagttttctgtaccccgttaccagtcggccttattatgtcgacttgaatcaggatctctacgttcaggctgagatcttgcactccgatgcagtactaaccctgttcgtggatacctgcgtggcctcaccttactccaacgattttacttctttgacctacgacctgatccggagcggctgtgtaagagacgatacatacgggccctattccagcccaagtcttcgtattgcgaggttccgctttcgtgcatttcatttcttgaatcgattccctagtgtatacctaagatgcaaaatggtggtatgccgggcctatgaccctagttctaggtgttatcgtggatgtgtcctccggtctaagagggatgtaggcagttatcaggagaaggtagatgtggtcctcggacccatacagctccagacgcctccccgcagagaggaggagccaagatag

SEQ ID NO: 23848 - DNA, 7242 bp, Artificial Sequence
  Description of Artificial Sequence: Synthetic coding sequence
atgggcatcagcaccgtgatcctggagatgtgcctgctgtggggccaggttctctctactggaggatggattcccagaactaccgattatgcctccctgataccttctgaggtgcccctcgatcccaccgtcgcggaaggctcgcctttcccttcagaatcgactctcgaaagtaccgttgcagaaggcagtcccatctcgctcgagtccactcttgagagtacggtggccgaaggatctctgatcccaagcgaatctacgctcgagagcacagtcgccgaggggagtgactccggcctggccctgcggctggttaacggggatggacgctgccagggcagggtagagatcctgtatcgcggcagttggggcaccgtgtgcgatgattcatgggacacaaatgacgccaacgtggtgtgtagacaactgggatgcggctgggccatgtccgcgccaggtaacgcctggttcgggcagggtagcggtccaatcgcactcgacgacgtgaggtgtagtggccacgagagctatctatggagctgtccccataacgggtggttgtcacacaactgcggccatggggaagatgccggcgtaatttgttctgctgcccagccacagtcaacactcaggcccgaatcttggcccgttaggatctccccaccggtgcctactgaaggatccgagtctagtctggccttgaggttggtcaatgggggcgacaggtgtcgcgggcgggtcgaagtgctatacagaggctcatggggtaccgtttgcgacgattactgggacacgaatgacgccaacgtcgtgtgtcggcaattaggatgtggctgggccatgtctgcccctggaaatgcgcaatttggccagggtagtgggcctatcgtgctggatgacgtcagatgtagcggccacgagtcctacctatggtcctgtccccacaatgggtggttgacacacaactgcgggcactccgaggacgctggggtgatttgctcagccccgcagtcccgacctacgccttcgcctgacacctggcccacttcccacgcgagcacagccggacctgaatcgtctctggccctgcgcctagtcaacggcggggacagatgccaggggcgcgtggaggtgctctatagaggtagttggggtacagtttgcgacgacagctgggacacctctgacgctaacgtggtatgtcgacagctgggctgcggctgggccacttcggctcccggcaatgcacggttcgggcagggctcgggccctatcgtgctggatgatgtgcgatgtagcgggtatgagtcttatctgtggagctgtccccacaatgggtggctgagtcataattgtcagcattccgaggatgcgggcgttatttgttcagccgcccactcatggagtacaccatcccccgacacattgccgacgatcactctgcccgcaagcaccgtaggttcggaaagcagtctcgctctgaggctggttaacggtggagaccgctgccagggccgcgtggaggtcctctatagaggtagctgggggacggtctgcgacgacagctgggacactaacgatgccaacgttgtgtgccggcagctcgggtgcggatgggctatgctggcacctggcaacgcccggttcggacagggtagcgggcccatcgtgcttgatgacgtgcgttgttccggcaatgagagctatctgtggtcatgcccccacaatggttggctgagtcacaattgtgggcactcggaagatgctggagtgatatgcagtgggcccgagagctccctggcattgcgcctcgtgaacgggggggatcgatgtcagggaagagtggaggtgctttatcgtggcagttggggaaccgtatgtgatgactcatgggatacaaatgacgccaacgtggtatgcaggcagctgggatgtggatgggccacgtcagctcccggtaacgccagatttggccaaggaagcggtccaattgtcctcgacgacgtcaggtgttctggccacgagagctatctttggagctgccctaacaatggctggttatctcataactgtgggcatcatgaggatgctggcgttatttgctcagcggcccagagccgctccacacctcgtcccgatacattgagtaccatcacactgccaccaagtaccgttggctctgaaagtagtctaacactgcggctcgtcaatggctccgaccggtgtcaggggagagtcgaagtgttgtatagggggagttgggggaccgtctgtgacgactcttgggacaccaatgacgcaaacgtggtgtgtcgtcaactgggatgtgggtgggcaacgtccgctcccggcaatgcccgcttcggacagggcagtggtccaatagtactagacgacgtccgctgcagtggccatgaatcctacctttggtcctgtccacacaatggctggcttagtcacaactgtggccaccacgaagacgcgggtgtcatttgctctgtgtcacagagccgaccaacccccagccccgatacatggcccacttcccatgcctccaccgcgggacccgaaagctccttggccctgcgccttgtaaatggaggcgaccgttgccagggcagggtggaagtgctgtacagaggctcatggggaaccgtctgtgacgactcctgggatacttctgacgctaacgtcgtgtgccggcagctaggctgtggatgggccaccagcgctcctgggaacgcacgcttcggtcagggctccggccctattgttctagatgacgtcaggtgttcaggctacgagagttacttatggtcttgcccacataacggatggttatctcacaactgtcaacacagcgaggacgccggagttatttgtagcgccgcacattcctggtccaccccctcccccgacaccctgccgactatcacactccctgcaagcactgtggggtcagagtcatctctggcgcttagactggttaacggaggagaccggtgccagggccgcgttgaggtcctgtatcagggtagttggggtaccgtatgtgatgattcttgggacactaatgacgctaacgtcgtttgcaggcaattaggctgtggctgggccatgtcagcacctggcaatgcccgattcggccaagggtccggccccatcgttctcgacgacgtcagatgttccggtcatgagtcttacttgtggtcatgtccgcacaacggctggctttcccacaactgcggacactcagaagatgcaggcgtgatttgttccgccagccagagcaggcccactcccagtccagacacctggccaacatcgcacgcatccaccgcgggctccgagtcctcgctggcgcttaggttggtcaatggcggcgacagatgccaaggacgggtggaggttctgtatcgtggatcttggggcactgtatgtgacgattattgggataccaacgatgccaacgtagtgtgccgtcagctaggatgcggatgggccatgtctgctcccggaaatgctagatttggccaggggtctggtcccatcgttctggacgatgtccgctgttctggacacgaaagttacctgtggtcctgccctcacaacggatggctcagtcataattgcggccaccacgaggacgcgggcgttatctgcagcgcgtctcagtctcagccaacgccatcccccgatacctggcctacttcacacgctagtacagccggcagcgaatcaagcttagctctgcggttggtcaacgggggtgataggtgccagggacgcgtcgaagtgttatacagggggtcatggggaactgtctgcgacgactactgggatacaaatgatgctaatgtagtgtgtcggcagctcggttgtggatgggccacctcagcacctggaaacgccagatttgggcagggtagtgggccaatcgtattagatgacgtgagatgcagcgggcatgagtcatacttgtggagctgtccccataacgggtggctgagtcacaattgcggccaccatgaggatgcgggagtgatatgttccgcctctcaaagtcagccgactccttctccagacacttggcctacgagccatgcctccacagccggctccgagagctcactcgctctgcggcttgtaaacggcggcgaccgttgccaggggcgcgttgaggtcctttaccggggatcttggggtactgtctgcgacgattattgggataccaacgatgccaatgtcgtatgtaggcagctgggatgcgggtgggccacctcagccccaggaaacgcacgttttggacagggctctgggcctatcgtgctcgacgacgtcagatgtagtggccacgaaagctatctctggtcctgcccacacaatgggtggctgagtcacaattgcggccaccatgaagatgctggagtgatctgctccgcttctcagtctcagcctaccccatctcccgacacctggccaacctcacgagccagcacggccggatccgaaagcacccttgccctgagacttgtcaatggcggagaccggtgtcggggacgcgtggaggttttgtatcaggggtcttgggggaccgtctgcgatgattattgggacacaaacgacgccaatgtcgtttgcaggcagctcggatgcggctgggccatgtcggcccctgggaatgcacagtttggccaggggagcggcccaattgtgctggacgacgtgcggtgctccggccacgaaagctacttatggagctgtccccataacggatggctcagtcacaattgtggccatcacgaagatgctggcgtgatctgctctgcagctcagtcccagtctactcctcgaccagacacatggctcacaacgaacctgcccgcgctgaccgttggcagtgagtcgtcattagctctaaggttagtgaacggcggagataggtgtagaggcagagttgaagtgttgtacagagggagctggggaaccgtctgcgatgattcttgggacaccaatgatgcgaacgtggtctgcagacaactgggatgtggctgggccatgtccgccccagggaacgcacggtttggacagggttctggacctattgtgctcgatgacgtgcggtgctccggaaatgaatcatacctgtggagctgcccccacaaaggttggttaactcataactgtggtcaccatgaggatgctggcgtcatttgctcagcaacccagatcaattccactaccaccgactggtggcacccaaccaccaccaccactgcacggcccagttctaactgcgggggcttcctgttctacgctagtggaaccttcagcagcccttcctatccggcctactatcccaacaatgccaagtgtgtgtgggagatcgaagtgaattcaggctaccggatcaatcttggtttttccaacctcaaactggaggcccatcataactgctccttcgattacgttgaaatattcgacggctccctgaactcatccctcttgcttggaaagatctgtaatgacaccagacaaattttcacctcatcttacaacagaatgaccattcacttcagatcggacatatcattccagaatacggggtttctggcttggtacaattctttcccctctgacgcgacactgagactagtaaatctgaatagcagctatggcttgtgtgctggcagagttgagatctaccatgggggaacatggggcactgtgtgtgacgacagctggaccattcaggaagctgaagttgtttgccgccagctcgggtgcggtagagccgtttcagcactggggaacgcctacttcggaagcggcagcggcccaatcacactggacgacgtggagtgtagtggcaccgagagtacattgtggcagtgcagaaaccgcgggtggttcagccacaattgcaatcatagggaggacgctggcgttatctgttcggggaatcatctaagcacacctgccccgttcctgaatattactaggccaaatactgattattcatgcggagggttcttaagccaacctagcggcgatttttcatcccccttttaccccggcaattatcccaataacgcaaagtgcgtgtgggatattgaagtccaaaataattatagggtcaccgtgatctttcgcgacgtacagctggaaggcggctgcaattatgactacatcgaagtgttcgatgggccctataggtcttctccactgatagccagagtatgtgatggggctagaggttcattcacctccagcagtaacttcatgagcattcgtttcatttccgatcatagcataacccgccgagggttccgcgccgagtattacagctccccaagcaatgattccacaaatcttctgtgcctccccaaccacatgcaggcctcggtttcaagatcctacctgcagtccttaggcttctcagcgtcagatctagtaataagcacctggaacggttattatgagtgcagacctcaaatcacacccaatctcgtgatcttcactattccgtatagcggctgtggcaccttcaagcaagccgataacgataccattgactacagtaatttcctcacagcggcggtgagcggcggcatcatcaagcgcagaaccgatttgagaattcatgtctcatgccggatgttgcagaacacctgggtggataccatgtatatagctaacgatacgatacacgtggccaataatacaatccaggtggaggaggtccagtatgggaactttgacgtcaacatcagcttctacacctcatcatcttttctctaccccgtgacctctaggccctactacgtggacttaaatcaggacctttacgttcaggctgagattctgcattcggacgcagttctgaccctgttcgtggacacatgcgtggccagtccgtactctaatgacttcacctctctcacatacgatttgattcgctcgggctgtgtgagagacgacacttacgggccgtactccagccccagcctcaggattgcacggtttcgcttcagagcctttcactttctcaacagatttccctccgtttaccttcgatgtaaaatggtcgtctgcagggcctacgatccctcttctcgctgttaccgtggctgtgtgctgcgcagtaagcgagacgtcggcagctaccaggaaaaggttgacgttgtacttggccccatccaactgcagactcctcctcggcgggaggaggagcccagatag

SEQ ID NO: 23849 - DNA, 5358 bp, Artificial Sequence
  Description of Artificial Sequence: Synthetic coding sequence
atgggcatcagcaccgtgatcctggagatgtgcctgctgtggggccaggtgttaagtacagggggttggatccccaggacaacagactatgctagccttattcccagtgaagttcctcttgatcctaccgtagccgagggctcccctttcccaagtgaatccacgttagaatcaacagtggccgagggttctccaatctccctggaaagtacactggagtccaccgtcgccgaggggtctttgattcccagtgagagcactctagaaagtactgtggcggagggctctgactctgggctggctctgcgcttggtcaatggagacggtagatgccagggacgcgtcgaaatcctttatagggggagctggggcacagtgtgtgacgactcatgggataccaatgacgccaatgtagtctgcagacaactaggctgtggttgggctatgtctgctcctgggaacgcctggtttggtcagggaagcggacccattgccttggacgatgtgagatgctctggccacgagagctatctgtggtcttgtccacataacggttggttatcgcataactgcggacatggcgaagacgcaggcgtgatctgttctgcggcacaaccccagagtactctgcgacctgagtcctggcctgtaaggatctctcctcccgtcccaacagagggttcagaaagctcacttgcccttaggctcgtcaacggaggtgatcgatgcagaggccgggtggaagtgctgtatcggggtagctggggcacggtgtgcgatgactactgggacactaatgacgccaacgtggtgtgccggcaactggggtgcggatgggcaatgtcagctccaggcaacgctcagttcggacaggggtctggcccgattgtccttgatgacgttagatgcagtggacacgaaagttacctgtggagctgcccccacaacggctggctcacacacaattgcggacactccgaggacgccggcgtgatttgtagtgcccctcaaagcaggcccactccaagtccagatacctggcccacgtcgcacgccagcacagccggcccagagtccagccttgctttgagattggtcaatggcggggacaggtgccagggccgcgtcgaagtgctctatcggggaagctggggcactgtgtgtgatgattcatgggacacctccgacgcaaacgtggtgtgtcgacagctcgggtgtgggtgggccactagcgcccctggcaacgccaggttcggccaaggctcaggccctatcgttcttgacgatgtgcgttgctccggatatgagtcctacctgtggtcctgccctcataatggttggctttcgcacaactgccagcactccgaggacgctggggtaatctgctctgccgcccactcttggtccaccccaagtcctgacaccctgccaaccatcaccttgccagcgtcaacagtcggttccgagtcatcactggctctgagactggtgaatgggggggacagatgccagggccgggtggaggtgctgtatcagggctcctgggggactgtgtgcgacgactcttgggatactaacgacgccaacgtcgtgtgccggcagctgggatgtgggtgggccatgagcgcacccggaaatgccaggttcggtcaaggcagcggtccaattgtgttagacgacgtccgttgcagcggccatgaatcttacctgtggagctgcccccacaacgggtggcttagccataactgcggccatagtgaagacgcgggtgtaatctgctcggctagtcagtccaggcctacgcctagtcctgatacttggccgacctcccacgccagtacagctgggagcgagtcgtcacttgcgctgcgtttggtgaacggcggggatagatgtcagggcagggtggaagtactctatagaggaagttggggcactgtatgcgatgactactgggatacaaacgacgcaaatgtggtgtgcaggcagctggggtgtggttgggctatgtctgccccagggaacgctcgctttggacagggctcaggaccaattgtgctcgacgacgtacggtgtagcggtcatgaaagctatttatggagctgccctcacaacggctggctgtctcataattgcggccatcatgaagatgctggcgtcatctgttcggcttcccagagccagcctacaccctctccagatacatggcctacttcacacgcctcgaccgccgggtctgagtcttctctcgctttaaggctcgtcaatggcggagatagatgtcaagggagagtcgaggtgctgtaccgaggcagctggggtacagtgtgcgacgattattgggatactaatgatgctaacgtggtgtgtcgccaattggggtgcggctgggccacctctgccccaggcaacgctcgtttcggtcaggggagcggcccaatcgttctcgacgatgtgcggtgcagcgggcacgagagttatctgtggagctgtccccacaatgggtggctttcacataactgtggtcaccacgaggatgccggcgttatctgcagtgcctcccaatcccagcctactcccagccctgacacctggcccacatcccgagcctcgactgccggttccgagtcaaccctcgcactgaggctagtgaatggaggggacaggtgccgcggacgagtggaagtactatatcaggggtcttggggcacagtgtgtgacgactattgggatactaatgacgcgaatgtggtatgccgtcagttaggctgcggctgggcaatgtcggccccgggtaacgcacaatttggacagggtagcggaccaattgtactggatgatgtgcggtgctcagggcacgaatcatacctatggagctgtccccacaacggttggctctcacataactgtggacaccatgaagacgcgggtgtgatttgctctgccgcacagtcacagtcgacaccaagaccagatacctggctgactaccaatctgcccgccctcaccgttggcagtgaaagcagcctggctctcagactcgttaatgggggggatcgatgtagaggtagggtagaggttctgtatcgaggtagctggggcaccgtctgcgatgactcctgggatacaaacgacgcaaatgtcgtgtgtagacaactcggttgtggttgggccatgtcagctcccggtaatgcaagattcggtcaagggagcggccccatcgtgctcgatgatgttcggtgcagcgggaacgaaagttatctatggtcctgcccccataaaggctggcttacacacaattgcggtcaccacgaggatgccggagtgatctgttcagccacacagataaactctacgaccaccgactggtggcaccctactacaactacaacagctagaccctctagcaattgcgggggtttcttgttttacgcaagtggaactttctcatctcctagctatcccgcctattatcctaacaacgctaagtgtgtatgggagattgaggtgaactctggctaccgaatcaatttgggatttagcaatttgaaacttgaggcccatcataactgctcctttgactacgtcgagattttcgatgggagtctcaacagcagcctgctgctgggtaagatttgtaacgatacacgccagatcttcacatcctcgtacaacagaatgacaatccattttcgaagtgatatctccttccagaataccggttttctggcctggtacaacagcttcccgagcgacgccacacttagactggttaatttgaatagtagttacgggctctgcgccggaagggtggaaatttaccatggcggcacttggggcacagtgtgtgacgattcctggacgatacaagaggctgaggtcgtttgccgtcaactgggatgcgggcgtgcagtatccgccctgggaaatgcttatttcggcagcggaagcgggcccattactttggatgatgtggagtgctctggtactgaatctactctttggcaatgtagaaataggggatggttctcacataactgtaatcacagggaagatgctggtgtgatttgcagtggcaatcacctgagcactcccgctcccttcctgaatattactcggccaaacactgactactcgtgcggcggcttcctgtctcaaccctctggagacttcagctctcctttttatccgggcaattatcccaacaacgcaaaatgtgtctgggatatcgaggtgcagaataattacagggtgaccgtcatcttccgcgatgtgcagttggaggggggctgtaactacgactacattgaggtgtttgatggcccctaccgctcaagcccccttattgcgcgcgtgtgcgatggagcccgaggttctttcacctcttcatcaaattttatgtctatacgattcataagcgaccatagcatcacaagacgtggctttagggcagaatattatagcagccctagcaacgactcgaccaacctactgtgtttaccaaatcacatgcaggcctctgtgagcaggagctacttacaaagcctgggcttctcggccagtgatctggtgatatccacttggaacggttactatgaatgccgaccacagataacccctaacttggtcattttcaccataccttactcaggctgcggcaccttcaagcaagccgacaacgataccatcgactattccaacttccttaccgccgctgtctccggcggcatcatcaagagacgcaccgatctacgcatccatgtctcgtgtcggatgcttcagaatacatgggtggacaccatgtacatcgcaaatgataccatacatgtggctaataataccattcaagtcgaagaagtgcagtatggaaacttcgatgttaacataagtttctatacaagcagctcctttctgtatcccgtgacctctagaccttattatgtggacttaaaccaggacctgtacgtgcaggcagaaatcttgcatagtgatgcagtgttgacgttgtttgtggacacctgcgtcgcttcaccttatagcaatgatttcacctctttaacatatgatcttatccgcagtgggtgtgtgagagacgatacatatggtccttattcatctccatcacttaggattgcacggtttcgcttccgggccttccactttttgaacaggtttcctagcgtctacctgagatgcaaaatggtagtctgccgcgcatatgacccgagtagtcggtgctaccggggctgtgtgctgagatctaaaagggatgtcggttcgtatcaggagaaagttgacgtggtcctgggcccgatccaattacagactccacctcggagagaagaggagcccaggtag

SEQ ID NO: 23850 - DNA, 7242 bp, Artificial Sequence
  Description of Artificial Sequence: Synthetic coding sequence
atgggcatcagcaccgtgatcctggagatgtgcctgctgtggggccaggtcctcagtactgggggatggataccgagaactactgattatgctagcttaattccgtcagaggttcccctagatcccaccgtggccgaaggaagcccttttccatctgaaagtacccttgagagcactgtggcagaaggcagcccaatttctctggagtctaccctggagtcgaccgtggctgaaggttccttaattccatccgaaagtactcttgagtctacagttgctgagggttcagattctggcttggccctgcgcctggtgaacggggatggtcgatgccaaggaagagtggagatcctgtaccggggatcctggggaactgtctgtgatgacagttgggacacaaacgatgctaacgtagtatgcagacagctggggtgtggctgggccatgtcagcgccgggcaatgcctggttcgggcaggggagcggcccaattgctttagatgacgtaaggtgtagcggacatgaatcttacctgtggagctgcccgcataatggatggctgagtcacaattgcgggcacggggaggacgccggcgttatttgcagcgccgctcagccacagtcaaccctgaggccagaatcatggcctgtgcgtatctcgcccccagtacctacagaaggcagcgagtcctccctggcccttaggctggttaacggcggggatcgatgcagggggagggtagaggttctgtatcgaggatcatgggggactgtgtgcgacgattactgggacaccaatgacgctaatgtggtgtgtaggcaattgggatgcgggtgggcaatgtctgcacccgggaacgcacagttcgggcaggggtcagggcccatagtgctggatgacgtccgttgttcaggccacgagtcctacctgtggagttgtccacacaacgggtggctgacccacaattgcggccactcagaggacgctggagtgatttgctcagcaccacaatctcggcccaccccctcccccgacacctggccaacctcccatgcctctaccgcaggaccagaaagttccttagcactgagactggtgaatggaggcgacaggtgtcaagggcgcgtggaagttctgtatagaggatcatggggaactgtgtgtgatgactcttgggatacctctgacgccaacgtggtctgcaggcagctgggttgcggctgggcaacatccgcacccggcaacgcccggttcggacaggggtcgggccctatcgtgttagatgatgtgaggtgtagcggttatgagtcctatctgtggtcctgcccccacaatggttggctgtcgcacaattgccagcacagcgaggacgccggcgttatatgttctgctgctcattcgtggagcaccccttctcccgataccctgccaactattaccctgcccgcttcgacagtcggctccgaatcgtcgctggcccttagacttgtaaacggtggcgataggtgccagggacgagtggaggtgttgtataggggctcatggggtacagtctgtgatgactcctgggacacaaatgatgctaacgtcgtatgtaggcagctgggttgcgggtgggccatgctggcccctggcaacgcccgcttcggacaggggagcggcccaattgtgctcgacgacgtgcgatgttcaggtaacgaaagctacctgtggagttgtccacacaatggttggcttagccataattgtggccactccgaggacgctggtgtgatatgcagcggccccgagtcaagccttgccctgaggctggtaaacgggggggatcggtgtcaggggcgggtcgaagtgctctatagaggaagctggggaacggtgtgtgatgattcatgggacacaaacgatgccaatgtcgtctgccgacaattgggatgcggctgggcaacaagtgctcccggaaacgcaagatttgggcagggcagcgggcccatcgtcttagacgatgtccgctgttcaggccacgagagctatctgtggtcgtgcccgaataatggatggctgtcccacaattgtggacatcatgaggacgctggagttatttgcagtgccgctcagagccgatccaccccaaggccagacacgctgtccacaattaccctccccccgtccaccgtcggttctgaatctagtctcacgcttaggctcgttaacggatcagacaggtgtcagggaagagtggaggtcctgtaccgcggatcttggggtaccgtatgtgatgacagctgggataccaacgatgccaacgtggtgtgccgccagctgggatgcggatgggccacaagtgctcccggcaacgctaggttcggacagggatcaggccctatcgtgctggacgatgtgcgctgctccgggcatgagtcatatttgtggagttgcccccacaacgggtggctctcccacaactgtggtcaccacgaggacgcgggtgttatctgctcggtgtctcagagtagacctactccctctcccgacacctggccgacttcacatgcctccactgctggccctgaatcctcactggctctgaggctggtcaacggcggtgacaggtgccagggcagggtggaggttctatataggggttcttggggaactgtgtgcgatgactcttgggatacgtccgacgcaaatgtggtgtgccggcaactcggatgcgggtgggcgacttccgcaccaggcaatgccaggtttggccagggctcagggccgatcgttctcgatgacgtgcggtgcagtggttatgaaagctatttgtggtcttgtccgcacaatgggtggctgtcacacaattgccagcattctgaggacgctggagtcatatgcagcgccgcacactcatggtccacacctagccccgacaccctccctactatcacacttccggctagcactgtcgggtcagagtctagcctggccctgaggctggttaacgggggcgatcgctgtcaggggagagtcgaggtcctctatcagggtagctggggcacagtctgcgacgacagctgggatactaatgacgccaacgtcgtatgtaggcagctgggctgtggctgggccatgtccgccccagggaatgccagattcggccagggctctgggcctattgtcctcgacgatgtccgatgctccgggcacgaatcttacctgtggtcatgtcctcacaacgggtggttatcacataattgcgggcattccgaggatgctggtgtgatttgctcagcctcgcagagccgaccaacgccttcccccgatacgtggcctacctcgcacgcctcgaccgctggatccgagtctagcctggccctgcgcctggtaaatggaggcgaccgctgtcaaggccgagtagaggttctgtacagaggcagctggggaacagtgtgcgacgactactgggatacaaacgacgccaacgtcgtttgtcggcaactcggctgcgggtgggctatgtcagcccctggaaatgcgaggtttggccaagggtccggccctatcgttctcgatgacgtgaggtgcagcggacatgaaagctacctgtggtcttgtccacacaacggttggttgagtcataattgcgggcaccatgaagatgcgggtgtgatttgctccgcttctcagagccaaccaacgccatcacccgatacttggcccacttcacacgcttctaccgccgggtctgaatcttcattagctctgcgtctggtcaacggaggagacagatgtcaggggcgggtggaggtgctgtaccgtggcagttggggcactgtctgcgacgactattgggataccaacgacgccaatgtggtgtgtaggcagctggggtgtgggtgggctacctctgcacctggcaatgcgaggtttggacaggggagcgggcccatagttctggatgacgtgaggtgttccgggcatgaatcatatctgtggtcctgtccccacaacggttggctgagccacaactgtggtcaccatgaagatgcaggcgtcatttgtagtgcaagccagtcccaaccaacaccttcccctgacacatggccaacatcccacgcaagcacagcagggagcgaaagttccctcgctctgcgattagtgaacggcggggacagatgtcagggtcgggtagaggtcttgtacagagggtcatggggcaccgtctgcgacgactactgggatacaaatgacgcaaatgtggtctgccgccagctgggatgtggctgggctacatctgcacctgggaacgccaggttcgggcaaggcagtggtcctattgtactggacgacgtcaggtgctctggccatgaatcttatctctggtcttgtcctcataacgggtggctatcgcataattgtggccaccacgaggacgcaggagtgatatgttcggcgtcccagtctcagcctacaccaagtcccgatacctggcctacgtccagagccagcacggcaggtagcgaaagcacactcgctctgcgccttgtgaacggcggtgatagatgcaggggtcgcgtggaagtcctgtaccaggggtcctggggtacggtgtgtgatgactattgggatacaaacgatgctaatgtggtgtgcaggcagcttggttgtggttgggccatgtccgccccaggcaacgctcagtttggtcagggaagcggacctatcgtgttggacgacgtgagatgcagcgggcacgaatcgtacctgtggagctgtcctcacaacggttggttgagccacaattgcggacaccatgaggacgctggcgtcatatgttccgctgcgcagtcccagtcaactcctaggccagatacttggctaaccaccaacctcccagcactgaccgtaggcagcgagtctagccttgccctcagattggtgaacggcggagaccgctgcagaggccgggtcgaagtgttgtacaggggaagctggggcacagtttgtgatgactcctgggatacgaatgacgccaatgtcgtgtgtaggcaattgggatgcgggtgggccatgtccgctcccgggaatgctcgcttcgggcaagggagcggaccgattgtgctcgacgatgtgcgttgttctggaaatgaatcgtatctgtggagctgccctcacaagggttggctgacacacaactgcggccaccacgaagacgcaggggttatatgcagcgccactcagatcaacagtacaaccaccgattggtggcacccaactaccaccacgacggctagaccatcctctaactgtggtggcttcctgttctacgccagcggcaccttttcctccccctcttatcccgcgtactacccaaataacgcaaaatgcgtgtgggaaatcgaggttaatagtggctaccgaatcaacttaggcttctcaaacttgaagctggaggctcaccataactgcagcttcgattatgtggagatcttcgatggcagtttgaactcgagtctgcttttgggtaagatctgtaacgacactcgtcagatattcacatcatcttacaatcgtatgacgatccactttagatctgatattagttttcagaacactggttttctcgcttggtacaattcatttcctagcgatgctaccctgagactggtcaatctcaactcctcatatggactgtgtgccggccgcgtcgagatctaccacggagggacatgggggacagtgtgcgatgatagttggacaatccaggaggccgaggtggtctgtaggcagctcggatgcggccgcgctgtctctgcattgggtaacgcatacttcggtagcggaagtggacccatcaccttagatgatgtggaatgtagcggcacggaaagcaccttgtggcaatgtcggaaccgcggttggtttagccacaattgcaatcatagagaggatgctggcgtgatctgctctggtaaccacctctccactccggctccctttctaaacatcacaagacctaacacagactactcgtgcggggggttcttgagccaaccctccggtgacttttctagccctttttaccctggcaactaccccaataatgcaaaatgtgtgtgggacatcgaggttcagaataattatcgtgtgaccgtgattttccgggatgtccagctggagggggggtgcaattatgactatatcgaagtgttcgacggcccctacaggtccagtccgctgatcgcccgcgtgtgcgatggcgcccggggatctttcacctcttcctctaactttatgtctattcgatttatctctgaccactcgataaccagacgaggctttcgcgcagagtattactcgtcaccctcgaacgattcaacgaacctgttatgtctgcccaaccatatgcaggccagcgtgagcagatcttacctccagagcttagggtttagcgccagtgatttagtcatctccacctggaatggatactacgagtgccgtcctcagattactcccaacctcgttatcttcacaattccatattccgggtgcggcacattcaagcaggctgataacgacacgatcgactattcaaacttcttaaccgctgccgtgagtgggggcatcatcaaacgccgaacggatctgagaatccacgtaagttgccgtatgctgcagaacacatgggttgataccatgtacatcgcaaacgacactattcacgtggccaacaacactatacaggtagaggaggtgcagtacgggaattttgatgttaatatcagcttttacacctcctccagcttcttatatcccgtgacatccagaccttactacgtcgacctgaatcaggacttatatgtccaggctgaaattctacactcagatgctgtcttaacattatttgtggatacttgcgtggcctccccctattccaatgattttacatccctgacctacgatctcattagatccggttgtgttagagacgatacatatggaccatatagtagccctagtctgcgtattgcacggttccggtttcgagcctttcacttcttaaatcgattcccatctgtttacctcagatgcaaaatggttgtatgtagagcatacgacccgtctagccgttgctacaggggctgtgtgcttcggtctaaacgagatgttggctcttatcaagaaaaagtggacgtagtgctgggacctatccaattacaaaccccacccagacgagaggaggaacctaggtag

SEQ ID NO: 23851 - DNA, 7242 bp, Artificial Sequence
  Description of Artificial Sequence: Synthetic coding sequence
atgggcatcagcaccgtgatcctggagatgtgcctgctgtggggccaggtgctaagtactgggggatggatccccagaacgacagattatgcctctctcatcccctctgaggtgcccctcgacccaactgttgctgaaggatctccattcccctcggaatcaacactggaatcgactgttgcagagggcagtcctatcagtctggagtctaccctcgaatctacagtggctgagggatcccttattccttctgagagtacccttgagagtaccgtggccgaaggctctgactccgggctggcactccgcttggtgaacggggatggccggtgccagggaagagtggaaatactgtaccgcgggagttggggtacagtgtgtgacgacagctgggataccaatgacgcaaatgtggtgtgccgacaactgggctgtggctgggccatgtctgcccctggaaacgcttggtttggccaaggctccgggcccatcgccctggacgacgttcggtgctccggacacgagtcttacctatggagctgcccacataatggctggctaagccacaactgcgggcatggcgaggacgcaggtgtaatctgtagcgccgcccaaccacaatccactctgcgtcccgagagctggcctgtgaggatttcccccccggtccccactgaaggaagcgaaagtagtctcgctttgcggctcgtaaatggcggcgacagatgtcggggcagagtagaagtgctgtaccgcggaagttgggggactgtgtgcgacgactactgggacaccaacgatgcaaacgtagtttgtcgccaactgggctgtggctgggccatgagcgccccggggaatgcccagtttgggcagggatcaggaccaatcgtgcttgatgatgtgcggtgttctggccacgaaagttacttgtggagttgtcctcacaacggctggctgacacataactgcggtcattccgaggatgccggagttatatgttctgcgccacagagtaggccaacaccaagtcctgacacttggcctaccagtcacgctagcaccgccggcccagagtcatctctggctttgaggctggtcaacggcggtgatcgttgtcaaggaagggtcgaggtgttgtacaggggctcctgggggacagtttgtgacgattcttgggatacaagcgatgccaacgttgtgtgcaggcagctggggtgcggctgggcgacaagtgccccaggtaatgcccgctttgggcagggtagcggtcctatcgtgctggacgacgtgcgctgcagcggctacgagtcttacctctggtcctgtccacacaacggctggctttcccacaattgtcaacactcggaggacgcaggggtaatctgtagcgccgctcacagctggtccaccccttcacctgatacactccctactataactctgccggcttctacggtcggatccgagagttccctagccctgaggttggtgaacggcggagatcgctgtcagggtcgggtcgaggtactgtaccgagggtcatggggtaccgtctgtgacgactcgtgggacactaacgatgcaaatgtggtgtgcagacagttagggtgtggctgggctatgctggctccaggaaatgcccggttcggacagggatccggccccatcgtcctggatgacgtgaggtgtagcggaaacgagtcatacctatggtcttgtcctcataatggctggctgtcacacaactgcggccacagcgaagatgcaggcgtgatctgctcaggccccgagtcatccttggcccttcggctggttaatgggggcgaccgctgccaaggaagagtcgaagtcctttatcggggatcctgggggactgtgtgtgatgattcctgggacaccaatgatgcaaatgtagtctgtagacaattaggctgcgggtgggctacctctgccccagggaatgcacgcttcggacagggcagcggccctatcgtccttgatgacgtcaggtgttccggacatgagagttatctgtggtcctgccccaacaatggttggctcagccataactgcgggcaccatgaagatgctggagtcatctgtagtgccgcgcagagcaggagtacccccagacctgacaccctgagcacaattacactccctccgagtactgtgggtagtgaatcatcactcactctgcggctggttaatggctctgaccgctgccagggcagggtggaggtgttatacagaggctcttggggcactgtttgtgatgactcatgggatacaaatgacgccaatgtcgtgtgcaggcagctcggttgtggctgggccactagcgcgcccggaaatgccaggttcggccagggatcaggacctatagtgctggacgatgtgcgttgtagcgggcatgaaagttacttgtggtcatgtccccacaacgggtggctgtcccacaattgtgggcaccacgaagatgcgggtgtcatttgtagtgtttcccagtccagaccaaccccatccccagacacatggccaaccagccacgcctcaacagccgggccagaatcttcactcgccttgcggttagttaacgggggcgaccgctgccaaggccgagtggaggtgctttatcgtgggtcctggggcaccgtctgcgatgatagctgggacacatccgacgcaaatgtggtttgccgacagttagggtgcggatgggccacctccgctccaggcaatgcaagatttgggcagggcagtggtccaatcgtactcgatgacgtccgttgctctgggtacgagtcttacctctggtcttgcccacacaacgggtggctgtcacataattgccagcactccgaggatgcaggagtgatctgttcagcggcccacagttggtcaacaccttcccccgacactctgccgacaatcaccctgccggccagcacagtgggatccgaatcgtccctcgccctgcgtttagtgaacgggggggaccgctgtcaaggaagagtggaagtgctctatcagggcagctggggcaccgtctgcgatgacagttgggatacgaacgacgcaaacgttgtctgcagacaactgggctgcggttgggccatgtctgcgccaggaaatgcacgttttggccagggatctggccccattgttcttgatgatgttaggtgttctggccatgagagctacctctggagctgtccacataatggatggctgtctcataattgcggacacagcgaagatgctggcgtcatctgcagcgctagccaatcccggcctacaccatcccccgatacgtggcctaccagccatgcaagcaccgcaggctccgagagcagcctggctctaagactcgtgaatggaggagatagatgccagggccgcgtggaagtactttaccgcggatcatggggaactgtttgcgacgattattgggacactaacgacgccaatgtggtgtgccgtcaactgggctgcggctgggctatgagcgcaccggggaacgcacgctttggacagggctcaggtcccatcgtgctggacgatgtcaggtgtagtgggcatgaatcgtatttgtggagttgtccacacaatgggtggctctcccacaattgtggccatcacgaagatgccggggtgatctgttctgctagccaatcccagcccactccctctcccgacacatggccgacttctcatgccagcacagctggatctgagagcagtctggccttaaggctggttaacggcggcgatcggtgccaggggcgagtcgaggtactctaccggggttcctgggggactgtgtgtgatgattattgggacactaatgatgccaatgtcgtgtgcaggcagctcggctgtgggtgggcaacctccgccccggggaatgcaagatttggacaagggagcgggcctatagtgctggacgatgtgcgatgctcaggtcatgagagctacctgtggtcatgccctcacaatgggtggttgtcccataactgtggacaccacgaggacgcaggtgtaatctgttctgcctctcagtcacagccaacccccagccctgacacctggcctacatctcacgcttctactgccggcagtgagtcttccctggctttgcgcttggtaaatggaggcgacaggtgtcagggacgagtggaggtgctgtaccgcggatcttggggcacggtttgcgacgattattgggataccaacgacgccaacgtcgtctgtagacagctgggctgcggttgggcgacatccgctcctggcaatgctcgctttggacagggatccggacccatagtactggacgatgtgcggtgcagtgggcatgagagttatctctggtcatgtccccataatggctggttatctcacaattgtggccatcatgaggacgccggggttatttgttccgcatcacagtctcaaccgactccttcacctgatacctggcctactagcagggcctctactgccggttccgagagcacactcgccttgagactggttaacggtggagacagatgtagaggcagagtagaagtcttgtatcaggggtcgtgggggacagtttgcgacgattactgggacacaaatgatgcaaatgtcgtgtgtagacaactcggatgcggatgggccatgagcgccccaggaaacgcgcaatttggccaaggaagtgggcctatcgtcctggatgacgttcggtgcagcgggcatgagtcctacctgtggtcctgtccacataacggctggctctcacacaattgcggccatcatgaggatgccggggtgatctgttctgccgcacaaagtcagtcaaccccacggcccgacacatggttgacaacaaatctgccagctctgaccgtagggtctgaatctagtctcgctctgaggctcgtcaatggtggagatcgatgcaggggcagggttgaggtcctctataggggaagctgggggacagtgtgcgacgattcctgggatacaaatgacgccaacgtggtttgtagacagctcggatgcggctgggcaatgagcgccccaggcaacgcgcgtttcggacaagggtctggaccgattgtgctggatgacgtgcgctgcagcggcaacgagagctacctgtggtcgtgccctcataaaggctggcttacgcacaactgtggccatcacgaggatgctggtgttatctgtagcgccactcagatcaactcgacaacaacagactggtggcatcccaccacaaccactacagccagacccagctcaaattgtggaggattcttgttctacgccagtggcactttctcatccccatcttatcctgcatactatccgaataacgcaaaatgcgtgtgggagattgaggtcaattccggctacaggattaatttgggcttttccaatttaaaattggaagctcatcataattgcagtttcgactacgtagagatttttgatggaagtttgaattccagcttgctgctgggcaaaatctgcaacgatacccggcagatttttacctcatcctacaataggatgaccattcacttccgaagcgacatctccttccaaaatactgggttcctggcgtggtacaactcctttccatctgatgctacattgcggctcgtgaatttgaactcatcctatggcctttgcgccggacgggtggaaatataccacggcggcacctggggcacagtgtgcgacgactcttggaccatccaggaggccgaggtggtgtgcaggcagttagggtgcggccgcgcagttagtgctttggggaatgcttacttcgggtctggtagtggacccataacgctggacgatgtagagtgtagcggcactgagagcaccctgtggcagtgcagaaaccgagggtggttctcacataactgcaaccatagagaggatgccggcgttatctgttctggaaaccacctgtcaacccctgcaccttttcttaacattacccggccgaacaccgactacagctgcggaggttttctgtcacagccaagtggagatttctccagcccattctatccaggaaactatcccaataatgcaaaatgtgtctgggatatcgaggtgcaaaacaactaccgggtcaccgtgattttcagggacgtccagctggaagggggatgtaactacgattacattgaagtgtttgacggcccctaccggtccagcccactgatcgctagagtgtgcgatggcgctagggggtcattcacgtcttcttccaattttatgtccatcaggtttatcagcgaccatagtatcacccggaggggatttcgtgcagagtattactcctccccaagtaacgattctactaacctgctatgcttgcctaatcatatgcaggcctccgtgtcaagaagctaccttcaatccctggggttctctgcctctgacctggttatcagcacgtggaacggatattacgaatgtaggcctcagattacccctaatctcgtcatctttactattccctattctgggtgcgggactttcaagcaagccgacaatgatactatcgattacagcaactttctgacagcggcagtgagtggcggaatcatcaagcgcagaacagacctgagaattcatgtgagctgtagaatgctgcaaaacacttgggtggatacaatgtacatcgcaaatgacaccattcacgtggccaataacactatccaagtagaggaagtgcagtacggcaatttcgatgttaacattagcttttacacaagcagctcatttctttaccccgtgacatcacgaccatattatgtcgatctgaatcaagatctgtacgtgcaagcggagatcttgcactcagacgcggtgctgacactgtttgtcgacacttgtgtggcatccccgtacagcaatgattttacaagcctgacatacgaccttatcagaagcggctgcgttagagacgatacttacggcccatattcttcaccgtcattgagaattgcccgttttaggtttcgagcgttccatttcctcaacaggttcccaagcgtatatctgcgctgcaaaatggtggtttgccgggcatatgatcctagttccaggtgctaccgcgggtgtgtcctcagatctaagcgcgatgtagggagctatcaggaaaaagtcgacgtcgtgttagggcccattcaactgcagacaccaccacggcgcgaagaggagccgaggtag

SEQ ID NO: 23852 - DNA, 7212 bp, Artificial Sequence
  Description of Artificial Sequence: Synthetic coding sequence
atgggcatcagcaccgtgatcctggagatgtgcctgctgtggggccaagtgctcagcacaggtggttggattccaaggacaactgattacgcctcccttatacccagcgaggtccccctggaccctaccgtggccgaaggctctcctttccctagcgagtctactcttgagtccaccgtagccgaaggctcccccatatcattagagagcaccctagaatctaccgtcgctgaggggagcctgatcccttcagaatctaccctggagagcactgtggccgagggtagcgattctggcctggcgcttcggcttgtcaatggggacggacgctgccaggggagagtggagattctctaccgtggttcctggggaaccgtttgtgacgacagctgggacaccaacgacgctaatgttgtttgcaggcaattagggtgtggctgggcaatgtctgcgcccggtaatgcatggttcggacagggatccggaccaatcgccctggatgatgtcagatgctccggccacgagagttatctttggagctgtccccacaatggttggttgtcccataactgcgggcacggggaggatgcaggcgtgatctgctccgctgcgcagccccagagcactctaagaccagaatcctggccagttaggataagtccccccgtgcccaccgagggaagtgaaagcagcctggcccttcgactagtgaatggaggggatcgatgcaggggtcgcgtagaggtgctgtaccgagggtcctgggggacagtttgcgatgattattgggacacgaatgacgccaacgtagtctgtcggcagcttgggtgcgggtgggctatgagcgccccaggcaacgcccagtttgggcagggatccggtccaatagttctcgatgacgtcagatgtagtggacacgaatcatatctttggtcgtgtcctcataatggatggttaacccacaattgtggtcatagtgaggatgcaggggttatctgtagtgcgccacagtcaaggcctacgccatcacccgacacatggcctactagtcatgccagcaccgcaggaccagaaagttctctggctctgaggttagttaacggaggagatcgttgtcaaggccgcgtagaggtgctttatcgcggtagctggggtaccgtatgcgacgactcttgggacacgtccgacgccaacgtcgtatgtcgccagctcgggtgcggctgggccacttcagcgcctggcaacgccaggtttggacagggtagcgggcccatagtcctggatgatgtgagatgcagcggatacgagtcttacctttggtcttgccctcacaacgggtggctgtctcacaattgccaacattccgaagatgctggggttatctgcagtgacacattgcctacaataactctgcctgcttccactgtcgggagtgaatccagtttagctctacgactggtgaacggaggcgatcggtgtcaaggccgtgtggaagttctgtataggggcagttgggggaccgtctgcgacgactcttgggacactaacgatgcaaatgtcgtctgccggcagttgggatgcgggtgggccatgctcgccccaggaaatgcgcggttcggccaggggtcaggacctatcgtgttggacgacgtgaggtgtagtggcaacgaatcgtatttgtggagctgcccccacaatggctggctgagccacaactgcggtcactcagaggatgcaggtgtgatatgttccgggccagagtcttctctggctctccgcctggttaatggaggcgaccgctgccagggcagggtcgaagttttatatcgtggctcgtggggaacagtctgcgacgactcttgggatacgaatgacgccaacgtggtctgtcgccagctcggctgcgggtgggccacgtccgcccctggcaacgcacgctttggtcagggctcagggccgatcgtgctggatgatgtgagatgttctggccacgaaagttacctgtggtcatgtccaaataatggttggctgagtcacaactgcgggcatcatgaggacgccggtgttatttgctccgccgcgcagagccgatcgacccctcggcctgacactcttagtacaattacgctccctccctctacagtgggatctgagtcatctctgaccctgagacttgtgaacggcagcgataggtgccagggtagagttgaggtgctgtaccgcggcagttggggaacagtttgcgacgactcctgggatactaatgacgcaaatgtagtgtgtagacaactgggctgcggatgggctacctctgctcctggcaacgcccgttttggacaggggtcagggcctatcgtgctggacgatgtacgatgcagcggacacgaatcttatctatggtcgtgcccccataacggctggctaagccataattgtggtcaccacgaggatgccggggtaatatgtagcgtgtcgcagagcagaccaacaccatctcctgacacctggccaacctctcacgcttcaacagcagggccagagtctagtctggcccttaggctggttaatggtggcgatcgttgtcagggaagagtggaggtcctttatcggggtagctggggcacagtttgcgatgatagctgggatacaagtgacgccaatgttgtgtgccggcaactggggtgtgggtgggcaacgtccgcacccgggaacgctcggttcggccaagggagcggtcccatcgtccttgacgacgtgagatgttcaggctacgaaagctacctgtggtcctgtccgcacaatgggtggctctcacataattgccagcattcggaagacgccggagtgatctgcagcgcagctcattcctggtcgactccaagcccagacaccctgcccaccattactctgcctgctagtacggtgggcagtgagtcttccctggctcttagactagtgaacggcggcgacagatgtcaggggcgcgtagaggtgttgtatcagggcagctggggaaccgtctgcgacgattcgtgggacacaaatgacgccaatgtggtatgtcgacagcttggatgcggctgggccatgtctgcccctgggaacgcccggtttgggcagggctccggccctattgttctcgatgatgtgcggtgtagcgggcacgaatcctacctctggtcctgcccccacaatggatggctgagccacaattgtgggcacagcgaagacgccggagtcatttgcagtgcaagtcaatctcggcccacccccagtccggacacatggcccacctcacacgcctctacagccgggtccgagagctctcttgcactccgtttggttaacgggggggatagatgccagggcagggtggaggttctttacagagggtcctggggcaccgtgtgcgatgattattgggacaccaacgacgccaacgtcgtgtgcaggcagttgggttgtgggtgggccatgagcgctcccggcaacgcaagatttggccaggggtccggccctatcgtactagacgatgtccgatgctcaggtcacgaatcatacctatggtcatgcccccataacggctggctgagtcacaattgcgggcaccacgaggacgccggagtaatttgtagcgcaagtcagtcccagcccacgccctctcctgatacgtggcctaccagccatgccagcactgccgggtctgagtcctctttggcgttgaggctcgtcaacgggggcgatcggtgtcaaggaagagtggaagtgctgtaccggggctcgtggggcactgtttgcgacgactactgggataccaatgatgccaacgtagtgtgcaggcaacttggttgtggctgggcaacttcagctccaggaaacgctagatttggccaggggtccggccccatcgttctcgatgacgtgcgctgctcagggcacgaatcctacctatggtcatgtccacacaacggctggctcagccacaactgtggtcaccacgaagacgcgggagtgatctgttctgcctctcaaagccagcctacccccagcccagacacctggccaaccagccacgcaagtactgcaggctctgaaagcagcctcgcgctaagactagtaaatggtggagatcgctgccaaggccgcgtcgaggtactgtaccgcgggagctggggcactgtgtgtgacgattactgggacactaacgatgctaacgttgtgtgtcgccaactgggctgcggttgggccaccagtgctccaggaaacgcgagattcggccaaggatcaggccccatcgtcctggatgacgtcaggtgctctggccatgagagctacctgtggtcttgtccccacaatggctggctctcacataattgcggacaccacgaggatgcgggggtgatttgctcagcttctcagagccagcccaccccatccccagacacgtggcccaccagccgcgcgtcaacggctggctctgaatcaaccctcgcactcaggctggtcaacggaggcgatcggtgcaggggccgcgttgaagtattgtatcaaggctcctggggcactgtttgtgatgactactgggatacaaacgacgcaaatgtcgtttgtcgccagctcggatgtggatgggctatgtcagcccccggcaacgcgcagtttggccagggctctggccccatcgttctcgatgacgtaagatgtagcggccacgagagttatctctggtcctgcccacacaatggctggctgagtcacaattgcgggcaccacgaagatgcaggcgttatttgcagcgcagcacagtctcagagcacaccccgaccagatacctggctgacaacaaacttaccagcactaaccgtcggaagcgagtcctctctagccctgaggctggtcaatggaggcgacagatgtaggggaagagttgaagtgctctaccgcggatcgtggggcactgtttgtgatgactcttgggacacaaacgatgctaatgtggtgtgcaggcagcttggctgcgggtgggccatgtcggcccctgggaatgcccgattcggccaggggagcggccctattgttttagatgacgtcagatgtagtgggaacgagagttacttatggtcatgccctcacaagggttggcttacgcacaattgcggtcatcacgaagatgccggcgtgatttgctctgctactcagattaactccaccacaaccgactggtggcaccccaccaccaccacaacggctcggccatccagcaactgcgggggctttctattttatgctagcggtaccttcagctcaccttcctacccagcttactatccaaacaatgctaaatgtgtatgggagatcgaagtcaactccggctatcggattaatctgggttttagtaaccttaagctggaagcccatcacaattgcagctttgactacgttgaaatctttgatgggagcctgaacagtagcctgttactcggcaagatctgcaacgatacccgccaaattttcacttccagctataacaggatgaccattcactttcggtctgacatttccttccaaaacaccgggttcttagcatggtataatagcttcccatctgacgcaactttaagactggtgaatttgaacagtagttatggcctgtgcgcgggccgcgtggagatctatcacggtgggacgtgggggacggtgtgtgacgattcatggactatccaggaagctgaggtcgtgtgcagacaactgggctgtggaagagctgtttcggccctgggcaacgcctattttggttccggatccggccccatcacactagatgatgtggagtgtagcggaactgaaagtaccctgtggcagtgcagaaacaggggatggttcagccacaattgcaatcacagggaagacgccggggttatttgctctgggaaccacctgagtacacctgctccgttcttgaacatcacacgtcccaataccgactattcttgcggaggattcctctctcagccgagcggcgacttttcatccccattttaccctggtaattacccaaacaacgccaagtgtgtgtgggatatcgaggtgcagaacaactatcgcgtgacagtcatctttagggatgtacaactggaagggggctgcaactatgactacatagaggtgtttgacgggccttatcggtcttctcccctgatcgcaagagtttgcgatggagcgagagggtctttcactagttcatccaatttcatgagcatccgctttatttctgaccactcgataactcggcgaggctttcgcgctgagtactactcttcaccctccaacgatagcactaatctgctttgtctgcccaaccacatgcaggcttcagtgagccggtcttatctgcagagcctgggcttcagcgccagtgatctggtcatcagcacatggaacggctactatgagtgccggcctcaaatcacccccaacctcgtgatttttactataccctactcaggatgcggcacattcaagcaggcagataatgacaccatcgactacagtaacttcctgacagctgctgtctctgggggcattattaaaaggcggaccgacttgcgcattcacgtgtcgtgtcgcatgctccagaacacatgggtagacacaatgtatatagctaatgatacaattcacgtagcaaacaatacaatacaggtcgaagaagtgcagtacggtaatttcgacgtgaacatctctttttacactagctcctccttcctgtatccagtgaccagtaggccgtattacgtggacctaaaccaggatctgtatgtgcaggcagaaattctgcatagtgacgcagttttgactctgttcgtggatacctgcgtggcttccccctattctaatgacttcacctctctgacatacgaccttattagaagcgggtgcgtacgggacgatacatacggtccttattcttcaccctctctgagaattgcacgctttcgcttcagggctttccattttttgaataggttccccagtgtctacttgcggtgcaaaatggtcgtctgtagagcgtacgatccctctagtaggtgctatcgggggtgcgtgctccggtctaagcgtgatgttgggtcatatcaagaaaaagtggatgtggttctggggcctattcagctgcagactccccctaggcgcgaggaagaaccgcgttag

SEQ ID NO: 23853 - DNA, 1680 bp, Artificial Sequence
  Description of Artificial Sequence: Synthetic coding sequence
atgaccatccacttccggagcgacatcagcttccagaacaccggcttcctggcttggtacaactcttttccctccgatgcaactctgcggctggtgaatttgaacagctcttacgggctctgtgcaggaagagtggagatctatcacggcgggacctggggaaccgtgtgtgacgatagctggactatccaggaggccgaggtcgtctgtcgacagctgggctgcggccgggccgtttccgccctaggaaacgcttactttgggagcgggtcaggtcctataacactggatgacgtcgaatgctcaggcactgaaagcaccctgtggcagtgccgcaatcggggatggttctctcataactgtaaccaccgagaggatgctggagtcatttgttctgggaaccacctgtcgaccccagcacccttcctaaatattaccagaccaaacactgattacagttgcgggggtttccttagccagccttccggagacttctccagtcctttctaccccggaaactacccaaacaacgctaaatgcgtctgggatattgaggtgcagaacaactaccgtgtgaccgtgatcttccgggacgtgcagcttgaggggggttgtaactacgactatattgaggttttcgacggaccttaccggagctcacccctgattgcacgagtgtgcgatggagctcgcggcagcttcacatcatcgtcaaactttatgagcattaggttcatctcagaccattccatcactaggcgcggatttcgcgctgaatactactcctctccaagcaacgacagcactaatttgttgtgccttcccaaccacatgcaggcctctgttagtcgaagctatttgcagagtcttgggttctcagcatctgatctagtgatttctacatggaacggttactacgaatgcagaccacagattacacccaacctggttatcttcactatcccctatagcggctgtgggacatttaagcaggcagacaacgacaccatagattattctaatttcctgacagccgccgtgtcaggtggaatcattaaacgaagaacggaccttaggatacatgtgagttgcaggatgctccaaaacacctgggtggatacgatgtatatcgctaatgacactattcatgtagcgaataacaccatacaggtagaagaggtccagtacggcaattttgacgtgaatatctccttctacactagctcatcctttttgtaccccgtgacatcacgtccctactatgtggatctgaaccaggatctgtatgttcaggcagagatcctgcacagcgatgcagtcttgacgctgttcgtagatacatgtgtggcttcaccgtactcaaacgattttacatcgcttacctacgacctgattcgctcagggtgtgtgcgcgacgatacgtacggcccgtattctagtcctagcctgcggattgcaaggtttcgctttcgcgcatttcacttcctgaatcggtttccgtctgtgtacttaagatgcaaaatggtggtttgccgggcctacgatcctagtagtagatgttataggggctgcgtgttgcgatccaaacgggacgtcgggtcctaccaggagaaggtggatgtcgtgttgggtccaattcagttgcaaactcccccacgtcgggaggaggaaccgcgttag

SEQ ID NO: 23854 - DNA, 3402 bp, Artificial Sequence
  Description of Artificial Sequence: Synthetic coding sequence
atgggcatcagcaccgtgatcctggagatgtgcctgctgtggggccaagttctgtcgacaggcgggtggataccaaggacaacagattatgcctcattgattcccagcgaagtgcccttggaccccactgtcgcggaaggttcaccctttccctcagagagtacactggaaagcaccgtagcagaaggaagccccatctcactggaaagcaccctggagtctacagttgccgagggcagccttatcccttcggagagcacactggagtcaaccgttgccgaaggatccgatagtggcctcgcgcttcggctggttaacggtgatggccggtgtcagggtagagtggaaatcttatatcggggttcctggggcaccgtgtgcgacgactcctgggatacaaatgacgcaaatgtggtctgtcgacagctcggttgtggttgggccatgtccgcacctggcaacgcctggttcggccagggtagcgggcctatcgccttggatgacgttcgctgctctggccatgaatcgtatctgtggagctgcccacacaacggctggctctctcacaactgcggccacggcgaagacgctggcgtcatttgtagcgccccacagagtcgcccaaccccgagtcccgatacatggccaacatcccacgcttccaccgccggctcagaaagcagtctcgcgctcaggctcgtcaatgggggagataggtgtcagggtcgggtggaagtgttgtacagaggttcctggggtaccgtctgcgatgactactgggacaccaatgacgccaatgtggtttgtcgacaactgggatgcggatgggccacgagtgccccagggaacgcaagatttggacaaggtagcggccctatcgtcctggatgatgttcgctgctctggacatgagagctacttatggtcgtgtccgcataatggctggctgagccacaactgcggtcaccatgaggatgcgggcgttatttgtagcgccagtcagagccagccgacaccttccccggacacttggcctacctccagagcttccaccgctggcagtgagtccacattggctctgcgcttagtgaacggaggtgacaggtgccggggtcgtgtcgaagtactgtaccagggctcctgggggaccgtctgcgacgactactgggataccaatgatgcaaacgttgtgtgccgacaactggggtgcggatgggccatgtcagcccccggtaacgcccagttcggtcagggttccggccctatagtcttggatgatgttaggtgctccggccacgaaagttatctgtggtcatgcccacataacggctggcttagtcacaactgtggccatcacgaggatgcaggcgtgatctgtagtgctacacagattaacagcactactaccgattggtggcatcccaccaccaccacaacagcacggcctagttctaattgcgggggattcttgttctatgctagtggcacgttctcatcaccatcctatccggcttactaccccaataatgccaagtgtgtgtgggaaattgaggtgaatagcgggtacaggattaacctggggttttcaaacttgaagctcgaggcgcaccataactgtagttttgattacgtagagatcttcgatggcagtctgaattcttcgctgctgttgggaaagatctgtaacgacactaggcagatctttacatcaagttacaatcgcatgactattcactttcgcagcgacatctccttccagaatactggattcctggcctggtataacagcttcccaagcgatgccaccctccggttagtgaatctgaattcctcttacgggctctgtgccgggagggtcgaaatctaccatgggggtacctggggtactgtgtgtgatgacagttggaccattcaggaagcagaggtggtctgcagacagctcggatgtgggcgagccgtttcggcactcggcaacgcttatttcggctctggtagcggccccattactcttgatgatgtggagtgttctggtactgagagcaccctttggcaatgccgcaatcggggatggttctcacacaattgtaaccaccgggaagacgcaggcgtgatttgtagtggaaaccacctaagcacgcccgctccctttttgaatataacaagaccaaatacagattattcctgcggcggttttctttcgcagccttctggggattttagcagcccgttttaccccggaaactatcccaataatgctaaatgtgtgtgggatatcgaggttcagaacaactatcgcgtcaccgttatctttagggacgtgcagctggaaggcggttgtaactatgactatatcgaggtattcgacggcccatatagaagcagccccctgatcgcacgtgtttgtgatggggccaggggaagtttcaccagctcctctaatttcatgtctatccggtttatctctgaccattctataaccagaagaggcttccgggctgaatattattcaagcccatcaaatgactccacaaacctgctgtgtctgcctaatcacatgcaggcatccgtgtcaagaagttacttacagagcctggggttttccgcatccgaccttgtcatatctacctggaatggctattatgagtgccgtcctcagataacacctaacttggttatcttcactataccttactctggatgcggaacatttaagcaagcggacaatgacactatagactattctaacttcctgaccgcggccgtgagcggcgggatcatcaagcgtcgcaccgatttgcggatccatgtgtcttgtaggatgctgcagaatacttgggtggatacaatgtatatcgccaatgacacaatacatgtggcaaacaatacaatccaagtggaggaggtgcagtacggaaacttcgacgtcaacatttcattttatacctctagtagctttttgtacccagtcaccagccggccgtattatgtcgatctcaaccaagacctctacgtgcaagccgaaattctccactccgacgctgtgctgaccctgtttgtggatacctgtgtggcctccccatacagtaatgattttacttcgctgacctatgatcttatcagatccggttgtgtgcgcgacgacacatacgggccgtactctagtcccagtctgcgcattgcgagattcagattccgcgcatttcatttcttaaataggttcccctccgtatacctgaggtgtaaaatggtggtgtgccgggcttatgatccttcgagtcggtgttacagaggctgcgttcttcgttccaagcgagatgtgggtagttaccaggaaaaagtcgacgtcgtcctaggccccatccagttgcagacgcctcctaggagggaggaggaaccacggtag

SEQ ID NO: 23855 - DNA, 7242 bp, Artificial Sequence
  Description of Artificial Sequence: Synthetic coding sequence
atgggcatcagcaccgtgatcctggagatgtgcctgctgtggggccaggtgctatctactggtggttggatcccccgcacaacagactacgcgtctctgatcccctccgaagtgccactggatcctactgtggcagaagggagccccttcccatcagagtccaccctggagtcaacagtcgccgaaggctccccaatctctttagagtcaaccctggaaagtaccgtggctgagggttcactgattccatctgaatctaccttggaatccacggttgccgaagggtctgatagcggactggcgctgagactggttaacggagatggtcgctgccagggccgggtggaaatactctatagaggatcctggggcacagtctgcgacgatagctgggacactaacgatgccaacgtagtctgtcgccagttgggatgtggatgggccatgtccgcccctggcaacgcctggtttggtcagggctccggccctattgcacttgacgacgtgcgatgtagcggccacgaaagctacttgtggagctgtccacataatggatggctttcacataactgcggacacggcgaggatgctggagtcatttgctccgcagctcagccacagtccaccctgcgccccgagtcgtggcccgtgagaatatccccccctgtccctaccgagggctctgaaagctcacttgcactgagactcgtgaacgggggagatagatgccggggccgggtagaggtcctatatcgaggcagctggggcaccgtgtgtgacgactattgggataccaatgacgccaacgtggtatgtagacagcttggttgcggatgggctatgagcgctccggggaatgcccagtttggccagggcagcggacccatagttctggatgatgttaggtgttccggacatgaaagctacctgtggagctgcccacacaatggttggttgacccacaactgcggacattctgaggatgctggggtcatttgttctgcacctcaatctcgaccaacccccagtccggacacttggcctacttcccatgctagcactgcagggcccgaaagcagcttggcacttcgattagtcaatgggggggataggtgccagggcagggtggaggtgttatatcgcggcagctggggcacagtgtgcgacgatagttgggatacctctgatgctaacgttgtatgccggcagttgggatgcgggtgggcgacctctgcccccggcaacgcccgattcggacaaggcagtgggcccattgtgctcgacgatgtccggtgtagcgggtacgaatcctacctgtggtcgtgcccccataacggttggctatcacacaactgccagcattccgaagacgccggagtgatctgctccgccgcacattcttggagcaccccctccccagacactctaccaacgatcactttgcctgctagtactgtgggatccgagagctccctggccctaaggctggtcaacggaggggaccgctgtcaagggagagtagaggttctgtatcgaggtagttgggggaccgtatgcgacgatagctgggacactaacgatgcaaacgtcgtttgtagacaactcgggtgtgggtgggcgatgctcgcccccgggaatgccaggttcggacaagggtccggccctatcgtgctggacgacgtcaggtgttctggcaatgagtcctatctgtggtcctgtcctcataatgggtggctgtcccacaactgcggacactccgaggacgccggcgttatatgttccggaccagagtcatccttggccctgcggctggtcaacgggggggacagatgccaggggagagttgaagttttgtaccgcgggtcatgggggacggtttgtgatgattcctgggacaccaacgacgcgaatgtagtgtgtcggcagctcggttgtgggtgggctactagcgcacctgggaacgctagatttggtcagggtagcggacccattgtcctagacgacgttcggtgctcaggacacgaaagctatctatggtcatgtccaaacaatgggtggctttctcacaattgcggccaccatgaggatgcaggcgtgatctgctcagccgcgcagtcacgcagcaccccacgtccagatactttatcgaccattacgttgccacccagcaccgttggttctgagagtagccttaccctcaggctggtcaacggatcggatcgctgtcagggaagggtcgaggtattgtaccgagggtcttgggggaccgtgtgcgacgactcgtgggataccaatgacgcaaacgtagtatgccggcaacttgggtgcgggtgggctacgtcagccccaggaaatgccaggttcgggcagggctcaggcccaatcgtcctggacgacgttcgctgcagtggtcacgagagttatctgtggtcctgtccccacaacggatggctgtcacacaactgtggccaccacgaggatgcaggtgtgatttgctcagtgtcccagtcacgccccacaccaagccccgacacctggcctacatctcacgcctctactgcaggccccgaatcgtcactggctcttagactggtcaacgggggcgatcgatgtcaagggagagtcgaggttctgtaccgaggctcctggggtaccgtctgcgatgactcatgggatacctccgacgcgaacgttgtgtgtagacaactgggatgcgggtgggcgacgtcagcccccgggaatgcaaggtttggacaggggagcgggcccatcgtgctggatgatgtgaggtgctctgggtacgagagctatttgtggagctgtcctcataacggatggttgtcccataactgtcagcacagcgaagacgctggcgtgatctgctctgcagcacatagctggtctaccccaagtcctgataccctgcctacgattacactgccagcatcaacagttggcagcgagagctccctggctctgaggctggtgaacggcggagaccggtgtcagggaagagttgaggtgctataccagggatcctgggggaccgtgtgcgacgactcctgggatacgaatgatgctaacgttgtctgccgacaactcggctgcggctgggcgatgagtgccccaggaaatgctcgctttgggcaggggagcggccctatcgtgctggacgacgtccggtgttccggacacgaatcatatctgtggagctgccctcacaacggatggctgtcacataattgcggtcactcagaggacgcaggggtcatatgcagcgcttctcaatcgagacccaccccatctccggatacctggcccacaagccacgcaagcaccgccggcagtgagtccagcctggctctgcgattggtcaatggaggggataggtgccagggaagagtggaggtcctttatcggggcagttggggaacagtgtgcgatgattactgggataccaatgacgcaaacgtagtgtgtaggcagcttggctgcggatgggccatgagtgcccccggaaacgcccggtttggtcagggcagcgggccgattgtcctcgacgatgtgagatgtagtggccatgaatcttatttatggagctgcccacataatggttggctgtcgcacaattgcgggcatcacgaggacgctggagttatatgctctgcttcccagagtcaacccactccgtcccctgatacctggccaacctcacatgctagtaccgcgggctcagaatcttctctggctctgcgcctggttaacggtggcgaccgatgtcagggaagagtggaggttctataccggggtagttgggggacagtgtgtgatgactactgggataccaatgatgctaacgtcgtatgtaggcagctcggctgcggatgggccacaagcgcaccagggaatgcccgtttcggacagggaagcggacccattgtcttggatgatgtgagatgcagcggtcatgagtcgtacctgtggtcctgcccacacaacggatggctttctcacaactgcggccaccacgaggacgcgggggtgatatgcagtgcatcacaatctcagcccacgccttcccctgacacctggcctacttcacacgcctcaacagccggttctgagtcaagccttgcccttcgtctggtcaacggcggcgacaggtgccaggggcgcgtcgaggtgctctaccgcggaagctggggaacagtgtgtgacgattattgggacaccaatgacgccaatgtggtgtgccgacagttggggtgcggatgggctacgtcagcacccgggaatgcaaggttcggacagggctccgggcctatcgttctcgacgatgtaaggtgctctggacatgagtcttacctttggtcctgtccacacaacggttggctgagccataactgtggtcaccacgaggatgctggagtcatatgtagcgcctcccagagtcagcccacccctagccccgatacctggcccacatctcgagcttctactgccggctcggagtctaccctagccttacgcctagtgaatggaggagatcgctgtcgaggcagagtcgaagttctctatcaggggtcttggggaacggtttgtgacgattattgggacaccaatgacgcaaatgtggtttgtaggcagctaggctgtggatgggcaatgtccgcacctggaaacgcacagtttggtcagggttccgggcctatcgttctagacgacgtcaggtgtagcggtcatgaatcctatctctggagttgccctcataatggttggctgtcgcacaattgtgggcatcatgaagacgctggtgtcatatgcagtgccgcccagagtcaaagtacaccccggcctgatacttggctgaccaccaacctgcccgccctgacagtgggttcggagtcctcccttgctttgaggctggttaacggaggagaccgctgtagaggtagggtcgaagtcctgtatagaggatcctggggtacggtgtgtgacgattcatgggatacaaatgacgccaacgtagtgtgccgtcagctgggttgtgggtgggccatgtcagccccagggaacgcgcgattcggtcaggggagcgggcctatcgtgctcgacgatgtgcggtgttcaggcaacgagtcctacctgtggtcttgcccccacaaaggatggctgacccacaattgcggacatcatgaggacgccggggtgatctgtagcgcaactcagattaactctactaccactgattggtggcaccccacaactacaaccactgcacgccccagctcaaattgtggtggttttctgttttacgccagtggaacattctcgtcaccgtcgtaccccgcttactatcctaacaacgccaaatgcgtgtgggagatcgaagtgaatagcggatatcgaatcaatctcggcttctccaaccttaagctggaggcgcaccacaattgttctttcgactatgtcgagattttcgacgggtccctaaattcctctctgttgttgggtaaaatctgtaatgacactaggcagatatttacttccagttacaataggatgaccatccattttcgctccgatataagttttcaaaatactggcttcctggcatggtacaatagtttcccgtcagatgccacgttaagactcgtcaacttgaatagcagctacggtctgtgcgccggtagagttgagatctaccatgggggtacctggggaaccgtgtgtgatgattcatggacaatccaggaggcggaagtggtgtgccgtcagctagggtgcgggcgggcagtgtcagctctgggtaatgcatactttggatccggaagcggacctatcacccttgatgatgttgagtgctctggcaccgagtcgactctgtggcagtgccgtaatagaggttggttcagccacaattgtaatcatagagaggatgcgggggtgatatgctcaggaaatcatctctctaccccagcccccttcctcaacatcactcgaccgaataccgactatagttgcggcggtttcctgtcccagccgagcggggacttttcctctcccttctatcccggaaattaccctaacaacgctaagtgtgtctgggacatagaagtgcagaacaattacagagttacggtcatctttagagatgtacagctcgaaggagggtgcaactatgattacatcgaggtttttgatggtccatacagatccagccctctgattgcacgagtttgcgatggcgcccgcgggagcttcacttctagctctaactttatgtccattcgttttatttccgatcatagtatcacccgacgaggatttagagccgagtattattcctctccatctaatgattccactaatctgctctgcctccctaatcatatgcaggccagtgtgagccgaagctacttgcagtcactgggtttctctgcttctgacctggtcatctcaacatggaacgggtactatgagtgccgaccacagattacccctaatttggtgatcttcaccattccttacagtggatgtggaacctttaaacaggctgataatgataccattgattattctaactttttaaccgcagctgttagcggtggcattatcaagcggcgcaccgatctgcgtattcacgttagttgtcgcatgctgcagaacacttgggttgacacgatgtatattgcaaatgacaccattcacgttgccaacaatactatacaggtggaggaggtgcagtatggcaactttgatgtcaacattagtttttatacatcctcaagtttcttgtatccagtcacctctcgtccttactacgtagacctcaaccaggacttatacgtccaggcagagatccttcattcagatgcggtactgacactgtttgtcgacacttgcgttgctagcccctatagcaatgacttcacttcactcacctacgaccttatacgctctgggtgcgtgagggacgatacctacgggccttatagctccccaagtctgcggattgcccgtttccgttttcgcgccttccacttcctgaatcgcttcccaagcgtctatttgcggtgcaaaatggtggtgtgcagggcatatgatccttcctccaggtgctatagggggtgcgtccttcgctctaaaagggatgttggttcttatcaggagaaggtggatgtggtcctgggccctatccagttgcagacccccccaagaagagaggaagagccgagatag

SEQ ID NO: 23856 - DNA, 7629 bp, Artificial Sequence
  Description of Artificial Sequence: Synthetic coding sequence
atgggcatcagcaccgtgatcctggagatgtgcctgctgtggggccaagttctctccaccggaggatggattcctaggactaccgactacgcgagcttgattccctccgaggtgcccctcgacccgactgttgccgaggggtccccttttccgagtgaatcaactctcgagtccaccgtggcagagggatcaccaatatcattggaatcaacgctggaaagcacagtggctgaagggtctcttatcccaagcgaatctacacttgaaagtaccgtggcagaggggtctgatagcggtctggccttgagactcgtgaacggcgatggtaggtgccagggcagagtggaaatcctgtaccgcggttcatgggggaccgtgtgtgatgatagctgggacacaaacgacgctaacgtagtgtgcagacaactggggtgtggctgggcaatgtccgcacctggcaacgcgtggtttggtcagggcagcggacccattgcacttgacgacgtgcgatgttcagggcatgagtcctatctgtggagctgtccccacaatggatggttgtctcataattgtgggcacggagaggatgccggtgtgatatgctccgccgcgcagccacaatcgaccctacgccctgagagctggcccgtccgaatttcccctcctgtgccaactgagggtagcgagtctagcctagcccttagactagtcaatggaggggatcggtgcaggggaagagttgaggtgctgtatcgcggctcatggggaacagtatgcgacgactactgggatactaacgacgccaatgttgtgtgccgacagcttggatgcggctgggccatgagcgcgccaggcaacgcccagtttgggcagggctccggacctattgtgctggacgacgttaggtgcagcggccatgagagctacctgtggtcctgccctcacaatggatggctgacacataactgtggccacagcgaggatgccggggtgatttgtagcgcaccgcagtcccgccctacccccagcccggacacgtggcccacaagtcatgccagcactgcagggcctgagtcaagcctggccctccgcctggttaatggtggggatagatgccagggacgagttgaggttctgtaccgcggatcatggggtacagtgtgtgacgattcttgggatacctcggacgcgaacgtagtctgccgccaattgggctgcggttgggcgacgagcgcgcccggcaacgctcgctttggccagggcagcgggcctattgtgcttgacgatgtgcgctgttccggctacgaaagctatttatggagctgcccacataatggatggctgtcccacaattgtcagcactcggaggacgcgggagtcatttgcagtgccgcccactcctggtctacgccaagtcctgacaccctgccaacaatcacactccctgcgtctacagtcggtagtgaatcctctctggcccttagactcgtaaacggaggcgacagatgccagggacgggtcgaggttctgtatcgggggtcctggggaaccgtgtgcgacgactcatgggacacaaatgacgcaaatgttgtgtgccggcagctgggctgcggatgggcaatgctggctccgggcaacgcaaggtttggacaagggagcggccccatcgtgctggatgacgtcagatgctctggtaacgagagttacctttggtcgtgtccccataacggatggctatcgcataattgcggtcatagtgaagatgccggggtcatatgcagtggacccgagtccagcctcgctttgcggttggtaaacggaggtgacaggtgccagggtagggtggaggtcctgtatcgaggatcttggggcactgtttgcgatgactcatgggataccaatgacgctaatgtggtctgtagacagttaggatgcggctgggcaacgtctgctccagggaatgctcggttcggccaaggaagcggccctattgttctcgacgatgtgagatgctccggacatgagagttacctgtggagctgccccaacaacggctggctgtctcataattgcggtcatcatgaagatgctggggttatttgttctgcagcgcaatctcggagcaccccccggcccgataccctctccaccattacactccctccttctacagttggatcagaatcttctctgaccttgcgacttgtgaacggcagcgaccgatgtcagggacgtgtggaagtgctgtacaggggctcctgggggacagtctgtgacgattcttgggacaccaatgatgccaacgtcgtttgccgccagctcggatgtggatgggctacttctgcccccggcaacgccaggttcgggcagggctcagggccaatcgtgctggatgatgtgaggtgcagcggccatgagagctatctgtggtcctgcccgcataatggctggctgagccataactgcggccatcacgaggatgccggcgtaatttgcagcgtttcccagtccagaccgacgcccagccctgacacttggccgacctcacacgcgtcgaccgctgggccagaaagcagcctcgccctaagactggtgaatggcggtgataggtgtcaagggagggtcgaagtgctttatagaggctcttggggcaccgtctgtgacgactcctgggacacaagcgacgccaatgttgtatgtcgccagctcggctgcggatgggcaactagcgcccctgggaatgcaagatttggacaggggagtggcccaatcgtgcttgatgatgtgcgatgttctggatacgaatcctacttgtggagttgtccccacaatggatggctctcccacaattgccagcatagcgaggatgccggagtgatttgttctgccgcccattcatggtccacccctagcccagacacgctgccgactatcaccctaccagcctctacagtggggtcagaatcttctctagcactgcggttggtgaacgggggggaccgatgccagggtcgcgttgaggtactctatcagggatcctgggggactgtctgtgacgattcctgggacacgaatgatgccaatgtagtttgcaggcagttggggtgtgggtgggcgatgagcgctccaggcaatgctagatttggacaggggagtggtccaattgtgttagatgacgttagatgctctgggcacgaaagctatttatggtcctgtccacataacggctggcttagtcataattgcggccacagcgaggacgctggcgttatttgcagcgctagccagtcaagacctactccaagccctgatacttggccaaccagtcacgcctccactgcggggtccgagtcttcactggcactgcggctggtgaacggaggcgatcggtgtcagggccgggttgaagtcttgtaccgcgggagctggggaacagtctgtgacgattactgggataccaatgacgctaacgtagtgtgtcgccagcttgggtgtgggtgggccatgagcgcacctggaaacgcccgcttcggacaaggtagcggcccaattgtacttgacgatgtgagatgtagcgggcacgaatcctacctctggagctgcccacataacggctggctgagccataactgtgggcaccatgaggatgcaggggtcatctgttccgcctcacagtctcagcccacgccgagcccagatacatggcctacttctcacgcttcaaccgcagggagcgagtcttctctggcgctgcgcctggtcaacggtggggatcggtgccaaggcagggtcgaggtgctgtaccgcggctcatgggggaccgtctgtgatgactactgggacacaaacgacgccaacgtggtgtgtagacaactgggctgtggctgggcaacctctgctccagggaacgcaaggttcggtcaggggtcaggcccaatcgtgttggatgacgttagatgttcagggcacgagagctacctgtggagctgtccacataatgggtggctgagtcataactgcggtcatcatgaggatgccggggtcatttgctctgcatctcagagccagccgacccccagccccgacacatggcccacttctcatgcctctaccgctggcagcgaatcttctcttgcacttagactcgttaacggtggagatcgatgtcagggtcgagtggaggtattatatagaggctcttggggaacagtgtgcgatgattattgggacaccaacgacgctaacgtggtgtgtagacagttgggctgcgggtgggctacaagcgctccagggaatgcgcgattcgggcaaggcagtggaccaatcgttctggacgatgtgagatgctccggtcatgagtcatatttatggagctgtccacacaatggctggttgtcccacaattgcgggcatcacgaggacgcgggcgtcatatgtagtgcttctcagtcacagcccacacccagtcccgatacctggccgacgagccatgcctcaactgcaggttcagagagctctttagctctccggctggtcaatggcggagaccggtgtcagggtcgagtggaggtgctgtaccgcggaagctgggggactgtttgcgacgattactgggataccaacgacgccaacgttgtctgtcgacagctgggttgtggatgggctaccagcgccccagggaatgcacgcttcgggcaggggagcgggcctatcgtgctggacgatgttcgttgctcaggccacgaatcctatttgtggtcatgtccacacaatgggtggttgtcgcacaactgtggccaccacgaggacgccggagtcatctgtagtgcatctcagtctcaaccaaccccctcaccagacacttggcccacgtctcgggcgagtaccgcagggtcagaaagtacgcttgcgctacgcctggttaacggcggggacagatgcagaggccgcgtggaggtactatatcagggttcctggggtacggtgtgcgacgattactgggacactaacgatgccaacgtggtttgtcgacagctggggtgtggatgggctatgtccgctcccggaaatgcccagttcggtcaaggttctgggcccattgtgctggacgatgttagatgctcagggcacgagtcctacctttggagctgtcctcataacgggtggttaagtcataattgcggccatcatgaggacgctggagtgatctgcagtgccgcccaatcacagagtaccccaagaccggatacatggttgactaccaaccttcctgccctcaccgtggggtctgaatcatcgctggcactgaggttggttaacggcggtgaccgttgccgcggaagggtggaagtgctctaccggggctcttggggcactgtgtgtgatgactcatgggatacaaacgatgcaaatgtcgtgtgccgacaactagggtgcggctgggctatgagtgcacccggaaatgcacgctttggccagggcagcgggccaattgttcttgacgacgtgaggtgttcaggcaatgaatcatatctgtggtcttgcccacacaaaggttggctaacacacaattgcggacatcacgaagacgcgggggtgatatgttctgcaacacagatcaactcaacaaccaccgactggtggcaccctaccactaccacaaccgcccgtccgagttccaactgtgggggctttttgttctacgcctccggtacgttctcttcacctagctaccctgcttactatccgaataacgcaaagtgcgtgtgggagatcgaggtgaatagcggatacagaattaatttaggttttagcaatctgaagctggaagcccatcacaactgcagcttcgattacgttgaaatctttgacggctctttaaattccagcttactcctgggcaagatttgtaatgatacgcgacagatattcactagctcctacaatcggatgactattcactttaggagtgatattagctttcaaaatacaggatttttggcatggtataatagctttcctagcgacgccactctgagactggtgaacctgaacagctcctatggcctctgcgctgggcgcgtggaaatttatcacggaggcacttggggcacagtgtgcgacgactcatggaccatccaagaggctgaagttgtctgcaggcaattggggtgtggccgcgccgtctcggcactcggtaacgcctactttggctctgggtcagggcccatcacactggatgacgtcgaatgctccggaaccgagagcaccctctggcaatgtagaaatagagggtggttctcccacaactgcaatcacagggaagacgccggagtgatctgtagtggaaaccatctaagcactccagctcctttcctcaatatcacgagacccaacactgactatagctgcggaggattcctgagccagccttccggtgatttttcttcccctttctaccctggaaactatcctaataacgcgaaatgtgtctgggacatcgaggttcaaaacaactaccgtgtcactgtgattttcagggatgtacagctcgaaggcggctgcaactacgattatatcgaggtgtttgacgggccctataggtcatcacctctcatcgcaagggtctgtgacggcgcccggggctcctttacaagctccagcaatttcatgtccattagatttatctccgaccacagtatcaccagaagagggtttcgagctgagtattacagctcccctagcaatgattcgaccaatctactgtgtctacccaatcatatgcaagcaagtgtgagtcgtagctacttacagtccctggggttttcagcttctgatttagtcatcagcacatggaatgggtactacgaatgccgcccccagataactccaaacctggtcatcttcacaatcccctattctggctgtggtaccttcaagcaggcagacaacgataccattgactactccaacttcttaacagccgcagtctctggtgggataattaagagacggacagacctgaggattcatgtttcgtgtcgcatgttacagaacacatgggtggatacaatgtatatcgccaacgacaccatccacgtcgctaataatactatccaggtggaagaagtccagtatggtaattttgatgtaaatatctctttttataccagcagctcattcctctacccagtgacctcacgcccctactatgtcgacctcaaccaagatctttacgtgcaggctgaaatcttgcactctgacgcagtgttaacactgttcgtggatacatgcgtggccagtccctactctaacgacttcaccagtttgacctacgacttaattagaagcggatgcgttcgcgacgacacctatggcccctattcaagcccgtctctccgaatcgcacggttccggttccgggcttttcatttcttaaaccgctttccatctgtctacctgcgttgtaaaatggtggtgtgcagagcttatgacccctccagccgctgttaccgtggctgtgtcctccgatcaaagcgagacgttggctcttaccaggagaaggtggacgtcgtgctgggtcctatccagttgcagacacctccgagacgggaagaagaaccccgatag

SEQ ID NO: 23857 - DNA, 7239 bp, Artificial Sequence
  Description of Artificial Sequence: Synthetic coding sequence
atgggcatcagcaccgtgatcctggagatgtgcctgctgtggggccaggtcctgtctactgggggttggataccccggaccaccgactatgcctcccttatcccctccgaggtacctcttgatcccactgtggctgagggcagtccctttccttcggagagcacactcgagtctaccgttgccgagggatccccaatctctctcgagtctactttagagagcactgtcgccgaggggagcctcatcccaagtgaatcaaccttggagtccacggtagcagagggttctgactcaggcctggcactgcgtctagtgaatggtgatggcaggtgtcagggcagggtcgagatcctttatcggggatcctggggtactgtttgtgatgactcttgggacaccaacgatgccaatgtggtctgtcggcagctggggtgcggatgggccatgagcgcccccggtaacgcttggtttggacagggttccggcccaatcgcactcgacgatgtgcggtgtagtgggcacgagtcttacctgtggtcttgccctcataacggatggttgtcccataattgtgggcatggggaggacgctggcgtgatttgctctgccgcccagccccagagcacgttgcggccagagagttggccagtgagaatcagcccacccgttccgacagagggcagcgagagctcactggctttgaggcttgtcaatgggggtgacaggtgtcggggccgcgttgaagtcctgtatcgcgggtcttggggcaccgtatgcgacgactattgggacaccaacgacgcgaacgtcgtgtgtcggcagctgggatgcggttgggctatgtccgctcccggaaatgcacagttcgggcagggctctggtcctattgttctagacgatgttcgttgctccggacatgaatcgtatctgtggtcttgccctcacaacggttggttgacccacaactgtggccactccgaagacgcgggagtgatttgcagtgccccccagtccaggccaactccttccccagacacatggcccacctctcatgcctccacagccggtcccgaatcttccctggcattgagattagtcaacggtggtgaccgttgtcaggggcgggtcgaagtgctgtacagaggctcttggggaacagtgtgcgacgattcatgggacacatccgacgcgaatgtcgtttgccgccagttgggttgcggatgggctactagcgcccctggcaatgctcgcttcggccagggatcgggccccatcgtgttagatgatgttcggtgcagtggatacgaatcctacctgtggagctgtcctcacaatggctggttgtcacataattgccaacactcagaagatgccggcgtaatctgctcagcagcccactcatggagcactccttcgccggatactctacccaccataacactgcccgctagcaccgtcggaagcgaatcaagtctggccttgcggctggtaaatggaggagataggtgccaggggcgggtagaagtgctgtatcggggatcatggggcactgtttgcgatgactcgtgggacactaatgacgcaaacgtggtttgccggcagctgggttgtggttgggctatgttggcacccggaaatgcgaggtttggacaaggctctgggcccattgttttggatgatgtgcgctgtagcggcaacgagagctacctgtggagttgtccccacaatggctggcttagtcacaattgcgggcactcagaggacgcaggagtgatttgcagtggccctgaatcttctctggctctgagacttgtgaatggcggcgaccgctgtcagggacgcgtggaggttctctaccggggttcctggggcacagtgtgcgacgactcttgggacacgaacgatgcgaatgttgtctgtaggcaactgggctgcgggtgggcgacatcggctcccgggaacgcacgctttggccagggctctggtccgatcgttcttgacgacgtgcggtgttctggacacgagagctatctttggtcctgtcctaataacggctggcttagccacaactgcgggcatcatgaagatgccggcgtgatctgttcagccgcccagtctaggagtactccacgcccagacacactgagcaccatcacactgccaccttcaaccgtggggtccgagtcctccctgaccctgagactggtcaatggaagtgacagatgtcagggcagagttgaagtgttataccggggcagctggggtaccgtgtgcgatgattcatgggatacaaacgacgccaatgtggtatgccgacagttaggctgcggatgggcaacctcagcgcccggcaacgcccggtttgggcaggggtccggccctatcgttctcgatgatgtgagatgtagcggacacgagagctacctatggagctgcccacataatggttggctaagtcacaattgtggacaccacgaggacgctggcgtaatctgtagcgtgtcacagagccgcccaaccccctcccccgatacttggcccacaagtcacgcctctaccgcagggccagaatcctcactcgctttacggctggttaacggtggagatcgctgccaaggtcgggttgaagtcctatatcggggtagctgggggaccgtctgcgatgactcctgggacacttccgacgcgaacgtcgtatgtcgtcagctgggctgcggctgggcaaccagtgcccctgggaacgcccgtttcggccagggtagcggcccaatcgtactcgatgatgtcaggtgctctgggtatgaatcatacctgtggagttgtccccataacggctggctgtcccacaattgtcagcactcggaagacgcaggtgtgatttgtagtgccgcacactcttggtctacaccctcaccagacactctgcccacaatcacattgcctgcatctactgtcggctctgaatcttctctcgctcttaggctggtgaatgggggggatcgttgtcagggtagagtcgaggttttgtatcaaggctcctggggtacagtgtgcgacgactcctgggatacaaatgatgccaacgtggtgtgccgacaactggggtgtggctgggcaatgtcagccccagggaacgcacggttcggtcaagggagcggcccaattgtgctggatgatgtgaggtgctccggacacgaatcatacttgtggagttgccctcacaatggctggttatcacacaattgcgggcatagcgaggacgcaggtgtgatctgctcggcctctcagtcccggcctaccccctcaccagatacgtggcccacaagtcacgcttcaactgcaggctctgagagtagcttggctctgcggctcgttaacggaggagataggtgtcagggaagagtggaggtgctgtatcgggggtcctggggaactgtatgcgatgattactgggacacgaacgacgcgaatgttgtttgccgccagcttggctgcggttgggccatgtctgctccgggaaacgctaggttcggccagggaagcggccccatcgtgctggacgacgtcaggtgtagtggacacgaaagctacttgtggtcgtgccctcacaatgggtggctcagccacaactgcggtcatcacgaagacgctggcgtgatttgttccgccagtcagtcacaaccgacccctagcccagacacgtggccaacttcacacgcctccacggctggcagcgagtctagcttagctcttcggctagttaatgggggcgatcggtgtcaagggcgagtggaggtgctgtacagaggcagctggggcactgtgtgtgatgactattgggacactaatgacgctaacgtggtttgcaggcaactggggtgtgggtgggcaacgagtgcccccggcaatgcccgtttcggccagggcagcgggcctatcgtccttgatgacgtgagatgcagcggacacgagtcttacctgtggagttgtccccacaacggctggctgtcccacaactgcgggcaccatgaggatgcgggagtaatctgttccgcctcacagagccaaccaacacctagcccagatacatggcccactagccacgctagcacagcaggcagtgagagcagcctggccctcaggctcgtaaatggtggcgaccgatgtcagggtcgtgtggaagtactttatagaggtagctggggcaccgtatgcgacgactactgggacaccaatgacgcaaatgtagtatgcaggcaactcggctgtggatgggcaacgagtgctcctggcaacgcccggttcggccaggggagcggtcctatcgtgctggatgacgtgagatgctctggacatgagagctatctctggagctgccctcataatggctggcttagtcacaactgcgggcaccatgaagacgctggtgtcatttgttccgcatcgcagtcacagcccactcctagccctgacacttggcctacctcacgggccagcacagctggatcagaatcgacgcttgccctcaggttagtgaacggcggcgatcgatgccgtggccgagtggaagtgctttatcagggtagctgggggacagtctgcgacgactattgggacactaacgatgcaaacgttgtgtgcaggcagttagggtgtggatgggccatgtctgctcctggtaatgcacagttcgggcagggaagcgggcccattgtgttagatgacgtgcgctgctccggccacgagagctacctctggagttgcccccacaatggctggctgagtcataattgtggccaccatgaggatgctggcgtcatctgcagcgccgcccaaagccagtcaacaccccgccccgacacctggttgacaaccaacctccctgcattgacagtgggttctgagtcctcccttgccctgcgtcttgttaatggaggagatcgatgcagaggacgggtggaagtgctttaccgtggatcttggggcaccgtctgcgatgattcatgggataccaatgacgcgaacgtagtgtgccgacagctcggttgcggctgggcaatgtcagcccccggtaatgcccgcttcggtcagggctccggccccatcgtccttgacgatgtgcggtgtagtggcaatgagagctacctgtggtcttgcccccataagggttggctgacgcataactgcggccaccatgaggacgcgggtgttatatgcagcgctactcagatcaatagcacaactacagactggtggcatcctacgaccaccacaaccgctagacccagctcaaattgcggcggctttttattctacgcctccgggaccttcagctctccttcatatcctgcatactaccctaacaatgccaagtgcgtctgggaaatcgaagtcaactccggatacaggatcaatctggggttctctaatctgaagctggaagctcaccacaattgctctttcgactatgttgagatctttgatggatccttgaatagttcattactacttggcaagatatgtaacgacacaaggcagatcttcacttcatcctacaaccgtatgactattcattttagaagcgacatcagcttccaaaacacaggcttcctcgcctggtacaatagcttccctagcgacgccacacttaggcttgtgaatctaaactcctcttacgggctgtgcgccggcagagtagagatctatcatgggggaacgtggggtacagtctgcgatgattcttggacaatccaagaggccgaagtggtgtgccgacagttggggtgtgggcgggctgtgtctgcccttggtaacgcgtactttggctctggatcgggacctatcaccctagacgatgtggagtgtagtggaaccgagagcactctgtggcaatgccgaaaccggggctggttttcccacaactgcaatcaccgcgaggatgcaggagtgatttgctcaggcaatcatctgtccacccctgctccctttcttaatataactcggccaaacaactactcctgcggcggatttttaagccagccgtctggggacttttccagtcccttctatcccggcaactaccctaataatgcaaaatgtgtctgggacatcgaagtccaaaataattatcgcgttaccgtgattttcagggacgtgcagctggagggcggctgcaactatgactacattgaggtattcgatggcccataccgcagcagtccactaatcgcccgtgtgtgtgatggcgcacgaggaagctttacatcatctagcaattttatgagcatccggttcatatcagaccattccatcacccgccggggttttcgcgccgagtactacagcagtcctagtaatgatagtacaaatcttctttgtcttcccaatcatatgcaggcaagtgtttccaggagctatcttcagagtctggggttctcagcctcagatctggttatcagtacatggaacggctactatgagtgccggccgcagatcacccctaacctggtgatcttcactataccatatagcgggtgtggcacattcaagcaggctgacaatgacacgattgactactcaaattttttaaccgcggccgtgtcaggtggcatcataaaaagaaggactgacctcagaattcatgtctcatgtcgaatgctacagaacacttgggtagacaccatgtacattgctaatgatactatccacgttgctaataatacaatccaggttgaggaagtgcagtacgggaattttgatgtcaatatctccttctacaccagttccagtttcctgtatccagtgacctccaggccatattacgtagaccttaatcaggacttgtacgtgcaggctgagattttacatagtgacgcggtgctgactctcttcgtggatacctgtgtcgccagcccctattctaatgactttacatcccttacgtatgacctgatcaggagcggatgtgttcgagacgacacatacgggccttatagctctccatctctgaggatcgctcgattccgtttcagagcattccactttctgaacaggttcccatccgtgtatctccgatgtaaaatggtggtgtgtcgggcatatgaccctagcagccgctgttacaggggatgcgtgttacggagtaaacgagacgtggggagttaccaggagaaggtggatgtggtccttgggcctatccaacttcaaacacctcctagaagggaggaagaaccgagatag

SEQ ID NO: 23858 - DNA, 7242 bp, Artificial Sequence
  Description of Artificial Sequence: Synthetic coding sequence
atgggcatcagcaccgtgatcctggagatgtgcctgctgtggggccaggtgttgagcaccggcgggtggatcccgcgaaccactgactatgcttccttgattcccagcgaggttccccttgaccctacggtagcggagggctctccctttcctagtgaaagcacccttgagagcaccgtcgctgagggaagcccaattagcctggagtctactctcgagagcacggtcgccgaaggtagtcttataccttcagagtccacactcgagagcaccgttgcagagggttctgactccgggctggcactacggctggtgaacggagacggacggtgtcagggccgggtggaaatactgtaccgggggagttggggcacagtttgtgacgactcctgggacacgaacgacgccaacgtggtgtgtagacagttggggtgcgggtgggccatgagcgcgcccggcaacgcctggttcggtcagggctctggcccgatcgctctggatgatgtccgctgtagtggacatgagtcctacctgtggtcctgcccgcacaatggatggctgagtcataactgtgggcacggtgaagatgcgggtgtgatctgcagcgccgcacagccccaatccaccctgcgacccgagtcctggcccgtgcggatctccccgccagtgccaactgagggtagtgagtcttcacttgccctgcggctggtaaatgggggggacagatgtcgtgggagggtggaggtcctatatcgcggatcgtggggtactgtgtgcgacgactattgggatactaacgatgcaaacgtcgtgtgccgacaattaggctgcggttgggcaatgtcagcccctggaaatgcccaattcgggcagggcagtgggcccattgtgctggatgacgtccggtgctcggggcacgagtcttatctatggtcgtgtccccacaacggatggctgacacacaactgtggccattctgaggacgccggggttatctgttcagcgccacagagcagaccaactccctcgccggatacgtggccaactagccacgcgtctactgccggcccggagtcttcattagcactgcggttggtgaatggaggtgacaggtgccagggacgggtagaggtactatacaggggatcttgggggaccgtctgtgacgattcctgggacacctcagacgccaatgttgtttgtcggcagctgggctgtggatgggcaacctcagcgcctggtaacgctcgctttggacaggggtccggacctattgtcctcgacgacgtaagatgttccggttacgagagttatctgtggtcctgtccccacaacggttggctgtcccacaattgtcagcactcggaagatgccggcgtgatatgcagcgctgctcactcctggtcaacccctagtcctgatacacttccaaccattacgttaccagctagtaccgtgggctccgagagtagcctggccctgcgactggtcaacggcggagaccgctgccagggacgcgtggaagttttgtaccgcggatcctgggggacagtatgtgacgattcttgggacacaaacgacgccaatgtcgtttgcaggcagctgggatgcggatgggccatgctggccccaggaaacgctcgattcggacagggatcaggtcccatagtcctagatgacgttcgctgctctgggaatgaatcttacctttggtcttgtccacataatggatggctgagccacaactgcggtcacagtgaggatgccggggtgatctgcagcggccctgaaagcagcctagccctccgactggtcaatggcggcgacagatgtcaggggcgggtggaggtgctttatagaggatcctggggcaccgtgtgcgatgatagctgggatacgaacgatgctaacgtagtgtgccgacagctgggttgcggctgggccacaagtgcccctgggaacgctaggtttggtcagggttccggccctatagtgttggacgacgtacgatgttcaggccatgagtcttacttgtggagttgcccgaataacggctggctctcccacaactgcgggcaccacgaggacgcgggcgtaatttgttctgctgcacagtcccgttcaactccacggcctgatacattaagtacaataaccctccccccttctaccgttggcagtgagtcaagcttgacattgagactcgtgaacggatccgaccgctgccagggccgggtcgaagtcctgtatagaggctcttggggaacagtgtgtgacgacagctgggacacgaatgacgcaaacgtggtgtgcagacagttaggttgcgggtgggcaaccagtgcgccaggaaatgcaagattcggacaggggtctggcccaatcgtgctcgacgacgtgaggtgttctggacacgaatcttacctgtggtcctgcccccacaatggatggttgtctcacaactgcgggcatcacgaagacgccggtgtcatttgcagtgtgtcgcaatctcgccccactcctagtccagacacttggccgacaagccatgcttctaccgccgggcctgaatcgtcgctcgcactgcggctcgtaaatggaggcgacaggtgtcagggtcgcgtggaagtgctctaccgcgggagctggggcacagtatgcgacgattcttgggacacatctgatgctaacgtggtgtgtcgtcagctggggtgcggctgggcgacaagtgccccgggcaacgccagatttggtcagggcagcggcccaatagttctggatgatgtacggtgttcaggatacgagagctacttgtggtcctgtccacacaacggctggctttcccacaattgtcagcactctgaagatgcaggagtgatttgttctgccgctcacagttggtccaccccttcacctgatacactgcctacaatcacacttcctgcctctaccgtaggctcagagtcctccctggctctccgtttggtgaatggaggtgaccggtgtcaagggcgcgtggaggtgttgtaccaagggtcctgggggaccgtttgcgacgatagttgggacacgaacgatgctaatgtggtatgccgccaactgggctgcggctgggctatgtcagcacctggtaatgctcggtttggccagggcagtgggcccatcgttctggacgacgtgagatgctctggacacgaatcttacctgtggagctgcccgcataacggatggctctctcacaactgcggtcactccgaagatgctggcgttatctgttctgcgtcccagagtcggcctaccccttcccccgacacatggcctacctcccatgcttcaacggccggcagcgaatcctctttggcactcaggcttgtgaatggtggtgatagatgtcagggccgagtcgaggtgctctaccgaggcagctggggcactgtctgcgatgattattgggatacaaacgatgctaacgtggtctgtcggcagctgggatgtggttgggctatgagtgccccagggaacgcacgcttcgggcagggctcaggccctatcgtgttggatgacgtccgatgtagtgggcacgaaagttacctctggagttgcccccataatggatggctgagccataactgtggccatcatgaggacgctggggtgatctgttccgctagtcagtctcaacctacccctagccctgacacctggccgaccagtcacgcctctaccgcaggctctgaaagctctttggccctgagacttgtgaacggcggagaccggtgtcaaggtagggttgaagtcctttaccgaggaagctggggaaccgtctgcgacgactactgggacactaacgatgcaaacgtagtgtgccggcagctgggttgtgggtgggcaacaagcgccccgggcaacgcacggtttggccagggttctggcccgattgtgttagatgatgtccggtgttctggccacgaatcctacttgtggagctgcccacataacggttggttgtcacacaattgtgggcatcacgaggacgcaggggttatatgttccgctagccagagccagcccaccccaagcccagatacgtggccgacttcgcacgcttccacggctgggtcagaatcatccctggcccttagactcgtcaacggtggggatagatgccaaggtcgagttgaggttctgtaccgcggatcatggggtaccgtgtgtgatgactattgggatactaatgatgccaatgtcgtctgtcgccaactgggctgcggttgggccacaagcgcaccggggaatgcaagatttggtcagggatccggacccatcgtgttagacgacgtcaggtgctctggacatgagtcttacctgtggtcctgcccacacaatgggtggttgagccacaactgcggtcaccatgaggatgctggcgtaatctgctccgcatcacagtcacagcccacccccagcccagatacctggcctacgtcgagggctagcactgcaggatccgagagcacactcgcccttaggctggtcaatggcggcgataggtgccggggaagggtagaagtactctatcaaggatcctgggggacagtttgcgatgactattgggatactaacgacgccaacgtggtgtgcaggcagttgggctgcggttgggccatgtcagccccagggaacgctcaatttggacagggaagcgggcccatagttttggacgacgttaggtgctctggtcatgagtcttatctttggtcttgtccccataacggctggctgtcacataattgtggccaccatgaagatgccggtgtgatctgctccgccgcacagagccaaagcactcctcgaccagacacttggttaaccacaaacctgccagcactgacagtggggtcggaatcctcccttgccttgcggcttgtgaacggaggcgatcgatgtcgggggagagtggaggtcctttacagaggtagttggggaaccgtttgtgacgacagctgggacaccaacgatgccaacgtggtttgtagacaactggggtgtgggtgggcgatgtccgcccccgggaacgcccggttcggccagggctctggtcctatcgtcctggacgacgtgcggtgcagcgggaatgagagctacctttggtcatgtcctcataaggggtggctgacgcacaattgtggccaccatgaggacgctggtgttatatgctctgccacccagataaattccacaaccactgactggtggcaccctaccactactactacagcgaggcccagctcaaattgcggtggtttcttgttttacgccagcgggacattttcatccccttcatatcctgcctactaccccaataacgccaagtgtgtgtgggagattgaagtgaattctggataccgaatcaatctgggcttctcgaatctgaagttggaagcgcaccataactgctctttcgactacgtggagatatttgacggatccctgaattcctcgcttctcctggggaaaatttgcaacgacacacggcaaatctttacgagctcttacaataggatgacaattcacttcaggtcagatatctccttccagaataccggattcttggcttggtacaactcatttccaagcgacgcaactctgaggttggtcaacctcaattcctcttacggtctgtgcgcgggccgagtcgagatctatcatggtggaacgtgggggacggtgtgtgatgattcctggaccattcaggaggccgaagtggtatgccgccaattaggttgcggtagagccgtgtctgcactcggaaatgcttacttcggctccggcagcggaccgattacactcgatgacgtagagtgctccggcacagagtccacgttgtggcagtgtaggaatcggggctggttttctcacaactgtaatcatcgggaggacgctggcgtgatttgttccggaaatcacctttcgacgcccgctccatttttgaatatcacccgaccgaacaccgactactcttgcggtggctttctgtcccaaccatccggggacttctcatcaccattttatcccgggaattaccctaacaatgccaagtgtgtctgggacatcgaggtgcagaataactatagggtgacagtgatctttcgcgacgtacagctggaaggaggctgcaactacgattacatcgaagtttttgacggtccctacaggagctcccctcttatcgctcgtgtgtgcgatggcgctcgcggtagctttacatctagcagtaattttatgtctattagatttatttcagatcacagcatcacccgtagggggttcagggctgaatactacagttcaccttccaatgattccacgaacctcctgtgcctacccaaccacatgcaagcctcggtcagccgatcatacttgcaatccctcggcttctcagcctccgacctcgtcatttcaacctggaacggctactatgagtgtagaccacagatcactcctaatctggtcatctttactatcccctatagcgggtgcgggacatttaaacaagccgacaatgacacgatcgactattctaactttctgaccgcggcagtgagtggagggatcataaagcgcaggacagatctgcgcatccatgtgtcatgcaggatgctccagaatacttgggttgatactatgtacattgccaatgacacgatccatgttgcaaacaacactattcaggtggaggaagtgcagtacggcaacttcgacgtgaacatcagcttttacacgtcatccagtttcctgtacccggtgacaagcagaccctactatgtggacctgaatcaagatctgtacgtgcaggctgagattctacactccgatgccgtcctgacactctttgtcgacacctgcgtggcctccccttacagcaacgatttcacctctttgacctacgatctgatccgatcaggctgtgtccgcgatgatacatacgggccatactcctcaccttctctccgtatcgccagattccgcttcagggcatttcatttcctgaacagattccctagtgtctacctgaggtgcaagatggtcgtatgccgtgcatacgatccaagcagtcgctgctaccgcggctgcgttctgagaagcaaacgcgacgtcggctcctaccaagaaaaggtcgacgtggtcctcggacccatccagctacagacaccgccgcgaagggaagaggaacctagatag

SEQ ID NO: 23859 - DNA, 7212 bp, Artificial Sequence
  Description of Artificial Sequence: Synthetic coding sequence
atgggcatcagcaccgtgatcctggagatgtgcctgctgtggggccaggttctgagcaccggaggatggatcccccgcactacagactatgcctccctgattcctagcgaggtgcctctcgatcccacggtggcggagggcagcccgttcccaagtgagtcaactttggagagcactgtggcagagggaagccccatctccctagaaagcaccctggagtcaacagtcgctgaggggagtctcatcccgtccgagtcgacactggagagcacagtggctgagggatctgattctggactcgctttgcggctggtgaacggggacggacggtgccaggggagagtagagatcctgtatcgaggaagctggggaacggtctgtgacgactcctgggacaccaatgacgccaatgttgtctgcagacagctgggctgtgggtgggcaatgagcgcgccaggcaacgcgtggtttggccaaggctccggccctatagccctcgacgacgtgagatgcagtggacacgaaagttatttgtggtcatgtccccacaacggatggctgtcccataactgtgggcatggggaggacgccggggttatttgctctgctgcgcaaccccagtcaacactccgacccgaatcatggcccgtacgcatctctccgcctgtccctacagagggaagtgagtccagcttggcactgagattggtcaacggaggggatcgatgtcggggaagggtggaagtgctgtaccgagggagttggggaacagtgtgcgacgattattgggacactaacgatgcaaatgtcgtgtgtcggcagttgggttgcggctgggccatgagcgccccaggaaatgcgcagtttggccaaggaagtgggcccatcgtgctggacgatgtgagatgctccggtcacgaatcatatctttggagttgtccacacaatggctggcttacccacaactgcggccactctgaagatgcaggtgtgatttgtagtgctccacaaagtcggcccacccctagcccagacacctggcccactagccacgccagtacggcggggccagagtcttcacttgccctccgtcttgttaacggtggcgaccggtgccagggtcgcgtggaggtgctgtaccggggctcatggggaacagtgtgtgacgactcctgggatacctctgacgcgaacgtagtatgtcgccaattaggctgcggatgggccacatcggccccaggcaacgctcgctttggacaggggtctggtcccatcgtgctcgatgatgtgcgatgcagcggttatgaatcctacctgtggtcttgcccccacaacggttggctttcccataattgtcaacattccgaggacgcgggcgttatctgttctgacacactccctaccattacacttccggccagcacagttggctcagaatcttccctggctctccgactggtgaacggcggggataggtgtcaaggccgggtggaggtgctgtatcggggatcttggggaactgtgtgcgacgactcctgggatacaaacgacgccaatgtagtctgtcgccaactggggtgcgggtgggctatgctagcacctggcaatgcgaggtttggccagggttcaggcccaatcgtgctggacgatgtgagatgttctgggaacgagtcctatctatggagttgtcctcacaatggttggctctcgcataactgtggccattcagaagatgcaggtgtaatttgttctggaccagaatcttcactagcactgcggctggtgaacggcggggatcgttgtcaagggcgagttgaggtactctatcgaggcagctgggggactgtgtgtgatgactcatgggataccaatgacgcaaacgtcgtgtgtcggcaattaggatgtggttgggctacgtcagcccctggaaatgcccgtttcggccagggctccgggcccatcgtcttagatgatgttcggtgctcaggccatgagtcctatttgtggtcgtgccctaataacgggtggttgagtcataactgcggccatcacgaagacgccggcgttatttgttccgccgcccagagccgcagtaccccccgacctgataccctcagtactataacgctacccccttctacggttgggagtgaatcgtctcttactttacgacttgtgaatggctcagatcgttgccagggacgagttgaggtgctatacagagggtcatgggggaccgtttgtgatgatagttgggataccaacgacgctaatgtcgtatgtaggcaattaggctgtggttgggcaacaagtgcgccaggcaacgccaggtttggtcagggctcaggcccgatcgtgctggacgatgtgagatgcagtggacatgaaagctatctctggtcctgtccccacaacggttggcttagccataattgtgggcaccacgaggacgcaggagtaatatgctctgttagtcaatcccgtccaactccctctcccgatacctggccaacttcccacgcaagcacagctggccctgagagcagtctggctttgcggcttgtgaatggaggagacaggtgccaggggcgggtagaggtgttgtataggggctcatggggaacagtgtgcgatgactcttgggacacaagtgatgctaatgtggtgtgccgccagctgggatgtggctgggcaacatcagcacccggcaacgcccggttcgggcaggggtctggtccaatagtgctggacgatgttaggtgctccgggtatgaatcctatctgtggagttgcccacataacgggtggctgagtcataattgccaacacagcgaggatgctggtgtgatatgctcggctgcgcacagttggtccactccatcaccagacacactgcctactatcactttgccagcaagcaccgtggggtccgaaagctctctggctctgcgtttagtgaacggcggagaccgatgccagggtcgagtggaggtgctttaccaaggatcttggggaacagtatgcgacgattcgtgggacaccaacgatgcaaacgtggtgtgcaggcagcttgggtgtggttgggccatgagtgccccgggcaatgccagattcggccagggctcaggaccaattgtgctagatgatgtcagatgttctgggcacgaatcttacttgtggtcatgtccacacaatggctggctctcacataattgcggacacagcgaagacgccggagtgatttgttcagctagccagtcgagacctacccccagtccggatacgtggcctaccagccatgctagtacggccggaagtgagagctccttagcgttacggttggtgaacgggggggatcggtgccaggggagggtggaggtgctctacagagggagttggggcacagtatgcgatgactactgggacaccaacgacgccaacgtagtctgccgccagctgggctgcggttgggctatgtctgcccctggtaacgcacggtttggacaggggagcgggcctatcgtgttggatgatgtgaggtgcagcggccatgagagctacctttggtcatgtccccataacggttggctttcgcataattgtgggcatcacgaagacgccggcgtgatttgcagcgcctcacaaagccagccaacacctagtccagatacgtggcctacttcgcacgctagtaccgccggcagcgaaagcagcctggctctgcgactagtaaacgggggtgaccgctgccagggcagagttgaagtactgtaccgcggtagctggggtactgtgtgtgatgattactgggacacgaatgacgccaacgttgtttgtaggcagctgggatgtggctgggctacttctgcccccggtaatgcaaggttcggacaaggctctggccccattgtactcgacgatgttcggtgctctggccacgagtcttatctgtggtcttgtccccataacgggtggttgtctcacaactgcgggcatcatgaggacgctggcgtgatctgttctgccagtcagagccagcctaccccctcaccggatacgtggccaacttcacacgccagcacggccggctcggagtcctctttggcactaagactggtgaacggcggagaccgctgtcagggaagagtggaagtcttatacagaggctcttggggaaccgtgtgtgatgactattgggataccaatgacgctaatgtagtgtgcagacaacttggatgcgggtgggctacatccgcccccgggaacgcacgtttcgggcagggctctggtccgatagtgctggatgatgtgaggtgctccggacacgaatcctatctgtggagttgtccacacaatggctggctgtcacataattgcggccaccatgaagacgccggtgtgatctgtagcgcaagtcagtctcagccaaccccttcacctgatacatggcccacctcacgggctagtactgccggctccgaatcaacactcgctctacgcctggtgaacgggggggaccgttgcaggggccgagtggaggtgctgtatcagggcagctggggtaccgtgtgcgacgactactgggacacaaacgatgccaatgttgtgtgcagacagcttggttgcggctgggctatgagcgcccccggcaatgcgcagtttggccaagggagtggaccaattgtgttggacgatgtgcgttgttcgggtcacgagtcctatctttggtcctgcccccacaatggctggttatcccacaactgtggtcaccacgaggacgcgggcgttatttgtagtgccgctcagtcccagtcaacccctcgacccgacacttggttgactacgaatttacctgcgctcacagtcggatctgaaagtagcctggctctaagacttgtcaacggaggggatcgctgtcgcggcagggtagaagtgctgtataggggatcttggggcacagtctgcgatgactcctgggataccaatgacgccaatgtcgtttgccggcaacttggatgtgggtgggcaatgagtgccccagggaacgcccgcttcggccaaggcagcggtcccatagtcctggatgacgtacgctgctcaggcaatgagtcttacctgtggagctgcccccacaaaggctggctgacacataactgcggacatcacgaagatgcaggcgtaatctgctcggcaactcaaattaatagcacaacgaccgattggtggcatcctaccaccactacgacagcccggccttccagtaattgtggcggatttctcttttatgccagcggcaccttttcttcaccgtcatacccagcgtattacccaaataatgccaagtgcgtgtgggagatcgaggttaacagtggatacagaattaacttgggtttttcaaatctcaagctggaggcacatcataactgctcatttgactacgtggagatattcgatggcagtctgaacagcagcctgcttctcggcaaaatctgcaacgacacacggcagatcttcacctccagctacaaccggatgactatccacttcaggtctgatatctctttccagaataccggcttcctcgcctggtacaattccttcccaagcgatgctacactgcgactggtaaatctcaacagtagttacggactatgtgcaggaagagtcgagatttatcatggcggcacgtgggggacagtgtgcgacgattcctggaccattcaggaagctgaggtcgtgtgtagacagttgggctgcggccgagccgtaagcgctctgggcaacgcatattttggctctggctctggcccaatcacgttggacgacgttgaatgctcaggaaccgagtcaactctttggcagtgcagaaatagaggctggttctcccataactgcaaccaccgcgaagacgccggcgttatctgctctggtaatcacctctccacccctgccccttttctcaacatcaccagaccgaacaccgattactcttgtggaggcttcctgtcccagcctagtggagacttctctagccccttttaccccggaaactaccctaataatgcaaagtgtgtctgggacattgaagtccaaaataactaccgtgtgacagtgatttttagagacgttcagctggagggcggatgtaactacgattatatagaggtgttcgacgggccttacaggtcctctcctctgattgccagagtttgcgacggcgctagagggtcctttacctcgtccagcaattttatgtcgatccggttcatctctgatcactctatcactagacgaggtttcagagctgaatactattcctccccctctaacgattctacaaacttgctgtgcctgcccaaccacatgcaggcatccgtgagccggtcctatctgcagtccttgggcttttcagcctccgatttagtcatctctacttggaacggttattacgaatgtcgcccccagatcaccccaaaccttgtcatcttcacaatcccgtactctgggtgtggcacctttaaacaggccgacaacgataccatcgattatagcaactttttgacggcggccgtttcaggcgggatcatcaagcggaggacagacctgcgcatacacgtatcttgtcgaatgcttcagaatacttgggtcgatacgatgtatatagcgaacgacaccatccatgttgccaataacactatacaagttgaggaagtccagtatggaaattttgatgtgaatattagcttttatacatctagtagttttctttaccccgtcacctctcgaccctactacgtcgacttgaatcaggacctttatgtccaggccgagattctgcactccgacgctgtgcttacactcttcgtggatacttgtgtggccagcccatatagtaatgacttcacctccttgacgtacgatctaattcgatctggctgcgtgagagacgatacttatggtccttactcttctccttcgctgcgcattgctcgcttccggtttagagctttccactttctgaatcggtttccatccgtttatttacggtgcaaaatggtggtgtgcagggcatatgacccttcaagcaggtgctacaggggctgcgtattgaggtccaaacgagatgtggggagctatcaggagaaggtagatgttgtgttaggccctatccaacttcagacaccaccacgacgggaagaggagcctcggtag

SEQ ID NO: 23860 - DNA, 5358 bp, Artificial Sequence
  Description of Artificial Sequence: Synthetic coding sequence
atgggcatcagcaccgtgatcctggagatgtgcctgctgtggggccaggtcttatccacaggtggatggatcccgcgcacaaccgattacgctagcttgatcccatcggaggtgcccctcgatccaactgtcgcagaaggaagcccatttccctctgagagtacactggagtcaacggtcgcggaaggtagtccaatatccctagaaagcaccctcgagagcacagtcgccgaaggcagtcttataccaagtgagagcaccctcgaatccactgtcgccgaaggtagcgattcaggacttgcgctcagattggtcaacggagacggcaggtgtcagggcagggtggagatactataccgcggctcttggggaacagtgtgcgacgattcctgggacactaacgatgcaaatgtagtatgtaggcaattaggatgtgggtgggcaatgtctgcccctgggaacgcatggttcggccagggatccggccctatagcccttgatgacgtgcgttgttccggccatgaatcatacctgtggtcctgtccccacaatgggtggctgagccacaactgtgggcacggggaagacgctggcgtgatttgtagcgccgcccagccccagtccactttgcggcccgaatcatggcctgtgcgcattagccctcctgtacccaccgagggcagcgagtcgtctttagccctcagactcgttaatggaggtgacaggtgcagaggacgcgttgaagtgctttaccgagggagttgggggacagtttgtgatgattattgggatacaaatgatgcgaacgtggtgtgtagacagctcggatgcggctgggcaatgagcgctcctggaaacgcccaatttggccagggtagcggtcccatcgttttagacgacgttaggtgtagtggccatgagtcatatctgtggtcctgcccacacaatggctggctgactcataattgtgggcactctgaggacgccggcgtgatttgtagcgcgccgcaaagtaggcctactcccagcccagatacttggccgacatctcatgctagcaccgctgggcccgagtcaagcctcgcgcttaggctcgtaaatgggggcgataggtgtcaggggcgggttgaggtactttatcggggatcctgggggacagtttgcgacgactcttgggatacttccgatgcaaatgtcgtgtgtagacaacttggttgcgggtgggccacgtcagcccccgggaatgcccgttttggacaagggtccggcccaatcgtgttagatgacgtccgatgctctggctatgaaagctatttgtggtcctgtcctcataacggatggttatctcacaactgtcaacacagcgaggacgctggcgtgatttgtagcgccgcccactcttggtcaacaccctctccagatacactccctacaataacgctccctgcttcaacggtgggctcggagagctcgcttgctctgaggctggtcaatgggggcgatcgctgccaagggagggtggaggtcctgtatcaaggatcctggggcaccgtctgtgatgattcctgggatactaacgacgcgaacgtggtttgccgacagctggggtgcggatgggccatgagcgcacccggaaatgccaggtttgggcagggctctggtccaatcgtgctcgacgatgtcagatgctctgggcacgagtcatatctttggtcgtgcccgcataacggctggctgagccataactgtggtcatagcgaggacgccggagtgatctgttccgcctctcaatcgcgccccacccctagtccagacacctggcccacctcacacgcctccacagcaggatctgagagctctctagctcttagactcgtcaacggcggggatcgctgtcagggccgagtggaggtgctgtaccgtgggagctggggaacagtctgcgacgactactgggacacaaatgatgctaacgtggtctgtagacagctgggatgtggttgggcaatgagcgctcccggcaacgcacggtttggtcaggggtccggacctatagtgctggatgatgttcgctgcagcgggcacgaaagctacctttggtcctgccctcacaacggctggctgtcccacaattgtggacatcatgaggatgcaggggtaatatgctccgcttcgcagtctcagccaacgccatcacctgacacttggccaactagtcacgcttccacagccggctcggagagtagcctcgccctccgtttggttaacggaggcgaccgttgccagggcagagtggaagtgctgtatagagggtcttggggtaccgtgtgcgatgattactgggacactaacgacgcaaatgttgtgtgtcgccaattgggatgcggctgggcaacctcagccccaggcaatgctcggttcggccagggttcaggacccatcgtcctggacgacgtccggtgctctgggcatgaaagctacttgtggagttgcccacacaacggatggttgtcccataattgtggccatcacgaagatgcaggggtaatttgcagcgccagtcaaagtcagccaaccccgagcccagacacctggccaacatccagagcgagcaccgccggttccgagtctaccctcgcgctccggctggtcaatggaggagataggtgccggggcagagtcgaagtgctttaccagggttcttgggggactgtatgtgatgactattgggacacaaacgacgctaatgtggtgtgccgccagcttggttgtgggtgggcaatgtccgcccccgggaacgctcagtttggccaagggtctggacctattgttttggatgatgttcgctgctcgggccacgaaagctatctgtggtcatgtccgcacaatgggtggttaagccacaactgtgggcaccacgaagatgctggcgttatttgctcagcggcacaaagccagtccacacctcgacctgacacatggttaacaacaaatttgcccgccctaacggttgggtctgaaagtagtctggctctgcgcctggtcaatggcggcgaccggtgtcgaggccgcgtggaggtgctgtaccgcgggtcttggggtaccgtgtgcgatgacagttgggacactaatgatgctaacgtggtatgccgtcagctgggttgcggctgggccatgagcgcccccggcaacgccaggttcgggcagggctctggtcctattgtgttggacgacgtgcgctgcagtggtaatgagagctacctgtggtcttgtcctcacaaaggctggctgacacataattgcggccatcatgaggatgctggcgttatctgtagcgctactcagatcaattctaccactacggattggtggcaccccactaccacgaccaccgcccgcccctcctcgaactgcgggggctttctattctacgcatccggcaccttttccagcccctcgtatccagcctactaccccaataacgcaaagtgcgtctgggagattgaggtgaactccggatacaggataaacttggggttctccaacctcaagttggaggctcaccataattgctctttcgactacgtggagattttcgacggcagcctgaactctagcctgctgctgggcaagatctgcaatgataccagacagatctttaccagcagctacaatagaatgacaatacacttccgaagcgacatttcttttcagaatactggttttctagcttggtacaattcattcccttctgatgccactttacgcctggtaaatctgaactccagttatggactttgcgcaggtagagtcgagatttaccacgggggtacctgggggacggtgtgcgacgactcgtggaccatccaggaggccgaggtagtgtgtcgccagctcggctgcggtcgagcggtgagtgcacttggcaatgcctatttcggcagcgggtctgggccaattactctcgacgacgtcgaatgttcaggtactgagagcaccctctggcagtgccgaaatcgcggatggttttctcacaattgcaatcatagggaggatgcaggggtgatctgctccggtaaccacctgagcacgcccgctcctttcttaaatatcactagaccgaacaccgactatagctgcggtggattcttgtcccagccatccggcgactttagctctcccttttaccctggcaattatccaaataatgccaagtgcgtctgggatattgaggtgcagaacaactaccgcgtgactgtcattttccgggacgtgcaattggaggggggttgcaactacgattatattgaagtgttcgacggaccctatagatcttctccactgatcgcacgggtctgcgatggcgccaggggatcgttcactagttccagtaattttatgtctattagatttatctctgaccatagcattaccagacgcggatttcgggctgaatactactcatcgcccagcaatgactccactaatctgttatgccttccaaatcacatgcaagcgagcgtgtcaagatcttaccttcagtccttgggattcagtgcttcggacctcgtgatcagcacttggaacggctattacgagtgccgaccgcagatcactccaaacttggtgatctttacaataccctatagtgggtgcgggactttcaagcaggccgacaatgacactatcgactatagcaacttcctgacagctgcagtttcaggcgggattatcaagcggcgaaccgatctgcgcatccacgtctcctgtcgcatgttgcaaaacacatgggtggacacaatgtatattgcgaatgacacgatccatgtcgcaaataacaccatccaggtggaggaggttcaatacgggaattttgacgttaatatttcattttacaccagtagcagctttctctatccagttactagtcggccttactacgtggatttaaaccaagacctgtacgttcaggccgaaatcctccactcagatgcggtgcttacactctttgtggacacttgcgtggcgtccccatatagtaatgactttacctcattgacttatgaccttatccgctccggttgtgtgagagacgatacatacggtccctattcgtccccctcgctcagaattgctaggtttcggtttcgagctttccatttcctgaatcggtttccgtcagtgtacctccgctgcaagatggtagtatgccgggcttatgatccctcctcccgttgctataggggatgtgtgttgagatctaagcgagatgttggttcctatcaggagaaagtcgatgtcgtgttggggccaattcagttgcagacccctccccgacgagaggaggagcctcgctag

SEQ ID NO: 23861 - DNA, 597 bp, Artificial Sequence
  Description of Artificial Sequence: Synthetic coding sequence
atggccgccgacatcagcgagagcagcggcgccgactgcaagggcgacccaaggaattccgctaagctggacgcggactacccactcagagtgctgtactgcggcgtgtgttccctgccaaccgagtattgcgagtatatgcccgatgttgcaaaatgtaggcaatggctcgagaaaaactttcccaacgagttcgccaaactgacggtagaaaactcccctaaacaggaagcaggcatctctgaagggcagggcaccgcaggtgaggaggaggagaagaagaagcagaagcgagggggacgaggtcagattaagcagaaaaaaaaaacggtaccccagaaagtgactatagctaaaataccacgcgccaaaaaaaagtatgtgacccgcgtgtgcgggctggctacattcgagatcgatctgaaagaggcacagcgcttctttgcacagaagttttcatgtggagcttccgtgaccggggaggatgaaatcataattcagggtgacttcacagacgacattatcgacgtcatccaggaaaagtggccagaagtagatgacgactctatcgaggacctgggcgaggtgaagaagtag

SEQ ID NO: 23862 - DNA, 1530 bp, Artificial Sequence
  Description of Artificial Sequence: Synthetic coding sequence
atggaccccccccgggccagccacctgagcccccggaagaagcggcctcggcagactggcgccctcatggccagttcaccgcaggatatcaaatttcaggacctggtggttttcatcttggagaagaaaatgggaaccactagaagggcttttctcatggaattagcacgcaggaagggattcagggtggaaaatgagttgtccgacagtgtgacccatatcgtcgccgagaataattccggatccgacgtcctcgagtggctgcaggctcagaaggttcaagtttcatcgcagcctgagctgctggatgttagttggctcatcgaatgtataagagccgggaagcccgtggaaatgaccggcaagcatcagctcgtggtccggagagactattccgactctaccaatcccggccccccaaaaaccccacccatcgcggtccaaaagatctcccagtacgcttgccaaagaagaaccactcttaataattgcaatcaaatctttacagatgcatttgacatcctggctgagaattgcgaatttcgcgaaaacgaagactcgtgcgttacattcatgcgagctgcctcagtcctgaagagcctcccgttcaccattatcagcatgaaagacaccgaggggatcccatgtttgggatctaaggtaaagggaataattgaggaaatcattgaggatggtgaaagttccgaggtcaaggcggtgctgaacgatgagcgatatcagagctttaaactgtttacttcagtatttggggtgggactcaagaccagtgagaagtggttccggatgggattccggacactttcaaaagtccgctccgacaaatccctgaaattcacaagaatgcagaaagctgggttcttatattacgaagatttggtgagctgcgtgacacgcgccgaggccgaggctgtgtcagtgctcgtgaaggaggctgtgtgggctttcctgcccgacgccttcgtcacgatgaccgggggttttcgcagggggaagaagatgggccatgatgtcgactttcttattactagcccgggctcgacagaggacgaggagcagctgctccagaaagtcatgaatctgtgggagaagaaaggcctgttgctgtattacgacctggtggaaagcacatttgagaagttgcgactgcccagccgaaaagttgatgccctggaccactttcagaaatgctttttaatctttaaactgccacggcagcgggtggacagtgaccagagttcctggcaggaagggaaaacgtggaaagccattcgcgtggatctggtactgtgtccctacgagcgaagagctttcgcactgctggggtggacggggagccgacagtttgaacgagacctccgacgctacgccacgcacgaaagaaaaatgatcctggataaccatgctctatacgataaaacaaagcgaattttcttaaaggcggaaagtgaggaagagatcttcgcccacctgggcctggattacattgagccatgggaaaggaatgcttag

SEQ ID NO: 23863 - DNA, 1527 bp, Artificial Sequence
  Description of Artificial Sequence: Synthetic coding sequence
atggaccccccccgggccagccacctgagcccccggaagaagcggccacggcagacgggtgccctgatggcgtctagccctcaggacataaagtttcaggatctggtggtgtttattttagaaaagaagatggggacgacacgcagggcatttctcatggagctggctcgcaggaaaggattccgagtcgagaacgagctgagcgatagtgtgactcatattgtggccgagaataatagcggctctgacgtcctagaatggctgcaagctcagaaggtgcaggtatcctcgcaacccgagctgctggatgtctcttggctcatcgagtgcattcgagccgggaaacccgtagagatgactgggaaacatcagctggtggttcgtcgtgactatagcgactctaccaatcccgggcctcccaagactccacctatcgctgtacagaaaatcagccaatatgcctgccagcgaaggactacactgaacaattgcaatcaaatattcaccgacgcttttgacatattggccgaaaattgcgaattcagagaaaatgaggacagctgcgtgacatttatgagagcggcaagtgtcttgaaatctctccccttcaccataatcagcatgaaagatacagagggcattccttgtctcggcagcaaagttaaggggattattgaggagattatcgaggatggggagtcgtccgaggtcaaggctgtcttaaacgatgagcgctaccaatcattcaaactcttcacctccgttttcggggttgggctgaagaccagtgagaaatggttccggatggggtttcgtaccttgagtaaagtgcgctccgacaaatccttgaagtttactagaatgcaaaaagctggattcctgtactatgaagatcttgtcagctgcgtgacacgggctgaggctgaggcagtctctgtgttggtgaaagaggctgtgtgggctttcctgcccgatgcctttgttaccatgaccggcggtttcagaaggggcaagaagatgggacacgacgtggatttcctaattacgtctccagggagcactgaagacgaggagcagctgctgcagaaggtaatgaacctgtgggagaagaaaggtctgctgctgtactatgacctggtggagtcgacattcgagaagctaaggctcccatcacggaaagtggacgcactagaccacttccagaagtgtttcttgatcttcaaacttccacgtcagcgggttgattcagaccagtcttcgtggcaagagggaaagacttggaaggccattagggtggacctggttctgtgcccctatgagagaagggctttcgcactcctgggatggaccggaagtcggtttgagcgggatctaaggcggtatgcgactcatgagcgcaagatgatacttgataatcatgccctctacgacaaaactaaacgtatctttcttaaggcggagtcagaagaagagatttttgcccacttaggccttgactatatagaaccttgggagcggaacgcttag

SEQ ID NO: 23864 - DNA, 2544 bp, Artificial Sequence
  Description of Artificial Sequence: Synthetic coding sequence
atggaggccgcccggcccagcggcagctggaacggcgccctgtgccgcctcctgttacttaccttggcaattttgatattcgccagcgacgcctgcaaaaatgtgacactccacgtgccctcaaaactcgatgcagaaaagctagttggtcgcgttaatcttaaggagtgttttacagccgcaaatctcatccacagctccgacccagactttcagatacttgaggacggaagcgtgtacaccaccaatacgattctgctgagcagcgagaagagatccttcaccatcttgctcagtaacaccgagaaccaggagaaaaaaaagattttcgtcttcctcgagcaccaaaccaaggtactgaagaaacgccatacaaaagaaaaagtgttaagacgcgctaagcgcagatgggcacccatcccttgttcaatgctcgagaactctttaggccctttccccttatttttacagcaggttcagtccgataccgctcagaactataccatctactattccatccgcggtcccggggtggatcaggagccacggaaccttttctacgtggagcgggacaccggaaatctgtattgcaccagacctgtcgatcgcgaacaatacgaatcttttgagattatcgcctttgccactacgcctgacggatacactccggagctcccgctaccgttgataattaaaattgaagatgaaaacgataactacccaatctttacggaggaaacctatacttttacgatcttcgagaattgtcgggtgggcacgactgtcggccaagtgtgcgccacagataaagacgagccagacacgatgcacacaagactgaaatacagtatcatcggccaggtcccgccttcccctacgctgttctccatgcatccaaccactggggtcataaccacgacttctagtcagcttgaccgggagctgatagataagtaccagctcaaaataaaggttcaggatatggatggccaatattttgggctacagaccacttccacctgtatcatcaatatcgatgatgtgaacgaccatctccctacatttacgaggacaagctatgtgacctcagtcgaggaaaacactgttgacgttgagattcttagagtcaccgtcgaagataaggatcttgtaaataccgcaaactggcgagctaactataccattcttaagggaaatgaaaatggaaattttaagatcgttaccgatgccaaaactaatgaaggcgtgttgtgtgtcgtcaagcctttgaactacgaggaaaaacaacaaatgattcttcagataggagtggtgaatgaggcacctttcagccgcgaagcctcacctaggtccgcaatgagcacagctactgtcacagtcaacgtcgaggatcaggatgaaggacccgaatgtaatcctcccattcaaactgtgaggatgaaagaaaacgcagaagtggggaccacctccaacggctacaaagcctacgacccagaaactcggtcttcctctggcattagatataaaaaacttaccgatcccaccgggtgggtaaccattgacgagaatactggaagtatcaaagtgttcaggtctttggaccgcgaagcggagacaatcaaaaatgggatttacaatataacagtgctggctagcgaccaagggggtcgcacctgcaccggcaccctaggaatcatactgcaggacgtgaatgataatagcccattcatccctaaaaagaccgttatcatttgtaaacctactatgtcctccgctgaaattgttgcagtggaccctgatgagcccatacatgggccccccttcgatttcagccttgagtcatccaccagtgaagtgcagaggatgtggagactgaaggccattaacgataccgccgccagactgtcttatcaaaacgacccccccttcggatcttacgtagtgcccatcacagttcgtgatcgcctcggcatgtctagcgtgacctcactcgatgtcacactgtgtgattgcatcacagagaatgactgcacacatagggtggacccacggatcggagggggcggcgttcagttaggaaagtgggctattctcgcaattttactcggtatagcactactcttttgcatcttgtttaccttggtctgtggtgctagtggaacttcaaaacagccaaaggtgatcccagacgacttggcccagcagaacctgatcgtgtccaatactgaggccccaggtgacgataaggtctacagtgctaatgggttcacaactcaaacggtgggggccagtgcccagggtgtatgcggaaccgtgggctccggcatcaagaacggggggcaggaaacaattgaaatggtcaagggtggtcaccagacctctgagagctgccgcggggccggccaccatcacaccctagactcgtgcagaggagggcatactgaggtggataattgcaggtatacttattcagagtggcacagttttacccagccacggctgggggaggagtcaattcgcgggcacaccttaattaaaaactag

SEQ ID NO: 23865 - DNA, 2706 bp, Artificial Sequence
  Description of Artificial Sequence: Synthetic coding sequence
atggaggccgcccggcccagcggcagctggaacggcgccctgtgcaggcttctcctactcacgttagccatactgatcttcgcatccgatgcctgcaaaaatgtgacgcttcatgttccatcgaaactcgacgctgaaaagcttgtagggcgcgtgaacctaaaggagtgtttcacagctgcaaatcttatccattcttccgacccagattttcagattcttgaggacgggagtgtgtatacaacgaatacaatactcttatctagtgagaaacgaagcttcaccatcctgctcagtaacaccgagaatcaggaaaagaaaaaaattttcgtatttctcgagcatcagaccaaagtccttaagaaaagacacacaaaggagaaggtgctgcgacgagccaaaagacggtgggcaccgattccatgttccatgttggagaacagccttgggccattccccctgtttttgcagcaggtccagtcagataccgcacagaactacaccatatactacagtatcaggggacccggggtggaccaagagccacggaacctcttttacgtggaacgtgacactgggaatctctattgcactcgtccggtggaccgggaacagtatgagtcattcgagatcattgcatttgcgactacgcctgacggatatacaccggagctgccgttacccctgatcattaagattgaagacgaaaacgataactacccaatctttactgaggagacctatacctttaccatcttcgagaactgtcgtgtcggcaccaccgtaggtcaggtatgtgcaactgacaaagacgagccagacacaatgcatacaagactgaagtatagcataattggacaggttccacctagccctactctgttcagtatgcacccgaccaccggagtgataaccacgacatccagccaactggaccgagagctgatcgataagtaccagctgaaaatcaaagtacaggacatggatggacagtacttcggcctgcagactacttcgacttgcatcattaatatagacgacgtaaacgatcacctcccaacgttcactcggacttcctacgttacttctgtggaggagaataccgtggacgtcgagattctccgggtgacagtggaggataaagatttagtgaatacagctaattggagagcgaattacaccattctgaaaggcaacgagaatgggaactttaagattgttacggatgccaaaacaaatgagggcgttttatgcgtcgttaagcccctcaattacgaggagaagcagcaaatgatcctgcagataggcgtggtgaatgaggcacctttctccagggaggcaagtccccgatcggccatgagcacggccactgtgacagtgaacgttgaagatcaggacgagggtccggagtgtaatccccccatccagaccgtaagaatgaaggagaatgctgaagtgggaacaacaagtaatgggtacaaggcctatgacccggaaaccaggagtagtagtggaatcaggtacaaaaaactgactgaccccacagggtgggtcaccatcgacgaaaatacaggaagtattaaggttttcagaagcctggaccgagaagctgagaccattaaaaatggaatctataacattaccgttttggcgtccgatcagggtggcaggacctgtacgggcactttgggtataatcctccaagatgtcaatgacaatagtccatttatacctaagaaaaccgtcatcatttgtaagccaaccatgtcatctgcggaaatcgtcgctgttgaccccgatgagcctatacacggaccaccctttgacttcagtctggagagctccacaagtgaggtacaaaggatgtggagactgaaggcgataaatgacactgcagctcgcctaagttaccagaatgacccgccttttggcagctacgtggtgccaatcacagttagggatcgcttgggcatgtcctccgtgacctcacttgatgtgacgctgtgcgactgcatcacagagaacgattgcactcacagggtggacccaaggatcggaggcggaggcgtccagcttggaaaatgggctatcctggccattctgctggggatcgctttactgttttgtattctcttcacactagtgtgtggggcgtctgggacctctaagcagccgaaggtgattccagatgatctggcacagcagaatctgatagtatccaacactgaggccccaggagacgacaaggtgtattcagccaacggatttactactcagaccgtgggagcttcggctcagggcgtctgtggtacggtcggatctggcataaagaatgggggtcaggagaccattgaaatggtgaaaggggggcaccaaacttcagagtcgtgccgaggtgctggacaccaccacacattagacagctgcagaggggggcacactgaggtcgataactgcaggtacacgtacagtgagtggcatagcttcacccaacccagacttggtgaaaaagtgtacctgtgtaatcaggatgagaatcacaagcatgcacaggactatgttctgacttataactacgaggggcgggggagcgttgccggaagcgtgggctgctgctctgaaaggcaggaggaagatggcctagagttcttagacaatcttgaaccaaagtttcgtactttagctgaagcatgcatgaagcgttag

SEQ ID NO: 23866 - DNA, 2745 bp, Artificial Sequence
  Description of Artificial Sequence: Synthetic coding sequence
atggaggccgcccggcccagcggcagctggaacggcgccctgtgccgccttctcttgttaactttggcgattttaatatttgcttccgacgcctgtaaaaacgtaactctgcacgtgccatccaaactcgatgcagagaaactcgtcggccgagtaaacctaaaggagtgttttaccgctgcgaatctgatccactcatcggatcccgatttccagatcctcgaggatgggagcgtatatacaacgaacacaattcttcttagttctgagaaaagatccttcacaatactgctttccaatactgagaaccaggagaaaaaaaaaatttttgtatttctggagcatcagactaaaatttctctcttagtaccatggctgtgcctggtggccgaagtattgaaaaaacggcataccaaggaaaaggtactccgtagggctaagagacggtgggcgcctattccttgcagcatgttggagaacagtttggggccctttcctctgtttttgcaacaggtgcagtcagacacagcccagaattatacaatctactatagtattcgcggacccggagtcgaccaagagcccaggaacctgttctacgtggagcgcgatacaggtaatctttactgtactcggccggtggatcgcgagcagtacgaatcatttgagatcattgcattcgccactacaccggatggctatactccagagctcccattgcccctgattatcaagatcgaggacgaaaacgataactatcccatcttcactgaggagacatatacattcactatcttcgagaactgtcgtgtcgggacaactgttggacaagtgtgtgccaccgataaggacgaaccggacacaatgcacactcgcctgaagtattccatcatcggtcaagtaccacccagccccactctgttcagtatgcaccccaccactggcgtgatcacgactaccagttcacagctggacagagagcttatagacaaatatcagcttaagattaaggttcaggatatggatgggcaatacttcggactgcagacgacgtcaacatgcatcataaatattgacgatgtaaatgaccaccttccaaccttcacaagaaccagctacgtgacaagtgtcgaagagaacacggtggatgtggagatcttgagagtaaccgtggaagataaggacctggtgaatacagccaattggagagcgaattacacgattctcaagggcaatgagaacggaaatttcaagatcgttacggacgctaagacaaacgagggtgtgctgtgcgtggtcaagccacttaattatgaagagaagcagcagatgattctgcaaattggggttgtcaacgaggccccattctccagagaagcatcaccacgctctgccatgtccacagccaccgtgaccgtaaacgtagaggaccaggacgagggacctgagtgcaatcccccgatccagactgtccgaatgaaagagaatgcagaagtcggcaccacctccaatgggtataaggcctacgacccagaaacccggagttcctcaggaataaggtacaagaaactcacagatcctacaggttgggtgactatcgacgaaaacaccggcagcataaaggtctttcgaagcctggatagggaggccgagaccatcaaaaacgggatctataacatcacagttctggcctcggatcaaggcggacgaacttgtacaggaactctggggattatcctgcaggacgttaacgacaactcccccttcatacctaagaagaccgtcattatctgtaagccaaccatgtcatcagccgaaattgtggcagtggaccccgacgaacctatacacggacccccttttgacttctccctcgagtcttctaccagcgaagtgcagcgcatgtggaggcttaaggctattaacgatacagccgctcggttatcttaccagaacgatcccccatttggaagctatgtcgtccccattacagtgagggatagattagggatgagctctgttaccagcctggacgtgacactgtgcgattgcattacggagaacgactgtacacatcgggtagatccaagaatcgggggcggaggtgtacagctgggcaaatgggcaattctcgctatcctgctgggcattgctttgctcttttgcatcctttttacgttggtctgtggggcaagtggaactagcaaacagccaaaggtgatcccagacgacctagctcagcagaatctgattgtcagtaatactgaggctcctggcgacgacaaagtatactctgccaatgggtttacaacccagacagtgggtgcctccgcccagggtgtgtgtggtacagtcgggtcaggcatcaagaacggaggacaggaaactattgaaatggtgaagggtggacaccagacctctgaatcctgtagaggagccggacaccaccacactttggattcatgtcgaggcggtcacaccgaggtggataactgccggtatacctatagcgaatggcactcgttcactcaaccaaggcttggagaaaaggtgtatctatgtaaccaagacgagaaccataagcatgctcaggactatgttctgacatacaactatgaaggcaggggctctgtggccgggtcagttggctgttgctctgagcggcaagaagaggacggtctcgagttcctggataatttagagcctaagtttagaaccctcgcggaggcatgcatgaagcggtag

SEQ ID NO: 23867 - DNA, 2004 bp, Artificial Sequence
  Description of Artificial Sequence: Synthetic coding sequence
atgaagatgatcaccacccagttcctgcagaagaagctgatcctgctccagtttctaaagattgcagaatgggggaccaccgtcggacaagtctgcgccactgacaaggatgaacctgacactatgcatactagacttaagtactctattataggtcaggtgcctccatcaccaactctgttttctatgcacccgaccacgggggttattaccacgacatcgagtcagttggacagggagctgatcgacaaataccagctgaaaattaaggtacaagatatggatgggcaatattttggattacaaactacttctacctgtatcatcaacatcgacgacgttaatgatcatcttcccacctttacacgtacatcctacgtaacgtcagtggaggagaatacagtggacgtggagattctgcgcgttacggtggaagacaaggacctggttaacaccgcgaattggagagccaattataccatcttgaaaggaaatgaaaatgggaacttcaagattgtgaccgacgcaaagactaacgagggagttctctgcgtagtaaagcctttaaactacgaagaaaagcagcagatgatcctgcaaattggggtggttaatgaggccccattctcccgcgaagctagccctaggtctgcaatgtctactgcaacggtcacagtgaatgttgaggatcaagacgagggcccagaatgcaatccaccgattcagaccgtacggatgaaggagaatgctgaggttggaactacatcaaacggatataaagcatacgatcctgaaacccggagctcaagcggtataagatacaagaaacttactgaccccactgggtgggtgaccatcgacgaaaacactggctctatcaaagtgttccgctcactggatagagaagcagaaactattaagaatggcatctacaacattactgtgttggcatcagaccagggtggtcggacctgtactggtaccctcggaatcatccttcaggatgttaacgataacagtcccttcatccctaagaagaccgtcatcatctgtaaaccaacgatgtccagcgccgaaatcgttgccgtggaccccgacgaaccaattcacgggccaccatttgatttcagcttggaaagttctacgtctgaggtgcagagaatgtggaggctaaaggccataaacgacacagcagcccgtctgagctatcaaaacgatcccccctttggcagttacgtggtgcctatcactgtacgcgatcgactggggatgagttcagtcacgtcacttgacgttacactctgcgactgtatcaccgagaacgactgtacgcacagagtggatcccaggatcggtggaggaggggtccagctgggtaaatgggcaatattggccatactgctgggcatcgcccttttgttctgtattctcttcaccctggtctgcggagcatcgggaaccagcaaacagcctaaagtgattcccgacgatttggcgcaacaaaacctcattgtgtctaacacagaggcccccggagacgacaaagtatactctgctaatggtttcacaacgcagaccgtgggcgcaagcgcccagggagtgtgcggaaccgttgggtcaggcataaaaaatggggggcaggaaactatcgaaatggttaagggcggccaccagacgagcgagagttgtcgcggcgcgggccatcatcatactttggattcgtgtcgcggtggtcacaccgaggtcgataattgtcgctatacttattcagaatggcattcattcactcagcctaggctgggagagaaggtctacctgtgcaaccaagatgagaaccacaaacatgcccaggactatgtcctgacgtataattatgaaggcaggggcagcgtcgccgggtctgtgggctgctgttccgagcggcaggaagaagacggcctagagttcctggacaacctggagcccaaatttcgaacgcttgcagaggcctgtatgaaaagatag

SEQ ID NO: 23868 - DNA, 3000 bp, Artificial Sequence
  Description of Artificial Sequence: Synthetic coding sequence
atgatgggcctgttcccccggaccaccggcgccctggccatcttcgtggtggttatccttgtgcatggggagttgaggattgagacgaaaggtcagtacgacgaagaagaaatgaccatgcagcaggcaaagagacgacagaagagagagtgggttaagttcgccaagccgtgtcgggagggagaggacaattcaaaaagaaaccccatcgcaaaaatcacctcagattaccaggcaactcagaaaattacctataggatatccggggtgggcattgatcagcctccctttggaatttttgtagtcgataagaatactggcgatatcaacatcacagccatcgtggaccgggaggaaactcctagcttcttgatcacatgtcgagcactgaacgcgcaaggcctggatgtggagaaaccgctcattctgactgtgaaaattcttgatattaatgacaatccccccgtgtttagtcagcagatctttatgggcgaaattgaagagaactccgcctccaattccctcgtaatgattctgaacgcgacagacgccgatgaacctaaccatctcaacagcaagatcgcgttcaagattgtgtcccaggagcccgccggtacgcctatgtttctcctgtcaaggaacaccggcgaagtccggaccttgacaaacagccttgatagggagcaagcaagttcctacagacttgtggttagtggtgcagacaaggacggagagggtctttcgacccagtgcgagtgcaacatcaaggtgaaggacgtgaatgataattttccaatgtttagggatagtcagtactcagccagaatagaagagaatattttgtcatcggaactgttgcgattccaggtgaccgacctggatgaagagtacacagataactggctggccgtgtacttttttactagcggcaacgaagggaactggttcgaaattcagacagatccacgaaccaacgagggcatcctcaaggttgtgaaggccctcgattatgaacagctccagtcagtcaagctgtccatcgccgttaaaaacaaagctgagttccaccagagcgtgatcagcagatatagggtgcagtccactcccgtgaccatccaagtcatcaacgtgagagagggcatagcatttagacccgcttccaagacttttaccgttcagaagggaatatccagtaaaaaactagtggattacattctgggcacctatcaggcaatcgacgaggacaccaacaaggccgccagcaacgtgaagtacgtgatggggcgaaacgatggagggtatctcatgatcgactccaagactgccgagatcaagttcgtgaaaaatatgaacagggatagtactttcatagtcaacaaaactattacagcggaggtgctcgcaattgacgagtatacgggaaagacatccacgggcaccgtctatgtaagagtgcctgactttaacgacaattgccctacggctgtgcttgagaaagatgccgtctgctcttcttctccctctgtggtagtgtccgcccgcactcttaataaccgctacaccgggccctatacattcgcattggaggaccaacccgttaagctgcctgctgtctggtccatcaccactctcaatgccacttctgctctccttcgagcacaggaacagattccacctggcgtttaccatatcagcctggtcctgacagactctcagaacaatagatgcgagatgccacggtccctgaccctggaggtgtgtcagtgtgacaaccggggaatttgcggcaccagttaccccacaactagccctggaacacgatacgggcgcccacattccggcaggctgggtcccgccgctattggactgttgctattgggattattgctgctcctgttggcccctctccttctgcttacatgcgattgtggcgccggctccacagggggcgtgaccggtggatttattcctgtgcccgacgggagcgaggggacgattcatcagtggggcatcgaaggcgctcatccagaggacaaggagataacgaatatctgcgttcccccggtgacagcaaacggagctgattttatggagtcatccgaagtctgtacaaatacatacgctaggggcacggcggtcgagggcacgagtgggatggaaatgaccacgaaattgggtgctgccacagaatctggcggagcggccggcttcgccacaggaacggtttccggtgcagcctcaggttttggcgctgcgaccggcgtgggaatttgctcatcaggtcaatcaggcacaatgaggacgcgtcatagcaccggaggaacaaataaggattacgctgacggagctatttcaatgaatttcctggactcctacttttctcagaaagcctttgcctgcgcagaagaagatgacggacaagaagccaatgattgtctgctcatttacgataatgagggagctgacgcaaccgggtcgcccgtcggatccgtgggatgctgtagctttattgccgacgacctggatgacagtttcctggacagcctgggccccaaatttaaaaaactggcagagatctccctgggagtcgacggggaggggaaggaggttcagccacctagtaaagacagcgggtacgggattgaaagctgtggtcaccctatcgaagtgcagcaaacaggcttcgtaaagtgccaaaccctgagcgggtctcagggcgcttcggccctgagcacctctggttccgtgcagcctgctgttagcatccctgatcccctgcagcatggcaactatctcgttactgagacctactcagcgagcggtagcctcgtccagccatccaccgctggattcgacccacttctgactcagaacgttatcgtgacagaacgggtgatttgtccaattagcagtgtgcctgggaacctggcaggtcccacccagcttcggggttcccacactatgctctgcacggaggacccttgtagtcgcctgatctag

SEQ ID NO: 23869 - DNA, 8616 bp, Artificial Sequence
  Description of Artificial Sequence: Synthetic coding sequence
atgagctgcaacggcggcagccacccccggatcaacaccctgggccgcatgatacgcgctgaatccggcccggatctccgctacgaggtaaccagtggtggtggcgggacctcccgtatgtattactctcggcgtggtgtgattacagaccaaaactcagacggctactgtcagactggtaccatgagcaggcatcagaatcagaacaccattcaggagctgttacagaactgctccgactgccttatgcgtgccgaactaatagtgcagcccgaactcaaatacggggacgggattcagcttaccagatcacgcgagctggacgagtgctttgcccaagcaaatgatcagatggaaattttagatagcctgatacgtgagatgagacaaatgggccagccatgtgacgcttaccagaaaagacttctgcaactgcaggaacagatgcgcgcattatataaagcaataagcgtccctcgggtgagacgagcttcctcaaagggagggggcggctatacgtgccagtcgggatctggatgggatgagttcacaaaacacgttacatcggagtgcctaggctggatgagacagcaaagggccgaaatggacatggttgcttggggtgtggacctagctagcgttgaacaacatatcaactcgcataggggtattcataactcaatcggtgactacagatggcagctcgataagatcaaagccgacctgagggagaagagcgctatatatcaactggaggaggaatatgaaaatctgctgaaggcctctttcgagagaatggaccacctaaggcagttgcagaatatcatccaggctaccagccgcgagatcatgtggataaacgattgcgaggaagaggaactgttgtacgactggtccgacaaaaataccaatatagctcagaagcaagaggcattctccatcaggatgagtcaattagaggtgaaagaaaaagagctgaataaacttaagcaagagtcagaccagcttgttttgaatcagcaccctgcgtccgacaaaattgaagcgtatatggacacattgcaaacccagtggagttggatcctgcagatcaccaagtgcatagacgtacatctcaaagagaatgcagcttactttcagttttttgaagaagcccaaagcaccgaggcctacttgaagggacttcaggactcaatcagaaagaaatatccctgcgacaagaatatgcccttgcaacacctattagagcaaatcaaggaattagagaaggagcgcgaaaagatattggagtataaaagacaggtacaaaaccttgttaataagagcaagaaaattgtacagctgaaaccccgcaatccggactatagaagcaacaagccaatcatcctgagggccctctgcgactacaagcaggatcaaaaaatagtgcataagggggacgaatgtatactgaaagataacaacgaacggtcaaaatggtatgtgaccgggcctgggggcgtagacatgcttgttccatcagtcggcttaattatcccccccccaaatccactggctgtggatctgagctgcaaaatagagcagtattatgaggctatactggcactatggaatcaactgtacataaatatgaaatcacttgtgagttggcactactgtatgatagatatcgagaaaattagagctatgactatcgcaaagctaaaaactatgaggcaggaggattacatgaagaccattgccgacttggagttgcattatcaggagttcattaggaattctcagggatccgagatgtttggggacgacgataaaaggaaaatccagtcccagtttaccgacgcccaaaaacattaccagactctggtgatccaactgcctgggtaccctcaacaccagactgtcacaacaaccgagatcacccatcacggaacttgtcaggacgtgaatcacaacaaggtgatcgaaaccaatcgggagaatgacaagcaggagacctggatgctgatggagttacagaaaataagaaggcagatcgagcattgcgaaggaagaatgaccctcaagaatttgcccctggccgaccagggctcctctcaccatatcaccgtcaaaatcaacgagctcaaaagcgttcagaatgactctcaagccattgctgaggtcctcaaccagctcaaggatatgctcgccaactttcggggcagtgagaaatattgctatttacaaaatgaagtattcggtctctttcagaaactggaaaacataaacggcgtgacagatggttacctgaactccttgtgcaccgtcagagcgctgcttcaggctatactgcagacagaagatatgctaaaggtctacgaggcacggctcaccgaggaagagacagtgtgtttagacctggacaaagtcgaggcctataggtgtggcttaaagaagataaagaatgatcttaaccttaaaaaaagtctgctagccacaatgaaaaccgaacttcagaaagcgcagcagatccatagccagacgtcacagcagtatccgctgtacgatctcgatcttggcaagtttggtgagaaagttacccagctgactgataggtggcagcgaatcgacaaacaaatagatttcaggctctgggatctcgaaaagcagattaagcagctcagaaactatagggacaactaccaggctttctgtaaatggctttacgacgccaagagacgccaggattctctagagtcaatgaagttcggagattctaacaccgtcatgagatttctgaacgagcagaagaacctacatagtgagatttccgggaagcgtgacaaatcagaggaggtgcagaagattgctgagctgtgtgccaactctattaaagattatgagctccagcttgccagctatacgtccggtttggagactctgctgaacatccctatcaaacggaccatgatacagtccccatccggcgtgatcctccaggaagctgccgacgtgcacgctcgttatatcgagctgctgacccggagcggcgactattaccgtttcctttctgaaatgctgaagtcactggaggacctcaaactcaagaacaccaagattgaggtcttagaagaggaactccgtcttgcccgagacgccaattcggaaaattgcaataagaacaagttcttagatcagaacttgcagaaatatcaagccgagtgcagccagtttaaggccaaactggcctccctcgaggaactgaagagacaggcagagctggatggtaagtcagctaagcaaaatctggataagtgctatggccaaataaaagagttgaacgagaagatcacccggctgacttatgagatcgaagacgaaaagcgtagaagaaaaagcgtagaagatagattcgaccagcaaaaaaatgattatgatcagcttcaaaaagcgagacagtgcgaaaaagaaaatttgggatggcagaaattggagtccgaaaaggctattaaagaaaaggagtacgagatcgagcggttaagagtgctactccaggaggaaggcacacgcaagcgtgagtatgagaacgagctggcaaaggtcagaaaccactacaacgaggagatgagtaacctgcggaacaaatacgagacggagattaatatcactaagaccaccatcaaggagatttcgatgcaaaaagaggacgactctaagaacctgcggaatcaattggatagactgtcaagagagaaccgggacctaaaagacgagatcgtcagactgaacgacagcatcctgcaggctaccgagcagcgccgccgcgccgaggagaacgcattgcagcaaaaggcgtgcggttccgaaatcatgcaaaaaaaacaacatttggagatagagttaaaacaggttatgcagcaaagatctgaggacaacgcacgtcataaacagtccctggaggaggctgccaagacaattcaggacaaaaacaaggaaatagagaggctcaaggcagaatttcaagaggaggcaaagcggcgatgggaatatgagaacgaactctcaaaagtgcggaataactatgatgaggagattatctcactcaaaaatcagttcgaaaccgagatcaatattactaagacgacaattcaccagctaaccatgcagaaggaggaggacacttccggctaccgggcacaaattgacaacctgacgcgagagaaccggtctctttcagaggagatcaaaagactgaagaacacgctgacgcaaacgacagagaacctaagacgcgtcgaggaggatattcagcaacaaaaggccactgggagtgaagtcagtcagcggaagcagcagcttgaggtggaactccggcaagtcactcagatgaggactgaggaaagcgtccgctacaagcagagcttggacgacgccgccaagactattcaggataagaacaaggagatcgaacgactgaagcagctgattgacaaagaaacaaatgataggaagtgtctcgaggatgagaatgcacgactccagcgggttcagtacgacctccaaaaggccaactcgagtgccacagaaacaatcaacaagctcaaagtccaggagcaggaactgactagactcagaatagactacgagcgagtcagccaggaacggacagtgaaagatcaggatattactcgctttcagaacagtctgaaggagttgcagcttcaaaagcagaaagttgaagaagagttaaataggctaaaacgtactgctagcgaggactcctgcaagcgcaagaaactggaggaagaattagaggggatgcgtagatcactcaaagaacaagctattaaaatcaccaacctgacccagcaattagaacaggcctcaatcgttaagaagagaagcgaagacgatctgcgtcagcagagggatgttctcgatggccacctcagggagaagcagcgcacccaggaagaactgagaagactttcctcagaagtggaagcactgcgtagacaactgctccaggaacaggaaagtgtgaagcaggcccacctcaggaatgaacacttccagaaagccattgaggataaatccagatcgttgaatgaaagtaagatagagatcgagcgactgcagtctttgacggagaatttgacaaaggaacacctgatgttggaagaggaactacggaatctgcgcctcgaatacgacgacctgaggcggggaagaagcgaggccgactcagataaaaacgccacgatcttggaactgcggagtcagctgcaaatatctaacaatcgcaccctcgagctccaaggcctgattaacgatctgcaacgcgaacgggaaaatctaagacaggaaattgaaaagttccagaagcaggcgctggaggcaagcaatagaatacaggagtcaaagaaccaatgcacccaagtcgtgcaggagagagagtcgttattagtgaaaattaaggtcttagagcaggataaggccagactccagaggctcgaggatgaactgaatcgcgctaagagcaccctcgaggctgaaacacgagtgaagcaacgcctggagtgcgagaaacagcaaatccagaatgatctgaaccagtggaaaactcagtactcccggaaggaggaagctattcgtaaaatagaatcagagagggaaaagagcgagcgtgagaaaaatagtctgcggagcgagattgagagactccaggcggaaatcaaacgaattgaagaacggtgccgacggaaactggaggattcgacaagggaaactcaatcacagctggagactgagcggagtcgctatcagagagaaatcgataagctgcggcagcgtccctatggttcacaccgtgagacccagactgagtgcgaatggaccgtggatacgtctaagttagtgttcgatggattgcggaaaaaagtcactgccatgcagctttacgagtgtcagcttatagataaaacaactttggacaaactgctcaagggaaaaaaatcagtggaagaagtggccagtgagatacagccgtttttgcgcggggccggcagcatagcaggagcatccgcttcaccaaaggaaaagtactctttggtcgaggctaaacgaaagaagctgatctccccagagtccaccgtgatgctcctggaagcacaggcagccactggaggtatcatcgacccccacagaaacgagaagctgacggttgactccgcaattgctcgtgatcttattgattttgacgacagacaacagatatacgctgcagagaaggcgattaccggttttgacgatccattctccgggaaaacagtgagtgtcagcgaggcaatcaaaaaaaacctaattgaccgagaaacaggaatgaggttactggaagctcagatcgcaagtgggggagtggtggatccggttaacagcgttttcctccccaaagacgtagccctggcccggggtttgattgacagagatctgtatcgatcattgaacgacccccgggactcacagaagaacttcgttgaccccgtaactaaaaagaaggttagttacgtgcagttaaaggagagatgccggatagagcctcacaccggattgctactgctgtctgtgcaaaaacgctctatgagcttccagggaattcgacagccggtgacagtgactgagctggtggacagcggaatcctgagaccgtccactgtcaatgagctcgaatctggtcaaatttcttacgacgaggtgggggaaaggatcaaggatttcctgcaggggtccagttgcattgcaggcatctacaatgaaacaacaaagcaaaagcttgggatctacgaggctatgaagatcggcttggtaaggcctggcacagcgctggaactcctggaggcacaggccgctacaggcttcatcgttgacccagtgagcaaccttcgcctgccggtggaggaagcatataagcggggcttggtgggcattgagttcaaggaaaaactcctttccgccgaaagagctgtcacagggtataatgaccctgaaaccggaaatatcatatccctgttccaggccatgaataaggaactcatcgagaagggccacggtattcggttgctggaggcccagatcgccaccggcgggattatcgacccaaaggaatctcataggctgccagttgatatcgcgtataaaagggggtatttcaatgaagagctctccgaaattctgtcagaccctagcgatgacacaaaggggttctttgatcccaataccgaggaaaacttaacttacctgcaactcaaagaaagatgcattaaggacgaggagacagggttatgccttctgccgctgaaggagaaaaagaaacaggtgcaaacttcacagaagaacaccctgagaaaaagaagagtcgtaattgtcgaccccgagactaacaaggagatgtcagtccaggaggcctacaaaaaaggcctcattgattacgagacttttaaagagctctgtgagcaggaatgtgagtgggaggagattaccatcacaggctctgacggctctactagggtggttctggtcgaccgcaagaccggaagccagtacgatatccaagacgccatagacaagggactcgtggacagaaagttctttgaccagtacaggtctggcagcctttcacttactcaatttgctgatatgatctccctgaagaatggtgttggaaccagcagtagtatgggctctggcgtgtctgatgacgtgttctcaagttctagacacgaaagcgtctccaagattagtacaatcagctctgtgaggaacctcaccatacgctctagttccttttccgatacgttggaagaatcctcccccatcgcagcgattttcgacaccgagaacttggaaaaaatttccatcactgagggcatagaaagaggtattgttgacagcatcaccgggcagaggctattggaggcccaggcctgtaccggcggaatcatccaccccaccacagggcagaaactctcgctgcaggatgccgtcagccaaggggttatagaccaagacatggctaccagactgaaacctgctcaaaaggcttttataggattcgagggggtgaagggtaagaaaaaaatgagcgccgcagaggcagttaaagaaaaatggctcccctatgaggcgggccagcgttttctcgaatttcagtatttgactggaggattagtggatcctgaggtgcatggacggatcagtacagaggaggccatcaggaagggattcatcgacggccgggccgctcaaaggcttcaggatacatcatcgtacgccaaaatactgacatgtccgaaaacaaagcttaagatctcctataaggatgccattaaccgctctatggtcgaggatatcacggggttaagactgttagaagccgcatctgtttccagcaaaggactcccttccccatataatatgtccagtgcacctggctcaaggtccgggtcccggtctggaagtcgcagcggttctagatccggctcacggtcaggatccaggcggggcagctttgacgctacaggaaactcttcatactcatactcctattcattttcctcttcgtcaattggtcattag

SEQ ID NO: 23870 - DNA, 2862 bp, Artificial Sequence
  Description of Artificial Sequence: Synthetic coding sequence
cagcagcagcgggccgagatggacatggtggcctggggcgtggacctggcgagcgttgaacaacacattaattctcaccgcggaattcacaacagtatcggagactacaggtggcagcttgacaaaatcaaggctgacctgcgagaaaagtctgccatctaccagttggaggaagagtatgaaaacctgttgaaagccagctttgaacgcatggatcatctgcgacagctgcagaatatcatccaggctaccagccgcgaaattatgtggatcaatgattgcgaggaggaagagcttctttacgattggagtgacaaaaacacgaatatcgcccagaagcaggaggccttcagcattcgtatgtctcaattggaagtcaaggaaaaagagctgaacaaactgaaacaggagtctgaccagctggttctaaatcagcatccagcaagcgataaaatcgaggcatatatggatacactgcaaacccaatggtcctggatcctgcaaattacaaaatgcattgatgtacatctcaaggaaaacgccgcctatttccagtttttcgaggaggctcaaagcactgaggcctatctgaagggcctccaggattccattaggaagaagtacccgtgtgacaagaatatgccacttcaacatcttctcgagcaaatcaaggagctcgagaaggaaagagagaaaatccttgagtataagagacaggtgcagaatctggtgaataaatccaaaaagattgtgcagcttaagccgcggaaccctgattaccggtctaacaagcccattattctgagggcgttgtgtgactacaagcaagaccagaaaattgtccacaagggagacgagtgtatcttgaaagataacaacgagaggtctaagtggtacgttaccggccctgggggggtggacatgttggtaccctcagttggccttatcataccaccccccaacccccttgccgtggacctctcgtgtaaaatagagcagtattatgaagcaatcctggccctgtggaaccagctgtacataaacatgaaatcgctcgtgtcgtggcactattgtatgattgacattgaaaagatcagagcaatgaccattgccaagctgaagactatgagacaggaagattacatgaaaacgatcgctgatcttgaactccattatcaagagttcatcagaaattctcagggctcagagatgtttggtgatgacgacaagcgcaagatccagagccagttcaccgacgctcagaagcactaccagacacttgttattcagttgcctggctacccgcaacaccaaacggttactacgacagaaatcacacatcatggcacctgccaggatgtgaaccataataaggtgattgagactaatcgggagaacgacaaacaggaaacatggatgctgatggaacttcaaaagatccggcgccagatagagcattgcgaggggcgaatgacactgaagaatcttccattggccgatcagggcagcagtcaccatattacggttaagataaatgagcttaagtctgtgcagaacgatagccaggcgattgccgaggtgctgaaccagctgaaggatatgctggcaaacttccgcggctcagagaagtactgttatctccaaaacgaggtcttcggcctgtttcagaaactggagaatataaatggagtcaccgatggctatctgaactctctgtgtaccgtcagggcgttgctgcaggcaattctccagacagaggatatgctgaaagtgtatgaagcacgcctgactgaagaggagacggtgtgtctcgacctcgacaaggttgaggcctaccggtgcggacttaagaaaattaaaaacgatctcaacctcaagaaaagtctccttgcgacgatgaaaacggagctccagaaagcccagcaaatccactctcagacctcacagcagtaccccctgtacgacctggacctgggcaaattcggagaaaaggtgacacagctgaccgatcgatggcaacgcattgacaaacagatcgattttcgcctctgggacttagagaaacagattaagcaactgagaaattatcgtgataactaccaggctttttgcaagtggctgtacgatgctaaaaggaggcaagactccctggagtccatgaaattcggggattctaacaccgtcatgaggtttctgaacgagcagaagaacttgcacagcgaaatttcagggaagcgcgacaaatccgaggaggtccagaagatagccgaactgtgcgccaattcaatcaaggactacgagttacaactggctagctatacaagcggcctggaaacattgctgaacataccaatcaaaagaaccatgatccagtccccaagcggggtgattctccaggaggctgctgacgtccatgcccggtacatagaactactcactcgcagtggcgactactacagattcttgtccgagatgttaaagagcctggaggaccttaaattaaaaaacacaaagattgaagttctcgaggaagagctgcgccttgcaagagacgcaaactctgagaactgtaataagaataaatttctcgaccagaatttacagaagtaccaggcagagtgctctcagttcaaagctaagctcgcctcgctcgaagaactaaaacgccaggcagaactcgacgggaagtctgcaaaacagaacctggacaaatgctacggacagattaaggagctcaatgagaaaattacccgcctgacctacgagattgaggacgagaagaggaggcggaagagcgttgaggatcgcttcgatcaacaaaaaaacgactacgaccagctccagaaggccagacagtgttag

SEQ ID NO: 23871 - DNA, 6819 bp, Artificial Sequence
  Description of Artificial Sequence: Synthetic coding sequence
atgagctgcaacggcggcagccacccccggatcaacaccctgggccggatgatcagggccgagtctggtcctgacctccgatacgaggtcacctccggaggtggtggaacttccagaatgtattacagtaggcgaggggttatcacagaccagaacagcgacggctattgccagaccgggaccatgtcacggcaccagaatcagaataccattcaggagctgctccaaaattgttccgattgcctgatgcgcgcagagctgattgtgcagcctgaacttaaatatggggatgggatccagctgactaggtctcgggagctggacgagtgtttcgctcaggcgaacgaccaaatggagattctggacagcttgatcagagaaatgaggcagatggggcaaccttgcgatgcgtaccagaagcgacttttgcagctgcaggagcagatgcgcgccctctacaaggcaattagcgtgccaagagtgcgtcgggcttcctctaagggtggcggaggatacacttgccaatccggctcggggtgggacgagtttaccaaacatgttacaagcgaatgtttgggctggatgcgacagcagcgcgctgagatggatatggtggcctggggtgtagacctagcttctgtggagcaacacatcaattcgcaccgaggtatccacaacagtatcggcgactatcgttggcagcttgataagattaaggctgacctgagggagaaatctgcgatctaccagctggaggaagagtacgagaatctgctcaaagctagtttcgagagaatggatcacctccggcagctgcagaacattatccaggcgactagcagggagataatgtggatcaacgattgcgaggaagaagaacttctgtatgactggtccgacaagaataccaacatcgcacaaaagcaagaggcctttagtataaggatgtctcagctcgaagtaaaagaaaaagaactgaataagctcaaacaggagtccgatcagctggtgctgaaccagcatccagcatctgataaaattgaagcttatatggacacacttcagacgcagtggtcgtggattctgcagataactaagtgcatcgatgtgcacctcaaggaaaatgcagcctattttcagttctttgaggaggcccagtccacagaggcatacttgaagggcttgcaggattccatccgcaaaaaatatccctgcgacaaaaacatgcctcttcagcacctgctggagcagatcaaggaattggaaaaagaacgagagaagattctcgaatacaagcggcaggtgcagaatctggtgaataagagcaaaaagatagtgcagttgaagccgcggaatcccgactacaggtcgaataagcccatcattctgagggcattgtgcgactacaagcaggatcagaagatagtgcacaagggagatgagtgtatcctgaaagacaataacgaacgctctaagtggtacgttactggcccagggggcgtagatatgctcgttcctagcgtgggcctgatcatcccaccaccaaatcctcttgccgtggacttgtcttgcaagatcgaacagtattatgaggccattctcgccctatggaaccagctatacataaatatgaaatcattggtgtcttggcactattgtatgatagatatagagaagatccgcgccatgaccattgctaaactcaaaacaatgcgacaggaagattacatgaaaacaatcgcagacttagagctgcactatcaggagtttattcgcaatagccaaggctcagagatgtttggggatgatgataagaggaagatccaatcacagtttacagacgcacaaaaacactaccagaccctcgtgattcagctgcccgggtacccccagcatcaaaccgtaactaccactgagatcacccaccatggaacctgccaggacgttaatcataataaagttatcgagaccaatcgcgagaacgacaaacaggaaacatggatgctgatggaactccagaagattcggaggcagatagaacattgtgaaggaaggatgaccctgaaaaatctgcccttggctgatcaaggctctagccaccacattacagtgaagattaacgagttgaagagcgtgcaaaacgactcccaggctatagctgaagtgctgaatcagctcaaggatatgctggcgaactttagggggtctgaaaaatattgctaccttcagaacgaagttttcgggttattccaaaagctggaaaatattaatggggtaactgatgggtatttaaattcactttgcaccgtcagggccctgttgcaggcgatcctccagacggaggacatgcttaaagtgtatgaggccagactcaccgaggaggaaacagtgtgccttgacttagataaagtggaggcatatcgctgcggattgaagaaaattaagaatgacctgaatctgaagaagtctctgctggccacgatgaaaaccgagctgcagaaggcgcaacagattcactcacagacaagccagcagtaccccctgtacgacttggatctcggaaagttcggtgagaaggtgactcaacttaccgatcggtggcagaggattgataaacagattgatttccgattgtgggatctggaaaagcaaataaaacaactaagaaattatcgggacaattaccaggcattctgcaagtggctctatgacgccaaacgtaggcaggacagtctggaatcaatgaaatttggcgattcaaacactgtcatgcgctttctcaatgagcagaagaacctgcacagtgagatctctggaaaacgggacaagagcgaggaagtacagaagattgccgagttgtgtgccaattcaattaaagattacgaacttcagctagcaagctatacttccggactggagactctgcttaatatccctattaagaggactatgattcagtctccatccggggtgatactgcaggaggctgctgacgtgcatgcccgctatattgaactcctgactagatctggagattactatcgtttcctgtctgaaatgctcaagtcactggaggatctcaaactgaaaaacaccaagatcgaagtgctggaagaagagctcagacttgcacgcgatgctaactctgaaaattgtaacaaaaacaagttcctcgaccagaacctacagaagtaccaagccgagtgctcacagttcaaggcaaaactggccagcctagaggagctgaagcgccaggcggagttggatggaaagtctgccaagcaaaatctggacaaatgttatgggcagataaaagaactcaatgaaaagataaccagattaacctacgagatcgaggacgaaaaacgaagaaggaaatctgtagaagatcggttcgatcaacaaaagaatgactacgatcaactgcagaaagctagacagtgcgagaaggaaaatcttggctggcagaaactggagagtgaaaaagccatcaaggagaaagagtacgagatcgagcggctgagagtgcttttgcaggaggaaggaacaagaaaaagggagtacgagaacgagcttgctaaggccagtaatagaatccaggagagtaaaaaccagtgtacccaagttgtgcaggagcgagagagcctgttagtaaagatcaaggtcctcgagcaagacaaagcacggctgcagcgcctcgaagatgaactgaacagggccaaatccactctcgaagccgaaacccgcgtgaagcagcggctcgagtgtgaaaagcaacagatccagaatgacttgaatcagtggaagacccagtacagtagaaaggaagaagcgatcaggaagatcgaatctgagcgggaaaagtccgagagggaaaagaatagtctccggtctgagattgaacgactacaagctgaaattaaacggattgaggaaagatgccgtaggaagcttgaagatagtacaagggaaacccagtcccaattagagactgaacgatcccggtaccagcgtgagatagataagctccggcagcggccctatgggtctcacagggagactcaaactgagtgcgaatggaccgtggatacctcaaagctggtcttcgacggtctgagaaagaaagttacagctatgcaactgtatgagtgccaactgatagacaagactactctggataagctgctgaagggtaagaagtctgtcgaagaggtggcaagcgaaatccagccattcctgagaggcgcaggctctattgcgggggccagtgcaagccccaaagaaaagtactcactcgtagaggccaagcgaaaaaagctgatcagcccagagtctactgtaatgttattagaagcccaggccgccactggcggcatcatcgatcctcaccgcaatgagaagttaacagtggacagcgccattgcaagagaccttattgatttcgatgacaggcagcagatttacgccgccgagaaggcaatcactggcttcgacgaccctttcagcggaaagaccgttagcgtttccgaggctatcaaaaagaacctgatcgatcgcgaaacgggcatgcggctgctagaggcccagattgcttccggtggcgtggtcgatccggtaaacagcgtatttttgccaaaggatgtcgcactggctaggggccttatcgaccgggacctgtataggtccctgaacgatcccagggattcccagaagaattttgtggaccccgtcactaaaaaaaaagtttcttacgtgcagcttaaggagagatgcaggatcgagccacacactggtctgcttctgctgtccgtgcaaaaacgaagtatgtctttccaaggtattaggcagcccgtaaccgtcactgagttagtcgattcaggcatcctgcggccatctacagttaacgagctggagtcagggcagatctcttacgacgaggtcggagagcgcatcaaggattttttacagggttcctcatgtattgcaggtatctacaacgagaccaccaagcagaagctggggatttacgaggccatgaaaatcgggcttgtaaggccaggaaccgccctggagttgctggaggctcaggcagccaccggcttcattgtggacccagtctctaatctccggctgcccgttgaagaagcctacaaacgtggcctggttgggatcgagtttaaggagaagctcctgagcgccgaaagagccgtaaccggatataatgatccagagactggcaatataattagcctcttccaggcaatgaataaggagctgatagaaaaaggtcacggcattcgtttgctcgaggctcagatcgcaacaggaggtataattgatcccaaggaatcccatcggctgcccgtagatatagcgtacaagcggggttacttcaacgaagagctctccgagatcttatccgaccctagcgacgacacaaaggggttctttgatccaaacaccgaggagaatctaacgtacctccagcttaaagaaagatgcatcaaggacgaggagacaggcctctgcctgctcccgctgaaggagaaaaaaaaacaggtgcaaacctctcagaaaaacacattgcgcaagcgcagagtcgtgatcgtagatccagagaccaacaaggaaatgagcgtacaggaagcttataagaagggccttatcgactacgaaaccttcaaggaactctgtgagcaagagtgtgagtgggaagaaattacgattaccggaagcgacgggtctacgcgagttgtgctagtggaccgaaagaccgggtcccagtacgatatccaggacgccattgacaagggactcgtcgatcgcaaattcttcgatcagtatcggtccggaagtctgtcactgactcaattcgctgacatgataagcctgaagaacggtgtgggcacctcctcctctatggggagcggtgttagtgacgatgtgttctcatccagtagacacgaatccgttagcaagatttccacaattagttccgtgcgcaatctgacaattagatccagttcattttctgacacgctggaggagtcttcccctattgccgctattttcgacacagaaaacctagagaagatttcaataacagagggcatcgagcgagggatcgtcgatagcataacggggcagcgcttgttggaggcacaggcgtgcaccggcgggatcatacaccccaccaccgggcagaagctgagtctgcaggatgcagtgtcacaaggagttattgaccaggatatggctaccagactaaaacctgcacagaaagcttttatcggcttcgagggagtcaagggaaaaaagaagatgtctgcagccgaagctgtgaaagaaaaatggctgccttacgaagcaggtcagagatttcttgagttccagtacttgactggtggactagtagacccagaagtgcacgggcgaatcagcaccgaggaggccattaggaagggctttattgatggccgtgccgcacagcgtctccaggataccagctcatatgccaagattctgacatgccctaagaccaaactcaagatatcatataaagatgccattaaccggtccatggtcgaagacataaccggtttaagactgctggaagcagcaagtgtgtcttcaaagggtctgcctagtccctacaatatgagtagcgcccccggcagccgatctggctcaagaagcggctcccggtcagggtctcgcagcggatctcggtccggctcccggagggggtcattcgacgctactggcaatagcagttactcgtactcttactccttttcttctagctccattgggcactag

SEQ ID NO: 23872 - DNA, 507 bp, Artificial Sequence
  Description of Artificial Sequence: Synthetic coding sequence
atggagccccccaacctgtaccccgtgaagctgtacgtgtacgacctgtccaagggtctcgcaagacggctcagccccatcatgctagggaagcaactagaagggatttggcacactagtattgttgttcacaaagatgagttctttttcggatcggggggtatctcttcatgcccaccaggggggacactgctgggaccgcctgactccgtcgtggatgtcggctccacagaagtcactgaagagatttttctggaatacctatcttccctgggggagagtttattcagaggagaggcgtataacctgttcgagcataattgcaacacattttctaacgaagtagcgcagtttctgaccggccgtaaaatcccgtcctatattacggacttacctagcgaggttctatcaaccccattcggccaggcgttgcgcccgcttttggactctatccagattcaacctcctggcggttctagtgtgggtagacccaacgggcagtcatag

SEQ ID NO: 23873 - DNA, 561 bp, Artificial Sequence
  Description of Artificial Sequence: Synthetic coding sequence
atgaagagcgacttctacttccagaagagcgagccccacagcctgtcttccgaggcactgatgcggagggccgtgtcactggtgacagatagcacttccaccttcctatcccagactacgtatgccttgatcgaggccatcacggaatacacaaaggccgtatacaccctgacgtcattatataggcaatacacgagtctgctgggaaaaatgaacagtgaagaggaggatgaggtctggcaggtgattattggcgcccgtgctgagatgactagtaaacatcaggagtatctcaaactggaaaccacttggatgactgcagtggggctgtctgaaatggcggcagaagccgcctatcaaacaggggctgatcaagcttctattactgcaagaaatcacatccagctggtgaaactccaagtcgaagaggtgcaccaactcagcaggaaggccgagaccaaactggctgaagcacagatagaagagttacgccaaaagacacaagaagaaggtgaagagagagctgaatccgagcaggaggcgtacttgagggaagattag

SEQ ID NO: 23874 - DNA, 588 bp, Artificial Sequence
  Description of Artificial Sequence: Synthetic coding sequence
atggccgccctgaagagctggctgagccggagcgtgaccagcttctttcggtatcggcagtgtctgtgcgttcctgttgtggctaattttaagaagaggtgcttttcagaactgattagaccttggcataaaaccgtgacgattggattcggggtcacgctttgcgcggtgcctatagctcaagccgtgtacaccctcacctccctgtaccggcagtacacgagcctgttgggaaaaatgaatagcgaggaggaagacgaagtgtggcaagtcatcatcggcgcacgagcagaaatgacctctaagcaccaagagtaccttaagttagagacaacatggatgaccgcggttggcctttcagagatggctgccgaggcggcctaccaaacaggagcagatcaggccagtatcacagctcggaaccatattcagctggtgaagcttcaggtggaagaagtccaccaactgtcacggaaagccgagaccaagctggctgaagctcagattgaagaactgaggcagaagacccaggaggagggggaggaacgcgccgagtcagagcaggaagcatacctgcgcgaggactag

SEQ ID NO: 23875 - DNA, 588 bp, Artificial Sequence
  Description of Artificial Sequence: Synthetic coding sequence
atggccgccctgaagagctggctgagccggagcgtgaccagcttcttcagataccggcagtgtctttgcgtgccagtggtagcaaatttcaaaaaaaggtgcttcagcgagctgatccgcccctggcacaagacagttactatcggcttcggcgttacactctgcgcagttcccattgcccaggcagtatataccctgacctcactctaccggcagtacactagtctactgggcaaaatgaatagcgaggaagaagacgaggtctggcaggtgatcatcggggcaagagcagagatgacatccaaacatcaggagtaccttaaactcgaaaccacttggatgactgcagtgggcctgtcagagatggcggcagaagccgcatatcagaccggagctgaccaggcttctataaccgcccggaaccacatccagctcgtgaaactccaggtcgaggaagtgcaccaactaagccgtaaggctgagactaaattagccgaagcacaaatagaggaactaaggcagaagacacaggaagaaggcgaagagagagccgagagtgagcaggaagcctacttgagggaggactag

SEQ ID NO: 23876 - DNA, 720 bp, Artificial Sequence
  Description of Artificial Sequence: Synthetic coding sequence
atggccgccctgaagagctggctgagccggagcgtgaccagcttctttcgctaccgccaatgtctctgcgtgcccgtcgtggccaatttcaagaaaagatgtttttcagaactgattcgcccatggcacaagacagtaaccattggctttggagttaccctgtgtgccgtacctattgcccagaagtccgagccgcattcccttagcagtgaggcactaatgcgaagggctgtctctctcgtgacggactctacctccacgttcctgtcacaaaccacctatgcgctgatcgaggccatcacagaatacacgaaagccgtttacacactgacctcgctttacaggcagtatacatcgctcctgggaaagatgaatagtgaggaggaagacgaggtgtggcaggttatcatcggtgctcgggcagagatgacttcgaagcaccaggagtatctgaagcttgaaaccacttggatgacagccgtgggactctctgaaatggctgcagaagcggcctatcagactggggccgaccaggcctcaataacggccaggaatcacattcagctggtgaagctgcaagtggaagaagtccatcaactgagcagaaaggccgaaacgaaactggccgaagcacagattgaagagcttagacagaagacgcaagaggagggcgaggagcgcgctgagtcggagcaggaggcgtatctgagagaagactag

SEQ ID NO: 23877 - DNA, 561 bp, Artificial Sequence
  Description of Artificial Sequence: Synthetic coding sequence
atgaagagcgacttctacttccagaagagcgagccccacagcctgtcatccgaagcactgatgagaagagccgtatctctcgtgaccgactcgacaagtacattcttatcccagaccacctatgcattgattgaggctattactgaatataccaaagctgtttataccctgacctccctctaccggcagtatacttccctccttggtaaaatgaatagcgaagaggaagacgaggtatggcaggtcatcattggcgcaagagctgagatgaccagtaagcaccaagagtatttaaagctggagactacatggatgacagctgtcgggttgtctgaaatggctgctgaggcagcctaccagacaggtgcggatcaagcgagcataacggcccgaaatcacatccaactcgtgaagctccaggtcgaagaggttcaccagctaagtcgcaaggcagagaccaaactggcggaggcacagattgaagagctgcgccagaaaacccaagaggagggtgaggaacgggcggagagcgaacaggaagcctatctcagggaggactag

SEQ ID NO: 23878 - DNA, 3822 bp, Artificial Sequence
  Description of Artificial Sequence: Synthetic coding sequence
atggagccccccggcggcagcctgggccccggccggggcacccgggacaagaaaaagggtagatccccggacgaactgccgtctgctggcggggatggcggaaaaagcaagaaatttactctaaagcgcctgatggctgacgagttggaacgttttacgagcatgcggattaagaaagaaaaagagaagccgaattctgctcatcgcaacagtagtgcgtcttatggagatgaccccacggctcagagcctccaggacgtaagtgatgaacaggtactggtgttgtttgaacaaatgctcctggacatgaacctaaacgaggagaagcaacagcccctccgggagaaggacattatcattaagagagaaatggttagccagtatctgtacacctcaaaggcaggcatgtctcagaaggagtcctcaaagtctgccatgatgtatatccaagaactaagatcaggattgagagatatgccactattgtcctgcttggagtcattaagggtctccttgaacaataatcccgtgtcttgggtgcagacttttggcgcggaaggcctggcatcactcctggacattcttaaacggctccacgatgagaaagaggaaaccgcaggttcgtacgactctcgaaacaaacatgaaatcatccgctgtttgaaggctttcatgaacaataaatttgggatcaagacaatgctggagacagaggaggggatcttactgctcgtccgcgccatggatccggcagtgccaaacatgatgatcgacgccgcaaaattgctgtctgctttatgcatcctgccacagcctgaggacatgaacgagagggtgctggaggccatgacagagcgcgcggaaatggacgaagtcgaaagattccagcctctgctcgacggactcaagagcggaaccacaatagctctcaaagtaggctgcctccagctgattaacgctctcattaccccagcagaagagctcgacttccgggtccatattcggtcggagctgatgcgcttaggcttgcatcaggttctacaggacttgagagagatcgagaacgaggacatgagggtccaactgaacgtctttgacgaacagggcgaggaggactcttacgatctgaaaggtaggttggatgacatcagaatggagatggatgactttaacgaggtcttccagatactgctgaacacagtgaaggattctaaagcggagccacactttctaagcattctgcaacacttgttgctcgtaaggaacgattacgaagccaggcctcagtactacaagctgattgaggagtgtatctctcaaattgttcttcacaagaacggcgctgacccagatttcaagtgccgacacctacaaattgaaattgaagggctaatcgatcagatgatcgataaaaccaaggtggagaaatcagaagctaaagctgccgagctcgaaaaaaaattggactccgagcttacggcgcgccacgagttgcaggtcgaaatgaaaaaaatggaatctgatttcgagcagaaactgcaggacctgcagggcgagaaggatgccttgcacagcgagaagcagcagatcgccacagaaaaacaggacttggaagctgaagtttctcaactgaccggagaggtggccaagctcacgaaggagctggaagatgccaagaaggagatggcctcactttctgctgccgccatcaccgtccccccatccgtaccgtcgcgcgctccagtgccacctgctccacctctacctggggattcgggcaccatcatcccccctcctcctgcacctggcgattccacgacgcctccccctccccctcctccccccccccctcctccacccctgcccggaggcgtgtgtatcagttccccacctagccttcctggaggtactgcgatctcccccccgccacccctgtccggggacgccaccatcccacccccaccccctctccctgagggtgtcggaatcccttccccgagttccctccccggaggcaccgccatcccaccccccccacccctgcctggctccgcacgcataccaccgcccccaccaccgctgcctggatctgccggaatacctccacctcccccccccctgcccggggaagctggaatgcccccacccccaccacccctgcccgggggccccgggatcccccccccccctccctttcccgggggacccggaataccacccccacctccaggtatgggtatgccgccaccacctccctttggcttcggtgtgcccgccgctcccgtactgccttttggccttactcccaagaagctgtataagccggaagttcagctgcgcaggcccaactggtctaaactagtcgcagaagatctaagccaggactgcttctggaccaaggtcaaagaggatcgcttcgagaataacgaactgttcgcaaagttgactctgaccttttcagcccaaactaaaaggaccaaaaaagcaaagaaggatcaggagggcggcgaggaaaaaaaatcggttcagaagaagaaggttaaggaactcaaggtgctggacagcaaaactgcacagaatctttctatattcctcggcagctttcgcatgccatatcaggagattaagaatgttattctggaggtaaatgaggccgtactgacagagagcatgatacagaatcttattaaacaaatgcccgagcctgaacagttaaagatgctgtctgagttgaaagatgagtacgacgaccttgcggagagcgaacagtttggcgtggtgatgggcacagtcccccgtctgcgccctaggctaaatgccattctcttcaagcttcagttcagcgagcaagtggaaaacatcaagcccgagatcgtttctgtgacagccgcttgcgaagaactgcgaaaatcggagagcttcagtaacctgctggaaatcactctgctcgtgggaaattatatgaatgctggcagcagaaacgcaggggcattcgggttcaatataagcttcttgtgcaagttaagggataccaaatcaacggaccagaaaatgaccctcttgcactttctggcggagttgtgcgagaatgactaccctgacgtacttaaatttcccgacgagttggcacacgtggaaaaggctagtcgtgtctctgctgagaatctgcagaaaaatctagaccagatgaagaaacagatctctgatgttgagagagatgtgcaaaactttccggcagccacagatgagaaagacaaatttgtggaaaaaatgacgatattcgtgaaagacgctcaggagcagtacaacaagctccggatgatgcatagcaacatggagaccttgtataaggaactgggagagtattttctgttcgatcctaagaagctgtctgtggaagagttctttatggatttgcacaattttcggaacatgttcctgcaagcagtaaaagagaatcagaagagacgcgagactgaagagaagatgaggagggccaagctcgcgaaagaaaaagccgagaaagagcgcctcgagaaacaacaaaaacgggagcagcttatagatatgaacgccgagggagatgaaactggcgtgatggactccctgctggaggccctgcaaagcggtgcagccttcagacggaaacgcgggccgcgacaagccaacagaaaggccggctgcgccgtcacctctctacttgctagcgaactcacaaaggatgatgctatggctgcagtacccgctaaggtctctaaaaattcggaaacattcccgacaattttggaggaagccaaagagctggtcgggagagcctcctag

SEQ ID NO: 23879 - DNA, 3810 bp, Artificial Sequence
  Description of Artificial Sequence: Synthetic coding sequence
atggagccccccggcggcagcctgggccccggccggggcacccgggacaagaaaaaggggagatcccccgatgagctgccctctgccgggggggacggaggaaagtctaagaaattcacccttaaacgactcatggccgatgagctcgaacgatttacctccatgcggattaagaaggagaaagagaagcctaatagcgcccatcggaacagtagcgcttcatatggcgatgatcccacagcccagtctttacaggacgtgagcgatgagcaagttttggtcctgtttgagcagatgctgctggacatgaacttaaatgaggaaaagcaacaacctctgcgagagaaggatataatcattaagagagagatggtgtctcagtacctttacacatccaaggcaggtatgtctcaaaaagagagcagcaagtccgccatgatgtacatccaggagctccgtagcgggcttcgagatatgcctttgctgagctgcctggaatcactacgtgtctcactgaacaataatccggtgagctgggtgcaaacgtttggcgcagaaggtctggctagcttactggatatcttaaaaagacttcacgacgaaaaggaggagacagcgggcagctatgactctaggaataaacacgagataatccggtgcctgaaggcattcatgaacaataagtttggcattaagactatgctggaaacggaagaggggattctccttctggtgcgggccatggatcctgctgttcccaatatgatgatcgatgccgctaagctgttgtctgctctgtgtattcttcctcagcccgaggatatgaacgagagggtgctggaggcaatgaccgagcgagcagaaatggatgaagtcgagcgcttccagcccttgctggacgggctgaagtctggcaccactatcgccctcaaggttggatgtctgcaactaatcaatgctctgattacccccgccgaagagctcgattttagggttcatataagatccgaactgatgcgtctgggcctgcatcaggtgcttcaggacctgagggaaattgaaaatgaggacatgcgagtgcaacttaacgtatttgacgaacaaggtgaggaggactcctacgacctgaagggacggttggacgacattaggatggagatggatgattttaacgaggtgtttcagatcctccttaataccgttaaagattctaaagccgagccccattttctgtctatcctacaacacctcctgttagttagaaacgactatgaggcccggcctcagtattacaaactgatagaagaatgtatctcccagattgttctacacaagaatggtgcggatccagactttaagtgtcgccacctgcagatagagattgaaggactcattgaccagatgatcgataagacaaaggtggaaaaatcagaagccaaggcagccgaactcgagaagaaactggattctgagctcactgcaaggcacgagctccaggtggagatgaagaaaatggagtcagactttgagcaaaaactgcaagatctgcagggcgaaaaggacgccctacactctgagaagcagcagatcgcaactgagaaacaggatctggaggcagaggtctcgcagttaactggagaagtagctaagcttacaaaagagctggaagatgccaagaaagagatggccagcctatctgctgccgcaattaccgtgcccccctccgtgcccagcagggcccccgtgcccccagccccacctctcccaggcgactctggaactataattcccccgccgcctgccccgggcgactcaacgacgccacccccccctcccccacctccgcctcctccaccccctctgcccggtggtgtgtgtatttcttctccgccttcgctaccgggcgggaccgccatcagtccccccccaccgctgagcggagatgccaccataccacctccacctccgctaccagaaggcgtaggaatcccctccccatcgtcccttccagggggcactgccatacctccccctcctcctcttccaggaagcgcccggataccaccacctccacctcctctcccaggctctgccggcatcccaccgcccccacccccccttccaggagaagccggtatgcccccccctccgccacctcttccgggcggaccaggcataccaccacccccgccttttccaggcggccctggaattccccccccccccccgggcatgggtatgccaccccccccaccattcggctttggtgtgcccgctgctccagtgctgccgttcggactgactcctaaaaagttatacaagcccgaggtacaattaagaagaccgaattggtcaaaacttgtagctgaagacctgagccaggattgcttttggacaaaggtgaaggaagataggttcgaaaacaatgaactgtttgcgaaactgaccttgaccttttcagcccagacaaagaccaagaaagaccaagagggaggtgaggaaaaaaaatccgtgcaaaaaaaaaaagtgaaggaactgaaggtgctggacagcaagaccgcacagaatctgagtattttcctgggttcctttcggatgccatatcaggagataaaaaatgtcatcttggaggttaatgaggctgtgctgaccgaatccatgatccagaacctcattaagcagatgcccgaaccggagcagctgaaaatgctttctgagctgaaggacgaatacgatgatctggctgagagtgagcaattcggtgtcgtcatgggaaccgtgccaaggttgcggccacgcctcaacgccatactgttcaagctacaattcagtgagcaagtggaaaacatcaaaccagaaatagtgtctgtcacggccgcttgtgaagaacttagaaaatccgaatcgttcagcaatctcctcgaaattactctgttggtgggaaactatatgaatgctggatcccgcaacgcaggagccttcggattcaatatcagctttctgtgtaaattgagggatacgaagtccacggatcaaaagatgactctcctgcatttcctggccgaactctgtgagaacgactatcctgacgtacttaaattccccgacgaactggcccacgtggagaaggctagcagagtaagcgctgaaaacctccagaaaaacctggatcaaatgaaaaagcaaatttccgacgtcgaaagagacgtgcagaactttcctgccgctaccgatgagaaggataagtttgtggagaagatgacgtctttcgtaaaggatgcccaggaacagtacaacaaactgcgcatgatgcattccaacatggagactctttataaggaattaggagagtattttctttttgaccccaagaaactcagtgtggaagagttcttcatggatttacacaatttccgaaatatgtttctgcaggctgtgaaggagaaccaaaagcgccgagagactgaagaaaagatgcgacgggcaaagctcgctaaggagaaagccgaaaaggagcgtcttgaaaagcagcaaaaacgcgaacagctgattgacatgaatgcggagggcgacgagacgggggttatggacagtctgctcgaggctctgcagtcaggcgctgcctttagacgcaaacggggcccacgtcaggctaatcggaaggcagggtgtgctgttacatcactcctggcaagcgagctgaccaaggatgacgcaatggccgctgtgcctgccaaggtgtctaaaaactccgagacatttcctaccattctggaggaggccaaggagttagtgggtagagccagttag

SEQ ID NO: 23880 - DNA, 3792 bp, Artificial Sequence
  Description of Artificial Sequence: Synthetic coding sequence
atggagccccccggcggcagcctgggccccggccggggcacccgggataaaaaaaagggtcgctcaccggatgaactcccctcggccggtggcgatgggggaaaatctaaaaaattcctggagcgcttcacatctatgagaatcaagaaggaaaaggaaaagcctaattctgctcaccgaaactccagcgcctcttacggagatgatccgaccgcccagtccctgcaggacgtctctgatgagcaagtgcttgtgttgtttgagcaaatgctgctggatatgaacctcaacgaggaaaagcagcagccgttgagagaaaaggatatcattatcaaaagagagatggtctcacagtatctctataccagtaaggcaggcatgagtcagaaagagtcttctaaatcagcaatgatgtacattcaggaactcaggtcaggactgagggacatgcctctcctctcctgtcttgaatctctcagagttagcttgaacaataaccccgtgtcctgggtccaaactttcggcgctgaggggctggctagcctactggatattcttaaacggctccacgacgagaaggaggaaaccgcaggcagttatgattcgcgcaacaagcacgagatcatacggtgcttaaaggccttcatgaacaacaagttcggaatcaagaccatgctggagacagaggagggcatcttattgctggtgcgcgccatggatcctgcagtacccaacatgatgatcgatgctgcaaaactcctgtccgcactctgcattctaccccagcccgaagatatgaatgaaagggtcctggaagccatgacagaacgagcagaaatggatgaggtcgagcgcttccagcctctgctggacgggctcaagtcgggcactacgatcgccctgaaagtaggctgcctgcagttaatcaacgccctgatcacacccgctgaggagcttgattttagagtacatatacggtcggagctgatgagattggggctgcatcaggttctccaggatctcagagaaattgaaaatgaggacatgagagtacagcttaacgtctttgatgagcaaggcgaagaagactcttacgacttgaagggacggctcgacgacatccgcatggagatggatgactttaatgaggtgtttcaaatactgctgaataccgtcaaagattctaaggctgagccccattttctttctatcctgcagcacctgctgctagtgcggaacgactacgaagctaggcctcaatattacaaattaatcgaggagtgcatcagccagatcgtgcttcacaaaaatggagcagatcccgattttaagtgcaggcatttacagatcgaaatcgaaggactgatcgaccaaatgatcgataagacaaaagtcgagaaaagcgaagcgaaggctgccgagttggagaagaagctggacagcgaactgactgctcggcatgagctccaggttgagatgaagaagatggagagtgattttgagcaaaaactgcaggatttgcaaggtgagaaggatgctctacacagcgagaagcaacagatagcaactgagaaacaagatctggaagcggaagtgagccagctaaccggcgaagtcgcgaagctgacaaaagaactcgaagacgcgaagaaagagatggcttctctcagcgccgctgcaattacagtcccgccttctgtcccatctcgcgcccctgtacccccagcccccccgctccctggcgattctggtaccataattcccccaccaccagctcctggtgatagtacaacaccccctcccccaccacccccccctccaccccctccccccctcccaggaggcgtgtgtatctcctcaccgcccagtctgcccggcgggacggctatctcaccccctccacctctgtctggggacgccactatccctcccccgccccctctgcccgagggcgtcggaatcccttcaccttcctctttacctgggggcacagctatcccacctcccccgcccctgcccggatctgctcggatccccccaccccccccacccttgccagggtccgcaggcatccctccccctccccctcccctaccaggagaagcgggtatgccaccaccaccgcccccgttgccagggggacccggaatcccccctcctcccccattccccggcggccccggcatccctccaccacctccggggatgggaatgcccccccctcctccttttggatttggtgtaccagccgcccctgttttgcctttcgggcttacccctaaaaaactgtacaaacccgaagtgcagctgagacggccaaattggtctaagctggtagccgaagatctgtcacaagattgtttctggacaaaagtgaaagaggaccggtttgagaataatgaattattcgcaaaactcacgctcaccttcagcgcacagactaagacttccaaggccaagaaagaccaggaaggcggcgaagaaaaaaagtccgtacagaaaaaaaaagtaaaagaattaaaggtgctggatagcaagacggcacaaaatctgtctatatttttggggagtttcaggatgccctaccaggagattaagaatgttatccttgaggtgaatgaggctgtactgactgagagcatgatccagaatctcattaagcagatgcctgaacctgagcagttgaaaatgctatccgagctgaaggacgagtacgatgacttggctgagtcggaacagttcggagtcgtgatgggcactgtgcctaggttgcgcccaagactaaatgcgatcctcttcaagctccagttttctgaacaggtcgagaacatcaaacccgagattgtgtccgtaacagcagcatgcgaagaactacggaaatccgaatcattctccaacttgctcgaaatcacactccttgtgggtaactatatgaatgccggaagtcgcaacgccggtgcatttggcttcaacatttcctttctgtgcaaactgcgcgatactaagtctacagaccagaagatgactctgctgcactttctcgcggagctgtgtgagaacgattatcctgacgtgcttaaattcccggacgaactcgcacacgtcgaaaaggcctcaagggttagtgccgagaatctacagaagaatctggaccagatgaaaaaacagatcagtgacgtcgagcgggatgttcagaacttccctgctgccaccgacgagaaggataagtttgtggagaagatgacttcctttgttaaagatgcccaggaacagtataacaaattacgaatgatgcattcaaatatggaaacactttataaggaactaggcgagtattttctatttgatccgaagaagctctctgtggaagaattttttatggatctccacaattttagaaatatgttcctccaggctgtcaaggagaatcagaagcggcgggaaaccgaggaaaaaatgagacgcgccaagctcgcaaaagaaaaagccgagaaggaacggctcgagaaacagcagaaaagggaacagctgattgatatgaacgccgaaggggacgaaacgggcgtcatggactctctgttggaggcactccagagcggagccgcattcaggaggaagagagggccccgacaggctaatcggaaggctggatgcgccgttacctccctcctggcctctgagttgacaaaggatgatgccatggctgcagttcccgctaaagtttctaagaatagtgaaacctttcctactatattagaggaagcaaaggaactggtagggcgagcctcatag

SEQ ID NO: 23881 - DNA, 3819 bp, Artificial Sequence
  Description of Artificial Sequence: Synthetic coding sequence
atggagccccccggcggcagcctgggccccggccggggcacccgggacaaaaagaagggacgatccccggatgagctgcccagcgcaggcggcgacggaggtaagtctaagaaattcacattgaagcgcctgatggccgatgaactggaacggttcacatccatgcgtatcaagaaggaaaaggagaagcctaactccgcacaccgcaattcatccgcgtcatacggggacgaccctaccgctcaatcactgcaggacgtgtccgatgagcaggtccttgtgctttttgagcagatgctgctcgatatgaatctaaacgaggaaaagcagcaaccattacgagaaaaggatatcattattaagagggaaatggtgagtcagtatctgtatacctctaaagcgggcatgagccagaaggaatcatctaaaagtgccatgatgtatatccaggagctaaggtcagggttgcgagacatgccacttctctcgtgcctggagagcctgcgcgtaagccttaataacaacccggtcagctgggtccagacattcggcgctgagggtctggcctctctcctggacattctcaagcgcttacatgatgaaaaagaggaaacagctggatcatacgactccagaaataagcacgaaattattcggtgcttgaaggccttcatgaacaacaagttcggtattaagaccatgctggagaccgaggagggcatcctgctgctggttcgagctatggatcctgctgttccgaacatgatgatagacgccgcaaaattgctctctgctctgtgtatcttacctcagccagaagatatgaacgaacgagtgttagaagccatgaccgaaagagccgaaatggatgaagtcgaaagattccagccactgctggatggattgaaatcagggaccaccatagccctcaaggtgggctgtctgcagttaatcaatgccctcatcacaccagccgaagagctggattttagggtccatatcaggagcgagctcatgcggctgggactccaccaggtcttgcaagatctgcgcgaaatagaaaatgaggatatgcgtgtacagctgaacgtgtttgacgagcagggcgaggaggattcatacgacctcaagggcaggttggatgacatacgaatggagatggatgactttaatgaagtcttccagatcctcttaaatacagttaaggactccaaggcggagccccactttttaagcatccttcagcacctgttgctggtcagaaacgactacgaagctcggccccagtactacaaactgattgaagagtgcataagccagattgttctccacaagaatggtgcggacccggacttcaagtgtcggcatctccagattgagatcgaagggctgattgaccagatgattgataaaaccaaagtcgagaagtctgaggccaaggctgcggaacttgagaagaaactcgacagtgagcttaccgccaggcacgaacttcaagtggagatgaagaaaatggagtcagacttcgagcaaaagctgcaggatttacagggagaaaaggatgctttacactctgagaaacaacaaattgcaaccgaaaaacaagacctcgaggcagaagtgtctcagttgaccggagaggtggcgaagctcactaaggaactggaagacgccaaaaaagagatggcttccctttcagccgccgctattaccgtgcccccttcagtgcccagccgtgctccggtcccgccagccccgcccttacccggcgactcagggaccatcatcccccctcctcctgctccaggagactctacaactcccccgccgcctcctccccccccaccaccacctcctccactcccaggcggggtctgcatctcctcacctccctccctgcccggggggactgccatatctcccccaccccctctgagcggcgatgccacaattcccccgcccccaccactgcccgagggcgtggggatccccagcccctcgtccctgccaggcgggacggcaatccctccgcccccgccactaccaggttctgcgaggatccccccccctccaccaccactgcctggatctgcagggatacccccccctccaccgcctcttcccggggaagctgggatgccacccccccctccacccctcccaggtggccccgggatccctccccccccccctttccctggcggtccaggaattccacctccgccgccaggtatgggcatgccccctccacccccgtttggatttggagtgcctgctgctcctgtactgccgttcgggttaacaccgaaaaaactgtacaagccagaggttcaactgcgtcgacctaattggagcaaactcgttgctgaagacctctcacaagactgcttttggacaaaggtgaaagaggatcgattcgaaaataatgaactatttgctaaattaaccttgacgtttagcgcccaaaccaagacatcaaaagcaaagaaagatcaagaaggcggggaggaaaaaaaatcagttcaaaagaagaaggtgaaagaactcaaggtgctagacagcaagactgcacaaaatctctcgatattcttgggatcctttcggatgccctaccaggaaatcaagaacgtgatactcgaggtcaatgaggcagtgctcacggagtcaatgattcaaaatctaatcaaacagatgcctgagccagagcaactgaagatgctgagcgagctgaaggacgagtatgacgatctcgccgagtctgagcagttcggggtggtcatggggactgtgccaaggctgaggccacgtctcaatgcaatcctgtttaaactgcagtttagcgaacaggtagagaatatcaagcctgagattgtaagcgtgaccgcggcctgtgaggaactacgcaaatccgaatcattcagtaaccttctggagataactcttcttgtgggaaattatatgaatgccgggtcgcgtaacgccggcgcctttgggtttaacatctccttcttgtgcaagttacgcgacaccaaatctactgaccaaaaaatgactctgctccactttctagcggagctttgcgaaaatgactatcccgacgtgctgaaattcccagacgaactggcgcacgtcgaaaaggcttccagagtctctgcagaaaatctgcaaaaaaatctggaccaaatgaaaaaacagatctccgacgtcgagcgggacgtacagaatttccctgcggctacagacgagaaagacaagttcgtcgagaaaatgacgtcattcgtgaaggatgcccaggaacagtacaataagctgcgcatgatgcatagcaacatggagaccttgtacaaagagctgggcgagtactttttgtttgatccaaagaaactctccgtggaggagttctttatggacctgcacaattttaggaacatgttcctccaggcagtcaaggagaaccagaagcgaagagagacagaggagaagatgaggcgcgctaagttggctaaggagaaggccgaaaaggagagacttgagaaacagcagaagcgagagcaactgatcgacatgaatgcagaaggagacgaaaccggtgttatggattccctgctggaagccctgcagtcgggggccgcctttcgccgaaaacggggacccaggcaagccaaccgtaaagcaggttgcgcagtcacatcacttttggcctcagagttgacaaaggatgacgcaatggccgccgtgccggccaaggtgtccaaaaattctgagacatttccaaccatactggaggaagctaaggagctagtggggagggccagttag

SEQ ID NO: 23882 - DNA, 3747 bp, Artificial Sequence
  Description of Artificial Sequence: Synthetic coding sequence
atggagccccccggcggcagcctgggccccggccggggcacccgggataagaaaaagggccgctctcctgacgaactaccgagtgcaggcggcgacggaggcaagtcaaagaagttcctggagcgatttacctcgatgaggatcaaaaaagagaaagagaagcccaactccgcacaccggaactccagcgcgagctacggcgacgaccctacagcacaaagtctgcaggatgtgagcgacgagcaagtgctggtattgtttgaacaaatgttgctggacatgaaccttaacgaagaaaagcagcaaccacttagggaaaaagacataatcataaaaagggagatggtaagccagtacctctacacatccaaagctggaatgtcacagaaggagagttcaaagagcgcgatgatgtacattcaggaacttcgatctggattgagggacatgcccttgctgagctgccttgagagcttgagggtgtccctaaataacaaccccgtgtcctgggtgcagacttttggggccgaaggcctggcctcactcctggatatcctgaaaaggcttcacgacgagaaggaagaaacagctggatcttacgacagccgcaacaaacacgagattatacgctgcctgaaggcctttatgaacaataaatttgggatcaaaaccatgctcgaaaccgaggaggggattctcctgctggtgcgggcaatggaccctgctgtccctaacatgatgatcgacgctgctaagcttctcagtgccctctgtatactccctcaacctgaggacatgaatgaacgtgttctcgaggccatgacagaaagggccgaaatggacgaggtagagagattccaaccgctcctggatgggctgaaatctgggacaaccattgcactgaaagtagggtgcttgcagctgattaacgctctaatcacgcccgcagaagaactggacttcagggtccatattagatccgaactaatgcggctcgggttgcatcaggtgttgcaggacttacgggagatagaaaatgaggatatgagagttcagttaaatgtcttcgatgaacagggggaggaggatagctacgacctgaaggggcggcttgacgacatacgcatggagatggacgacttcaacgaggtgttccagattttgctgaacacagtgaaggattcaaaggctgagcctcatttcttgagtattcttcagcacctgctgcttgtgaggaatgattacgaggcgaggcctcaatattacaaactcatcgaggaatgtatatcacagatagtgctgcacaaaaacggagctgatcctgatttcaaatgccgccatctccagatcgaaattgaaggtttgatcgatcaaatgattgataaaaccaaggttgaaaagtccgaagctaaagccgcggaattagagaaaaaactggacagcgaactgaccgccagacatgagctgcaggtggaaatgaagaagatggaaagcgactttgagcagaagctacaggacttgcaaggggagaaagatgccctgcattctgagaagcagcaaattgccaccgagaagcaagacctagaggctgaggtgtcccagctgaccggagaagtcgctaaactaaccaaggaactcgaggatgccaagaaggagatggctagcctctctgccgccgcgattacagtcccgccctcagtcccatcacgggcgccagtgccacccgcacctcctctccctggtgactccgggacaatcatcccaccgccacccgccccgggcgattccaccactccccctcccccgcctcctcctccccccccccctccgccactccccgggggaacggctatcagcccccctcctcctttgtcgggggacgctacaatcccaccccccccccctctgcctgagggggtggggatcccaagtcctagctccctgcccgggggtaccgcaataccaccaccgccacccctgcctgggtccgctagaatccctcctccccctccccctttgcccggctcagccggcatcccacctccgcccccacccctgccaggggaggcaggaatgcctccccccccccccccactccctggcggaccaggaatccccccacccccccccttccctggcgggccaggcattcctcctcccccccccgggatggggatgcccccccccccaccatttggctttggcgttcctgccgctccagtccttccgttcggactcaccccaaagaaattgtacaaacccgaggttcagctgagacgcccaaactggtccaagctagtcgcagaagacctttcgcaggactgcttttggacgaaggtgaaagaggacaggtttgagaataacgaactcttcgctaaactcaccctgaccttctctgcacagaccaagacgaaaaaagaccaggaggggggggaagagaagaaaagcgtgcaaaaaaaaaaagtgaaggagctgaaagtgctcgactccaagactgcccagaacctgagcatctttcttgggagctttcggatgccttaccaagagatcaagaatgtgatcctggaagtgaacgaggccgtgctaactgaatcaatgattcagaatctcatcaagcaaatgcccgagccggagcagttgaaaatgctctctgagttgaaggacgaatacgatgacctcgccgagtcagaacagtttggtgtggtaatgggcacagtgcccaggctgagaccccggctgaacgcaatactgtttaaactgcagttttcagagcaggtggagaacatcaagcccgagatagtgtccgttacggctgcctgcgaggagctgcgcaagagtgagagcttcagtaatttgttggagatcaccctcctggtgggtaattacatgaacgcgggatcccgtaacgccggagcgttcggatttaatatcagcttcctctgcaagctgagagacactaagtcaaccgatcagaaaatgaccctgttgcatttcttggcagagctgtgtgagaatgattaccccgatgttctgaagttcccggacgagctggcacacgtggagaaggcatcaagggtctctgctgaaaacttgcaaaagaacctggatcaaatgaagaagcaaatctccgacgtagaacgtgatgtgcagaactttcctgccgctacagatgagaaggataaattcgtagagaagatgacaatatttgtcaaggatgcacaggaacagtataacaagttgcggatgatgcattccaatatggaaacactgtacaaggagctgggcgagtacttcctcttcgatccaaagaaactgtctgtcgaggagttctttatggacctccacaatttccggaatatgtttctacaggccgtgaaagagaaccagaagagacgcgagactgaggaaaaaatgcgccgggcaaaactcgcaaaggagaaggctgagaaagaacggctagagaagcagcaaaagagagaacagctaatcgatatgaatgctgagggggatgaaaccggggtgatggattctcttttggaagcactacagagtggggctgcattccgccgcaagcgcggcccccgacaggccaatcgaaaagctgggtgtgctgttacgagccttttagctagcgagttaacaaaagacgacgctatggcagccgtccccgctaaagtgtctaagaacagcgagacattccctactattctagaggaggcgaaggagttagtgggcagggccagctag

SEQ ID NO: 23883 - DNA, 3795 bp, Artificial Sequence
  Description of Artificial Sequence: Synthetic coding sequence
atggagccccccggcggcagcctgggccccggccggggcacccgggataagaaaaaggggaggagcccagacgaattgccttctgccggaggcgatggagggaagagtaaaaaatttctggagcgatttacatccatgagaatcaagaaggagaaggaaaagcctaacagcgcacatcgcaattcctctgcgagctacggcgatgaccctacagcacagagtcttcaggatgtgagcgacgaacaggttctggtcttgttcgagcagatgctgctagacatgaatctgaacgaagaaaagcaacagcccctcagggaaaaggacattattatcaagagagaaatggtatctcagtatctgtatacatcaaaagcaggtatgtcacagaaggagtcctccaagtctgcaatgatgtacattcaagaactccgttcaggactccgggacatgccactcctcagctgtctcgaatccctccgcgtatccctgaataacaaccccgtatcgtgggtccagacctttggtgcggaaggattggctagcttgctggacatcctcaagcgcttgcacgacgagaaagaagaaacggcaggctcttacgacagcaggaacaaacatgagattatccggtgtttaaaagccttcatgaacaataaatttggaattaagacaatgctggaaacagaagagggaatccttctactggtgcgggccatggatcctgcagtgcctaacatgatgatcgatgctgccaaactgttatctgcattgtgtatcctacctcaacccgaggatatgaacgagcgtgttctggaagccatgacagaacgggccgaaatggacgaagttgagagatttcagccattattagatggtctcaagagcggaactactatcgccctcaaagtggggtgtctccaactcatcaacgctctcataactccagctgaggagctggattttcgtgtgcatatccgctcagagctcatgcgcttaggactccatcaggtgctgcaggatctcagagagatcgagaatgaggacatgcgcgtccagctgaacgtgttcgacgagcaaggggaagaagactcttacgacctgaagggacggttggacgacattcgaatggaaatggacgacttcaacgaggtcttccagatcctactcaacacagtgaaggattccaaggctgaaccacatttcttgtctattctgcagcacctgctcctggtccgcaacgattatgaagcacgtcctcaatactacaagcttattgaggagtgcatctcacagattgtgcttcacaagaatggagctgatccagatttcaagtgtaggcacctgcagattgaaatagaagggcttatcgaccagatgatcgacaagaccaaagtggagaaatccgaagcgaaagcagctgagcttgagaagaagttggactctgagcttacagcgagacacgagctccaggtagaaatgaagaagatggagtcggacttcgaacagaaactgcaggatcttcagggcgagaaagacgctctgcattccgagaaacagcaaatagcaaccgagaaacaagacctggaggccgaggtttctcagcttactggggaagtcgcaaagctgaccaaggagcttgaggatgctaagaaggagatggccagtctttcggctgccgctataactgttcccccctctgtgccctcgcgggctcccgtgccacctgcgcctccccttcctggagactctggcactattatccccccccccccagcccccggcgattccacaacgccgccacctcccccaccaccgcccccgccaccacccccattgcctgggggcgtctgtatttccagccctccaagtctaccaggcggtacagctattagtcctcctcctccactcagcggggatgcgacgatccccccaccccccccactccctgaaggcgtagggatcccaagcccctctagcctgcccggaggcaccgcaatccctcctccgcctccactgcctggaagtgcacgtataccccccccaccaccccctcttcctgggagtgctggcatcccgccccccccccctccacttccaggagaagctgggatgccacctcctcccccgccactcccaggaggtccgggcatcccgccccctccgcccttcccaggcggccccggcattccacctccaccccctggcatgggcatgccacctcccccaccctttggattcggggtgccggctgcaccagtgctgccatttggcctgactcccaagaagttgtacaaacccgaggtgcagctccgccggcctaactggtccaagttagtagcagaagatctgtcccaagactgcttttggactaaagttaaggaggaccgattcgagaacaacgagctgttcgctaaattgacactcacgttctctgcacagacgaaaaggacgaagaaagccaaaaaggatcaggaagggggcgaagaaaagaagtcagtccagaaaaagaaagtgaaggaattgaaggttctggattcgaagacagctcagaatctgagtatctttctggggagcttccgaatgccttatcaggagataaagaatgtgattcttgaggtcaacgaggccgtgctgacagagagcatgattcaaaaccttatcaaacagatgcccgaacccgaacagctgaaaatgctgtcagagcttaaagatgagtatgacgatttggccgagagcgagcagtttggcgtggtaatggggaccgtaccaaggctgcgccctcgattaaacgctattctcttcaaactccaattctctgagcaagttgagaatattaaaccagagatagtgtcagtgacggccgcctgtgaggagctgagaaagtcagaatctttttctaacctgctggaaatcacgttattagtcggaaactacatgaacgctggcagtcgtaacgccggagccttcggtttcaacatctccttcctatgcaagttgagggacaccaaaagcacagatcagaaaatgacactcttacacttcttggccgagctttgcgaaaatgactacccagatgttctcaagttccctgatgagttagcgcatgtcgagaaggcaagccgcgtgtccgccgaaaatctgcagaagaatctggatcaaatgaagaagcagataagcgacgtggaaagagatgttcagaactttcccgccgcgaccgacgagaaggacaagtttgtggaaaaaatgaccattttcgtgaaagacgcgcaggagcagtacaataagctgagaatgatgcactcaaacatggagacgctgtataaagaactcggggagtattttctgtttgatccgaaaaagctatcagtggaagagttcttcatggacctgcacaacttcaggaatatgttcctgcaagcagtgaaggaaaaccaaaaacggagggagacagaagaaaaaatgcgacgggccaagctagcaaaggagaaggccgagaaggagcgtctggagaagcaacagaagagggagcagctcatcgatatgaacgcggagggtgacgagaccggcgtcatggacagtctactggaggctctccaatcaggcgcagcctttcgccgtaagcgcggtccaaggcaggctaaccggaaagcaggctgtgcggtgacatcacttttagctagcgagctgaccaaggacgacgccatggcagccgtgcctgcgaaagtctcaaagaatagtgagactttcccgaccattctcgaagaggccaaggagctggtggggagagcttcctag

SEQ ID NO: 23884 - DNA, 855 bp, Artificial Sequence
  Description of Artificial Sequence: Synthetic coding sequence
atggccagcctgagcgccgccgccatcaccgtgccccccagcgtgccatcgagggcgccagttcccccagctccaccattgcccggtgactccggtaccataatacctcctcctccagccccaggggacagcaccaccccaccccccccaccccctccgcctccccctccacccccacttcccggaggtgtttgcatttctagccctccttcgctgccaggggggacggccatctctccccccccaccactatccggagacgcaactatcccacctccaccaccattgccggagggagtcggaattccctctccctcaagcctgcccgggggaaccgccatacctcctcccccgccactcccaggttcggctaggatcccccccccgcccccacccctccctggaagtgccgggatccccccccctcctcctcctctgccaggggaagcaggaatgcctccacccccccctcccctgcccgggggccccggcattccacccccccccccttttccaggcggacccggcatcccccccccccctcccggtatgggcatgccacccccaccacctttcgggtttggggtccccgccgccccagtgctgcccttcggactgacaccgaagaaattatacaagccagaggtgcagcttaggcggcctaattggtccaaactggtggcagaagacttatcgcaggactgtttttggacaaaagtgaaagaggaccgctttgagaacaatgaactctttgctaagcttacactgacgttttcggcccagacgaagagtgaaaaggctaagaaagatcaggaaggcggggaggagaagaagagtgtccaaaaaaaaaagtag

SEQ ID NO: 23885 - DNA, 513 bp, Artificial Sequence
  Description of Artificial Sequence: Synthetic coding sequence
atgtactgccagttcgccagcttccagtacacctgccagccctgcaggggccagagaatgctgtgtacacgggattccgaatgttgcggcgaccagctctgtgtatggggccactgtacgaaaatggccactaggggcagcaatgggactatttgcgataaccagagggattgccaaccaggcctgtgctgcgcgtttcagcggggcctcctttttcccgtatgcacgcctctgcccgtggaaggcgaactgtgccacgatccagcaagtcggctgttggacctcattacatgggagctggaacccgacggtgctctcgataggtgcccctgcgcgtccggacttctctgccagccgcacagtcactcgcttgtttatgtatgcaaacctacatttgtaggctcgcgcgaccaggatggtgagatcctcctgcctcgggaggtacctgatgagtatctagcagcgtcttggagaaggtgcgcccgttcctggcgcacctggaggggagcatag

SEQ ID NO: 23886 - DNA, 1053 bp, Artificial Sequence
  Description of Artificial Sequence: Synthetic coding sequence
atgcagcggctgggcgccaccctgctgtgcctgctgctggccgccgcagtccccaccgcccccgcaccagccccgactgcaacgtcagcaccagtcaaaccaggcccagccctgtcttatccccaggaggaggcaacactgaacgaaatgtttagggaagtggaagaactgatggaggatacgcagcacaaacttaggtctgcagttgaagaaatggaggcagaggaggccgcagctaaggccagttcagaagtgaatctggccaatcttccaccctcgtatcacaatgaaacaaacaccgacacaaaggtggggaataacaccatccacgtgcatagggagatccacaagattacgaacaaccagaccgggcagatggtgtttagcgaaaccgttatcactagcgtaggagacgaagagggaagaagatcccatgagtgcattatcgatgaggattgtggcccctccatgtactgccaattcgcttctttccaatacacctgccagccatgtaggggtcagcgaatgctgtgcacacgcgacagcgagtgttgtggcgatcagctctgcgtgtggggtcactgtaccaaaatggctacccgcggatcaaacggcactatctgcgataatcagcgagattgtcaacccggactctgctgcgccttccaacgagggcttttgttcccggtgtgtacccccctgcccgtggagggcgagctgtgtcacgacccagcgagtagactgcttgatctcataacgtgggagctcgagcctgatggcgcactggacagatgcccatgcgcgtcaggcctgctgtgtcaaccccattcccatagcctagtgtatgtgtgtaagcctacgtttgtgggctcgcgcgatcaggatggagagatattgcttcctcgggaggttccagatgaatacgaagtgggaagtttcatggaagaggtccgacaggaacttgaggatttggaacggtccctaaccgaggagatggctctgcgcgagccagctgccgctgccgcggctctcctggggggagaggagatctag

SEQ ID NO: 23887 - DNA, 882 bp, Artificial Sequence
  Description of Artificial Sequence: Synthetic coding sequence
atggaggacacccagcacaagctgcggagcgccgtggaggagatggaagctgaggaggccgctgctaaggcaagttccgaggtgaacctggcaaatctaccgccgagctatcacaatgaaacaaacacagatacgaaggtcggtaacaacacaatccacgtacaccgggagatccacaagatcactaacaaccagacagggcagatggtcttcagcgaaacagttatcacttctgtgggtgacgaagaagggagacgcagccacgagtgcatcatcgacgaagactgtggacctagcatgtattgccagtttgccagcttccaatacacctgccagccatgtagaggacagagaatgctgtgtactagagacagcgaatgttgtggggaccaattatgcgtgtggggacactgtactaagatggcaaccagaggctccaacggcacgatttgcgataatcagcgagactgccagcccgggctgtgctgtgcgttccagaggggcctgctgttccccgtctgtacacctctccctgtcgagggagaactttgccatgatcctgctagtagactgctggacctcataacatgggaactggagcctgacggagcacttgacagatgcccatgcgctagcggtctactgtgtcagcctcactcccatagcctggtgtacgtgtgcaagccaacattcgtagggtcacgggaccaggacggcgagatcctgcttccacgtgaagtgcccgatgagtacgaagtcgggagcttcatggaggaggttcgacaggagctagaggatctcgaacgaagcctgactgaggaaatggccctcagagaaccggccgcagcagctgcagccctgctaggcggagaggaaatttag

SEQ ID NO: 23888 - DNA, 1053 bp, Artificial Sequence
  Description of Artificial Sequence: Synthetic coding sequence
atgcagcggctgggcgccaccctgctgtgcctgctgctggccgccgctgtgccgacggctccggctcctgctccgacagccacatcagccccagtgaaaccaggtcccgccctcagttatccccaggaagaagcaacgctcaatgagatgttccgggaggttgaggaactcatggaggacacccagcacaaactcaggagtgccgttgaggagatggaggctgaagaagccgctgccaaggcaagctccgaggtcaacttagccaatctgcctcccagctaccataatgagacaaatacagacacaaaggttggaaataatacgatccacgtgcatcgagagatccacaaaatcaccaacaaccagaccggacaaatggtcttcagcgaaaccgtgattacgagtgtcggcgacgaagaaggaagaaggtcccacgagtgcatcattgatgaggattgcggcccatctatgtattgtcagtttgcttcttttcagtatacatgtcagccgtgtcggggccaacgtatgctgtgtacacgtgatagtgagtgttgtggcgatcagctatgtgtgtgggggcactgtaccaaaatggccacacgaggtagcaacggtactatatgcgataatcagcgtgactgccagccaggtttatgttgtgctttccagcgtggactgctcttccccgtgtgcacccccctgcccgtcgagggcgagctttgtcatgatcccgcctcaagactgctggatcttattacgtgggagctggaaccagacggcgccctagataggtgcccatgcgccagcgggctgttatgccaaccacactcacactctctcgtttacgtgtgtaagcccacatttgtaggctctcgcgaccaggacggggaaatccttctgccccgtgaggtgcctgatgaatacgaagtagggtcattcatggaggaggtcagacaggaactggaggacctggagcggtctctgacggaggaaatggcccttcgagaacctgcagctgccgctgcagctcttttgggcggcgaagagatctag

SEQ ID NO: 23889 - DNA, 969 bp, Artificial Sequence
  Description of Artificial Sequence: Synthetic coding sequence
atgcagcggctgggcgccaccctgctgtgcctgctgctggccgccgccgtaccgaccgcacccgctccggccccaacagccaccagcgcgccagtgaaaccaggccctgctttaagttaccctcaagaggaggcaacccttaacgagatgttcagggaggttgaagagcttatggaggatacacagcataaattaagaagcgcagtagaggaaatggaggccgaggaagccgctgctaaggccagctcagaggttaatctggcaaatctcccaccatcgtaccataacgaaaccaacacggatacaaaagtcggcaacaatactatccatgttcacagggaaattcacaaggagtgcatcatagacgaagattgtggtcctagtatgtactgccaattcgctagctttcagtacacatgtcagccttgtcgggggcagcgcatgctttgcacaagagacagtgagtgctgcggtgatcagctttgcgtttggggacactgtaccaaaatggcgacacgaggctccaacgggactatttgcgacaatcaacgtgactgtcaacccggtctttgttgcgcctttcaacgcggcctgctgttccctgtgtgtactccccttcccgtagaaggcgagctctgccacgatcccgcctcgcgcctgctagatctaatcacctgggagctggagcctgacggggccctcgatcgttgcccttgtgcctctggcctgctctgtcagcctcactcccactcactagtgtatgtctgcaaaccaacatttgttggatcgcgggatcaggacggcgaaattcttctgccacgggaggtacctgatgaatatgaagtgggcagcttcatggaggaagtccgccaggagttagaggatttagaaagatccctaaccgaagaaatggcgcttagagagccagcagccgcagctgctgctctcttaggtggggaagaaatctag

SEQ ID NO: 23890 - DNA, 708 bp, Artificial Sequence
  Description of Artificial Sequence: Synthetic coding sequence
atgcagcggctgggcgccaccctgctgtgcctgctgctggccgccgctgtccccaccgcaccagcgccagcaccaactgccacttcagcacctgtgaaacctgggccagcacttagctatccccaggaagaggccactcttaacgaaatgttcagggaggtcgaggagctgatggaggatactcaacacaagctgcgatccgctgttgaggaaatggaagctgaggaggctgccgccaaagcttcctcggaagtcaacttagcgaaccttcccccaagctatcacaatgagactaacaccgatacgaaagtaggcaataacactatccacgtccacagggagatccacaagataaccaacaaccagacaggtcagatggttttttccgagaccgtgataaccagtgtgggagatgaggaaggacgccggtctcacgagtgtataattgacgaagactgtggtccgagcatgtactgtcaattcgcctcttttcagtatacctgccaaccttgccgcggacagagaatgttgtgcacaagggacagtgaatgctgcggcgaccagctgtgcgtttggggccattgcaccaaaatggccacacggggctcaaacggaaccatatgcgataaccaaagggactgtcaacccggcctttgctgtgcttttcagcgtggcctgttgtttcctgtgtgcacccctctgccctag

SEQ ID NO: 23891 - DNA, 2301 bp, Artificial Sequence
  Description of Artificial Sequence: Synthetic coding sequence
atgaagaccccctggaaggtgctgctgggcctgctgggcgccgccgctctcgtgaccatcataaccgttcccgttgtcttgcttaacaaagggacagacgatgccacagccgatagtcgcaaaacttacaccctgaccgactacctcaagaacacctatagactgaagttgtacagcctccgctggatatcagatcatgaatacctgtacaagcaggaaaacaatattcttgtgttcaacgctgaatatggcaattcctccgttttcctggagaacagtaccttcgatgaattcggacattctattaacgattactcaatatcccctgacggacagtttatcctcctagaatacaactatgttaagcagtggcggcactcctacactgcatcatacgacatttatgatctgaacaagagacagttaataaccgaggaacgaattcccaacaatacacagtgggttacttggtcgcccgtcggccacaaactcgcgtacgtttggaacaacgacatatatgtgaagatcgagccgaatcttcctagttatcgaatcacttggaccggtaaggaagatatcatctacaatggaatcacagattgggtgtacgaagaagaggtgttcagcgcatactctgccctttggtggagtcccaatggcacctttttggcttacgctcagttcaacgacaccgaagtgccattgattgagtacagtttctattcggatgaatctctacagtaccccaagaccgtaagagtcccatatccgaaagctggagcagtcaacccgacagtaaaatttttcgtggtcaatactgattccctatcgtcggtcaccaacgccacatcaatccaaatcaccgcacccgcttcaatgctgatcggggatcactatctctgtgacgttacctgggctacccaggagaggatttctctacaatggctccgacggatacagaactatagtgtcatggatatctgcgattacgatgagagttccggcagatggaactgtctggtcgcacggcagcacatcgaaatgtccactacaggatgggttggacggtttcgtccttctgagccccatttcacactggatggaaacagtttttacaaaattatatcaaacgaagagggctatcgacatatttgctacttccaaattgataaaaaggactgtactttcattacaaaaggcacctgggaagtaattgggattgaggcactgacttctgactatctgtattacatttccaatgaatacaaagggatgccgggcggacgcaacctgtacaaaatccagttgtccgattacacgaaggtgacgtgcctgtcctgtgaacttaatcccgaacgctgccagtattatagtgtcagttttagcaaagaggccaagtattaccaactccgctgcagcggacccggtcttcctctttacacgctgcattcctccgttaatgacaagggcctccgggtgctcgaggataactccgcattagataagatgctacagaatgtgcaaatgccctccaagaagttggactttatcattctgaatgagacaaaattctggtatcagatgattctgccccctcatttcgataagtctaaaaagtatccgttgttacttgatgtgtatgccggcccctgcagtcaaaaagccgacacagttttcaggctaaactgggccacctacctggcaagtaccgaaaatattatcgttgcctccttcgacggaagagggtccggctaccagggggacaagattatgcacgccattaatagaagattgggcaccttcgaagtcgaagatcagatcgaagctgcccgccagttttctaagatgggattcgtagacaataagaggattgctatctggggctggtcatatggcggctatgtgaccagtatggtcctgggatctggcagcggtgtatttaaatgtggcatcgccgtggcccctgtctcccgatgggaatattacgattctgtctatactgaacgttatatgggccttccaactccagaagacaatctggatcattatcgtaacagtaccgtaatgtcaagggctgaaaattttaagcaggttgagtacctgctgattcatgggaccgcagatgataacgtacacttccagcagtcagcccaaatctctaaggccctcgttgatgttggcgtggattttcaggctatgtggtacactgatgaagaccacgggattgcgtccagcacagcccatcagcatatctatacgcacatgtctcattttattaaacaatgcttcagtctgccatag

SEQ ID NO: 23892 - DNA, 645 bp, Artificial Sequence
  Description of Artificial Sequence: Synthetic coding sequence
atgaacgtgttccggatcctgggcgacctgagccacctgctggccatgatcctgctcctgggaaagatttggagaagtaagtgttgcaaaggtatcagtgggaagtcacagattctgtttgccctcgtatttactacccgctacctcgatctgtttacaaactttatctcaatctataacactgttatgaaggtcgtgtttctgctgtgcgcctatgtaactgtgtacatgatctatggcaaatttagaaagacttttgattcggaaaacgacaccttcagactggagttcctgctggtacccgtaattggcttatctttccttgaaaattatagttttacacttttggaaattctgtggactttctccatttatttggagtctgtcgctatccttccccagctattcatgatttcaaagacaggagaagctgagactattaccacacattatctgtttttcctcggcctgtatagggctctttacctggcaaactggattcgccgttaccaaaccgagaatttttacgaccagattgccgttgtctctggagttgtgcagactatcttttactgtgactttttctatttatatgtgaccaaggtgcttaaaggtaagaagctgagtctaccaatgccgatttag

SEQ ID NO: 23893 - DNA, 498 bp, Artificial Sequence
  Description of Artificial Sequence: Synthetic coding sequence
atgaaggaggaccaggtggtggccgaggagcccggcttccaggacgaggaggagtcgctcttccaagacattgatctgctccagaaacacggcataaacgtggctgacataaaaaagctgaagtctgtaggcatctgcacaataaagggtatacagatgacgacacgacgagctctgtgcaatgtcaagggactgtctgaggccaaagtggacaagatcaaagaagccgcaaataagctgatcgagcctgggttcttgactgcctttgagtacagtgagaagcgtaaaatggtttttcacattactaccggcagccaagagtttgataaactgcttggggggggaattgagtccatggctattacggaagcctttggcgagtttcgtactggcaaaacacagctgagccatacgctgtgcgtcacagcccagcttcctggtgctggcggctatcccggaggaaagattatctttattgacacggagaatactctgtag

SEQ ID NO: 23894 - DNA, 420 bp, Artificial Sequence
  Description of Artificial Sequence: Synthetic coding sequence
atgaaggaggaccaggtggtggccgaggagcccggcttccaggacgaggaggagagcctgttccaggatatagatctcctccagaaacatggcattaacgttgcagacattaagaaactgaaatccgttgggatctgtaccattaaaggcattcaaatgaccacacgccgggcactctgcaacgtgaaaggattatcagaagcaaaggttgacaaaattaaggaggcagcgaataaattgatcgagcctggttttctgacagcctttgaatactccgagaagcgcaaaatggtctttcatattacgaccggcagccaggagtttgacaaactcctggggggtggcatagaatcaatggcaatcactgaggcttttggtgagttccgaacaggtaagacgcaactgtcacacacgctatag

SEQ ID NO: 23895 - DNA, 858 bp, Artificial Sequence
  Description of Artificial Sequence: Synthetic coding sequence
atgaaggaggaccaggtggtggccgaggagcccggcttccaggacgaggaagaaagcctgttccaagatatagatttgttgcagaaacacgggattaacgtggcagacattaaaaagttaaagagcgtagggatatgtacaattaaagggattcagatgacaacgcggcgcgccttatgtaatgtcaagggtttatccgaagccaaggtggacaaaattaaggaggctgccaacaagctgatagagccaggctttctcaccgcgttcgaatacagcgaaaagcggaagatggtctttcacattacgaccgggagccaggagttcgacaagctcctcgggggcggcatcgaatcaatggcaataaccgaggcttttggagagtttaggaccggaaaaacgcagctaagtcacaccttgtgcggagagcatcaaatggagctgttagattacgttgcagctaaattccatgaagaggctggaatcttcaagctactgatcatagatagcattatggctctcttcagagtcgattttagcggtcgaggagagctggcagagcgacaacagaagctggcacagatgctcagtagactccagaagatttctgaggagtacaacgttgccgtgtttgtaaccaaccagatgaccgccgaccccggggcaaccatgaccttccaagctgatcccaaaaagcccataggaggccacatactggcccacgcttcaacgactagaattagcctcagaaagggacgcggagagttacggattgccaaaatctacgacagtccagagatgcccgagaatgaagccacattcgctattactgccggtggcattggggacgcaaaagagtag

SEQ ID NO: 23896 - DNA, 612 bp, Artificial Sequence
  Description of Artificial Sequence: Synthetic coding sequence
atgaaggaggaccaggtggtggccgaggagcccggcttccaggacgaggaggaaagcctctttcaggacatcgacctactccaaaaacacgggatcaacgtggcagatatcaaaaaattgaaaagcgtcggtatttgcactattaaagggattcagatgaccacacggcgcgccttatgtaacgtcaaaggcctatctgaagcgaaggttgacaagattaaggaggccgcaaataaactgattgaacctggatttctgacagcgttcgaatatagtgagaaacgtaagatggtgtttcatataactacaggaagtcaggaattcgataaactcctgggcggcggtattgagagtatggccatcacagaggcatttggcgagttccgaacaggcaaaacccaactttcccatacgctgtgtggcgagcatcagatggagttgttggactacgttgccgccaagttccacgaggaggctgggattttcaaattgttgatcattgattccattatggccctgtttagagtggatttctcaggaagaggtgagcttgccgaacgtcaacagaagttggcacagatgctttccaggctccaaaagattagcgagtag

SEQ ID NO: 23897 - DNA, 1599 bp, Artificial Sequence
  Description of Artificial Sequence: Synthetic coding sequence
atgaacggcgtgctgatcccccacacccccatcgccgtggacttctggagtttgcgacgggcaggcactgcgcgcctattttttctatcacatatgcactccgaccacactgtgggcctaagctcaacctgggctcgccccctctactgtagccccattactgcacacttgctgcacaggcacctgcaggtcagcaaacagtggattcaagccttggaggtcggggagtcacatgtgctgccgctggatgagatcggccaggaaaccatgactgtcaccttgctcgatgccaaccattgtcccggcagcgtcatgttcctgtttgagggctacttcggaaccatcctgtataccggagatttcagatacactcctagtatgctgaaagagcccgcgctgaccctcggcaagcagattcatactctatacctcgacaacaccaactgcaaccctgcccttgtgctgccaagcaggcaggaggctgcccatcaaatagtccaactgatcaggaagcaccctcagcacaacataaagataggcctgtattccctcggcaaggagtccctgctggaacagctggccctcgagtttcagacatgggtggtgttgtctcccaggagactcgagctggttcagctgttggggctggcggacgtgttcaccgtcgaggaaaaagcgggtcgaatccatgctgtcgatcatatggaaatctgtcacagcaacatgctccggtggaaccagactcatcctaccatagccatattgccaacttccaggaagatccattcgagccatccagacattcacgtgattccatactctgatcactcctcttacagcgaactaagggcgttcgttgccgccctgaagccttgccaagtggtgcccatagtgtcccgccgcccctgcggaggcttccaggattctctgtcccctaggatttctgtgccattgataccggattcagtgcaacagtatatgagttcttcctcacggaagccctcactgttgtggctcctcgaacgtcgcctgaagcgccctcggacccaaggcgtcgtattcgagtctccagaagaaagtgcagaccaatcccaggcggacagggattccaagaaggcgaagaaggaaaaattgtctccctggccagccgacttagagaaacagccttcccaccacccgctccgtataaagaagcagctctttcctgacctctacagcaaggagtggaataaggcagtccctttctgcgagagccagaaaagagtgactatgctgactgcacccttgggcttttcagtgcacctccgaagtactgatgaagagtttatttcacaaaagacccgcgaggaaatcgggctcgggagtcctttggtgcctatgggcgatgatgatggaggacccgaggccacagggaaccagagcgcatggatgggacatggctcgcccttatcccacagcagtaaaggaactccgcttctggccaccgaatttcgggggcttgcgcttaagtacctgctcaccccggttaactttttccaagccggttacagcagtcggcggttcgatcaacaagtggaaaaatatcacaaaccttgctag

SEQ ID NO: 23898 - DNA, 1734 bp, Artificial Sequence
  Description of Artificial Sequence: Synthetic coding sequence
atgaagcaccaggagcggttcctgttccagggcaacaacggcaccgtgctgtacactggcgacttccggcttgcacaaggcgaggcagcccgcatggagctccttcacagtgggggacgagtcaaggacattcagagcgtatatttagacacaactttctgtgacccgaggttttatcagatcccctcacgggaggaatgcctttcgggtgttctggagctcgtaaggagttggatcactcgctccccatatcacgtggtgtggttaaattgtaaggcggcatatggctatgagtacctctttacaaacttgtccgaagagctcggagttcaagtgcatgtaaataagttggacatgttcagaaatatgcccgagattctgcatcatctcacaaccgatagaaatacacaaattcatgcctgtaggcaccccaaagccgaagaatactttcagtggtcgaaacttccttgtgggattaccagccggaatcgaatcccactacacataatctcaatcaagcccagtacgatgtggtttggggaacgaagtcgcaaaacgaatgtcatcgtgaggacgggagagtctagttaccgcgcatgtttctcttttcactcttcgtatagcgagattaaggattttttaagttacctgtgtcccgttaatgcttatcccaacgtcattccagtggggacgactatggataaggtggtggagatactgaaaccactctgcagatctagccagagcacggagccgaaatataaacctctgggcaaactgaagcgggcgcggacagtccatcgggacagcgaagaggaggacgactacctgttcgacgacccactcccgatcccactcagacataaagtcccataccccgaaaccttccaccccgaagttttttctatgacggccgtcagcgaaaagcagcctgaaaagttgcggcagactcccggatgttgtcgcgccgaatgcatgcagtcttctcgtttcactaacttcgtggattgtgaagagtccaatagcgagagtgaggaggaggtcggcatcccagcaagtttgcagggagatctcggctcagttctgcatttgcagaaagctgatggcgatgtgccccagtgggaagtgttttttaaaaggaacgacgaaatcacggatgagtcccttgagaatttcccctccagcaccgtggccggcggatcccagagcccaaagttattttcagattctgatggcgagtcaacacatataagctcccaaaattcctcccagagcacccacataacggaacagggatcacagggctgggacagccagtctgacacagtgctgttaagtagccaggagagaaacagcggtgacataacttccctcgataaggcggattatagacccaccataaaggagaatatccctgcatctcttatggagcagaacgtcatttgcccgaaagatacatactccgatttaaagtcacgggataaggatgtcaccatcgtgcctagtacaggcgaacctaccaccctgagttcagagactcatattcccgaggagaaaagcctgctgaacctgtccacaaatgcggattcccagtctagcagtgattttgaggtgccctctactcctgaggctgaattgcctaagcgggaacacctgcagtatctctacgagaaactggccaccggagaaagcatcgccgtcaagaaaaggaagtgcagtctgctagacacatag

SEQ ID NO: 23899 - DNA, 255 bp, Artificial Sequence
  Description of Artificial Sequence: Synthetic coding sequence
atgttcctgttccagggcaacaacggcaccgtgctgtacaccggcgactttcgactggctcagggcgaggcggctaggatggagttactacatagcggtggtcgcgtgaaagatatccagtccgtttacctggacaccaccttctgcgatcccagattttaccagatcccttcgagagaagagtgtctcagtggagtgctggagcttgtgaggagctggatcacacggagtccttaccacgtagtctggctgtag

SEQ ID NO: 23900 - DNA, 1038 bp, Artificial Sequence
  Description of Artificial Sequence: Synthetic coding sequence
atggacaaggtggtggagatcctgaagcccctgtgccggagcagccaaagtacggagcctaagtacaagccactcggtaaactcaagagggcccgcaccgtccatagagactccgaagaggaggatgactatcttttcgacgatcccctgccaatccctttgcgccataaggtgccttacccagaaactttccaccccgaagtgttctcaatgactgccgtctctgaaaaacagcctgagaagctacggcagaccccagggtgctgtagggctgagtgcatgcagagctcaagattcacgaatttcgtcgattgcgaggagtccaatagcgagagcgaggaggaggttgggatccccgccagtctccaaggcgacttgggaagtgttctccatcttcagaaagcagacggcgatgtgccacagtgggaagttttttttaaaagaaacgacgaaatcacggatgagtcactggaaaacttcccctccagcactgtcgcaggaggctctcagtctccaaaattatttagcgactcagatggcgagtcgacgcatatttcctcccagaactctagccagtcaacacacatcacggaacagggctctcaaggttgggattctcagtcagataccgtgctgctaagcagccaggagcgtaattctggagatataacaagcctcgacaaggccgactatagacccacaatcaaggagaacataccagcaagccttatggagcaaaacgtaatctgccctaaagacacgtacagcgatctcaagagccgagacaaggatgttaccatagtgccctctacgggcgaacctacaactctttcctccgaaacccacatccccgaagagaagagcttgctaaatctgtcaaccaacgctgattcacagtcatctagcgatttcgaagttccaagcacacccgaggccgaacttcctaaaagagaacatctccagtacctatatgagaaactagcgaccggcgagtccattgccgtcaaaaagcgcaaatgtagcctgctcgacacctag

SEQ ID NO: 23901 - DNA, 1734 bp, Artificial Sequence
  Description of Artificial Sequence: Synthetic coding sequence
atgaagcaccaggagcggttcctgttccagggcaacaacggcaccgtattgtacactggagacttccgacttgctcagggagaagccgctaggatggagctgctgcactctggcggccgggtcaaggatattcaaagcgtgtatctcgacacaaccttctgcgaccctagattttatcaaatcccatcccgagaggaatgtcttagtggagttctggaactggttcggagctggatcacccgtagcccctaccacgtggtgtggctaaattgtaaagctgcctacggctacgagtacttgtttacgaacctcagtgaagagctgggcgtgcaggttcacgtcaacaagttagacatgtttcgaaacatgcctgagatactccaccacctgacaactgacaggaatactcagattcatgcttgccggcatcccaaggctgaggaatattttcaatggtccaagttaccctgcggtatcacatcaagaaatcggatacctcttcatatcatctcaattaagccctctacaatgtggtttggagaacggtcgcgcaagaccaatgtcatagtgagaaccggcgagagcagctacagagcatgtttctccttccacagtagctattccgaaatcaaagattttctgtcttatctgtgtccggtgaatgcatacccgaacgtgatacccgtgggcaccaccatggataaagtggttgagatattgaaaccactgtgcaggtcctcacagagtactgagcctaaatacaagccgctaggtaagctgaagcgggcgaggactgttcaccgagacagcgaggaagaggatgactatctctttgatgatcccctgcccataccactgagacacaaggtgccttaccccgagacctttcatccagaggtgttctctatgaccgctgtgtctgaaaaacaaccggaaaagctgagacagacacccggatgttgccgggcagagtgcatgcagtcatctagatttacgaactttgtggactgtgaagaatccaacagcgagagtgaagaggaagtgggcattccagcttctctgcagggtgatctggggagcgttctgcatcttcaaaaggcggatggcgatgttccacaatgggaagtattctttaaacggaatgacgaaataacggacgagtcattagagaatttcccatcttccacagtcgcagggggaagtcagtcccccaagctgtttagcgatagcgacggcgagtcaactcacatatcatcccagaactcctctcagagcacccatattaccgagcaaggctctcaaggctgggactcgcagtccgataccgtcctcctgtctagtcaggaacgcaattcaggggacattacctcactcgataaagcagactatagacctactattaaggagaatatccctgcctcgctgatggagcagaacgtgatttgtccaaaggacacatactccgacctaaaaagccgcgataaggatgtaacaattgtgccgtctactggcgaacctacaacgttatcttctgagacccacattccagaagaaaaatcactgctgaacctgagcacgaacgctgattctcagtcttcctcggatttcgaggtgcccagtacccctgaagccgagctacctaaaagagagcacctccaatacctttacgagaagcttgctaccggcgaaagtatcgccgtgaagaagcggaagtgtagcttacttgatacctag

SEQ ID NO: 23902 - DNA, 1734 bp, Artificial Sequence
  Description of Artificial Sequence: Synthetic coding sequence
atgaagcaccaggagcggttcctgttccagggcaacaacggcaccgtcctttacacaggcgacttcaggctggctcaaggagaggccgctcgcatggagctgttgcacagcggtggacgcgtgaaggatattcaatcagtatatctggataccacattctgcgacccgcggttttaccagataccatcacgcgaagaatgtctttccggtgtgctggagctggtccgctcttggataactagatccccataccatgtggtctggctgaactgcaaggccgcctatggctatgaataccttttcaccaatctgagtgaagagctcggagtgcaggtacatgtcaacaaattggacatgtttcggaatatgcctgaaatcctgcaccacctgactactgatagaaacactcagatacacgcttgcagacacccaaaagctgaggagtactttcagtggtcaaagcttccttgcggcattacaagccgcaatcgcatcccgctgcacattatttctatcaagccgtctacaatgtggttcggcgagcggagtcggaaaacaaatgtgattgtgaggactggcgagtcgtcctaccgcgcttgcttcagcttccacagttcatattctgaaatcaaggatttcctctcctacctctgccccgtgaatgcctacccgaatgtcatccctgttggcaccaccatggacaaagttgtagagattctgaaacctctttgccgatcatctcagtcaaccgaacctaaatacaaaccgctgggcaagctcaaacgcgcccgtacagtccatcgggacagtgaggaagaagatgattatctgtttgatgaccccctgccaatcccacttcggcacaaggttccttatcctgagacctttcacccagaggtgttcagtatgacagcggtcagcgaaaaacagccagaaaaacttcggcagaccccagggtgttgtcgcgccgagtgcatgcagtcatctcggtttacaaactttgttgattgcgaggaatcaaactccgagagcgaagaagaggtggggattcccgctagtcttcagggagatcttggcagcgttttgcatctgcagaaagctgatggggatgtgcctcaatgggaagtgtttttcaagcgaaacgatgagattactgatgagagcctcgaaaacttcccatcctccaccgtggccgggggctcccagtcccccaagctcttttcagattccgatggtgaatccacccacattagttcacagaactcttctcagagtactcatatcactgagcaggggtcgcagggatgggattcacagtcagacacagtgcttctgtcttcccaggagaggaactccggagatataacaagtctggataaagccgactatcgccccacgatcaaggaaaacatccctgcttcattgatggagcaaaatgtcatctgtccaaaggatacttattcagatctaaagagcagggataaagacgtgaccattgtgccgagcaccggagaacctaccaccctctcgtctgagacgcatataccggaggagaagtctctattgaatctgagtacaaacgccgacagccagagttcctctgactttgaggtaccgtcaaccccagaagctgaattgcctaagcgggagcacctccagtacctttatgagaaacttgctacgggagaatccatcgcagtgaaaaagcgcaagtgctcccttttagacacatag

SEQ ID NO: 23903 - DNA, 1719 bp, Artificial Sequence
  Description of Artificial Sequence: Synthetic coding sequence
atgttcctgttccagggcaacaacggcaccgtgctgtacaccggcgactttcgtctggcacaaggcgaagcagcaagaatggaacttctgcattcaggagggcgggtgaaggatattcagtctgtttatctggatacgacgttttgcgatccccgtttttaccagatacccagtcgcgaggagtgcctcagtggcgtactagagcttgtgagaagctggattacaaggtcgccctatcacgtggtgtggctgaattgtaaggcggcttacggctacgaatacttgttcactaaccttagcgaagaacttggcgtgcaggttcacgtgaacaaacttgacatgttcaggaatatgcccgaaattctgcatcatctgacaacggataggaacacccagattcacgcctgcagacaccccaaggctgaggaatacttccaatggtccaagttgccatgtggtattaccagccgcaatcggatccctctccatatcattagcatcaaaccatcaaccatgtggttcggcgagaggagtcgcaaaactaacgtcatcgtacggaccggggagagttcgtaccgcgcatgtttttctttccattcctcctactccgaaatcaaagactttctgtcctatctgtgtcccgtaaatgcctatcctaacgtgataccagtggggactaccatggataaagtcgtggagatattgaagcccttgtgtcggtcttcccaaagcaccgagccaaaatacaaacctctgggaaagctgaaacgcgcccgcactgtgcaccgcgattctgaggaagaagatgactatcttttcgatgatcccctcccaatccctctacggcacaaggtcccttacccagagacatttcatcccgaggtgttcagcatgaccgcagtctcagagaagcagccggagaagttgaggcaaaccccggggtgttgtagggccgaatgcatgcagagctctagattcacaaacttcgttgactgcgaagaaagtaatagtgagtccgaggaagaagtgggaatcccggcctcgctgcagggagatctaggaagcgttctccatttacaaaaggctgatggcgatgtgccccaatgggaggtgttctttaagagaaacgacgagataaccgacgagtctcttgagaacttcccgtccagtaccgtcgccggcggaagtcagagtcccaagctgttctcagacagcgacggagaatctacacatataagctcgcaaaactcttctcagtccacccacattacagagcaaggctcacaaggctgggacagccagtccgacactgtcctgctctcttctcaggaaaggaactccggagatataacatccttagacaaggccgattacaggcccaccattaaagaaaacatcccggccagcctgatggaacaaaatgtcatttgtccaaaagatacctactcagacctgaagagcagggataaggacgtcactatcgtgccatccacaggagagcccacaaccctgagctcggaaacgcatattccggaggaaaagtcacttctcaacctaagtacgaacgcggacagtcagtcaagctctgacttcgaagtccctagcacccctgaagcggagcttcccaaacgcgagcacctacaatatctctacgaaaaactagcaacaggcgagtcgattgcagtaaaaaagcgcaagtgctccctgctggacacatag

SEQ ID NO: 23904 - DNA, 1719 bp, Artificial Sequence
  Description of Artificial Sequence: Synthetic coding sequence
atgttcctgttccagggcaacaacggcaccgtgctgtacaccggcgattttcggttggcacagggcgaggccgcaaggatggagctgctgcactccggcggacgcgtgaaagatattcaaagcgtctacctggacaccacattttgcgaccctcggttttaccagattccatcgagggaagaatgtctatctggggtattagagctggtacgctcctggatcacccgtagcccgtaccacgtggtttggctgaattgcaaggccgcctacggttacgaatatctctttaccaacctttctgaagagctgggtgttcaggtccatgtcaacaagctggatatgtttagaaatatgcccgagatcctgcaccaccttaccactgacagaaatacccagattcacgcatgccgccatcctaaggctgaggagtacttccagtggtccaagctgccatgcggaattacctcacggaatcgaattcctttgcacataatctccattaaacctagcactatgtggtttggggaaaggagccgaaagactaatgttattgtgcgcaccggcgaatcttcttatcgtgcctgcttcagttttcacagctcttattccgagataaaggacttcctgtcttacctgtgcccggtgaacgcttatcccaacgttatacctgttggaacaactatggataaagtggtggagatcctgaagccattgtgcaggagttcacagtcaacggagcccaagtacaagcccctgggtaagctgaagcgcgctcggaccgttcatcgtgactccgaggaggaggacgactatctgtttgatgatcctttgccaattccgcttcggcataaggtgccttaccccgagaccttccaccccgaagtcttttcgatgactgccgtctcggaaaaacagccagaaaagctaaggcagactccagggtgttgtcgcgcagaatgtatgcagtcttcccgctttacaaacttcgtggactgcgaggaaagcaactccgagtcggaggaggaagtcggcatacccgccagcttgcagggcgacctcgggtccgtgctgcacctccagaaagctgatggagatgtgcctcagtgggaagtctttttcaaacggaacgacgagatcaccgatgagagcctcgagaactttccatcctcgaccgtggcgggaggctcgcaaagcccaaagctgtttagtgacagtgacggagagtcaacacacattagctcacaaaacagctcccagtcaacacacattactgaacagggcagtcaagggtgggactcccagtctgatactgtcctgctctcctcccaggaacggaattccggggatattacaagcctcgataaggctgattacaggcctactatcaaggaaaacataccagccagcctgatggagcagaacgtgatttgtcccaaggatacctacagtgatctcaaaagcagggataaggatgtgaccattgtgccatctaccggagaacctactacactgtcctccgagacccacatcccagaggagaagagcctgctgaacttgtcaacaaatgccgactcccagtcctcttctgatttcgaggtgccctctacccctgaggccgagttaccaaagagagagcatctgcagtacctatatgagaagctggctactggtgaatctattgctgttaaaaagcgtaagtgctctctcctggacacctag

SEQ ID NO: 23905 - DNA, 1719 bp, Artificial Sequence
  Description of Artificial Sequence: Synthetic coding sequence
atgttcctgttccagggcaacaacggcaccgtgctgtacaccggcgattttagactcgcacaaggagaggccgcgaggatggaacttctgcacagcggaggccgcgtgaaggacatacagtccgtttacctagataccacgttctgtgatcccaggttttatcaaataccatctcgagaggagtgtctctccggagtgctggagctagtgcgtagttggattaccaggtcaccttatcatgtagtgtggttaaactgtaaggcagcatatggatatgagtatctgtttacaaatttgagtgaggagttgggggtccaggtccacgtgaacaaactggacatgtttcgtaacatgcctgaaattctccaccacctgacaactgacaggaacactcagattcatgcctgccgacatcccaaggcagaggagtatttccaatggagcaagctgccatgtgggatcacatccaggaacaggattcccctgcatatcatttcaatcaagcccagtaccatgtggtttggcgagcgatctagaaagacaaatgtgatcgtgaggacaggcgaaagcagctacagggcgtgcttcagctttcatagcagttacagcgagatcaaggacttcctgtcttacttatgtcctgtcaatgcttatcccaatgtcatcccagtcggcacaacaatggataaggtggtggagatcttaaaacccttgtgtaggagttcccagagtactgaacccaagtacaagcctctgggcaagcttaaaagggcccgaactgtccaccgcgattccgaagaggaagatgactaccttttcgatgacccgcttcctatcccgcttagacacaaagtgccttaccccgaaacattccatcctgaggttttttccatgacagccgtctctgagaaacaacctgagaagctgaggcagacgccaggctgctgccgcgcagaatgcatgcaatcttctaggttcacgaatttcgttgactgtgaggaatccaatagcgagtcggaggaggaagtgggcatccctgcgagtctacagggtgacctgggctccgttctgcatcttcagaaagccgacggcgatgtgccccagtgggaagtattcttcaagcgcaacgatgagatcacagatgaaagtctagagaactttcctagtagtacagtggccggaggctcccagtctcccaaactgttttcagacagtgacggggagtccacacacatctctagtcagaatagttcacagagcacccacatcaccgaacaagggtcccaagggtgggattctcaatccgatacagtcctattgtcctctcaggagaggaacagcggagatatcacatccctggataaagcggactacagaccgacgatcaaggaaaatatcccagcttcactgatggaacagaacgtgatctgtcccaaagacacatacagcgacctaaaatcaagggataaggacgtgaccattgtcccttccaccggggagcctacaaccctgtcgagtgaaacgcatatcccagaagaaaagagtctcctgaatctatcgacgaatgccgactcacagtcgagctcggacttcgaagttccttccactccagaagccgagctgcccaagcgcgagcacttgcagtatctgtacgagaagctggcaacgggagagtctatagccgtcaaaaagcggaaatgctctctgctggacacttag

SEQ ID NO: 23906 - DNA, 2079 bp, Artificial Sequence
  Description of Artificial Sequence: Synthetic coding sequence
atgagcagcttcgagggccagatggccgagtaccccaccatcagcatcgaccgatttgacagagaaaacctccgggcacgcgcctattttctgtcccattgtcacaaagatcacatgaaaggcttgcgcgcccctacattaaagcgaagactggagtgttctctgaaggtgtatttgtactgttcacccgtcaccaaggagctgctgctgacaagcccgaaatataggttttggaaaaagagaataatttccatcgagattgaaacgccgactcaaatttctcttgtggacgaagcgagcggggaaaaggaggagatcgttgtgactctgctcccagccggccactgcccaggctctgtaatgttcttgtttcaagggaataatggtaccgttttgtataccggggactttagattagcacaaggcgaggctgccaggatggaattgctacactccggtggtagggtgaaggacatacagtccgtgtacctagatacgactttctgcgaccctagattttaccagatcccatccagagaggagtgcctgagtggggtgctcgagctcgtgcgttcatggatcacccggagtccttatcacgtcgtgtggctgaactgtaaagccgcctacggctatgagtacctgtttacaaatctctcggaagaactgggggtgcaagtgcacgtaaataaattggacatgttcagaaacatgcccgaaatattgcaccatctcactaccgaccgaaacacccaaattcatgcctgtagacaccctaaagctgaggagtactttcagtggtccaagcttccgtgcggtataacttcccggaataggatacccctccacatcatcagcattaaaccatcaactatgtggttcggggagagatcccggaagaccaacgtgatcgtgagaacgggggaatcatcctatcgggcctgtttttccttccattcttcttacagtgagatcaaagactttctgtcctatttgtgtcctgtgaacgcctatccaaacgtgatacccgttggcactaccatggacaaggtggtagagatccttaaacccttgtgtcgcagctcgcaaagcacagagccaaaatacaaaccactgggcaagctcaaaagggcccggaccgtgcatcgcgattctgaggaggaggacgactacttgtttgatgatcccctgccaattcccttgcgacacaaggtcccttacccagagacattccatcccgaggtgttctctatgaccgcagtctcagagaagcagccagagaagctgagacagacccccggttgttgcagggcagagtgtatgcagtcaagccgattcaccaatttcgtagactgtgaggagagtaacagcgagtccgaggaggaggtaggcataccagcttctctgcaaggcgacttgggctccgtcttgcacctgcagaaagcagacggagatgtgccacagtgggaggtgttttttaaacggaacgatgaaatcactgatgagtccctggagaacttcccctcttcaacagtggccggcggaagtcagagccccaaactgtttagcgattccgatggtgagtcaacacatatcagttcacagaacagtagtcagtccacccatatcactgagcagggctctcaaggttgggactctcagtctgacactgtcctgctatcttctcaggagaggaatagcggagacatcacatcccttgataaagccgattaccgcccaacaatcaaggagaacattcctgcctccctgatggaacaaaacgttatctgcccaaaggacacgtatagtgatctcaagagccgcgataaggacgtgaccattgtgccttccacgggggagccaacaaccttgtcttccgagacacacatcccagaggaaaaaagcctgctgaacttatccaccaacgccgatagtcagtcttccagcgattttgaggtgccaagcacccccgaggccgagctccccaagcgtgaacacctgcaatatctgtatgaaaaacttgctaccggcgagagtatcgctgtgaaaaagcggaagtgttccttgctcgatacatag

SEQ ID NO: 23907 - DNA, 1305 bp, Artificial Sequence
  Description of Artificial Sequence: Synthetic coding sequence
atgagcagcttcgagggccagatggccgagtaccccaccatcagcatcgatcgcttcgaccgagagaatctgcgagcgcgagcttacttcctctcccactgccataaggatcacatgaaaggtctccgagcacctaccctcaaacgtagactcgagtgcagccttaaggtctacctgtactgtagcccagtgactaaggaactcctcctgacctccccaaaatatagattttggaaaaaacgaattatatcaattgaaattgagacaccgactcagatcagtcttgtagacgaagcgtccggggagaaggaggagatcgtggtgaccctcctgcccgccggccactgtcccggaagcgtcatgttcctttttcaagggaacaacggtacggtactctataccggagattttaggttggcccagggggaggcagctcgcatggagttacttcattccggtggtcgggtcaaggacattcagtcagtctatctcgacacgaccttttgcgacccgagattttatcagatcccttctagagaagagtgcctctcaggcgttctcgaacttgtgcgctcatggatcacccggagtccctatcacgtggtgtggctgaattgcaaggccgcttacggctacgagtacctcttcactaacctgtccgaggaactgggagtgcaagtgcacgtgaataagctggacatgttcaggaacatgcccgaaatcctgcatcaccttactacagaccggaatacccaaatacacgcatgccgacaccccaaggccgaagagtattttcagtggagtaagcttccttgtggcattactagtcgcaatcgcattccactgcatataatcagtatcaaaccctccacaatgtggtttggagagcgctctagaaaaacaaatgttattgttcggaccggcgaatcatcttatagagcatgtttttcttttcatagtagttactctgagatcaaggactttctgtcctacttgtgccctgtgaacgcatatcctaatgtgatccccgttggaacaaccatggacaaggtagtcgagattctcaaaccactgtgtagaagtagccagtccactgagcctaagtataagcctctcggaaaactgaaacgagctcgaaccgttcacagggactccggcagtcactcagtgacccaagctcgcatgcgttggtgccatcacgatagcctgtatccgttaactccagggattaaacgttcgtcctgcctgtccttgttgacatcgtggatcacaggggcatatagacacgcccagttgatgatctag

SEQ ID NO: 23908 - DNA, 1719 bp, Artificial Sequence
  Description of Artificial Sequence: Synthetic coding sequence
atgttcctgttccagggcaacaacggcaccgtgctgtacaccggcgactttaggcttgcacagggcgaagccgccaggatggagctgttgcactcggggggccgggtgaaagatatacagtctgtgtatcttgatacgacgttctgtgaccctaggttctaccagattccaagcagggaggagtgcctatccggtgtcttggaactcgtgcggtcctggattacacgtagcccttaccacgtagtttggttaaattgtaaggctgcctacggctacgagtacctttttactaacctgagtgaggaactgggagtgcaggtccacgtgaataagctggacatgttccgcaacatgccagaaatacttcatcacttgacgaccgataggaacacccagattcacgcctgccgccatcctaaggcagaggaatacttccaatggagcaaattgccatgcggaattacttcacgcaaccgcattcctctccacattatcagcatcaaacccagtacaatgtggtttggcgaaaggtcacggaaaaccaatgttattgtgcggacaggggaatccagctatagggcctgttttagcttccatagctcatactcagagatcaaggacttcctctcttacctttgtcccgtgaacgcttacccgaatgtcatccccgttggcacaactatggacaaagtggtggaaatcctgaagcctctgtgccgaagctcccaatcaaccgaaccaaaatacaaaccactggggaagctgaaacgagctaggactgtccacagggattccgaggaagaagatgattacctgttcgatgatcctctacccatccctcttaggcacaaagtgccctatccagagacatttcatcccgaggtgttctcaatgacagcagtgagcgagaagcagccagagaagctcaggcaaacaccgggatgctgtagagcagagtgtatgcagagctctcgctttactaattttgttgattgtgaagagagcaattcggagagcgaggaggaagtcggcattcccgcatccctccaaggtgacctcggttccgtgctgcatttgcagaaagctgatggcgacgttccgcagtgggaggtttttttcaagcgtaacgatgagattaccgacgagtccttagagaacttcccatcttccacagtcgccggtgggtcccaatcacctaagctgttcagcgactcggatggtgagtctacacacatctctagtcagaattcctcacagagtacacatatcaccgagcaaggcagccaagggtgggatagccagagtgatacagtgctcttgagctctcaggagcggaacagtggggatattacgagtcttgacaaggccgactaccggcctactataaaggaaaacatcccagcctctcttatggagcaaaatgtgatctgtcctaaagacacctactcggacttgaaaagccgggataaagacgtcacaattgtccccagtactggtgagcccacaacactatcttctgagactcacatacccgaggagaagagtctcttgaacctgagcaccaatgctgattcacagtcctctagtgatttcgaggtaccatccacaccggaagccgaattgccaaaaagagaacaccttcagtacctgtatgagaaactggcaacaggcgagtctatcgctgtcaagaagcgaaagtgttctctgctcgatacatag

SEQ ID NO: 23909 - DNA, 354 bp, Artificial Sequence
  Description of Artificial Sequence: Synthetic coding sequence
atggagctgctgcacagcggcggccgggtgaaggacatccagagcgtctatttggatacgacattttgtgacccccgtttttaccagatcccatcacgagaagaatgtctgagcggagttctcgagttagttaggtcatggatcacccgatccccctaccacgtagtgtggttaaattgtaaagccgcctatgggtacgagtacctgttcacaaacctgtctgaggagctaggagttcaggttcatgtcaacaaactggatatgttccgaaatatgcccgaaattctgcatcatctcacgactgatagaaacacacagatccacgcttgcagacaccctaaggcggaggagtag

SEQ ID NO: 23910 - DNA, 1719 bp, Artificial Sequence
  Description of Artificial Sequence: Synthetic coding sequence
atgttcctgttccagggcaacaacggcaccgtgctgtacaccggcgacttccggcttgcccaaggggaggctgctcggatggagctgcttcactctggaggacgtgtcaaggatatccagtctgtctacctggacacaaccttttgcgacccgagattctaccagatcccctctagggaagaatgtctctccggcgtcttagaactggtgcgatcatggatcactcgatcaccgtatcacgtggtctggctcaattgcaaggctgcctacggctacgaatacctgtttaccaatctctcagaggagctcggcgtccaagtccacgtaaataaacttgatatgttcaggaatatgcccgagatccttcaccatctgacaactgataggaatacgcagattcacgcgtgcagacatcccaaggccgaagaatattttcagtggagtaagctgccctgtggaataacctctagaaacagaatacccctgcacatcatctcgattaaacccagcacgatgtggttcggcgagcggagtagaaaaactaacgttattgtgaggactggcgagagtagctatcgtgcctgctttagcttccatagttcatactccgagatcaaggacttcctgtcatacctgtgccctgttaatgcctacccgaatgtcattcccgttggcacaactatggacaaggtggtcgagatcctcaaaccactgtgtagatcaagccagagtaccgagcccaaatacaagccactcggcaaacttaagagagcccggactgtccaccgggatagtgaggaagaggatgattacctgtttgatgaccccctgccaattccactacgccacaaagttccatatcctgagacctttcatccagaggtattttctatgaccgccgtgtccgaaaagcagccagaaaagttgcgacagacaccaggatgttgtcgtgccgaatgcatgcagtcatccagattcacaaattttgtggattgtgaggagagcaactcagagtccgaagaggaggtcgggatacccgctagtctgcagggggatcttggatcagtgcttcacctgcaaaaggccgacggtgatgtgcctcagtgggaagttttctttaagaggaacgacgagatcacagatgaatccttggaaaatttcccctccagcacagtagcagggggcagccagtctccgaagctattcagtgactcagacggagagagcacccatatcagtagtcagaacagctcccagagtacccacataaccgaacagggcagccaggggtgggattctcagagtgataccgtcctgctgagcagtcaggaacggaatagcggtgatatcacttctttagacaaagctgactataggccgacgattaaagaaaatataccagcctctctgatggaacagaatgttatctgcccgaaggacacctactccgacctgaagtcccgggataaagacgttaccattgtaccctcgaccggagaacctacaactctgagcagcgagactcacatcccagaggagaagtccctgctgaacctgtctaccaatgcggactctcagtcctctagcgactttgaggtgccttccactcctgaagccgagttgcccaaaagggagcacctccagtacctgtatgaaaagctcgccactggagagtccatagccgtgaagaagcggaaatgctcactgctggacacttag

SEQ ID NO: 23911 - DNA, 174 bp, Artificial Sequence
  Description of Artificial Sequence: Synthetic coding sequence
atgaagcaccaggagcggttcctgttccagggcaacaacggcaccgtgctctacacaggcgacttccgcctggcccagggcgaagccgcacggatggaactgctccatagtggggggcgcgtcaaggatattcaatccgtgtaccttgacaccacgttctgtgaccctaggtag

SEQ ID NO: 23912 - DNA, 807 bp, Artificial Sequence
  Description of Artificial Sequence: Synthetic coding sequence
atggaggtgaccggcgacgccggcgtgcccgagagcggcgagatccggaccctcaaaccatgcctcctccgtagaaactattctcgcgaacagcacggggtcgccgcctcctgcctggaagatcttagaagcaaagcttgtgatatcctggctattgataaatccctgactccagtgactttagtgctggccgaagatgggaccattgtggatgatgatgactactttctttgtctgccctcaaacactaagttcgtcgccctggctagcaacgagaagtgggcctacaataacagcgacggaggcaccgcctggatctcacaggagagctttgacgtagatgagactgatagtggggccggattaaaatggaagaacgtggccagacagctgaaagaggacctgtcctccatcatcctgctttctgaggaggaccttcagatgttggtcgacgctccttgtagtgatctggcccaagagctgcgacaaagttgcgccaccgtccagaggctgcagcacactctacaacaagtactggaccagagggaagaagtcagacagtctaagcagctgctgcagttataccttcaggccctcgaaaaagaagggagtctgctaagcaagcaggaggagagcaaggccgcattcggagaggaggttgatgcagtcgacacggggatatctagggaaacctcctcagacgtggccctagcttcccacattctcacagccttgagggaaaagcaggcaccggaactgtcactcagcagccaggatctggaggtcggagggaatcaggggcattag

SEQ ID NO: 23913 - DNA, 996 bp, Artificial Sequence
  Description of Artificial Sequence: Synthetic coding sequence
atggaggtgaccggcgacgccggcgtgcccgagagcggcgagatcaggactctgaagccttgcttactgagacgaaactactcaagggagcagcacggcgtcgctgcttcctgcctggaggatctgagaagcaaggcttgtgacatcctggctattgataagagtctcactcctgtgaccctggttctggctgaagatgggactatcgtggatgacgatgattatttcttatgcctgcccagtaacacaaaattcgttgccctggcaagcaatgaaaagtgggcctacaataactctgatggagggactgcatggatctcccaagaaagtttcgatgttgatgaaaccgactccggagcgggcttgaaatggaagaacgtagcaaggcagctaaaagaagacctgtcttccatcattttgctgtccgaggaagacctccagatgcttgttgacgccccatgcagcgatcttgcccaggaactccggcagtcttgtgccacggttcagcgactccagcacacactccagcaggtgctagaccagagagaggaggttaggcagagtaagcagctgcttcagctgtaccttcaggccctggagaaggagggttcactgctttcaaagcaggaggaaagcaaggcagcgttcggcgaagaggtcgacgcggtcgacaccggcatatccagagaaaccagcagcgacgtagcactggcctcccacattctgacggccctgcgagagaagcaggcccctgagctcagcttatcctcccaggatctcgaattggtgacaaaagaggaccccaaagccttggccgtggcactgaactgggacatcaaaaagactgaaaccgtccaggaggcttgtgaaagggagctcgccttgaggctgcagcagacacagagcctgcactccctgcgaagtatttccgctagtaaggcatccccgccgggtgatctgcagaatcctaagagagcgcggcaggaccctacttag

SEQ ID NO: 23914 - DNA, 510 bp, Artificial Sequence
  Description of Artificial Sequence: Synthetic coding sequence
atggccgccgagagcctgcccttcagcttcggcaccctgagcagctgggagcttgaggcctggtacgaagacctacaggaggtactgtcatcagacgagaatggcggtacctacgtgtccccccctggtaatgaggaggaggagtcaaagatttttacgaccctggacccagcttctctggcatggctcaccgaagaggagccagaacctgctgaagtaacatctacttcacagagccctcactcccctgattccagccagagcagccttgcacaggaagaagaagaggaggatcaggggaggacccgcaaaaggaagcagtcagggcatagccccgcgcgcgccgggaaacagcggatgaaggaaaaagagcaggagaacgagagaaaggttgcccagctggctgaagagaacgaaaggctgaaacaagaaattgagagactcacccgagaggtggaggctactcgacgcgccctgattgatcgtatggtaaatctgcatcaagcctag

SEQ ID NO: 23915 - DNA, 510 bp, Artificial Sequence
  Description of Artificial Sequence: Synthetic coding sequence
atggccgccgagagcctgcccttcagcttcggcaccctgagcagctgggagctagaggcatggtacgaggacctacaggaggtcttgtcctccgacgagaatgggggcacttacgtatcaccccccggcaacgaggaggaagagagtaagatattcacaacgctggaccctgcaagtttagcctggctaactgaggaagagcctgagcccgccgaggtcacatcgacaagccagtctccccatagccctgattctagccagtcgtctctggctcaggaggaggaagaggaggatcagggccgaacccgcaaacgtaagcagagcggccactctcccgccagggccgggaagcagagaatgaaggaaaaggagcaggaaaacgaacgcaaggtggcacagctggctgaggaaaatgagagactgaagcaggagatcgagaggctgacacgggaagttgaggcaacaaggcgggccctgatcgacagaatggtaaacctccaccaggcttag

SEQ ID NO: 23916 - DNA, 438 bp, Artificial Sequence
  Description of Artificial Sequence: Synthetic coding sequence
atggagctggtgcccgccaccccccactaccccgccgacgtgctgtttcagacagaccccaccgcagaaatggccgctgagtccctcccattctcctttggcaccttatcgagctgggagctcgaagcgtggtatgaggatctccaagaggtactctcaagcgacgaaaatggaggtacttacgttagtcctccagggaacgaggaagaggaatcaaaaatcttcactacactggaccccgcaagcttagcctggctgaccgaggaagaaccggagcccgctgaggtcacgagcacatcccagtcaccccactcccccgattccagccagtcatctctggcacaggaagaggaggaagaagaccaggggcgtactagaaaaaggaagcagtcaggccactctcccgccagagccggcaagcagcgaatgaaggaatag

SEQ ID NO: 23917 - DNA, 579 bp, Artificial Sequence
  Description of Artificial Sequence: Synthetic coding sequence
atggagctggtgcccgccaccccccactaccccgccgacgtgctgttccagactgatccaacagccgagatggctgccgagagcctgccctttagctttggcaccctcagctcatgggagctggaggcctggtacgaggatcttcaggaggtcctgagttccgacgagaatggcgggacatatgtctcccccccaggaaacgaggaagaagagagcaagatcttcactacattagaccctgcatcactagcctggttgactgaagaagagcccgagcctgccgaggttaccagcactagccaatccccacattctcctgattcctctcagagtagtttggcgcaggaggaggaggaggaggatcagggcagaacacgaaaacggaagcagtctggccattccccggcaagagcgggaaagcagaggatgaaagaaaaagagcaggagaacgagaggaaggttgcccagcttgcagaggaaaacgaaagacttaaacaggagattgaacgactgacccgtgaggtagaggccacacggcgggcactgattgataggatggtcaacctgcatcaagcctag

SEQ ID NO: 23918 - DNA, 579 bp, Artificial Sequence
  Description of Artificial Sequence: Synthetic coding sequence
atggagctggtgcccgccaccccccactaccccgccgacgtgctgttccaaactgacccgacggcagaaatggcggcggagtccctgccattctccttcgggacattgtcttcttgggaactggaggcctggtacgaagacttgcaagaggtcctgagctccgacgaaaacggtggcacgtacgtttctcctccgggtaacgaggaagaggaatccaaaatcttcaccacattagatcccgctagtcttgcctggctgaccgaggaagagcccgagcccgcagaggtcacgagcactagtcaaagccctcacagcccggacagcagccagagctccctggcccaggaagaggaggaagaagatcagggacgtacgcgcaagaggaaacagagcggccacagtcccgcccgcgccggcaaacagcgcatgaaggaaaaagagcaggaaaatgaacgcaaggtggcccagctcgctgaggagaacgaacgcctcaagcaggagattgaaagacttactcgggaggtggaggccactagacgggccttgattgatcgaatggtgaatctgcatcaggcttag

SEQ ID NO: 23919 - DNA, 864 bp, Artificial Sequence
  Description of Artificial Sequence: Synthetic coding sequence
atggccagcctggaggtgagccggagcccccggcggagccggcgggagttggaagttcgatctcctcgacaaaacaagtactcagtgcttctccctacttataatgaaagggaaaacctacctctgattgtctggctgctggtgaagtcattctctgaatctggcataaattatgagatcataatcattgacgacgggagtcctgacggcacgagagacgtggccgagcaactggagaagatatacggctccgatagaatactgcttaggccaagagaaaagaagttgggactgggcaccgcttacattcatggcatgaaacacgccaccggaaattacatcatcataatggacgccgacctctcacaccatcccaaatttattccggagttcatccgcaagcagaaagaaggcaattttgatatcgtgagtggcactcgctataagggcaatggcggagtgtatggctgggatctgaagaggaaaatcatcagcgacggcgttctgccctgctgccccggatggtctctgctgggatccagtgatccagcgatcctggccagctgggactatagtagaggagcaaatttcttgactcagatactactgagacctggcgcaagtgatctcacagggtcatttcgcctttatcgaaaggaagttctggagaaactgatcgaaaaatgtgtgtctaaagggtacgtgttccaaatggaaatgatcgtgcgcgctcgccagttgaactacaccatcggggaagtgcccatctcatttgtcgacagagtgtacggggaatccaagctggggggaaacgaaattgtcagttttttgaagggcctactcactctgtttgcaaccacctag

SEQ ID NO: 23920 - DNA, 768 bp, Artificial Sequence
  Description of Artificial Sequence: Synthetic coding sequence
atggccagcctggaggtgagccggagcccccggcggagccggcgggaattggaggtacgatcccccaggcagaacaaatattccgtgctgcttcccacttataatgagcgggagaatctgccattgatcgtgtggctgcttgtgaaatctttctcggagtccggaatcaactacgaaatcattataatcgacgatgggtcacctgatggtactcgagatgtggcggagcagttggaaaaaatatacgggagcgatcgcattctgctcaggccacgggaaaagaaactcggattgggaaccgcatatatccatggcatgaagcacgctacagggaattacataatcatcatggatgccgatctgagccaccatcctaagttcatccctgaattcatcagcgatggcgtgctgccatgttgccccggatggtcactgctgggctcctctgacccggctatcctcgcatcctgggattactccagaggagccaactttctcactcaaattctgttgcgcccaggcgctagcgatcttaccggatccttccgcttataccggaaagaggtgttggaaaaactcattgaaaagtgtgtgtccaaggggtatgtcttccagatggaaatgattgttagagcacgccagctgaactacaccatcggggaagtgcctataagctttgttgatagagtgtacggcgagtcaaagttgggtggcaacgaaattgttagcttcttgaaagggcttctgacgctctttgcaaccacatag

SEQ ID NO: 23921 - DNA, 888 bp, Artificial Sequence
  Description of Artificial Sequence: Synthetic coding sequence
tgagccagcctggaggtgagccggagcccccggcggagccggcgggagttggaggtgcgatctccacgacaaaataaatactcggttcttcttcctacctacaatgagcgcgaaaacttgccgctgatcgtgtggctccttgttaagagcttttcagaatcagggattaactacgagatcatcatcattgatgatgggagcccggacggaactagagacgtggcagaacagctcgagaagatttacggtagcgatcggattttgttgagaccccgcgagaagaaactcggacttgggactgcctatattcacggaatgaaacacgccacaggtaactatatcattatcatggatgccgatctgtctcaccatcctaaattcatccccgaatttattcggaaacagaaagagggtaacttcgacatcgtgtccggaacacgttacaaggggaatggcggagtctacggttgggatctcaaacgcaagatcatcagcgacggcgtgctcccttgttgtccgggttggagcctacttggtagcagtgatcctgccattctcgcttcctgggattatcgatgtgaacctccgcggttagcatctcggggtgcgaactttcttacgcaaattttgctcagaccaggagccagcgacctaacggggtcattccgcctttatagaaaggaggttcttgagaaattgattgaaaagtgtgtgtctaaaggttatgtcttccagatggagatgatcgttcgggcacgtcagttgaattatactataggggaagtgccaattagttttgttgacagagtatacggagagtccaaacttggaggtaatgaaattgtctctttcctgaaagggctcctgacactctttgctacaacctag

SEQ ID NO: 23922 - DNA, 783 bp, Artificial Sequence
  Description of Artificial Sequence: Synthetic coding sequence
atggccagcctggaggtgagccggagcccccggcggagccggcgggaactggaagtgaggtcccccaggcaaaataagtactccgtactcctacccacttataatgagcgagaaaacttgccactcattgtatggctgctagtaaagtcattttccgagtctggcatcaactacgagatcattatcatcgacgacgggtcccctgatgggactcgcgatgtcgccgaacagctcgaaaaaatctacggcagcgatcgtattcttttaaggccccgggagaagaaactcgggcttggtacagcttatatccatggaatgaaacacgccacggggaactacatcatcatcatggacgctgacctgagccaccaccctaaatttattccagaattcatcagaaagcaaaaggaaggcaatttcgatatcgtgtctggaacccgttataaaggtaatggtggcgtgtacggatgggacctcaaaagaaaaataatctccagaggggccaattttttgacacagatcttgctgcgcccaggtgccagcgacttgaccgggtcatttcgcttgtatcggaaggaggtgttagagaagctaatcgaaaagtgtgtatccaaggggtatgtattccagatggaaatgatcgtccgcgcaagacagctcaactatactatcggcgaggtgcccatatcattcgttgaccgggtgtatggggagagcaaattgggcggcaacgaaattgtctcattcctgaagggccttttaactttgttcgcgaccacttag

SEQ ID NO: 23923 - DNA, 666 bp, Artificial Sequence
  Description of Artificial Sequence: Synthetic coding sequence
atggccagcctggaggtgagccggagcccccggcggagccggcgggaattggaggtcagatcccccagacagaacaaatacagtgtgctcttgcccacatacaacgagcgcgagaatctgccattaattgtatggttgctcgtgaaatctttctcagaatctgggatcaactacgaaattattataattgacgacggctcaccagacggaacccgcgacgtggccgaacagcttgagaagatttatggctcagaccgcattctgttacgaccaagagaaaagaaattggggttggggacggcctacatccacgggatgaaacatgccacaggtaactatatcattattatggacgccgacctgtcccaccacccgaagttcattccagagttcatctctgacggcgtcctaccctgctgtcctggctggtctctgctgggttccagtgatccggctattttggcaagctgggattactcccggggagccaactttttaacgcagattctgctgcggccaggcgcctctgatttaaccggctccttccggctgtaccgcaaagaggtcctggagaagctcatcgagaaatgtgtgagtaagggatacgttttccagatggagatgatcgtcagggcccgccagctcaactacaccatcggggaatag

SEQ ID NO: 23924 - DNA, 888 bp, Artificial Sequence
  Description of Artificial Sequence: Synthetic coding sequence
atggccagcctggaggtgagccggagcccccggcggagccggcgggagctcgaggtgcggtctcctcgccagaacaagtattctgttttgctgccaacctacaatgaacgtgaaaacctaccattgattgtgtggcttctagtgaagagcttcagtgagagcgggatcaattacgaaatcataattattgatgacggcagccccgatggcactcgggacgtggcagaacagctggagaagatatacgggtccgaccggatcctgctccgtccacgtgaaaaaaaattggggcttggcaccgcctatatccatgggatgaaacatgccaccggaaactacatcataattatggacgctgatttatcccaccatcctaagttcatcccagaattcataagaaagcagaaggaggggaactttgatattgttagcggtactagatacaaggggaacggcggcgtgtacggctgggatctcaaacggaaaatcatttcagacggagtgctgccatgctgccctgggtggagtcttctcggtagctctgaccccgccatacttgcatcctgggattatagatgtgaaccccctcgtctggcatctagaggggccaatttcttaactcagatcttactgcgcccgggggcgagcgacctgaccgggtcatttcggctctatagaaaagaggttctggagaagctgatcgagaaatgtgtgtcgaaaggttatgtgtttcagatggaaatgatcgtaagggccaggcagctcaactacacaatcggcgaggtccccatatcattcgtggacagggtgtatggagagtcaaagctgggtgggaatgaaatcgtcagctttctcaagggcctgcttaccttattcgctaccacctag

SEQ ID NO: 23925 - DNA, 1332 bp, Artificial Sequence
  Description of Artificial Sequence: Synthetic coding sequence
atgcggcggcaggtgatggccgccctggtggtgagcggcgccgccgagcagggcgggagagacggccccgggcggggccgtgctccgagaggtagagtggcaaatcaaataccacccgaaatcctcaagaatccacagctgcaagcagcgatccgcgtcttgccaagcaactacaacttcgaaattcccaaaactatttggaggatacaacaagcccaggccaaaaaggtggcactgcagatgcccgaaggtctgctgttattcgcgtgtacaatcgttgatatcctggaacgctttactgaagctgaagtgatggttatgggcgacgttacatatggggcctgctgcgtagacgactttaccgcgagagctttgggcgctgacttccttgttcactatggccacagctgcctcatccccatggatacaagcgcacaggactttcgggtgctttacgtgttcgtggatatccgtattgacactacacacctgctcgattcacttcgcctgacattcccacccgcaactgcacttgctcttgtctcaactatacagttcgtatctacactacaggcagctgcacaggaacttaaagctgagtatagggtgtcagttccacagtgcaaacctctgtctccaggggagatcctggggtgcacctccccgaggctttccaaggaagttgaggcagtggtgtacctgggagatggaaggttccacctagagtcagtaatgattgccaatcccaacgtgcctgcctatcggtacgacccctactcaaaggtgttgagccgggagcactatgatcaccaaagaatgcaggccgcacgacaagaagcgatagcgaccgcacggtctgccaaaagctggggcctcatcttgggcacactggggcgccagggctcaccaaaaatccttgaacacttagaaagccgactgcgagccctgggtctgagctttgtcaggttgctcctaagcgagatattccctagcaagctgagcctccttcctgaagtggacgtttgggtccaagttgcatgcccgagactcagcattgattggggcacagcctttcccaaacccctgctgacaccctatgaggcagcggtggcactgcgtgacatctcatggcagcagccctatcccatggatttttacgcaggatcgagtctgggcccatggacagtcaaccacggtcaagatcggcgaccacacgctccgggcagacccgcacgggggaaggtccaggagggcagcgctcgacctccgtccgctgtggcttgcgaagattgttcctgcagagacgaaaaggtcgcaccactcgccccttag

SEQ ID NO: 23926 - DNA, 1146 bp, Artificial Sequence
  Description of Artificial Sequence: Synthetic coding sequence
atgatcgacaccctgcggcccgtgcccttcgccagcgagatggccatttctaagaccgtcgcatggctaaacgagcaacttgagttaggaaatgagcggcttctcctgatggactgtagaccccaggaactgtacgaaagttcccatatcgaatctgcaattaatgtggctattccagggatcatgctgcgccgccttcagaagggcaacttgcctgtacgggcactattcacccgaggagaggatagggaccggttcacaagacggtgcggcacggacaccgttgttttgtacgatgaatcctccagtgattggaacgagaacactgggggcgagagtgttctgggtctgctgctgaagaagctgaaagatgaggggtgtagagctttttacttggaggggggtttctctaagttccaggccgagttctccctgcactgcgaaacaaacctcgatggctcttgctcctcttcctctcctccactcccagtcctggggcttggcggtcttaggattagttctgactcatcctccgacatcgagagcgatctggacagagaccctaattccgccaccgactctgacggcagccccctgtcaaattctcagcccagctttccagtggaaatcctgccgtttctctatcttggctgcgcaaaggatagtacaaatctggacgtcctggaggagttcggtatcaagtacattctgaatgtgacaccaaacctgcctaatttgtttgagaacgccggcgagtttaaatataagcagatccctatttcagatcattggtcacaaaacctgtcccagttcttccccgaagccataagttttatcgatgaagccaggggcaaaaattgtggggtcctagtgcactgtttagccgggatcagtagatcagtcaccgtcaccgtagcctacctaatgcaaaaactgaacctgtctatgaatgacgcttacgatatcgtgaagatgaagaaatcgaacattagtccaaacttcaatttcatgggccaactcctggatttcgagcggactttggggctatcctccccatgcgacaaccgggtgcctgcccagcaattgtatttcacaaccccttctaatcaaaatgtttatcaggtggatagcctgcaatcaacctag

SEQ ID NO: 23927 - DNA, 708 bp, Artificial Sequence
  Description of Artificial Sequence: Synthetic coding sequence
atgatcgacaccctgcggcccgtgcccttcgccagcgagatggccattagtaaaacagtagcttggctgaacgaacagctggagctcggcaatgagcggctgctgctgatggattgcagaccacaagagctctacgagagctcccatatagagtctgccatcaacgtggctattccaggtatcatgcttaggcgcctgcagaagggtaacctacccgtcagggctctgtttacaagaggagaagatagagaccgatttacaagacgatgcggaacggatacagttgttctgtatgatgagagttctagcgattggaatgaaaacaccggcggggaaagcgtcctgggcctgctccttaagaaattgaaggacgagggctgccgggcattctatctggaagatgaagctcgcggaaagaattgtggcgtgcttgtacactgcctggctgggatcagccgttctgtgaccgttactgtggcctacctgatgcagaagttgaacttgagcatgaacgatgcttacgacattgttaaaatgaaaaaaagtaatatctcccccaatttcaatttcatgggacagctgttggatttcgagcgcaccctcgggctctccagtccatgcgataaccgcgtccccgcccagcagctatactttaccaccccaagtaatcagaacgtttatcaggtggacagtctccaatctacctag

SEQ ID NO: 23928 - DNA, 354 bp, Artificial Sequence
  Description of Artificial Sequence: Synthetic coding sequence
atgatcgacaccctgcggcccgtgcccttcgccagcgagatggccatctccaagaccgtggcttggctcaacgaacagctcgaactggggaatgagcggctgctgctcatggattgtcgtccgcaggagctctatgaaagtagccatattgagagcgccattaacgtggcgatccccggcatcatgctgcgccgattgcagaaaggaaatttgccagttagagctctgtttaccaggggtgaggatcgagaccggtttacccgtcgatgcgggaccgacaccgtggtactctatgacgagagtagttccgactggaacgaaaatacaggcggagagtcggtgctcggcttgtag

SEQ ID NO: 23929 - DNA, 1545 bp, Artificial Sequence
  Description of Artificial Sequence: Synthetic coding sequence
atggccgacgccgaggtgatcatcctgcccaagaagcacaagaagaagaaggagaggaagtctctaccagaggaggacgtggctgagattcagcacgctgaagagttcctgatcaaacccgagtcaaaggtcgccaaactggatactagccagtggccactcctactcaaaaacttcgataagctgaatgtaagaactacccactatacccccctggcctgtggaagcaatccactcaaacgggaaataggagactacattcgaaccggctttatcaatttagacaagccatcaaacccaagcagccacgaagtcgtggcttggatacgaaggattctcagagtagaaaaaactggacacagtggtaccctggacccgaaggttactggttgcctgattgtgtgcattgagagagcgacacggctcgtgaagtcgcagcagtccgcaggaaaggagtacgtcggcatagtcaggctgcacaacgctattgagggagggacccagttaagcagggccttggaaactctgactggagcactgtttcaacgcccccctctcatcgccgccgtgaagcgccaactaagggtgcgaactatctatgagagcaaaatgatagagtatgatcccgaacgccggttgggtatattctgggtatcttgcgaggcaggtacctacatacgcacgctgtgtgttcatttagggctccttctgggggttggggggcaaatgcaggagcttaggcgggtgaggagtggggtgatgtcagaaaaggatcatatggtgaccatgcatgatgtgcttgatgcccagtggctgtacgacaatcataaagacgaaagctatcttagaagagtcgtgtaccccctggagaagcttttgacctctcataagaggcttgtgatgaaggactctgccgtgaacgccatctgttatggtgccaagatcatgctgccgggtgtgctcaggtacgaagacggtatcgaagtcaaccaggagatcgtggtaatcaccacaaagggtgaagcaatatgtatggctattgctctgatgacgaccgcagtgatctccacctgcgaccatggcatcgtcgccaaaattaagcgtgtaatcatggagcgggacacttacccccgaaagtggggcctgggcccaaaggcatcccagaagaaactgatgataaaacagggcctgctggataaacatgggaaacctactgattctacccctgccacctggaagcaggagtacgtagattattccgaatcagccaaaaaggaagtggttgccgaggttgttaaagcgccccaagtcgtggccgaggccgccaaaacagccaagcgcaagcgtgagagcgagtctgaaagcgatgaaacaccacctgccgcaccgcagctgattaagaaggagaaaaagaagtctaagaaggataaaaaggcaaaggctggtctggagagcggtgcagagcctggagacggggatagtgataccacaaaaaaaaagaagaaaaagaaaaaggcgaaggaggttgagttagtgagtgaatag

SEQ ID NO: 23930 - DNA, 7245 bp, Artificial Sequence
  Description of Artificial Sequence: Synthetic coding sequence
atggccgagaacgtggtggagcccggcccccccagcgccaagcggcccaagttgtccagccccgccctctctgcttctgcaagcgatggcaccgatttcggctccctgttcgatctcgagcacgacttgccagatgaacttataaacagcaccgaacttgggttgaccaatggcggcgacattaaccagcttcaaacctctctggggatggtgcaggatgccgcctcaaagcacaagcagttgtccgagttgttgcgaagtggaagtagtcccaatctgaacatgggagtggggggccccggccaggtcatggcgtcccaggctcagcaaagctcacccggcctgggccttattaattccatggtgaagagccccatgactcaagccgggctgacatctccaaatatgggcatgggcacaagcgggcccaaccaaggtcctactcagtctacgggaatgatgaatagccctgtgaatcagcctgcaatgggcatgaatacaggtatgaatgccggaatgaaccccgggatgctggccgcaggaaatggacaggggataatgccaaaccaggtcatgaatgggtccatcggagccgggcgcggcaggcagaatatgcagtacccaaatcccggaatggggtccgcaggcaacctgctaaccgagccgctccagcagggctctccccagatggggggccaaacgggcttgcggggccctcagccactgaagatggggatgatgaataatcctaatccatatggaagtccatatactcagaatcctgggcagcagattggcgcaagtggtctgggtttacagatccaaactaaaacagtgctgagcaacaacttgagcccttttgccatggataagaaagccgtgcccggaggggggatgccaaacatgggacagcaaccagcaccacaggtgcagcaacccggcttggtaaccccagtggcacaagggatgggttccggggcccatacagcagaccccgaaaagagaaagcttatccaacagcagttagtactgttattgcacgcccacaagtgccagcggcgcgagcaggctaacggggaggtgcggcagtgtaatctgccacactgtagaaccatgaagaatgtgcttaaccacatgactcactgccagagcgggaaaagttgtcaggtggcacattgtgcgagtagcagacagattatctctcattggaagaactgcaccaggcatgattgcccagtctgtctgcctctcaagaacgctggagataaacggaatcagcagcccattctgactggtgcgccagtgggtctgggtaatccaagcagcctgggcgtgggccaacaatccgcacctaatttgagtacagtatctcagatagaccctagctcaattgagcgcgcatacgccgctctgggcttaccgtaccaagttaatcagatgccaacgcaaccgcaggtgcaggccaagaatcagcagaatcagcagccgggacagtcccctcagggaatgaggccaatgtcaaatatgtccgcgagtccaatgggcgtgaatggcggcgtcggcgtacagaccccaagcctattaagcgatagcatgctccactccgccattaatagtcagaatcctatgatgtctgaaaacgccagtgtgccttcacttggcccaatgcctaccgctgcacagcctagtaccacggggattcgtaagcagtggcatgaggatattactcaggatctacggaaccacctggtgcataagctcgttcaggcaatattcccaacacccgatcccgccgccctcaaggatagaagaatggaaaacttagtggcttacgcccgcaaagtggagggggatatgtacgagtccgccaataaccgcgccgagtattatcaccttctcgcagagaaaatatacaaaatccagaaggagctggaggaaaagagaaggacccgacttcagaaacaaaacatgcttcccaacgccgcggggatggtcccagttagcatgaaccctggccctaatatgggacaacctcagcccggtatgacttcaaatggcccactgcctgatccctcaatgattcgtgggagcgtacccaatcagatgatgccccggatcaccccccagtccggcttaaatcaattcggacaaatgtccatggctcagccaccaattgtacccaggcagacacctccccttcagcatcacggtcagcttgctcagcccggagcgctcaacccgccaatgggctacggtccacgcatgcagcagccttctaaccagggtcaatttcttccccagacccagtttccatctcagggcatgaatgtgacaaatatacctttggccccgtcctctgggcaggccccagttagccaggcacaaatgagcagttcttcttgtcctgtaaatagccccatcatgcctcctggatcccaggggtcccacatccactgccctcaacttccacagccagccttacaccaaaattcaccctctccagtgccctctcgaacacccacacctcaccacactcctcccagtatcggggctcagcaaccccccgctacaaccatccctgcccctgtccctaccccaccggccatgccacctgggccccaaagtcaagcattacacccccctcccaggcagaccccgacacctcctacaacacagctgccccagcaggtgcagcctagcctccctgccgccccttccgcagatcagccacagcaacagccaaggagtcagcagagtaccgcggcgagcgtgcccaccccgacagccccactgttgccaccccagcctgctacacctctctcccaaccggctgtttctattgaaggtcaggtgagcaatcctccctctacatcatctacggaagttaattctcaggcaatcgcagaaaaacagccgtcgcaggaggtgaagatggaggctaaaatggaagtggatcagccggagccagccgacacccagcccgaagatatctctgagtctaaggtcgaagattgtaagatggagagcaccgaaactgaagagcggtcaacagagctgaagacagagattaaggaggaggaagatcaacctagcaccagtgcgactcaatccagccctgcgcctggccaaagcaaaaagaagatcttcaaacccgaggagctccggcaggcccttatgcctacactggaggccctttaccgccaggaccccgagtctctcccctttagacagccggtggacccacagctgctcgggattcctgactacttcgacatcgtcaaaagccccatggatctgtccacaataaagaggaaactggacacaggccagtaccaagagccatggcagtacgtagatgatatctggctcatgtttaacaacgcgtggttatataatcggaaaacctctagagtttacaagtactgctccaagctcagtgaggtttttgagcaggagattgaccctgtgatgcagtctctaggatactgttgtgggcgtaagctcgagttttctccccaaacactgtgttgttatggtaagcagctttgcaccattccaagagatgcgacatattactcttaccaaaacaggtaccatttttgcgaaaagtgttttaatgagatccagggagagtcggtaagcctgggcgatgatccgtcccagcctcaaactacaataaataaggaacagttcagcaagcggaagaacgacacactggatccagaattgttcgtggagtgcaccgagtgtggcagaaagatgcaccagatttgtgtgcttcaccacgagataatttggcccgcaggttttgtgtgcgatggatgtttgaaaaaaagcgcccggacccgaaaggaaaacaagttttctgcaaagcgactacccagtacccgactcggcacattcttagaaaacagggtcaacgatttcttgcgtaggcagaaccacccagagtcaggcgaggtcaccgtcagggtcgtgcatgccagcgacaaaaccgtggaagttaagccgggcatgaaggctcgatttgtggacagcggcgagatggccgaatcgttcccttataggacaaaggcgctcttcgcctttgaagaaattgacggcgtggacctctgctttttcggaatgcatgtccaggaatacgggagcgactgcccgcccccaaatcaacgtagagtgtatatctcctacctcgattcagtgcatttttttaggcctaaatgcctgcgcaccgccgtgtaccacgaaatactgattggataccttgaatatgttaagaagctgggatacactactggtcacatttgggcctgtccacccagcgagggcgatgactatattttccattgtcaccctccagaccagaaaattcctaagccgaagcgactccaggagtggtataagaaaatgttagacaaagcagtatccgaacgcatcgtgcacgattataaagatatctttaagcaagccactgaggatcgcctaacctcagccaaagaactcccttattttgaaggggatttttggcccaacgtgttagaggagagtatcaaagagctggaacaggaagaagaagagagaaaaagagaagaaaatacaagcaacgaatctactgatgtgaccaaaggcgatagcaagaacgctaagaaaaaaaataacaagaagaccagcaaaaacaagtcctccctgtcaagggggaataagaaaaaacccggaatgccgaatgtatctaacgatctaagccaaaagctctatgctaccatggaaaagcataaagaggtctttttcgtaattagactgatcgcaggccctgccgcaaatagcctgccgcctattgtggatcctgaccctttgatcccctgcgacttgatggacggccgggacgcttttctgacactggcacgagataagcatcttgagttcagttctctgagaagagctcagtggagtaccatgtgtatgctggtggaacttcacactcaaagccaggaccgctttgtctacacatgcaatgaatgcaaacaccatgtggaaacacgttggcattgtaccgtgtgtgaggattatgacttgtgcatcacctgttataacaccaagaatcatgatcacaaaatggaaaagctgggactgggattagacgacgaatccaacaatcagcaggcagccgctacccagagtcctggggactcccggaggctctcaatccagcgatgtattcagtccttagtccatgcttgccagtgtaggaacgcaaactgcagcctccccagctgccagaaaatgaagcgagtagtacagcacacgaaaggctgcaagcggaaaactaacgggggatgccccatctgtaaacagcttattgccctgtgttgctaccatgctaaacactgtcaggaaaacaagtgtcccgtccccttttgtctgaatatcaaacaaaagctgcgtcagcagcagctccaacaccgcctgcagcaggcacagatgttgcggcgtcggatggcatccatgcagcggaccggtgtggtcggccagcagcaggggctgccctctcccacacccgccacccctacaaccccaactggtcagcagcctactacaccccaaacaccacaacctacttcgcaacctcagcccactcccccaaacagcatgccaccatatctgccccggactcaggcggctggccctgtgtcccagggcaaggcagcaggtcaagttaccccgcctacccctcctcaaactgctcaaccaccccttccggggccacctcctgcagctgtggagatggccatgcaaattcaacgagccgccgagacacagaggcagatggcccacgttcaaatcttccagcggccaatacagcaccagatgcccccgatgacacctatggccccaatggggatgaatcccccaccaatgacccggggccctagtggacatctagaacccgggatgggtcccactggtatgcaacagcagcctccatggtcacagggcggactgccgcagccgcagcagttgcagtccggaatgccccggcccgcaatgatgtctgtagcacagcatggccagccacttaatatggcgcctcagcctggtctgggacaggtgggtattagtcccctgaagcctggaactgtgtcgcagcaagctctccaaaacctgctgcggactctgcgatcaccctctagtccacttcagcagcagcaagtcctgtctattctccatgctaaccctcagctcttagcagctttcataaaacaaagggctgcaaaatacgctaactcaaacccccagcctatccccggccaacccggaatgccacaggggcagccaggcctgcagcccccgacaatgcctggccagcagggtgtgcattcaaacccagcaatgcaaaacatgaacccaatgcaagcaggtgtgcaaagggccggtctgccacagcagcagccgcagcagcagctgcagcccccaatgggcggcatgagtccacaagcccagcagatgaatatgaatcataacacaatgccatcccagttcagagatatactgcgcagacagcagatgatgcagcagcagcagcagcagggcgcaggccctggaattgggcctggcatggccaaccacaatcaattccaacagccccaaggagtgggatatccacctcagcagcaacagagaatgcagcatcatatgcagcagatgcaacagggcaatatgggccaaatcggacagctgccacaggcactgggggccgaggcgggggcgtccctgcaggcctatcagcaacgtctgctgcagcaacagatgggttcccccgtgcaaccgaaccccatgtctccacaacagcacatgctgcccaatcaggcgcagtcccctcatctgcagggccagcaaataccaaactcactctccaatcaggtgcggtctccccagccggtgcccagtcccagaccacagtcccaaccgccgcacagttcccctagccctcggatgcagccccagccttcaccgcatcatgtctctcctcagacgagttccccccatcccggtcttgtggccgcccaggcaaatcctatggaacaggggcacttcgcctccccggatcagaacagcatgctttctcagctcgcttctaaccccggtatggccaacctgcacggcgcatctgctaccgatctgggcctttctacagacaatagcgatctgaacagtaacctgagccaatccacactggacatccactag

SEQ ID NO: 23931 - DNA, 1314 bp, Artificial Sequence
  Description of Artificial Sequence: Synthetic coding sequence
atggccctggccggcgcccccgccggcggcccctgcgcccccgccctggaagcactgctaggggccggagccctgagactgctggatagcagccagattgtaatcattagcgccgcccaggatgctagcgccccccccgcgcctactggtccagctgcccccgctgcaggaccgtgtgatcccgacctgttgctgtttgctacaccacaggcccctaggccaactccttctgctccacgacctgcgctggggcggccacccgtcaagaggaggctggacctagagactgatcatcagtacctcgctgagtcgagcggcccagcaaggggaagggggagacaccccgggaaaggtgtcaaatctccaggggagaaatcccggtacgagaccagcttgaacttaaccaccaagcggtttcttgagctgttaagtcattcagctgatggagttgtggacttgaactgggccgcggaggtcctgaaagtgcagaaaaggagaatctatgatattactaacgtgctggagggtattcaactgatagcaaaaaaatcgaaaaatcatattcagtggcttggcagccacacaacggtgggcgtgggcggcagactggagggtctgactcaggatctgcggcagctacaggagtctgagcagcagctggatcacctgatgaacatatgcactactcagctgaggttactgagtgaggataccgattcccagagactggcttacgttacctgccaagatttaaggtccatcgccgacccagccgaacagatggtaatggttattaaggctccgccagagactcagttgcaggccgtagattcaagtgagaattttcagattagcctgaagtccaagcagggacccatagatgtgttcttatgcccagaggagacagttggcggtatctcgccaggtaaaacaccaagtcaggaggttaccagcgaagaggaaaaccgcgccactgattccgcaaccatcgtaagtcctccgccaagttcccctccgtcttccctaacaacagacccgtctcagtcattgctcagcttggagcaggaacctctgctgtctaggatggggtcacttcgggcccctgtcgatgaggacaggctgagtccacttgttgccgccgactctctcttagaacatgtcagggaagacttcagcgggttgttgcctgaagagtttatctcgctctctccccctcacgaagctttagactatcacttcggattggaagagggcgaggggattagagatctgttcgactgcgatttcggggatctgacccccctggatttctag

SEQ ID NO: 23932 - DNA, 1242 bp, Artificial Sequence
  Description of Artificial Sequence: Synthetic coding sequence
atggccgaggccggcccccaggccccccccccccccggcaccccctcacggcacgagaagagcttgggtctgttgaccaccaaatttgtgtctttgttgcaagaggccaaagatggcgtcctggatctgaagttggcagccgacactttggccgtacgtcagaagcgccgtatttacgacattaccaatgttctcgaaggcatcgggctcatagaaaagaagtctaaaaatagcatccagtggaagggggtgggccctggctgtaatacccgggagattgctgacaagctgatagaattgaaggccgagatcgaagagttgcagcagagagagcaggagctggatcagcataaggtctgggtgcagcagagtattcgtaacgtgactgaggacgtgcaaaacagttgccttgcctatgtcacacatgaggacatttgccgctgctttgccggtgatacactgctcgctattcgcgccccctcagggacctccctagaagtgccaatcccagagggactgaatggtcagaaaaaatatcagatccatctcaagtcagtctccggaccaattgaggtgctgctggtgaacaaagaggcatggtcaagtcctccagtcgccgtgcccgttccgccgcccgaggatttactgcagagcccctcggccgtgagtacccccccccctctccccaagcctgctctggcccagtcacaggaggccagccggcccaacagcccccagctgacacctaccgccgttcccgggtccgccgaggtgcaaggcatggcggggcctgctgcagagattaccgtctctggaggccccgggaccgacagcaaagactccggcgaactcagttccctgccgctgggccccactacgcttgacaccaggcccttgcaatccagcgccctcctcgacagctcaagctcctctagctctagttcttcctcttccagtaactccaactcctcgtcctcttctggccccaatcctagcacctccttcgagccgattaaagccgacccgaccggtgtccttgaactgccaaaggaactgtctgaaatattcgaccccacgagagagtgcatgagctcagagctgcttgaggaactgatgtcttctgaggtttttgcaccattacttcgcctgagcccaccacccggcgatcacgactatatctacaaccttgacgagtcagaaggcgtttgcgatctgtttgacgtccctgtattaaatctctag

SEQ ID NO: 23933 - DNA, 1164 bp, Artificial Sequence
  Description of Artificial Sequence: Synthetic coding sequence
atgaccggcaagctggccgagaagctgcccgtgaccatgagcagccttctaaatcaactgcccgacaacttatatcctgaagagatcccatccgctttgaacctcttctcaggcagtagcgatagcgtggtgcactacaaccagatggctacagagaatgttatggacatcggcctgaccaatgagaagcccaatcctgagctgagttatagtgggagcttccaaccagctcctggcaataagaccgttacgtatctgggaaaatttgcctttgactccccaagtaactggtgccaggataacattattagcttgatgagtgcaggtattctgggggtgccgccggcctccggcgctctgtccacgcagaccagtaccgcctctatggtgcaacccccccagggagatgtcgaggcgatgtaccccgccctgccaccatacagcaattgtggcgacctgtactccgaacctgtgagctttcacgatccgcaaggaaaccctggcctggcatactccccacaggattatcagagtgctaaaccagctctggattctaacctcttcccaatgatccctgattataatttgtatcatcaccccaatgacatgggaagcatcccggaacacaagcccttccagggcatggaccctataagagtgaatccacctccaatcactccactggaaacaatcaaggcgtttaaagacaaacagatacatcctggctttggttcacttccccaacctcctctaaccctaaagccgatccgccctaggaagtaccctaaccgccccagcaagacacctctacacgagcgaccccacgcctgtcccgccgaaggctgtgatcggcgcttcagtcggagtgatgaactgacacggcatctcagaatccataccgggcacaagccctttcagtgtagaatttgcatgcgcagttttagtaggtcagatcaccttacgacccacattcgcactcacaccggcgaaaaaccttttgcatgtgagttttgtggccgaaaatttgccagatccgacgagaggaaacggcacgccaagatacacttgaaacagaaggaaaaaaaggccgagaaaggaggtgcccccagtgcctccagcgcccccccagtgtctctggccccagtggtgaccacctgtgcctag

SEQ ID NO: 23934 - DNA, 687 bp, Artificial Sequence
  Description of Artificial Sequence: Synthetic coding sequence
atggacatcggcctgaccaacgagaagcccaaccccgagctgagctacagcgggtcttttcagccggcccctggtaataagacagtgacaatgatccctgattacaatctgtaccaccaccctaatgatatgggatctatcccagaacataagccatttcaggggatggaccccattcgtgtgaatccccctccgataactccgctggagaccattaaggcgttcaaggacaagcagattcaccctggcttcggaagcctcccgcagccccctctaacgctcaaaccaatacgcccaaggaagtaccccaatagaccctccaaaacacctctacatgaaagaccacacgcttgtccagccgaagggtgtgaccggaggttctctcgttcggacgagctaacacgccaccttcggattcacaccggacacaaaccgtttcagtgcagaatttgcatgcgatctttcagccgcagcgatcatttgacaacccacatcaggactcacactggcgagaaaccgtttgcttgcgaattctgcggcagaaaatttgcgcgcagtgatgagcgaaagcggcacgcgaaaattcacctgaagcagaaagagaaaaaagctgagaaaggcggagcacctagcgcaagttccgcccccccagtgtccctcgcacctgtcgtaactacatgtgcctag

SEQ ID NO: 23935 - DNA, 1050 bp, Artificial Sequence
  Description of Artificial Sequence: Synthetic coding sequence
atggagccctgcgccgcctggagcccccggggcggccgggagaacgtgatggacatcgggctgacaaacgagaaaccaaatcccgagctttcatatagtggatcttttcagccagcccctggcaataagactgtgacatacctcggcaaatttgctttcgatagccctagcaattggtgccaggataacattatcagcttaatgtctgctggcatccttggagtgcctccggcttccggcgcattgtccacccaaacgagcacagctagcatggttcaaccgccccagggggatgtggaagccatgtatcctgccctcccaccctactctaattgtggggacctctattctgagccagtctcttttcacgacccgcagggtaaccccggcttggcttacagcccccaggactaccagtctgcaaaaccggccctcgacagtaacttgtttccaatgatcccagactacaacctgtatcaccatcccaatgatatggggtccattcccgagcacaagccctttcagggcatggacccaattagagtcaacccaccaccaattacgcctctcgagacgatcaaggctttcaaggacaagcagatccacccggggtttgggagcttgccacagccaccgttgaccctgaaacccattagacctaggaaatacccaaacaggccaagcaaaactcctttgcatgagcgccctcacgcatgccccgctgaaggatgcgaccgtcggttttcacgttcggacgaactgaccaggcatctccggattcacaccggccacaagcccttccagtgcagaatttgcatgcgttccttctctagatccgatcacctcacaacccatataagaacgcatactggcgagaagccatttgcgtgtgagttctgtggccgaaagttcgctaggagtgacgaaagaaagagacatgctaagatacatttaaagcaaaaggaaaaaaaagccgagaaaggcggcgccccttctgcatctagcgcaccccctgtctcgctggcacccgtggttactacttgcgcctag

SEQ ID NO: 23936 - DNA, 3696 bp, Artificial Sequence
  Description of Artificial Sequence: Synthetic coding sequence
atggccagcgtgtggaagcggctgcagcgggtgggcaagcacgcctctaagtttcagttcgttgcttcctaccaggagcttatggtagaatgtacaaaaaagtggcagcctgacaaactggtcgtcgtttggacgcgccgcagccgcagaaagtcatctaaagcccacagctggcagccaggcatcaaaaacccttaccgcggagtggtggtttggccagttcctgaaaatattgagatcaccgtcaccctctttaaagatccgcatgcagaagaatttgaagacaaggaatggacctttgtgatcgagaatgagagcccttccgggagaaggaaagcactggccactagtagtatcaatatgaagcagtacgccagccccatgcccacccagactgacgtgaagctgaagtttaagccactgtccaagaaagtcgtgtccgctgctttgcagttctcactgagctgtatatttctccgcgagggcaaagccactgacgaagacatgcagagcctggccagcctcatgtccatgaagcaggccgatattggcaacctcgacgactttgaggaggacaatgaggacgatgatgagaaccgggtgaaccaggaggaaaaggccgctaaaattacggaaatcgtgaaccagttaaacgccttgtcctcactggatgaggatcaggatgattgcatcaagcaggcaaatatgagaagtgccaagtccgcttcgtcttccgaggagcttatcaacaagctgaacttcttggacgaagctgagaaggatttggcaacagtcaattctaaccccttcgatgaccccgacgccgccgagctgaacccgtttggcgaccctgactccgaagaaccaatcacagagactgcttctccgagaaagacagaagacagcttctacaacaactcttacaacccctttaaggaagtccagacaccacagtatctaaatccatttgacgagcccgaggcttttgtcacaattaaggactcacctccacaaagtaccaaaaggaaaaatatacgccccgttgatatgagcaagtacctttatgccgactcaagtaagactgaggaggaggagttggacgagtccaatcccttttacgaaccaaagagtacccctcccccgaataacctcgtcaaccccgtgcaagaattggaaacagaacgcagagtaaagcggaaagcacctgccccaccagtgttgtctcctaagaccggcgtgctgaatgaaaatacagtatctgccgggaaagacctttctaccagccccaaaccaagtcctattcctagccccgtattgggacgcaagcctaacgccagtcagagtctcctggtctggtgcaaagaggtcacaaagaactaccgtggcgtgaagattacaaactttacgacatcatggcggaatggcctgtctttttgcgccatccttcaccactttaggcctgatctcatagactacaaaagcctgaacccacaagacattaaagagaacaataagaaagcatatgatggattcgctagtattggaatctctcgcctcctggagccctcagacatggtactgttggccatccctgacaaactaacagtgatgacgtatttataccagatacgcgcccatttctcaggccaggagctgaatgtcgtgcagatcgaagagaattcgtcaaagtccacgtataaggtcgggaattacgaaaccgacacaaactcatctgtggatcaggagaagttctatgccgagctttctgatctcaagagggagcccgaattacagcagcccatctccggcgccgtcgatttcttgtcccaagatgatagcgtgtttgttaacgacagcggcgttggcgagagtgagtctgagcaccagactcctgacgatcatttatcccctagcaccgcctctccttactgccgccggacgaagtccgacacagagcctcaaaaaagtcaacagtcatccggccgcactagcggaagtgacgaccccggaatttgcagcaacacagatagcacccaggcccaggtgctgttggggaagaagcgcctcctgaaggctgagactctggaactgtctgacctgtacgtgagcgacaaaaagaaagatatgtcaccgccttttatctgcgaagaaactgatgagcagaaacttcaaactctggatatcggttccaaccttgagaaggaaaaattagaaaactcccgtagtctggaatgtaggtctgacccagaaagcccgatcaagaagacatccctgagccccaccagcaagcttgggtacagctactctcgagacctggatctcgccaagaagaaacacgcctctttaaggcagactgaatctgatccagacgcagacaggactactcttaaccatgcagatcactcctccaagatcgtccagcatagactgctcagcaggcaggaggagcttaaggaaagagccagggttctgctggagcaggccaggcgagacgccgcactgaaagcaggcaataagcacaacacaaacactgccacccctttctgcaaccgtcagctatcagatcaacaggacgaggaaaggaggcggcaactcagggagagggcccgacaactgatcgcagaggccagatccggagtaaaaatgtcggaactgccatcatatggagagatggccgctgaaaagctcaaggagcgatccaaggcgagcggtgatgagaatgataatatcgagattgacacgaatgaggagatacccgaggggttcgtggttggcgggggtgacgagctgactaacctagaaaacgatctggatacgcctgaacaaaattctaagctggttgacctaaagctgaaaaagctgctcgaggtgcagccccaagtcgcaaactctcctagcagcgcggcccagaaagcagtaactgagagctcagagcaggatatgaaatccgggaccgaagacttacgaacggagcgtctgcaaaaaactacggaacggttccgcaacccggtcgttttcagcaaggattccacagtccgaaaaacacagctacaatcattctctcagtatatcgaaaaccgccccgaaatgaagcgtcagaggagtatccaggaggacaccaagaagggcaatgaagagaaggcagccataaccgagactcagaggaaaccttccgaggacgaggtgctgaacaaggggttcaaggacacaagccagtacgttgtgggggagcttgctgccttggaaaatgagcagaagcagatagacactcgcgccgcactggtcgaaaaaagactgcgctatctgatggacaccggcaggaacaccgaggaggaggaagccatgatgcaggagtggtttatgctggtcaacaagaaaaatgctctcatccgccgaatgaatcagctgtcacttctggagaaggagcacgacctcgagcgcaggtacgagctgctgaatagggaattacgggcgatgctggccatagaggattggcagaagacagaggcacagaagagacgtgaacaactcctgttggacgaattggtggccttggttaacaagcgggatgctcttgtcagggacctggatgcacaggagaagcaggccgaggaggaagacgagcaccttgaaagaacattagaacaaaataaagggaaaatggccaagaaggaggagaaatgcgtactgcagtag

SEQ ID NO: 23937 - DNA, 3591 bp, Artificial Sequence
  Description of Artificial Sequence: Synthetic coding sequence
atggccagcgtgtggaagcggctgcagcgggtgggcaagcacgccagtaagttccaattcgtcgcttcttatcaggaactcatggttgagtgtaccaaaaaatggcagcctgacaaactcgtcgtggtctggactcggagatcccgcaggaaatcaagcaaggcccattcctggcagccaggtattaaaaatccctacagaggcgtggtggtgtggccagtccccgaaaacatcgagataacagtgactctttttaaggaccctcacgctgaggagttcgaggataaagaatggactttcgtcatcgagaacgagtctcccagcggaagaagaaaagctcttgctaccagctctataaacatgaaacagtacgcgtcacccatgccaactcagaccgacgttaagctgaagttcaagccgctctctaaaaaagtggtttctgcggccttgcagtttagcctcagttgcatattccttcgtgagggtaaggctactgacgaagatatgcagtccttggccagccttatgtcgatgaaacaggccgatattggtaacttggatgacttcgaagaggacaatgaggacgacgatgaaaaccgagtaaaccaggaggagaaagctgcaaaaataaccgaactgatcaataagctcaacttcctggacgaggcggaaaaggatctggccaccgtcaattcgaacccgtttgacgatcccgacgcagccgaactcaacccctttggggacccggattctgaagaacctatcacggaaacggcctccccccgaaaaacagaggatagcttctacaataattcctataatccttttaaggaagtgcagacgccccagtacctaaatcccttcgatgagccagaggccttcgtgacgattaaagattcaccaccccagtcaactaaacgaaagaacattcggcctgttgatatgtcgaagtacctgtacgccgactcctcgaagaccgaggaggaggagttggatgaatctaacccattctacgagcccaagtctacacccccccctaataacctcgttaaccccgtgcaggagcttgagacagaaagacgcgtgaagagaaaagcaccagccccccccgtgctatctcctaaaacaggggtcctgaatgaaaataccgtatccgcgggcaaagatttgtctaccagcccgaagccctctccgattcctagtcctgtcctgggtaggaaacctaatgccagccaaagtttgctggtttggtgcaaagaggtaacaaaaaactatagaggcgtgaaaatcacaaactttacgacaagttggaggaatggcttgagcttttgcgcaatccttcaccattttcggccggatctcatcgactataaatcactgaaccctcaggacatcaaggagaataataagaaagcctacgacggatttgcctcgattggtatcagtagattacttgagccatccgacatggtgttgctcgccatcccagacaaattaacagtgatgacatacctgtatcagattagggcccactttagcggacaggagttgaacgttgtgcagatcgaagagaactcttctaaatcaacatacaaggtcggcaactacgagaccgataccaatagctccgtcgaccaggagaaattttacgcggagctctccgacctgaaacgggagcctgaactccagcagccgatctctggtgcagtcgacttcctctcccaggacgattccgtgttcgtgaacgatagtggcgtgggagaatccgagagtgaacaccaaactccagacgatcacctgtccccctccactgcttctccatattgccggaggacaaagtccgacaccgaaccccagaagagccagcagtctagcgggcgcactagcggaagcgacgaccccggcatctgttcaaatacagattctacacaagcccaggtgttgctggggaaaaagcgcttgctgaaggccgagaccctggagctttctgacctgtatgtttccgacaaaaaaaaagacatgagccccccttttatatgcgaggagacggatgagcagaaattacagaccctcgacatcggctctaatctggagaaagaaaaactcgagaatagccgctcgttagagtgccggtcagaccccgaaagcccaattaagaagacgtccctctcacccacttctaaactggggtactcttactctcgcgatttagacctggccaagaaaaagcacgcttccttgcgccagacagagagcgatccagacgctgataggaccacattgaatcacgcagatcacagtagcaagattgtacagcatcgactgctttccaggcaggaagagttgaaggagagagctagagtcctgttggaacaggctcgcagagacgcagcactgaaagccgggaataagcacaacactaataccgccacacccttttgtaacaggcagctaagcgaccagcaggatgaagaacgaaggagacagctgcgagaacgggcccgccagttaatcgccgaagccaggagtggggtgaagatgtctgagcttcctagctatggtgaaatggccgctgagaagttgaaagagagatccaaagcaagcggcgacgaaaatgataacattgagatcgacacaaacgaggaaattcctgaaggttttgttgtggggggaggggacgagctcacaaaccttgagaatgacttggatactcctgaacagaactccaagttggttgatttgaagcttaaaaaactcttggaggtgcaaccacaggttgcaaacagtcctagcagcgcagcccagaaggctgttactgagtcctctgagcaggatatgaagtccggcactgaggacctcagaactgaaaggctgcagaagactaccgaacgttttcgaaaccctgtagtgttttctaaagactccactgtccggaaaacgcaactgcagagctttagccaatatatagagaatcgaccagaaatgaagcgccaaagatccatccaggaagacactaaaaaagggaacgaagagaaagcagccatcactgagacacagcgaaaaccgtcagaagacgaggtgttgaacaagggtttcaaagacacctctcaatacgtagtgggcgaactggctgccctggagaacgagcagaaacagatcgatactagggcggcgttagtcgagaagcgtctgagatacttgatggacacagggagaaatacagaggaagaggaagccatgatgcaggagtggtttatgttagtcaacaaaaagaacgctctgattcggcgcatgaaccagctgtccctgcttgagaaagaacacgacctcgaacgtcgttatgaattgctcaatagggagcttcgtgctatgctggctatcgaggactggcaaaagactgaggcacagaaacgcagagaacagctgctactagacgagctggtggcactcgtgaataagagggacgccttggtacgggacctcgatgcacaggagaagcaggcagaagaagaagatgagcacttggagcggacactagaacaaaataaaggaaagatggcaaagaaagaagaaaagtgtgttctgcaatag

SEQ ID NO: 23938 - DNA, 3483 bp, Artificial Sequence
  Description of Artificial Sequence: Synthetic coding sequence
atggccagcgtgtggaagcggctgcagcgggtgggcaagcacgcctctaagtttcagtttgtcgcctcctaccaagaactgatggtggagtgtacaaaaaagtggcagccggataagttggtggtcgtctggacaaggaggtcccgccgcaagagtagcaaagcccactcttggcaacccggcatcaaaaatccctaccgaggggtggtggtgtggccagtgccagaaaatattgaaatcacagttaccttgtttaaagatccacacgccgaggagtttgaagacaaggaatggacttttgtgatcgagaacgagtcgccatccggacgaagaaaggccctggccacctccagcattaacatgaaacagtacgctagtccgatgcccacccagaccgatgtaaagctgaaatttaagccactgtctaagaaggttgtcagcgcagccctccagttttcactatcctgcatcttcctgcgggagggaaaagcgaccgatgaggatatgcaaagtcttgccagcctgatgtcaatgaagcaggcagacatcggcaatctcgatgactttgaggaggataacgaagacgacgatgagaatagggttaatcaggaggagaaggcggctaagatcaccgagctcatcaacaaactcaatttcctggatgaggctgaaaaagacttggccactgtgaattccaaccctttcgacgaccctgacgccgcagaattgaatccattcggcgaccccgacagtgaggaaccaattaccgagacggcctccccccgcaaaaccgaggattcattctataataattcctataacccatttaaagaagtccagactcctcagtatctaaatccctttgacgagccagaggcatttgtgacgatcaaggactccccaccgcagagcactaaacgaaaaaacattagacccgtggatatgagcaaatacctttatgccgattcatctaagacagaggaggaggagctggacgaatcaaatcccttctatgagcctaaatccactccacctcctaacaacctggttaaccctgtccaagagctggagaccgagcgtcgggttaaaaggaaggcacctgcaccacccgtgcttagccctaaaacaggggtcctaaacgagaacactgtttccgctggaaaggatttatcgaccagcccgaaaccaagtccgatcccttcgcctgtgctaggaagaaaacccaacgccagccagagcttattagtttggtgcaaggaagtaaccaagaattacagaggcgtgaagatcactaatttcaccaccagttggcggaacggtctgagcttctgcgccatattgcaccatttccggccagatcttatagactataagagcctgaaccctcaggacattaaagaaaacaataagaaggcctatgatggcttcgcatcgataggtattagccggcttctggagcctagcgatatggtactgctggcaattcctgataagctcactgtgatgacgtacttatatcagattagggcccacttctccggccaggaactgaatgtcgtgcagatcgaggagaactccagcaagtctacgtacaaagtgggaaactatgagactgataccaactcatcagtggaccaagagaaattctatgcggaactttctgacctaaagcgcgagccagagctgcagcagcccatctccggtgctgtggattttttaagccaggatgacagtgtgttcgtgaacgactctggagttggagaaagcgagtctgaacatcagacccccgatgatcacctgagcccgtccacagctagtccctactgcagacgaactaagtccgacacagaacctcagaagagccagcagtcatctggccgcacctctggaagtgacgaccccgggatctgttccaacacagatagcacccaggcacaagtgctgctcggcaaaaagcgacttctgaaggcagagaccctcgaactgtctgacctgtatgtgtcagacaagaagaaggatatgtctccaccttttatttgtgaagaaaccgacgagcagaagttgcagactttagacattggttctaatttggagaaagagaaactggaaaactcacgcagcttagaatgccgcagtgatccagaaagccctatcaagaaaacttccctatccccaaccagtaaactggggtacagctattctagggacctggatctggcaaagaaaaaacatgctagcctacgacagacagagtctgacccagacgcagacaggactacgctcaaccatgcagaccactcctctaagatcgtgcagcatcgactgctttcccgccaggaggaattgaaggaaagggccagagtcttgctcgaacaggcaaggagggacgccgctctgaaggccggcaataagcacaacaccaacaccgccactccattttgtaatagacagttatctgatcagcaggatgaggaacgccgtcggcagctgcgggaacgtgcacggcagctgattgccgaggcccgctctggcgttaagatgtcagagctgccgtcctacggggaaatggcggcagaaaaattaaaagaaaggtcgaaagcatccggggaacagaattctaagctggtcgacctcaagttgaagaagctactggaggtccaaccacaggttgccaatagcccatccagtgccgcccagaaagccgtgacagagtcatccgagcaggacatgaagtctgggaccgaagacctgcgaactgagcggctgcagaaaactacagagagatttcgcaatccagtggtcttcagcaaggatagcactgtgagaaaaacacagctccagtctttctcacagtacattgaaaatcggccagaaatgaagaggcagcgctcaattcaggaagacacaaagaagggaaacgaggagaaagcagcaattacagaaactcagaggaaaccctccgaggacgaagtgctgaacaagggttttaaggacacaagtcagtacgttgttggagagttggcagctctggaaaatgagcagaagcagatcgataccagagccgctttggtggagaagaggctgaggtacctgatggacaccggccgtaacactgaagaggaagaagccatgatgcaggaatggttcatgttggttaataaaaaaaatgctctgataaggcgaatgaaccagctttcccttctggaaaaggagcacgacttggagagacgctacgagcttctgaatcgcgaattaagagccatgctagcaatcgaagactggcagaaaacagaggcccagaaaaggagggaacagctattgcttgacgaactcgttgcgctagtgaataagcgagacgcccttgtgagggaccttgacgcgcaagaaaaacaagccgaagaggaggacgagcacttagagcgaaccctcgaacagaataaggggaaaatggccaaaaaagaggaaaaatgcgtgctgcagtag

SEQ ID NO: 23939 - DNA, 3591 bp, Artificial Sequence
  Description of Artificial Sequence: Synthetic coding sequence
atggccagcgtgtggaagcggctgcagcgggtgggcaagcacgcctcaaaatttcaatttgtcgcatcctaccaggaactgatggtggagtgtactaagaagtggcagcctgataagctcgtcgtggtgtggacccgcagaagcaggcgaaagtcctccaaggcccactcgtggcagccggggatcaaaaacccctaccggggtgtagttgtgtggccagtgccagagaacatagagatcacagtgaccctatttaaggatccacacgcggaagaatttgaagataaagaatggacgttcgtaattgagaacgagtccccatcaggtcgacggaaagctcttgcaacttcctccatcaacatgaagcagtatgccagtccaatgcctacgcagacggacgtcaaactgaaatttaaacccttgtccaaaaaggtggtgagcgcagctttgcagttttccctctcatgtatctttctgagagaaggtaaggcaacagacgaggatatgcagagtcttgcatctctgatgtctatgaagcaggccgacatcgggaacctcgacgactttgaggaggacaatgaagacgatgacgagaatagggtcaaccaggaagaaaaggcagcaaaaatcaccgaactgatcaataaactcaacttcctcgacgaggccgagaaagaccttgccacagtgaattcaaatccttttgacgacccggatgccgcagagcttaacccattcggcgaccccgatagtgaagagcccatcacggaaacggcatccccaaggaaaacagaggactctttttacaataatagctataacccttttaaggaggtgcagacacctcagtatttaaatcccttcgatgagcctgaggcctttgtgaccattaaagacagccctccgcagtcgacaaagaggaagaatataaggcccgtggacatgagcaagtacctttatgcggacagtagtaaaactgaggaggaggagcttgacgagtcgaaccccttctacgagcctaaaagcactcctccaccaaacaaccttgtcaatcctgtgcaggaactggagactgaacgcagagtcaagagaaaagctccagctccccctgtcctgtcccccaagaccggcgttctcaacgagaatacagtgagtgccgggaaggatttgtcaacaagccccaagcccagtccaattccttctccagttcttggccgaaagcccaatgcaagccaatcgctactggtatggtgtaaagaagtcacaaaaaactacagaggcgtcaagataacgaactttaccacatcgtggcggaatggtctttcattctgcgctattctgcatcactttcgccctgacttgatagattacaagtctctcaacccgcaggatataaaggagaacaacaaaaaggcttacgacggtttcgcctccattgggatcagcagattattggagccaagcgatatggttctgttagccatccctgataaacttaccgtgatgacatacctgtaccagatccgggcccacttttctggccaggaactgaacgtggtccaaattgaagagaattcttctaagagcacctataaagtcggcaactatgagactgacacgaattcctctgtggatcaggaaaagttttatgcagaactgtccgaccttaagagagagcccgaactgcaacaacctatcagcggcgcggtggatttcctctcgcaggacgactcagttttcgtgaacgactcgggcgttggggagagcgagtcggagcaccagactcctgatgatcacctaagcccgtctactgccagtccgtactgcaggagaaccaagtcagatacagagccacagaagagtcagcaaagctccggacgcactagtggcagcgacgaccctggtatctgtagcaacacagactcaacacaagctcaagttttattgggtaagaagcgcctcctgaaagcagaaacgctggaactcagcgatctatacgttagcgataaaaagaaagacatgagcccacctttcatctgcgaagagacagatgagcagaaactgcagacacttgatattggctcgaatctagagaaagagaaactcgagaactcccgcagcctcgagtgcagatccgatcctgagagtccaattaaaaagacctctttatcccctacatcgaagttgggttacagctactcgagggacctagatttggctaaaaagaagcatgcttccttacggcagacggaaagcgaccccgatgctgacagaacaacccttaaccatgccgatcacagctcaaaaatcgtgcagcaccggctgctgtctaggcaggaggaactgaaagaacgggcacgggttttactggaacaagccaggagggacgcagcccttaaagccggaaataagcataatactaacactgctacaccattctgcaatagacagctttctgatcagcaggacgaagaaagacgccgccagctgagggagcgggcaaggcaacttatcgccgaggcccgcagcggtgtgaaaatgtccgaactgccatcctatggtgaaatggctgctgagaagttgaaagagagatccaaagcgagtggcgatgagaacgacaatatagaaatagataccaatgaagaaatccccgagggcttcgtggtgggtggcggagatgaacttacaaatttggagaacgacctcgatacacctgaacaaaactctaagctggtggatctcaagctgaagaagctcttagaagtccagcctcaggtggccaactccccttctagtgccgcccagaaagcggtcaccgagtcctctgaacaggatatgaaatcagggactgaggatctgagaaccgagagactgcagaaaacgactgagcgcttccgtaacccagtcgtattcagtaaggactctactgtcaggaagacacagctgcagtctttctcccaatatatcgagaacagacctgaaatgaaacgccaacgaagcatccaggaggatactaagaaggggaatgaagagaaagcggcgatcaccgaaactcagcgcaaacccagtgaagatgaagtcctgaacaagggcttcaaagacacatcacagtatgtagtgggcgagctggcggcactagagaatgaacagaaacagatcgatacccgggctgctcttgtagagaagagattaagatatctgatggacactggtagaaacaccgaggaggaggaagccatgatgcaagaatggtttatgctcgtgaataagaagaacgccctcatcaggcgaatgaaccagcttagccttttggagaaagaacacgacttagagaggcgatacgagctcctgaacagagagctccgtgcgatgctcgcgatagaggattggcagaagacagaggcccaaaagcgacgagagcagctgcttctggacgagctggttgcgctcgtgaacaagagggatgcccttgtcagagatcttgacgctcaggagaagcaggcggaggaggaagacgagcacctggagcgaactctggagcagaataaaggcaagatggccaaaaaggaggagaagtgcgttctgcagtag

SEQ ID NO: 23940 - DNA, 933 bp, Artificial Sequence
  Description of Artificial Sequence: Synthetic coding sequence
atggccagcgtgtggaagcggctgcagcgggtgggcaagcacgccagcaagtttcagtttgtggcctcataccaagagctgatggtggagtgtactaaaaagtggcagcccgacaaactggttgtcgtttggactcgtcgttcccgacgcaagtcctcgaaggcccattcttggcaaccaggcattaaaaacccgtaccgcggggtggtggtctggccagtgccagaaaacatcgaaatcaccgtgacgctgtttaaagatccgcatgcggaggaattcgaggataaggaatggaccttcgtgatcgagaatgaatccccttcagggcgaagaaaggcactggccacgtccagtatcaacatgaagcaatacgcttcaccgatgccgacccagacagatgtgaagttaaagtttaaaccgctgtccaagaaagtggtctccgcagctctgcagttctccctgtcctgtatcttcctccgagaggggaaggccacagacgaggatatgcaatctcttgccagcctcatgtcgatgaaacaggctgacatcggaaacctggacgattttgaggaggataacgaggatgacgacgaaaatagagtcaaccaggaggaaaaggctgccaagataactgagttgatcaataagctgaactttcttgatgaagccgaaaaagacctggcgacagtcaattctaacccctttgatgaccctgacgctgcagagctgaatccgtttggagatcctgactctgaagaaccgataacggaaacagcctctccaaggaagaccgaagatagcttctacaacaacagttacaatccttttaaggaagtacaaacgccacagtaccttaacccattcgatgaaccagaggccttcgtaactattaaggatagcccaccccagtcaaccaaaagaaagaacatatag

SEQ ID NO: 23941 - DNA, 234 bp, Artificial Sequence
  Description of Artificial Sequence: Synthetic coding sequence
atggccagcgtgtggaagcggctgcagcgggtgggcaagcacgcctcaaagtttcaattcgtggctagctatcaagaactgatggtcgagtgtaccaagaagtggcagcctgacaagctggtggtggtgtggacccgacgctcccggcgcaaatcctcaaaggctcattcctggcagcctggcatcaagaacccgtacaggggcgtggtcgtctggcccgtaccagaaaactag

SEQ ID NO: 23942 - DNA, 3483 bp, Artificial Sequence
  Description of Artificial Sequence: Synthetic coding sequence
atggccagcgtgtggaagcggctgcagcgggtgggcaagcacgcctccaagttccaatttgtagcctcgtaccaggagctgatggtggagtgtacaaagaaatggcagcctgacaagctggttgtcgtgtggactcggcgctctcgtcgaaagagtagcaaggcccacagctggcagccggggatcaagaacccctatcggggcgtcgtggtctggcccgtaccagaaaatattgagatcacggttaccctatttaaggatccccacgcagaggagttcgaggataaggagtggacatttgtcatagagaatgagagcccgagcggtcggcgcaaagcgctggctacctcttcaatcaatatgaaacagtatgcttcacctatgcccacacaaactgatgtgaagctgaagtttaagccattatcaaagaaggttgtgagcgccgcattacagttctctcttagctgcatcttcttaagagaggggaaggccacggatgaagatatgcaatctttagcatctctaatgtcaatgaagcaagcagatatcgggaatcttgacgacttcgaagaagataatgaggatgatgatgagaatcgggttaatcaggaggaaaaagcagctaagatcacggagctcatcaataaattgaacttcctcgacgaggcagagaaagatctggccactgtgaacagcaacccttttgacgatccagacgccgcagagctgaacccgtttggggatcctgactctgaggagcccataactgaaacagcttcgcctaggaagacagaggactctttctacaataacagctataaccccttcaaagaggtacagacaccccagtacctaaatcctttcgacgagcctgaggcgttcgtgacgatcaaggattcccccccgcagagcacaaagcgcaagaacatacggcccgtggatatgtcaaagtatctatatgccgacagctccaaaacggaagaagaggagcttgacgagtcaaatcccttttacgaacccaagtccacacccccacccaataacctcgttaacccggttcaggagctagagacggaacgccgtgttaaacgaaaggctcccgctcctcccgtcctttctcccaaaacaggagtcctcaatgagaatactgtaagcgcggggaaggacctgtcaactagcccgaagccttctccaattccttccccggttttgggcagaaaacctaacgcctcccagagcctgcttgtgtggtgtaaggaggttacaaaaaattatcgaggcgtaaaaattactaactttacaactagctggagaaatggcctgtctttttgtgccatccttcaccactttagacctgaccttatcgactataagagcctgaatcctcaggacattaaggagaacaataagaaggcatacgacggcttcgcctctataggcatttcgcgtcttctggagccatcagatatggtgctcctagccataccagacaaactgactgtgatgacctatctctaccagattagggcccattttagcggccaggagttaaacgttgtgcagattgaggagaactcctcaaagtccacctataaagtaggcaactatgagacagacacgaatagctccgttgatcaggagaaattctatgccgaactctctgacctcaaaagagaacctgagctgcagcagccaatcagtggagcggtggactttctttctcaggacgatagcgtattcgtgaatgacagtggcgttggtgaatctgagtccgaacaccagacccccgatgaccacctgtcacctagcaccgccagcccgtactgtcggaggaccaaaagtgatacggaaccacagaagtcccagcaatcctcaggcagaacctcaggctctgacgaccccgggatctgtagcaacacggactccactcaagcacaagtcctattaggaaaaaaaagactgctgaaagcagaaaccctggagctaagtgacctgtacgtttcagacaaaaagaaggatatgtcaccgccatttatctgcgaggagaccgatgaacagaagctgcagaccctggatattggctccaacctggagaaggaaaagcttgaaaactctcgaagcctggagtgccggagcgacccggagtctccaattaagaagacatccttaagtccaacaagcaaattggggtatagttattcccgcgacctggacttagctaagaaaaagcacgcatctctgcggcaaaccgagagtgacccagatgccgaccgcactacactgaatcatgccgaccactcatcgaaaattgtgcagcatcgtttgctgtctagacaagaggagctcaaggagcgtgcacgcgtgctcctagaacaggctcggcgggacgccgcgctaaaggcaggcaataagcacaacacaaacactgctacacccttctgcaacaggcaattgtcagaccagcaggatgaggaaaggcggagacagctgcgggagcgtgccaggcagttaatcgcagaagccagaagcggagtcaagatgtccgagcttccttcttatggagaaatggccgccgaaaagctgaaggagcgttcaaaagcttccggcgagcaaaattcaaagctggtggacctcaaattgaagaagctgttggaagttcagccccaggtggccaatagcccctccagcgcggcgcagaaagccgtcacggaatcctccgaacaggatatgaaaagcggtacagaagatcttagaactgagcgcctgcagaagactaccgagaggttcagaaatcctgtggtcttttcaaaagacagcacagtacggaaaacccaattgcagagcttttctcagtacatcgagaacagaccagagatgaaaaggcagaggagcattcaggaggacacaaagaagggcaacgaggaaaaggccgccattaccgaaacccagaggaaaccttcggaggacgaggtgctcaataaaggcttcaaagatacaagccagtatgtcgtcggcgagcttgctgcgctagagaatgaacaaaagcagatcgatactagggccgccctggtcgaaaagcgcctgagatatttaatggataccggccgcaataccgaggaagaagaagcaatgatgcaggaatggttcatgcttgtgaacaagaaaaacgctcttattcgacggatgaatcagctatcgctactggaaaaggagcacgacttggagcgtagatatgagctgcttaacagagagcttcgggccatgctagccatcgaggattggcaaaaaactgaggcccaaaaaaggcgggaacaactccttctcgatgagttggttgctctggtgaacaagagagatgccctcgttcgggacctcgatgcccaggagaagcaggcagaggaagaggatgagcatctcgaaaggactcttgaacaaaacaagggaaagatggctaagaaggaagagaagtgcgtactgcagtag

SEQ ID NO: 23943 - DNA, 609 bp, Artificial Sequence
  Description of Artificial Sequence: Synthetic coding sequence
atgaagcggcagcggagcatccaggaggacaccaagaagggcaacgaggagaaggcagcaatcaccgagactcagaggaagccttctgaggacgaagtcctgaacaaaggctttaaagacaccagccagtatgtggtcggagaactggccgctctcgagaatgaacagaaacagattgatacccgcgcggcactcgtggagaaacggttacgttatctaatggacacaggccggaacactgaggaagaagaggccatgatgcaggagtggttcatgctggtcaataagaagaatgctctgatcaggagaatgaaccagctgtcactcctcgagaaggagcacgacttggaaagaaggtacgagttgttaaacagggagttgcgtgcaatgctggccattgaagattggcaaaaaactgaggctcagaaaagacgtgaacaattgctcctggatgagctggtcgctctcgtgaacaagcgtgatgccctggtgcgcgatctggacgcccaggagaagcaagcagaggaggaggatgaacatctagaacggaccttggaacaaaacaaagggaagatggccaagaaagaagagaagtgcgtgcttcaatag

SEQ ID NO: 23944 - DNA, 1287 bp, Artificial Sequence
  Description of Artificial Sequence: Synthetic coding sequence
atggaccccagcgtgaccctgtggcagttcctgctgcagctgctgagggaacagggaaacggccatattatctcttggacttctagagacggcggcgagtttaagctcgtggatgctgaagaggtcgctcgcctgtggggccttcgcaaaaataaaaccaatatgaattatgataagctgtctagagctctacggtactactacgataagaatattatccggaaagtgtcggggcagaagtttgtgtacaaattcgtaagttaccccgaagtggcaggctgtagcacagaagactgcccaccacagcctgaggtgtccgtgacttcgaccatgccgaacgtagctcccgccgccatccatgcagcgccaggagacaccgtgtccggcaaaccaggcactccgaagggggccgggatggcaggacccgggggccttgcaaggtcctctcgcaatgaatacatgaggtctggactgtattccactttcacaatccagagcctccaaccacagcccccaccccaccctcggccagcagtcgtcctaccctctgccgccccagcaggggccgccgctcctccatccggatctaggagcacatcaccaagcccactggaggcttgtctggaggccgaggaagcaggactacccctgcaggttatcctgacgccaccggaggctccgaacctgaagtctgaggaactgaacgtcgaacctggcctgggcagggccctcccgccggaggtcaaagtcgagggcccaaaggaagagctggaagtggcaggcgaaagaggtttcgtaccggagactactaaagccgaacctgaagtgccacctcaggagggagtgcctgcccggctgccagctgtggtaatggatactgccggccaggctgggggacatgccgcttcttcccccgaaatctcccaaccccagaagggacgaaaaccccgggacttggagctcccactatccccgtcccttctcggaggacccgggcctgagagaacaccaggatctggatccggatccggtctgcaggcacctggacctgctctaacccccagcttgctacccactcataccctgacacccgtgctgctgacgccatcatcactgcctccttctattcacttctggtctacactgagccccatagcccccaggagcccagcaaagttgagctttcagttcccatccagcggtagcgcccaagttcatatcccgtctatatcggtagacgggctctctactccagttgtactcagccctggtcctcaaaagccatag

SEQ ID NO: 23945 - DNA, 288 bp, Artificial Sequence
  Description of Artificial Sequence: Synthetic coding sequence
atggaccccagcgtgaccctgtggcagttcctgctgcagctgctgagagaacagggaaatggccacatcatcagttggacttcccgcgatgggggggagttcaagttggtcgacgcagaggaagtggctcgcctgtggggattacgcaagaacaagacaaatatgaattacgacaagctgtctcgcgctctgaggtattattacgacaagaacataattcgtaaggtctcagggcagaaatttgtgtacaaatttgtaagttatccggagtcccattgcgcaccatag

SEQ ID NO: 23946 - DNA, 1287 bp, Artificial Sequence
  Description of Artificial Sequence: Synthetic coding sequence
atggaccccagcgtgaccctgtggcagttcctgctgcagctgctgcgggagcaaggaaatggacacatcatcagttggactagcagggacggaggtgaattcaagcttgtcgacgctgaggaggttgcaaggttgtgggggttgcgtaagaacaaaaccaatatgaattatgacaaactgtctagagcactgcgctactattatgataaaaatattatcagaaaggtaagtggccagaagttcgtgtataaatttgtgagctacccagaggtagccggctgtagtacagaagattgccccccacagcccgaagtcagcgttacctcaactatgcctaacgttgccccggctgctatccacgcagccccaggcgacaccgtaagtggaaaaccgggaacccctaaaggcgctggaatggccgggcccggcggcctggcgcgtagcagcaggaatgaatacatgagatcaggcctgtactcaaccttcacaatacagtctttgcagccccaaccacctcctcaccctcggcccgcggtcgtcctcccttcggcagccccggcaggtgctgccgctcctcctagcggctccaggtctacctcaccctcacctctcgaagcatgtctggaggctgaagaggcaggattgcccctacaagtcatccttaccccgcctgaggcccctaatctgaagtccgaagaactgaacgtagagccagggctggggagagccctgccccctgaggttaaggtggagggcccaaaagaggagctggaggttgcaggcgaacgcggatttgtgcctgaaacaacaaaagctgaaccagaggtcccgccccaggagggcgtgccagcccgactacccgctgtagtgatggacacggcagggcaggccgggggtcatgccgcatctagcccggagatctcccaacctcagaagggccgaaaaccaagggacttggagttaccgctctctccaagtctgctggggggtcccggaccagaaagaactccaggctccggctctggctctgggcttcaggcacccgggcccgcactgacaccaagcctacttccgactcatactctaacccccgtcctgttaaccccctcctctctgccaccaagcattcatttctggagcaccctaagccctatcgctcccaggtcgcctgcaaaattatccttccagtttcccagcagcggaagtgcccaggtgcacatccctagcataagcgtcgacggactgtccaccccagttgtactgagccctggccctcaaaaaccatag

SEQ ID NO: 23947 - DNA, 366 bp, Artificial Sequence
  Description of Artificial Sequence: Synthetic coding sequence
atggacaccgccggccaggccggcggccacgccgccagcagccccgaaatctcccagcctcaaaaagggaggaagccccgggatcttgaactccccctgagcccgagccttctgggtggacccggccccgaacggactcctgcgctactccctacacataccctgactccagtgctgcttactccatcttcactccctccctctattcatttctggtccacactctcgccaatcgcgccccgctcacctgcaaagctgtcattccagtttccttcaagtgggagtgcacaggtgcacattccgagcattagcgtggacggattgtctactcctgtcgtgctgtcaccaggacctcagaagccatag

SEQ ID NO: 23948 - DNA, 1713 bp, Artificial Sequence
  Description of Artificial Sequence: Synthetic coding sequence
atgagcgagcagagcatctgccaggcccgggccgccgtgatggtgtacgacgacgccaacaaaaagtgggtccctgcggggggaagcaccggattcagcagagtacacatatatcatcatacaggaaacaacacctttcgcgtagtcggcagaaaaatacaggaccaccaggtcgtgataaactgtgctatccccaagggactaaagtacaaccaggccacccagacttttcaccaatggcgggatgcccgtcaggtgtacggactgaattttggatcaaaagaggacgcaaatgtgtttgccagcgctatgatgcacgcgctggaggtcttaaactcccaggaaaccggtcctacacttccgcgccagaactctcagttgccagctcaggtgcagaacggcccctcgcaggaggaattggagatccagaggcgccaactccaggagcagcagcgccagaaggaattggaacgggaaagactggaacgggagcggatggagcgggagagactggagagggaacgactagagcgagagagactcgagcgggagaggctggagcaagagcagctggagcgcgagcgccaggaacgtgaacgtcaagagcgattggaacgccaggagcgtcttgaaagacaggagcgcctagagcgccaggaaaggttggacagggagcggcaggaacgtcaggaacgagagagactcgagcgcctggagcgagagcgccaagaacgtgagcgacaagagcaactggaaagagaacagctagagtgggaaagggagaggcgcatatcctccgctgcagcacccgccagtgtggagacaccattgaactcagtgctgggcgactcttcagccagcgagccaggactgcaggctgcttcccagccagccgaaaccccaagtcagcaaggcatagtgcttggccctcttgccccccccccccccccgccactgcccccgggaccagcccaggcatcggtggccctcccacccccacccggcccaccaccaccccccccactgccgagcaccggtccccctccccctcccccacctcctccactcccgaaccaggtgccgccccccccacccccccccccggccccccccctccccgcttcggggtttttcctagcctcaatgtcagaggacaaccgcccactaaccggcctcgccgcggccattgccggagcgaaactgcgtaaagtttctagaatggaagacacttccttcccatcaggggggaacgccatcggggtgaattccgcaagcagcaaaaccgacaccggccgcggcaacggacccctcccacttggcgggtctgggctaatggaagaaatgtctgccttgcttgcccgacgccggcgcatcgcagaaaagggctcaacaatcgaaactgaacaaaaagaggataagggtgaagactccgagcccgtgacctcgaaggcttcttcaactagtacccctgaacccacgcgcaagccatgggaacggactaacacgatgaacggcagcaagtctcctgtgatctcccggcccaaatcaactccactgtcccaaccatctgcgaatggagtgcaaaccgagggacttgattatgatcggctgaagcaggacatcctagacgagatgcgcaaagaactgacgaaattaaaagaagagctgattgacgcgattaggcaggaactctctaagagcaataccgcgtag

SEQ ID NO: 23949 - DNA, 1776 bp, Artificial Sequence
  Description of Artificial Sequence: Synthetic coding sequence
atgagcgagcagagcatctgccaggcccgggccgccgtgatggtgtacgacgacgccaataagaagtgggtccccgctggaggatctactggcttttctagagtacacatttaccaccatacgggtaacaacaccttccgggtggtagggcggaagatccaagatcatcaagtggtcattaattgtgccatccctaaggggcttaagtataatcaagccacacagacgtttcaccagtggcgcgacgcccgccaggtgtatggtctcaacttcggttcaaaagaggacgccaatgtgttcgcatccgcgatgatgcatgcacttgaagtgctcaacagccaggagaccggaccaacactcccgaggcaaaatagccagctgccagcccaggtccagaacggccccagccaagaagaactggagatacagcgcagacagctgcaagaacagcaacgacagaaggagctggagcgagagcggctagagcgggagagaatggagcgagaacgcttggaaagggagcgcttggaaagagaaagacttgagcgcgaacgactggaacaagagcaattggagcgggagaggcaagaacgcgagcgccaagaaagacttgagcgtcaggagcggctcgaacggcaggaaaggctggaacgtcaggagcggctggacagagagcggcaggaacggcaggaacgcgagagactggaaagacttgaaagggagcggcaggaaagagaaaggcaggagcagctggagcgcgaacagctagagtgggagcgggagcgcaggatatccagtgctgcagcacccgcatcggtggaaacgccactgaactccgttctgggagattcgagtgcttcggagcctggacttcaggccgcatctcaaccagcggaaaccccatctcaacagggtatcgtgcttggtccacttgcaccccccccaccccccccactgccaccgggccccgctcaagcctcagttgctctgcctccgccacctggacccccgcctccacctccactgccatcaactgggcctccccctccccctcctccccccccgttgccaaaccaggtgcctcccccacccccacctccgcccgcgccccctctcccagccagtggattttttttggcaagcatgtctgaggacaatcgtccacttactgggctagccgcggctattgctggagctaagctgaggaaagtgtcccgtatggaggatacctctttcccttcgggcggaaacgccataggcgttaattccgctagttccaagaccgataccgggcggggcaacggaccgcttcctctgggaggaagtgggctgatggaggagatgagcgctctgctcgctcgccgtagaaggattgccgagaaagggagcactattgagacagagcagaaagaagacaaaggcgaggacagtgagcctgttacaagcaaggcctcttcgactagtacgccggagcctacgcgcaaaccctgggagaggacaaacaccatgaacgggagtaagtccccggtgatttctagacgcgattctccaagaaagaaccagattgtgttcgacaataggagctacgacagcctgcaccggcccaagtccactccgttgagtcagccttcagccaacggagttcagacagagggactggactacgaccgactgaaacaggatatcctggacgagatgcgtaaggaactgacgaaactcaaggaagaacttattgacgctataagacaagaactgtcaaagagtaacaccgcctag

SEQ ID NO: 23950 - DNA, 1599 bp, Artificial Sequence
  Description of Artificial Sequence: Synthetic coding sequence
agcgagcagagcatctgccaggcccgggccgccgtgatggtgtacgacgatgctaataagaagtgggtgcctgcaggagggtcgacaggttttagccgggtccatatctaccaccacacaggtaacaatacctttagggttgtgggacgtaaaatccaggaccaccaggtggttattaactgtgcgatccctaaagggctgaagtacaaccaagcaacacagacttttcatcagtggagagacgcaagacaggtgtacggactcaactttgggtcaaaggaggacgccaatgtcttcgcctcggcaatgatgcatgcactggaggtgctgaacagtcaggaaacaggacccaccctgcctcgccagaactctcagctgcctgcccaggtgcagaatggcccctcacaggaagaactggagattcagcggagacagcttcaggagcaacagagacagaaggagctggagcgcgagcgtcttgaacgggaacgaatggaacgagaacgcctggagagggagaggcttgagagggaacgcctggagagagaaaggttggagcaggaacagttggagagggagcgccaagagcgcgaacgtcaagagcgcctcgaacggcaagagagactggagagacaggaacggctcgaacgccaggaacggctggaccgagagcggcaggagcgccaggaacgcgaacggttggaacgactagaacgggagcgacaggagagagagagacaggaacagttagaacgcgaacaactcgaatgggaacgggaaagaaggataagctctgctggaatagtactcggaccactggcaccacctccccccccccctctcccgccaggcccagcccaggccagcgtcgcattacctcctcctcctggaccaccgccccccccgcctttgccatctacaggtcctccaccacctccccctccccctccgctgcccaaccaggttccacccccacctccccccccgcctgctccgcccttacccgcctccggctttttcttggcatctatgtcggaggacaatcgtcctcttactgggctcgctgctgccatagcaggcgccaaactacgcaaggtgtcgcggatggaagatacctcctttccttccggggggaatgctataggggtgaactccgcaagcagtaagactgatactggacgtggtaacggccccttgcccctgggggggagcggactaatggaagaaatgtcagcacttcttgcccggcgccggcgcattgcagagaagggatctaccatcgaaaccgagcagaaggaagacaagggagaggactctgagcctgtgacttccaaggctagtagcacatctaccccagaaccaaccaggaagccctgggagaggacaaacactatgaacggctctaaaagccctgttataagccgtcccaaatcaacacccctgtcacaacccagtgccaacggggtgcaaactgaaggcctcgactacgatagacttaaacaggatatcctggatgagatgcgaaaggaactgaccaaattgaaagaggagctgattgatgctatccggcaagagctgagcaaatccaacaccgcttag

SEQ ID NO: 23951 - DNA, 1878 bp, Artificial Sequence
  Description of Artificial Sequence: Synthetic coding sequence
atggaccggggcaccctgcccctggccgtggccctgctgctggccagttgttcactgtcccccactagcctggctgagaccgtccattgtgacttgcagcctgtgggcccggaacgtggcgaagttacatacacgactagccaggtatctaaagggtgtgtggctcaggctcccaacgctatactggaagtacatgtcctgtttctggagtttccaactggcccaagtcagctggaattgaccctacaggcaagcaagcaaaatggcacatggcccagggaagttctactggtattgtctgtaaacagctctgtgttcctgcatttgcaggccctcggaatccctctgcacctggcttataatagttccctggtgacttttcaggagccaccaggagtcaatacaacagaactacccagcttccccaaaacacagatacttgagtgggccgctgaaaggggcccaataacatctgctgcagagctgaacgatccacagtctatcctgcttagactgggtcaagcccagggctcactgtccttttgtatgctcgaggcctctcaagacatggggagaacattagagtggcgacctcgcactcccgccctggtccggggctgccacctggaaggtgtggccgggcataaggaagcgcacatactaagggttctgccaggacatagtgccgggccccggacagtcactgtgaaagtggagctgtcttgcgccccaggagatttagacgcagtcctgatcctgcagggccccccatacgtgagctggctgatagatgctaaccacaacatgcagatctggactacgggagagtattcttttaagatatttcccgaaaagaacataagaggatttaagctgcctgacacccctcaagggctgctaggagaggctcgcatgctcaacgcaagtattgtggccagcttcgtggagctgcccttggcaagcatcgtgtctctccacgcttcttcctgtggaggcagactgcagacttcccccgctcctatccagaccactccgcccaaggacacgtgttctcctgaactcctcatgtcacttatccagacaaagtgcgccgacgacgccatgacactcgtacttaaaaaagagctagttgcacatttgaaatgtactatcacgggcttgactttttgggacccgagctgcgaagcagaagacaggggggataagttcgttctgcggtcagcttacagtagctgcggtatgcaggtttctgcctccatgatttccaatgaagctgtcgtgaatatcctgagctcatcttcaccccagcgaaagaaagtgcactgtcttaatatggacagtctgagcttccagctgggattgtacctgagtccccactttctgcaagccagtaacacgatcgagcctggccagcagtcttttgtgcaggtgcgcgtgtccccatctgtctccgagttcttgttgcagctggactcttgccatttggatctgggcccagaaggcggaaccgtggagctgattcaaggcagagccgcgaaggggaactgtgtgagtctgctctcaccctcccccgagggcgacccaaggttctcttttctcctgcatttctatacagttcctatccccaagaccggcacactgtcttgtacagtggcgcttcgccccaaaactggctctcaggaccaagaggtgcatcgcacagtgttcatgcgtttaaatatcatctccccagacctgtctggctgcacctccaagggcctcgtgctgcctgcggtactcggcatcactttcggtgccttcttgatcggtgctctgcttacagccgctctctggtatatttatagccatacccgcgagtacccgcgcccgccacagtag

SEQ ID NO: 23952 - DNA, 1977 bp, Artificial Sequence
  Description of Artificial Sequence: Synthetic coding sequence
atggaccggggcaccctgcccctggccgtggccctgctgctggcctcttgtagcctctcacctacgtccctcgccgagactgtgcactgtgacctgcagccagtgggccctgagagaggagaggtcacttacaccacaagtcaggtctcaaagggctgtgtggcccaggccccaaacgctatcctggaagttcacgtgctctttcttgagtttcctacgggcccaagtcagttagagctgactctgcaggcttctaaacagaatgggacatggcctagggaggtgcttctcgtacttagcgtgaacagctcggtttttttgcatttacaagcccttggaatacctctccatcttgcttataattcttctctggtaacatttcaggagcccccgggtgtgaacacaaccgaattaccaagttttccaaaaacccagattctcgaatgggccgctgaacgcggtccaattaccagcgcggctgagttgaatgatccacagtccattttgctcagactggggcaagctcaggggtctttatctttttgcatgctggaggcaagccaggacatgggtaggactctggagtggaggccaagaactcccgcccttgtgcgtggttgccacttagagggggttgcagggcacaaggaggctcatatccttcgcgtgttgcctggtcacagcgccggtccacggacagttactgttaaggttgaactcagctgcgctcccggtgatctggatgccgtcctgatcctgcaggggcccccttatgtgtcatggctcatcgacgccaaccacaatatgcagatatggacaactggcgaatatagcttcaaaatctttcctgaaaaaaatattcgggggtttaaattgccagatacgccacagggcctgctgggggaggcccggatgctgaatgcttctattgttgcttctttcgttgaacttccgctggccagtatagtgtcactgcatgcatcttcatgcggtgggcggctccagacaagtccagcccccattcagaccacacctccgaaggacacgtgtagccctgagcttctgatgtccctcatccagaccaaatgcgccgacgatgccatgaccctagtcctgaaaaaggaattggtggcacaccttaagtgtacaattacagggctgactttctgggatccgtcttgcgaggccgaagaccgaggcgacaagtttgtacttcgttcagcgtactcctcctgtggcatgcaggtcagtgcatccatgatttcaaatgaagcagtggtgaatatcttgtcaagttctagtcctcaacggaaaaaagtgcactgtctcaatatggatagtttgagctttcagctgggactctacctgtctccgcattttttgcaggcatccaatacaatcgagcccggccagcagtcctttgttcaggtacgggtttctccgagcgtgtccgagtttcttttgcagctcgattcatgtcacttggatcttggccccgaagggggcaccgtcgagcttatccagggccgagctgccaaaggaaattgtgtctcactgttgtctccctcgcccgaaggggatccccgattctccttcctgcttcatttttatacagttccaatccccaagaccggtacgttgagctgtacggttgctttaagacccaagaccgggagtcaggatcaagaggtacatcgaaccgttttcatgaggctgaatatcattagcccagacctgagcgggtgcacctcaaagggcctggtattgcccgcagtgctggggattacctttggagcatttctgatcggcgcccttctgactgcagcactgtggtacatttactcccacacacgaagtccctccaagcgggagcccgtggttgccgtggccgcacctgccagtagcgagtccagttcaactaaccattctataggatctactcagtccaccccctgttcaacttcaagcatggcatag

SEQ ID NO: 23953 - DNA, 1977 bp, Artificial Sequence
  Description of Artificial Sequence: Synthetic coding sequence
atggaccggggcaccctgcccctggccgtggccctgctgctggcctcttgctccctgtctcccacctctctcgcagagacggttcactgcgacctccaacctgtgggccccgagagaggggaggtcacctacacaacctcgcaagtctccaagggttgcgttgcacaggcccctaacgccatcctggaagttcacgtgctattcctggagtttcctacaggaccttctcagctagaactgactttacaagccagtaagcaaaacggcacatggcctcgggaggttcttcttgtgctcagtgtgaactcatctgtgttcttacaccttcaagccctgggcatacccctccacctggcgtacaattcttctctggtcacttttcaagaaccccccggtgtcaatacaaccgaactgccaagcttccctaagacccaaatactcgagtgggccgccgagcgagggcctataacctcagcagctgagctcaatgatcctcagtccatactgctgcgcctggggcaggcccagggcagtctctctttctgcatgttagaagctagccaagatatgggacggaccttggagtggcggcctagaacaccggcgcttgtgcgaggatgccatcttgagggagtggcaggccataaagaagctcacatcttgagagtgctccctggtcactctgcgggtcccaggaccgtcaccgtgaaagtcgagctctcctgtgcccccggagatcttgatgccgtacttattcttcagggccctccatacgtttcctggctgatcgacgccaatcataatatgcaaatatggacgactggcgaatacagttttaagatctttcccgaaaaaaacataagaggcttcaagctgcctgacactccacagggactcttaggcgaggcccgcatgctgaatgccagtatcgtggcgagttttgtggagcttcctctggcctctattgtctctctacacgcaagctcatgtgggggaagattacagacatcaccagcaccaatccagaccacaccccctaaggatacgtgttctcctgagctcctgatgtccctcatacaaactaaatgcgccgatgacgcaatgaccctggtgcttaaaaaagagcttgtcgcccacctgaaatgcaccatcactggacttaccttttgggatcccagctgcgaagctgaggatagaggggacaaatttgttcttcggtccgcttacagcagctgtggaatgcaggtgagtgcctcaatgatctccaacgaagccgttgtgaacatcctgtcttcatcgtcgccccagcggaaaaaagtccattgtctgaatatggattccctgagcttccaactggggttgtatttatctccgcactttttgcaggcttccaacactatcgagcccggtcagcagtcgttcgttcaggtcagagtctcccctagtgtttcagagtttctattgcagctcgatagctgtcacttggatctgggccctgagggtggcaccgtggaacttatacaagggagggccgcaaaaggcaactgtgtgagcctactttcccctagtccagagggggacccgcggttcagtttcttgctgcacttttatacagtgccaatccctaaaaccggaaccctgtcatgtactgtggcccttaggccgaaaaccggatcacaggatcaggaggtccaccgtactgtttttatgcggcttaacataatcagccccgacctctcaggttgcacctccaaaggcctagtgttgccagccgtgctggggatcacctttggtgctttccttattggcgctctgctgaccgccgccctgtggtatatctatagtcacactaggtcgccgagcaagcgcgagcctgttgtcgccgtggcggccccggcgtcgtcagagagcagctccacaaatcatagcatcggatctactcagtccactccgtgtagtacgagttcaatggcttag

SEQ ID NO: 23954 - DNA, 1431 bp, Artificial Sequence
  Description of Artificial Sequence: Synthetic coding sequence
atgctggaggccagccaggacatgggccggaccctggagtggcggcctcgaactcctgcactggtacgggggtgtcatctggaaggcgtggcgggacataaagaggctcacattctccgcgttctccctggccattccgcaggccccaggaccgtaaccgttaaggtggaactctcatgcgcccccggcgatctagacgcggtcctgatcctccagggcccaccctacgtcagctggctgattgacgcaaatcataacatgcagatttggaccaccggggaatactctttcaaaatttttcccgagaaaaatatacggggattcaaactccctgatactccacagggactcctgggagaggcccggatgctcaatgctagcattgttgccagctttgtggagctcccactggcttccatagtttcactgcacgcctccagctgcggaggtcgtctgcagaccagccccgcccccatccagactactcccccgaaggacacttgttctcctgagctcctgatgtccctgatccagacaaaatgcgcagatgacgccatgaccctggtgttaaaaaaagaactggttgcccacctgaagtgcacaattacaggtctgacattctgggaccccagctgcgaggctgaggacaggggagacaagttcgtgctgcggtctgcatacagctcttgtggaatgcaggtgtctgctagcatgatctccaatgaagccgtcgtcaacattttgtccagctcatcgccacaacggaaaaaggtccactgcctgaatatggattctttgtcttttcagctgggtttatacctgagcccgcatttcctccaggcctcaaacactatcgagcccggacagcagtcatttgttcaggtccgtgtgtcaccgtcagtgagcgagttcttgctccagttggattcatgccatctggacctcggtccggagggggggactgtggagctgatccagggccgggccgctaagggcaattgtgtttctcttctttcaccctccccagagggagatcctagattctccttcttgctccacttctataccgttccaatccctaagacgggcacactgtcatgtaccgtcgctttgcgacccaagaccggtagccaggaccaggaggttcaccgtaccgtgtttatgcggttaaatatcattagccctgacctctctggctgtactagcaagggactggtgttacccgcggtcttgggcattacttttggggcgtttctcataggcgctcttttgacagcggctctctggtacatctatagtcacacgcggagcccatctaagcgggagcctgtggtggccgtggctgccccagcttcctctgaatcatcctccaccaaccattcgatcgggagcactcagtcgacaccatgcagcactagcagtatggcatag

SEQ ID NO: 23955 - DNA, 639 bp, Artificial Sequence
  Description of Artificial Sequence: Synthetic coding sequence
atggactacctgctgatgatcttcagcctgctgttcgtggcctgccagggtgctcccgagacagcagtgttgggagctgaactgtcagccgtgggcgagaatggaggtgagaagccgacaccaagccccccatggcggctacggcgcagcaagcgttgttcttgctcttccttgatggacaaggaatgtgtgtatttttgtcacctggacattatctgggtcaatactccggaacatgtggtcccttatgggttgggctccccgaggtctaaacgggcattggagaatttgttgcctacaaaggccacagaccgcgagaacaggtgccagtgtgcgagtcagaaggacaagaagtgctggaacttctgtcaggcggggaaggaactccgagctgaagatattatggagaaagattggaataaccataagaagggtaaagactgcagcaagctgggtaagaagtgcatataccagcagcttgtcaggggacggaagattaggcgcagctcagaggagcatttgcgtcagacacggagtgagaccatgagaaattctgtaaagagtagctttcacgatcccaagctgaaggggaagccatcacgcgagcgttatgtgacccataatagggcacattggtag

SEQ ID NO: 23956 - DNA, 1329 bp, Artificial Sequence
  Description of Artificial Sequence: Synthetic coding sequence
atgcagcccccccccagcctgtgcggccgggccctggtggccctggtgctggcctgtggactatctcggatctggggggaagagcgaggcttccccccagatcgggccacacctctgttgcagaccgccgagatcatgacaccccccaccaagacgctctggccaaaggggtcaaacgcttcgttggctaggagtctggcaccagctgaggtgccaaaaggcgaccggaccgcagggagccctccccgtacaatcagtcctccgccctgccagggcccaattgagataaaggagacctttaagtacataaatactgtggtttcttgcctggtttttgtgttgggcatcatcgggaactccaccctgctgcgcatcatctacaagaacaagtgcatgcgcaatgggccaaatatcctcatagcctcccttgctctgggtgacctcctgcacattgtcatcgacattcctattaacgtgtataagctgctcgccgaagattggcctttcggcgccgagatgtgcaagcttgtgcccttcatccagaaggcctccgtggggattaccgtcttgtcactatgtgcactatctattgacaggtaccgcgcagtcgcctcatggtcccggattaaaggcataggagtaccaaaatggactgcagtcgagatcgtgctgatatgggttgttagtgtcgtcctggcggttcccgaagcaatcggctttgatatcataacaatggactataaggggtcgtacctgcggatctgtctgcttcacccagttcaaaaaacagcattcatgcagttctacaaaacggccaaagattggtggcttttttcgttctacttctgtttgccactggctatcacagccttcttttacaccctgatgacatgtgaaatgctgcgaaagaagagtggtatgcagatcgcactcaacgatcacctgaaacagcgacgggaagtggccaaaacagtgttttgtctggttctggtgtttgccctctgctggcttcctttgcacctgagcaggatcctgaagctaactctgtacaaccagaatgaccctaaccggtgcgaactactaagctttctgctcgtgttggattacataggaatcaacatggcgagtttaaactcgtgtataaacccaatagcattgtatttggtgtctaagcgatttaagaattgctttaagtcttgtctgtgttgttggtgtcagagttttgaggaaaagcagtcactggaggagaagcagtcatgcctgaagttcaaggccaatgaccatggctacgacaacttcagatcaagcaataagtatagttcttcctag

SEQ ID NO: 23957 - DNA, 1599 bp, Artificial Sequence
  Description of Artificial Sequence: Synthetic coding sequence
atgaacaagagcacctgcctgatggccgccgagacccccagcaagcgatggcggttgcactgcctggcattcagccaaaggtttgtaagggctggccccgcctgttccagccgtgaggcctgctcttcccccagagccggctggaatcctgccggatttcgactccccggcaggtggtctcctttcgttgccttacatctggtttgtcagattagggaagcacttaaactgagatccggccaccgcaccccatccggagctgggtcgagcatgcagcccccaccaagtttgtgtgggcgggctcttgtggcactggtcctggcgtgcggtctgtcccgcatctggggagaggaaaggggatttcccccagatcgagccactcccctcctccagacagctgagatcatgacaccaccaaccaagacgttgtggccaaagggctctaatgcatccttagcacgatctctagcccctgcagaagttcccaagggcgacaggacagccggatcaccacctcgtaccattagcccacccccttgtcagggaccaatcgagattaaggagacttttaagtatattaacacggtggtgagttgtctggttttcgtcctgggaatcatcgggaattctaccctgctccggattatttataagaataagtgcatgcgcaacggtcctaacatactgatcgcatccttagctctgggcgacctgctccacatcgtgatcgacattcctataaacgtatataagctcttggccgaagactggccatttggggccgagatgtgcaagctagttccatttatccagaaagcctcagtggggattactgtactgagcctgtgcgccctttcgattgatcgctatagggccgtggcctcttggtctagaatcaaaggaatcggagtaccaaaatggacggcagtggaaattgtccttatctgggtcgtttccgttgtgctcgccgtacctgaggctatcggcttcgatatcatcactatggattacaaggggtcttatctcagaatttgcctgttgcacccagtccagaaaactgcgtttatgcagttctacaagaccgccaaggactggtggctgttctcattctacttttgcctgccattggccataacggcgttcttttacacactgatgacatgcgaaatgctgcggaaaaagtccggtatgcagattgcattgaatgatcacctgaagcagcggcgagaggtggctaagaccgtgttttgtctggtcttagtctttgctttatgttggctgccactacacctgagtcgaatcctcaagcttactctgtacaatcagaatgatccaaatcgctgcgaactgctttctttcttgctcgtactggattatattggcattaatatggctagccttaatagctgtatcaatccaatcgcactgtacctggtgagtaagcgttttaagaattgttttaaatcctgtctgtgttgttggtgtcagtcctttgaggagaagcagagcctggaggaaaagcagtcctgtttgaaatttaaggcaaacgatcacggatacgataatttcaggagctcaaacaagtactcgtcgtcctag

SEQ ID NO: 23958 - DNA, 1311 bp, Artificial Sequence
  Description of Artificial Sequence: Synthetic coding sequence
atgcagcccccccccagcctgtgcggccgggccctggtggccctggtgctggcatgtgggctttcacgcatctggggagaggaacgtggattccccccggaccgtgccactcccttgttgcagacggccgaaatcatgacacctcctaccaagacgttatggcctaagggcagcaacgctagcctggcccgtagcttagcacccgctgaggttccaaagggcgaccgcacggccggcagcccccccaggaccatatctccccccccatgccagggtccaatcgagattaaagagaccttcaagtacattaacacggttgtcagctgtctggtgttcgtgcttgggataatcggaaacagtaccctccttcgcattatttacaagaataaatgcatgcggaacgggcccaatattctgattgcaagcctggctctaggcgatctgctacacattgtgatagacattcctatcaacgtgtataagttactcgcggaagactggccgtttggagcggagatgtgtaagctggtgcccttcattcagaaagccagtgtaggcatcaccgtactgtctttgtgtgccctttcaattgaccgttaccgagctgtagccagttggagccggatcaaggggattggcgtgcccaagtggaccgccgtagagattgttctaatttgggtggttagtgtggtcctggccgtgcccgaggctataggtttcgatatcattactatggactacaaggggtcttatctacggatttgtctgcttcacccggtgcagaaaacagcctttatgcaattttacaaaaccgccaaggattggtggttattctctttctacttttgtctgccccttgcaataaccgcttttttttacactctgatgacatgcgagatgctgagaaagaagtctgggatgcagatcgccctaaatgatcacctcaagcagcggcgggaggtggcaaagaccgtgttttgcctggttttagtcttcgcactgtgttggctccccttgcatttgagtagaatcctgaagctgactctgtataaccaaaatgaccccaatcggtgtgagctgctttcctttctactagttctggattacatcggcattaacatggcctccctaaatagttgtattaaccccatcgccctataccttgtcagcaagagatttaagaattgttttaaagccggcccgcacgtgggaaacaagctggttatgcttttttccgtcaacatcgagtgtgatggaactgttaatcaaaatccaaccatgtggcctgaacgcaaaagtaataacaactag

SEQ ID NO: 23959 - DNA, 2787 bp, Artificial Sequence
  Description of Artificial Sequence: Synthetic coding sequence
atggccctgcggcggctgggcgccgccctgctgctgctgcccctgcttgcagccgtggaggagacccttatggactcgacaaccgccactgctgaactaggctggatggttcatcctcctagcggatgggaagaagtatctggttatgacgaaaacatgaatacgattcgaacataccaagtctgcaacgtctttgagagcagtcagaataattggctgaggactaagttcatccgcagaaggggcgcacatcggatccacgtcgaaatgaaattcagtgtgagagactgctcttcaattccatccgtcccaggatcctgtaaggagaccttcaatctgtattactacgaggcggatttcgattccgcaaccaaaaccttccctaattggatggaaaatccctgggtcaaggtggacactatagcagccgatgagtctttctcccaggtcgacctcggcggaagggtgatgaagattaatactgaggttcggagctttgggcctgtgtcccggtcaggcttctatttagcattccaagactatggagggtgcatgtccctgatcgccgtccgtgtgttctaccggaaatgcccccgcattatccaaaacggcgccatctttcaggagactttatctggtgctgagagcacatcccttgtggctgctcgcggcagttgcatagctaacgcggaagaagtggatgtccccatcaagctttattgtaatggtgatggtgaatggctcgtacctatcggtcggtgcatgtgtaaggcggggttcgaagccgtcgagaatgggacagtgtgtcgaggatgcccatctggcaccttcaaggccaatcagggggacgaggcctgcacacactgtcctattaattcccgaactacttctgaaggcgccacgaattgtgtctgtcgcaacggatactacagggctgacttggatccactggacatgccatgcaccaccataccttccgccccccaggcagtaatttccagcgttaatgaaactagcctcatgctggagtggactcccccccgagactctggggggagggaggacctggtttacaacataatctgcaaaagttgcggctcaggacgtggagcctgtactcgatgcggagataatgtgcagtatgcacctcgtcaattaggcttgactgaaccccggatttatatcagcgatttgctcgcacatacacagtatactttcgaaatccaagcggttaacggggttaccgaccagtctcctttttctccccagtttgccagtgtcaacatcacaacaaatcaggcggccccatccgcagtgagcatcatgcatcaggtctctagaaccgtggattctatcacacttagctggtcacaaccggaccagccaaatggagtcatactggattacgaattgcaatactatgaaaaagaactgtccgaatacaatgcaacggccatcaaatcacctaccaacaccgttactgtccaaggcttgaaagccggggcaatatatgttttccaagtacgggctagaaccgttgctggatacggcaggtatagcgggaaaatgtactttcagaccatgacagaagtgaccccagggatgaagatatacatagacccgtttacttatgaggaccctaatgaagcggttcgtgaatttgccaaagagatcgatatctcctgcgtgaaaatcgagcaggtaatcggggccggcgaattcggcgaggtgtgcagtggacatcttaagctgccaggaaagagggagattttcgtagctatcaagacgttgaagtctggctacacagagaagcagagacgcgatttcctgtccgaggcaagcatcatgggtcagtttgatcaccccaatgttatccacctggagggcgtggtgaccaaatcaactccggtgatgattattacagaatttatggagaacgggagcctcgactcattcctgcggcagaacgacggccagttcactgttatccagctggtcggaatgcttcggggaattgctgcaggcatgaaatatctggcggacatgaattacgtgcatagggacctggccgctcgaaacattttggtcaattctaacctggtatgtaaggtgtcggacttcggtttgtctcgattccttgaggacgatacgtctgatccaacctatacctcggctctgggtgggaagatccccatccgatggacggcgcccgaggcaattcagtaccgaaagttcacgagtgcttctgatgtttggtcctacggcattgtgatgtgggaggtcatgtcctatggtgagcgaccctattgggatatgacaaatcaggacgtaattaatgctatagaacaagactaccgactcccacctccaatggattgcccatccgcccttcaccagttaatgctcgactgctggcagaaggatcgcaaccacaggcctaagtttggccaaatcgtcaacaccctggacaaaatgatccggaaccctaatagtcttaaggctatggccccactttcctctggaatcaacttaccacttttagaccgtacaatacccgactacacctctttcaacacagtcgacgaatggctggaggccattaagatgggccagtataaagagtcctttgctaacgctggatttacatccttcgacgtcgtatcccaaatgatgatggaggatatattgagggtgggcgtaactctggctggccaccagaaaaagatactgaattcaatccaggtgatgcgcgcgcagatgaaccagatccaatctgtggaagtctag

SEQ ID NO: 23960 - DNA, 2841 bp, Artificial Sequence
  Description of Artificial Sequence: Synthetic coding sequence
atgtgggtgcccgtgctggccctgcccgtgtgcacctacgccgagacacttatggattctaccaccgctacggccgaattgggctggatggtacaccctccgtctggctgggaagaggtgtccggctacgatgagaatatgaataccattcgaacctatcaagtttgtaacgtatttgaatctagtcagaacaactggttacgcacaaagttcattcggcggcggggagcccacaggatccatgtggagatgaaattctccgtacgggattgctcttcaatcccttctgtccccggctcatgtaaagaaacgttcaatctgtactattacgaggccgatttcgacagcgccacaaagacattcccgaactggatggagaatccctgggtgaaagttgatactatcgccgctgatgaatctttttctcaggtggatctaggaggcagggtgatgaaaataaacacagaagtccgatccttcggacccgtaagtagaagcgggttctaccttgcattccaggactacggcggatgtatgagtttgatcgccgtcagagttttctaccggaaatgtccgcgcataatccagaacggcgccatcttccaggagacgcttagtggagcggagtcaacctcactggtagcagcccgaggatcttgcatagccaacgccgaggaggtggacgtgcccattaagttgtattgcaatggcgatggcgagtggctcgttccgataggacgatgtatgtgcaaggctgggtttgaagcagtcgagaacggtacagtttgccgcgggtgtccaagcggaaccttcaaggctaaccagggcgacgaagcgtgcacccactgcccgatcaattctcgcactacctcggagggtgcaactaattgcgtgtgtcgaaatggatactatcgcgcagacctggacccgctggacatgccctgtaccacaatccccagcgctccacaggctgtcatctctagcgtgaacgagacatcactaatgttggagtggacgcccccgcgcgactccggcggtagggaagacctggtatataacatcatatgcaagtcttgcggctctggaagaggtgcttgcaccagatgtggggataatgtccaatacgctccacgccagctggggcttactgaaccacgaatctatatctctgacctcttggctcacacgcagtataccttcgagattcaagcggtaaatggtgtcacagaccaatcacctttttctccccagttcgcttcggtgaacatcactacaaaccaggctgcccccagcgcggtcagcatcatgcaccaagtctcccgcacggtggatagcatcacactgtcttggtcacagcctgatcagccaaacggggttatcttggattacgaactacaatattacgagaagcaggagttgtctgaatataacgccacagcaattaaatcgccgaccaataccgtgaccgtgcagggattaaaagcaggagcaatctatgtttttcaggtgcgggcaagaacagtggctggatacggtcggtactctggaaaaatgtattttcagactatgacagaggcggagtatcagacttcaattcaggagaagcttcccctgattattggatccagcgcagccggtcttgttttcttgatcgccgtcgtggtgattgctattgtgtgtaacaggcgggggttcgagcgggcggattctgagtacacagataagttgcagcattacacctctgggcatatgacacctggaatgaaaatctatatagacccattcacatacgaagatcctaacgaagctgtacgggaatttgccaaagagatagatatctcttgtgttaagattgagcaggtcataggcgctggcgagttcggtgaggtgtgtagcgggcacttaaagctcccaggaaaacgagagatctttgtggctatcaagaccctgaaatctgggtatacagagaagcagagacgcgattttctgagcgaagcctcaatcatgggccagtttgaccacccaaacgtcattcacctggaaggggtggtgactaaatccacccccgtcatgatcatcaccgaatttatggagaatggttctctcgacagcttcctccgccagaacgatgggcagtttacagtgattcagttggtcggcatgttgcgggggatagcggccgggatgaagtacctcgccgacatgaactatgtgcacagagatctcgcggcccgaaacatcctcgtgaactccaaccttgtgtgcaaagtcagcgatttcggtctgagtcgatttttagaggatgacacatcagaccccacttatactagcgcactcggtggcaagatacccatccgctggacagctccggaagccattcaataccgtaagttcacctccgcatccgatgtttggtcctatggcatagtcatgtgggaggtcatgtcttacggggaaaggccttactgggatatgactaaccaggatgtgataaacgctattgaacaggactaccgactcccgcctccaatggattgtccttccgccctgcatcagctgatgctggattgctggcagaaggacaggaatcaccgccccaagttcggtcagatcgtgaacacactcgacaaaatgatccggaacccaaactccctgaaggcaatggccccactaagcagcggcattaacctgccactgctggacagaactatccctgattacacatctttcaatacagttgatgagtggctggaagccattaagatggggcagtacaaggaaagcttcgctaatgcaggattcacgtctttcgacgtggttagtcagatgatgatggagtag

SEQ ID NO: 23961 - DNA, 2961 bp, Artificial Sequence
  Description of Artificial Sequence: Synthetic coding sequence
atggccctgcggcggctgggcgccgccctgctgctgctgcccctgctagcggctgttgaagaaacccttatggattccacgactgccaccgccgaactcggctggatggttcatccaccctctgggtgggaagaggtgagtggttatgacgagaatatgaacactatacggacatatcaggtgtgtaacgtctttgaatcttcgcagaacaactggttgcggacgaaattcatccgacgtcgaggggcacacagaatacacgtggagatgaagttctcagttcgagactgctcgagtattcccagcgtgccgggttcctgcaaagaaacctttaatctctactactacgaggctgattttgactctgcaacaaaaacctttccaaattggatggaaaacccatgggtgaaggtggatactatcgcagccgacgagtccttctctcaagtcgacctcgggggtagagtgatgaagattaatacagaagtacgtagtttcggccctgtttctaggagtggattctacctcgcttttcaggactatgggggatgcatgtcattaattgccgtccgcgtgttttataggaagtgtccccgcatcatccagaatggagcgatttttcaggagactctttcaggagctgagtctacatcactcgttgctgccagaggaagttgtatcgctaatgcggaagaggttgatgtccctattaaactctactgcaacggcgacggcgaatggttggtcccgattggcagatgcatgtgcaaggctggcttcgaggccgtggaaaatggcactgtgtgtagaggctgtccaagtggaaccttcaaagctaaccagggcgatgaggcttgtacgcattgcccaataaattcacgcactacaagtgagggcgccaccaattgcgtttgccggaacggttactaccgcgctgatctggaccctctggatatgccctgcactactatcccttcagccccacaagcagtgatttcatctgtcaatgagacgtccttaatgttggagtggacacccccccgcgattcaggaggccgcgaggacctggtctataacattatatgtaaatcttgtggaagcggacggggggcctgcaccaggtgtggagataatgtgcaatacgccccccgtcaactgggccttacagagccacggatctacatctccgacctcctcgcgcacacacagtacacattcgagatccaggcagtaaatggggtcacagatcagagtcctttctcaccacagttcgcttccgtgaatatcaccacgaaccaggctgccccgtcagctgtgtctattatgcatcaggtaagccgcaccgtggactctattaccctctcctggagtcagcctgaccagccaaacggcgtgattttggattatgaactgcagtactacgagaaggagctcagcgaatacaacgctactgctattaaatctccaacaaacaccgttaccgtgcagggactgaaggccggcgctatatatgtctttcaggtcagggcacggacagttgccgggtacggccgttattcaggcaagatgtatttccagaccatgaccgaggctgagtaccagacatccatccaggaaaaattaccattgattataggaagcagcgctgcaggactcgtctttcttatagctgttgtggtcattgccatcgtgtgcaaccgccggggctttgaacgggcagattctgaatatacagacaagctccaacattacacgtccgggcatatgacaccaggaatgaagatctacatcgaccccttcacctacgaggatcctaacgaggccgtccgggagttcgcaaaagaaattgatattagctgcgtgaaaatcgagcaggtcattggagccggtgagtttggtgaggtgtgtagcggacacctcaaacttcctggaaagcgggaaatattcgtggctatcaagacgctgaaatctgggtacaccgaaaagcaaagaagggatttccttagcgaggcatccataatgggacagtttgaccatcctaatgttattcatttagaaggggtggtaacaaaaagcacccccgttatgatcatcacggagttcatggagaatgggtcactggatagcttcctgcggcagaatgatgggcagtttacagtcatccagctggtaggcatgctgaggggcatcgccgccggaatgaaatatcttgcagacatgaattacgtccatcgagacctggcggccaggaacattctcgtcaatagcaacttggtgtgtaaggtgagcgactttggcctgtctagatttctcgaggacgatacctccgaccccacatatacatcggctctggggggtaagatacccattcggtggacggcccccgaagccatccagtatcgcaagttcaccagcgccagtgatgtgtggtcttacgggattgtgatgtgggaagtcatgagttacggcgagagaccctactgggatatgaccaatcaagatgtcataaatgctattgagcaggattatcggctgccgcctcctatggattgtccatctgccttacaccagttaatgctggattgctggcagaaggatcgaaatcatcggccgaagttcggtcagatcgtgaataccttggacaaaatgattcgtaaccctaattcactgaaggcgatggcgccccttagctccggaatcaatttgccactgctggacaggacgatccccgactacaccagttttaatactgtggacgaatggctggaagccatcaagatgggccagtacaaagaatcattcgctaacgctggatttacatctttcgacgtagtgagtcaaatgatgatggaggatattctcagggtgggggtgactctggcagggcaccagaagaagatcctcaactctattcaggtaatgcgtgctcaaatgaaccaaattcagtctgtggaggtttag

SEQ ID NO: 23962 - DNA, 2964 bp, Artificial Sequence
  Description of Artificial Sequence: Synthetic coding sequence
atggccctgcggcggctgggcgccgccctgctgctgctgcccctgctggcggccgtggaagaaactctcatggacagcactactgcgaccgccgaattgggatggatggtgcacccaccgtccggctgggaagaagtctccggctacgacgaaaacatgaacactattcgaacctaccaggtctgtaatgtttttgagtcttctcagaataattggctcaggaccaagttcatccggagaaggggggctcacaggatccatgtggaaatgaaattttccgtgcgggattgttctagtatcccatctgtgccagggtcctgcaaggagactttcaatctctactactatgaggccgattttgattctgctaccaaaactttccctaactggatggaaaatccttgggtgaaggtggatactatcgccgcggatgagagcttttctcaagttgatcttggtggacgcgtcatgaagatcaacacagaagtgcggagctttgggcccgtttctcgttctggattctacctcgcattccaggattatgggggctgcatgagcctgatcgcagtacgcgtgttctaccgcaagtgccctcgcatcatacagaacggggctatctttcaggaaacattatcgggggctgaaagtacaagtttggttgcagcacgtggatcatgcatcgccaacgcagaggaagttgacgtaccgataaaactgtactgcaatggagacggtgagtggctcgtgccaatcggcaggtgcatgtgcaaggcaggcttcgaggccgtcgaaaacggaacggtctgtcgggggtgtccaagcggcaccttcaaagctaatcagggcgacgaagcctgcactcactgccccatcaactcaagaactacttcagagggagccacaaattgtgtgtgccgaaacggttattaccgagcagatctggatcccttggatatgccatgcacgactattccaagtgccccccaggccgtgatctcttcagtcaatgaaaccagcttgatgcttgagtggacaccacctcgggacagtggcggtcgcgaagatctcgtgtataacataatttgcaagtcgtgtggaagcggcaggggagcctgtacaagatgcggcgacaacgtgcagtacgccccgagacaactgggactcaccgaaccccgaatctacatcagcgatctattagctcacacccagtatacgtttgagatccaggccgtcaacggtgttacagaccagtcaccattttccccacagtttgcgagcgtgaacattactaccaatcaggctgcaccctccgcagtgtcaataatgcaccaggtgtcaaggaccgtggatagcattacgctgtcctggtctcagccagatcagcccaatggggtgatcctggattatgagctgcaatactacgagaaggagctctctgagtataacgctaccgctattaagtcccccactaatacggtaacagtgcagggacttaaggccggggcgatctatgtcttccaggtgcgggctaggaccgtggccggttacgggcgttacagtggcaagatgtatttccaaaccatgacagaagccgagtaccaaacatctattcaggaaaagctgccactaattatcggttcctctgcagcggggttggtctttctcatcgccgtggttgtcatagcaatagtctgtaataggagacgtgggtttgagagagccgattccgaatacacggacaaattgcagcattacacttcaggccacatgacccccggcatgaagatctatattgatccttttacatacgaagatccaaatgaagctgttagagagtttgctaaagagatcgatatatcctgcgtgaagattgagcaggtgatcggagcaggtgaatttggggaggtgtgttccggacatctgaagctgcccgggaagcgcgagatctttgtggccataaaaactttaaagagtggatataccgaaaagcaacgaagggacttcctctccgaggctagcatcatggggcagttcgatcacccaaatgttatccacttggagggggtggtcaccaagagtaccccggtgatgattattaccgagttcatggagaatgggtccttggactcttttttgcgccagaacgatggtcagtttacagtgattcagctggtggggatgctccggggcatcgcagccgggatgaagtatctcgccgatatgaactatgtacacagggacttggctgcacgaaatattctggtgaacagcaacttagtctgcaaagtgtcagacttcggactctctcgattccttgaggatgatacaagtgaccctacctatacctccgctctaggcggcaagatcccaatcaggtggaccgctccggaggcaatccaataccggaaattcacctctgcttctgacgtgtggagctatggcattgttatgtgggaagtcatgagctacggagagcgtccatactgggatatgacaaaccaggacgtcattaacgcgatcgagcaggattaccgacttccccctccaatggattgcccaagtgcccttcaccagctcatgctggattgctggcaaaaggatcgaaaccaccgccctaagttcggtcagatcgtgaacactttggacaagatgatccgcaacccaaattcactgaaagcaatggctcctctgtcatctggcattaatttgcctttactggaccggactatacccgattacacatctttcaatactgtggatgagtggcttgaggccatcaagatgggccagtataaggaaagttttgctaacgccgggttcacttctttcgacgtcgtgagccaaatgatgatggaggatattctccgggtcggggtcacacttgctggacaccaaaaaaaaatcctgaactcaattcaggtaatgcgtgcccagatgaaccaaatccagtcagtggaggtgtag

SEQ ID NO: 23963 - DNA, 3168 bp, Artificial Sequence
  Description of Artificial Sequence: Synthetic coding sequence
atggccctgcggcggctgggcgccgccctgctgctgctgcccctgctggcggctgttgaggagactctcatggactctactacggccacagccgaactgggatggatggtgcaccctcctagcggctgggaagaagtgagcggctacgatgaaaatatgaacacgattcgtacctaccaggtctgtaacgtttttgaaagctcccagaacaactggctcagaaccaagttcattaggagaaggggagcccaccgaatccatgtcgagatgaagttttctgtacgggattgctcgagcattccctccgtgccaggttcatgcaaagagactttcaatctttactactacgaggctgacttcgattcagcaacgaaaacctttcctaattggatggaaaacccatgggttaaagtggatacgattgccgcagacgaatccttttcccaggtggacctcggcggtagggtcatgaaaataaatactgaggtgcggagcttcggaccagtgtcacgatctggcttttacttggcatttcaagattacggagggtgcatgtccctcattgctgtccgtgtcttttacaggaagtgtccaagaattatccaaaacggagcaatttttcaggaaacactctccggtgccgaaagcacctctctggtggccgcccgggggagttgtattgccaatgcggaagaggtggatgtgcctattaaactctattgcaacggagacggagagtggctcgtgccgattggcagatgcatgtgcaaagctggtttcgaggccgttgagaatggcacagtatgccgagggtgcccctctgggacctttaaggccaatcaaggcgatgaggcttgtacccattgcccaattaacagcaggacgacgtccgaaggcgccactaactgtgtttgtagaaatggatactaccgcgccgatctggaccccctcgatatgccttgcacaactattccaagcgcccctcaggcagtcataagctcagtaaatgagacttctttaatgctcgaatggactccaccccgagattctggcggaagagaggacttggtatataatataatttgcaaatcttgcgggtcgggtagaggcgcctgcaccagatgtggagacaatgtgcaatatgcccctcgacaacttggcctaaccgagcctagaatttatatctccgatctgctggctcatacacaatacacattcgaaatacaagcagtgaacggcgtcactgatcagtcccctttctcgccacaatttgccagcgtcaatataacaacgaaccaagccgccccttccgctgtttctatcatgcatcaggtgagcaggaccgtcgattctattacacttagttggtcacagccagaccagcccaatggtgtgatcttggattatgaacttcagtattatgaaaaagagttgtccgagtacaacgctacagccatcaaatcgccaactaacacggtgactgtgcagggactcaaggctggggcgatatacgtgtttcaagtaagagcgagaacagtggcggggtacggcaggtatagcggcaaaatgtacttccagacaatgactgaggccgagtaccagacttccatccaggaaaagctgcctctgatcatcgggtcgagtgctgctggcctcgtcttccttatcgccgttgtcgtgatcgctatcgtgtgcaacaggcgcggtttcgagcgcgcagattctgaatatacagacaagcttcagcattatacatcgggtcatatgaccccaggtatgaagatctacatagacccctttacgtacgaagatcccaacgaagccgtccgggagttcgccaaggagatagacatctcctgcgttaagatcgaacaagtgattggagcgggtgagtttggtgaggtatgctcagggcacctgaagcttcctggcaaaagagaaatctttgtcgctatcaagacactgaagagtggatatacagagaagcagagacgagatttcctgagcgaagctagcataatgggtcagtttgatcaccccaacgttatccatctggagggagtggtcaccaaaagcaccccagtcatgattatcactgaattcatggagaacgggtccctcgactcttttcttagacaaaatgacggccagtttaccgtaatccagctcgttgggatgttgcgtgggatcgcagcgggcatgaagtacctggccgatatgaactatgttcaccgagatcttgccgctcgcaacatcctggtgaacagtaaccttgtctgcaaggtgtctgactttgggttgtctaggtttctcgaggacgatacaagcgaccctacatatacatcagcgctggggggtaagattcctattaggtggacagcgccggaggctattcagtacaggaaatttacatcagcgtcagatgtctggagttacggtatagtgatgtgggaagttatgagctatggtgaacgaccatactgggatatgaccaaccaagacgtaattaatgcgatcgagcaagactaccggctgccaccaccaatggattgtccttctgcccttcaccagctgatgctcgactgttggcagaaagatcgcaaccatcgcccaaaattcgggcagattgtgaatactctggacaagatgatcagaaatcctaatagcttgaaagccatggccccactgagctccggcattaacttgccactactcgacaggaccatacccgattatacttccttcaatacggtagatgagtggctggaggcaatcaaaatgggtcagtataaggagagcttcgccaatgccgggtttaccagtttcgacgttgtttcacaaatgatgatggaagatattctacgcgttggagtgactctggcgggccatcagaagaaaattctgaactcaatccaggtaatgagagcccagatgaatcagattcagtctgtcgagggccaaccgcttgctcggagaccccgggcaacaggacgcaccaagcgttgccagccccgtgatgtcacaaaaaagacttgcaactctaacgacggcaaaaaaaaaggaatggggaaaaaaaagaccgaccccggcagaggtagggagatccaagggatcttcttcaaggaagatagccacaaagagagtaacgattgttcatgcggcggctag

SEQ ID NO: 23964 - DNA, 1449 bp, Artificial Sequence
  Description of Artificial Sequence: Synthetic coding sequence
atggccctgcggcggctgggcgccgccctgctgctgctgcccctgctggccgcagtcgaagagactctgatggactccacgaccgctaccgctgaactcggatggatggtgcacccacccagcgggtgggaggaggtcagcggctatgatgagaacatgaacactataaggacatatcaggtgtgtaacgtgtttgaatcatctcaaaataattggctcagaacaaaatttatccgccgaagaggtgcccaccggatccacgtggaaatgaaattcagcgtgcgagactgcagttcaatcccttctgtccctgggagctgtaaggagacattcaacctatactattacgaggctgactttgattcagcgaccaagacgtttccaaattggatggaaaacccctgggtcaaggtcgataccatcgccgcagacgaatctttctcccaggtcgacctggggggccgcgtgatgaaaatcaatacagaggtcaggagctttggacccgtgagccgttccgggttctatcttgcgttccaagattatgggggctgtatgtctctcatcgccgtacgggtgttttatcgcaaatgtccccggataattcaaaatggggccatcttccaggagactttatcgggtgccgagtccacctcactggtcgccgccaggggcagctgcattgcaaatgccgaagaagtcgatgttcccattaaactgtactgtaacggcgacggcgagtggctggttcccataggccggtgtatgtgtaaagcgggcttcgaagcggtggagaatgggacagtctgcaggggctgccccagcggtacattcaaggctaaccagggcgacgaggcttgtacacattgccccatcaactccaggaccacctccgaaggcgcaaccaactgcgtatgtaggaatggctattatcgggccgatctggaccctttggatatgccatgtaccaccatcccgtctgccccgcaggccgtcatctctagcgtcaatgaaacctcgctgatgttggagtggacaccacccagggactctggtgggagggaggacctagtgtacaacataatctgcaaatcttgcgggtcaggaaggggagcatgtactcgatgtggtgataatgtccaatacgcaccccgtcagctgggacttacagaaccgagaatctacatttccgacttgctcgcacacacccagtacacatttgagattcaggcagtgaacggagtcacggatcagtcacctttttcaccacagtttgcctccgtgaatatcacgaccaatcaggctgccccaagcgccgtcagtattatgcatcaggtgagtcgcacagtggattccattacgctgagctggagtcagcccgaccagcctaatggggtcatcctggattatgagctccagtactacgagaaaatgaagacgcagagatcttag

SEQ ID NO: 23965 - DNA, 2964 bp, Artificial Sequence
  Description of Artificial Sequence: Synthetic coding sequence
atggagctgcgggtgctgctgtgctgggccagcctggccgccgccctggaggaaactctccttaatacaaaactggagaccgccgatttgaagtgggtgacctttccgcaggttgatggccagtgggaagagctttcaggcctagatgaagagcagcattctgtcaggacatacgaggtgtgcgatgtccaacgcgcgcccggccaggcccattggcttagaactggatgggtgcctcggcgaggagctgtacatgtgtacgccacacttcggttcacaatgcttgagtgtctcagcttacccagggccggtcgcagctgcaaggagactttcactgtgttctactatgaaagcgacgctgataccgcaaccgcgctgacaccagcatggatggaaaacccatacatcaaagtagacactgtggccgccgaacacctgactcgtaagcgccctggcgctgaagcaactgggaaggtgaacgtgaagacattacggctgggccccttaagcaaagcgggcttttacttggcttttcaggatcagggggcgtgcatggcgctcctgtcccttcacctcttctacaaaaaatgtgcccagctgactgtcaatctgactagattccccgaaaccgtaccgagggaactggttgtccctgttgcaggttcatgtgtggtcgacgcggttcccgcccctggaccttccccatcactttactgtcgggaagatggccaatgggctgagcagcctgttaccggttgctcatgcgcccccggcttcgaagccgctgagggtaatacaaagtgtcgcgcctgtgcccaggggacatttaagcctctgagtggggaggggagctgtcagccatgccctgcaaatagccactccaatacaattggctcggcagtctgtcagtgccgcgtaggttacttccgcgccagaactgaccccagaggtgctccgtgtacaacaccgccctccgccccacgatctgtcgtgagccgcttaaatgggtcgtctctgcatctcgaatggtccgcaccgctcgaaagcggagggcgggaagacctaacctatgccttgcgttgccgggaatgccgacccggggggtcttgcgcaccttgcggcggcgacctcacctttgacccaggccctcgggacctcgttgaaccatgggtcgtagtgagggggctcaggcctgatttcacctacacatttgaagtcacggcgctgaacggcgttagctccctcgccaccgggccggtcccctttgagcctgtaaatgtcacgaccgatagggaagtgccgcctgccgtctcagatatcagagtgactcgcagtagtccctcttctctcagtcttgcctgggctgtgccccgggctcccagcggtgcggtacttgactatgaggtgaagtatcacgaaaagggtgccgagggcccctcgtcagtgcgtttccttaagactagtgagaatcgtgccgaactgaggggcctgaagcgtggggcgtcatacctggttcaggtccgagccagatctgaggcagggtacgggccgttcggccaggagcatcactcccagacacagttggacgaatccgaaggatggcgggagcagctggcgctgattgctggcaccgccgtagtcggagtagttctggtcctggtcgtgatcgtcgtcgccgtgctgtgcctacggaaacaatctaatggacgcgaggcggaatattccgataagcatggacagtacttaataggccacggaacgaaggtctacatagacccgttcacttacgaagatcccaacgaggctgtgcgtgagttcgccaaggaaatcgacgtttcttatgtgaaaattgaggaggtgattggggccggggagttcggcgaagtctgtcggggcagactgaaagcccctggcaaaaaagagtcctgtgtggctatcaaaacgcttaagggtggctacaccgaacgtcaaaggcgcgaattcctcagtgaagcctcgatcatgggacagtttgagcatccaaatatcatcaggttggagggtgtagtgacaaactccatgcccgtaatgattcttacggaatttatggagaatggggccctggactcctttctccgcctgaacgatggacagttcactgtaatccagctggttgggatgctgcgtgggattgcatccggcatgcgatatctcgctgagatgagttacgtccaccgcgatcttgctgctagaaatattctggtcaactccaaccttgtgtgtaaggtctccgattttgggctgtcacgcttcttggaggaaaattcctccgatcccacatacacatccagcttgggcggaaaaatcccaatcagatggacagctcccgaggcaattgccttcaggaaattcactagtgcaagcgatgcttggagttacggcattgtgatgtgggaggtgatgtcatttggtgaaagaccatactgggacatgtctaaccaggacgtgatcaacgccatcgaacaagattataggttacccccaccgccagactgcccgacttctcttcatcagctgatgctggactgctggcagaaagaccgcaacgcaagacccagatttccacaggtggtcagcgccttggacaaaatgatcaggaatccagcctctctcaagattgtggcaagggagaacggtggagcatcccaccccctgctggatcaaaggcagccacattactccgcttttgggagtgtgggggagtggctccgtgcgatcaagatgggccgttatgaggaatcattcgcagccgccggattcggctctttcgagctggtgagccaaatctccgctgaagatctgctgcgaatcggagtaacactagcaggacaccagaagaaaatcctggccagtgtgcagcatatgaaaagccaggccaagcccggtacccctggcggaactggcggaccggctccacaatactag

SEQ ID NO: 23966 - DNA, 2808 bp, Artificial Sequence
  Description of Artificial Sequence: Synthetic coding sequence
atggagctgcgggtgctgctgtgctgggccagcctggccgccgccctggaggagacattattgaacaccaaactggaaaccgctgatctcaaatgggtgaccttcccccaggtagacggacagtgggaggagctttctggactggacgaagaacagcactccgtgagaacgtacgaggtgtgtgatgtgcagagggcccccgggcaagcccattggcttagaacgggttgggtgccgaggagaggagccgtgcacgtttatgccactcttcgattcactatgttggagtgcttatcactacccagggcaggaagatcttgtaaggaaacgtttacagtgttctactatgaatcagacgcagacaccgccactgctcttacccccgcgtggatggaaaacccgtacattaaggtcgacacggtcgccgcagagcacctgacgaggaaacgccctggtgcggaggccactggaaaggtgaacgtgaaaaccctacgtctcgggccgctcagcaaggctggcttttacctggccttccaggatcaaggcgcctgcatggctcttctctccctccatctgttttataagaagtgtgcccagttgaccgtcaatctaactaggttcccagaaacggtaccgagggaactcgtggttccggttgcaggttcctgcgtggttgacgccgttcccgcgcctggtccaagcccatccctgtattgtcgtgaagacggtcaatgggcagagcaacccgtgacggggtgcagttgtgctcccggctttgaagccgccgaggggaacaccaaatgtagggcatgcgcccagggcacattcaagccactgtccggagagggatcctgtcagccctgtcccgctaacagtcactcaaatacaattggcagcgccgtgtgccagtgcagggtggggtacttcagggcccgtaccgatccacggggcgccccctgtactactcccccttcagcaccccggtccgtggtgagccgtctcaatggaagttctcttcaccttgaatggtccgcacccctggaatccgggggccgggaggatttaacttatgcactgagatgtagggagtgcaggccaggaggcagttgcgctccctgtggcggcgatctgaccttcgatccaggcccgagggacctggttgaaccgtgggtggttgtccggggtctgcgacccgatttcacttacactttcgaagtgactgcactgaacggcgtgagcagcctggctactggaccagtgccatttgagccggtgaatgttactaccgatcgagaggtccctcctgccgtcagcgatatccgcgtcacgagatcatctccctcatctctgagtctggcctgggcggtacctcgggctccttctggggctgtcctggattacgaggtgaagtaccacgagaaaggcgccgaaggtccaagctccgttagattcctaaaaacaagcgaaaatagggctgagcttaggggcctcaagcgcggtgcctcttacctggtgcaggtgagagccaggtctgaggccgggtatggcccctttgggcaggagcaccattcgcagactcaacttgacgagagtgaggggtggcgagagcagctggctctgattgccggcaccgcggtcgttggagttgtgttagtcctcgtggtgattgtcgtggcggtgctctgtcttcgcaaacagtcaaatggtagagaggccgagtactccgataaacacgggcagtatttaattgggcacggcactaaagtatatatagacccattcacttacgaagaccctaatgaggccgttcgcgaattcgctaaagagatcgacgtcagttatgtgaaaattgaagaggttattggggccggcgagttcggggaagtgtgcaggggcaggctcaaggccccagggaagaaggagagctgtgttgcgataaagactctgaaagggggttacaccgagcgtcagcgtagggaattcctaagcgaggcctctatcatgggacaatttgagcatccaaacattatcagactagagggcgtcgtgacgaactctatgcccgtcatgatcctgacagaattcatggagaacggtgctctggattcattccttcgactaaacgatggccagtttactgttattcagttggttggcatgctgcgaggtatcgcatccggtatgagatacctcgctgagatgtcctatgtccaccgtgacctggccgcgcgcaacatcctcgtaaactctaacctcgtctgcaaagtgtctgacttcggactatcaagatttctggaggagaattcttctgatcccacatatactagctcattgggaggcaaaatccccattcggtggactgcccctgaggctattgctttccggaagttcacatccgcatctgatgcctggagctacggaatcgttatgtgggaggtgatgagcttcggagagcggccttactgggatatgtcaaatcaagacgtgataaacgccatcgagcaggattaccgccttcctcccccccccgactgcccaacttcgttgcatcagcttatgctggattgttggcaaaaagatcgcaacgcgcggccgaggttcccccaggttgtctctgccctggacaagatgataaggaacccggcatctcttaagatcgttgccagagaaaatgggggtgacttactccgcataggagtaacattggctggacaccagaaaaagatcctggcctcggtccagcacatgaagtctcaggcaaagcccggaacaccaggcggcacagggggcccagcaccacagtattag

SEQ ID NO: 23967 - DNA, 552 bp, Artificial Sequence
  Description of Artificial Sequence: Synthetic coding sequence
atggagttcctgtgggcccccctgctgggcctgtgctgcagcctggcagcagccgatagacataccgtattctggaatagttccaatccaaaattcaggaacgaagactatacaatccacgtgcagttgaacgactacgtggacattatttgtccccattatgaggaccatagtgtggcagatgctgccatggagcagtacatcctgtatttagtggaacacgaggaataccagttgtgtcagccacagagtaaggaccaagtccggtggcagtgtaacagacctagcgcgaaacatggtcctgaaaaattgtccgaaaaatttcagcgctttaccccttttactctgggcaaagaattcaaggagggccactcttactactacatatcccacagtccgcaagcgcatgacaatccccaggagaagcgcctggctgccgacgaccctgaggtacgcgtgctccactcaatcggacattcggcagctccgcgattatttccactcgcttggacggtgctcctgctgcccctcttgctgttgcagaccccctag

SEQ ID NO: 23968 - DNA, 618 bp, Artificial Sequence
  Description of Artificial Sequence: Synthetic coding sequence
atggagttcctgtgggcccccctgctgggcctgtgctgcagcctggccgcagcggatcggcatacagtgttttggaactcctctaatccaaagttccgcaacgaggattataccattcatgttcagctgaatgactatgtcgatatcatctgtcctcattacgaggaccatagcgtcgcggatgccgccatggagcagtacattctgtatctcgtagagcacgaagagtatcagctgtgccagccccagtccaaagatcaggtgcggtggcaatgtaaccgtcctagcgcgaagcatggccctgagaagctttccgaaaaattccagcggtttactccctttaccctaggaaaagaattcaaagaggggcactcttattactatatcagtaaacctatccatcagcacgaggatagatgcctgcgactgaaagtcacagtctcgggaaaaattacacatagccctcaggcccacgataatccccaggagaagaggctcgccgccgacgatcctgaggttcgcgtgctccattctatcggacattccgctgcccctaggctgtttccattagcttggacagtgcttctgttgcccctgctgctgcttcagacaccgtag

SEQ ID NO: 23969 - DNA, 1002 bp, Artificial Sequence
  Description of Artificial Sequence: Synthetic coding sequence
atggccgtgcggcgggacagcgtgtggaagtactgctggggcgtgctgatggttctttgtcgaacggccatctctaaatctattgtgctcgaaccaatctactggaattcctccaactccaagttcctgccgggccaaggcctcgtgctgtatccccaaattggtgataaacttgacatcatctgtcctaaggttgactcaaagacagtgggtcagtacgaatactataaggtttatatggtggacaaagaccaggccgacaggtgtacaataaagaaagaaaatactcctctgctgaattgtgctaaacccgatcaggacatcaagtttacaataaagtttcaggagtttagcccaaacctgtggggcctggaatttcagaagaacaaggactattatattattagcacatcgaacggatctctcgagggcttggacaaccaggaggggggtgtctgtcagacacgggctatgaagattcttatgaaggtgggtcaggacgcgtctagtgcagggtccacccggaataaagaccctacccggcgacctgagctggaagcagggactaatggtaggtcctctaccacttctccttttgttaaaccgaacccagggtcttccacagatggtaacagcgctggtcactcaggtaataatattcttggatctgaagtggccctgttcgctggcattgcttcaggctgtatcatctttatcgtaattatcattaccctcgtggttttgctgctgaagtataggcgtaggcatagaaagcatagcccccagcacactactactctgtcattgagcaccctggctacacccaagcgtagcgggaataataatggaagcgaaccctccgacatcattattcccttgcgcaccgccgattccgttttttgtccccactacgagaaagtgtccggcgattacggccaccccgtctacatcgtgcaggagatgcccccgcagagtcctgccaacatatactacaaggtctag

SEQ ID NO: 23970 - DNA, 3624 bp, Artificial Sequence
  Description of Artificial Sequence: Synthetic coding sequence
atgctgctgaccctgatcatcctgctgcccgtggtgagcaagttcagtttcgtgagtctcagtgcccctcagcactggagctgtcctgaaggaacacttgccggtaacggaaattccacgtgcgtaggccccgcccccttcctcatcttcagtcatggaaactcgatattccgcatcgacaccgagggaaccaattacgagcaactggttgtggacgccggggtttcagtaataatggactttcactataatgagaagcgaatctactgggttgatctggagaggcagctcttacagagagtattccttaatggctcacgccaggagagagtgtgcaatatcgagaagaatgtaagcggaatggcgatcaattggattaacgaggaagtcatctggtcaaaccagcaggagggcattataacagtgacagatatgaaggggaacaattcacatatcctgctgagcgccctcaaatatcctgccaatgtcgccgttgatccagttgaacggttcatcttctggtcctctgaagtggccggttccctgtatcgcgccgaccttgatggtgtcggcgtgaaggcgctgctggagacttctgagaagattaccgccgtgtcgctagacgtcttggacaagcgcttattttggatccagtacaatagagaagggagtaacagcctcatctgtagttgtgattacgatggtggatccgtccatatttctaagcatccaacgcagcacaacctctttgcaatgtcactctttggggaccggattttttatagtacgtggaagatgaaaacaatttggatagctaacaagcacactggtaaggacatggtccggatcaacctgcacagctcctttgtgccactgggggaactgaaggtggtgcatcccttagcccagcctaaagcagaggacgacacctgggagcctgaacagaaactgtgtaagctaagaaaagggaactgcagctccaccgtttgtggccaggacctgcagagtcacctgtgcatgtgtgccgaaggctatgctctgtcaagggataggaaatactgtgaggatgtgaatgaatgcgccttctggaatcacggatgcacgctgggctgcaaaaacacacccggaagctactattgcacctgcccggtgggattcgtgctgctgccagacggaaagagatgccatcagctcgtgtcatgcccccgcaatgtctcagaatgttctcacgattgcgtgctgacatctgagggtccgttgtgcttttgcccagaaggctccgttctggagcgcgacggaaagacttgcagtggatgcagctcccctgacaacggcggctgttcccagctttgcgtgcctctgtcgccagtctcatgggagtgcgattgctttccaggatacgaccttcaactggatgagaaaagttgtgctgccagcggaccgcagcccttcctgctctttgcaaactctcaggatatccgccatatgcactttgacggtactgactatgggacactgctgtctcagcagatggggatggtctatgcactcgaccatgacccagtggagaacaaaatctattttgcccatacggctctcaagtggatcgaaagagcaaatatggatggctcacaacgagagaggctgatcgaggaaggggtggacgtacccgagggactagccgttgattggatcggccgtagattttattggacagatcgcgggaagtcactgatcggccgaagcgatctgaatgggaaacgttccaaaatcatcactaaagagaacatctcccagcctcgtggcatagcagtgcatcccatggccaagaggctgttttggacggacaccggcataaacccgcgcattgaaagttcctcactgcagggcctaggtcggctggtaatcgcaagttccgatctaatttggcctagtggcataacaatagactttctgacagataagctctattggtgtgatgctaagcagagcgtaatagagatggctaatctggatggcagcaagaggcgacgccttacccagaatgacgtggggcatccgttcgccgttgccgtgttcgaggattacgtctggttttctgactgggcaatgccctctgtgatgcgggtgaacaagcgaacggggaaagatcgagtgcgtctgcaggggtcaatgctcaaaccgtcatcactggtcgtcgttcacccacttgccaagcctggcgctgatccttgcctgtatcagaatggcggttgtgagcatatctgtaagaagcgccttggaaccgcctggtgcagctgcagagaggggttcatgaaggcttctgacggcaaaacctgcctcgccctcgatggtcaccagctgctagctgggggagaggtggacctgaagaaccaggttacgccattagacatcctgagcaaaacccgggtgtcagaagacaacataaccgagagccaacacatgcttgtagccgagattatggtttctgatcaggatgattgtgcacctgtgggatgcagcatgtatgcacgatgtatcagcgaaggtgaagacgcaacctgccagtgcctgaaggggtttgccggcgacggaaagttgtgttccgacatcgacgaatgcgagatgggcgttcccgtttgcccccccgcttccagtaagtgtattaataccgaagggggttacgtctgccggtgctctgaaggataccaaggggatggaatccattgcctggacatcgacgaatgtcagcttggtgaacactcatgcggcgagaatgcttcctgtacgaataccgaaggcggctacacctgcatgtgtgccggacgcttgagtgagcccggtcttatctgcccggacagtacaccccctccacacctgcgggaagacgatcatcactactcggttagaaactctgacagcgaatgccccttgtcacacgatggctattgccttcatgacggcgtttgcatgtatatcgaagcgctagacaaatacgcctgcaactgtgtggtaggatacattggcgagcgatgccagtaccgagacctcaagtggtgggaactcagacacgcgggccacggacagcagcaaaaggtgattgtggtagctgtgtgcgtggttgtcttggtcatgcttctgcttctcagtctatggggtgcccactactaccggacccagaaactcctatccaagaaccccaaaaatccctatgaggaatcatctcgggatgtgcggagcaggcggccggcagacaccgaagacggaatgagctcctgtccccagccttggtttgtggtgatcaaagaacatcaggatctgaagaatggcggccaacccgtggccggggaggacggacaggctgccgatggatcgatgcagcctacaagctggcggcaagaaccacagttgtgtggcatgggtaccgagcaaggctgctggatacctgtctcctctgacaagggcagttgcccgcaggttatggagagatccttccacatgccctcctacgggacgcagaccctggaaggcggagttgagaagccccacagcctgttgtcagccaatcctctgtggcagcagagggccctggatccaccacatcagatggaactaactcagtag

SEQ ID NO: 23971 - DNA, 3501 bp, Artificial Sequence
  Description of Artificial Sequence: Synthetic coding sequence
atgctgctgaccctgatcatcctgctgcccgtggtgagcaagttctcattcgtatctctgagcgccccccagcactggtcatgccccgaagggaccctagcaggaaacggcaacagcacctgcgttggacctgccccattcctgatttttagccatggtaacagcatcttccgcatcgacacagaggggaccaactacgagcagcttgttgtcgatgccggtgtgagcgtcatcatggacttccactataacgagaagcggatatattgggtcgaccttgaacgccagttgctgcaacgggtgttcttaaacggaagtcgtcaggaacgcgtgtgcaatatcgagaagaatgtaagtggcatggccatcaattggatcaatgaagaagtgatctggtcaaatcaacaggagggcatcataacagtgacagacatgaagggtaataatagccatatattgctttcagccctcaaatatccagcaaacgtcgctgtcgatcctgtagaacgatttatcttctggagttcagaagttgccgggtctctgtatagagccgacttagacggcgtcggggtgaaggctctcctggagacatctgaaaagatcactgccgtgtctttggacgtgctggataaacgtttgttttggatccagtataacagagaggggtcaaacagtctgatttgctcctgcgactatgatgggggatctgttcacatctcgaaacatcctacccagcacaacctgttcgctatgagcctgtttggtgaccgaatcttctactctacgtggaaaatgaagaccatctggatcgcaaacaaacacaccggcaaggatatggtgcgcattaaccttcattccagttttgttccactgggtgaactcaaggtcgttcacccattagcccaaccaaaagctgaggacgatacatgggagccagagcagaagctctgcaagctgcggaagggaaactgcagctccactgtttgtgggcaagacctgcagtcacacctgtgtatgtgcgcagagggctatgcgctgtcccgagatcgcaaatactgtgaagacgttaacgaatgtgcgttctggaaccatggatgtactttgggctgtaaaaacaccccgggttcttactattgtacctgtccagtagggttcgttctgctgccagatggcaagcggtgtcaccagcttgtgagctgtcctcggaacgtgtccgagtgctcacatgactgcgtgcttacttccgagggtccattatgtttttgcccagaggggtcagtgcttgagagggacggaaaaacatgttctggatgtagcagccctgataatggggggtgctcccaattgtgcgtgcccctgtctccagttagctgggaatgtgactgttttcccggctatgacctacaactggatgaaaagagctgcgctgcctctggacctcagccctttctgttgtttgctaatagccaggacattcgccacatgcactttgacggcaccgattatggcactcttttatcacagcagatgggaatggtctacgcgttggatcatgaccccgtcgagaacaagatctactttgcacatactgcgctgaaatggattgagcgcgctaacatggatggaagtcaacgagagcgcctcatcgaggaaggagtagacgtgcccgaaggccttgcagtcgactggataggccgccggttttactggactgatcgaggaaagagtctgatcggcaggtctgacttaaatggcaaaaggtccaagatcatcacaaaggagaatatctcgcagcctcggggtattgctgtacaccctatggcgaaacgtctcttctggacagacacaggcataaacccgagaatcgagtcatccagcctgcagggcttagggcgactggttattgcttcctctgatctgatctggccaagcgggattactatcgactttctcacagataagctgtactggtgtgatgcaaagcagagcgtcattgagatggcaaatctcgacgggtccaagcggcggcgcctcacccagaacgacgttgggcacccctttgccgtcgccgttttcgaggactatgtctggttctccgattgggctatgccatccgtgatgcgggtcaacaaacgtacaggaaaagatcgggttcgcctgcagggtagcatgctgaagccctcaagcctcgtggttgtgcatccactggcaaagcccggggctgacccctgtttatatcaaaacggaggctgcgaacacatatgcaaaaagcggttgggcacagcttggtgtagctgccgggaggggttcatgaaagcctccgacgggaagacttgtttggcactagacggtcaccagctgctcgccggcggagaggtggacctcaagaatcaggtcacaccactagacatcttatctaagaccagagtcagcgaagataacatcaccgagagtcagcatatgctcgtggccgagatcatggtaagcgatcaggacgattgcgccccagttgggtgctctatgtatgcacgctgtatcagcgagggagaggacgctacctgccagtgtctcaaaggcttcgccggggatgggaaactgtgttcagacatcgatgaatgtgagatgggtgtgcccgtgtgccctcccgcttctagtaagtgtataaacactgaggggggttacgtgtgtcgatgctccgaagggtaccaaggagatggcatacattgcttagattccacacctccacctcatctgcgcgaagacgaccaccattactcagtgcgtaatagcgactcagaatgtccactcagtcacgatgggtattgtcttcatgatggcgtgtgtatgtatatcgaagctctcgacaaatacgcgtgtaattgtgtggtgggctacattggggagcgttgccaataccgggacctcaaatggtgggagttaagacacgccggccacggtcagcagcagaaggtgatagtggtcgctgtgtgcgtcgttgtgctagtgatgctcttacttctttctttgtggggcgcgcattattataggacgcagaagctcctctccaagaaccctaagaacccctatgaggagtcctctagggatgtgcggtccaggaggccagcggatacagaggacgggatgagttcctgcccccaaccatggtttgttgtgattaaagagcaccaagacctcaagaatggagggcagccagtggcaggcgaagacgggcaggcggccgacggtagtatgcagcccacgtcctggcgacaggagcctcagctgtgcgggatgggtacagaacaaggctgctggatccccgtgtcttctgacaaaggctcctgcccacaggtcatggaacggagttttcacatgcccagctatgggacacagacactggaggggggagtcgagaaaccacacagccttctcagcgcaaatccactgtggcaacagcgcgccctggatccccctcatcagatggagctcacacaatag

SEQ ID NO: 23972 - DNA, 3498 bp, Artificial Sequence
  Description of Artificial Sequence: Synthetic coding sequence
atgctgctgaccctgatcatcctgctgcccgtggtgagcaagttctctttcgtgagcttgtctgcgccacagcactggagctgccccgaggggacgttggcagggaacggtaattctacctgcgtgggacctgcaccctttttgattttctctcacggcaacagtattttcaggatcgacactgaaggcaccaactatgagcaacttgtagtcgacgcaggcgtctcagtgatcatggattttcactacaatgagaaacgcatttactgggtggacctcgaacggcagctcctgcaaagagtgttcctcaatggttcgcgacaggagagagtgtgcaacatcgagaagaatgtcagcggaatggcaatcaattggataaatgaggaagtgatctggtctaaccagcaggagggcataataacagtaacagatatgaaaggcaataactcccacatccttctctcagctctgaaataccccgcaaatgttgctgtagacccggtggaacgcttcatcttttggtctagcgaagtggccggttccctatacagagctgatctcgatggtgtgggcgtgaaagccctgttagaaacctcagaaaagattaccgccgtgtccctggacgttttggacaagcgactgttctggatacagtataatagagaaggttccaactccctcatttgctcctgtgactacgatggtggttccgtccacattagcaaacaccctacccagcacaatctgttcgcaatgtctctgtttggtgaccgtattttctacagtacatggaagatgaagaccatctggatcgctaataagcacacagggaaagacatggtgcgtattaacctgcacagcagttttgtcccgctgggagaactgaaggtcgtgcatcccttggcacagccaaaggcagaagacgacacctgggagcccgatgtcaacgagtgcgccttctggaaccacggttgcaccttgggatgcaagaatactccagggagctactactgcacgtgtccagtgggatttgttctgctgcccgacggcaaacgatgccaccaactcgtgagctgccccaggaacgtttcggagtgtagccacgattgtgtgttgacatctgaaggtcctctgtgcttttgtcccgaaggctctgtgcttgaaagagatggtaaaacttgctctgggtgctccagtccagataacgggggctgctcacaattgtgtgtgccactttccccagtaagctgggaatgcgattgcttccccggctacgaccttcagttggatgaaaaaagttgcgccgcaagtggaccccagccttttctgttattcgctaattcccaggatatcagacatatgcattttgatggaacagattacggtacactgttgtctcagcagatgggaatggtctatgcacttgaccacgaccccgtcgagaataagatctacttcgctcatacagcactgaagtggatcgagcgtgcaaacatggatggcagccagagagagcgattgatcgaagagggagttgatgtgcctgaaggcctggcagtggactggatcggtaggaggttttattggacggatcggggaaagtccctcattggcagatcagatttgaacggcaagcgctctaaaataatcaccaaagagaacattagccagccgcggggaatcgcagtgcaccccatggccaagcggctgttctggacagatacaggtattaatccaagaatcgaaagcagcagtttgcagggcttaggtagactggtgattgcctcctctgatctgatctggcctagcggcattacaatcgatttcctcacagataaactatattggtgcgacgccaaacaatcagtaatagaaatggctaatctggacgggtcaaagaggcgtcgactgacccagaatgacgtgggccacccattcgcggtggcggtgtttgaagactacgtgtggttttctgactgggcgatgccttctgtgatgagggtcaacaagcgcaccggaaaggatcgcgtgaggctccagggctccatgttgaaaccgagctccctggtggttgtgcatcctctcgcaaagcctggggccgatccctgtctttaccagaacggaggctgcgagcacatttgcaagaagcggttgggaacagcatggtgtagttgtagagaggggtttatgaaggccagcgatggaaagacgtgcttggccttggatggacatcagctcctggctggaggagaagtagacctgaaaaaccaggtaacacctctggacatcctttcgaagacacgcgtctccgaagacaatataacagagtcccagcacatgctcgttgccgagatcatggtgtccgatcaggatgattgcgcccccgtgggatgttccatgtatgcccggtgcattagtgaaggagaggacgccacttgccagtgtctgaagggattcgcaggtgacggaaaactgtgttcagatattgacgagtgcgaaatgggagtccctgtttgcccgccggcgagctcaaagtgcattaacactgaaggggggtatgtctgcaggtgcagcgagggttaccaaggcgatggaatccattgtttagacatcgatgagtgccagctcggcgagcactcttgcggcgagaatgcatcttgtactaatactgagggagggtatacctgcatgtgcgccgggcggctgagtgagcctggcttaatatgccccgatagcacccctccgccccaccttcgggaagatgatcaccactattcagtgcgcaatagcgattctgagtgtccactcagccatgacggatactgcctgcatgacggggtctgcatgtacatagaggccttggataagtacgcttgtaattgcgtggttggttacattggcgaaaggtgtcagtatcgcgatcttaagtggtgggagctccggcacgcgggccacggccaacagcaaaaagtgatcgtggtcgccgtgtgtgtcgtcgtactggtgatgttgctgctgctgtcattgtggggtgcacactattatcgcacgcaaaagttgctgagtaagaacccgaagaatccatatgaagaatcaagcagagacgtccgaagtaggcgcccagcagatactgaggacgggatgagcagctgtcctcaaccttggttcgtggtgatcaaggagcatcaggacctaaagaatggcgggcagcccgtggccggagaggacggccaagcggccgatggtagcatgcagccaaccagttggcgacaggagccgcagctgtgtggaatggggaccgaacaggggtgttggattcctgtttcttccgataaggggagctgccctcaggtgatggaacgctcttttcacatgccaagctacggaacacagaccctggagggaggcgtggaaaaaccccacagcctcctgagcgccaatccactctggcagcagcgcgcgttagacccgccccatcagatggagctgacccagtag

SEQ ID NO: 23973 - DNA, 3633 bp, Artificial Sequence
  Description of Artificial Sequence: Synthetic coding sequence
atgcggcccagcggcaccgccggcgccgccctgctggccctgctggccgctctctgccccgcatctcgggccctcgaggagaaaaaggtttgccaggggactagtaataagttgacccagctaggaactttcgaggaccactttctctcactccaacgcatgtttaataactgtgaagttgttctgggtaatctcgagatcacatatgttcaacgcaactacgacctctcctttctaaaaacaatccaggaggtcgccgggtacgtcctgatcgcattgaacacggtggagcggatccctttggaaaatctgcagatcatccgcggcaacatgtactacgaaaattcctatgctctggccgtcctaagcaactacgatgccaacaagacgggattgaaagagctgccaatgaggaacctgcaggagatcctccacggagccgtccgattctcgaacaatccagccctatgcaacgttgagtccatccaatggagggatattgtctcatctgacttcctgtctaatatgagtatggactttcaaaatcatctaggatcatgtcagaaatgtgatcccagttgccctaatggaagctgttggggcgccggcgaggaaaactgccagaagcttaccaagattatttgtgctcagcagtgcagtggccgctgtagaggcaaatccccgtcagactgttgccacaaccagtgtgctgctgggtgtacaggaccccgagagagtgactgtctggtctgccggaagtttagagacgaggctacatgtaaggacacttgtccaccactgatgttatacaaccctaccacatatcaaatggatgtcaacccggagggcaagtacagctttggagccacatgtgtgaagaaatgccctcggaattatgtggtcacggatcatgggtcctgtgtgagagcctgcggtgctgatagttatgagatggaagaggatggtgtgcggaaatgtaagaagtgtgaaggtccttgccgcaaggtctgcaacggcatcggaataggggaattcaaggatagtctaagtatcaatgccacaaatataaaacactttaagaactgcacaagcatttcaggagacctgcatattctgccagtcgcttttcggggggatagtttcacacatacaccccccctggatccccaggagcttgacattctgaaaaccgtgaaggagattaccggatttctgcttatacaggcttggcccgagaaccgaacagatttgcatgcctttgagaatttggaaatcatcagagggcgaaccaaacagcatggacagttcagcctggcagtggtttcactgaatataaccagtctgggactgaggtcacttaaagagatatcagacggtgacgtgataattagcggcaacaaaaacctgtgttacgcaaatacaattaactggaaaaagctattcggaactagcgggcagaaaactaaaattatttccaatcgcggagagaacagttgcaaggccacagggcaagtgtgtcacgccctgtgcagcccggagggctgttggggtccagaaccaagagattgtgtgtcgtgtcgcaacgtgtcgaggggacgcgagtgtgtggacaagtgcaacctgctggaaggcgagccccgggagttcgttgagaattcagagtgcatacagtgccatcccgagtgcctgcctcaagctatgaatatcacttgcaccggccgcggcccagataactgcatccagtgcgctcattatatcgatggcccccactgtgtcaagacatgccccgccggcgtcatgggtgaaaacaatactctggtgtggaagtatgctgacgccggtcacgtgtgtcacctgtgtcaccctaactgtacctacggttgtaccggtcccggattagaaggttgccccactaacggccccaagatcccctctattgctacaggaatggtgggtgcgctgctccttctgctggtggtagcacttggtatcgggctgtttatgaggcggcggcacatcgtgagaaaacggactctccggcggcttctccaagagcgtgagctggtggagcccctgaccccctctggcgaggctcctaaccaagccctcctacggatactgaaggagaccgaatttaaaaagattaaagtgttaggatccggggccttcggcaccgtgtacaagggcctctggattcccgagggcgagaaggtgaagatacctgtggccatcaaggaactgcgggaggctacatccccaaaagccaataaagagatcctggacgaagcatacgtaatggccagtgtcgacaatccccatgtttgcagattgctgggcatatgcctcacctcaacagtacagttgatcacacaactgatgccatttgggtgtctcttagactatgtgagggagcacaaagacaacatcgggagtcagtatctcctaaactggtgcgtgcagattgcaaaagggatgaattaccttgaggatagaaggctggttcatcgtgatctagcagcgaggaacgtgttagtgaagactccccagcacgtgaagattacagattttggcctggcaaaactcctcggagccgaggaaaaggagtaccatgccgaggggggaaaggtccctataaaatggatggctctggaatcaatcctgcaccgaatctacacccatcagagtgacgtgtggtcgtatggagtcaccgtctgggaactcatgacattcggctctaaaccttatgatgggatcccggcctccgagatttcatccatcttggaaaagggtgagcggctcccccagccccccatctgcaccatcgatgtgtatatgattatggtcaaatgctggatgatcgacgctgattcgcgcccaaagtttcgcgaattgatcattgagttcagcaagatggccagagatcctcaacggtacctcgtcatacagggggatgagcgcatgcacctgccttccccgaccgactcgaatttttacagagctctgatggacgaggaggatatggacgacgttgtggatgcagacgagtatctgattccacagcagggctttttcagttcaccttccacatcacgtacccccttgctctcatctctgagcgccacttctaacaactccaccgtggcatgtatcgatcgtaatgggttgcaaagctgcccaattaaggaggacagtttcttgcagcggtattcttccgacccaaccggtgctctaacagaagactctatcgacgacactttcctgcccgtccccgaatacatcaaccagagtgttccaaaaaggccagcaggcagtgtgcagaatcctgtctaccataatcagccactgaaccctgccccatcccgagacccccactaccaagatccccactctactgccgtgggaaacccagagtatttgaacaccgtgcagccgacctgtgttaatagcactttcgactcaccggctcactgggcccagaaggggtcgcatcaaatttcactggataacccagactatcaacaggacttcttccctaaggaggcaaaacccaacggaatattcaaaggaagcaccgccgaaaatgccgagtaccttagagtggccccccagagttcagaatttatcggtgcctag

SEQ ID NO: 23974 - DNA, 1887 bp, Artificial Sequence
  Description of Artificial Sequence: Synthetic coding sequence
atgcggcccagcggcaccgccggcgccgccctgctggccctgctggcagcattatgcccagccagcagagcgctggaggaaaagaaggtatgtcagggtaccagtaataaactgacacagcttggaaccttcgaggatcactttctgtccttgcagcgcatgtttaataactgcgaagtagtgctcggcaacctggaaatcacttatgtgcagaggaactacgatcttagcttcctgaaaacgatccaggaggtggccgggtatgtgctgatcgccctgaacacagtagagcggatcccgctggaaaatttacagatcatacgggggaacatgtactacgaaaactcttacgccctggcagtgctgagcaattatgatgccaacaagactggcctgaaggaattgcccatgagaaatctgcaggagatcctgcacggcgccgtcagattctccaacaatcccgccttatgtaatgtcgagagtatccagtggcgcgatattgtctcttccgatttcctcagcaatatgtccatggactttcagaaccatctcggctcctgccagaagtgcgacccgtcatgccctaatggaagttgctggggcgctggagaggaaaattgccagaagttaactaaaattatctgtgctcaacagtgtagtgggaggtgccgggggaaaagtccgagcgattgttgtcacaaccagtgcgcagccgggtgtacgggccctcgtgaaagcgactgtctggtgtgtagaaagttccgagatgaggctacctgtaaagatacttgtcctccattgatgctgtacaacccgaccacctaccagatggacgtgaatcccgagggcaaatactcttttggagcaacctgcgtgaaaaaatgtcctcgtaattatgtggtgacggaccacggatcttgcgtccgggcctgtggcgcagattcctacgagatggaggaggacggcgtaagaaagtgcaagaagtgcgagggaccatgtagaaaagtatgcaatgggattggtatcggcgagtttaaagattctttgtctattaatgccaccaatattaaacacttcaagaactgcacctccattagcggagacctccacatactccctgtggccttcaggggcgactctttcactcacaccccacccctcgacccacaagaactcgatatattgaagaccgtgaaagagataaccgggtttctgctgatccaggcatggcctgagaatcgcactgatttgcatgcttttgagaatctcgaaattatcagaggacgtacgaagcagcacggccaattcagcctggcagtggtttcactaaacattactagcttaggcctcagaagtctgaaggagatctcggatggtgatgttattatttccggcaacaaaaacctatgttacgccaatacaatcaactggaagaaattgtttgggacatctgggcagaaaaccaaaattatatccaacagaggcgagaattcttgcaaagctacagggcaggtgtgccacgctctgtgttcccctgagggctgttggggccctgaaccacgcgactgcgtcagttgcaggaacgtgtccagggggcgtgagtgtgttgataaatgcaatttgttggaaggtgaaccccgcgagtttgtggaaaactcagagtgcattcagtgtcatcccgagtgtctgccgcaagccatgaatatcacctgcaccggccgaggccccgacaactgcattcagtgcgcccactacattgacgggcctcattgcgtcaagacgtgtcccgcaggcgttatgggcgaaaacaacaccctcgtgtggaaatacgccgatgcagggcacgtgtgtcatctgtgtcatccaaattgcacgtacggcagctag

SEQ ID NO: 23975 - DNA, 2118 bp, Artificial Sequence
  Description of Artificial Sequence: Synthetic coding sequence
atgcggcccagcggcaccgccggcgccgccctgctggccctgctggcagctctgtgtccagcctcacgcgccctggaagaaaaaaaggtgtgccaaggtacatccaacaaactgactcagttaggaacctttgaggaccattttctgagcctgcagcgcatgtttaataactgtgaggtcgtgctgggcaatcttgagatcacctatgtccagcgcaactatgacttgagtttccttaagacgatacaggaggttgccggttacgtcctgatcgctctcaacactgtcgaacggattcccctggaaaatttgcagatcattcgcggcaatatgtactacgaaaatagctacgctcttgctgtgctgagcaactatgacgccaacaagactggactgaaggagctgccaatgagaaatctgcaagaaatcttgcatggagccgttaggttctctaacaaccctgccctttgtaatgtagagtctatccaatggcgggacatcgtatctagcgattttttgtccaatatgagcatggactttcagaaccacctcggttcctgccagaaatgtgacccttcatgtcccaacggatcttgctggggggccggggaggaaaactgtcagaaactaaccaagataatctgtgcccaacagtgcagcggccgatgtaggggaaagtcgccttcagactgttgccacaaccagtgtgccgccggatgtacgggccccagagagtccgactgcctcgtctgcaggaagtttagggatgaagctacttgcaaagacacatgtccacctctgatgctgtataatccgactacctaccagatggacgttaatccagagggcaagtacagcttcggagccacctgcgtgaagaagtgtcctaggaattatgtggtgaccgaccatggttcctgtgtgagggcctgcggcgctgattcctatgaaatggaagaagacggtgtcaggaaatgtaagaagtgcgagggtccttgcaggaaggtatgtaacgggatcgggataggtgaattcaaagattccctttccattaatgccacaaatataaagcacttcaaaaattgtacttcaatttccggggacttacacatcctgcccgtcgccttccgcggggattcctttactcacaccccgcctctggatccacaggaactggacattttgaaaactgtgaaggaaatcactggattcctcttaattcaggcttggcctgaaaaccgcacagatttgcatgcctttgaaaacctggaaatcatcagggggcgcacgaaacagcacggccagttctcccttgctgtcgtatcgttaaacattaccagtctgggactacgcagcttgaaggaaatctctgacggcgacgtgatcatctcagggaataaaaatctgtgctacgctaacacaattaattggaagaagcttttcggaacaagcggtcagaaaacaaaaattataagcaatcgcggtgaaaattcatgtaaagccaccggacaggtctgccacgccctctgctcgcccgagggctgctggggccccgaaccccgggattgtgtctcctgcagaaacgtttcacgaggtcgtgagtgcgtcgacaagtgcaatcttttagaaggggaaccacgagaattcgttgagaacagtgagtgtatccagtgccaccccgaatgcctcccccaggccatgaatattacctgcacgggccgcggcccagataattgtattcaatgcgcccactacatcgacggtccacattgcgtaaagacctgtccagccggtgtgatgggcgaaaataatactctcgtgtggaagtatgctgacgccgggcatgtatgtcatctgtgtcatccaaactgtacttatggccctggcaatgagagcctcaaggctatgcttttctgcctcttcaagctttcctcttgcaatcagagcaatgatgggtcagtgagccaccagtcagggtctccagccgctcaggagtcgtgtctaggctggatcccatctctgcttccaagtgaattccagctggggtggggaggctgctctcatctgcacgcctggccctccgcctcagtgattattaccgccagctcatgccactag

SEQ ID NO: 23976 - DNA, 3243 bp, Artificial Sequence
  Description of Artificial Sequence: Synthetic coding sequence
aaccggaccgagggcgccgcccacgagaagttcaccggcaaccccgcctggaggcgagccgtacagcaacagccgtgtccggttgtggaaagcatacagtggagagacattgtttccagcgacttcttatcaaacatgtccatggacttccagaaccatctgggcagctgccaaaagtgtgacccctcttgtccgaatggaagctgctggggggccggagaagaaaactgccagaaactgactaaaatcatctgtgcacagcaatgttccggaagatgcagaggcaaatctccgtctgactgttgccataatcaatgcgcagccggctgtacaggtcctcgcgaatcggattgtttggtttgtagaaagttcagggatgaagcaacgtgcaaggatacgtgtccaccacttatgctgtacaaccctacaacgtaccagatggatgtaaatcccgagggtaagtacagcttcggagccacttgtgtgaaaaagtgtccacggaactacgtggtgactgaccatggttcttgcgttagagcctgcggtgccgactcctatgaaatggaagaggacggcgtcaggaagtgtaaaaagtgtgagggcccatgtaggaaggtgtgcaacggtatcggtatcggtgaattcaaagattcactaagcattaacgcaaccaatatcaaacactttaagaattgcactagcatctctggcgatttacacatacttcccgttgcctttcgcggagacagcttcacacatactccccccttggacccacaagagctcgacatcctgaagaccgtgaaagaaattacagggtttctcctgatccaggcctggcccgagaacaggaccgatcttcatgcctttgagaacctcgaaatcattcgggggcggacaaaacaacacggacagttctccttagccgtggtgagtctgaatataacgtctcttggcctcaggagtctgaaggagattagtgacggggacgtcatcatcagcggtaacaagaacttatgttacgcgaatacaatcaattggaagaagctgttcgggactagcgggcagaagaccaaaattattagtaatcggggagagaacagctgtaaggccaccggtcaggtttgccacgccctgtgtagccctgagggctgctggggccccgagcctcgggactgcgtcagctgtcgaaacgtttcacgcggcagagaatgcgtagataaatgcaacctgttagagggcgaaccgagagagttcgtggagaactccgaatgcatacagtgccaccccgaatgcctcccacaagccatgaatattacatgcaccggacggggaccagacaactgtattcagtgcgctcattacattgatggccctcactgcgtcaagacctgtccagccggagtcatgggtgagaacaatactctggtgtggaaatatgcggacgccggtcacgtgtgtcatctgtgtcaccccaactgcacctatggctgcactgggccggggttggaagggtgtcccaccaacgggccaaagattccttcgatcgctacagggatggtgggcgccttactactgctcctcgtcgtcgcattaggaatcggactttttatgcggagacgtcacatagtgagaaagcggacgcttaggagacttctgcaggagcgcgagctcgtagaaccactgacgccaagtggcgaagcccccaaccaagcgctacttcggatcttgaaagagaccgagttcaagaaaattaaggtcctgggatccggggcctttgggaccgtgtacaagggactgtggatccctgaaggtgagaaagtgaaaatacccgtggcgatcaaggaacttagagaggccacttcacccaaagcaaacaaagagatactggatgaagcttatgtcatggcttcagtggacaacccacatgtgtgccggttgctcggaatctgtctcacgagtaccgtccaactcataacacagcttatgcccttcggatgcctgctcgactacgttcgcgagcacaaggacaacatcggaagccaatacctgctgaactggtgtgtgcagatcgccaaagggatgaactacctggaggacagaagactggtgcacagagacctggctgcccggaacgtcctggtgaaaactccgcagcacgtgaaaatcaccgattttgggctcgccaagcttttgggagcagaggagaaggagtaccacgccgagggaggcaaagtgcccatcaaatggatggcattggaatcaatccttcacagaatttatactcatcagagcgacgtgtggtcttatggggttaccgtttgggaactcatgaccttcgggagtaagccttacgatggtatcccagccagtgaaataagctcaatcctagagaagggtgaacggcttccccagcctcccatttgtaccatagatgtctacatgatcatggttaagtgctggatgatcgatgctgacagcaggcctaaattccgtgaactaatcattgagtttagcaagatggctagggaccctcagaggtatctggtgattcagggggatgaaagaatgcatcttccctcacctacagatagtaatttttacagagccttgatggacgaagaagacatggacgacgtggtagatgctgacgaatacctgatcccgcagcagggcttcttctcttctccatccacctctcgcacccctctactgagctccctgtccgccacctcaaacaacagcaccgtggcctgcattgatcggaacggcctccagagctgcccaatcaaggaggacagctttttacagagatactctagcgaccctactggggctttgaccgaggactccatcgatgataccttccttcccgttcccgaatacatcaaccagtcagtgccaaagagaccagcaggcagtgtccagaaccccgtgtaccacaaccagcccctcaatcctgcgccgagtcgcgacccacactaccaggaccctcattctactgcggtggggaaccccgagtacctgaacacagtgcaacccacatgtgttaactctaccttcgacagccccgcccattgggcccaaaagggtagtcatcagattagcctcgacaatcctgactaccagcaagatttcttccctaaggaagccaaaccaaacggaatattcaagggaagtacagcggaaaacgcagaatatttgcgagttgcccctcagtcaagcgaatttattggggcatag

SEQ ID NO: 23977 - DNA, 1218 bp, Artificial Sequence
  Description of Artificial Sequence: Synthetic coding sequence
atgcggcccagcggcaccgccggcgccgccctgctggccctgctggcagccctgtgtcctgccagccgcgcactagaggagaaaaaggtctgccaaggtacatcaaataaactcacgcagctgggcacctttgaggaccattttttgagcctgcagcgcatgtttaacaattgcgaagttgtgctggggaatcttgagattacctatgttcagcggaactacgatctgtccttccttaaaacgatccaggaagtggctggctatgtgcttattgctctgaataccgtggaacggatcccactggagaatcttcagataattaggggcaacatgtactacgaaaatagctatgcactggccgttttgtcaaattacgacgccaataaaaccggcctgaaggagcttccaatgaggaacttgcaagaaatcttgcatggagccgtgcgcttctctaataaccccgctctatgcaacgtcgagagtatacagtggagggacattgtgagctctgactttctgagtaacatgagtatggattttcagaaccatctgggtagctgtcaaaaatgcgatccttcgtgtccaaatgggagctgctggggagcgggagaagagaactgccagaaactgacaaagattatctgtgcccagcagtgctccggaaggtgcaggggtaaatctccttctgattgttgtcacaatcagtgtgccgccggatgcaccggcccacgcgagagcgactgcttggtctgccgaaagtttcgcgatgaggccacatgtaaagacacctgccccccacttatgctgtacaatcccacaacctaccagatggacgtcaaccctgagggtaagtattctttcggagcgacctgtgtgaaaaaatgtccgagaaattatgtggtaactgatcatggatcatgtgtgcgcgcttgtggggcagactcatacgagatggaagaagacggggtgcgcaaatgtaagaaatgtgaaggcccttgtcggaaagtttgtaatggaataggaataggagaatttaaagacagcttgagcataaacgcaactaacatcaagcattttaaaaactgcacctctattagtggcgacctacatatcctaccggtggctttcaggggggacagcttcacccacaccccacctctcgacccacaggaactcgatatccttaaaactgtcaaagagattaccgggctgtcctag

SEQ ID NO: 23978 - DNA, 1974 bp, Artificial Sequence
  Description of Artificial Sequence: Synthetic coding sequence
atgcggcccagcggcaccgccggcgccgccctgctggccctgctggccgccctgtgcccagctagtagagcgctagaggaaaagaaagtgtgccagggtacctcaaataagctgacacaacttggcacattcgaggaccactttctgtctctccagcgtatgttcaacaattgtgaagtagtattaggcaaccttgagatcacatacgtgcagcgaaattatgatctgagcttcttaaaaaccatccaggaagtggctggctacgtgctcatagctctgaacaccgtagaaagaatacccttggagaatcttcagataatacgagggaacatgtactatgaaaactcatatgcgctcgcggtactgtccaactatgacgcaaataaaaccgggctcaaagaactgcccatgcggaatctccaagagatcctgcacggagcggtgaggttctctaacaacccggctctgtgcaacgtcgagagtatccagtggcgtgacattgtgtctagtgacttcctatctaacatgtcaatggactttcagaaccatctgggctcatgccaaaaatgtgaccctagctgccctaacggaagttgttggggcgcaggagaggagaattgccaaaaattgaccaagatcatctgtgctcaacagtgcagtggccggtgccgggggaagtcccccagcgactgttgtcataaccagtgcgccgcggggtgcaccggaccacgggagtcggactgcctggtgtgccgaaagttccgcgacgaagccacttgcaaggacacttgcccacccttgatgctttacaacccgaccacataccagatggacgttaacccagaagggaagtacagcttcggagcaacatgtgtgaagaagtgtcctagaaattacgtggttactgaccacggttcatgcgtcagagcatgtggagcagactcatacgagatggaggaggacggagtgcgcaaatgcaaaaaatgtgagggtccatgtcggaaggtttgcaatgggattggcatcggggaattcaaggactcactgagcattaatgccactaacatcaaacactttaagaattgtacaagcatctctggtgacctgcacatactgcccgtggcattcaggggcgattcctttacacatacgccccccctcgaccctcaagagcttgacatcttaaagaccgtcaaggagataacgggattcctgctgattcaggcgtggccggagaaccgcactgacctccacgcctttgagaatttggagataatccgcggacgcaccaagcaacatggccaattcagtctagctgtggtgtcattaaatataacgagcctgggacttcgctctctgaaggagatcagcgatggtgatgttattatctccggtaataaaaatctctgctacgctaatactattaattggaaaaagttgttcggcacttccggtcagaagacaaagatcatttccaatagaggagaaaactcctgtaaggcaacaggacaggtctgtcacgccctgtgcagcccagaaggatgttgggggcccgagcctcgtgattgtgtgagctgtagaaatgtctccagggggagggagtgtgtcgacaagtgtaatctcttggaaggcgaacctcgagagtttgtagaaaacagcgagtgcattcagtgtcacccagagtgtctgcctcaagctatgaatattacttgcaccggtcggggaccagacaattgcatccaatgtgctcattatatcgacggccctcactgtgtcaaaacctgtcccgccggtgtgatgggcgagaacaatacactcgtttggaagtacgccgacgctggtcatgtgtgccacctctgccaccctaattgcacctacgggtgcacgggtcccggtctcgagggatgccctacaaacggcagctacatagtgagccacttcccccgatcattctataagatgagtgtgcactag

SEQ ID NO: 23979 - DNA, 3474 bp, Artificial Sequence
  Description of Artificial Sequence: Synthetic coding sequence
atgttcaacaactgcgaggtggtgctgggcaacctggagatcacctacgttcagcgcaactacgatctgtccttcctgaagactatccaggaggtagccggctacgtcctgatcgccctcaacacagtggaaaggatcccattagaaaaccttcagatcattaggggcaatatgtattatgaaaactcctacgctcttgcagttctgtctaattacgatgccaataaaacaggcctgaaggagttgcccatgcgaaatctccaggagattctacacggcgcagtgaggttttctaataatcccgcactctgcaacgtcgagagcatccagtggcgcgatatcgtatcaagtgactttctctctaacatgagcatggatttccagaatcatctggggtcatgccagaagtgcgacccctcctgccccaatggaagctgttggggggccggcgaggagaattgccagaagttaacaaagatcatctgcgctcagcagtgctccggcaggtgccgggggaagtcaccaagtgactgttgccataatcagtgtgctgctggttgcaccggacccagagagtctgattgtctagtgtgcagaaagttcagggatgaagctacatgcaaggacacatgccccccccttatgctttacaaccctaccacatatcagatggatgtcaacccagaagggaaatattccttcggggccacgtgtgtcaaaaagtgtcccaggaattatgtggtgaccgaccacggatcttgcgttcgggcttgcggagcagactcctatgaaatggaagaggatggagttcggaaatgtaaaaagtgcgaaggtccgtgcagaaaggtgtgcaacgggattggcatcggggaattcaaagactcattgagcatcaatgcgacaaacattaagcacttcaagaactgcacaagtatctctggagatctgcacatccttcctgtcgcgttcagaggcgatagctttactcacactccgccactcgatccacaggaacttgacatattgaaaaccgtgaaggaaattactgggttcctgctgatccaggcatggcccgagaatcgaaccgatctgcatgcttttgaaaaccttgaaattattcgaggtcgtaccaagcagcacgggcagttttctctggcggtggtgtccttgaatattacaagcctcggattaagaagcctcaaggaaatcagcgacggggacgtcatcatctctggcaataaaaatctgtgttacgccaatacgatcaattggaagaagctctttggcacaagtggacagaagactaaaatcatttctaaccggggggaaaacagctgcaaagccaccggtcaggtttgtcacgctctttgctcacctgaaggctgctgggggcccgagccacgcgattgcgtctcttgccgcaacgttagccggggtagggagtgcgtggataaatgcaaccttctggaaggagaaccaagggaattcgtggagaattcagaatgcattcaatgccatcctgagtgcctccctcaggccatgaacatcacctgcacgggcaggggccctgacaattgcatccagtgcgcacactacattgacggaccgcactgtgtcaagacatgtcctgccggtgtgatgggtgagaataatacactggtgtggaagtacgctgatgccggtcatgtgtgccacctgtgccatcctaattgcacatatggctgtaccggcccaggtctggaggggtgccctactaatggtcccaagatcccaagcatcgctaccggaatggtcggggctctcttgctgctcctggttgttgcacttggaatcggactgtttatgagaagacggcacattgtgaggaagagaacactccgccgtttactgcaggaacgcgagctggtggagcccttgaccccttctggcgaggcccccaaccaggctctgctccggattttgaaggagaccgagttcaagaaaataaaagtcctcggtagcggggcttttggcaccgtgtataagggcctatggataccggaaggggagaaggttaagatacccgtggccatcaaagaactgagagaggccaccagcccaaaagccaataaagagattctggacgaggcttacgtgatggcctcagtggacaatccccacgtgtgtaggttgcttgggatatgtctcactagtacagtgcagttgatcactcaattgatgccattcggatgcctgctggattacgtgagggagcataaagacaacatcggtagccagtatctcctgaactggtgcgtgcagattgcaaagggaatgaactaccttgaggacagaaggctcgtgcacagagatcttgccgcgcgcaatgtgctggtgaaaaccccgcagcacgttaagatcacagatttcggactcgccaaactgctgggggctgaagaaaaagaataccatgcggagggtggaaaagtacccattaagtggatggcattagagtctatccttcatcgcatttacacccatcagtcagatgtctggtcgtacggcgttactgtgtgggaactcatgacttttgggtctaaaccttatgatggcatccccgcttccgaaatcagtagtatactggagaaaggagagagattgccacagccccctatctgcacgatcgatgtttatatgatcatggtcaagtgctggatgatagatgccgattcccggcccaaattccgagagctcatcatagaattctcaaagatggcccgagatccacagaggtatctggtcatccaaggcgatgagcgcatgcaccttccaagtcctaccgattctaacttttatagagcacttatggatgaggaggacatggatgacgtggtagacgccgacgaatacctgattcctcagcagggtttcttttcttccccctccacctcccgaactccactgcttagcagcctcagtgcaacctctaacaattctaccgtcgcatgtatcgaccggaatggcttgcaatcctgccctatcaaggaggattcctttctccaacgttactccagcgaccctacaggggctctgacagaggacagcatcgatgataccttcttgcctgtccctgaatatattaatcagtctgtgcctaaacggcccgcggggtcagtccagaaccccgtctatcacaaccagcccctcaatccagcgccttcccgggatccccactatcaagatcctcactccacggcagtggggaaccctgagtacttgaataccgtgcagccaacctgtgtcaatagcacttttgattcccccgcccactgggcacagaagggctcgcaccagatcagtctggacaatcccgactaccagcaggacttctttccgaaggaggccaagcccaatggcatattcaaaggtagcacagccgagaatgccgagtatctcagggtggctcctcagtcttccgaatttattggcgcttag

SEQ ID NO: 23980 - DNA, 3276 bp, Artificial Sequence
  Description of Artificial Sequence: Synthetic coding sequence
atgcggcccagcggcaccgccggcgccgccctgctggccctgctggcagctttgtgccccgcaagcagagcgttggaggagaaaaaggtgtgccagggaactagtaacaaactgactcagctgggcactttcgaggatcactttctctccctgcaaaggatgtttaataactgtgaagtggtgttgggaaacctggagatcacctacgtgcaaagaaactatgatctgagctttctcaaaactatccaggaggtggccgggtacgtactgatcgcccttaataccgtcgaacgaattcccctcgagaatctacagataatcaggggcaatatgtattacgagaatagttacgctctggctgtgctctccaattatgacgcaaataaaactggtttaaaagagttaccaatgcggaacctccagggccagaaatgtgatccgtcttgcccaaatggtagttgctggggagcaggcgaggagaactgtcagaaacttacgaaaatcatttgtgcccaacagtgttcgggcagatgcaggggaaagagcccaagcgattgctgccacaaccagtgtgccgcaggatgcacgggtccaagagagagtgattgtctcgtgtgccgcaagtttcgtgatgaggctacctgtaaagacacatgcccaccacttatgctttataatccaacaacgtaccaaatggacgtgaacccggagggcaagtattctttcggcgctacatgtgtcaaaaagtgccccagaaactatgtagtaacagaccacgggtcatgcgtgcgtgcttgcggggcggactcatatgaaatggaggaagacggggtgcgcaagtgtaaaaagtgcgaaggtccctgccggaaggtgtgtaacggaatcggtatcggcgagtttaaagactctttgagcataaacgctaccaacattaagcattttaaaaattgtacctctatctcaggggatcttcatattctgccagttgccttcagaggagactcgttcacgcatacaccacctttggatccccaagagctggacattctgaaaacagtcaaagagattactggatttttgctgatacaggcctggcccgagaacagaacagatcttcatgcgtttgaaaacttagagattatacgcggaagaaccaagcagcatgggcagttcagtctggccgtcgtgtctctgaacattacgtctctgggcctccggtccctcaaggaaatcagtgacggggacgtcatcatttcaggtaataagaacctgtgctacgctaatactatcaactggaagaaattgttcggcacgtccggacagaagactaaaatcatcagcaaccgcggcgagaattcctgtaaggccactggtcaagtgtgtcacgctttatgttctcccgaaggatgctggggaccagagccaagggattgtgtgagctgcaggaatgtttctcgcggcagggaatgtgtcgacaagtgtaatctgctggagggcgaacctagggaattcgtagagaattccgagtgcattcagtgtcaccctgagtgtctccctcaggctatgaacataacgtgtaccgggcgaggacccgacaactgcattcagtgcgcacactacattgacggaccacactgcgtgaagacgtgtcccgctggggttatgggcgaaaacaatacgctggtatggaagtatgccgatgccggccacgtgtgccacctgtgtcacccaaattgcacgtatgggtgtactggtcctgggctggaaggatgtccaaccaatggccccaagatcccaagcatagcaacggggatggtgggagccctcttattactgctcgtcgtggctctcgggatcggtctttttatgcgccgcagacatatagtgcgaaagagaacattgcggaggctgctacaagagcgggagctagtcgaacctcttaccccctcaggtgaggcaccgaaccaggctctgctaagaattcttaaagagacagagtttaaaaaaataaaggtgctggggagcggtgcattcggaacagtttacaagggcctgtggattcccgagggtgaaaaggttaaaattcccgtcgcgatcaaggaactgcgcgaggcaacttctcctaaagccaataaagaaatcctcgacgaggcctacgtcatggcaagcgtggacaatccacatgtgtgtaggttgctgggtatatgcctaacctccaccgtccaactgattacacagcttatgcccttcggttgcttgctggattatgtgagagagcacaaggacaatattggtagccagtacctcctgaattggtgcgttcagatagccaaagggatgaattacctggaggaccggcgactggtgcatagagacctggcagcccgaaatgtactcgtaaagactccccagcatgtcaagattaccgacttcggattggccaaactgctgggggctgaggaaaaggagtatcatgctgaaggagggaaagttccaattaaatggatggccctggaatcgattctccacaggatctatacacatcagtcagatgtgtggtcctatggcgtgaccgtctgggaactcatgacattcggaagcaagccctacgacggcatcccagcttccgaaatctctagtatccttgagaagggagaaaggttgccacagccccccatctgtaccatcgatgtgtatatgatcatggtgaagtgttggatgattgatgcagattcccggcccaaattcagagaactaataattgagttttccaagatggcgagagatccacaaagatatctcgtaatccagggagacgagaggatgcaccttccctcaccaacggattcgaatttttatagagcactgatggacgaagaggatatggacgatgtcgtcgacgcggacgagtatttaatcccacaacaggggttcttctcctccccatcaaccagcagaaccccgctcctatccagcctgtccgccacatccaacaactctactgtagcatgcatcgacaggaacgggctgcaaagctgccctattaaagaagattcattcttgcagcggtacagctccgaccccacaggcgcactgaccgaagattctattgatgacacatttttaccggtcccaggagaatggttggtgtggaaacaaagctgcagctctacctccagcacacacagtgctgccgcatcgctccagtgtccatcccaggtcctgcctcctgcttctccagaaggggagacagtggcggacctgcaaactcagtag

SEQ ID NO: 23981 - DNA, 1395 bp, Artificial Sequence
  Description of Artificial Sequence: Synthetic coding sequence
atgagcagcctgaccaagatcatctgcgcccagcagtgcagcggcagatgcagggggaagagccccagtgattgttgccacaatcaatgcgctgccggttgcactgggcctcgcgagagtgattgtctcgtctgtcgcaaattccgcgacgaagctacctgcaaagacacttgcccgcctctaatgttatataacccaacgacttaccaaatggacgtcaacccagaagggaaatacagcttcggggccacatgtgtgaagaagtgcccccggaactacgtggtgaccgaccacggatcatgtgtgagagcatgtggggcagactcttacgaaatggaggaggacggagttagaaagtgcaagaagtgcgagggaccttgcaggaaggtgtgtaacggcatcggcatcggcgagtttaaggactccttgtcaattaatgcaacgaatattaagcatttcaaaaactgcacttccatctcaggagacctgcacatcttgcctgttgccttccgaggcgacagtttcactcacacaccacctctggacccccaggagctcgatatccttaagacagtcaaagaaatcacaggtttccttttaatacaggcatggcctgaaaatcgcactgatttacacgcgttcgagaatttggagatcattcgcggccggacaaagcagcatggacagttcagtttagcagtggtgagcctcaacataacgagcttaggcctgcgtagcctgaaagaaatcagcgacggcgatgtaatcatttctgggaataaaaacctgtgttatgccaataccattaactggaaaaagttattcgggacgtccgggcagaaaacaaagattatatctaatcgtggcgaaaactcttgtaaagccactggacaggtgtgccacgcattgtgcagtcctgaaggttgttgggggcctgaaccaagggactgcgttagctgcaggaatgtatctcgaggcagagagtgcgttgataagtgcaatctgttggaaggtgaaccacgcgaatttgtagaaaacagcgagtgtattcagtgccacccagagtgtttgccgcaagccatgaacatcacatgtaccggccgagggcctgataattgcattcaatgtgcacactatattgatggtccacactgtgttaagacctgcccggccggggtcatgggtgaaaacaacacattagtatggaagtacgccgacgccgggcatgtgtgtcatctgtgtcacccaaactgcacgtacgggtgtacaggacccggactggagggctgcccaactaacggtccgaaaatcccctccattgctaccgggatggtgggggccctgctcctactcctggtcgtggcgctcgggatcgggctatttatgcgtaggtag

SEQ ID NO: 23982 - DNA, 843 bp, Artificial Sequence
  Description of Artificial Sequence: Synthetic coding sequence
atgcccgccgacatcatggagaagaacagcagcagccccgtggccgctacccccgctagtgtgaacacaacacccgacaagcccaaaactgcatccgagcatcgtaagtcctcaaagcccataatggagaagagacgacgggcacgtataaacgagtcactctcccagctgaagacacttattctggatgcattgaaaaaggattccagtaggcatagcaagcttgaaaaggcagatatcctagaaatgaccgttaagcacctgagaaaccttcaacgtgcacaaatgacagctgccctctctacagatcctagcgtcctgggcaagtatagggcagggttcagcgagtgtatgaatgaggtgactcgtttcctgtccacatgtgagggtgtgaacacagaagtgaggactcgcctgctcggccacctggccaattgcatgactcagataaatgcgatgacctatcctgggcagccacaccccgctctgcaggccccccctcctccccctccaggacccggcgggccccaacatgcaccatttgcccctccccctcccctcgtccccattcccgggggcgcagctccacccccaggcggtgcaccatgcaagttgggctctcaggccggagaggcggccaaagttttcggtggatttcaggtcgttcccgcgccagacggccaatttgcttttttgattccgaatggcgcctttgcacactctggacccgtgattcccgtgtacactagcaacagcggaactagtgtaggacctaatgcagtcagcccttccagcggtccttccctaacagcggattcaatgtggcgtccctggaggaactag

SEQ ID NO: 23983 - DNA, 57 bp, Artificial Sequence
  Description of Artificial Sequence: Synthetic coding sequence
atggccgagaacagcgtgctgaccagcaccaccggccggaccagcctggccgactag

SEQ ID NO: 23984 - DNA, 2745 bp, Artificial Sequence
  Description of Artificial Sequence: Synthetic coding sequence
atggccgagaacagcgtgctgaccagcaccaccggccggaccagcttggccgactcctccatcttcgactccaaagtgacggagatttccaaagagaatctgcttatcggatccacaagttacgtcgaagaggaaatgcctcagatcgagacaagagtcattttggtgcaggaggctggcaagcaagaggaactcattaaagccctgaagactatcaagatcatggaagtgccagttatcaagatcaaggagagttgtcccgggaaaagcgacgagaagctgatcaagtctgttattaatatggacattaaggtaggcttcgtaaaaatggagtctgtggaagagttcgagggcctagattcccctgagttcgaaaatgtttttgtggtaaccgattttcaagatagtgtctttaacgacttatataaagctgactgcagagtcataggccctcctgtggtgctaaactgctcccaaaaaggcgaaccattaccctttagctgtaggccgttgtattgtaccagtatgatgaacctagtgttatgctttactggattccgaaaaaaggaggagctggtcagactcgttaccttggtgcaccatatgggcggcgtgattagaaaagacttcaattcaaaggtcacgcacttagtcgccaactgcacccaaggcgaaaaattcagagtcgccgtgagcctcggcacaccaattatgaaacccgagtggatatacaaggcctgggagcgccgcaatgaacaggatttttatgccgcagtcgacgatttccgcaacgagttcaaggtccccccattccaggactgtatattgagcttcctcggtttctccgacgaagagaagacaaacatggaagagatgacagagatgcaaggcgggaagtacctaccactgggagacgagagatgcacccacctggtcgtggaggagaatatagtgaaagatttgccttttgaaccgtcaaagaaactctatgtggtgaagcaggaatggttctggggtagcatccagatggacgccagagcaggggagacgatgtatctatacgagaaggccaacacacctgaactgaagaaatccgtatccatgctatcccttaatactccgaactctaatcgcaagcggcgccggctaaaagaaacactcgcgcagttgtcaagggagaccgacgtaagcccttttccaccccgcaaaagaccatccgcagaacattcactatcaattgggtcactcctggacattagtaatacccctgaatctagcattaactacggtgataccccaaaatcttgcacgaaatcgtccaagagctccactcctgtgcctagcaaacaatccgccaggtggcaggtggccaaagaactgtaccagacagaatcaaattacgtgaacattctggccaccataattcaactcttccaggtacctttagaggaggagggccagagaggaggccctattttggctcctgaagaaatcaagacaatatttggctcgattccggatattttcgacgtccatactaaaatcaaagacgatctggaagacctaatcgtgaattgggacgagagtaagtcgattggagatatctttctgaaatatagtaaagaccttgtgaaaacatatccacctttcgtgaattttttcgagatgtctaaggagaccataatcaagtgtgaaaagcagaagccacgctttcacgccttcctgaagatcaatcaagccaagccagagtgtggtcggcagtccttggtcgaattgctgattaggccagtccagcgcctgcctagtgtggcactgctgctcaatgatctgaagaaacacaccgcggatgagaacccggacaagtccacactggaaaaagccatcggcagcctcaaagaggtgatgacgcacattaatgaggataagcgaaagacagaagcacaaaagcagatcttcgatgtcgtctatgaggtggatggctgtccagctaatttgttgagtagtcataggagccttgttcagcgtgtggagactatttcactcggggaacatccctgtgataggggggaacaggtgacccttttcttattcaatgattgcttggagatcgctcgcaagcgccataaggtgattggcacttttaggtcccctcacggacagacccgtcctccagcctccctgaagcacatccacctgatgcctttgtcacagataaagaaagttctggacattcgcgagacggaggactgccataatgcctttgcccttctcgtgaggcctcctaccgagcaggctaatgtgcttctaagttttcagatgacatccgacgaacttcccaaagagaactggctgaaaatgctgtgtcggcacgtggctaacacaatctgtaaggccgatgccgaaaatctaatctacaccgcggacccggaaagctttgaggtgaatacgaaggatatggattccactctttccagggccagccgcgccatcaaaaagacatcaaagaaggtcacccgggcttttagcttctccaagactcccaagagagctctgcggagggctctgatgacgtctcatgggagcgttgaagggcgatcccccagctcaaatgacaagcacgtgatgtcgcgcctcagctccacttcatccttggcagggattccctcgcctagtctcgtctctctcccaagcttttttgagagaaggagccatactctgagtagatcaaccactcatctgatctag

SEQ ID NO: 23985 - DNA, 480 bp, Artificial Sequence
  Description of Artificial Sequence: Synthetic coding sequence
atggccgagaacagcgtgctgaccagcaccaccggccggaccagcctggcggactcctccatttttgatagtaaagttactgaaataagtaaagagaacctgctgattgggtcaacctcctatgtcgaggaagagatgcctcagatcgagacccgggtcattttagttcaggaagcaggaaaacaggaagagctgatcaaggcattaaaggacatcaaagtcggcttcgttaaaatggaaagcgtagaagagtttgaaggattagactcgcccgagtttgagaacgttttcgtggtaacggacttccaggatagcgtttttaatgacctctacaaagcggactgcagagtgataggccctcccgtcgtgctgaattgcagtcaaaagggggagcccctaccttttagctgccggcccttgtactgtacctccatgatgaacctggtgctgtgcttcacagggtttagaaagaaagaatag

SEQ ID NO: 23986 - DNA, 2649 bp, Artificial Sequence
  Description of Artificial Sequence: Synthetic coding sequence
atggccgagaacagcgtgctgaccagcaccaccggccggaccagcctcgcggatagcagcatctttgactccaaggtaaccgagatctcaaaggagaaccttctgataggcagtacaagttacgtggaagaaatgccacagatcgaaacaagggtaatcttagtgcaggaggcgggaaagcaggaggagctcattaaagctctgaaggatatcaaggtgggcttcgtcaaaatggaatctgtagaggaatttgaagggctggacagccctgagttcgagaatgtgttcgtggtgaccgatttccaggattctgtgttcaatgatctctacaaggctgactgccgggtgattggtcccccagtggtcctgaattgtagccagaaaggggagcctttacccttctcatgtagaccactgtattgcacaagtatgatgaacctggtactctgcttcacgggcttccgaaaaaaggaggagttagttaggcttgtaaccctcgtacaccacatgggcggagtgatccgaaaggactttaactccaaagtgacccacctggtggcgaactgcacccagggagagaaattccgagtggccgtgagcctcggtacccctattatgaaaccagagtggatatacaaggcgtgggaacggcgcaatgagcaagacttctacgcggcagtcgatgattttcgcaatgagtttaaagtaccgcccttccaggactgtatcctgtcatttcttggtttcagcgacgaggagaagaccaacatggaggaaatgaccgagatgcagggggggaagtatctccctttgggggacgagcgctgtacgcacttagtggtggaagaaaatattgtcaaagacctgcctttcgagccaagtaaaaagctatacgtcgtcaaacaagagtggttctgggggagcattcaaatggatgcccgggccggcgagacaatgtacctgtacgagaaggcgaacactccagagctgaagaagtctgtatcaatgctgagtctgaacacaccaaactccaataggaaacgccgccgactgaaggaaactctagcccagctgtcacgcgagaccgacgtaagccccttccctccgcgcaagcgcccatccgcagagcattctctctccattggttcactgctggacatctccaacacgccggaaagttctatcaattacggagatacaccgaaaagttgtaccaaatcaagtaagagcagtaccccagtccccagcaagcaatccgcgcgctggcaggtggccaaggaactgtaccagaccgagtctaactacgtcaatatcctcgccacgattatccagctattccaagttccgctagaagaggagggccagcgggggggccccatattggcccctgaggagatcaagaccattttcggctcaatccctgacatcttcgatgtgcacactaagattaaagacgaccttgaggatctcatcgtgaactgggacgagagtaagagcatcggcgacatattcttaaagtactcaaaggatctcgtcaagacatacccccctttcgtgaatttttttgaaatgtcaaaagagacgattattaagtgtgagaaacaaaagccgaggttccacgcgttcctgaaaattaaccaggccaagccagagtgcggacgccagtctctggtggaactattgattagacctgtgcaaagactgcccagcgtggccctattgctgaacgatttgaaaaaacacacagccgatgagaaccctgacaagagcaccttagaaaaagccataggctccttaaaggaagtgatgacccacataaatgaggataagcgcaagactgaagcccagaaacagatctttgatgttgtgtacgaggtcgatggctgtcctgcgaacctattgtcttcccacagaagcctggttcagagggtggagactatctccttgggggaacacccttgtgatcggggagaacaagtgaccctgtttctgttcaatgactgcttggagattgctcgtaagcgacacaaggtgataggaacctttcgcagccctcatggccagacacggccaccggctagtctaaagcatatccacctcatgccactgtctcagattaagaaagtcctggatattagagagactgaagactgtcataacgcattcgccctgttagttcgtcctcccactgagcaagccaatgtcttactgtcgtttcagatgacttcagatgaactgccaaaggagaattggctgaagatgctttgcaggcatgtcgcaaataccatttgcaaggcggacgccgaaaacctgatttatactgctgatccagagtctttcgaggtcaatactaaagacatggacagtacactgagtagagcaagccgcgctattaagaagacctcaaagaaagtaactcgggctttttccttttcgaagacccctaagagagcccttcggcgggccctcatgacctcacacgggtctgtcgaggggagaagcccttcctccaatgataagcacgtgatgagtcggctgagttccacatcatctctggcaggcatccctagcccgagcctggtgagcctgccgagcttcttcgagcggagatcacacactctgtctaggagcaccactcacctcatttag

SEQ ID NO: 23987 - DNA, 321 bp, Artificial Sequence
  Description of Artificial Sequence: Synthetic coding sequence
atggccgagaacagcgtgctgaccagcaccaccggccggaccagcttggcagattcgagtattttcgattctaaagtaacagagataagcaaggaaaacctcttgattggaagtacaagttatgtggaagaggagatgccacagatcgaaacccgggtgattcttgtacaggaagccgggaaacaagaggaacttatcaaggcccttaaagacatcaaggtaggtttcgtcaagatggagagcgttgaagagttcgaggggctcgatagccctgaatttgagaacgtattcgtggttaccgactttcaggacagtgtatag

SEQ ID NO: 23988 - DNA, 2784 bp, Artificial Sequence
  Description of Artificial Sequence: Synthetic coding sequence
atggccgagaacagcgtgctgaccagcaccaccggccggaccagcctggccgactccagcatttttgactctaaagtcaccgaaatctccaaagaaaatctcttgatcggcagtacgtcatatgtggaagaggagatgccccaaatcgaaacccgagtcatcctcgtccaggaagcagggaagcaagaggagttgattaaagccctgaaggatattaaagttggattcgtgaaaatggaatctgtggaagagttcgagggactggattcccctgaattcgaaaatgtgttcgtggtgacagacttccaagactctgttttcaacgatctgtacaaggccgattgcagagtgatcggtcccccagtcgttcttaactgcagccagaaaggcgagcccttgccattttcctgcagaccattgtattgtacgtccatgatgaatctggtcctgtgtttcactggttttcggaagaaagaggaacttgtgcgactggtcacactggtgcatcacatgggcggcgtaatacggaaagatttcaactctaaggtcacccatctggtcgcgaactgcacccagggcgaaaagttcagagtggcagtgtctctggggacccccatcatgaaacctgagtggatttataaagcttgggagaggcggaatgaacaggacttctacgccgccgtcgacgacttccgaaatgagtttaaagtgcctccatttcaggactgtattctcagtttcctcggcttcagcgatgaagaaaaaaccaatatggaggaaatgaccgagatgcagggaggaaaatatctgcccctcggcgacgaaagatgtacacacctcgtggttgaggaaaacattgtaaaggatcttccgttcgagcccagtaagaagctttacgttgtgaaacaggagtggttctggggatctattcaaatggatgctcgcgctggcgagacaatgtatctctacgagaaggccaacacacctgagctgaagaagtcagtgtccatgctcagcctgaatacacctaattccaatagaaagcgacgcaggcttaaggaaaccttggcccagctcagccgcgaaacagacgtctcgcccttcccaccaagaaaacgcccttcggcagagcatagcctgtctatcggatcactcctggacatcagcaacactcccgagtctagtattaactacggcgacacccctaaaagttgcacgaagagttcaaagagcagtactccagtcccttctaagcagagcgctcggtggcaagtcgccaaggaactgtatcagacagagtccaattatgtaaacatcctggcgaccattatccagttgttccaagtgccccttgaggaagaaggccagagaggcggaccaatcttggctccagaggagattaagactatctttgggagcataccagacatttttgatgtccacaccaagatcaaggacgacctggaggacctgattgtgaattgggacgaatccaaaagtatcggagacattttcctcaagtattctaaagacctggtgaaaacgtaccccccatttgtcaacttttttgaaatgtctaaggaaaccattatcaaatgcgagaaacaaaagcccagattccatgccttcctgaaaattaatcaggccaagccggaatgcggacgccagtctctggtggagctcctgatcaggcccgtgcagcgtctgccttctgtagccctgttgttgaatgatctgaagaagcacaccgcggatgaaaaccccgacaagtctaccctggagaaagctattggaagtttaaaagaggtcatgacacatatcaatgaggataaaagaaagactgaggctcaaaagcaaatattcgacgttgtctacgaagtcgacggttgtccagcgaaccttctaagcagtcatcgatcattggtccagcgggtggagacaatctctttaggcgagcatccctgtgaccgcggggagcaggttactctgttcctgttcaatgattgccttgagatcgctaggaagaggcataaggtaataggcacattcaggtcccctcatggccagactaggccgccagcctccctgaagcacatccacttaatgcctctgtcacagatcaaaaaagtgctagacattagggaaacagaggactgtcataatgcttttgccctcctggtcaggccccccacggaacaggccaatgtgctactgtcattccagatgacctcagatgagctccctaaggagaactggctcaaaatgctatgtagacatgtggcaaacacaatctgcaaagcggatgctgaaaatctgatttatactgctgacccggagtcctttgaggtgaacactaaggacatggatagcactctgtcaagggcctcccgcgccattaagaaaacatcaaagaaggtgaccagagccttttcgtttagcaaaactcccaagcgcgccctgcggagggccctgatgacctcccatggcagcgttgaaggccgcagcccctccagtaacgataagcatgtgatgtctaggctctcgagcacttcttctctcgccattacccattccgtgtcaacctcaaatgtgattggcttcacaaaacatgtttacgtgcagagactgaattccactggcggacggagtcagtattcctggttccagtccgtgcggcacagcgctttccgcgcatcgttctctgaaatcttggagggcaatactgattttagcaacttcaagaaagttttgtccaagtcgagcttgacctttgttaagaactag

SEQ ID NO: 23989 - DNA, 2652 bp, Artificial Sequence
  Description of Artificial Sequence: Synthetic coding sequence
atggccgagaacagcgtgctgaccagcaccaccggccggaccagccttgcggactcctcaatcttcgacagcaaagtaactgagattagtaaagaaaacttacttatcggaagtacgtcctacgtggaagaagagatgcctcagattgagacgagagtgattctggtccaagaagcaggcaagcaggaggaactgatcaaggccctgaaagacatcaaggtgggatttgtgaagatggagtcagtcgaggagttcgaaggtcttgactcacctgagtttgagaacgtgtttgtcgtaactgatttccaagattccgtgttcaacgacctgtataaagcggattgccgggtaatcggaccaccggtggtgttaaactgctcccagaagggtgaacctcttccattttcatgtcggcccctgtactgcacctctatgatgaatctagtgctatgcttcactgggttccgtaagaaggaggaactggtccgtctggtcacactcgtgcatcacatgggtggggtcattcggaaggattttaatagcaaagtcacacacttggttgcaaattgcacccaaggagaaaaatttagagtagccgtctccctcggtaccccgattatgaagccagaatggatctacaaggcatgggaaagaagaaatgaacaagatttctacgctgcagtcgacgacttccgaaacgagttcaaggtgcccccattccaggactgcatactctctttcctcggcttttcagatgaagaaaagaccaatatggaggagatgacagagatgcagggcggaaagtaccttcccctcggagacgagcgatgcacccacctggtggtggaggaaaacatagtcaaagacctgccctttgagcctagcaagaagctgtacgtggttaagcaagagtggttttggggtagtattcagatggatgcccgagccggggaaaccatgtacctgtacgagaaagccaacacccctgagctcaaaaagtcagtcagcatgctgtcgctgaacacccctaattccaataggaagagaagacgcctgaaagagactctagcccagctgtcgcgagagactgacgttagcccgttccctccaaggaagcggcccagcgccgaacactcattatctataggaagtttgttggacatttctaacacacctgagtcctccatcaactacggagacacaccaaaatcctgtacgaagagctccaagagcagtacccctgtcccctccaaacagtctgccaggtggcaggtggcaaaggagttatatcaaaccgagtccaattacgtcaacatcctggcaaccatcatccaattattccaggtgcccctggaggaggagggtcagcgcgggggccccattttagcacccgaggaaattaagaccattttcggaagcatcccagatatcttcgatgttcacactaaaatcaaggatgacctggaggatctgattgttaactgggatgaatctaagtcaattggtgatattttcctgaagtacagcaaggatctcgtaaagacgtatccccctttcgtgaattttttcgagatgtccaaagaaacgattataaagtgtgagaaacagaaacctcggtttcatgcattcctgaagatcaaccaggcaaagcccgagtgtggcaggcagagcctcgtcgagctccttatccggccggtgcagcgtctgcccagcgtcgccctgttactgaacgatctcaaaaagcacacagccgatgagaatcccgataaatctacattggagaaggcaatcggcagtctcaaagaggttatgactcacataaacgaagacaaacgcaagaccgaagcacagaagcaaatcttcgacgtcgtgtacgaggtggatggatgtcctgctaatctgttgtcaagccacaggagtttggtgcaacgagtggaaactatctcccttggtgaacacccctgtgatcggggcgaacaagtaacactattcctgttcaacgattgtctcgagatagcgcggaaacggcacaaggtgatcgggacttttagatcacctcatgggcagacgagacccccagcaagtctcaaacacatacacctgatgccactgtcacaaatcaaaaaagtactagacattagagaaacagaggactgtcacaatgcctttgccctcttggtgcgtccccctacagaacaagctaatgtactactgtcctttcagatgacttctgatgaacttccgaaggaaaattggctcaaaatgttatgtcgacacgttgccaacactatatgcaaggcggacgcggaaaatctgatatacacagccgaccccgagagcttcgaagtcaacacgaaggatatggactcgaccctgtcaagggcgtctcgcgctatcaagaagacatctaagaaggtcaccagggcgttctctttcagcaagactcccaaaagagcattgcgcagggccctgatgacctctcatggttcggtagaagggcgatcccccagctccaatgacaaacatgtgatgtcgaggttgtcaagtacaagcagcttggccgggattccttccccctctctggtgtctctcccaagcttcttcgaacggagatcacacaccctgtcacgtagcaccacccacctgatctag

SEQ ID NO: 23990 - DNA, 2745 bp, Artificial Sequence
  Description of Artificial Sequence: Synthetic coding sequence
atggccgagaacagcgtgctgaccagcaccaccggccggaccagcctggcagactcaagcatctttgattccaaggttaccgagatttcgaaagaaaatctgctgatcggtagcacatcttatgtggaagaggagatgcctcaaatcgaaactcgggttattctggtgcaagaagcgggcaagcaagaagagctgataaaggctcttaagacaattaaaattatggaagttccggtgattaagatcaaggagtcatgtcccggtaagtcagatgagaagctgataaaatccgtgatcaacatggacatcaaggtcgggtttgtgaaaatggagtcggtggaggaatttgagggactggattccccggagtttgagaatgtgttcgtcgttaccgactttcaggactccgtgtttaatgacctttacaaagcagattgccgggtgattgggccacctgtcgtcctcaactgctcacagaaaggagaacccctgccattcagctgcaggccactttattgcaccagtatgatgaatctggtgctgtgttttacgggcttcagaaaaaaggaggaactagtgcggcttgtgacactggtgcaccatatgggcggcgtcatcagaaaggacttcaactcaaaagtaacccatctggtagccaactgtactcagggtgaaaagttccgcgtcgctgtttcccttggcacacccattatgaagcctgaatggatatataaagcctgggagagacggaatgaacaggacttttacgcagccgtggacgatttcaggaacgaatttaaggtgccacccttccaggattgtatactctcattcctgggcttctcagatgaggagaaaaccaacatggaagaaatgaccgaaatgcagggaggcaagtacttgcctctgggagatgagcggtgcactcatttggttgtggaagaaaatatagtgaaggatcttcccttcgagccttctaaaaaattgtacgtagtcaaacaggagtggttctggggaagcatccagatggatgctagggccggggagaccatgtacctgtacgaaaaggctaacacccccgaattaaaaaagtccgtgtcaatgctgtccctgaacacacctaattcaaatcgtaaacgcagacgactgaaagagacactggcccagctgtcaagagaaaccgatgtcagcccctttccccctagaaagcgaccttccgccgaacactccctgtccatcgggtctttgctggatattagcaacaccccggagagttctattaactacggcgatacacctaagtcctgtacaaaatcctcaaagtcgtccacccctgtgccgagtaagcagtccgctcggtggcaggtggcaaaggagctgtatcagaccgaatccaattacgtcaacatcctggcaactataatacaactgtttcaggtaccactggaagaggagggtcagagaggcggccccatcctagctccagaggaaatcaagacaatatttgggtctatcccagatatcttcgatgtgcatacaaagataaaagatgatctagaggatctgatagtcaactgggacgagtccaaatccatcggtgacatattcttaaaatatagtaaagatctcgttaaaacgtacccaccctttgttaattttttcgagatgtctaaagagaccatcataaagtgcgagaagcagaagcctagatttcatgcttttctcaagatcaatcaggctaaaccagaatgcggaaggcagtcgctggtcgagctgctaattcggcccgtgcagcggcttccttctgttgccctgttgctgaatgatctcaaaaagcacactgctgacgagaacccagacaagagtacgctggaaaaggccattggcagtctcaaagaggtgatgacgcatataaatgaagataaacgcaagactgaggcccagaaacagattttcgacgttgtttacgaggtggatggatgcccagccaatctgctgagttcacacagaagcttagtccagagggttgaaacaatctcactaggcgaacatccttgcgaccgaggtgagcaagttactctgtttctgtttaacgactgtctcgaaatagcgcggaaacgccataaggtgatcggaaccttccgttcccctcacggccaaaccagaccaccagcgtctctcaaacacatacatctcatgcccctgagccagataaagaaagtgctcgacatacgggaaaccgaagactgtcacaatgcattcgctttactggtgagacctcctactgaacaggcaaatgttctccttagcttccaaatgacatcggacgaattaccgaaagagaactggctaaagatgttatgtagacatgtcgcaaatactatatgtaaagctgacgcagaaaatctgatctacacggctgatcctgaaagcttcgaagtgaacaccaaagacatggattcaaccctctctcgagctagccgggccatcaaaaagacgtccaagaaagtgactcgtgccttctccttcagtaaaactcccaaaagggccctgcgcagagcactcatgacttctcatggatccgtggaaggccgaagtccctcttcaaacgataagcatgttatgagcagactttcctctaccagttctctggcaggaattccaagcccatcactggtgtctctgcctagcttttttgaacggcggtcgcacacactgtccagaagcactacacacctgatttag

SEQ ID NO: 23991 - DNA, 1389 bp, Artificial Sequence
  Description of Artificial Sequence: Synthetic coding sequence
atgagcatcgccggcgtggccgcccaggagatccgggtgcccctgaaaacggggtttttgcataacggcagagctatgggaaacatgaggaaaacctactggtcatctcggtcagagttcaaaaacaatttcttgaacattgatcccatcacgatggcctacagcttgaacagctccgctcaagagcgtctgatcccattgggccacgcatcgaagtccgctccgatgaacggacattgtttcgcagaaaatggaccctctcagaagtcctctctaccgccccttttgataccccctagcgaaaacttggggccacacgaggaggatcaggtagtgtgcggattcaaaaagctcaccgtgaacggagtttgtgcgtcaaccccgccgctgacccccataaagaattcacccagtctgttcccctgtgctcctttgtgcgaacgaggcagcagacctttgcccccactgcccatctccgaagcattgtcgctggacgacaccgactgcgaggtggagtttctcacatccagtgataccgactttcttcttgaagatagtaccttatcagactttaaatatgacgtgccggggcggcgcagctttaggggatgcggccagatcaattatgcctattttgatacccccgccgtgagtgctgcggacctttcctatgtctccgaccagaacggaggagtgcctgatccaaacccaccaccaccccaaactcaccgtaggctccgccgctcccattctggccctgcaggcagtttcaataaaccggctattcgtataagcaactgctgtatccaccgcgcttcgcctaattcagatgaggacaaacctgaagtgccccctagagtaccaatccctcctcggcccgtgaaaccagactaccgtagatggtcagctgaggtcactagttctacatacagtgacgaggaccgccccccaaaggtgcctcctagagaacctctctcccctagcaactctcgcacccctagccctaaatcccttccctcatatttgaatggggtaatgcctcctactcagtcttttgcaccagatccaaagtacgtgtcctccaaggccctgcagagacaaaactcggagggttctgcttctaaggtaccttgcatcctgccaataatcgagaacggcaagaaggtctcatcaacccattactacctcctgccagagcggccaccctatctggataagtatgagaagttctttagagaggccgaggaaacaaatgggggcgcgcaaatacagcctctccccgctgattgcggaatctcctctgcaacagaaaaacccgactccaaaaccaagatggacttggggggccacgtaaagcgcaaacatctcagctacgtggtcagcccatag

SEQ ID NO: 23992 - DNA, 1713 bp, Artificial Sequence
  Description of Artificial Sequence: Synthetic coding sequence
atggccctgaagaagagcagccccagcctggacagcggcgacagcgatagcgaggagctgccgactttcgccttcttgaaaaaggaaccaagtagcacaaaacgaagacagcctgaacgagaagagaagatagtcgttgtggatattagtgactgtgaggcttcctgtcctcccgcacctgagttgttctctcccccagttccagaaattgccgagactgtgactcagacccagcccgtgcgccttcttagctccgaatctgaagacgaggaggaatttatcccactcgcacaacgcctgacctgtaagtttctcacccacaagcaactgtcaccggaggatagctctagtcccgtgaaaagtgtgttggaccatcagaacaatgagggcgccagctgcgattggaaaaagccctttccaaagatccccgaagtccccctccacgatacccccgagagatctgccgcagacaacaaggacctgatcctcgacccttgttgccagctgccggcctacttgtcaacctgtcccggccagagctccagcctggcggtgaccaaaactaatagcgatatcttgcccccacagaaaaagaccaagccatcacagaaagtgcaggggagaggatcccacgggtgccgacagcaacggcaggccagacagaaagaaagtacactccgaaggcaggaaaggaagaacgctgcactggtgacacgaatgaaagctcagcgtccagaggagtgcttaaagcacataatcgtggtcctggatcccgtgttgctgcagatggagggtggggggcagttactgggtgcacttcagacgatggagtgcagatgcgttatcgaggcccaggctgtcccctgcagtgttacttggcgacgccgtgcgggaccaagtgaagatcgagaagattgggttgaagagccaaccgtgttggtgttgctaagggctgaggcattcgtaagtatgattgacaacgggaaacagggttcactggacagcaccatgaaaggcaaggagaccctccaggggttcgtcaccgatattaccgcaaaaacggccggtaaagctcttagtctggtcattgttgaccaagagaaatgtttttcagcccagaatccccccagacgaggcaagcagggtgccaataaacagactaaaaaacagcaacaacgccaacccgaggccagcatcgggagcatggtgagcagggtagatgcagaggaggctctcgtagatctgcagctgcacacggaagctcaggcccaaatagtgcagtcttggaaggagcttgccgactttacttgcgcatttacaaaagcagtggcagaggcaccctttaaaaaactccgcgacgagaccaccttcagcttttgccttgagtccgactgggccggaggagtgaaggtcgatctagcaggacgcggtctggctctggtctggcggaggcaaatccagcagttaaacagagtgagccttgaaatggcttctgcagtggtgaacgcctatccctctcctcagctactggtgcaggcttatcagcagtgctttagcgataaggagcgccagaatctgttagccgatatccaggtcagaaggggagagggcgtcactagcacgtcccgccgcattggccccgagctgagcagacgcatctacctgcagatgaccactttgcagccccatctgtctctggacagcgccgactag

SEQ ID NO: 23993 - DNA, 1752 bp, Artificial Sequence
  Description of Artificial Sequence: Synthetic coding sequence
atggccctgaagaagagcagccccagcctggacagcggcgacagcgactccgaggagttgcctacatttgcattcttgaagaaagaaccctcctcaacgaagcggcgccaacctgagcgcgaagagaaaatcgtggtcgtggacatctcagactgcgaggcatcctgccctcccgcgccagaacttttttctcctcccgtgcctgagatcgcagaaacggtcacccaaacacaaccagttcgactgttgtcttcagagtcagaagacgaggaggagttcattccgctggctcaacggctcacctgcaaattcctgacacataaacagctatctccggaagactcaagctctcccgtgaagagtgttttagaccatcagaacaacgaaggagcatcttgtgactggaaaaaacccttccccaaaatccctgaggtgccacttcatgatacaccagagcgatcagccgccgataacaaggatctgatactcgatccttgttgccagctgccagcttatcttagtacttgtcccggacaatctagcagcctggcagtaacgaaaaccaatagcgacatcctgccacctcaaaagaagaccaaaccttcacagaaggttcagggaagagggtctcatgggtgtaggcagcaaagacaagctcgccaaaaagagagtaccctcaggcggcaggagcgaaagaacgccgcactagtaaccaggatgaaagcccagcggcctgaggaatgtctcaagcacatcattgttgttctggatcctgtcctactgcaaatggagggcggagggcagctcttgggagccctccagaccatggagtgtcggtgcgtaattgaggcccaggccgtgccttgctctgtcacctggaggaggagggctggtccctcagaggacagagaagattgggtggaggagcccacagtgctcgttctgctacgagccgaagccttcgtaagtatgattgataacggcaaacagggttccctggattctactatgaagggtaaagaaactcttcagggcttcgtgaccgatatcacagctaaaactgccgggaaggccctctccttagtaattgtcgatcaggagaagtgcttctcactcgagttgcttttcttcgattttcttccctgtacttcggctcagaaccctcccagacgcgggaagcagggggcaaataaacagactaaaaagcagcagcagaggcagcctgaggcctcaatcggctccatggtctccagggtggacgctgaagaggcattggtggatctccaactacatacagaggcacaagcccaaattgtgcagtcttggaaggagctagccgatttcacctgcgcttttacaaaggctgttgctgaggcccctttcaaaaagctccgagatgaaaccacgttttctttttgtcttgagagcgattgggctgggggtgttaaggtggaccttgccgggagaggcctggccctagtctggagaaggcagattcagcagctcaatcgggtcagcttagagatggcatccgcggtcgtgaacgcctaccccagcccacagctgctggtgcaagcctatcagcagtgtttctccgacaaagagagacaaaatcttttagccgatatacaggtgcgcagaggggagggcgtaaccagcaccagcaggcggattggaccagaattatcgaggagaatctacttgcaaatgaccactctgcaacctcacctcagcctagactctgccgactag

SEQ ID NO: 23994 - DNA, 1752 bp, Artificial Sequence
  Description of Artificial Sequence: Synthetic coding sequence
atggccctgaagaagagcagccccagcctggacagcggcgacagcgactccgaagagcttccaacattcgccttcctcaagaaggagccgtctagtactaaacgacgccagccagagcgagaggagaaaatcgtagttgtggacatttccgattgtgaagccagctgcccaccagcccctgagctgttcagtcccccagtgcctgagattgctgaaactgttactcagacacagcccgttaggctcttgagctctgagtccgaagacgaagaagaatttatacctctcgcccagagattgacctgcaagtttctgactcataaacagctgtcgcccgaagacagctcatctccagtgaagtctgtgctggaccatcagaacaatgaaggggcctcctgtgactggaagaagcccttcccaaaaattcccgaggtgcctctgcacgatactccggaaaggagtgccgctgacaataaagacctgatccttgatccatgttgccagctgcccgcatatttgtctacgtgtccaggccagtcctcaagcctagctgtgacaaaaaccaatagcgatatcctgcctccccagaaaaaaactaaaccatctcagaaggtgcagggacggggcagtcatgggtgtaggcagcagcgccaggccagacagaaggagtctaccttgaggaggcaggaacgcaagaacgcggctctggtcacgcggatgaaagctcaacgtccagaggagtgtttaaagcacataatcgtggtgctcgatcccgttctgcttcagatggaggggggagggcagttactaggtgccctccagaccatggagtgtcggtgtgtcatcgaagctcaggcagttccttgctctgtaacatggaggcgtcgagctggaccatctgaagaccgcgaggactgggtggaggagcccactgtcttagttctgctgcgcgcagaggcatttgtgagtatgattgataatgggaagcaaggcagtctggactccactatgaaaggtaaggagacactccaagggtttgttacagacattaccgctaaaaccgccggtaaggccctgtccctggtgattgtcgaccaggagaaatgtttttccctcgagctcctattttttgattttctcccttgtacttccgcccaaaatcccccccggagaggcaagcagggcgctaataagcaaactaagaagcagcagcagcggcagcctgaggcctccatcggctccatggtcagccgcgtcgatgccgaagaggctctggtggacctgcagcttcacaccgaggcccaggcccagattgtgcagtcttggaaagagttggccgatttcacgtgcgcttttactaaagccgttgccgaagccccttttaaaaaactgcgggacgaaactacattttccttttgcctggagtctgactgggcgggaggagttaaggtggacctcgcggggcgtggcctggccctcgtatggcggagacaaatccagcagctcaacagagtgtcactcgaaatggcttctgcagtagttaacgcatatccctcgccacagctgctggtacaggcttaccagcaatgcttctcagacaaggaacgccagaatttactggctgatatccaggtcaggcgaggcgagggcgtgacctccacatctcggcggatcggcccagagctatctcggcgaatctacctgcagatgactactttgcagccccatctgtccttggatagcgctgattag

SEQ ID NO: 23995 - DNA, 684 bp, Artificial Sequence
  Description of Artificial Sequence: Synthetic coding sequence
atggccgacctgctgggcagcatcctgagcagcatggagaagcccccttcgttgggggatcaggagacacgcagaaaggcgcgcgagcaagcagctcggcttaagaagctgcaggaacaagaaaaacagcagaaagttgagttccgcaaaagaatggagaaggaagtgagcgatttcatccaggactccggccaaatcaaaaaaaaattccagcccatgaataaaatagagagatcaattttacacgacgtggtcgaggttgccggtcttaccagctttagttttggagaggacgatgattgtcggtacgtgatgatatttaaaaaggagttcgcaccaagcgacgaggagctcgactcctacagacggggcgaagagtgggacccgcagaaggcagaggagaagcgcaaactgaaggagttggcccagcgtcaggaagaggaggcagcccagcagggccccgtcgtagtgtcccccgcttcggactataaggacaaatattctcacttgatcgggaaaggagctgctaaggacgctgcccatatgctgcaggcaaacaaaacgtacggctgcgtaccagtcgctaataagagggataccaggtccatagaggaggccatgaatgaaatccgagcaaaaaagcgcctgcgacagtcaggggaggagctgcctcccacctcatag

SEQ ID NO: 23996 - DNA, 1788 bp, Artificial Sequence
  Description of Artificial Sequence: Synthetic coding sequence
atgaccatgaccctgcacaccaaggccagcggcatggccctgctgcaccagatccagggcaatgagcttgagccactgaacagaccccagctgaagatcccactggaacgccccctcggagaggtgtacttagacagttcaaaaccagctgtgtacaattacccggaaggggcggcatacgaatttaacgcagccgcagccgcaaacgcccaagtctacggccaaactgggttaccatatggaccaggctccgaggccgctgccttcggctcaaacggcctggggggattccctcctctcaattcggtctctcctagcccgctgatgttgctgcaccctcctccacagctcagccccttcttgcaaccgcacggacaacaggtgccctactatctagagaatgagccctccggctacaccgtgcgggaggccggcccccccgctttttacagacccaacagcgacaaccggcgacagggaggcagggagagattggcctcaactaatgacaaggggagcatggccatggaatccgctaaggaaacaagatattgcgcagtgtgtaatgattacgcttcgggctatcactatggcgtatggtcctgcgaaggatgcaaagccttcttcaaaaggagtattcagggccacaacgattacatgtgccccgctacgaatcaatgcactatcgataaaaaccggcggaaaagttgccaggcctgtaggctccggaaatgttacgaagtagggatgatgaaggggggcatcaggaaggacaggagaggtggaagaatgctgaagcacaaaaggcagagggacgatggggagggccgcggcgaggtggggagtgcgggcgacatgcgggcggctaacctgtggcctagccctttgatgatcaaacgttcaaagaagaattccctcgctctctccctcacagctgaccagatggtctcggctcttctggacgccgaaccccctatcctttacagcgaatatgaccccaccaggccattctccgaggcgtccatgatgggactgcttactaacttggctgaccgggagctggtgcatatgatcaactgggctaagagagtccccgggttcgttgacctcacactgcacgatcaagtacatctgctggaatgcgcatggctggaaattttaatgatagggttagtgtggcggtctatggagcatcccggcaagcttctgttcgcacctaatctcttgctggatcgaaatcaaggaaagtgcgtggaggggatggtcgagatttttgatatgctgctggcgacctctagtaggttcaggatgatgaatcttcagggcgaagaatttgtatgtctcaagtctatcattcttctgaacagcggggtgtatacattcctgtcttccactttgaagtctctcgaagagaaagaccatattcacagggtgctagacaagatcacggacacattgatacatctcatggccaaggctggtctgacccttcagcagcagcatcagcggttagctcaattactgctgattttgagccacatcaggcatatgtccaataaaggaatggaacacttatattcaatgaagtgtaagaatgtagtacctttgtacgaccttctgctcgaaatgctggacgctcatagactgcatgcccccacgtctcgaggcggggcttccgtcgaagagaccgaccagtcacatctcgccacagccgggtctacgtcctctcattcgttacagaagtattacattacgggggaagccgagggctttcccgcgacggtttag

SEQ ID NO: 23997 - DNA, 549 bp, Artificial Sequence
  Description of Artificial Sequence: Synthetic coding sequence
atggagagcgccaaggagacccggtactgcgccgtgtgcaacgactacgcttctggataccactacggtgtctggagttgtgaaggatgcaaggccttcttcaagaggtcaattcaaggacataacgactatatgtgccctgccactaatcagtgtacaatcgacaaaaatcggagaaaatcttgccaagcgtgtcgcttaagaaaatgctacgaagtgggaatgatgaaaggaggtattcgcaaggatagacggggggggaggatgttaaagcataaactgctgttgatcctgtcgcacatccggcacatgtccaataaaggtatggagcacctctacagcatgaagtgcaaaaacgtggtccctctctacgacctgctcctcgagatgcttgacgcccacaggttgcacgcccctacatcccgcgggggcgcctctgtggaagagacggatcaatcccatcttgcaaccgcaggttcaacaagcagccattctcttcagaagtactacataactggagaggcggaggggttcccggcaaccgtgtag

SEQ ID NO: 23998 - DNA, 255 bp, Artificial Sequence
  Description of Artificial Sequence: Synthetic coding sequence
atgaccatgaccctgcacaccaaggccagcggcatggccctgctgcatcagattcaaggaaatgagttagagccactgaaccggcctcagctgaagataccgctggagcgccccctgggggaagtttatctggatagctctaagccagccgtttacaattatccagaaggagccgcctacgagttcaatgctgctgcagcagccaacgcccaagtgtatggacagacaggcctgccttacggccccggctcctag

SEQ ID NO: 23999 - DNA, 1005 bp, Artificial Sequence
  Description of Artificial Sequence: Synthetic coding sequence
atgaccatgaccctgcacaccaaggccagcggcatggccctgctgcatcagatccaggggaatgagctagagccccttaatcggccccagctgaaaatacctctcgaaaggccactgggcgaggtgtacctggattcatcaaagcccgccgtgtacaattaccctgaaggagcagcgtatgaatttaacgctgccgcagccgccaatgcccaagtgtatggccaaaccgggttgccttacgggcccggatccgaagcagctgcctttggctcaaacggtctcggtggctttcctccattaaacagcgtctctccaagtccattgatgcttctccacccgcctccccaactcagtccatttctgcaaccccacggccagcaggtgccatattatctggaaaacgagccctcgggctacaccgtccgcgaggcaggacccccggcattctacagaaatcaaggcaaatgcgtggagggaatggtggagatcttcgatatgctgctggctacttcaagcaggtttcggatgatgaacctccagggcgaggagttcgtctgtctaaagtctatcatcctactcaactcgggagtgtataccttcctttcaagtacgcttaagtcacttgaagaaaaggaccatatccaccgcgttttggataaaatcacggacactctgatccacctgatggccaaagcaggacttacactacaacagcaacatcaacgactagcccagttattgctgattctatcccacatccgccacatgtccaataagggcatggagcacctatactctatgaaatgcaagaatgtagtaccattatacgatctattactggaaatgctcgatgctcacaggctgcacgccccgacttcaagggggggtgcctcagttgaagagacagatcagtcgcacctagccacagccggtagcacctctagccacagcctgcagaagtactacataaccggtgaggccgaagggtttccagctacagtgtag

SEQ ID NO: 24000 - DNA, 324 bp, Artificial Sequence
  Description of Artificial Sequence: Synthetic coding sequence
cacaacgactacatgtgccccgccaccaaccagtgcaccatcgacaaaaacagacggaagtcctgccaggcgtgtagactccggaagtgctacgaggtgggtatgatgaaaggcggttttgtcgacctaactctccacgatcaggtacatctgttggagtgtgcgtggttggaaattctgatgatcggccttgtgtggagaagtatggagcaccctgggaagcttctcttcgccccgaatcttctcctggatagaaaccaaggtaaatgcgtagaaggtatggtggagattttcgatatgctgcttgctacttcatcacgctag

SEQ ID NO: 24001 - DNA, 1167 bp, Artificial Sequence
  Description of Artificial Sequence: Synthetic coding sequence
tgactgaagatcatcagctgccagcccagcgacaagcccgtgccccccggcgagaacgctcccgagtggcgagctgggcaacccgggtctgctcctcgctcccattgtggccgcagtgccgcaggccccgggcatcgccgccctctatgcgacttcaatggcgagggccccaactctgataacagacggcagggggggagggagagactggcgtcgactaacgataagggttccatggccatggagagcgcaaaggagacgcggtactgcgcggtttgtaacgattacgcatccggataccattatggcgtttggagttgtgaaggctgcaaggctttctttaagaggagtattcagggacacaacgactacatgtgtcccgctaccaatcagtgcactattgacaagaaccgccgcaagtcctgtcaggcatgccgcctcaggaaatgctacgaagtcgggatgatgaagggaggtattcggaaagaccgcagaggaggacgcatgctcaaacacaaacgccagcgtgacgacggagagggccggggagaagtgggctcggccggagatatgagggcagccaatctgtggccatcgcccctaatgattaaacggtctaaaaaaaactctctggctttgtctttgaccgccgaccagatggtgagcgctcttctggacgcagagcctccaattctctatagtgaatatgaccctacacgaccattctctgaggcgtccatgatgggcttacttaccaatttagcggaccgtgaattagttcacatgataaattgggccaagagagttccggggttcgtggatctgacccttcacgatcaggtgcacctgttggagtgcgcctggctggagatcctgatgatagggcttgtgtggcgaagcatggaacacccaggcaagcttctgttcgcgcctaatctcctgctcgatcgcaaccaggggaaatgtgtggaaggcatggtggagatctttgatatgctgcttgccacgtcatcccgatttaggatgatgaatttgcagggcgaggaattcgtgtgtctgaagagtataattctgctgaatagcggaatctcccacgtcgaggctaagaaaaggatcttgaatctgcatcctaaaatctttggtaataagtggttcccacgggtgtag

SEQ ID NO: 24002 - DNA, 813 bp, Artificial Sequence
  Description of Artificial Sequence: Synthetic coding sequence
atgtgccccgccaccaaccagtgcaccatcgacaagaaccggcggaagagttgtcaggcatgcagattgaggaagtgttacgaggtaggtatgatgaagggcggcatcaggaaggacagaagagggggacgaatgcttaagcacaagcggcagagggatgacggagagggccgaggggaagtcggttcagctggggacatgcgcgctgccaatttatggcctagcccattgatgatcaagcggtcaaagaagaatagcttagctcttagcctcactgccgaccagatggtcagcgcactcctggacgccgagccaccaattctatactctgaatacgaccccactcgcccattttctgaagcaagcatgatgggtctgttaacaaatctggcggatcgggaactggtgcacatgatcaattgggctaaaagagttccaggtttcgtggacctcactcttcatgaccaggtgcacttgctcgagtgtgcctggttagagatactcatgatagggctcgtgtggcgttccatggagcatcccggtaagcttctattcgctcccaatctgctactggatagcaataaggggatggagcacctctacagcatgaagtgtaaaaatgtcgtaccgttgtatgacttgctgttagaaatgctggatgcgcatagactgcatgctcccacatcccgaggtggagcttcggtcgaggagacggaccagtctcacctcgctacagccggatccactagcagtcattctctccagaagtactatattacaggggaagcagagggattcccggcaactgtttag

SEQ ID NO: 24003 - DNA, 1572 bp, Artificial Sequence
  Description of Artificial Sequence: Synthetic coding sequence
atgaccatgaccctgcacaccaaggccagcggcatggccctgctgcaccagatacagggaaacgaactggagcctcccccactgaactcagtctcaccatctcccctgatgcttctacatcccccaccacaactgtcccccttccttcagcctcacggtcagcaagtgccatactacctcgaaaatgagccgtctggatacactgtgcgggaagccggtccgccagccttctatcgccctaactctgataatagacgccagggcggcagggagcggctggccagtacaaatgataaggggagtatggcaatggagtcggctaaagaaacacgttactgtgctgtttgcaatgactatgcctccggatatcactatggcgtgtggagctgtgagggttgcaaagccttcttcaaaaggtccattcagggccataatgactatatgtgtccagccactaaccagtgcacaatagacaaaaacaggaggaagagttgccaggcatgcaggttgcggaagtgctacgaagtcggaatgatgaaaggtggaatcaggaaagaccggagaggcggaagaatgttgaaacataagcggcaacgagatgacggcgagggacgcggcgaggtgggctcggcaggagacatgcgggccgccaacttgtggccgagtcccctaatgattaaacggtcaaagaagaatagcctcgccctgtctttgaccgcagaccagatggtaagtgcactgctagacgctgaaccacccattctctattcggaatacgaccctaccaggcctttcagcgaagccagcatgatgggattgctcaccaatttggcggatagagagctggtgcatatgatcaattgggcgaagagagtgccgggatttgtagatctgacactgcacgaccaagtgcacctcttggagtgtgcatggttagaaattctgatgataggcctggtgtggagatctatggagcacccgggtaaactcttgtttgctcctaatctcctgctggaccgaaaccaaggcaagtgtgtggagggcatggtggaaatatttgatatgctgcttgccactagttctaggtttagaatgatgaacctccagggcgaggaattcgtttgtctcaagtcaattatcctgctcaattcaggcgtctacacctttttatctagtacattaaaatccttggaagaaaaggaccatattcatcgcgttctggacaagatcaccgacaccctgattcacctgatggccaaggcaggcctgacactccagcagcagcaccagcgtctggcccaacttctactgatcctctcgcacattaggcacatgtccaacaagggaatggaacacctctattcgatgaaatgtaagaatgtggtgcccctctacgatctgctgctcgaaatgctggatgcgcaccgcctgcatgccccaacctcacggggcggggcgagcgttgaggagaccgatcagtcccatctggcaaccgctggatccacttcctctcacagcttgcaaaaatactatatcaccggggaagcagaaggatttccagctaccgtttag

SEQ ID NO: 24004 - DNA, 1788 bp, Artificial Sequence
  Description of Artificial Sequence: Synthetic coding sequence
atgaccatgaccctgcacaccaaggccagcggcatggccctgctgcaccaaatccagggcaacgaattggagcctctgaatcggccccagctgaaaatccccctggagcgtccactcggggaggtctacctcgactcttccaaaccggctgtatataactacccagagggagcagcttacgagttcaacgcagcagccgccgccaatgcccaggtctacggtcaaaccggtttgccttacggccctggtagtgaggctgctgcgtttggaagtaatgggttgggcggctttccgccacttaacagcgtgagtcctagtccactcatgttgctgcatcctcccccccagttgtctccgtttctgcagccgcacggccagcaggtgccatactacctggagaacgaaccttctggttacaccgtaagagaggctggcccgccagcattctaccgacctaacagcgataatcgccggcagggtgggcgagagaggctggcttccacaaacgacaaaggctcgatggccatggagagtgccaaagaaacacggtactgtgcggtctgtaacgattatgctagtgggtatcactacggagtctggagttgcgaaggttgtaaggcctttttcaaacggagcatacaggggcacaatgactatatgtgccccgccaccaatcagtgtactatcgataagaaccgcagaaaatcctgccaggcctgtcgcctgcgcaagtgctatgaggttggaatgatgaaagggggcatacgcaaggacagaaggggggggcggatgctgaagcacaaaaggcagcgcgacgacggtgaaggcaggggagaggttggctctgccggtgacatgcgggccgcaaatctgtggccttctccactgatgataaaacgttctaaaaagaactcactggcgttgagcctgacagctgatcagatggttagcgctttgctggacgctgagcctcctatactgtattcggagtatgatccgaccagaccattctctgaggcgagcatgatggggctcttgaccaatttggccgaccgggagttagtacatatgattaattgggccaagcgcgtgcctgggttcgttgacctaacgttgcacgaccaggtccacctgctggaatgtgcatggctggagatcctgatgattggactggtgtggaggagcatggaacaccccggtaagttactcttcgctcctaacctgctactggataggaaccagggcaagtgtgtggaggggatggtggagatctttgacatgctcctcgcaacgagttcacgatttaggatgatgaatctccagggcgaggagttcgtctgcttaaaaagcatcatcctgttgaattccggcgtctacacattcctgagctcaaccctgaagtcactcgaagagaaggaccacatacacagggtgctggacaaaatcaccgatacactgatacacctcatggcaaaggccggactgactctgcagcagcagcaccagcggctggcccaactgctgctgatcctgtcacacatcagacacatgtcaaacaagggaatggagcacctgtactctatgaaatgcaaaaatgtggtccctttgtatgatctcttactggagatgctggatgcccacaggctccacgctcctacaagccgggggggcgccagcgtcgaggaaaccgatcaatctcatttagccacagccggttccaccagcagccacagcctccagaagtactacatcacaggtgaggcagaaggcttccccgctactgtttag

SEQ ID NO: 24005 - DNA, 1788 bp, Artificial Sequence
  Description of Artificial Sequence: Synthetic coding sequence
atgaccatgaccctgcacaccaaggccagcggcatggccctgctgcaccagatccaaggtaacgaattagagccgctcaaccggccccagctaaagattcctcttgagagacctttgggggaagtgtatctcgacagcagcaagcccgcggtgtacaattaccctgaaggggcagcatatgaatttaacgccgctgccgcagctaatgcccaggtttatgggcagactggactcccatacgggcctggctctgaggctgcagcctttggaagtaatggtctggggggattccccccactgaacagtgtcagcccttcaccactgatgctcctgcatcccccaccccaactttctcccttcctccagccacacggtcaacaggtaccctactatctggagaacgagccatcggggtatacggtgagagaggctggtcctcccgcattttaccgccctaacagcgataatcggcgacagggcggtcgggagcggctggccagcacgaacgataagggttccatggctatggaatccgccaaggaaacacggtactgcgccgtgtgcaacgattacgctagcgggtatcactatggtgtctggtcctgtgagggttgcaaggcattttttaagaggtctatccagggccataacgattatatgtgcccagctactaatcaatgcactatagataagaatcggcgaaaatcatgtcaggcttgccggcttcggaaatgctatgaggtggggatgatgaaaggaggcatcagaaaggacagacgaggcgggcgcatgctcaaacataaaaggcagcgggacgacggcgagggtaggggcgaagtgggatcagctggagatatgagagctgcgaacctgtggccgtcaccccttatgatcaagaggtcaaaaaaaaatagccttgccctcagtcttacggccgatcagatggtcagtgccctactcgacgctgaacccccgattttatatagtgagtacgatcctactagacctttctccgaggcatcaatgatgggactgctgaccaatctggcagatcgggagctggtacacatgatcaactgggctaagagagttcctggcttcgtggacctgacacttcacgaccaggttcatctcctcgagtgtgcatggttagagatcctcatgatcggacttgtctggcggagcatggagcacccaggcaagttactgttcgcgccaaatttgctccttgacaggaatcaagggaaatgcgttgagggcatggtcgaaatctttgatatgcttctggccacttcaagtcggtttaggatgatgaacctccagggcgaggagtttgtttgccttaaatctattatcctcctgaactctggagtatacacatttctgtccagtaccctgaagtccctcgaagaaaaagatcacatccaccgggtgctcgataaaattacagacaccctcattcatctgatggccaaggcagggctgaccttgcaacagcaacaccaaagattggctcaactcttactcattctttctcatattagacatatgtcaaataagggcatggaacatctctacagtatgaaatgtaagaacgttgtgcccctctatgacctcttgctcgagatgctggatgcgcaccgattacatgcgccgacatcaagaggaggagcttccgtagaagagactgatcaatcccacctggctacagctgggagtaccagttcccattctttgcagaagtactacataaccggagaggctgagggcttccccgctactgtgtag

SEQ ID NO: 24006 - DNA, 348 bp, Artificial Sequence
  Description of Artificial Sequence: Synthetic coding sequence
atgaccatgaccctgcacaccaaggccagcggcatggccctgctgcaccagatccaggggaacgagctggagcccctaaaccgtccgcagcttaaaatccctttggaaaggcctctaggtgaggtctacctggattcttctaaaccagccgtgtacaattacccagaaggagctgcttacgaatttaacgccgccgctgccgccaacgcacaggtatacggacagaccgggctgccctatgggcctggttcagaagcagcagccttcggaagcaatggtctgggcggcttcccccctctgaacagtgtgtcacctagcccattgatgctactacaccctccaccttag

SEQ ID NO: 24007 - DNA, 1452 bp, Artificial Sequence
  Description of Artificial Sequence: Synthetic coding sequence
atgaccatgaccctgcacaccaaggccagcggcatggccctgctgcatcaaatccagggcaacgagctggaaccactcaaccggccacaactgaaaatccccctagaaagaccactgggagaggtctatctggattcttctaagccggctgtgtataactatcccgagggggcggcctatgagttcaatgctgctgccgctgccaatgcccaggtctatgggcaaacgggactaccatatggccccgggtccgaagcagccgctttcggatccaatgggcttgggggtttccctcctttgaacagtgtgagtccttcgccccttatgctcctccatccaccaccacaactgtcgcctttcttgcaacctcatggccaacaggttccatattatcttgagaacgagccgagcggctacacagtccgggaagccggcccccccgccttttaccgtccaaattcagacaaccggcggcagggaggcagagaacggctggcttcaaccaacgacaagggatctatggccatggagtcagcaaaggagacgagatactgcgctgtgtgtaatgactatgccagcgggtaccactatggggtgtggtcttgtgagggctgtaaggctttctttaaacgttccatccaggggcacaatgactacatgtgtcccgccacaaaccaatgcacaatcgacaagaatagaagaaagtcatgtcaggcttgtagattacgcaagtgctacgaagtgggtatgatgaagggcggctttgtggacctgacactccacgatcaggtccatctgctggaatgtgcttggctggaaattttgatgatcggactggtctggagaagcatggaacaccctgggaagttactgtttgcccctaacctccttttagatcggaaccagggaaagtgcgtggagggaatggtggagatttttgatatgctcctcgctacttcttctcgattccggatgatgaacttgcagggagaagaattcgtgtgcttgaaatctataatcttgctcaattctggagtgtacacctttcttagctcaacactaaaatcactcgaagaaaaagaccacattcaccgcgtccttgacaagatcactgatacactaattcatctcatggccaaagccggtctgactctgcagcagcagcatcagcgcctggctcagctgctgttgattctgtcccatatcaggcatatgagtaataagggcatggagcacctatacagtatgaaatgtaagaatgtagtgcctctctacgatcttcttcttgagatgctcgacgcacataggcttcatgcccccacatctagaggtggcgcttccgtggaagaaactgaccagtctcatttagctactgccggatctactagtagtcactcactccagaaatattacattaccggagaagctgaaggctttcctgctaccgtgtag

SEQ ID NO: 24008 - DNA, 933 bp, Artificial Sequence
  Description of Artificial Sequence: Synthetic coding sequence
atggccatggagagcgccaaggagacccggtactgcgccgtgtgcaacgattacgcttctgggtatcactacggtgtgtggagctgtgaaggctgtaaggccttcttcaagcgttccatccaggggcacaacgattatatgtgcccagctacaaaccagtgtactattgataagaatcggaggaaaagttgccaggcctgccggctgaggaagtgttacgaggttggaatgatgaagggaggcattcgcaaagataggcgaggcggaaggatgctgaaacataaaagacagagagacgacggcgaaggacggggagaggtcggttcagccggagatatgcgtgccgctaacctgtggccttcacctctcatgattaaaagatcaaagaaaaatagcctcgctctgagcctcacagctgatcagatggtctccgccctgctggacgctgagccgccaattctctactccgaatatgaccccacacggccattttcagaagcctccatgatgggcctactgactaatctggccgatcgagaactggtgcacatgatcaattgggccaaaagagtcccagggttcgtcgacctgacgctccacgatcaagtgcacttgctggaatgcgcatggttggagatcctgatgatcggcctggtgtggagatcgatggaacatccagggaagcttctctttgcacccaatctgctcctggatcggaatcagggcaaatgtgtggagggcatggttgagattttcgatatgctgctcgccaccagtagtagattccgcatgatgaatctgcagggtgaagagttcgtctgtttaaagagcattatcctcttaaacagcgggatctctcatgttgaagccaagaagcgtattttgaacctgcaccctaaaattttcgggaataaatggtttccccgagtctag

SEQ ID NO: 24009 - DNA, 1320 bp, Artificial Sequence
  Description of Artificial Sequence: Synthetic coding sequence
atggacatcaagaacagccccagcagcctgaacagccccagcagctacaattgttcccagagcatcctgccccttgaacacggatcaatttacatcccgtccagctacgtggatagtcaccatgagtatcctgccatgacattttatagtccagcagtcatgaactatagcatcccgtctaatgttaccaacctggagggtggaccgggccgtcagaccacctcccctaatgtgctgtggccaaccccaggacacctgagtcccctcgtggtgcatcgtcaactttcccacctctacgcggagccccagaaatctccgtggtgtgaggctagatctctggaacataccttgccggttaaccgggaaactctgaagcggaaagtgtctggaaataggtgcgctagccctgttaccggcccagggagcaagcgcgatgcccatttttgcgccgtatgctctgattacgcatctggctaccactacggggtctggagctgcgagggttgcaaagccttcttcaagcgatccattcagggacacaacgattatatttgccctgcaactaatcaatgcaccatcgataagaataggaggaaaagttgtcaagcatgtcgattgcgtaagtgctatgaggtgggcatggtcaagtgcgggtcacgtagagagcgctgtggctaccggctcgtacgccgccaaagaagtgccgacgagcagttacattgtgctggcaaagcaaagcgaagtggagggcatgccccacgggtccgcgaactcctgctcgacgccctgagccctgagcagctagtgttgacacttctggaggccgagccaccccacgtcctgatcagcagaccttcagcaccctttacagaagcttcaatgatgatgtccctcaccaagctagccgacaaagaactcgtgcatatgatcagctgggccaagaagatacccgggatgtacccacttgtgaccgccacccaggatgcagacagcagtagaaagctggcccatctgctcaacgccgtcacggacgccctggtgtgggtgatagctaaatcaggcatatcgtcccagcaacagtcaatgcggcttgctaacctgctgatgctgctgagccatgtaaggcacgcctctaacaaagggatggagcatctgctcaatatgaagtgtaagaatgtggtgccagtgtacgacctgctcttagaaatgctcaacgcacatgttctaagaggatgcaaaagttctattactggttctgagtgcagccccgcagaggattccaagtctaaagaaggctcacagaatccacaatcacagtag

SEQ ID NO: 24010 - DNA, 1593 bp, Artificial Sequence
  Description of Artificial Sequence: Synthetic coding sequence
atggacatcaagaacagccccagcagcctgaacagccccagcagctacaattgctcccaatccattctaccactcgagcacggatccatttatatcccttcttcctatgttgactcacaccatgagtacccagccatgacattttattccccagccgtaatgaattactctatcccctctaatgttacaaacttggagggagggcccggaaggcagacaactagccctaatgttctttggccgactcccggtcatctaagtcctctagtggtgcataggcaactgtcccatttgtatgccgaaccacagaaaagtccgtggtgtgaggcgcgcagcctggagcataccctgccagtgaatagggagacactgaagagaaaggtgtccgggaatcgctgcgccagtcccgtgaccggccccggcagtaaacgcgacgctcatttttgtgctgtctgttctgactacgcctctggttatcattatggagtgtggagctgtgaagggtgcaaagccttttttaagcgttccatccaagggcacaacgactacatttgtcctgctaccaatcaatgcaccattgataagaatcggcgcaagagctgccaagcatgtaggctgaggaagtgttatgaggtgggaatggttaagtgtgggtccaggcgggagagatgcgggtatcggcttgtgagaagacagcgatctgcggacgaacagctacactgtgcaggcaaggccaagcgctccggcgggcatgccccacgggtgagagagttgcttcttgatgcgctgagtcccgagcagcttgtgttgactttgctcgaagcggagcccccccatgtcctgatctctagacctagcgcaccctttacagaggcgtccatgatgatgagccttaccaaattggccgacaaggagctggtacacatgattagttgggccaagaaaatcccaggattcgtggaactgtctctgtttgaccaggtgcgcctcctggaaagttgctggatggaggtgctcatgatgggactcatgtggcggtctatcgaccatccgggcaagcttatctttgctcccgacctggtcctggatagggatgaaggtaaatgtgtggagggtatcctcgagatttttgacatgctcttggcaacgacctcccggttccgggagctgaagctgcagcataaggagtatctgtgcgtgaaggctatgatcctgttgaactcctctatgtaccctttggtcacagccacccaggacgcggattcaagcagaaagctcgctcacctgctgaacgccgttaccgatgctttggtttgggtgatcgctaagagcggtatcagttctcaacagcaatcgatgcggttagcgaacttattaatgttactctctcatgttaggcacgcatcaaacaaaggcatggaacatttgctcaacatgaagtgtaaaaacgtagtccctgtgtacgatctgctgctggaaatgctgaatgctcatgttctgcggggctgtaaaagctctattacgggaagtgagtgcagtccagcagaggactcaaaatctaaggagggctctcagaaccctcagagccaatag

SEQ ID NO: 24011 - DNA, 1488 bp, Artificial Sequence
  Description of Artificial Sequence: Synthetic coding sequence
atggacatcaagaacagccccagcagcctgaacagccccagcagctacaactgttcgcagagtatcttaccgctggagcacggcagcatctatattccctccagttatgtggacagccaccacgagtatcctgccatgactttctacagccctgctgtaatgaattacagcatcccgagtaatgtgacgaaccttgagggcggtccaggcaggcagacgactagtcctaatgtgctgtggcctactcccggacatctgagcccgctagtggttcacagacaattaagccatctctatgcagagccccaaaagtcaccctggtgtgaagctcgctctctggagcatactttaccagtcaacagggagaccctcaagcgcaaggtgtcaggcaatcggtgtgctagcccggtcacggggcccggatccaagagggatgcccatttctgcgcagtatgttccgattatgcatccggctaccactatggcgtgtggtcctgtgagggttgcaaagcattctttaaaagaagcatccagggtcataatgactacatctgcccggcaaccaatcaatgcaccatagacaagaatagacgaaagagttgccaggcatgtagattgcgcaaatgctacgaggtaggaatggtgaagtgtggcagtcgtcgggagcgttgtggctatagattggtgaggcggcagcgaagcgccgacgaacagctgcactgcgccggaaaggccaaaaggagcggcgggcacgcaccgagggtgcgcgaactgcttttggatgcactgtctccagagcagcttgtgctgactctgctcgaggccgaacccccccacgtcctgattagccgcccaagcgccccatttaccgaggcctccatgatgatgtctttaacaaagctcgccgataaagaactggtccatatgattagctgggcaaaaaaaatcccaggtttcgtggagttgagcttgttcgaccaagtgcgcttactcgagagctgttggatggaggtgctgatgatgggattaatgtggcggtccatcgatcatcccggaaaactgatctttgctcctgatcttgtactcgatcgagacgagggtaagtgtgtagaagggatcttggaaatcttcgacatgttactcgcgacgacttccagattcagggagctaaagctgcaacacaaggaatacctgtgcgtaaaggctatgatcttgcttaacagcagcatgtaccctcttgtcaccgctacacaggacgcggactcctctcgcaagctggcccaccttctcaacgcagtgacagacgccctcgtatgggttatcgccaagtccggcatttcttcacagcagcagtcgatgcgcctggctaacctgctcatgttgttgtcccacgtacgccacgcaagagcagagaaggcctctcaaaccctgaccagctttgggatgaagatggaaaccttgctgcccgaagctacgatggagcagtag

SEQ ID NO: 24012 - DNA, 1446 bp, Artificial Sequence
  Description of Artificial Sequence: Synthetic coding sequence
atggacatcaagaacagccccagcagcctgaacagccccagcagctacaattgttcccaatctatcctgccgctcgaacacggttcaatatacattccatcgagctacgttgattcgcaccacgaatatccagccatgacgttttattcacccgctgtcatgaactattcaatccccagtaacgtgacaaatctagaagggggtcctgggcgccagacgacttctccaaacgtgctgtggcctacacctggtcatctctcccctcttgtggtgcaccggcagctgtcccacttgtacgcggaaccacagaaaagcccttggtgcgaggccagaagcttggagcacacactgcccgtcaaccgggagacactgaaaagaaaagtctccggtaaccggtgcgcatctccagttaccgggccaggcagtaagagggacgctcatttctgcgccgtgtgttcggactatgcaagcggatatcattacggtgtgtggtcttgtgagggttgcaaggccttcttcaagcggagtatccagggtcataatgattatatctgtcctgccaccaatcagtgcacgatcgataagaatcgaagaaaaagctgccaagcatgcaggctgaggaagtgttatgaagtcggcatggtgaagtgcggctctcggagggagagatgcggatatcgccttgtcagaaggcagcgctctgccgatgaacagctgcactgtgctgggaaagccaagagatcaggaggccatgccccgcgggtcagagagttactcttagatgccctgtctcccgagcagcttgttctgactctcctggaggcggaacctcctcacgtacttatctccagacctagtgcacccttcacagaggcgtccatgatgatgtctctcaccaagctggcagataaagaactcgtgcacatgatctcttgggctaaaaagattcccggcttcgtggaactttcactgttcgaccaggtaaggctcttagagagctgctggatggaggtgctgatgatgggcttaatgtggagatccatagaccaccccggaaaactgatatttgctcccgaccttgtgctggatcgcgatgaaggcaaatgcgttgaaggcatccttgagatctttgatatgttactggcaaccacatctcgtttccgtgaattaaaattgcagcacaaggaatatttgtgcgtgaaagccatgattctccttaattcttctatgtaccctcttgttaccgcaacacaggatgcggacagttcccgcaagttagcgcacctgctcaatgctgttacagacgctcttgtttgggtcatcgcaaagtccggaatttcctctcagcagcagtctatgaggctggcaaacttgctgatgcttctgagccacgtgaggcatgccagatggggggaaaagcaattcatccatctgaaactgagttag

SEQ ID NO: 24013 - DNA, 1488 bp, Artificial Sequence
  Description of Artificial Sequence: Synthetic coding sequence
atggacatcaagaacagccccagcagcctgaacagccccagcagctataattgttctcagtcgattctccccctcgagcacggctccatctacattccttccagctacgtggacagccatcacgaatacccagccatgactttttacagtccagctgtgatgaattatagcattcccagtaacgtgacaaatcttgagggcgggccaggtcgtcagacaacctcccccaatgtcttatggcccacaccaggtcacctttcacccctggtcgttcatcggcagttgagtcatctgtatgccgagcctcagaagtccccgtggtgcgaggctagatcgctggagcatacactcccggtgaacagagagaccctgaagcgcaaggtatccggcaatcgatgcgccagtcctgtgaccggaccaggatctaagagagacgcccacttttgtgccgtgtgtagtgactacgcctctggctatcattacggagtgtggtcctgtgaaggctgtaaggctttctttaaaagatctatccaggggcataatgattatatttgtcctgcaaccaatcagtgtaccatcgataaaaatcggcgcaaatcctgccaagcttgtaggctccgaaaatgctacgaggtcggaatggtcaagtgcggcagtcgcagggagagatgtgggtacaggctggtccgccggcagaggtctgctgatgaacagctgcattgtgccgggaaggccaagcggagtgggggccacgcaccacgagtccgggaacttctcctcgacgcactgtcccctgaacagctagttctgaccttgttagaggctgagcctcctcacgtgctcatttccagaccaagcgccccctttacagaggcttcaatgatgatgagcctgacgaaactggccgataaggagctcgtgcatatgatctcctgggccaaaaagatccccggtttcgttgaactgagcctgtttgaccaggtgcgactattggaatcttgttggatggaggtgctaatgatgggcctcatgtggcggtcaatcgaccacccgggaaaactcatcttcgcccctgacctggtgctggaccgagacgaaggtaagtgtgtggaagggattctggagatctttgacatgctgcttgctacaacctcccgctttcgggaacttaagttgcagcacaaggagtatctgtgcgtgaaggctatgatcctccttaatagtagtatgtaccctttagtgactgccactcaagatgctgacagttcgcgaaagctggctcacttgctgaacgctgtgacagacgccctggtctgggtgatcgccaagtctggcatcagcagccagcagcagagtatgagattagcgaaccttttgatgctgttgagtcatgtccgtcatgccagggcagagaaagcaagtcagacactgacctcattcggcatgaagatggaaacactgttaccagaagctaccatggagcagtag

SEQ ID NO: 24014 - DNA, 1542 bp, Artificial Sequence
  Description of Artificial Sequence: Synthetic coding sequence
atggacatcaagaacagccccagcagcctgaacagccccagcagctacaactgttcacagtccatcctcccactcgagcacggcagcatctacatacccagcagttacgttgactcccaccatgagtatcctgctatgaccttctactcacccgcagttatgaattattccatcccctcaaatgtgaccaatcttgaaggcggccccggcagacagaccacatcccccaacgtgctgtggcctactcccggacacctgtctcccttggtggtccaccgacagctatcgcacctctatgccgagccccagaaatctccttggtgcgaggcacggtcacttgaacacactctaccggttaatagagagaccctgaagcggaaggtctctgggaatcggtgcgcttctccagtaacaggcccgggaagcaaacgggatgctcatttctgcgccgtgtgcagtgattacgcatccgggtatcactacggggtgtggagttgtgagggatgtaaagccttcttcaaaaggagcattcagggacataacgactatatttgccctgctacaaatcaatgcacgattgataagaaccgcaggaagtcatgtcaagcctgtcggctgcggaagtgctacgaggtcgggatggtgaaatgtggcagtagacgggagcgatgtggatacaggctcgtccgcagacaacgatccgccgatgagcagctgcactgcgcagggaaagcgaaacggagtggaggacacgcgccccgggtgagggagttactcttagatgctctatcacccgaacagctggtcttgactctgttagaggcagaacccccgcacgtcctgatcagtaggcctagcgcaccatttacagaagctagtatgatgatgtccctaaccaaattggctgataaagaactagtacatatgatctcctgggcgaaaaagatccctggcttcgtggagttaagcttgttcgaccaagtgcggctgcttgagtcttgttggatggaagtgctgatgatgggcctgatgtggagatcgattgaccatccggggaagctaatctttgccccggacttggtgttagatcgggacgaagggaagtgtgtggaggggatactggaaatattcgacatgctcctggctactacctctcgctttcgggaattgaagctacagcataaggaatatctgtgcgtcaaggctatgatattactaaacagctctatgtatcccctggtgaccgcgacccaggacgccgactccagtcggaagctggcacatttgttgaatgcagtaaccgacgcactggtgtgggttatcgccaagtccggaataagctcccaacagcagtccatgcgcctggcgaacctgttaatgctcctttcccatgttaggcacgcgagttccctcagcctctcttggagattgtttatgctcagggaagccagctgtcacggcgttaggcagacacctgggggagcccatgtttcagtgtcgcgaagcagaagttttgaggcctgccagcaaccaagagaatag

SEQ ID NO: 24015 - DNA, 1488 bp, Artificial Sequence
  Description of Artificial Sequence: Synthetic coding sequence
atggacatcaagaacagccccagcagcctgaacagccccagcagctataattgcagtcagtctatcctgccacttgagcacgggtcaatatatatacccagttcgtacgtggactctcaccacgaatacccggcgatgacattttactccccagctgtcatgaattattcaatacctagtaatgtgactaacctcgagggtggccccggaagacagacaacttctccaaacgttttatggccaacgccggggcatttatcacccctagtggtgcatagacagctgtctcatctgtatgccgaacctcagaaatcaccttggtgcgaagctcggagcctagagcatactttgcccgtgaaccgagagacgctaaagaggaaggtgtccggaaacaggtgcgcctcccccgttaccggtccgggctcaaagcgagacgcacacttttgtgccgtgtgctccgactatgcttcaggataccactacggtgtgtggtcctgcgaagggtgcaaagctttcttcaagagatcaattcagggccacaatgactacatctgccccgccaccaatcagtgcacgatcgacaaaaatcggcgaaaatcatgccaggcatgcaggctacgcaagtgctacgaggtcggcatggttaaatgcggtagtcggagagagcggtgcggttatcggctggtcaggcggcaaagatcagcggacgaacagctccactgcgctggtaaggccaaaaggtctggcggacacgctcccagggttcgtgagctcctcctcgatgctttgagccctgaacaactggtgctcacactcctcgaagccgagccaccgcatgttctgatttcccgtcccagcgccccattcactgaagcttctatgatgatgagtcttactaaactggccgataaagaactggtacacatgatatcttgggccaagaagattccgggctttgtggagttgtccctcttcgatcaggtgcgattactcgagagttgctggatggaagtcctgatgatggggcttatgtggcgatccatcgatcacccaggtaaacttattttcgcgccggacctcgtgctggaccgtgatgagggcaaatgcgtggaagggatcctggagatttttgacatgctgctggccaccaccagcagatttcgggaactcaagttgcagcacaaagagtatttgtgcgtgaaggccatgatattattaaattccagcatgtaccccctggtgaccgccacgcaggatgctgacagcagccggaagctggcacatctgttgaatgctgttaccgacgctctcgtgtgggtgatcgccaagtcgggtatatcgtcacagcagcagtccatgcgcttggccaatttgctgatgctcttgagccacgtaaggcatgctagggcggagaaagcctcacagacattaacaagctttggaatgaagatggagaccctcttgcctgaggctacaatggagcaatag

SEQ ID NO: 24016 - DNA, 1419 bp, Artificial Sequence
  Description of Artificial Sequence: Synthetic coding sequence
atggacatcaagaacagccccagcagcctgaacagccccagcagctataattgtagccaatcgatcctgccattggaacacggaagtatatatatcccctcctcatatgtcgacagccatcacgagtatccagctatgacattctattctcccgccgtgatgaattattccattccctccaatgtaactaaccttgaggggggccccggtcgacagacgacaagtccaaacgtgctgtggccaacaccagggcacttatctcctctagtggtacaccggcagctttcccacctttatgctgagcctcaaaaaagcccttggtgcgaagccagatcacttgaacatacgctgcctgtcaaccgtgagaccttaaagaggaaagtatcggggaatcgttgcgcctcgcccgttacggggcccggatctaagcgggatgcccatttttgcgccgtgtgttctgattatgcttctggataccactacggagtgtggtcctgtgagggatgtaaagccttctttaagcgttctatccagggccataacgactatatctgcccagccaccaaccagtgcacgattgacaagaataggcggaaatcgtgccaggcctgtcgcctcagaaagtgctacgaagtgggtatggtaaagtgcggaagtaggcgcgagaggtgtggatatcgtctggtgcggcgtcagagaagcgcggacgagcagctgcattgcgcaggcaaagctaagcgatcaggtggacatgctccgagggtcagagagttgctgctagacgcattgtcgccagagcagttggtccttaccctcctggaggcagaaccaccccacgtattgattagccgcccatctgctccttttacagaggcttcgatgatgatgtcactgacgaaactggcagacaaagaacttgtgcatatgatctcctgggccaagaaaatccctggattcgtagagctctctctattcgaccaggttagattattagagtcctgctggatggaggtgcttatgatgggcttaatgtggcgttctattgatcacccagggaagctgatctttgctcccgacttagtgctggatagagatgagggaaagtgcgtcgaggggattctggaaattttcgacatgctgcttgctactacgagtcggttccgtgagctcaaactacagcataaagagtacctctgcgtgaaagcaatgatacttctgaacagcagcatgtatccgctcgtcacagctacccaggacgctgacagctcccggaaactcgcacacctgttgaacgcagtgactgatgccctggtttgggttatagccaaatctggtatatcttcccagcaacagtcgatgcgtctggccaacctgctgatgcttctgagccacgtcaggcacgcccggtatgctccctag

SEQ ID NO: 24017 - DNA, 1446 bp, Artificial Sequence
  Description of Artificial Sequence: Synthetic coding sequence
atggacatcaagaacagccccagcagcctgaacagccccagcagctacaactgttcccagagcatcttgcccttggagcatggcagcatttacattccttccagttacgtagatagtcatcacgagtatcctgccatgacattttactcccctgcggtgatgaactactccattccaagcaatgttactaatctggagggcggccccggccgccagactacgtcacccaatgttctgtggcccacaccaggacatctctccccacttgttgtccaccgccagttaagccacttatatgcagaaccccagaagtctccttggtgtgaggctcgatcactggagcataccctgccagtgaatcgggagactctgaagcggaaagtttcaggcaataggtgtgcgtcgccagtgaccggcccaggcagcaaacgtgacgcccacttttgtgctgtgtgctccgactacgcaagcggatatcattatggagtgtggtcttgtgaaggctgtaaagcattttttaagcgctccatccaaggccataatgattacatatgtcctgcaacaaaccagtgcacaatagataaaaatcgtaggaaatcttgtcaagcctgccgcttgagaaaatgttatgaggtggggatggttaagtgtggatctcgtagagaacgctgcggatatcgactggtgcgacggcagcgcagtgctgatgagcagctgcactgcgctgggaaggcaaagaggagcggtggacatgccccgagggtgcgagagctgttgctggatgcgctgtctccagaacagctggtgttaaccctcctcgaagccgagcctcctcacgtcttgataagtcggcctagcgcacccttcacagaagcatccatgatgatgtcactgacaaaattggccgacaaggagttggtgcacatgattagctgggcaaagaaaattcccggatttgtcgagttgtctctcttcgatcaagtgagacttctcgaaagttgttggatggaagtacttatgatgggactcatgtggcgtagtattgatcaccccggaaaattgatttttgcccctgatctggtgctggacagagacgaagggaaatgcgttgaaggaatcctagaaatttttgatatgttactcgcgacaacatctcggtttcgggaactcaagcttcagcacaaggaatatctgtgcgttaaggcaatgattttgctgaacagtagcatgtacccccttgtgacggccactcaggacgcagacagttcccgaaagttagcacacttgctgaatgctgtgacagacgccttggtctgggttattgcaaaatctggcataagttctcaacagcagtccatgagactcgcgaacctactcatgctcctttcccacgttaggcacgcgaggtggggcgagaaacaattcatccacttgaagctgagctag

SEQ ID NO: 24018 - DNA, 1380 bp, Artificial Sequence
  Description of Artificial Sequence: Synthetic coding sequence
atggacggcttctacgaccagcaggtgccctacatggtgaccaactcccagaggggcagaaactgcaacgagaaacctacgaacgtccgcaaaagaaaattcatcaacagagatttagcccatgactccgaagaactgttccaggacctgagtcagctccaggagacatggctggctgaggtcgctttccacggcttgcctttaaagataaaaaaggagccccattccccatgcagcgaaatttcgagcgcgtgtagccaagaacaaccattcaaattttcttacggagagaaatgtctgtacaatgtgtctgcgtacgatcagaaaccacaggtcggtatgcgtccaagcaaccctcctactcctagcagcacacctgtatctccgctacatcacgcttcccccaacagcacacatactcccaaacctgatcgggccttccccgcgcacctaccaccgagtcagagtattcctgactcatcttatccaatggatcacagatttcgccggcagctgtccgagccatgtaactcctttccaccactgcctacgatgcccagggagggcaggcctatgtatcagagacaaatgtccgagccaaacatccccttccctccacaagggtttaagcaggaataccacgaccctgtatacgagcacaacacaatggtgggaagcgcagcttctcagtccttcccaccccctctgatgataaaacaagaaccccgggactttgcctatgacagcgaggtgcctagctgccattccatctacatgcggcaggaaggcttccttgcccatccttcgcggaccgaagggtgcatgttcgagaaaggcccacggcagttctatgacgatacctgcgtagtgcctgagaagtttgacggcgacattaagcaggaacccggaatgtaccgcgaagggcccacttatcagcgtagaggctctctgcagctctggcaattccttgtggccttattagacgatccgagcaacagtcatttcattgcatggaccgggagaggcatggaattcaagctgatcgagcccgaggaggttgcaagaagatggggcatccagaaaaacaggcccgccatgaattacgacaagctgagtcggtctctcagatattattatgagaagggcatcatgcagaaggtcgccggggagcgatatgtgtacaaattcgtttgcgaccctgaggccctcttctcaatggcattccccgacaaccagcgccctctgcttaagacagatatggaacgccacataaacgaagaagacactgtgcctctgtctcacttcgacgagtccatggcgtatatgccggagggcgggtgttgtaatccccacccttataatgagggttacgtttattag

SEQ ID NO: 24019 - DNA, 1380 bp, Artificial Sequence
  Description of Artificial Sequence: Synthetic coding sequence
atggacggcttctacgaccagcaggtgccctacatggtgaccaacagccagcgggggcgcaactgcaatgagaaacccaccaatgtgagaaaaaggaagtttattaaccgcgatttggctcatgatagcgaggaactttttcaagatctgagtcaactccaggagacttggctggctgaggtggcctttcacggactgccactcaagataaagaaggagccgcactcaccatgctcagaaataagcagcgcatgttcgcaggagcagccttttaagttttcttacggagaaaagtgcttgtacaatgtgtccgcttatgaccaaaagccacaagtgggcatgcgaccaagcaacccccctactccttccagtacccccgttagcccactgcatcacgctagccctaatagtacccacacacctaagccggacagagcttttcctgcccacctaccaccgtcacaaagtataccggacagctcatatcctatggatcatcgctttcggcggcagctgtcagagccctgtaactcattccctccgctgcccacaatgccccgggaaggacgcccaatgtaccaacgtcagatgagtgaacccaacatccctttccccccacagggatttaaacaggagtaccatgatcctgtctacgagcacaataccatggtgggctcagcagcttcacagtcctttcctccccccctgatgatcaagcaagagcctagagattttgcctacgatagtgaggtccctagttgccactctatctatatgagacaggagggcttccttgcccatccctcccggacagaaggatgcatgttcgagaaggggccgaggcagttctacgacgatacatgcgtggtgcctgagaagttcgacggcgatatcaagcaggaacccggcatgtatcgggaaggtccaacgtatcagcggcggggaagtctgcagttgtggcagttcctcgtagcgttattagacgacccctctaattcacacttcatcgcgtggacgggtagaggcatggaattcaaactgattgagcctgaggaggtggctcgacgttgggggattcaaaagaatcgcccggcgatgaactacgacaagctttcacggtcactgaggtactactacgagaagggcattatgcaaaaagtggccggtgagcgatatgtgtacaaatttgtgtgcgatcctgaagccctgttttctatggcctttcctgataaccagcgccctctgctgaagactgacatggaacgccacataaacgaggaagataccgtccccctatcccacttcgatgagagcatggcttatatgcctgagggtggatgctgtaatccacacccatataacgagggctacgtgtactag

SEQ ID NO: 24020 - DNA, 1125 bp, Artificial Sequence
  Description of Artificial Sequence: Synthetic coding sequence
atgctgcaggacctgagcgccagcgtgttcttccccccctgcagccaacatcgaacgttggcccaagttccagataacgacgaacagtttgtccccgattatcaggctgaaagtctcgcctttcacggactgcccctaaaaatcaagaaggaaccgcattcaccatgcagtgaaatctcttccgcctgctcacaagagcaaccttttaaatttagctacggggagaagtgcctctacaacgtacgatttcggcggcagctaagtgagccatgcaacagcttccctccactccccacaatgcctcgagagggccggcctatgtatcagagacaaatgagtgaacctaacataccgtttccgccacagggcttcaagcaagagtaccacgatcctgtttacgagcacaatactatggtaggatccgccgccagccagagttttccgccaccgttgatgattaagcaggagccacgcgatttcgcttacgattcagaagtcccatcgtgccattctatatacatgaggcaggagggttttctagctcacccctcccgcactgaaggctgcatgtttgaaaagggcccacgccaattctatgacgatacatgtgtggtccccgagaagttcgacggtgatataaagcaggaaccaggaatgtaccgggagggtcctacctaccagagacgtggttccctccagctgtggcagttcttggtggccctgctcgacgatccctccaactcccattttattgcatggaccggccggggaatggagttcaagcttatcgaaccggaggaggttgcgcgcagatgggggattcaaaagaatcgacccgccatgaattatgacaagctgtcccggtcactgcgatactactacgagaaagggattatgcagaaagtagccggagagcgttatgtctacaaatttgtttgcgacccagaagcgctgttcagcatggctttcccagataatcagcgacctctgctgaagacagatatggaacgacatataaatgaggaggatactgttcccctaagtcattttgacgaatcaatggcgtacatgcccgaggggggctgttgcaatccccacccttataacgaggggtacgtgtactag

SEQ ID NO: 24021 - DNA, 1380 bp, Artificial Sequence
  Description of Artificial Sequence: Synthetic coding sequence
atggacggcttctacgaccagcaggtgccctacatggtgaccaactcccagcgaggccggaactgtaacgagaagcccacaaacgttcgcaagcgaaaatttatcaatcgggacttggctcacgattctgaggagctgtttcaggacctcagccaactgcaggagacttggttagctgaagtcgcttttcatggtcttccattaaaaatcaaaaaggaacctcactcgccatgctccgagattagcagcgcctgttctcaggaacagccattcaagttctcctacggcgaaaaatgtttatataacgttagtgcttatgatcagaagcctcaagtgggaatgaggcctagtaaccctcccacgccatcctctacaccagtgagtcccttgcatcatgctagcccaaactccacgcacactcctaaaccagacagggcatttccggcccacttacccccgtcgcagtcgatccctgactccagttatcccatggaccatcgatttagacgtcagttatccgaaccctgcaattctttccctcctctccctactatgccccgcgagggtagacccatgtatcagagacagatgtctgaaccgaacattcctttccctccccaagggtttaagcaagagtatcacgaccctgtgtacgagcacaacacaatggtaggctctgccgcctcgcagtcgttccctccacctctgatgatcaaacaggagccgcgcgattttgcttacgactctgaggtacccagctgtcactcgatatacatgcggcaggaagggtttctcgctcatccatcaagaacggaaggctgtatgtttgagaaaggccctcgacagttctacgatgacacatgtgtcgtgccggaaaagttcgatggggacattaagcaggagcctgggatgtaccgggaagggcctacctaccagcgcagagggagtctccagttatggcaattcctggttgcactccttgatgatcctagcaactcccatttcattgcttggaccggcagagggatggagtttaagctgatagaaccagaggaggtggcccgcaggtggggcattcagaagaaccgtcccgccatgaattatgataaactgtcccgttcactccggtactactacgagaaagggatcatgcagaaagtggccggagagcgctacgtgtacaaatttgtgtgtgaccccgaagccctattcagcatggcttttcctgataatcagaggccactcctcaaaaccgatatggaacgccacataaatgaggaggacactgtccctttgtctcacttcgatgaaagcatggcctacatgcccgaaggtggatgctgcaatcctcacccgtataatgagggatacgtttattag

SEQ ID NO: 24022 - DNA, 1434 bp, Artificial Sequence
  Description of Artificial Sequence: Synthetic coding sequence
atggacggcttctacgaccagcaggtgccctacatggtgaccaacagtcaacggggccgcaattgtaacgaaaagcctaccaacgtgaggaaaaggaagtttatcaatagagatctggcccatgactcagaggagctatttcaggatcttagccagttgcaagaaacttggttggccgaggctcaggtcccggacaatgatgaacagttcgtgcccgactatcaggcagaatccctcgccttccacggcctccctctcaagattaaaaaagaacctcatagcccctgttcagaaatctctagtgcctgtagccaggagcagcctttcaaatttagttacggcgagaaatgcttatacaacgtatcagcgtatgatcaaaaaccacaggtagggatgcggcctagcaacccaccaacccccagcagcacaccagtctcaccactgcatcacgcgtccccaaattcaactcatacacctaaacccgatcgggcgttcccagcacatttaccaccttcccagagcatccccgactcatcctatcccatggaccacaggtttcggcggcagctcagcgagccgtgtaatagttttccaccgctacccaccatgcccagagaaggtaggccaatgtaccagaggcagatgagcgaacctaatattccttttccaccacaggggttcaaacaggaatatcacgacccagtttatgagcataataccatggttgggagtgccgcgtctcagtctttcccaccccctcttatgatcaagcaggaaccacgtgacttcgcctacgattctgaagtgccatcctgtcattcaatttacatgagacaggaaggctttttagcccatccctcccggacggaaggctgtatgttcgaaaaagggccaagacaattttatgacgatacttgcgtcgttccggagaagttcgacggggacatcaagcaagagcccggcatgtaccgtgaaggtccaacataccagcgccgaggaagcctgcaattgtggcagtttctggtggcactcctcgacgatccgagcaatagccactttatcgcctggacaggacgtggcatggagtttaagcttattgagccggaagaagtggccaggaggtggggcattcaaaagaatcggcccgccatgaactatgataaactgtctcgatctctccgatactactacgagaaaggaatcatgcagaaagtggcgggcgaaaggtatgtctataaattcgtttgtgaccccgaggcactgtttagtatggcctttccagataaccagcgcccactcttaaaaacagatatggaacggcatatcaacgaagaagatactgtgcctctttctcatttcgacgaatctatggcctacatgcccgaaggaggttgttgtaacccacatccatataacgaaggatacgtctactag

SEQ ID NO: 24023 - DNA, 1260 bp, Artificial Sequence
  Description of Artificial Sequence: Synthetic coding sequence
atgctgcaggacctgagcgccagcgtgttcttccccccctgcagccaacatcggacgctggtagcctttcacggacttcctctgaagattaaaaaagaaccacactcgccttgctccgaaatctcttcagcctgttctcaggagcagccgttcaaattctcctatggagaaaagtgtctgtacaatgttagcgcatatgaccagaagccccaggtcggcatgagaccttccaatcctccaacaccgtcatcaacacccgtgtccccactccatcatgcatcccccaatagcacccacactcctaagccggatagagcttttccggcacatctgccaccgtcccagtcgattcctgattctagctatcccatggaccacagattccgaagacagctgagcgagccatgcaactcttttccacctttacccactatgccgcgagaaggtcggcccatgtatcagcgccagatgagtgaacccaacatcccctttccaccacaagggtttaagcaagagtatcatgacccagtatatgaacacaacacaatggtgggtagcgctgcatcacagtccttccctcctcctctcatgattaagcaagagcctagagatttcgcttatgatagtgaagtgccctcctgtcattccatttacatgaggcaggagggcttcctggctcatccttcacgcaccgagggatgcatgttcgagaaaggtccacggcaattctacgatgacacctgcgttgtgcccgaaaagtttgacggcgatattaagcaggagcctgggatgtaccgcgaaggaccgacataccaacgcagaggaagcctgcagctttggcagttcctggtggccctcttggacgacccatcaaacagtcactttattgcctggaccggccgcgggatggagttcaagctgatcgagccagaggaagtcgcccgtaggtgggggatccagaagaacagaccagcaatgaactacgataaactgagccgcagtctccgatattactatgaaaagggtattatgcagaaggtggcaggcgaaaggtacgtgtacaaattcgtttgcgacccggaggctcttttcagtatggcttttccagataatcagagaccgctgctgaaaacagacatggagcgccacattaatgaagaagacacagtcccactgtcccatttcgatgaaagcatggcttacatgcctgaaggagggtgttgcaatcctcacccatataatgaaggatatgtttattag

SEQ ID NO: 24024 - DNA, 372 bp, Artificial Sequence
  Description of Artificial Sequence: Synthetic coding sequence
atggacggcttctacgaccagcaggtgccctacatggtgaccaactctcagcgggggcgtaactgcaacgagaagcctacaaacgtgcggaagcgcaagtttataaatagagacttagctcatgattccgaggagctcttccaggacctatcgcagctgcaggaaacctggcttgctgaagcccaggtccctgacaacgatgaacagttcgtgccagattaccaggcagagtctctggcttttcatggcctgccactgaagattaagaaagaaccacacagcccttgcagcgagatatccagcgcctgtagccaggagcagccattcaagttctcttatggcgaaaaatgcctgtataatgtctctgcctag

SEQ ID NO: 24025 - DNA, 1434 bp, Artificial Sequence
  Description of Artificial Sequence: Synthetic coding sequence
atggacggcttctacgaccagcaggtgccctacatggtgaccaacagtcaacggggcagaaattgtaatgaaaaacccaccaatgtcaggaaacggaagtttatcaatcgcgacctagctcacgacagtgaggaactgtttcaggatctgtcgcagctccaggagacctggttggctgaagcccaggtaccagacaatgatgagcagttcgtgcctgactatcaggccgagtcactcgcgttccacggccttcctctcaaaatcaagaaggagccacattcgccatgtagcgaaatctcttctgcatgttcacaggagcaacccttcaaattttcgtacggggagaagtgtctctataatgtgtcagcttacgaccagaagccacaagtgggtatgagaccttccaatccacctacgccatcgagcacccctgtatccccgttgcaccacgcctcacccaatagtactcatactccaaagccagaccgtgccttccctgcccaccttccaccgtcccagagtatccctgacagttcctacccaatggaccaccgcttccggcgccaactgagcgaaccatgtaactccttcccccccctgccgactatgccacgggaaggtagacctatgtatcagcggcagatgagcgaacccaacattcctttcccgccccagggttttaaacaggagtatcatgacccggtatatgagcataataccatggtgggctcagctgcatctcagagtttccccccaccattgatgattaagcaggagcctcgcgattttgcttacgactccgaagttccaagttgtcattccatttacatgcgtcaggagggattcttagcccatccttcacgaactgagggctgtatgttcgagaaggggcctaggcagttctacgatgacacctgcgtggttcccgaaaagtttgatggggacatcaagcaggagccaggcatgtatcgcgaaggccccacctaccagagacgcggaagtctacaactatggcaattcctagtggctctgctggatgaccccagcaatagccatttcatcgcctggaccgggagaggcatggagttcaagctcatcgaaccggaggaagttgctcgtcggtggggaatacaaaaaaatagaccagccatgaactatgataagctgtcccgcagcctccgttactattatgagaagggaattatgcagaaggtcgctggtgaacgttacgtatacaagtttgtgtgtgatcctgaggcactcttctcaatggcctttcctgataatcagcggcccctgctcaaaaccgatatggaaagacatatcaatgaggaagatacggtgcctctaagccacttcgatgagtcgatggcgtatatgcctgagggtggctgttgtaaccctcacccttataacgagggatacgtttattag

SEQ ID NO: 24026 - DNA, 288 bp, Artificial Sequence
  Description of Artificial Sequence: Synthetic coding sequence
atggacggcttctacgaccagcaggtgccctacatggtgaccaactcacagcgtggtcgtaactgcaatgagaaacctacaaatgtcaggaaaagaaaattcatcaatagggacctggcacacgactctgaggagctgttccaggacctctcacagttacaggagacctggctcgccgaagcccaagtcccggacaacgacgagcagtttgtccctgactaccaggccgaaagcttggcctttcacgggttacccctcaagattaagaaagagccacattctccatag

SEQ ID NO: 24027 - DNA, 63 bp, Artificial Sequence
  Description of Artificial Sequence: Synthetic coding sequence
atggacggcttctacgaccagcaggtgccctacatggtgaccaacagccagcgaggacggtag

SEQ ID NO: 24028 - DNA, 1314 bp, Artificial Sequence
  Description of Artificial Sequence: Synthetic coding sequence
atgctgcaggacctgagcgccagcgtgttcttccccccctgcagccagcatagaaccctggcgcaggtaccagataacgatgaacagttcgtgcctgactaccaggctgagtcccttgctttccacggacttcctctcaaaatcaagaaagaaccacattctccctgtagtgagattagcagtgcatgttcccaggagcagcctttcaagttctcatacggggagaagtgtctgtataacgtgagcgcatatgatcagaaaccgcaagtgggcatgaggccctccaacccgccaaccccgtctagcaccccagtatcccccctccatcacgccagtcctaacagtacccacacaccaaaaccagaccgtgctttcccagctcacctgccaccatctcagtctatccccgattcatcctatcccatggatcacaggtttcgcagacagctcagcgaaccctgcaacagctttcctccgctcccgacaatgcctcgcgaaggtagacctatgtatcaaagacagatgtctgagccaaatattccctttccccctcagggattcaagcaggagtatcatgaccccgtgtacgagcataacactatggtggggagtgcagcatctcagagtttccccccacccctcatgatcaaacaggaaccccgcgacttcgcatacgacagtgaggtcccctcctgccatagtatctatatgagacaggaaggattcctagcgcatcctagccgaactgaggggtgcatgttcgagaagggcccgagacagttttatgacgatacttgcgtggtgccagagaaatttgacggagacataaagcaggagccaggcatgtaccgcgagggacccacataccagcgcagagggtctctacaactgtggcaattcttggttgcactcctggatgacccgtcaaacagccactttatcgcttggaccggtcgggggatggagtttaaactaatcgaaccagaggaagtggccagacgttggggaatccagaaaaatcgccccgcaatgaactacgacaagctgagcagaagtctgcgctattactacgagaagggcatcatgcagaaagtggcgggcgagaggtatgtgtacaagttcgtgtgcgatcctgaagccttgttcagcatggcttttccagacaatcaacgccctttattgaagacagatatggaaaggcacataaatgaagaagatacagtccctctctcccacttcgatgagagcatggcatatatgcccgagggcggatgctgtaacccacacccatacaacgaagggtacgtgtattag

SEQ ID NO: 24029 - DNA, 1365 bp, Artificial Sequence
  Description of Artificial Sequence: Synthetic coding sequence
atggacggcttctacgaccagcaggtgccctacatggtgaccaactcccagagaggccgcaactgtaacgagaagccgacgaacgtccgaaagagaaaatttataaacagggacttggcccatgatagtgaggagctgtttcaggacctgtcccagctgcaagagacctggctggccgaagcacaggttcctgacaacgatgaacagttcgtgccggattatcaagcagaatccttggcctttcatggactacccctgaaaattaagaaggagcctcactctccctgctccgagatatcctcagcttgcagccaggagcagccatttaagttttcatatggcgagaagtgcctgtataacgttagcgcctacgaccagaagccgcaagtgggcatgagaccctcaaacccacccacgccctcatcaacgcccgtgtccccactccaccatgcctcccctaatagcactcatactccaaagccggaccgagcgttccctgcccacttgcctcctagtcagtcaatcccagactcttcttaccccatggatcaccgctttaggcggcagctgtcggaaccttgtaactcctttcccccactccctacgatgccgcgtgagggaagaccgatgtaccagaggcaaatgtccgagcccaacattccttttccaccacaagggtttaagcaggagtatcacgacccagtgtatgagcacaatactatggtaggtagcgccgctagccagtcctttcctccgccgctgatgattaagcaggaacccagggattttgcttatgactcaggatgcatgttcgaaaaaggcccacgacagttctatgacgacacctgtgtggtgcccgaaaagtttgacggagatataaaacaagaaccaggtatgtaccgggaagggcctacctatcagagacgaggttccctgcaactgtggcagttcttggtggccctgttagacgatcccagcaactcccattttattgcgtggacaggacgcgggatggagtttaaactcattgagcccgaggaagtggcgagaaggtgggggattcagaaaaacagaccggccatgaattatgataagttatcacgctcgcttagatactattatgaaaaggggattatgcaaaaggtcgcaggagagcggtacgtttataagtttgtttgtgatccagaggccctcttcagtatggcctttccggacaaccagcgccctttgctgaaaactgatatggagaggcatataaatgaggaggatactgtaccacttagccacttcgatgaatctatggcttatatgcctgaaggagggtgctgcaacccacacccttataatgaggggtacgtgtattag

SEQ ID NO: 24030 - DNA, 1455 bp, Artificial Sequence
  Description of Artificial Sequence: Synthetic coding sequence
atggagcggcggatgaaggccggctacctggaccagcaggtgccctatactttctcctcgaagagccctggtaacggctctctccgggaagccttgatcggccctcttgggaagctgatggatccgggtagtctccctcctttggacagcgaagatttgttccaagacctaagtcacttccaggagacatggctggcggaggcccaagtgcctgatagcgacgaacagttcgttcccgactttcactcagaaaacctggctttccactctcctaccactcggattaaaaaggaaccgcaatctcctcgcacagatccagccctcagctgctcccgcaaacccccactgccctaccaccacggggaacagtgcctgtactcctctgcatacgatccgccgcggcagattgcgatcaaatcgcccgcacctggagctctgggccagtcccctctccaaccttttccacgggctgaacagagaaattttcttcgtagctctggaaccagccagcctcatccaggacatggttatctgggagaacactctagcgtatttcagcagcctttggacatctgccattccttcacttcacaaggcggaggacgtgaaccgctccccgccccctatcagcatcaactttccgaaccctgccctccatacccgcaacaaagctttaagcaagagtaccacgaccccctttatgaacaggctggacagcctgccgtcgaccagggcggtgtgaatgggcacaggtatccaggcgccggagtcgtgatcaagcaggaacaaaccgatttcgcgtacgactccgacgtcaccggctgtgcctcgatgtacctccacaccgaagggttttcaggcccaagccctggtgacggagctatgggatatggctacgagaaacccttgcgcccatttccagatgacgtttgtgtggtgcctgaaaaattcgagggggacataaaacaggagggggttggcgcctttagggagggacccccctaccagcgccgcggagcattgcagctctggcagttcctggtcgcactgctggacgacccaaccaacgcccacttcattgcttggaccgggaggggaatggaattcaaattaatcgagcctgaagaggtggccagactttggggcattcagaaaaaccggcccgctatgaactacgataagctgtccagatccctgagatattattatgagaagggaatcatgcaaaaagtggccggtgagaggtacgtctacaagtttgtctgtgagcctgaggccctgttttcgctagcgtttccagacaaccagcgccccgccctgaaggcggagtttgaccggcccgttagtgaagaagatacagtgcccctctctcacctggatgagtccccagcttacctgcctgaactggccggcccagctcagcccttcgggcccaagggcggctattcctattag

SEQ ID NO: 24031 - DNA, 1455 bp, Artificial Sequence
  Description of Artificial Sequence: Synthetic coding sequence
atggagcggcggatgaaggccggctacctggaccagcaggtgccctatactttttcctccaagtctcctggaaatgggtccctgagagaggccctgataggaccactcggaaagctgatggatcctggctcactgcctcctcttgactccgaagacctcttccaggatcttagtcactttcaagaaacatggctagctgaagcgcaagtccctgactccgacgaacagttcgtgcctgattttcattccgagaatctagcgttccatagtcctacgactcgcataaagaaggagccacagagccctaggactgaccctgctctctcctgcagtcgcaagccgccattaccctaccaccatggcgagcagtgcctgtatagcagtgcctacgaccccccccgccagattgctatcaagtctccagcccccggagcccttgggcagagtcctttacagccctttcctagggctgagcagagaaattttctcagatcttctggtacctcccagccacatcctggccacgggtacttaggagaacacagcagcgtatttcaacagccactggacatttgtcatagcttcacatctcagggcggcggtcgcgagcctctgccagcaccctaccaacaccagctgagcgaaccgtgcccaccttatccccagcagtcctttaagcaggagtaccacgatcctttgtatgagcaggcagggcaacccgccgttgatcagggaggcgtgaacggccacaggtaccccggcgccggtgtggtaatcaaacaggaacagactgacttcgcctatgattctgacgttacagggtgtgcttctatgtacctacacaccgagggcttctccggaccatctcctggcgatggggctatgggctacgggtatgagaaaccactccggccttttcccgatgacgtgtgtgtggtgcccgagaagttcgaaggcgatattaaacaggagggagtgggcgcattcagggagggccccccctaccaacgtaggggcgctctgcaactctggcagtttttggtcgcccttttagatgaccctacaaatgctcatttcatcgcttggaccggtcggggtatggagtttaagttgatcgagccagaagaagtagcccgtctttggggcatccaaaaaaatcgtcccgcaatgaattatgataaactcagcaggtcgcttcgatattattatgagaaagggatcatgcagaaggtagcaggcgaacggtatgtttacaagttcgtatgcgagcctgaggccctgttttctctggccttccctgacaaccagaggcctgctctcaaagccgaattcgatagacctgtgagtgaggaagacacagtacctttatcccaccttgacgaaagcccagcatacttgcctgaacttgctggccctgcccagccctttggccccaaaggaggttattcttattag

SEQ ID NO: 24032 - DNA, 1338 bp, Artificial Sequence
  Description of Artificial Sequence: Synthetic coding sequence
atggaccccggcagcctgccccccctggacagcgaggacctgttccaggatttaagtcattttcaggagacctggctggcggaggcccaggttcctgattctgacgagcagttcgtccccgactttcacagcgaaaatttggcttttcattcacctacgacccgcatcaaaaaagaacctcagtctcccagaaccgaccccgcactgtcttgctcccgaaaacctccactgccgtatcaccacggggagcagtgcttatactcgtccgcatacgatcccccacgccaaattgcaattaagagccctgcccctggcgctctgggccagagcccactgcagccgttccctagggcggaacaaagaaatttccttcgaagctcgggtacaagccaacctcatcctggtcacggctatctcggggagcacagctccgtgttccagcagccacttgacatatgccactcttttacctcccaagggggggggcgagagcctctgccagcaccctaccagcaccagctgagcgagccatgccccccatatccccagcagagcttcaaacaagaatatcacgatcctctgtacgagcaagcagggcagcccgctgtggatcagggaggcgtaaatggtcacagataccccggggctggtgtcgttatcaaacaggaacagactgactttgcctatgacagtgacgtaactgggtgcgcctcgatgtatctacacacggagggattcagtggaccctcccccggggacggggcaatgggctacggctatgagaagcctctgcgaccctttccagacgacgtgtgcgtggtacctgagaaattcgagggggatatcaaacaggaaggggtgggggccttcagagaaggacctccataccaaaggcgtggtgcgctgcagctctggcagtttctggtcgccctgctggacgaccccacaaacgcacactttatagcctggactggacggggcatggagtttaagctgatcgagccagaggaggtagcccgtctgtggggtatccaaaagaatcgaccggctatgaactatgataagctgtcccggtccctgagatactactatgagaaagggattatgcagaaagtggctggcgagcgatacgtgtacaagtttgtgtgtgagccagaggccctgttttccttagcctttcccgacaaccagagacccgcattgaaggcagaattcgatcgccctgtctccgaagaggatacagtgccactgtcacatctggacgaatcacccgcatatttacctgaactggccgggccagcccagccattcggtccaaagggtggctactcctactag

SEQ ID NO: 24033 - DNA, 1293 bp, Artificial Sequence
  Description of Artificial Sequence: Synthetic coding sequence
atggagcggcggatgaaggccggctacctggaccagcaggtgccctacactttttccagcaagagcccgggcaacggatcactcagggaagctcttatcggtccacttggcaagctaatggaccccggttctctccctcccctggatagcgaagacctttttcaggacctttcccacttccaagagacctggcttgcagaagctcaggtgcctgatagcgatgagcaatttgtgcccgacttccactccgagaacctagcctttcatagcccaaccacacggattaagaaggagccccagagccctagaaccgatcctgccttgtcatgttcccggaagcctccactgccttaccatcacggggaacaatgcctgtacagtagctcagtgttccaacagcctcttgatatctgccacagtttcaccagtcagggcggcggccgggaacccctcccagccccctatcaacaccagctgagcgagccgtgccctccttatcctcagcaatctttcaaacaagagtaccacgatcccctgtacgaacaagcgggacagccagctgtggatcagggtggcgtcaacggacatcggtatcctggggctggggtagttatcaaacaggagcagaccgactttgcctatgattctgacgtaactgggtgtgcgtccatgtatctccatactgagggtttctctggtcccagtcctggcgatggcgccatgggctacggctatgaaaagccactacggccttttcccgacgacgtctgtgtcgtgcccgaaaaattcgaaggtgatatcaaacaagaaggcgttggagcctttcgagaaggccccccttaccagagacgcggggctctgcaactgtggcagtttttggtcgcactattggatgacccgaccaatgcccacttcatcgcttggacgggtcgcgggatggaattcaagctcattgagcctgaagaggtggccagactgtggggaattcagaagaatcgccctgccatgaactacgacaagctgagtcgctctttgcgctactactacgagaaaggcatcatgcagaaggtagccggtgagaggtatgtctacaagttcgtttgcgagcctgaagcccttttctccttagcattcccagacaatcagagaccagcgctcaaagcagaatttgaccgacctgtctctgaagaagatactgttcctttgagccacctagacgaaagccccgcttatctacccgaattagctggccctgcccagccattcgggccgaaaggcgggtattcttactag

SEQ ID NO: 24034 - DNA, 1338 bp, Artificial Sequence
  Description of Artificial Sequence: Synthetic coding sequence
atggaccccggcagcctgccccccctggacagcgaggacctgttccaggacttgtctcactttcaggagacatggctggcagaggcccaagtgcctgatagcgacgaacagttcgtgcccgacttccacagcgagaacttggctttccactcccctacaacgcgaataaaaaaggagcctcagtccccccggacggacccagccctgagctgttctcgaaagccaccactcccatatcaccatggcgagcagtgcttgtatagctctgcttacgatccgccacgtcagattgccattaagtcacccgcacctggggcattgggtcagagtcctctccagcctttccctcgggccgagcaacgtaatttcctccgctcaagcggtacgtctcagccgcatccagggcatggctacctgggggagcattcttccgtcttccagcagcctcttgatatctgccacagttttacatcccagggcgggggacgggaacctctgccagctccctaccagcaccaactgtccgaaccgtgtcccccttatcctcagcagtccttcaaacaggaataccacgatccactttacgagcaggctggtcagccggctgtggatcaggggggggtcaatggacatcggtaccccggcgcaggcgtggttattaaacaagaacagacagactttgcctatgactccgacgtaactgggtgtgcctccatgtacctgcacactgaaggatttagcggcccaagtcctggcgatggggctatgggttacgggtatgagaagcctctcagaccatttcccgatgacgtgtgcgtcgtgccggagaagttcgagggcgacattaagcaggaaggggtgggagccttccgcgaggggccgccgtatcagaggcgtggcgcactgcaactgtggcagttcctggtagcacttctcgatgatccaacaaatgctcactttatcgcctggaccggtcggggtatggaatttaaactcatagagcccgaagaagtggccaggttatgggggatccagaaaaaccgacctgcaatgaactacgataaattatcacggtccctgcggtattattatgagaaaggcattatgcagaaagtggcaggcgagcgctatgtttacaagttcgtgtgcgagcctgaagctcttttcagcctggctttcccagataaccagcgccccgcattgaaggccgagtttgatcgtcccgtctctgaagaggacactgtgcccctctctcatctggacgaatccccagcctatctccccgagcttgctgggccggcacagccttttggccccaaaggagggtatagctactag

SEQ ID NO: 24035 - DNA, 1791 bp, Artificial Sequence
  Description of Artificial Sequence: Synthetic coding sequence
atggccggccggcgggtgaacgtgaacgtgggcgtgctgggccacatcgacagcggcaagaccgctcttgcccgtgctttgtctacgactgcttctaccgctgctttcgacaaacagccccagagccgagagcggggaataacacttgacctaggatttagctgctttagtgtgcctctccccgccaggctgcgctcctcccttcctgagtttcaagcagctcccgaagcggagcctgagcctggcgagcctctcctacaagtgacgttggtggattgcccaggccacgcctcattgatccgtacaatcatcggtggcgcccagatcatagatctgatgatgctggtcatcgatgtcactaaaggaatgcagacccaatctgctgagtgcctagttattggtcagatcgcctgccagaaactcgtggtcgtgttaaacaagatagaccttttacctgagggcaagaggcaagcagctatcgacaaaatgacaaagaagatgcagaagacactggagaatactaaatttcggggtgcccctatcatacctgtcgctgcgaagcccgggggccctgaggccccagagactgaggcgccccagggaatccctgaacttatcgagctcttgactagtcagatttctattcccactagggacccatcgggccccttcctcatgtccgtggaccactgcttctctatcaagggacagggaaccgtgatgacaggaacaattcttagcggtagcatctccctaggagactcagtcgaaattccggccctcaaggtagtgaaaaaggttaaaagcatgcaaatgtttcacatgcctattacctcggctatgcaaggtgataggcttggcatctgcgtcacccaattcgatccgaagctattggagcgcggactggtgtgtgctcccgagtccctgcataccgttcatgcagctctcatatctgtggagaaaattccatattttaggggccccctccagacaaaggcaaagtttcacatcactgtcggtcacgaaacagtgatggggcgcctcatgttcttttcacctgcacctgataacttcgatcaagagcccatcctggactcgttcaacttttcgcaggaatacctgttccaagaacaatatctgagcaaagatttgacaccagcagtgacagataacgacgaggcggacaaaaaggcgggacaagccactgaaggtcactgtcctaggcagcaatgggccctggtggaatttgaaaagccggtcacatgcccccgtctatgcctggtaataggtagtcgattagatgctgacatccatacgaatacgtgtagactggcctttcacggcatactgctgcacggcctggaggatcgcaactatgccgatagctttctgcctcgactcaaggtgtacaaactgaagcataagcacggtctagttgagcgcgctatggatgattatagcgtgatcggtagaagcctgtttaagaaggaaaccaacatccagctctttgtcgggttaaaagtgcacttgtccaccggtgagctaggcattatcgattccgccttcggccaatcaggcaaattcaaaatacacatccctgggggcctgagtcctgaaagtaagaaaatcctcactcccgccctcaaaaaaagggcgcgggcgggaagaggagaggccaccagacaggaggaaagcgcagagagaagtgagccgagccagcatgtggtactttctctgacatttaaacggtatgtttttgacacacacaagcggatggttcagtcaccgtag

SEQ ID NO: 24036 - DNA, 1233 bp, Artificial Sequence
  Description of Artificial Sequence: Synthetic coding sequence
atggccgccgagatccacagccggccccagagcagccggcccgtgctgctctcaaagatagagggccaccaggacgcagtcactgcagctctgctgatccccaaggaagacggggtcataacagcgtccgaagaccgaaccatacgggtgtggctcaaacgggattcaggacagtactggccatcaatctaccatactatggcctccccctgttcagcaatggcgtaccatcacgactctcggcgcatcttcgtagggcaagacaatggcgctgttatggagtttcatgtgagcgaagactttaacaagatgaattttatcaagacatacccagcacaccaaaatcgggtgtcagccatcatcttcagcctcgcaactgaatgggtcatttcaacaggccacgacaagtgcgtcagctggatgtgcacaaggtctggtaatatgctgggtcgacatttttttacttcctgggcttcttgcctccagtatgatttcgacactcagtatgctttcgtaggagactactcaggacagatcacattattaaaactggagcagaatacctgtagcgtgatcaccactcttaaggggcacgagggtagcgtagcttgcctctggtgggatcccatccagcgactgctgttcagtggggcttctgacaactccattatcatgtgggatattgggggtagaaaaggcaggacactgctgcttcaaggccatcatgataaagtgcagtctttgtgctatctacagctgactagacagctggttagttgttcttctgatgggggaatcgccgtctggaacatggacgtgtcacgagaagaggcacctcagtggctggagtcagactcctgccaaaagtgcgagcagcctttcttctggaatattaagcagatgtgggacactaagaccttggggctgcgccagcaccactgtcggaaatgtggccaagctgtttgtggcaagtgctccagtaagagatcttcatatcccgtgatgggctttgagtttcaagttagggtttgtgactcatgttatgactccattaaggacgaagaccgaacctccctagccacatttcatgaggggaagcataatatctcgcatatgtcaatggatatcgcacgcggcctaatggttacctgtggaaccgacaggatcgtcaaaatctgggacatgaccccagtcgttggatgcagtctcgcaacagggttctcccctcactag

SEQ ID NO: 24037 - DNA, 1092 bp, Artificial Sequence
  Description of Artificial Sequence: Synthetic coding sequence
atggccggcgacctgagcgccggcttcttcatggaggagctgaacacttaccgccagaagcaaggcgtggtgctgaaataccaggagctgcctaactcagggcctcctcacgataggcgctttacctttcaggtcatcatcgatgggagggagtttcccgagggagagggccggtcaaaaaaagaagccaaaaatgcagcggccaaactagctgtggagattctgaacaaggagaagaaagcagtgtctcccctgttactgaccacaacaaacagctccgagggtctgtctatgggaaactatatcggcctaatcaatcgtattgcgcaaaagaagaggctcactgtcaattacgagcagtgcgcttccggggttcatggccccgaaggtttccactacaaatgcaaaatgggacagaaggaatacagcattgggactggatctacaaaacaggaagccaagcagctcgcggccaaactcgcctacctacagatcctgagcgaggaaactagtgttaagtctgactacttaagctcaggctcatttgcaactacctgcgaatcgcagagtaacagcttagtgacatccactctcgcctctgagagctcttcggagggcgactttagcgctgacacctcagaaatcaactcaaattcagacagcttaaatagctcttcgcttctgatgaatggactgaggaacaatcagcggaaagcgaagagatccttagcaccccgtttcgatctgcccgatatgaaagagaccaagtataccgtcgataaaaggtttggtatggacttcaaggagatcgagttaataggctcaggtggcttcggccaggtgttcaaggccaagcaccggattgatggaaagacatatgttatcaagcgggtgaagtacaacaacgagagcaaaacgaaatgtctcttcatccaaatggaattttgcgataaggggaccctggagcagtggatagagaagcgccgtggagagaagctggataaagtactggctctggagctgttcgaacagatcaccaaaggagtggattacatccattctaaaaagaagaaaaaaaaaaagaaaaaatag

SEQ ID NO: 24038 - DNA, 309 bp, Artificial Sequence
  Description of Artificial Sequence: Synthetic coding sequence
atggccggcgacctgagcgccggcttcttcatggaggagctgaacacttaccggcagaaacagggagtcgtgctgaaatatcaggagctgcccaactctggccccccccacgaccgacggttcactttccaggtcatcattgacggcagggaatttccagagggggaaggtaggagcaagaaggaggctaagaacgccgcagccaaactggcagtcgagattctcaacaaggaaaagaaggccgtgtcccctcttttgttgaccaccaccaactcctcagagggactcagcatgggaaactacatctag

SEQ ID NO: 24039 - DNA, 1656 bp, Artificial Sequence
  Description of Artificial Sequence: Synthetic coding sequence
atggccggcgacctgagcgccggcttcttcatggaggagctgaacacctaccgtcagaagcagggcgtggtgcttaaatatcaggaactaccaaactccggacccccccacgaccgcaggtttacattccaagtcatcatagatgggcgcgagtttcccgagggggagggaaggtcaaagaaggaagccaagaacgctgccgcaaagctggcagtcgaaattctaaataaggagaagaaagcggtatcgcctctgctgttgaccaccaccaattcttcggaagggctctcaatggggaactacattggcctgatcaaccggatcgcccaaaagaaacggctgaccgtgaactatgaacaatgtgctagcggcgtgcacggcccagaaggtttccattacaagtgcaagatgggacagaaggagtattccatcggcaccggctcaactaaacaggaagccaaacagttagccgccaaattggcctacctgcagatccttagtgaagaaacttctgtaaaatcagactatttgtcctccgggtcatttgccacaacgtgtgagagtcagagtaactccctcgtgacatcgaccctggcctccgagagtagcagcgagggagatttctccgcagacacttcagagatcaattccaacagcgatagcctcaatagttcaagcctgctcatgaatggtctgcggaacaatcagcgaaaggccaagaggagcctggccccccgatttgatctacccgacatgaaagaaaccaagtacaccgtggacaagagattcgggatggacttcaaggagatcgagctgattggaagcggcggcttcgggcaggtttttaaagccaagcaccgtatcgacggcaaaacgtacgtcataaagcgagtcaagtacaacaatgagaaggccgagagagaggtgaaggcgctggctaagcttgatcacgttaatatagtccattataatggatgctgggatggtttcgattacgaccctgagacatcagatgactctttggaaagtagcgactacgaccctgagaatagtaaaaattcctctaggtccaaaactaagtgcctgtttattcagatggaattttgcgacaaggggaccctcgagcagtggatcgaaaaaagacggggagaaaagctcgacaaggtactggccctcgagttgttcgagcagattactaagggcgtggactacattcacagtaaaaaattgattcatagggatctgaaaccttctaatatttttctcgtggacactaaacaggttaagattggcgattttggcctggtgacaagtttgaagaacgatggcaagaggacccggtccaagggcacgctacgctacatgagtcccgaacaaattagtagccaagactacgggaaggaggtggacctgtacgctcttgggttgatccttgccgaattgttacacgtgtgcgatacagcttttgagacgtcaaaatttttcaccgatttgcgagatggcattatttctgacatctttgacaagaaagaaaagactctgttacaaaagctcttgtcaaagaagcctgaagacaggcctaacactagcgagattctcagaaccttgaccgtgtggaaaaagtctcccgagaagaatgagcgccacacgtgctag

SEQ ID NO: 24040 - DNA, 351 bp, Artificial Sequence
  Description of Artificial Sequence: Synthetic coding sequence
atggccggcgacctgagcgccggcttcttcatggaggagctgaacacataccggcaaaaacagggagtggtgcttaaataccaggaactgcccaattctggcccaccacatgaccgacgttttactttccaagtgattatcgatggccgcgagttcccagagggagaggggcggtctaaaaaagaagcaaaaaatgctgcggcaaagctggctgtcgagattttgaataaggagaagaaagccgtcagccccctcctcctgacgaccaccaatagttctgagggactgagcatgggaaactacatcggcctgattaaccggattgcccagaagaagagactgactgtatag

SEQ ID NO: 24041 - DNA, 1533 bp, Artificial Sequence
  Description of Artificial Sequence: Synthetic coding sequence
atggccggcgacctgagcgccggcttcttcatggaggagctgaacacctaccggcaaaagcagggggtggttttgaagtatcaagagctgcccaactctggtccaccacatgaccggcgcttcaccttccaggtcataatcgatggtagagaattcccagagggcgaagggagatcgaagaaggaggccaaaaacgctgccgccaaacttgccgtagaaattttgaacaaagaaaagaaggcagtgtctccgctcctgttaaccacaactaacagcagcgaaggtttgagtatgggaaactatatcggactgattaaccgaattgcacagaagaaaaggctcacagttaactacgaacagtgtgcgagcggggtgcacggtcccgaggggtttcactacaagtgcaagatgggacagaaggaatatagtatcgggacggggagcaccaaacaagaagcaaagcagctagcagctaaactggcctatctgcagattcttagtgaggaaacctccgttaaatcagactatctctcatccggctctttcgcgacaacgtgtgagtctcagtctaactccctcgtgacatccacccttgcctctgagagcagctctgagggagattttagtgccgacacttccgaaattaacagtaattccgattcacttaattcatctagtctgctgatgaacggacttcgaaataaccaaagaaaagccaaaaggagtttagccccccgttttgatctgcctgacatgaaggaaaccaagtatacagtcgataagcgcaaagctgaaagggaggtaaaagcgttagcgaaactcgaccatgtgaacatcgtgcattacaacggatgctgggacggcttcgactatgacccagaaacctcggatgactcacttgaatcatcagattatgatcctgagaatagcaaaaacagctcccgatctaaaaccaagtgccttttcatccagatggaattttgcgacaaggggactcttgagcagtggattgagaagcggcgcggcgagaaactggataaagtactcgcccttgaactctttgaacagattacaaaaggagttgactacattcacagcaagaaactgattcatcgtgatctcaaacccagtaatatctttctagtagacaccaagcaagtcaaaatcggcgattttggcttggtgacctccctgaaaaatgacggcaagcggactagaagcaagggcaccctgcggtacatgtcccccgagcagatctcatcacaggattacggaaaggaagtcgatctgtatgctctggggcttatcctggccgagttgctgcacgtctgcgacaccgcctttgagacctccaagttttttacagaccttagagatgggatcatctcagatattttcgacaagaaggagaagacacttctacagaagttgctctcaaagaaacctgaagaccgccctaacacgagcgagattttgcggacacttaccgtgtggaagaagagccctgaaaagaatgagcgtcacacctgctag

SEQ ID NO: 24042 - DNA, 4800 bp, Artificial Sequence
  Description of Artificial Sequence: Synthetic coding sequence
atgaacaaggccccccagagcaccggccccccccccgcccccagcccaggcctgccccagcctgcttttcctcctggtcagacagctccagttgtattctccactccacaggcaactcagatgaatacccccagccagccaagacagcatttctatcccagcagggcacaaccccccagctccgccgcttcccgagtgcaatccgcggcccccgcccgcccggggcctgcggcacacgtttatcccgccgggtcgcaggtgatgatgatcccctcacagatttcctacccagcaagccagggcgcctattacatccccggccaggggagatcaacatatgttgtcccgacccagcagtatccagtacagcccggagcccctggcttctaccctggcgccagcccaacagaattcggcacgtacgctggagcttattacccagcccagggcgtccagcaattcccgactggcgttgcacccacccccgtgttgatgaatcaacccccacagatcgctcccaaacgcgaaaggaaaaccatccggattagggatcctaaccaaggtggaaaggacattaccgaagagatcatgagcggggcccgcacagcgtccacgccgacaccccctcagaccgggggtggactggagccgcaggctaacggagagacacctcaggttgccgtgatcgtaaggcccgatgaccggtctcagggggctatcatcgccgataggcccggtcttccggggccagaacattctccaagcgaaagccagccatcttcgccatcacccacgccatcgccctcccctgtcttggagcccggaagcgaaccaaatttagctgtcttgtctatcccgggggacactatgaccacaatacagatgtctgtggaggaaagcacccccatctcccgtgaaactggagagccataccgtctgagcccagagccaactcccctggcagaacctatcctggaggttgaggtgacactttctaaacccgtaccagagtctgagttctccagcagcccactgcaggcccctacaccattagcatctcacactgtggagattcatgagcccaacggcatggtgcctagcgaggacctggagccagaggtggaaagctcacccgagctggccccccctcccgcctgcccgtctgagtcacccgtgccaatagcccctaccgctcagcctgaggaattgctaaacggtgccccatctcctccagccgtcgacctcagtcccgtctccgagccagaagagcaggccaaggaggttacagcctctatggcgcctcctacaattccatccgcgacacccgcaaccgcaccttcggccacctccccagcgcaggaggaagaaatggaggaggaggaagaagaggaagaaggagaggccggtgaagccggagaggcggagtctgagaagggcggagaggagcttcttccgcctgaatctacccccatcccagcgaatctctctcagaacttggaagccgctgcagcaacacaagtggcggtttccgtgccaaaacgtaggagaaagatcaaggaactaaataaaaaggaagcggtgggagatctgctcgacgcgttcaaagaggccaatcctgccgttcccgaggtggaaaatcagccaccagccggcagcaatcctggccctgagtcagagggctctggggtgcccccacggcctgaagaagccgacgagacctgggactctaaagaggataagattcacaatgccgagaacatccagcccggcgagcaaaagtatgaatacaagtccgaccagtggaaacctctgaacttagaggaaaagaagcgttacgatcgggagttcctgctggggttccagtttattttcgcctcaatgcagaagcccgagggactgcctcatatatcagatgtcgtgctggataaggcgaacaagacgcctcttcggcctctggaccccacacgcctacaaggcatcaattgcggccccgacttcactccaagtttcgcaaatctgggcagaaccacactctccacgagaggcccccctcgaggcggccctggcggtgaactgcccagagggccggctggactgggcccccgccgctctcaacaagggccccgaaaggagcccaggaaaatcatcgccactgtgctgatgacagaagacatcaaactgaataaggccgagaaggcctggaaacctagctccaaacgaacagctgccgataaggaccgaggggaagaggacgcagatggatcaaaaacccaagacctcttccgccgtgtgcgcagcattttaaacaaattaactccacagatgtttcagcagctcatgaaacaggtaacacagctcgctatcgacacagaggagaggttgaagggggtgatcgacctgatatttgaaaaagccatcagtgagcccaattttagcgtcgcttacgcaaacatgtgtaggtgtttgatggccctcaaagtcccaactaccgaaaagcctaccgttactgttaactttagaaagttactccttaaccgctgtcaaaaagagtttgagaaggataaggacgacgatgaggtgtttgagaagaagcaaaaagaaatggatgaagccgcaacagctgaagaacgtggcaggctaaaggaggagttagaagaggcccgcgatatagcacgaagacgaagcctcgggaatattaagttcatcggggaactgtttaagttgaagatgcttactgaggctattatgcatgattgcgttgtgaaactgctcaaaaatcacgatgaggaaagtttggaatgcctttgtaggttgctcacgaccatcggcaaggatctagactttgaaaaggctaaacctagaatggaccagtactttaaccagatggaaaaaattattaaggaaaaaaaaacctcctcaagaattcggtttatgctccaggacgtgttggatttaagaggatctaactgggtcccccgacggggagaccaaggtcccaagacaattgaccagatacataaagaggccgaaatggaggagcacagggagcatattaaggtgcagcagttaatggcaaagggtagcgacaagcggcgggggggcccgcctggccctcctattagtcgcggactccccctcgtggacgacggtggctggaatacggtcccaatatcaaagggtagccgcccaatagacaccagtaggctcactaaaattaccaagccaggaagcattgattctaataatcagttgttcgcccccggaggccgactgtcctggggaaaaggatcttctggtggcagcggcgctaaacctagcgatgcggcgtctgaggctgcacggcccgcgacatcaactctaaatcggttttctgctctacagcaggcggtgcccacagaatccaccgataatcgccgtgtggtgcagcgaagctccctaagccgcgagcgcggcgaaaaagccggggaccgaggagatagactggaaaggagcgagcggggaggcgaccgcggagacagactggaccgtgccagaacacctgccacaaaacgctccttttcaaaagaagtcgaggaacgtagcagagaacggcccagccagccagaagggctgcgtaaagctgcctcccttacagaagacagagacagggggcgcgacgcggtgaaaagggaggcggccctaccgccggtcagcccgctgaaagccgcattgtcagaggaagaacttgagaagaagagcaaagctatcattgaggagtatctgcacctgaacgacatgaaggaagcggttcagtgtgtgcaagaattggcatctccaagcctgttgttcattttcgtgagacacggagttgaaagcactctggagcgatccgctatagcccgcgaacatatggggcagctgttacatcaacttctctgcgctggccacctgtcaaccgctcagtactatcaaggactgtatgaaattctggagttggccgaggatatggaaattgacatcccccacgtctggctgtacttagcggaactcgtgacacctatcctgcaggaaggcggggtgcctatgggagagctgtttagagaaataaccaaacctctgagacccttaggcaaagccgcgagcttacttctggagatcttgggacttctttgcaaatcaatgggcccaaaaaaggttggcaccctgtggcgagaagccggtctgtcctggaaagagtttttaccagagggtcaggacatcggggcttttgtggcagaacagaaagtggagtacacgctgggcgaggaatctgaagcgcctggtcagcgcgccttaccttcggaagagctaaaccgtcaactggaaaagttactgaaggaaggctcctccaaccagagagtgttcgactggattgaggccaacttgtcagaacaacagattgtgtctaacactctggttcgcgctttgatgacagcggtctgctatagcgccatcatctttgaaacaccgctcagggtggatgttgcggtcttgaaggcccgggccaaacttctccagaaatacctgtgtgacgagcaaaaagaactacaggccctttatgccttgcaggcactggtcgtgacgctcgagcagccgcccaacctccttcgaatgttctttgatgcactgtatgatgaagacgtggtaaaggaagacgctttctacagttgggagtcgagcaaagacccagccgaacagcagggaaagggagtcgccctgaagagtgttaccgccttctttaagtggctgagggaagccgaagaggaatcggaccacaattag

SEQ ID NO: 24043 - DNA, 4803 bp, Artificial Sequence
  Description of Artificial Sequence: Synthetic coding sequence
atgaacaaggccccccagagcaccggccccccccccgcccccagccctgggcttccccaacccgccttccctcctggccaaaccgccccagtggtgttttctaccccacaagccacccagatgaatacgccatcacaacctaggcaacacttctatccatctcgcgcccaacctcccagctcagccgcatcaagagtacagagcgctgcccccgcccgacctgggcctgccgcacatgtctaccccgccggaagccaggtgatgatgattccgagccagatcagttatcccgcatctcagggagcgtattacattcctggtcagggcagatccacatacgtagtgcccactcaacagtaccccgtccagcccggtgcccccggcttttatccaggtgctagcccaacggaatttggaacatatgccggtgcttactatcccgcgcagggagtccagcaatttcccaccggcgtggcaccaacccctgtgctgatgaatcagccacctcagatcgcaccaaagagggagcggaaaacaatccgaatccgggaccctaaccagggcgggaaagacattacagaggaaataatgtccggcgcccgaaccgcctcgacgccaacgccacctcaaaccggaggaggactcgagccccaagcgaatggggaaacgcctcaggtcgctgtaatcgttagacccgatgatcggagccagggagctatcatcgccgacagaccaggtctgccagggcctgaacattcacctagtgaatctcagccctcttcgcccagtcctaccccttctccaagccctgtccttgaacctgggagtgaaccgaacctggccgtactctctatccctggagatacgatgactactattcagatgtcagtggaggagagcactcccatttctagagagactggcgagccctatcggctgtctcctgaaccgacaccactagcggaacccattctcgaagtggaggttaccctgtcaaagccagtgccggagagtgagttctcatcctccccacttcaggcgcctacccctctcgccagccacacagtggaaattcacgagcctaacggcatggtgcctagcgaggacctggagcctgaggtcgagtcctcccccgaactagcccctccacctgcctgcccatctgaaagccccgtgcccatagcccctactgcccagccagaggagctgctgaacggggcaccttccccccctgcggtggacctgagccctgtaagcgagcctgaagaacaagccaaggaggtgacagcctcgatggcccccccaacaatccccagtgctacacctgctactgccccctcagcaacgtcaccagctcaggaagaggaaatggaggaagaggaggaggaagaggagggcgaggctggtgaagctggcgaagccgaatctgagaagggcggggaggagctattacctccagagagtacccccatccctgcgaatctgagccagaacctagaagctgccgcagccacacaggtggctgtgtccgtgccaaaaagacgccgcaaaattaaagagctgaacaagaaagaggcagtgggggacctgctagatgccttcaaagaggctaaccccgccgttccagaggtggagaatcaaccccccgcggggtccaaccccggtccagaaagcgaggggtccggtgtaccaccacgtcctgaggaagctgacgaaacatgggattcaaaggaagacaaaatacacaacgccgagaacatccaaccgggtgagcagaaatacgagtacaaatccgaccaatggaagccgttaaatctggaggagaaaaagagatacgacagggaattcttgctgggattccagttcatcttcgccagcatgcaaaaacccgagggactgccacacatcagcgatgtcgttctggacaaagccaacaagacacccctcaggcccctagacccaacccgcctgcagggtattaactgtggtcccgatttcacaccttctttcgcaaatctgggtcgcacaacattatctaccagaggacccccccgaggaggacccggaggcgagctgccaaggggaccccaggctggactaggacccagacgttcccagcagggccccaggaaagagcctcgaaagatcatagccaccgtgctcatgacagaggacatcaagttaaataaagccgagaaagcttggaagccctcgagcaaaaggacggccgcagataaagatcgtggcgaggaagatgccgacggttctaaaacccaagatctgtttcgacgtgtacgaagcattctcaacaagctgacaccgcagatgtttcagcagctgatgaagcaggttactcagctggccattgataccgaggagcggctgaagggagtgatcgacttaatttttgagaaggccatctctgaacccaacttctccgtggcttacgctaatatgtgtcgatgcttgatggcactgaaagtgccaactaccgaaaaacccacggtgacggtgaatttccggaaactactgcttaatcgatgccaaaaggaattcgaaaaagataaggatgatgatgaagtgttcgaaaaaaaacagaaagaaatggacgaagccgccaccgctgaggaacgagggagactgaaggaggaactagaggaggcccgggatattgctagacggaggtccctgggaaatattaagtttatcggcgaactctttaagctcaaaatgttaaccgaagccatcatgcacgattgcgtggtgaagctgctgaaaaatcacgacgaagagagccttgagtgtctttgtaggctgctgacgacaatcggcaaagacctagatttcgagaaggcaaaacctcggatggatcagtattttaatcagatggaaaagataataaaggaaaaaaaaacaagctcacggattagatttatgctacaggacgtgctcgatctgcggggttccaattgggttcctaggaggggtgatcagggccctaaaacaattgatcagattcacaaggaggctgaaatggaggagcaccgcgagcacatcaaagtgcagcagctgatggccaaaggctccgataaaaggcgtggaggacctcccggcccgccaatctctagagggttgccactggtggacgacggcggatggaacaccgtgccgattagcaaaggttctcggcccatcgacacatctcgtttgacaaaaatcacaaagcctggctctatcgatagtaacaaccaactgttcgcacccggtggccgtctcagttggggcaaagggtcctccggtggtagcggggcgaaaccatccgacgctgcatccgaggcggcgagacccgccactagcaccctcaaccggttttccgctttgcagcaggccgtgccgactgaaagcactgacaacaggagagtagtccaacgtagttctttaagcagggaaaggggagagaaagccggggatagaggggaccgcttggagcgatccgagcgcgggggggacaggggggaccgactggatcgtgctcgcacgcctgcaacaaagcgcagtttcagcaaagaagtggaggagcgttcaagagaaaggccatcccagcctgaaggattacgaaaggctgcctctctgaccgaggaccgagaccgcgggagggacgcagtgaaacgcgaagccgcgttgcccccagtgtcgccactgaaggccgcactcagcgaggaagagctggaaaagaaaagcaaggctattatcgaggaatacctccacctcaatgatatgaaggaggccgtccaatgcgttcaggagctcgcatctccatctctgctgtttatctttgtgcgacacggtgtggagtcaaccctggagcggagtgccatcgcccgggaacacatgggacagctgctgcatcagctattatgtgccggccatctatctactgctcaatattatcaagggctctatgaaatccttgagttggctgaggacatggagatagacatccctcatgtttggctatacctggctgaactcgttaccccgatcctgcaagaagggggtgtgcctatgggagagctgttcagagaaataacaaagccgttgcgtccactcgggaaggctgcctccctcctgctggagatcctggggctgctgtgcaagtctatggggcccaagaaagtcggaaccctgtggcgcgaggccggcctgtcatggaaagagttcctgcccgaggggcaggacataggagcatttgtcgctgagcagaaagtggagtacaccttaggggaggagagcgaggcccccggccagcgtgcattgccgagcgaggaactgaatcgccagcttgagaaactactgaaagagggctccagtaatcagagggtcttcgattggatcgaagccaatctgtccgagcagcaaatcgtgagcaacacactggtcagggctctgatgacagctgtgtgttacagcgcgattatctttgagactccgctgagggttgacgttgccgtcttgaaggcacgtgccaaactgctgcaaaaatatctgtgtgacgagcaaaaagaactccaagccctctatgcactgcaggcattagtcgtgaccttagagcaaccacccaatctacttcgaatgttcttcgatgccctgtacgacgaagatgttgtaaaagaggacgctttctattcttgggagagttctaaagaccctgctgaacagcaaggaaaaggggttgccttgaagtcagtcacagctttcttcaaatggcttagggaggccgaggaggaaagtgatcacaactag

SEQ ID NO: 24044 - DNA, 4800 bp, Artificial Sequence
  Description of Artificial Sequence: Synthetic coding sequence
atgaacaaggccccccagagcaccggccccccccccgcccccagcccaggactccctcagcctgctttcccacccgggcaaacagcccctgtagtgttcagcaccccccaagcaactcagatgaacacacccagccagccaagacaacacttctacccttccagggcacagccacccagtagcgctgcctctagggtgcaatcagctgcccccgctcggcccggtccagcggctcacgtctaccccgccggctcacaggtcatgatgatcccgtctcagatttcttatcccgccagtcagggagcatattacatccctggtcaaggccgctctacttacgtggttccaactcagcagtacccggtgcagccaggcgcgcccgggttttatccaggagcaagccctactgagtttggaacctatgccggtgcttattatcctgcccagggcgtgcagcagtttcctactggcgtggctcctacacctgtgttaatgaaccaaccacctcagatcgcccctaagcgcgagagaaagactattcgaatccgcgaccccaaccagggaggaaaggacattactgaggagatcatgtccggtgcccggacggctagcacccctacacccccccaaacaggtgggggcttagagccacaggccaatggcgagaccccacaggtggcagtgatcgtaaggcccgacgatcgttcgcaaggcgcaataatcgccgacaggccggggcttcccggccccgagcactcgccttccgagtctcaaccaagtagcccatcccctacgccaagcccctcgccggtgctcgaaccggggtcagagcccaacctcgctgtcttatctatccccggcgacaccatgacaacgatccagatgagtgtggaggagtctacccctatttctagagaaactggtgagccctacagattgagtccagagcccactcccctcgctgagccgatcctggaggtcgaagtgaccctgtctaaaccagttcccgaaagtgagttttccagctctcccttgcaggcccctacccctttggcttctcacacagttgagatccatgaacccaatggaatggtaccatctgaggatctggagcctgaagtcgaatccagcccagaactagcccccccacctgcttgcccctccgagtctcctgtgccaatcgcccccactgctcagccagaggagctgctgaatggtgccccatcgccccctgctgttgacttgtcacctgtcagtgaaccggaggagcaagccaaagaggtcactgcatctatggctcctcccaccattccctccgcaacacccgcgacagccccctcagcaacttcgcccgcacaggaggaggaaatggaagaagaagaggaggaggaggaaggtgaagctggcgaggctggcgaagccgaatctgaaaaaggaggcgaggaacttctgccacccgagtctacccccataccagcaaaccttagccagaatttggaggctgccgccgccactcaagtcgcagtgagtgtacccaagcgcagacgtaaaatcaaagagctcaataagaaagaggccgtaggtgaccttctcgatgcttttaaggaagccaaccccgccgtgccggaggtggagaatcagccacctgccggcagtaacccaggaccagagtctgagggttcgggagttccccccaggcccgaagaggcagacgagacttgggattctaaagaagacaagattcacaacgcagaaaacatccaacccggtgagcagaagtatgaatacaaaagtgaccaatggaagcccctcaacctagaagagaaaaagaggtacgaccgggaattcctgttaggctttcagttcatatttgcctccatgcagaagccagaggggctgccccatatctccgacgtggtgctggataaggcaaacaagaccccactcagacctttggatccaactaggttacagggcataaactgcggccccgatttcacaccctctttcgcaaatctaggacggaccactcttagcacaagaggcccccctagaggaggccccggtggagagcttccgcgcggaccagcaggactgggaccccgccgctcccaacaagggccccggaaagagccgaggaagatcattgccaccgtgctcatgaccgaggatatcaagctcaacaaagcagagaaggcctggaagccctcatccaagcgaaccgctgcagataaggataggggcgaagaggacgcagatggttccaaaacacaggatttgttccgacgcgtccgatcaatcctgaataagttaacccctcagatgtttcagcagctcatgaagcaggttactcagctggccatagataccgaggagaggctgaagggcgtgatcgacctaatattcgagaaagccattagcgagcccaatttcagtgtggcatacgccaatatgtgtagatgcctaatggcattaaaagtccccaccaccgagaaacctacggttacagtgaatttcaggaagctgctgctaaatcgttgtcagaaagagttcgaaaaggacaaggacgatgatgaggtgtttgagaagaagcaaaaagagatggacgaggctgccaccgcagaggaaagggggcggttaaaagaggaacttgaggaggctcgggacatagcccgcaggcgttcacttggcaatattaagttcataggcgagctgtttaagctgaagatgctgaccgaggcgattatgcatgattgcgtggtaaagctcctcaaaaaccacgatgaagagagcctggaatgtctttgtagattgctgacaaccatcggaaaagacttggacttcgaaaaggcgaagccaagaatggaccagtatttcaatcaaatggagaaaatcatcaaggagaagaagacaagctctcgaatcagatttatgctgcaggatgtcctggacctgagaggtagcaactgggttcctcgtagaggggaccagggacccaaaacgattgaccagattcacaaagaagctgagatggaggagcaccgagagcatattaaggttcagcagctcatggccaagggaagcgacaaacgtaggggaggaccacccggtccacctataagccgcggactgccccttgtcgacgacggaggttggaacactgtgcctatctctaaagggagtaggccaatcgatacctcccggttgacgaagatcaccaaacctggcagcatcgactcaaacaaccagctttttgcccctggaggacgcctgtcttggggtaaaggtagcagcggaggaagcggcgctaagcccagcgatgccgcctcggaggctgctcgaccggctacctcaactctgaatagattttctgctctccagcaagctgtgccaactgagtctactgataataggcgcgtggttcagcgcagtagtctgtcacgggaacggggggagaaagcaggagataggggtgatcggctggagagatctgaacgtgggggcgatcggggggacagacttgatcgcgctcggacccccgcaactaagaggagtttctccaaagaggtcgaagaaaggagcagggaacggcctagtcagcctgagggccttagaaaagccgcctcgctgacagaggaccgagatcgcggacgtgacgcagtgaaacgggaggcggccctccctccggtgagccctctgaaggcagcgctcagcgaggaggagctggagaagaaatctaaggcaatcatcgaggaataccttcatttaaatgatatgaaggaagctgtgcagtgcgtccaagagctggcctcgccttccttattgttcatttttgtgcgtcacggggtggagtctactttagaacgaagcgccatagcaagagaacatatgggtcaactactgcaccagctgctgtgcgctggacacctctccaccgcacaatattaccaagggctgtatgaaattctcgaattagccgaggacatggagatcgacattcctcatgtctggctgtatctggccgagctcgtcacccccattctccaggaaggaggcgtcccaatgggcgaactttttagggagattacaaagcccctgcggcctttaggaaaagcagcctctttgctgctcgaaatactgggacttttgtgcaagagcatggggccaaaaaaagtcggcacgctgtggcgcgaggcaggactgagctggaaagagttcctgcccgagggacaggacattggtgcattcgtggccgaacagaaagtagaatacaccctgggggaagaatctgaagcaccggggcagcgggcactacccagcgaagagctgaaccgccagctggaaaaattgctgaaggaggggtcatcaaaccagcgcgttttcgactggatcgaagctaacttatccgagcagcagattgtgagcaatacattggttagagcattgatgaccgcagtgtgctactctgccattattttcgagacacctctgcgggtcgatgtcgcagtgttgaaagctagggcaaaactgctccaaaagtacctgtgcgatgagcagaaggagctgcaggcgctatacgctctgcaagccttggtggtgaccctggagcagcctcctaaccttctgcggatgttctttgatgcgctctacgatgaggacgtggtaaaagaagacgctttttacagttgggaatccagtaaggatcctgctgagcaacagggaaagggtgtggctctcaagtcggtgacagcattttttaagtggcttagagaagctgaggaagaaagtgatcacaactag

SEQ ID NO: 24045 - DNA, 4308 bp, Artificial Sequence
  Description of Artificial Sequence: Synthetic coding sequence
atgaaccagcccccccagatcgcccccaagcgggagcggaagaccattcgtatccgtgatccgaaccagggcggtaaggacatcaccgaggagataatgtcgggagctcgcacagcttctacccccacacctcctcagacaggcggggggttggagccccaggcaaacggcgagactcctcaggttgccgttatcgttagacccgacgaccgaagccagggggccattattgctgaccgaccggggctccccggcccagagcattctcccagcgaatcgcagcccagctcgcctagcccgacaccgtcgccctcgcccgtgttggagcctggatccgaacccaatcttgccgtgctatctattccgggcgacaccatgactactattcagatgagtgttgaggagtctactcctatttcaagagagaccggtgagccataccgcctatcccctgagcctaccccactggccgagcctattctggaagtggaggtgactttatctaaaccggtgcccgaatccgagttctcatcctctcccttgcaagctccaacccctttggcaagccataccgtcgagatacatgagccgaatgggatggtacctagcgaagacctggagcccgaagtcgaatcctcccccgaactcgcaccccccccggcctgtcccagcgagagtccagttcccatcgcacccacagcacaaccagaggagctactcaacggagcgccctcaccgccagccgtggatctgtctccagtgtccgaacccgaagaacaggctaaggaggtaacagccagcatggccccccccaccatccctagcgccaccccagccaccgcccctagtgccacctctcctgcccaagaggaggaaatggaggaggaggaagaggaagaggaaggcgaggcaggggaggcaggtgaggccgagtccgaaaaaggaggagaggaactgctgccccctgagtcaacgccaataccggccaatttgagtcaaaatctggaagccgccgctgctacgcaggtcgccgtctcagttcctaagcggcgtcggaagataaaggagctcaataagaaagaggcagtgggagatctgctcgacgccttcaaagaagccaaccctgccgtccctgaagttgaaaatcagcctcctgctggaagtaatccaggacctgagtctgagggctcaggtgtccccccgcggcctgaggaggccgacgagacctgggactcaaaggaagataagattcacaacgccgagaacatccagcccggagaacaaaagtatgagtacaagagcgaccagtggaaacctctcaatctcgaagaaaaaaaacggtatgacagggagttcctgctcggctttcagttcatttttgccagcatgcagaagccagaggggctgcctcacatctctgacgtggtgttagacaaggcaaacaagacccctctgcgaccattagacccaacgaggctgcagggcattaattgtggccctgacttcacaccaagttttgccaatctgggtcgtaccaccttgtctacccgagggcctccacggggcggccccggcggcgagctgccacgtggaccagctggactaggcccccgtcggtcccaacagggcccaagaaaagagcctaggaaaattatcgcaactgtgttgatgactgaagacattaagttgaataaggccgagaaagcatggaaaccttccagcaaaaggaccgctgctgacaaggatagaggcgaagaggatgcggacggctcgaaaactcaggacttgttcaggcgtgtgcgctcgattctcaataaactgaccccccagatgtttcaacaactgatgaagcaggtgacacagctcgccattgacaccgaggagagattgaagggtgtgatcgatctgatattcgagaaggccattagtgagcccaacttctctgtggcgtacgccaacatgtgcaggtgtctcatggctctcaaagtaccaactaccgaaaaaccgaccgtaaccgtgaactttagaaaactgctcttgaatcggtgtcagaaggagttcgagaaggataaagacgatgacgaggtcttcgagaagaaacaaaaagagatggacgaagctgctaccgcggaggagagagggcgacttaaggaggaactggaggaggcaagagacatcgctaggcggaggtctctcgggaatattaaattcattggggaactgtttaagctgaagatgctgaccgaagcaataatgcacgattgtgtggtcaaactgctgaaaaatcacgatgaagagagtttggaatgtctctgcaggctactcactacgatcggcaaagacctggatttcgagaaggcaaaaccccggatggatcagtacttcaatcagatggagaagatcatcaaggagaagaaaacctcttccagaatccgcttcatgctacaggatgtccttgatctgcggggctctaactgggtgccgcgccgaggtgatcaggggcccaaaaccatcgaccaaattcataaggaagcagaaatggaggagcacagggagcacattaaggtacaacagttgatggccaagggcagcgacaaacgtagggggggaccgccgggacccccaatctccagaggactccctctggtggacgacggcggctggaatactgtgcctatttccaaggggtcccgcccaattgatacttcccgactgactaagattacaaaacccgggtccatcgatagtaataatcaacttttcgcacccggcggacgtttgtcttggggcaaggggtcctctggtggtagtggcgccaagcctagcgacgccgcgagcgaggcagcccgaccagctacaagtaccctgaatagatttagcgctcttcagcaagctgtgccaaccgaatctactgacaacaggagagtggttcagagaagtagcctgtctcgcgagcgcggggagaaagcgggagacagaggagatcgcctcgagcgaagtgagcgtggcggcgacagaggcgataggttggatcgggccagaacccccgctaccaagcgttcttttagtaaagaggtggaagagagatccagggagagaccttcccagcccgaggggctgcgaaaggctgcttccttaactgaggaccgagatagagggcgcgatgccgttaagagggaggcagcgctgccgccagtctctccgcttaaggcagctttgagcgaggaggaactcgagaagaaatcgaaggcaattattgaggagtacttgcatcttaacgacatgaaggaagctgtgcagtgcgtgcaggaactggccagtccgtccctgctcttcattttcgtgagacatggcgtcgagagcactctggagcggagcgccatagctcgggagcatatggggcaactgttgcaccagctactgtgcgccgggcatctatccaccgctcagtactatcagggcttatacgagattctcgaactggctgaagacatggaaatcgatatccctcatgtctggctctatctagctgagctggtaactcctatactgcaagaggggggcgtgcctatgggggaacttttcagggagattactaagccgcttcgccctctgggtaaagcggcgagcctgcttcttgagattttaggcttgctttgcaagtcaatgggccctaaaaaggtgggtaccctgtggcgggaagcgggcctgagctggaaagagtttctgccggaggggcaagatatcggagcttttgttgccgagcagaaggtcgagtacacactcggagaagagtccgaggctcccggccagcgggcactgccctccgaggagctcaatcggcagcttgaaaagctcctgaaggagggatctagtaaccaacgcgtgttcgactggatcgaagccaatttatccgagcaacaaatagtctcgaacacactcgtgagggctctgatgaccgccgtgtgctattccgccattatcttcgaaacgcccctccgagttgatgtcgctgtgctgaaggctcgcgcaaaactattgcaaaagtacctttgtgacgagcagaaagaactgcaggcactgtatgccctgcaggcgttggtggtaaccttagagcagcctcccaatttgctccgtatgttcttcgatgccctttacgacgaggatgtggttaaagaggacgctttctacagctgggaatcctctaaagatccagccgagcaacaaggcaaaggagttgctctgaagagcgttacagccttttttaaatggttacgcgaggccgaggaagagtccgatcataattag

SEQ ID NO: 24046 - DNA, 4821 bp, Artificial Sequence
  Description of Artificial Sequence: Synthetic coding sequence
atgaacaaggccccccagagcaccggccccccccccgcccccagccctggcttgcctcagcccgccttcccgcctggccagacagcacctgtcgtattcagcactccacaagccacacagatgaatactccatctcagcccaggcaaggcggtttccggtcactccagcacttttatccctcccgagcccagcccccttctagcgctgcaagtcgggttcaatccgcagcaccagctagacctggccccgccgcacatgtgtaccctgctggaagccaggtcatgatgattccatcccagatatcttaccctgctagtcaaggagcctactacatacccggccaaggccggtccacatatgttgtgccgacgcagcagtaccctgtacaacctggcgccccagggttctacccaggcgctagtccgacagagtttggaacatatgccggagcctattatccggcacagggggtgcagcaattccctaccggtgtagcacccacgcccgtgctgatgaaccagcctccccagatagcaccgaaacgcgagagaaaaactattagaattcgcgatccaaatcagggcggaaaagacatcaccgaagaaatcatgtctggagcacggacggcgagcacaccgacccctccccagacaggcgggggcctggaaccccaggcaaacggagaaacccctcaggtagccgttatcgtccgacccgatgacagaagtcaaggcgctatcattgcggatcgaccaggactgcccggtcctgagcattccccatcagaaagtcagccctccagcccaagcccgactccttcacctagcccagttctggagcccgggtcagaaccaaacttggccgtgctttccattcctggggacactatgacaactatccaaatgagcgtagaagaaagcaccccaattagtcgggaaacaggggaaccgtatcgtttgtctcccgagcctacacctctggctgagcccatcttagaagtggaagtgactcttagcaagcccgttcctgaatctgaattttcatcgagcccgcttcaagcacctactcctcttgcctcccataccgttgagatccacgagcctaacgggatggtgccatcggaggacctggagcctgaagtggagagctccccagaactggcccctccccctgcctgcccctctgaatcccccgtccctattgctcctactgcacagcccgaagagttactcaacggcgcccccagccctcccgcggtcgacctaagccccgttagcgaacccgaggaacaggctaaagaggtgacagcatctatggccccgccgaccattccttctgctactcctgcaacggcccccagtgccacctcaccagcccaggaggaagagatggaagaagaggaggaagaggaggagggagaggcaggcgaagccggcgaagctgaatcagagaagggaggagaagagctgctccctccagaatccacccccatccctgccaatctgagccagaacttagaggccgctgcagccactcaggtggcggtgtccgttcctaagaggaggcggaagatcaaggaacttaataaaaaggaagcggttggggatctcttggacgcctttaaggaggccaaccccgccgtacctgaagtggaaaaccagccgccagccggcagcaacccagggcctgagtccgagggaagcggggtaccaccaagaccagaggaggcagacgagacctgggattctaaggaggataagatacacaatgctgagaacatccaacccggggagcaaaaatacgagtataagtccgaccaatggaagcctctgaatctggaagaaaaaaaacggtacgaccgggagttcttgctaggtttccagtttatttttgcctccatgcaaaaacccgaggggctgcctcacattagtgacgtcgtgctcgacaaggctaataaaaccccgcttcgcccgctggatccaacgcgcctacagggcatcaactgtgggcccgatttcaccccctctttcgcaaacctgggtaggactaccctgtcaacaaggggccctccacgggggggccccggtggcgagctgccgaggggaccagcgggacttgggccacggagaagtcagcaggggcctcgaaaggagcccaggaaaatcatagctaccgtcctgatgaccgaggacattaagcttaataaggccgagaaggcctggaaaccctcatctaagagaacagcagctgacaaggataggggagaagaagacgcagacggtagcaaaactcaggacctgttcagaagagttcgctctatacttaacaaactgaccccccagatgttccagcagttgatgaagcaggttacccaactcgcgatcgatacagaagagagactgaaaggtgtaatcgatctgatttttgagaaagccatctcagaaccgaacttcagtgtggcctatgcgaatatgtgccgctgtctgatggcactaaaagtgccgaccactgagaagccaacagtgacagttaatttccgcaagctactcctcaatcgctgtcagaaagagtttgagaaggacaaggacgatgacgaagtcttcgagaagaagcagaaggagatggatgaggcggccactgcggaggaacgggggcggctcaaggaggaacttgaagaagcccgagacatcgccagaagacggtcgttaggcaatattaaatttattggggagttgtttaagctgaaaatgttaaccgaagctataatgcatgattgtgttgtcaaactgcttaagaaccacgacgaagaaagcctcgaatgtctctgtcgcctgctgactactatcgggaaggatcttgactttgagaaagccaaaccaaggatggatcaatactttaaccagatggagaagatcataaaggagaagaagacctctagcagaatccgcttcatgctgcaagacgtgctggatttgcgcgggagtaactgggtccctcgcagaggagatcagggtcctaaaacaattgaccagatccataaggaggccgaaatggaggagcacagggagcatatcaaagttcagcagcttatggcaaagggaagcgacaagaggagaggcggtccgccaggtcccccgatctcaaggggcttgcccttagtggacgacggaggctggaatacggtcccaatcagtaaaggcagcaggccaattgacacctcacggctgaccaaaatcactaagcccggctctatcgattccaataatcaattgtttgcaccagggggtcggctgtcctgggggaaaggctccagcggaggctcaggggctaagccctccgatgccgccagcgaggccgctaggcctgccacttcaacgctgaacagattttccgcactacagcaagctgtgcccaccgagagcactgataacagaagggtcgtgcagagaagctctctgtcgcgagagcggggtgaaaaggccggagatcgcggtgaccgcctggaaaggtccgagcgaggaggagaccgcggggaccgactagaccgcgccaggactcctgctaccaaaaggagtttctcaaaggaagtcgaggaaagatccagggagcggccctcgcagccagaggggctgcgaaaagccgcgtcactaacagaagatagggataggggccgagatgccgtcaaacgcgaagcagcgcttccaccggtaagtcccctcaaggcagctctttccgaggaggagttggagaagaagagcaaagccatcattgaggagtatctgcatctcaatgatatgaaggaggctgtacaatgcgttcaggaactcgcaagtccttcgctcctttttatctttgtgaggcacggcgtggagtctactcttgagcgatccgccatcgcaagagagcatatgggtcagttgctgcaccagctgttatgcgctggccatctctccacagcacaatattatcagggtctttatgaaatcctggaactcgccgaggacatggagatcgatattccacatgtgtggctctacctggccgagctcgttacacccatattgcaggaggggggcgtcccgatgggggagctgttccgagaaattacaaaaccgctcaggcctctgggaaaggccgcctccctgttgctggaaattctgggactgctctgtaaaagcatgggaccaaaaaaagtgggcaccctgtggcgggaggctggcttgtcatggaaggagtttttaccagaaggacaggacatcggggcctttgtcgccgaacagaaagttgagtacactttaggcgaggagagcgaagcacccgggcaacgggctttacccagtgaggaactgaaccggcagctcgaaaagttgctgaaggagggctcatcaaatcaacgagtcttcgattggatagaggccaatttatcagaacagcagattgtctccaacacactggtcagagctctcatgactgccgtctgttatagcgccataatcttcgagactcccttgagagtggacgtagcagtgctcaaggcccgtgccaagctgctgcagaaatacctgtgcgatgagcagaaggagctacaggcactctacgccctccaggctctggttgtcacgttggaacaaccaccaaatctgctgcgtatgttcttcgacgctttgtatgacgaggatgttgtcaaagaggacgccttttactcctgggagagctccaaagaccctgccgaacagcaaggaaaaggggtggcgctgaagtctgtgaccgcttttttcaagtggctgcgcgaagcagaagaagaatcagatcataactag

SEQ ID NO: 24047 - DNA, 4821 bp, Artificial Sequence
  Description of Artificial Sequence: Synthetic coding sequence
atgaacaaggccccccagagcaccggccccccccccgcccccagccccggacttcctcaaccagcctttccaccaggacagaccgcccctgtggtctttagcacacctcaagccacacagatgaatactcccagccaacccagacagggtggattcagatccctgcagcacttctacccctcccgagcccagccccccagttctgctgctagtcgggtgcagtcggcagcccctgcaaggccgggcccagccgcccacgtgtacccagccggaagccaggttatgatgatacctagccagatttcctaccccgcctcacaaggtgcctattatattcccggacagggccgatcgacctatgtagtgcctacgcagcagtaccccgtccagcccggggctcccgggttctatcccggcgcgagtcctacagagtttggaacctacgccggtgcctattaccccgcccagggagtgcaacagttccctacaggtgtggcacctaccccggttctaatgaaccagccaccccagattgcacccaaacgagagaggaagacaattcgtattcgcgatcccaatcagggtggcaaggatataaccgaggaaattatgtcaggtgccagaacggcatctacacccacccccccccagacgggcggaggcctggagccccaggctaatggggagaccccccaggtggccgtcatcgtccggccagacgatcgctcccagggcgcaattattgctgatcggccaggtcttcccggaccagagcattctccatcagagagccagccttcgagcccatcccctacacctagcccatcgcccgtgctggaacccggaagcgagcccaatctcgctgtgctgtccatacccggagacaccatgacaaccattcagatgagcgttgaggaatcaacccccatctctcgcgaaactggcgaaccctacaggctgtctccagagcctacccccttggcagaaccaatactcgaggtcgaagtgactctttctaaacctgtgccagaaagcgaattttcgagcagtccccttcaagctcccaccccactcgcctcgcataccgttgagatacacgaaccaaacggcatggttccaagcgaagacctggaacccgaggtggaaagttcccctgagcttgctccccccccagcttgtccttcagagagtcctgtcccaatcgctccaactgctcagcctgaggagctcctaaatggtgctccctctccccctgcagtagatctaagccccgtaagcgaaccagaagagcaagccaaggaggtgactgcaagtatggccccaccaactattccatccgccactcccgctaccgctccgagtgctacatctccagctcaagaggaggaaatggaggaggaagaagaggaggaagagggggaggccggtgaagcaggggaggctgaatccgagaaaggcggcgaagagctactacctcccgaaagcactcccatccccgccaacctcagccagaatttggaagcagcagcagcgacccaggtcgcagtctccgtgccaaaaaggaggaggaagatcaaggagcttaataagaaagaggctgtaggggacttactggacgcgttcaaagaagcaaaccccgctgtaccagaagtggagaatcagcctccggctggatcaaatcctggcccagagtctgaaggatccggagtgccccctaggcctgaggaagccgacgagacatgggactccaaggaggacaaaatacacaatgcagagaatattcagcctggagagcagaagtacgagtacaagagcgaccagtggaagcctctgaacctggaggagaagaagcggtacgatagagaatttctgctgggtttccagtttattttcgctagtatgcaaaagcccgaaggactgccccacatttctgatgtggtgctagacaaggccaataagacgccacttaggcccctcgatcctacacgtttgcaagggataaactgtggcccagacttcaccccctcttttgcgaatctcgggagaacaactttaagtaccagaggcccacccaggggtggaccaggcggggaactacctcgcggcccggcgggcctcgggcctcgtcggtcacaacagggccctcggaaggagccaagaaagattatcgcaaccgtactaatgaccgaagacatcaagcttaataaggctgagaaggcatggaaacccagttctaagaggactgccgccgataaggacaggggcgaggaggatgctgacggctcaaagacccaggacctattcaggagggtacgatccatcctcaataaattaacaccacagatgttccagcaactgatgaagcaagtgacccagctggccatcgacacggaggaacgactgaaaggcgtcattgacctaatctttgaaaaggcgatctctgagcctaatttctcagttgcttacgctaatatgtgtcgctgtcttatggctttgaaggtgccaacaaccgaaaagccaactgtgacagtgaatttcaggaaactgctgctcaatcggtgtcagaaggagttcgaaaaagacaaggatgacgacgaggtctttgaaaaaaagcagaaggagatggacgaagccgcgacggctgaagagagggggcgtttgaaagaggaactggaggaagccagggacatcgccaggcgacggtccctggggaatatcaaattcattggcgagttgttcaaactgaagatgttaactgaggcaatcatgcacgactgcgtggtgaaactgctgaaaaaccacgacgaggaatcactggaatgtctatgtcgactgctgacgaccataggaaaggacctggactttgaaaaagctaaacctcgcatggatcagtactttaatcagatggaaaaaattattaaggagaagaaaaccagttcccggatcagatttatgctacaagatgtactcgacctcagaggatccaactgggtgccccgaaggggcgaccaggggccaaagacaatcgaccagatccacaaggaagctgaaatggaagaacacagagagcacatcaaggtgcagcagctgatggctaaggggtctgataagagacgtgggggacccccaggccctcccatatcccgtggtctcccgctcgtggatgacggcgggtggaacacggtgccaattagtaaagggtctcgacccattgacacttcgcggctgactaaaatcacaaaaccaggctcaatcgactccaataatcagctgtttgcgccaggcgggcgcctgtcctggggcaaaggaagcagtggggggagcggggctaagccaagtgacgccgctagcgaagcggctagaccagcaacaagcacccttaacagatttagcgccctccagcaggccgtgcccaccgagagcacagacaatcgaagggtcgtccaaagatcaagtttgtctcgtgagcggggagaaaaagctggggatcggggtgatcggctcgaacggtctgagcgaggtggcgacagaggcgatagactggaccgtgctagaactcccgccacaaaacgatctttttctaaggaggtggaggagcgttctcgggagagacctagccagcctgaaggcctaaggaaagcagcctccttgactgaggatagagacagaggacgcgatgccgtgaagagagaggccgcgcttccgcccgtctcacctttgaaggccgctctgagtgaggaggaactggagaaaaaatccaaagccattatcgaggagtatctgcatttgaacgatatgaaagaggccgtgcagtgcgtgcaggagttggcttcacccagtcttctgttcatatttgtgcgtcacggagtagagtctacactagagcggagcgcgatagcgagagaacacatggggcagctcctccaccaattactgtgtgctgggcatctttctacagcccagtactatcaggggctgtacgaaatcctggaacttgccgaagatatggagatagatatacctcatgtgtggctgtacctcgcagaactcgtaactccaattctgcaggagggaggagtgcccatgggcgaactttttagggaaataacaaagcccctgaggccattaggcaaggcagcttctttactgttggagatcctgggcctcttatgcaagtcaatgggacctaagaaagtaggcaccctctggagagaagccggcctgtcatggaaggagttcctacccgagggacaggacattggcgccttcgttgcggagcagaaggtggaatacaccctgggtgaggaatctgaggcccctgggcagcgggcgctgccttccgaggagctgaatcgccagctggaaaagctgctgaaggagggatcaagtaaccagcgggtttttgattggattgaggcaaatctgagcgagcagcagatcgtgtccaatacactcgtccgggcactgatgaccgcagtctgctattctgctattattttcgaaacaccgctgcgagttgacgtggctgttctgaaagcccgcgcaaagctgctgcaaaagtatctatgcgatgagcaaaaagaattgcaggcactctacgctctgcaggctttagttgtcactctggagcagccccctaaccttttgaggatgttcttcgacgcgttgtatgacgaggatgtggtcaaagaagacgctttctattcctgggagtcgtcaaaggaccctgccgaacaacaaggcaaaggtgtcgccctgaaaagcgtgacagccttcttcaaatggcttagggaagctgaggaagaatccgaccacaactag

SEQ ID NO: 24048 - DNA, 4539 bp, Artificial Sequence
  Description of Artificial Sequence: Synthetic coding sequence
atgatgatccccagccagatcagctaccccgccagccagggcgcctactacattccgggccaaggacggtctacctatgtggttccaacacagcagtacccagtgcagccaggagccccaggattttaccccggggctagccctacggagttcggcacgtatgccggtgcgtactatcctgcacaaggcgtgcagcagttccccacgggcgtggccccaactcccgttctcatgaaccagccaccgcaaattgcacccaaaagggagaggaaaacaataagaatacgcgatcccaatcagggaggaaaggacattactgaagaaattatgagtggagctcggaccgctagcactccaaccccgcctcagaccgggggagggcttgaacctcaggccaatggagagactcctcaggtggctgtgatagtccgacccgacgaccggtcacagggggccatcatcgccgaccggcctggattgccaggccctgagcacagccctagcgaaagtcagcctagttccccgtcacccacccccagtccaagtcccgtcctggaacctggatctgaacccaacttggccgtgctgtcaatccccggcgacaccatgaccaccatccagatgtctgttgaggaaagtactcccatcagtcgggagactggagaaccataccgtctgtcgccggagcctactcctttggccgagccaatcctggaggtcgaagttactttgagtaaaccagtgcctgaatccgaattttcatccagccccctccaagcccccacacctctggccagccatacagtggagattcacgagcctaacgggatggtccccagtgaagacttggaacctgaggtggaatcaagccccgaactggcgccccctcccgcctgtccctctgagtcccccgttccaattgctcccaccgcccagcccgaagaactgctcaacggcgcccctagccctccggccgtggacctgagccctgtaagcgaacccgaagagcaggcgaaggaggtgacggcatctatggctccaccgaccattccttccgccaccccagccactgctcctagcgcaaccagtcctgcacaagaagaggaaatggaggaggaagaagaggaagaggaaggagaggctggagaagctggggaggcagaaagcgagaagggaggcgaagagttgttgcctcccgaaagcacccccatccccgctaacttatcccaaaatctggaggccgccgccgctacccaagtcgccgtgagcgtccctaagaggagacggaagataaaggagctcaacaaaaaggaggccgtgggcgatcttttagatgcgttcaaagaagcgaatcctgccgtgccggaggtggaaaatcagccaccagccggcagtaaccccggcccggaatccgaaggtagcggggttcccccacgaccagaagaagctgacgaaacgtgggattctaaagaggacaagattcacaacgccgagaacatccagccaggagaacagaagtacgagtataaatcagatcagtggaagcccctgaatctggaggagaagaaaaggtatgatagagagttcttgctcggttttcaatttatctttgcatccatgcaaaaaccggagggattaccgcacatctcagacgttgttttggataaggccaataaaacccctctgagaccccttgatccaacccgtcttcagggcataaactgcgggccagatttcactccaagcttcgcaaacctgggtaggacaacgctctctacacgcggacctccccgtggtggccctgggggggagctgccccggggccctgcaggcctgggacctagacgttcacagcagggaccgcgcaaagaacctaggaagattattgcaaccgtcctgatgactgaggatattaagctgaacaaagctgagaaggcctggaagccatccagtaagcggacggcggccgacaaggacaggggggaagaggatgctgatggtagcaagacacaagacttgttccggcgcgtgcgtagcattttaaataaactcactcctcagatgttccagcagctgatgaagcaggttactcaactcgccatcgacaccgaggagcgactgaagggcgtaatagacctaatctttgagaaagctattagcgagccaaacttctctgtggcctatgcgaacatgtgtcgatgcctgatggcacttaaggtccccactacagagaagccgaccgttacagttaacttccgaaaactccttcttaacagatgtcagaaggagttcgagaaagacaaagatgacgatgaggtgttcgagaaaaagcagaaggaaatggacgaagcggcgactgctgaggaacgagggagactgaaagaggagctggaagaagccagggatatcgccaggcgaaggtcactggggaatataaaatttatcggcgaactgtttaagctcaagatgctgaccgaggccataatgcatgattgtgtggtgaaactgttgaagaatcacgacgaggagtctctggagtgtctgtgccgactcttgaccaccataggaaaggacctggatttcgagaaagcaaagccccgcatggaccaatattttaaccagatggaaaagattataaaggagaagaagacaagctcacggataaggtttatgctgcaggacgtgctcgatctgcgtggaagtaactgggttccaaggcgcggggaccagggccctaagactatcgaccaaattcacaaggaggctgaaatggaggaacacagggaacatatcaaagtgcaacagctcatggccaaggggtccgacaaaaggaggggcgggcccccaggaccacctattagcaggggcctgccactagtggatgacggcgggtggaacactgtgcctatttctaagggaagccggcccattgacacttctaggctgaccaagataactaagccaggcagcatcgatagcaataaccagctgtttgcccctggaggccgtttatcatggggaaaggggagctctggagggtccggcgcaaaacctagcgatgccgcatctgaggccgccaggccagcaacctccaccctaaacagattttcagcccttcagcaggctgtgcctactgaaagtaccgataatcgcagggttgtgcaacgctctagcctaagtcgagagcgtggggagaaggccggggatcgcggagatcgacttgagcgaagcgagcgtggaggagaccgcggggacaggcttgaccgcgcccgcactcctgccactaagcggtctttttccaaagaagtggaggaaagatcacgggaaaggccttcgcagccagagggcctgagaaaggccgccagtctgacagaggatcgtgatcgtggccgcgatgctgtaaagcgagaggccgctttgccaccagtttcccctctaaaggccgcccttagcgaagaggaacttgaaaaaaagtctaaagccataatcgaggaatacttacacctgaacgatatgaaagaagcagtacagtgtgtccaggaacttgcaagccccagtctgctgtttattttcgtcagacatggagtcgagagcaccctagaaagaagcgctattgcccgcgaacacatgggtcagctcctgcaccagctactttgtgccggacacctttcaacagctcagtattaccagggactgtacgagattttggagctggccgaagatatggaaatagacatacctcacgtctggctctacttggcagaattagtgaccccaatcttgcaagaggggggtgtgcccatgggggaattattccgggaaattacaaagccactgaggccactgggaaaagcggcgtccctgctgctggagattttaggccttctctgcaagtccatggggcctaagaaagtcggaacactgtggcgcgaagccgggctttcctggaaagagtttctgcctgagggccaggatatcggagcattcgtggctgaacaaaaggtggaatacactctgggcgaggaaagtgaggctccgggccagagggccttacccagcgaagaacttaataggcaactcgagaagctgctcaaggagggctccagcaatcagcgagtttttgactggatagaggccaatctttcagagcagcaaattgtaagtaatacccttgtgcgggcactgatgaccgctgtgtgctactctgctatcatcttcgaaacgcctctgcgagtcgacgtggctgtgctgaaagcaagagcaaagctgttacagaagtatctttgtgacgagcagaaagaactgcaggctttgtacgccctgcaggcattggtcgtgaccctcgaacagcctcccaatcttcttcgcatgtttttcgatgcactgtacgacgaagatgtcgtgaaggaagatgctttctacagttgggaatcaagtaaagaccctgctgaacagcagggcaagggcgtcgccctgaaaagtgtgactgcgttctttaaatggctgagagaggctgaagaggagagcgatcataactag

SEQ ID NO: 24049 - DNA, 4539 bp, Artificial Sequence
  Description of Artificial Sequence: Synthetic coding sequence
atgatgatccccagccagatcagctaccccgccagccagggcgcctactacattccagggcagggcagaagtacttacgtggttccaacccagcaatatcccgtgcaacccggggcccctgggttttacccaggcgcgagccctaccgaatttggtacttatgccggtgcttactatcccgcgcagggcgtgcagcagttccccaccggggtcgcccctaccccagtcttgatgaaccagcccccccagattgctcctaagagagagagaaagactatccggattagagaccctaaccagggaggcaaggatattactgaggaaatcatgagcggggcacggacggcgtcaacccccacgccaccccaaaccggaggggggcttgaacctcaagctaacggagaaacaccccaggttgctgttatcgtgcggccggatgacagatcgcagggcgcgattatcgctgacagacccggactccctggcccagagcattccccttccgagtcccagccatcttcgccctctccaactccgtctccaagtcctgtgttggaacccgggagcgagcctaaccttgcagtgctcagcatcccgggcgatacgatgacgaccattcagatgtccgtagaagagagcacacccatcagtagagagaccggagagccttatcgcctttcccccgaacccaccccattggccgagccgattctggaagtggaggtgaccttaagcaagcccgtgcctgagtcagagttctcctcttcccccctgcaggcccccacccctctcgcgtcccacactgttgagatccatgagcccaatggtatggtgcctagtgaggatctggagcccgaagtggaaagcagcccagaactagccccaccaccggcttgtcccagtgagagccctgttcccattgcacccaccgcccagcctgaggaactactgaacggcgccccaagtccaccagcggtggacctgagccctgtttctgagcccgaggagcaggccaaggaagtgactgccagcatggccccacccactattccttcagctactcccgccacggctcccagcgcaacttctcccgcacaggaagaagaaatggaagaagaggaggaggaggaggagggcgaagccggagaagcaggtgaggctgagagcgaaaaagggggcgaggagctgctgccacccgaatctacacctatccctgccaatctgagccagaatctcgaggctgccgcagccactcaggtggccgtgagcgtgcctaagcgcagacggaagataaaagaactcaataagaaggaggcagtgggggacctccttgacgcctttaaggaggctaaccctgctgtgcctgaggtggagaaccagccccccgctggcagtaatccaggaccagaaagcgaagggtccggtgttccacctcgccctgaagaggccgatgaaacctgggacagcaaagaggacaaaatccataatgccgaaaacattcagcctggagagcaaaaatacgaatataaaagcgaccagtggaagcctctaaatctggaagaaaagaaaagatatgatagggaattcctcctcggctttcagttcatctttgcaagcatgcagaagcccgagggtctgcctcatatttctgatgtggtcctggacaaagccaataagacacccctgcggccgctcgacccaacacgactgcagggcataaactgtgggcccgatttcacaccttcctttgccaatctcgggagaaccaccctctccacacgcggacccccaaggggcggacctggcggcgagctccccagggggcccgctggactcggtccccgccggtcacagcagggccctcgcaaagagcctcgaaaaattattgctacagttctcatgacagaggatataaagctcaataaagctgaaaaggcatggaaacctagttctaagcggacagccgccgataaggatcgcggcgaggaggacgcagatggctcaaaaacccaggacctctttcggagggttcgatccattttaaacaaactcaccccccaaatgtttcagcagctgatgaagcaggtaacacagctcgcaatagatacggaggaacgactgaagggcgttatcgacctgatctttgaaaaggctatttccgagcccaacttttcggtggcttacgccaatatgtgtcgttgcctgatggcacttaaagtgcccacaacggagaaaccaacagtgactgtgaactttagaaaactactgcttaatcgatgccagaaagagtttgagaaggacaaagacgatgacgaagtgtttgaaaagaagcagaaggagatggatgaggcagcaacagcggaagagagaggccgattaaaggaggagctggaggaagcgagggacattgccaggcggcggtctcttggaaacatcaaatttataggtgaactctttaaactcaagatgttgaccgaggccatcatgcatgattgtgtggttaagctactcaaaaatcacgatgaagagagcctggaatgtctgtgtcgcttgttaactaccatagggaaagacttagatttcgaaaaggcaaaacctcgcatggatcagtatttcaaccaaatggagaagatcataaaggaaaaaaaaacatctagtagaattcgcttcatgttgcaggatgtgctcgatttaagaggatcaaattgggtgcctagacggggagatcaaggtcccaagaccatagaccaaatacataaggaggccgagatggaggaacatagagagcacattaaggtacagcagctcatggccaagggctcagataagagacgtggcgggcctcctggtccccccatttctaggggcctgcctctggttgacgacggaggttggaatactgtgcctatttctaaaggctccaggcccattgatacctcccgactgacaaagatcacgaaacctgggtcgatcgactcaaacaaccagctttttgctccaggcggaagactaagttggggcaaaggaagctccgggggctctggcgcaaaacctagtgacgccgctagcgaggccgccaggcccgccacctcaactttaaatcggtttagtgctttacagcaggctgtgcctactgagtccacagataacagaagagtggtgcagcgttcctccttgtcacgtgagaggggagaaaaggcaggcgacagaggggacagactcgagaggagcgagagaggcggtgacaggggggaccgtctggatcgggcaagaaccccggccactaagcggtctttcagtaaggaggtcgaagagagatctcgcgaacgccccagccagcctgaaggtctccggaaggcggccagtctgacggaagatcgagaccggggccgagatgcagtcaagcgtgaggccgcgttacctccagttagcccactgaaagccgccttgtcggaggaagaacttgagaagaagagtaaggcaatcatcgaggaataccttcacctgaatgatatgaaagaagccgtgcagtgtgtgcaggaactggcatctccatccctgctgtttatattcgtgcgacacggtgtcgagagcaccctggagcggtccgcaattgcccgagagcacatgggacagctgctgcaccagctgctctgtgctggacatctaagcactgctcagtactaccaaggtctgtacgagattctggagctcgccgaggatatggagatagacattcctcacgtgtggttgtatctggccgaactggtcacacctatactccaggaaggcggggttccaatgggcgaattgttccgcgaaattactaagccacttcgtccgctcggtaaagcagctagtctgctgctcgaaatcctcgggctgctttgtaaaagcatgggacccaaaaaggtcgggaccctttggagggaggctggtctgtcctggaaggagtttctgcctgagggccaggatataggggcttttgtggctgaacagaaggtcgagtacaccttaggggaagagagtgaggcgcctggtcagagagccctcccttctgaggaactgaacaggcaactagaaaagctcctgaaagaggggagctcgaaccagagagtgttcgactggattgaggccaatctcagcgaacaacaaatagtctccaacaccctggtgcgggctctgatgactgctgtgtgctattctgccatcattttcgaaactcctctgagagtcgatgttgccgtgttgaaggcccgagccaagctgcttcagaagtatctctgcgacgagcagaaggagctccaggctctctatgctctacaggcgctggtcgttacattggaacaacctcccaatctgctgcggatgtttttcgacgccttatacgacgaggatgtggttaaagaagacgctttttactcctgggaatcttccaaggatcccgccgagcaacaaggtaagggcgtggccttgaaaagtgttactgcattctttaaatggctccgagaggccgaggaagagtccgaccacaactag

SEQ ID NO: 24050 - DNA, 4683 bp, Artificial Sequence
  Description of Artificial Sequence: Synthetic coding sequence
atgaacacccccagccagccccggcagcacttctaccccagccgggctcaaccaccatcttccgccgcatctagggtgcagtccgctgctcccgcccggcctggtccagctgcccatgtttacccagccgggtcccaggtgatgatgattccttcccagatcagttaccccgcatcccaaggggcttactacattccaggccaagggcgcagtacttacgtagtgccgacacagcagtatcctgtgcagcctggagcccccggtttctacccaggggcgagtcccaccgagtttggaacctatgctggcgcatattaccctgctcagggagtacagcagtttcctaccggcgtcgcccccacccccgtgttaatgaatcaaccaccacaaattgctcccaaaagagagcggaaaacaattcgaattcgggatccaaaccaaggggggaaagacatcaccgaggaaattatgtccggggcaagaaccgccagtactcccacaccaccccagaccgggggaggactggagccgcaggcgaacggagagacccctcaggtggccgtgatagtcagacccgatgatagatcacagggtgctattattgccgaccggccgggccttccgggaccggagcactccccaagcgaaagccagccatcaagtccatcccctaccccaagtcctagcccggtgcttgaacctggctctgagcccaatctggcagtgctgtccataccaggcgacacaatgactacgattcagatgagcgtggaagaaagcactccaatcagcagggagactggtgaaccatacagactgtctcctgaaccaactccccttgctgaaccgatactggaagtagaagtgacactctctaaacctgtccctgaaagcgagttttcctcttccccactccaggcacccaccccactggcttctcacaccgtcgaaatacacgagccaaacggaatggtcccatccgaggacctggagcctgaagtggaatccagtccagaactcgcaccaccacccgcttgtccaagcgaatcccctgtccccatcgcccccactgcccagcctgaggagctattgaacggcgccccttctccacctgccgtagacctgagtcctgtctctgagcctgaggaacaggccaaggaagttacagctagtatggccccacctacgattccctctgccacccccgctactgcacccagtgctacaagccccgcccaggaggaagagatggaggaggaggaagaagaggaggagggggaagcgggggaggccggagaagcagagtctgaaaaaggaggcgaggagctgttgccgcccgagagcacccccatacccgccaatttaagccagaatctggaggccgcagctgcaacgcaagtggcagtgagcgttcctaaacggaggcggaaaatcaaggaactcaataagaaagaggcagtgggggatttgttagacgcatttaaggaagcaaaccctgccgtcccagaggttgaaaaccaaccgccagccggttcaaatcctggaccggagagcgagggatctggcgttcctccacgaccagaggaggcagacgagacctgggattctaaggaagacaagatacacaacgcagagaatattcagcccggcgaacagaagtatgagtacaaatccgatcagtggaagcctctaaatttggaagagaagaagcggtacgatcgagaattcctcctgggatttcagttcatttttgcctcaatgcagaagcctgaaggcttaccacacatctctgacgttgtgctcgataaggccaataaaactcccctgaggcctctggacccaacaaggctccagggcatcaattgtgggccggacttcacaccaagcttcgctaacttgggtaggactaccctcagtacacggggacctccacggggcggacccggcggagaactgcctcgtggtccccaagcggggcttggccctagacggagtcaacagggcccccggaaagagcctcggaaaatcattgcgaccgtgttgatgactgaggacatcaaactgaataaggctgagaaggcctggaagccctcctccaaaagaactgccgccgacaaagacaggggagaggaggatgccgacggcagcaagacccaggatctgtttagaagagtaaggtccatcctcaataaattgacccctcaaatgtttcagcagcttatgaaacaggtgacccagctggcgattgatactgaggaaaggttaaaaggcgttatcgatttaatttttgaaaaagcaatttcagagccaaatttcagcgtagcttacgcaaatatgtgtaggtgtctgatggccctgaaggtgccgacaaccgaaaagcccactgttacggtgaacttccggaaacttctgttgaacaggtgccagaaagagtttgagaaggacaaggacgatgatgaggtgtttgaaaaaaagcagaaggaaatggacgaagcagctacagccgaggaacgagggaggctgaaggaggagctggaagaagcgcgggacattgcgcgccggcgtagtctgggcaatataaagttcattggcgagttgtttaaactgaaaatgttaaccgaggccatcatgcacgattgtgttgtgaaattactcaaaaaccatgacgaagaaagtctggagtgcctctgcaggcttctcactaccatcggaaaagacctcgattttgagaaagcaaaacccagaatggaccagtatttcaaccagatggagaaaattatcaaagaaaagaagacttctagcagaatccgttttatgctgcaggacgtcctagacctgagaggatctaactgggtgcccagacgaggcgaccagggccccaagacgatcgatcaaatccataaagaagccgagatggaggagcacagagaacacattaaagtccagcagctcatggcaaaggggtctgataagcggcgtggagggccccccggacctccaattagtagaggcttgcccctagtggacgacggaggatggaacacagtgcccattagtaagggctctcgtcctatcgacacctctcggctcaccaagattacgaaacccggatccattgactctaataaccagctgtttgcgccgggaggacggctgagttggggtaaaggttcttcaggcgggtctggtgccaagccaagcgatgccgccagtgaagccgccagacccgcaacctctacattgaaccggttttccgccctgcagcaagcagttccaaccgaatcaaccgataataggagagtcgtgcagagaagtagcctctctagagaaaggggggagaaggcaggtgataggggggaccggcttgagcgcagcgagcgaggcggcgataggggggataggctcgatagagcccgcacacctgctaccaagaggagcttctcaaaagaagtcgaggagagatcacgggagcgcccgagtcagcctgagggactgcggaaggccgcgtccctgacggaggatagggaccgagggagggacgcggtcaagagagaggccgcactgccccccgtaagtccactcaaggctgccctgagcgaggaggagctcgagaaaaaatccaaggcaatcattgaagaatacctccatcttaacgatatgaaagaagcagtccaatgtgtacaagaactggcctcaccctcccttttattcatattcgtcagacatggagtcgagtcgacacttgagagatccgcgatcgccagggaacacatgggccaactgctgcaccagctcctctgcgcaggacatctctcaactgcccagtactaccaaggactttatgaaattcttgagctggcggaagacatggagatcgacataccgcacgtctggttatatttggctgaattggtgacccccattcttcaggaggggggagtgcctatgggagagctgtttagagagattacgaagcccctccggcctcttgggaaagccgccagcctcttattagagattctagggctgctgtgtaaatccatggggccaaaaaaggttggcactctgtggcgagaggcaggcttgagctggaaggagttccttcctgaggggcaggacattggtgcgttcgtagccgagcagaaagtggaatacaccctgggcgaagagtccgaggctccaggccaacgcgctctgcctagcgaagagctgaatcgacagctagaaaaactgctaaaggaggggtcctcaaaccagagggtgttcgactggattgaagctaatttatctgaacagcagattgtttccaatacactagttcgcgcactcatgacagcagtgtgctattccgccatcattttcgagaccccactgcgggtcgacgtggcggtcctgaaggctcgagctaagctactccagaagtacctgtgcgatgagcagaaggagttacaggccctgtatgctctgcaggccctggtggttaccctcgagcaaccccctaacctgttacgaatgtttttcgacgccctgtatgacgaagacgtggtcaaggaagatgccttttattcctgggagtctagtaaggacccagctgaacaacaagggaagggggtggccctgaaaagtgtaaccgcttttttcaagtggctgcgggaagctgaagaggagagtgatcacaattag

SEQ ID NO: 24051 - DNA, 4680 bp, Artificial Sequence
  Description of Artificial Sequence: Synthetic coding sequence
atgaacacccccagccagccccggcagcacttctaccccagccgggctcagccgccaagctcggccgctagccgggtgcagtcagccgccccggccaggccaggccccgccgcgcacgtctacccagcaggctctcaggtgatgatgataccctcacagatttcataccccgctagccaaggggcctactacatcccgggacaaggaagaagcacttacgttgtacctacccagcagtacccagtgcagcccggcgcgccggggttttatcctggagcgtctcccaccgaatttggaacctacgccggagcatactaccccgcccagggagtgcagcagttccctactggcgttgcgccaacccctgttcttatgaatcagccccctcagattgcacctaaacgagaaaggaagacaatcaggatacgagacccaaatcagggagggaaagacatcaccgaggaaattatgtcgggtgcaagaaccgctagcacacccacccccccccagaccggtggaggcttagagccgcaggccaatggcgaaacaccgcaagtagcagtcattgtgcgcccagatgatcgaagccagggggctatcatcgcagatagaccagggctacccgggccagagcactccccctccgagtctcaacccagcagcccatccccaacacccagcccttcacctgtgctggagcccggctccgagccgaacctggctgtgctgagcatcccaggcgacacgatgactaccattcaaatgagcgttgaggagtcaacgccaattagtagggaaactggagaaccctaccgactcagccctgaaccgacccccctcgccgagccaatactggaggtggaggtgactctgtcaaagcccgtgcctgagtcggagttcagttcaagccctttgcaggcccccactcctcttgcatcccacacagtggagattcatgagcctaacggcatggtgcctagcgaggacttggaaccagaagtggagtcctcaccagagttggcccccccacctgcttgcccttctgaaagtcccgtgccgattgcccccaccgctcagcctgaggagctgctgaacggagctcctagtcctcctgcagtcgacctatcccctgtttcagagcctgaggagcaggccaaggaagtcaccgcaagcatggcacctccaactataccatcagcaacacctgctacggccccttcagctacgagcccagcccaagaggaggaaatggaagaggaggaagaagaagaggagggcgaggcaggggaggccggagaggccgaaagtgagaagggcggcgaggagctgctgcccccagagagcactcccatacctgctaatctgtcgcagaatcttgaggccgccgccgctacacaagtcgctgtgtcagtcccaaaacgtagacggaaaataaaggaactgaacaaaaaagaggctgtcggcgacctgcttgacgcctttaaagaagctaaccccgcggttcccgaggtagagaaccagccgcctgcaggctctaaccccggcccagaaagcgaaggtagcggcgtcccacctaggcccgaggaggcagatgaaacatgggactccaaagaggataaaatccacaacgcagagaatatccagccaggagagcaaaaatacgagtacaagagtgatcagtggaagcctcttaacttagaggaaaagaagcggtacgacagggagttcctgttggggttccagtttatcttcgcttccatgcagaagccagagggtttgccccatatctctgacgttgtgctggataaggcaaacaagacgcccctgcggccactagatccaacccggctgcagggaatcaactgtgggcccgattttacacctagctttgcaaacctgggtcggacaacgctgtctactcgtggcccaccccgggggggtcccggaggagaactgcctagggggcccgcaggccttggaccaagacgatcccaacaggggccaaggaaagagccgcggaagattattgctacggttttaatgacagaagacattaaactcaacaaagccgaaaaagcctggaagccaagctccaaacgcactgcggccgacaaggacagaggcgaggaggatgcagacggaagcaaaacccaagacttattccggagggtcaggagcatcttaaataagctgaccccccagatgttccagcagctgatgaagcaggtcacccagcttgcaatagataccgaagagcgtcttaagggagtgatagacctcatcttcgagaaggccatttcagagcctaacttctcagtcgcttacgctaacatgtgcagatgtctgatggccctcaaagtgcccacaacggagaagcccactgtgaccgttaacttccgaaaacttcttttgaacagatgccaaaaagagttcgagaaggataaagacgacgatgaggtattcgagaaaaagcagaaggaaatggacgaggccgccactgctgaagagcggggccgtctcaaggaagaactcgaggaggcccgcgacatcgccagacgccgttcgctgggaaatattaaattcattggtgaattgttcaagctcaagatgctgaccgaggcaatcatgcacgactgcgtcgttaagctgcttaagaaccacgacgaagaaagcctcgagtgcctgtgtcgtctgctgaccactatcggcaaagacttagactttgaaaaagctaaaccccgcatggaccagtactttaatcaaatggagaaaatcatcaaggagaaaaagacgtcctcacggatcaggttcatgctgcaagacgtgctggaccttcggggcagcaactgggttcctagaagaggggatcagggtcccaaaactattgatcaaattcataaagaagccgagatggaagagcacagggagcatatcaaagtgcaacagctgatggccaagggctcagacaaacggagaggcgggcctcccggcccgccgattagccggggcctcccactggtggatgatggaggatggaacactgtcccgatttccaaagggagtagacccatcgacacgtctcggcttacaaaaatcaccaagcctggcagtatcgactcaaacaaccaactttttgcgcccgggggacgcttgagctggggaaagggctcttcgggcggatcaggggccaagccaagcgatgctgcctccgaagcagccagaccagccacctcaaccttgaatcggttcagcgctctccagcaagctgtgccgaccgagtccaccgataatcgtagggtcgtgcaaaggagctctctgtcgcgcgagcgaggtgaaaaagcaggcgaccggggtgatcggctggaaaggtccgagcggggaggcgatcggggggaccgcctcgatcgtgctcgcacccccgccaccaagcggtccttcagtaaggaagttgaggagcggtctagggagagaccctcacagcccgagggcttgagaaaggctgcgtcgttgaccgaggaccgggaccgtggtagagacgctgtgaaaagagaagccgcactccctcccgtttccccattgaaggcagctctctccgaggaggaactggagaagaagtcaaaggccattatcgaagagtacttacacctgaatgatatgaaagaggccgtccagtgtgtgcaggagctcgcatccccgtctttactattcatatttgtgaggcacggggtcgagtctacgttggaacggtcggctattgccagggaacacatggggcagctgctccaccaactcctgtgtgctggccacctgagcactgcgcagtactatcagggcctgtatgaaatcctggaactggcggaggatatggagatagacattccacatgtctggctttacttggctgaattggtaactccaattctccaggaggggggcgtcccgatgggcgagttgtttcgagagatcacgaagccgctcaggcccctcggcaaagcagcctccctgttgctcgaaattctggggctgctgtgcaaatctatggggcccaagaaggttgggaccctgtggcgggaggccggactatcctggaaggagtttctcccagagggccaggacattggagcctttgtggcagagcagaaagtcgaatataccttgggcgaggagagtgaggcaccgggtcagcgcgccctcccaagtgaggagctgaacagacagctggaaaagcttttgaaagagggaagctcaaatcaacgcgtgtttgactggatcgaggcaaacctcagcgagcaacagatagtgagtaacactctggtgcgcgccctgatgacagcggtctgttactcagccatcatcttcgaaacccccctgcgggtcgacgtagccgtgctgaaggcccgggccaaactgctgcagaaatacctatgcgacgagcagaaagaactccaggctttgtacgcgctgcaggccctggtggtcacattagagcagccaccaaacctgctgcgcatgtttttcgatgcactgtatgatgaggatgtggtgaaagaagacgcattttattcatgggagagttctaaagatcccgcagagcagcagggcaaaggtgtggccttgaaaagtgtcaccgctttcttcaaatggcttcgggaggcagaggaggagagcgaccacaactag

SEQ ID NO: 24052 - DNA, 4821 bp, Artificial Sequence
  Description of Artificial Sequence: Synthetic coding sequence
atgaacaaggccccccagagcaccggccccccccccgcccccagcccgggactgccgcagcccgcttttccgcccggacagaccgctccagtggtgtttagcacaccacaggctactcaaatgaatactccttctcaaccacgacagggcgggtttcgttccctgcagcatttttatccctcccgggcccagcccccctctagcgcagcaagtagagtacaatccgctgcaccagccaggcccggtcccgcagctcacgtgtacccggccggctcacaggtcatgatgattccaagccagatctcatatccggcatcccagggcgcctactacatccctgggcagggcaggtcgacatacgtggtccctacacagcagtatccagtgcagcctggagctcccggcttctatcccggcgcatcccctaccgagttcgggacctacgcgggggcctactacccagcgcagggcgtgcaacagttccccactggcgttgcgccaacccccgtgctgatgaaccagccacctcagatcgctcctaaacgagagcgaaagacaattcgcattagggatccgaaccaagggggcaaagatatcactgaggagattatgagcggggccagaacagcatccacccctacgccgcctcagactggcggaggtctggaacctcaggccaacggagagacaccccaggtagccgtgattgtcagacctgatgatcgcagccagggggctattatcgctgatagaccggggctgccggggcctgaacacagtccatccgaatcccagccttccagcccttcgccaacaccaagcccaagccctgttctggaaccagggagcgagccaaacctggccgtcttgtcaatccctggagataccatgaccacaatccagatgtctgtggaagagtccaccccaatcagcagagagaccggagagccttaccgactgtcccccgaacccacacccctagctgaacccatcctcgaggtggaggttaccctgagcaaacctgtacctgagtctgagttctcgtcttctccgctccaggcaccaacacccctggcttctcataccgtagagatccacgagcccaacggtatggtcccgtctgaagatctggagcctgaagtcgagtcatctcccgaactcgctccacccccagcatgcccctctgaaagccccgtgccaatcgcccctacagcccagccagaagagctattgaacggcgctccctcccccccggccgtggacctctcgcctgtgagcgaacctgaagaacaggccaaggaggtgaccgccagtatggcaccccccacaattcctagtgcaaccccagccaccgctccttctgccacgtcccctgcccaggaagaggagatggaggaagaggaggaagaggaagaaggcgaagccggcgaagccggggaggccgaatctgagaaaggcggcgaggagttacttcctcctgaatccacaccaatcccagcgaatttatcacagaatttggaagcagccgccgcaacccaagtggctgtgagcgtgcccaaaaggcgaagaaagataaaggaactgaataagaaggaggccgtgggagatttgctcgatgccttcaaagaggctaaccctgcagtgcctgaagttgaaaaccagccccccgcggggtctaatcccggaccggagagtgaggggtcaggcgtgcctccacgaccagaagaggctgatgaaacatgggacagcaaggaagacaaaatccacaatgccgaaaacatccaaccgggagaacagaagtatgagtacaaatcagatcagtggaaaccactaaacctcgaggagaagaagcgatacgaccgtgagttcctgctggggtttcagtttatctttgccagcatgcagaaacccgaagggctgcctcatatttctgatgtggtcttagacaaggcaaacaagacgcctctccggccgttagaccccacccgcctgcaaggtattaactgcggtccagatttcactccatcatttgctaacctgggccgcactacgctctctactcgcgggcccccccgtggagggcctgggggtgagctccccagaggacctgcgggcctgggtcctagaagatcacagcagggaccgcgcaaagagcccagaaaaataatcgcgacagtcctcatgacagaagacatcaagcttaataaggccgaaaaggcgtggaagcctagttcaaaacggacagccgccgacaaagacagaggtgaggaagacgcggatggttcgaagactcaagacctatttaggcgcgtgaggagtatcctgaacaagctcacaccacagatgttccagcagctcatgaagcaagttacccagctggccatagacactgaggaacgattgaaaggagtgattgatctcatctttgaaaaagccatctctgaacctaacttctctgtggcctatgctaatatgtgccggtgcctaatggccttgaaggtgcccacaactgaaaagcctaccgtcacggtcaactttaggaagctactgcttaaccggtgtcagaaggagttcgagaaagataaagacgacgacgaggtcttcgaaaaaaagcagaaggagatggacgaagcagcaacggctgaagaaaggggtcgactcaaagaggaactcgaggaggcccgtgacatcgcccgtagaaggtcactgggaaacattaagtttattggcgagttgttcaagcttaagatgctgaccgaagccattatgcacgattgcgtggtcaaactgctcaagaaccacgatgaggagtctctggaatgtctgtgtcggctgttgactactattggcaaggatctcgatttcgagaaagctaaaccgcgcatggaccaatactttaaccagatggagaaaatcatcaaagagaagaagacctcaagtagaatacggtttatgctacaggacgtgctcgatctccgcggcagcaattgggttccccgcaggggagatcaagggcccaagactatcgatcagatccacaaggaggccgaaatggaggagcatcgggagcacataaaagtccagcaactaatggctaaaggcagtgacaagcggcggggcggcccccctggtccccccatttcaagagggctccccctggttgatgacggcggatggaacaccgtgccgatatctaaagggtcacgacctatcgatacctcaaggctgacaaaaataaccaagcctggcagtatagactctaataaccaattattcgcgcctgggggtagactgagctgggggaaaggcagcagtggaggtagtggcgcaaagccatcagatgcagcgagtgaggccgcccgccccgccactagtactcttaaccggttttccgcactccagcaggcggtgccaacagaatctaccgataacaggcgggtggtgcagcggtccagcctgtccagggaacggggcgagaaggctggcgatagaggcgacaggctggagcgcagtgaaagagggggcgaccgcggcgaccgcttggatcgcgcgcgcacaccagctacaaaacgtagcttcagcaaggaagtggaagaaaggtccagggagcgacctagtcagcctgagggcctgcgaaaagctgctagcctcactgaggatcgtgacaggggaagagatgcagtgaagcgcgaagctgcattgccgccagtatcccctctgaaagccgcactgagcgaagaagagctggagaagaagtctaaagccatcattgaggagtatttacacctcaatgacatgaaggaagcggtacaatgtgtgcaggaactggcctcaccatcccttctatttatctttgtgcgccatggggtggagtcaaccctggaaaggagtgccattgctcgagagcacatggggcagctgctgcaccagttactatgcgccgggcacctgtctactgcgcaatactatcaaggactgtacgagattctggagttagccgaagacatggagattgatattcctcacgtctggttatatctagcagagttggtcaccccaatcttacaagaaggcggggtgcccatgggtgaactgttccgggaaataacaaagcctctacgacctctcggaaaagcagcatctcttttgctggaaattctggggctgttgtgtaaaagcatgggaccgaaaaaagtggggacactttggcgcgaagccggactgagctggaaggagttcctaccagagggtcaagacatcggtgccttcgtggccgaacaaaaggtcgagtatactctgggtgaggagagtgaggccccaggccagagggcactgccttctgaagagttaaacagacagctcgagaaattgctgaaggagggctcgtccaaccagcgggtatttgactggatcgaagctaacctgtccgaacagcagatcgtgagcaacactcttgttcgcgcccttatgaccgccgtgtgttactctgccatcatcttcgagacaccactaagagtagacgtggctgtcttgaaagcccgggcaaagctgctgcagaaatacctgtgcgatgaacagaaagagctgcaggcgctctatgcactccaggctcttgttgtaaccctcgaacagcctcccaacctgctgcgaatgttctttgatgctctgtatgatgaagatgttgtgaaagaggatgccttctacagttgggagtctagcaaagatccagctgagcagcagggtaagggtgtcgcattgaagtcggtcacagcgtttttcaaatggttgcgagaggccgaggaggagtctgaccacaactag

SEQ ID NO: 24053 - DNA, 492 bp, Artificial Sequence
  Description of Artificial Sequence: Synthetic coding sequence
atgagcggcgcccggaccgccagcacccccacccccccccagaccggaggcggcttggaaccacaggccaatggcgaaactccgcaggtggcggtcattgtccggccggacgatcgctcccagggagccataatcgccgatagacccgggctcccagggcccgagcactccccttcagagagtcaaccgtcctctccatccccaacacctagtcccagtcccgttttggagcctggctctgaacctaacctcgccgtgctctccatcccaggagataccatgaccaccattcaaatgtctgtcgaggaatccacacccatatcacgggagactggggaaccctaccgcctgagcccggagcccacccccctggcggaaccgattctagaggtggaagtaacgctctctaagccggtgccggagtctgagttctcctcatctccactgcaggcaccaaccccactcgcatcccatacagtcgagatacactag

SEQ ID NO: 24054 - DNA, 4542 bp, Artificial Sequence
  Description of Artificial Sequence: Synthetic coding sequence
atgatgatccccagccagatcagctaccccgccagccagggcgcctactacatacccggccaggggaggtccacgtacgtggtcccgactcagcagtaccccgtgcagcccggcgccccaggattttaccctggcgcctcccccaccgagtttggaacgtacgcaggcgcatattatcctgctcagggcgtccagcagttcccaactggcgtggccccaacaccagtgctgatgaaccaaccacctcagattgcccctaaacgcgagcgaaaaactatccgcattcgagatcccaaccaaggcggcaaagatatcactgaggaaatcatgtcgggtgcccgtacggccagcaccccaacaccccctcagaccggaggagggctagaaccccaggccaacggcgaaaccccacaagtggccgtcatcgtgcggccggacgacagaagccagggtgctatcatagccgatcgccctggcctaccagggcctgaacatagtccaagtgagagtcagccaagcagccctagccctacccctagtccctcgcccgtactcgagccagggtccgaacccaacttggctgtgttatctattcccggggacacgatgaccactatccagatgtccgtggaggaatctactcctatctctcgagagacgggcgagccttatcggctgtcgccagaacctactcccctggccgagccaattcttgaggtggaagtcactcttagcaagcccgttccagagagcgaatttagcagttcaccgctgcaggcaccgaccccgctcgcaagccataccgtggaaatccacgagccgaatgggatggtgccgagcgaagatctggaacctgaggttgaatcatctccagagcttgccccccctcctgcttgccccagcgaatcccccgtccccatagcccctaccgcacagcccgaggaactcctgaacggcgctccgtcaccgcccgcggtggacctatcaccagtcagcgaaccagaagaacaggccaaagaggtgacagcatctatggcacctcccactataccctcagctacccccgctactgctccgtccgcaacctctccagcccaggaggaggagatggaagaagaggaagaagaggaagagggcgaggctggggaagctggggaggccgagtcagagaaggggggggaggaactcctcccgccggagtcgacaccaatcccagcaaatttgagtcagaatctggaagccgccgctgccactcaggtcgccgtgagcgtgcccaaacggcgcagaaagatcaaggagttgaacaaaaaagaagctgtaggagaccttctggacgcctttaaagaagcaaatcccgccgtgcccgaagtggagaaccagccacctgcaggctctaaccctgggccagaatctgaaggctccggtgtaccgcctcgacctgaagaggcggatgagacctgggactccaaagaggataagatccacaatgcagagaatatacagccaggagagcagaagtacgaatataagtcagaccagtggaagccgctgaacctagaggaaaaaaaacgatacgatagggaattcctgctgggctttcagttcattttcgctagtatgcaaaaacccgagggcctgccccatatctccgacgtcgtcctggacaaggcaaataagacccctctccgccccctggaccctacacgtttgcaggggattaattgcgggcctgatttcacaccttcattcgccaatctggggcggactaccctctctacccgcggacccccccgcgggggaccaggtggggaattgccccgaggtcctcaggccggcctcggacccagacgatctcagcagggtccgaggaaggaacccagaaaaatcatcgccacggtgctgatgaccgaggatattaagctgaacaaggctgagaaagcctggaagcctagtagtaagcggacagccgccgacaaagataggggcgaggaagatgcagatgggagtaaaactcaggatcttttccggcgggtgcggagcattctgaacaaacttactcctcagatgttccagcagttaatgaagcaagtgacgcagctggccatcgacacagaggaacgtctgaagggagtaatcgatctcattttcgagaaagctataagtgagccgaacttctcagtggcctacgcaaatatgtgtcggtgtctgatggctctcaaggttccaacaacagagaaaccaacagtgaccgtaaacttcagaaaactgctcctcaaccgctgtcaaaaggaattcgagaaggacaaggatgatgacgaggtgtttgaaaagaagcagaaagaaatggacgaggctgccactgctgaagaaagagggcgcctgaaggaggaattagaagaagcccgagacatcgctcgcaggagatcattagggaatataaagtttataggggagcttttcaagttaaaaatgctgacagaagcaatcatgcacgactgtgtagtcaagcttctgaagaatcatgacgaggagagcctggagtgtctgtgtaggttattgaccactatcgggaaggatctggactttgagaaagcaaagcctcgtatggaccagtactttaaccagatggaaaagatcatcaaggagaagaaaacaagctccagaattagattcatgctccaagatgtgctagatctccgggggagcaactgggtacctaggaggggagaccagggccccaagacgattgatcaaatacataaagaagcagagatggaagaacacagagaacacatcaaggttcaacaacttatggctaaaggttctgataagcgacgtggcggccctccaggacccccaatctcaaggggtcttcctctggtggatgacggtggctggaatacagtgccgatctcaaagggctctcgccctatcgacacatctagacttacgaagatcactaagcccggttcaatcgatagcaataaccagttatttgcacccggtgggcgcctcagttgggggaaaggaagttccggcggttccggggcaaagccaagcgacgcggcatctgaggccgccagacccgccacctcaaccctgaatcgattttccgccctccaacaggctgtacctactgagagcaccgataataggcgagtagtgcagaggtcatcactatctagggagaggggcgagaaagcaggcgatcgaggggacaggctggaacgatctgaaaggggaggagaccgcggggatcggctggaccgtgctcgaaccccggccaccaagagatctttctcaaaggaagtggaggaaagatctcgagagcggccttctcagccagaaggcctgcggaaggcggcctctcttactgaggatagagaccgtgggagggacgcggtgaaaagggaagcagccttgccacccgtgagtccattgaaggcagccctgagtgaggaggaactggaaaagaagtccaaggcaattatcgaagagtatcttcatctaaacgacatgaaggaagccgttcaatgcgtgcaggaactggccagtcctagtctgctgtttatcttcgtccggcatggcgtcgaatccacgctggagcggtctgctatagcgcgggaacacatgggccaactgctgcaccagctcttgtgtgcagggcacctttcaaccgcacaatattaccaaggcttatatgaaatccttgagctcgccgaagatatggagattgacattccacatgtttggttatacctggccgagttggtgacacccattctgcaagaaggtggcgtacccatgggcgagcttttccgcgaaatcactaaaccgctgcggcccctgggtaaggctgccagtctgctcttggaaatcctcggtctcctctgcaaaagtatgggccctaagaaggtggggactctgtggagggaggcaggcctaagctggaaggaattccttccagaaggccaggatatcggagcttttgtggcagagcagaaggtagaatacaccctgggggaagagagcgaggcacctggccagagggcgctccctagcgaagagctcaaccgccagttggaaaagctactgaaagaaggcagcagcaaccaaagggtctttgactggatagaagctaatctgagcgagcagcagatcgttagtaatactctagtgagggccctgatgacagccgtctgctactccgcaatcatttttgaaaccccccttagggtggatgtggccgtgctgaaggcccgggccaaactgctgcagaaatacctctgcgacgagcagaaggagctgcaggcgctgtatgccctccaagccctcgtcgtaactctcgaacagcctcctaacttgttaaggatgttcttcgatgctttatatgacgaagacgtcgtaaaggaggacgcgttctactcttgggagagcagcaaggatccagccgagcaacagggaaaaggtgtggctcttaaaagcgtcaccgcttttttcaaatggctcagggaggccgaggaagagagcgatcacaattag

SEQ ID NO: 24055 - DNA, 432 bp, Artificial Sequence
  Description of Artificial Sequence: Synthetic coding sequence
atgagcggcgcccggaccgccagcacccccacccccccccagaccgggggcgggcttgagcctcaggccaacggtgaaactccccaggtggcagttatagtccgcccagacgaccgctcacaaggagctataatcgccgaccgccccggtttgcccggacccgagcactccccaagcgaaagccagccatcctccccttctcccacccccagtcccagccccgtacttgagccaggtagcgagcctaatctggctgttctgagcatcccgggtgacactatgaccacaatccagatgtccgtggaggagtccacgcccataagtcgcgagacaggcgaaccataccggctttcccctgagcctactcccctggccgaacccatcctcgaggtggaggtaacactcagcaagccagtgcccgagtctgagtag

SEQ ID NO: 24056 - DNA, 4215 bp, Artificial Sequence
  Description of Artificial Sequence: Synthetic coding sequence
atgagcggcgcccggaccgccagcacccccacccccccccagaccggcgggggactggaacctcaagccaatggggaaactccccaagtggctgttatagtgaggcccgacgaccgttcccagggcgcaatcatagccgacaggcccggactcccaggccccgaacactctcccagtgagagccagccatcttcccccagccctacgccttccccctctcctgtgctcgagcctgggagtgaaccaaatctcgcagttttgtcaattcctggcgataccatgacaaccatccagatgtctgtcgaagagagcacaccaatctcacgggaaaccggcgaaccctatcgcctttcacccgaacccacaccgctggcggaacccatcctcgaggtggaggtgaccctgtcaaagccagtaccggagagcgaattctctagttcgccactgcaggctcccacccccctggccagccataccgtcgaaattcacgagccaaacggtatggttccctccgaggacttggaaccagaagtagaatcttctcccgagcttgccccccctccggcatgccccagcgaaagccctgtacctatcgcaccaactgcccaacccgaagagttgctcaacggcgcaccatctccacccgcagtagatctctcgcccgtctcagaacccgaagagcaggcaaaggaagtgacagctagtatggcccctcctaccattcctagcgctactcctgcaaccgccccttctgccacttcacctgctcaagaggaggagatggaggaggaagaagaagaagaagagggcgaagccggggaggccggcgaagctgagtctgaaaaaggaggggaagagctgctcccgccagagtccacccccatacctgcgaacctaagccaaaacttagaggctgccgctgcaacacaggtggcagttagtgtccctaagcgacgccgcaagatcaaagaattaaacaagaaggaagccgtgggggatctgctggatgctttcaaggaggccaatccagccgtgccagaggttgagaatcaaccaccagcagggagtaatcccggtcccgaatctgaaggcagtggggttccaccacgccccgaggaggctgatgaaacatgggacagcaaggaagataaaattcacaacgccgaaaacattcaacccggtgagcagaagtacgaatataaaagcgaccaatggaagcctctgaatctggaggaaaagaaacgctacgatagagagtttcttctgggatttcagttcatctttgcctcaatgcaaaagccagaaggcctgcctcacatctccgacgtcgttttagacaaagccaacaagacgccccttagacccctggatcctactcgccttcaagggatcaattgcggccctgacttcactccatccttcgccaacctgggcaggacaacactttctacccgcggccctcccagagggggtcccggtggtgagctgccacgcggaccacaagcgggccttggacccagacgaagccaacaaggtcctagaaaagagccgaggaaaattatcgccaccgtgttgatgactgaggacattaagctgaataaggccgaaaaagcctggaaacctagttcgaaacgcacggcagctgataaagatcgcggagaagaggatgccgacggcagcaagacccaggacctttttagaagggtacggtcaatcctgaataagctaaccccacagatgttccagcagctcatgaagcaggtcacccagttagcaatcgatacagaggagcggctcaaaggggtaatcgacctgatcttcgaaaaagcgatctctgagccgaacttttctgtggcctacgcaaacatgtgtcgctgtctaatggccctgaaagttcctaccactgaaaagcccacagtgacagttaacttcagaaagctgttactaaatcgttgtcagaaggagttcgagaaagataaagatgacgatgaggtttttgaaaaaaaacaaaaggagatggatgaggcagctacagcggaggaaagggggaggctcaaagaggagctggaggaggcacgggacattgctcgaagacgctccctcggcaatataaagtttattggcgagctgtttaaactcaaaatgttgacagaggccatcatgcacgactgcgtggtaaagctgctgaagaaccatgatgaagaatctctggaatgtttgtgtaggctgttaacaacgattggcaaagatttagacttcgagaaggcaaaacctcggatggatcagtactttaatcaaatggaaaaaattattaaggagaagaagacatccagcagaatcagatttatgctccaggatgttctggacctgcgggggagcaactgggtgccccgaaggggcgaccagggcccaaagacaattgatcagatccataaagaagccgaaatggaggaacatcgcgagcacatcaaagtgcagcagctgatggcgaagggcagtgataagaggagaggcgggccacccggacctcccatttcaaggggacttcccttggtcgatgacggcggctggaacacggttccgatcagcaaggggtcacgacccatcgacactagccggttgactaagatcacaaagcctgggagcattgatagtaacaaccaactgttcgcccccggcgggaggttaagctgggggaaaggctctagtggtgggtccggtgcgaagccctctgatgccgcttcggaggccgccaggcccgccacatccacactaaatcggtttagcgcactacaacaggccgtccctacggagtccaccgacaaccgtcgcgtggtgcagcgtagctccttatctagagagcgcggtgagaaagccggggacaggggtgaccggcttgagcggtctgaaagagggggagacagaggcgacagactggatagagctaggacacctgccacaaaaaggagcttttccaaggaggtggaagagagatctcgcgagaggcccagccagcccgagggcttgcgaaaggcggcttccctcaccgaggaccgtgaccgcggcagagacgcggtaaagagagaagctgcactcccacccgtgtcgccactgaaggcggctttgtctgaggaagagcttgaaaagaaatcaaaggccatcatcgaagaatacctgcatctgaatgatatgaaagaggctgttcaatgtgttcaggagctggcttcgccgagcctactttttatcttcgtgcgtcatggagtcgaatccaccctggaacgcagcgccattgctagggagcacatggggcagctactgcatcaactcctgtgcgcgggtcacctgtcaaccgcccaatattatcagggcttatacgagattttggaacttgccgaagatatggaaatagacatacctcatgtgtggctttacttggctgagctggttacgcctattctccaagaaggcggtgtgcctatgggtgagctgttcagggagatcacaaaacccctgagacccctgggaaaagcagcctccctactgcttgagatattggggttgctgtgcaaatcaatgggcccaaaaaaggtcggtaccctctggcgcgaggccggcctgtcctggaaggaatttctgccagagggccaggacatcggcgcattcgtggctgagcagaaggtggaatacacgcttggggaagagagcgaggctcctggccagcgggcgctcccgagtgaagaactgaatcgtcaactggagaagctattgaaagaaggctcttctaatcagcgcgttttcgattggatcgaagcaaatctctccgagcagcagattgtcagtaacacactcgtccgagccttaatgacagcagtttgttacagcgccataattttcgagacccccctgcgcgtggatgtcgccgtcctcaaggcaagagctaagctgcttcaaaagtatctgtgtgacgagcagaaggagcttcaggcgctctatgccctgcaggcactggtcgtgactttagagcagcctcccaacttgctcagaatgttctttgacgcactgtacgatgaggacgtggtgaaagaagatgccttttactcctgggagtctagtaaagacccagcggaacaacagggcaagggggtggcactgaagtctgtgacagcgttttttaagtggttgcgggaagcggaagaggagagtgaccacaactag

SEQ ID NO: 24057 - DNA, 4212 bp, Artificial Sequence
  Description of Artificial Sequence: Synthetic coding sequence
atgagcggcgcccggaccgccagcacccccacccccccccagaccggaggtggactcgagcctcaggcaaacggcgaaacaccacaagtggcggtcattgtgcggcccgacgacagatcccagggtgctatcatagcggacaggcccgggcttccgggacccgaacattccccatccgagtctcagccatcatccccctctcccacgccaagtccgtctcccgtacttgaaccgggcagtgagcccaacctggccgtcctttccattcccggcgataccatgacaacaattcagatgtccgtggaagaatcaaccccaatttcacgagaaaccggcgaaccatatcgactgtctccggagcccactcctctggctgagcctatactcgaggtggaggtaacgttgtccaagcctgtgccagagagtgaattctcaagctctccactgcaggcaccaacacccctcgctagccatactgttgagatccacgaaccaaatggaatggtgcccagtgaagaccttgaacctgaagtggaaagtagccctgagctggcaccgccacctgcgtgcccttctgagtcccctgtaccaatcgcccctactgctcagccagaagaacttttgaatggtgcgccctcacctccggcggtcgacctgagtccagtgagtgagccagaggaacaggctaaagaagttactgctagcatggctccccctacaattccgtccgccacccctgcaaccgcgccctccgctacgtctcctgcccaggaagaggagatggaggaggaagaagaggaagaagagggtgaggccggagaggccggtgaggctgagtcagagaagggcggcgaggagttactacctcccgagtccacccctatcccggccaacttgagccagaacctcgaagcagctgccgctactcaggtggctgtgagcgtccccaagcgtcggagaaagattaaggaactgaacaaaaaggaagccgtgggtgacctcctggacgcattcaaggaggccaatcccgcagtcccagaagttgagaaccagcctccggctgggtccaatcccggcccggaaagtgaaggttccggggtccccccccgccccgaagaggctgatgagacatgggattccaaggaggacaagatccacaacgccgagaacattcagccgggggaacaaaagtacgaatacaagagtgaccaatggaagcctctcaaccttgaagaaaagaagcgctacgaccgtgaattcttattgggcttccagtttatcttcgcttccatgcagaagccggaggggctgccgcacatcagcgatgtggtcctggacaaagcgaacaagacccccctgcgacctctcgacccaacccgactgcagggtataaactgcggtcctgacttcacgccctcgtttgctaatctgggaagaaccactctgagtactcggggtcctccgagggggggacctggcggagaactgcctagaggacccgccggcctggggcctagaaggagtcagcagggacccaggaaagagccccgaaagatcattgccaccgtcctcatgacagaagatatcaaacttaataaagctgagaaggcctggaaaccttcctctaaaaggaccgccgctgataaagaccggggggaggaggacgcggacggtagtaaaactcaggacctgtttcgccgtgtgagaagtatattgaataaactgaccccccagatgtttcaacagttaatgaagcaagtaacccaactcgccatcgacaccgaagagcggctgaagggcgtcattgatttgatcttcgaaaaggcaatttcagagcccaattttagcgtggcatacgccaacatgtgtcgttgccttatggctctaaaggtgcccaccacggaaaaaccaacggtcaccgtgaatttcaggaaactgcttcttaatagatgtcagaaagaattcgagaaggacaaagacgacgacgaagtttttgaaaaaaaacagaaggagatggacgaggctgcgaccgctgaagagcgtgggaggcttaaagaagaattggaggaggctagggacatcgcaaggagacggtcgcttggtaatataaaatttattggagagctgtttaaactaaagatgttaactgaagcaattatgcatgactgtgtggtaaagctccttaaaaaccacgatgaagagtcccttgagtgtttatgccgcctcttgactaccattgggaaagatcttgattttgaaaaagccaagccccgtatggatcagtatttcaatcagatggagaagattattaaggaaaaaaaaacatcgagccggatccgctttatgctgcaggacgtgctggatctgcgggggagtaattgggtgcccagacggggggaccagggacccaagaccatagatcagattcacaaggaggccgaaatggaggagcacagagagcacatcaaggtgcaacaactcatggcaaaagggtccgacaagaggcgcggaggcccgcctggcccccctatttcgcgcggcctgcccctcgtggatgacggcggctggaacactgtccccatctcaaagggctcacgtcccatcgacacttctaggctgacgaagattaccaagccaggaagcattgacagcaacaaccagctctttgcgcctggaggacggctctcctgggggaaaggtagcagcggtggatccggagccaaaccatcagacgccgcctctgaagccgcaagaccagccaccagcaccctgaataggttctccgccttgcagcaggccgtgcccaccgagtcgacagacaatcggcgagtggtgcaaaggtcaagtctgagtagggaacgtggtgagaaagctggggatcggggcgaccgattagagagaagcgagaggggaggcgaccgtggtgaccgcctggacagagcacggactcctgcaaccaagcgctcatttagcaaggaggtggaagagcgaagcagagagagacccagccagccggaaggtctgcggaaggcagcttccctgactgaggatcgcgataggggacgcgatgccgttaagcgcgaggcggcacttccaccagtaagccctcttaaggcagcactgagcgaagaggaacttgagaaaaaatctaaggctattatcgaggagtatcttcatctcaacgatatgaaagaggcagtgcagtgcgtccaggagttagcttctccctctctgctctttatcttcgttagacatggagtggagagcacactggaacgctccgctatcgcacgggaacacatgggtcagctcctgcaccagctcctgtgtgcaggccacctgtccacagcccagtactaccaggggctttacgagatcctcgagcttgccgaggacatggaaatagatataccccatgtgtggctgtatctggctgagctcgtgaccccaattctgcaggagggtggcgttccgatgggggaactgttccgggagatcaccaagcccctccgccccctgggaaaggccgcttcattgctgctcgaaatattggggttattgtgcaagagtatggggccaaaaaaggtcggaacactatggagagaggccggcttgtcttggaaggagttcctcccagagggtcaggacataggcgcattcgtggccgagcaaaaggtcgagtacaccctcggggaagagtcggaagctcccggtcagagggcgctgcccagcgaagagctcaacagacaactggagaagttactgaaagagggttcgagcaaccagcgcgtcttcgattggattgaagctaatctgagcgagcagcagatcgtgagcaataccttagtacgggccctcatgactgctgtgtgctactcggccatcattttcgaaacaccattgcgcgtcgacgtggccgttctgaaagcacgcgccaagcttctccagaaatatctgtgtgacgaacagaaggagctgcaagccctgtatgcccttcaagccttagtagtcacacttgagcagcccccaaacctgctgcggatgtttttcgatgctctgtacgacgaagacgtcgtcaaggaagacgccttttactcctgggaatctagcaaagaccccgcggagcaacagggaaaaggcgtggctctgaaaagtgtgactgccttctttaagtggcttcgtgaagcagaggaagagtctgaccacaactag

SEQ ID NO: 24058 - DNA, 4311 bp, Artificial Sequence
  Description of Artificial Sequence: Synthetic coding sequence
atgaaccagcccccccagatcgcccccaagcgggagcggaagaccattaggattcgcgaccctaaccagggggggaaagatataaccgaggaaattatgtccggtgccaggacggcgtccacaccaacaccccctcagacggggggaggactggagccccaggcaaacggggagacccctcaggtggctgtgatcgtaagacctgacgaccgttctcagggtgcaattattgccgatcggccggggctgcctggaccggaacattccccttctgagagccagcctagctccccatcaccgactccaagcccatcccccgttctggagcccggatcagaacccaatctggcggtgctgtccatcccgggagataccatgaccacaatccagatgtccgtggaggaatccaccccgattagtcgcgaaaccggcgagccttataggcttagtccagagccgacaccccttgccgagcccatactggaagtagaggtcactctttcaaaaccagtgcccgagtccgagttcagttccagccccctacaggcacctactccgcttgcgtcccatactgtggaaattcatgagccgaacggaatggtacctagcgaggacctggagccagaggtggagagttcccctgaactggcccccccaccggcatgcccgagtgaatcacctgttcctatcgctcccactgcccaacccgaggagctgttgaatggggccccgtcacctccagctgtcgacctgagtcctgtctcggagcctgaagagcaggctaaggaagtcacagcctctatggcgccgcctactattccaagtgccactcccgccactgctccaagcgcaaccagcccagcccaagaagaggagatggaagaggaggaagaagaggaggaaggggaggccggggaggctggcgaagcagagagcgaaaaagggggcgaggagttgctcccacccgaatctacacccatccccgccaatcttagccagaacctcgaggccgctgcggcgacccaggtggccgtgagcgtgcctaaacggaggcggaagataaaggagttgaataaaaaggaggccgtgggggatctcttggatgccttcaaggaggcaaatccagccgttccagaagtcgagaatcagccccctgctggttcgaaccccggacccgagtcggaaggatccggggtcccgccgaggcctgaggaggctgacgagacatgggacagtaaagaagataagatccacaacgcagagaatatccaaccaggagaacagaaatatgagtataaaagcgaccagtggaaacctctgaaccttgaagaaaaaaagcgctatgatagagaattcttacttggttttcaattcatctttgcatcaatgcagaaacctgagggtctgcctcatatctcagatgtcgtgttggacaaagcgaataagactcctctgcggccactcgacccgacccggcttcaggggattaattgtggtcctgacttcaccccatccttcgcaaacctggggagaaccacactttcaacgcgcggtccaccaagaggcggtccgggaggcgagctgccccgggggccacaggctggcctaggaccacgccgatctcagcagggccctagaaaagagccgagaaagatcatcgcgacggtcctgatgacggaagacatcaaacttaataaggctgagaaagcctggaagccttcttccaagcgaacagcggcggacaaggacagaggggaggaggatgcagacggctctaaaacacaggatctgtttagaagagtgagaagcatactgaacaaactgacacctcagatgttccagcagctcatgaaacaagtgactcagctggctatcgataccgaagaacgtctgaagggagtgatcgacctgatcttcgagaaggccatcagtgagcctaacttctctgtggcatatgctaatatgtgtaggtgtctcatggccctgaaggtcccaacaaccgagaaacctacagtaaccgtaaactttagaaaactcttattgaacagatgtcaaaaagagtttgaaaaagataaggatgatgatgaagtcttcgagaagaagcaaaaagaaatggatgaagctgcgactgctgaagaaaggggccgcttaaaggaggaactggaggaggcacgtgacatagcaaggcgtcgcagcctgggcaatattaaattcataggagaattattcaagctgaaaatgctaactgaggcgataatgcacgattgcgtcgtgaaactcctaaagaatcatgatgaagaatccttggagtgcctgtgccgcctcctgacgactattggcaaagatcttgactttgagaaggctaaacctagaatggaccagtacttcaaccagatggaaaagataatcaaagaaaagaaaaccagctcgcgaattcggttcatgcttcaggacgttctagacctgcgaggtagcaactgggtgccccgtcggggagatcaaggaccaaagacaatcgatcagattcacaaagaagccgagatggaagaacacagagaacatatcaaggtccagcagctaatggccaaagggtctgacaaaagacggggcgggcctccgggaccccctatatcgcggggcctgcctctcgtcgacgacggtggatggaataccgttccaatctctaagggctcaaggcccatcgataccagtagactgacaaagatcacaaagcctggcagcattgacagtaataatcagctgttcgcccccgggggacggctcagttggggtaaaggctcctctgggggctccggggccaaaccttccgacgcagcaagcgaggcagcccggcccgccacctccactctgaaccggtttagtgcactgcaacaggcagtgcctacggaatccacagataaccggcgtgtggtgcaacgtagcagcctgagtagggagcgaggtgagaaagctggcgaccgtggagatagacttgaacgcagtgaaagaggaggagatcgcggcgataggctcgatcgcgctcgtactcccgctactaagagatctttcagcaaggaggtggaggagcgaagtagagagcgacctagtcagcctgagggcctgagaaaagctgcgagtctgactgaagaccgcgacaggggccgtgatgcggtgaaacgtgaggcagcattgccgccagtttcaccactcaaggccgccctctcagaagaggaactggaaaaaaaatccaaagcaatcatcgaggaatatctgcacctgaatgacatgaaggaagccgttcaatgtgtacaggaactggcctcacccagtctgttgttcatatttgtgcgacatggagtggagagtaccctagaacgatctgccattgctcgggaacatatgggccagctcctacatcagctgttgtgtgccggccacctgtctacagcacagtattaccaggggctttacgagatcttggagctggctgaggacatggaaatcgacatcccacatgtctggctctatttggccgaattggttacacccatcctccaagagggcggcgtgccgatgggggaactctttcgtgagatcacgaagcccttaaggccattgggaaaggccgcctctcttctgctggaaattctgggcctactttgtaagtctatgggaccaaaaaaggtggggacgctctggcgggaggccggtttgtcatggaaggagttcctgccggaaggccaggatataggagcattcgtggctgaacagaaggtcgaatatacactcggggaggaaagtgaagctccagggcagcgggccctccccagcgaggagctcaataggcagctggagaagctgctgaaagagggctcttctaatcagcgagtcttcgattggatcgaagctaacctgtccgaacagcagatcgtgtctaacactttagtaagggctttgatgaccgctgtgtgttatagcgccataatcttcgagacacccttacgggtcgatgtcgccgtgctgaaggcaagggcaaaactgctccagaaatacctgtgtgacgagcagaaggagctccaggccctgtatgcattgcaggctctggtggtgactctcgagcagccccctaatttgctccgaatgttcttcgatgctctgtacgacgaggacgtcgttaaggaggacgccttttactcctgggagtcctccaaggatccggccgagcagcaaggcaagggggtggctctcaagtcagtgaccgcatttttcaaatggcttcgcgaggctgaggaagagtcagaccataactag

SEQ ID NO: 24059 - DNA, 384 bp, Artificial Sequence
  Description of Artificial Sequence: Synthetic coding sequence
atgagcggcgcccggaccgccagcacccccacccccccccagaccggcggagggctcgagccacaggcaaacggggagactccccaggtggccgtgattgtgagacccgacgaccgcagccagggggctataattgccgataggccaggtctcccagggcccgaacacagtccctccgagtcccagccctctagccctagccccaccccctcaccctcgcctgtcttggagcctggtagcgaacccaatttggctgtgctgtcgatccctggggacaccatgacgacaatccaaatgtcagtggaggagagcaccccgatttctcgggagaccggcgagccataccgcctgagtccagagcctactccacttgccgagccttag

SEQ ID NO: 24060 - DNA, 264 bp, Artificial Sequence
  Description of Artificial Sequence: Synthetic coding sequence
atgaacacccccagccagccccggcagcacttctaccccagccgggcacaaccacccagtagtgcagcctctcgcgtgcagagcgcggcacccgctcgcccagggccagctgcccacgtttatcctgctggtagtcaagtgatgatgatcccgagtcagatctcatatccagcttcccagggggcttactatattccggggcaaggccgatctacctacgttgtcccaacccaacagtacccagtgcaacccggcgccccttag

SEQ ID NO: 24061 - DNA, 858 bp, Artificial Sequence
  Description of Artificial Sequence: Synthetic coding sequence
atgagcggcgcccggaccgccagcacccccacccccccccagaccgggggcggcttggaaccacaggctaacggtgagactccccaggtggctgtcatcgttcgccccgatgacagatcccaaggcgccatcattgcagacagacccggactgccgggccccgagcacagtcctagcgagtcccagccatcttctccgagccccacccccagtccttcacccgtacttgaaccagggtccgaaccaaacctagctgtcctttccatccccggggatacgatgacaactatacagatgagcgtagaggagagcacacccatcagtagggaaacaggagaaccttatcgtctgagccccgagccgacccccctggccgaaccgatcttagaagttgaggtcactctgtccaagccagttcccgaatccgaattcagctcctcacccttgcaggccccaacacctctggcatctcatactgtggaaatccacgagccaaacggcatggtgccaagtgaggacctcgagcctgaagtggaaagcagtcccgaattggcacccccccccgcttgtccaagtgagtctcctgttccaattgcaccaaccgcccagcccgaggagctcctgaacggcgctccaagtccgccggctgtcgatctttcacccgtaagcgagccggaggaacaggctaaggaggtgacagcctctatggcgcctccaacaatcccttctgccacgccggctaccgccccaagtgcgaccagcccggcacaggaagaggaaatggaagaggaagaagaggaagaggaaggcgaagcgggcgaagcgggcgaggctgaatctgaaaaaggcggcgaatag

SEQ ID NO: 24062 - DNA, 1836 bp, Artificial Sequence
  Description of Artificial Sequence: Synthetic coding sequence
atggccgccagcgccaagaagaagaacaagaagggcaagaccatctccctcacagactttttagcagaagatggcggcactggcggcgggagcacttatgtgtctaaacctgtatcttgggccgatgaaactgacgatctggaaggagatgtctctacaacttggcacagtaacgatgatgatgtatatcgggcgcctccaattgaccgcagcatactccccacagccccccgtgctgccagagaacctaatattgaccgcagtaggttaccaaagtcccctccatatactgcttttttagggaatttgccttacgatgtgaccgaggagagcatcaaagagtttttcagagggttgaacatctctgccgtgaggctcccccgggaaccatctaaccctgaacgactgaagggcttcggatatgctgagttcgaggatctcgatagtctgctttccgctctttctctcaacgaagaatctcttggcaacaggagaatccgcgttgacgtggccgatcaggcacaagataaagaccgcgacgaccggtcctttggcagggacaggaatcgggactcagataagaccgatactgactggagagcacgtcccgcaactgattcattcgatgattacccccctaggcgtggggacgatagtttcggggataaatatcgggatcgctacgactcagacagataccgcgatggctatcgtgatggctatcgagatgggcctcgccgggatatggacaggtacggtggcagggacaggtacgatgacagaggttcccgggattacgatagagggtacgactcaagaattggttctggcaggagggcttttggcagtggttacaggagggatgatgattataggggcggcggggatcgctacgaagataggtatgaccggagggatgatcggagctggtcttctcgggacgattattcgagggatgattatcgaagagatgacagggggcccccacagcgacccaaattgaatctgaaacctagatcaacacctaaggaggacgacagctcagcctccactagccagtctacccgtgcagctagcatttttggaggcgccaagcccgtcgatactgccgcacgcgagcgcgaagtggaggaacgattgcagaaagagcaggagaagctccaaaggcagcttgatgagcccaagctggaaagacgacccagggagcggcatccgtcttggcggtccgaggaaacacaggaaagagagcggagtagaactgggagcgagtcctcccagacaggcacgagtactacctccagccgaaatgccaggaggagggagtctgagaagagtttagagaatgagaccctgaataaggaggaggactgtcatagtcctacgtccaagcccccgaagcctgatcaacctttaaaggtgatgcctgcccccccccccaaagaaaacgcctgggttaagcggtcctccaatccccccgctcgaagccagagctctgatacagagcagcagtcccctacctctgggggaggaaaggtcgctcccgcacaaccctccgaagagggccctggaaggaaggatgagaacaaggtggacggtatgaacgcacccaagggacaaacagggaactcgtctcgcggaccgggtgacgggggtaatagggatcattggaaagaatcagatagaaaggacgggaaaaaagatcaggacagcagatccgcccccgaacccaaaaaaccagaagaaaatcccgcttctaaattctctagtgcctctaagtatgctgccctgtccgtcgacggggaagacgaaaacgaaggagaagactatgctgaatag

SEQ ID NO: 24063 - DNA, 1764 bp, Artificial Sequence
  Description of Artificial Sequence: Synthetic coding sequence
atggccgccagcgccaagaagaagaacaagaagggcaagaccatctctctgaccgacttcctcgccgaagatggtggcaccggtggcgggagcacttacgtgagtaaaccagtctcttgggcagacgaaaccgacgatctggagggggacgtgtccaccacttggcattctaacgatgacgatgtataccgggccccaccgattgacagatcaatcctcccgaccgcgccaagggcagcaagagaaccaaatatagacaggtcaaggctgcccaagtctccaccatacacggcatttctggggaatttaccctatgacgtcacagaggagtccatcaaggagtttttccgcggcctaaatattagcgccgtgcgtcttccaagagaaccttccaatcccgaaagacttaagggatttgggtatgccgagttcgaagacctagatagcctcctgtccgctctctccctcaatgaggagagtctgggaaataggcggatcagggtggatgtggctgatcaggctcaggacaaggatcgcgacgacagatcattcgggcgcgaccggaaccgagattctgacaaaacggacactgactggcgcgcccggcctgcaaccgattcttttgacgattatcctcctaggcgaggcgatgactccttcggcgacaagtatcgggaccgctacggcgggcgcgacagatatgatgatagagggtccagggattatgacaggggatatgactcccgaattggcagtggccgtagggccttcggatcgggataccgtcgcgatgacgattatcgaggaggcggagatcggtacgaagatagatacgatagacgggatgaccgaagctggagctccagggacgactactctcgcgacgattaccggcgcgatgatcgaggacctcctcagcgtcctaagctgaaccttaagcctagatcaaccccgaaggaggatgattcttctgctagtacttcacaaagcacacgcgcagcatccatattcggcggagctaaacccgtggacacagctgccagagaaagagaagttgaagaaagattgcaaaaggagcaggagaagcttcagcgccaactggacgagccaaagcttgagaggagacccagggaacggcatccatcctggcgaagtgaagaaacccaggaacgagaaagatccaggaccggaagcgaaagctcacagacaggtacaagcacgacctcatcacggaacgctagacgccgggaatccgagaagtctctggagaacgagactcttaataaggaggaagactgtcacagtccgacctcaaagcctccaaagcctgaccagcccctgaaagtgatgccagctccaccacctaaggaaaatgcatgggtcaagcggtcatccaaccctcccgcccggagccagtctagcgatacagaacagcagtctcctaccagtggtggtggaaaggtggctcccgcccaaccttctgaggagggccccggcaggaaggacgaaaacaaggttgatggaatgaatgccccgaaaggacagacaggtaattcaagccggggacccggggatggcggaaacagggaccactggaaggaaagcgatcgcaaggatggcaagaaagaccaggattcccggagcgcgcccgagcctaagaaacctgaagaaaatccagcctctaaattttccagtgccagtaagtacgccgctctatcagtcgacggggaagatgagaatgagggtgaggactatgcagaatag

SEQ ID NO: 24064 - DNA, 714 bp, Artificial Sequence
  Description of Artificial Sequence: Synthetic coding sequence
atgctggacctgaccagccggggccaggtgggcaccagccggcggatggctgaagctgcatgttctgcccattttcttgagacaactccaacaccaaacccccctactaccgaagaggagaaaaccgaatctaaccaagaggtcgccaaccccgaacattatattaagcatccccttcagaaccgatgggcactgtggttttttaaaaacgacaaatctaagacttggcaggcaaatctgcgcttgatctcgaaattcgatacagtggaagacttctgggcactgtataatcatattcagttaagtagtaatctaatgccaggctgtgactatagcctgttcaaagatggcattgaacctatgtgggaagatgagaagaataaaagaggaggacgctggctgattactctgaacaaacaacaacgccggtctgatctcgacaggttctggctcgaaaccctgttgtgcctgattggtgaaagcttcgatgactacagcgacgacgtatgcggggcagtggtaaatgtgagggcaaagggcgacaagatagctatctggacgacggagtgtgagaatcgggaggccgtgacccacatcgggcgcgtatataaggagaggctcggtctgccacccaaaattgtcataggctaccagtctcacgctgacactgcgaccaaaagcggatctacaaccaagaatagatttgtagtttag

SEQ ID NO: 24065 - DNA, 654 bp, Artificial Sequence
  Description of Artificial Sequence: Synthetic coding sequence
atggccaccgtggagcccgagaccacccccacccccaacccccccacaaccgaagaggaaaagacggaaagtaatcaggaagtagctaacccggaacactatataaaacacccactgcagaacagatgggccctgtggttctttaaaaatgataagtccaaaacttggcaggccaacctgcggttgatctccaaattcgacaccgtggaggatttctgggcactatataatcacatccaactgtcttcgaacctgatgcctgggtgcgactactcactgtttaaagacggtattgagccaatgtgggaagatgagaaaaataagcggggtgggagatggttgattaccctcaacaaacagcagcggaggtcagacctggaccgcttttggctagagacattgctctgcttaatcggtgagagctttgatgactattctgatgatgtctgcggcgctgtggtgaatgtgcgcgcaaaaggagacaagatcgcaatttggactaccgagtgtgaaaatcgcgaagccgtcacgcacattgggcgtgtgtacaaggagaggcttggcttgcctcctaagatcgtgatcggctatcagagccacgccgataccgccacaaaatcggggtcaacaactaaaaacaggttcgtggtgtag

SEQ ID NO: 24066 - DNA, 747 bp, Artificial Sequence
  Description of Artificial Sequence: Synthetic coding sequence
atggccaccgtggagcccgagaccacccccacccccaacccccccaccaccgaggaggagaaaaccgagtcgaaccaggaggtggcaaatccggagcattacataaagcatcccttacaaaacagatgggcactgtggttctttaagaatgataagagcaagacctggcaagctaacctgcggctcatctccaaatttgatactgtcgaagacttttgggcactgtacaatcatattcagctctcctcaaacttaatgcccgggtgtgactattccctgttcaaagacggcattgagccgatgtgggaagatgagaaaaataaacgtggcgggcggtggttgataacgctaaacaaacagcagcgaaggtctgacttggatcggttctggcttgaaacccggtgggatctcgccatgctgcctcgattagtgtctaacttttggccccaagtgattctaccattgcagcccccaaaggtgctggaattgcaattgctttgcctgatcggagaatcttttgacgactacagtgacgatgtgtgtggcgccgtcgtgaacgtacgggccaagggagacaagatagccatatggacgacagaatgtgaaaaccgggaggcagtgacccacatcgggcgcgtttacaaggaacggctgggccttcccccaaagatcgtgataggctaccagtcacacgccgatacagccacaaaaagtggttctactactaagaatcggttcgttgtctag

SEQ ID NO: 24067 - DNA, 357 bp, Artificial Sequence
  Description of Artificial Sequence: Synthetic coding sequence
atgagcggcggcagcagctgcagccagacccccagccgggccatccctgccactcgtagagtggttctcggggatggcgtgcaacttcctccaggcgattattctactacgccaggcggaacattgttctccaccacaccgggtggcacaaggatcatctacgacaggaaatttctgatggaatgcagaaactcacctgttaccaaaacccccccgcgcgacctaccaactatccccggcgttacctcaccatcatccgacgagcctcctatggaggctagccagagtcatctacgcaacagccctgaagataagagagccggcggtgaggaatcccagtttgagatggatatttag

SEQ ID NO: 24068 - DNA, 1857 bp, Artificial Sequence
  Description of Artificial Sequence: Synthetic coding sequence
atggccagcaccgactacagcacctacagccaggccgccgcccagcaaggatacagtgcttacaccgcccaaccgactcaaggctacgcccaaaccacccaagcttacgggcagcagagctacggcacctatggccagcctacagacgtgagctatacccaagcgcagactacggcaacctatggccaaacggcatacgcaacatcctatggccagccccccacaggctatactacccctacagcacctcaagcttatagtcagcccgtgcaaggatatggcacaggggcatatgacaccaccacagcgactgtgaccacaacgcaggcctcttatgccgcccagtctgcctatgggacccagcctgcctaccctgcctacggccaacaacctgcagccacagctcctactcgaccccaagatgggaataagccgacagaaacctcccagccacagagtagtacagggggttataatcaaccaagcttaggctatggtcagagcaactatagttacccacaggtccctggttcttaccctatgcagccagtgactgcgcccccatcctacccgcctacttcctatagcagcacccaacccacttcctacgaccagagttcttattctcaacagaacacctatggccagcccagctcctacggacagcaatcatcctatggccagcagtcatcgtacggacagcagcctccaacgagttatccgccccagaccgggagctactcccaggcgccctctcagtattcacagcagagttcctcctacggtcagcagtcctccttccgccaagatcatcctagtagcatgggcgtttacggccaggagtctggggggttttccgggcctggagagaataggagtatgagcggacccgataatagaggacgcgggcgcggaggatttgatcgcggcggaatgtccagggaccccgatgaagatagcgacaatagcgccatctacgtccaaggccttaatgatagcgtgacgctcgatgacctcgcggattttttcaaacagtgtggcgtggtcaaaatgaataagagaactggtcaacctatgatccacatctatcttgataaggagaccggaaaaccaaaaggcgacgccactgtgtcatacgaagacccaccaaccgctaaggcagcagtcgagtggttcgacggcaaggacttccagggcagcaagctaaaagtatccctcgcaagaaagaagcctcccatgaattctatgcgcggggggctgcctcctagagaggggagagggatgcccccacccctgcggggggggcccggcgggcccggaggccccggaggacctatggggcgcatggggggacggggcggcgataggggagggttccccccgagaggccctcgggggtcccgcgggaatccctctgggggaggaaacgtgcaacaccgcgcaggagactggcagtgccccaaccccgggtgtgggaaccagaatttcgcatggcgtaccgagtgtaaccagtgcaaagccccaaaacctgaaggcttcttaccgccacccttcccccccccaggcggtgaccggggacgcgggggtcccggagggatgagaggtggccgaggaggactgatggaccgtggcggcccgggggggatgtttagaggcggtcgtggaggagacagagggggtttcagaggtggccggggaatggacagaggagggtttggaggcgggagacggggaggccctggaggaccccccggccctctgatggagcagatgggagggcggcggggtgggcgcggaggacccggaaagatggacaaaggggagcatcgacaggagaggcgggaccgcccatactag

SEQ ID NO: 24069 - DNA, 1803 bp, Artificial Sequence
  Description of Artificial Sequence: Synthetic coding sequence
atggccagcaccgactacagcacctacagccaggccgccgcccagcagggatacagcgcctacacggcccagcccacccaggggtatgctcagactacccaggcatatggccagcagtcctacggtacttacggccagccaaccgacgtgagttacacccaggcacagaccaccgctacctacggccaaactgcgtatgcgaccagttacgggcagcccccgactggatataccacacctacagccccacaagcatactcgcaaccagtccagggctatggaaccggtgcttacgatactaccaccgccactgtgacaaccacccaggcatcctacgccgcacaaagcgcatacgggacccagccggcctaccccgcttatggtcagcaacccgctgctactgcccccacttcgtactcctcaacacagccaacctcttacgaccagtcatcttactctcagcagaatacctatggccagccgtcaagctacggtcagcagtcctcgtacggtcaacagtcctcctacgggcagcaaccacccaccagctacccgccacaaacaggcagttactctcaggccccctcccagtactcccagcagagcagcagctatggccagcagtccagctttagacaggaccacccaagctctatgggcgtttatgggcaggagagtggaggcttttccggtcctggcgaaaatagaagtatgtcagggcctgataatcggggcaggggacgcgggggtttcgaccggggaggtatgagccgcggcggccgtggagggggccgtgggggtatggggagcgcgggtgaaagaggaggatttaataaaccaggtgggcccatggatgaagggcccgacttggacctggggcctcccgttgaccccgatgaagactcagacaattctgctatttatgtccagggactgaacgactcagttactctcgatgacctggccgattttttcaaacagtgtggcgttgtgaagatgaacaagcggacggggcaaccgatgattcatatctacctcgataaggaaaccggcaaaccgaagggtgacgctacagtgtcctacgaggatccaccgactgccaaggccgcagttgagtggttcgacgggaaggattttcagggcagtaagctgaaggtgtccctcgcccgcaagaagcctcctatgaatagcatgcgcggtggccttcccccaagagaaggaaggggaatgcctccaccgctgaggggaggccctggtggcccaggtgggcccggcggtcccatgggccggatgggcggccgcgggggtgatcggggtggattcccccccagaggtcccaggggatcgaggggaaacccttctggcggcggaaatgtccagcatcgagccggcgattggcagtgccctaaccccggttgcggaaatcaaaactttgcatggcgcaccgaatgtaatcagtgcaaggcaccaaagccagaagggttccttccaccaccctttcccccacccggcggcgatcgcggcagaggagggcctggcggaatgcggggtggcagaggcgggctgatggacaggggagggcccggcggaatgttccggggtgggcgaggcggcgatcgcggagggtttagaggaggccgtggcatggaccggggtggatttggcggcgggcgcagaggggggcctgggggacctccagggccgctcatggagcaaatgggtggtcgcagaggaggcaggggcggcccgggcaagatggataaaggggagcaccggcaggaaaggagagacaggccctactag

SEQ ID NO: 24070 - DNA, 1752 bp, Artificial Sequence
  Description of Artificial Sequence: Synthetic coding sequence
atggccagcaccgactacagcacctacagccaggccgccgcccagcagggatatagcgcgtacacagcacagcctacccagggctatgctcagacaacacaggcctatggacagcagagctatgggacctatggccaacctacagacgtgagctatacgcaggcccagaccactgctacatacgggcagaccgcctatgccacgtcttacggccaacctcccacagggtacactacacccacagccccacaggcctacagccaacctgtacaaggatacggaacaggtgcttacgatacaacaaccgccaccgtcactacaactcaagcgtcttacgcggctcagagtgcgtatgggactcagccggcatatcctgcatacggtcagcagcccgccgccacagcacctaccagaccgcaggacggaaataagcctactgagacaagccagcctcagtcctcaaccggcggatataaccaaccatcactgggctatggacagtccaattattcgtaccctcaagtccctgggtcatatcccatgcaaccggtgactgctcccccaagttatccccctacatcctattcgtccacccaacctacctcatacgaccagagttcctatagtcagcaaaacacctacggacagcccagctcctacgggcaacagtcatcttatgggcaacagagttcgtacggtcagcagcctccgacgtcttacccaccacaaactggtagttacagtcaagctccctcacagtactcccagcaatccagctcctatggccaacaacggccaatggatgaaggaccagacctggacttgggccctccagttgatcccgatgaggattctgataatagtgctatttacgtccagggtttaaacgatagcgttacactcgacgacttggcggacttcttcaaacaatgtggcgtggtgaagatgaacaagcgcaccggacaacctatgatccacatttacttagataaagaaactgggaaaccgaaaggggacgcaaccgtctcttacgaagatccacctactgcaaaggccgccgtagagtggttcgacgggaaagatttccagggttctaagttaaaggtgagtttggcacgtaagaaaccccctatgaattcgatgcgggggggcctgcccccacgggagggccggggtatgcctccacccttgaggggcgggcctggcggaccaggaggtccaggagggccaatgggtaggatgggtggtcggggcggagacagaggcgggtttccaccacgtggcccccgggggagtcggggcaatccctcgggagggggtaacgttcagcatagagctggggactggcagtgtccaaaccccggatgtggtaatcagaatttcgcctggagaaccgagtgcaatcaatgcaaggctcctaaacctgaagggtttttgcctccgccttttcccccccctggtggcgacaggggtagagggggccccggtggtatgaggggaggccggggcggactcatggacaggggaggtcccggtggcatgtttagaggcggccgggggggcgacaggggaggtttccgcggcgggaggggaatggacaggggaggttttggggggggcagaagagggggcccgggcgggcctcccggacccctcatggagcagatgggcggtcggaggggggggcgcggaggccccggcaaaatggataagggtgagcaccgccaggaacgaagggacagaccatactag

SEQ ID NO: 24071 - DNA, 1971 bp, Artificial Sequence
  Description of Artificial Sequence: Synthetic coding sequence
atggccagcaccgactacagcacctacagccaggccgccgcccagcagggctactccgcctataccgctcaacccacccagggatatgcgcaaacaactcaggcttacggccagcaaagctacgggacatacggacagcctacagacgtgtcctacactcaggcacagacaactgcgacctatgggcagacggcatatgcgacgtcttacggacagccccccactggatatacaacacctactgcccctcaagcctactcccagccagtccaggggtacgggactggggcctacgataccaccaccgctacggtgaccaccacccaggcctcctatgctgcccagagcgcatatggcactcaacctgcctatccggcttacggtcagcagccggcagctaccgcgccaacacgacctcaggacgggaacaagcccactgagacctcccagccgcaatcatccactggcggttataatcagccatcactggggtatgggcagagtaattatagctatccccaggtccccgggtcttatcccatgcagcccgtgaccgcgcctcccagttatccacctaccagctacagtagcactcagcccaccagttatgatcaatctagctatagtcagcagaatacttatgggcagccctctagctatggacaacagagctcctacggccagcagtcaagctatggacagcagccgccaactagttatcccccacagactggcagttacagtcaggccccaagccaatacagtcagcagagtagtagctatggtcaacagtcctcattcagacaagatcacccgtcctctatgggtgtgtatggacaggaaagtggtggcttttctgggcccggtgagaaccgttcgatgtcggggccagacaatcggggaagaggtcgcgggggttttgatcgcgggggaatgtctcgcggcggacgcggcggggggcggggcggcatgggctccgccggtgagcgaggcgggttcaataagccaggggggcctatggatgaagggcctgatcttgatctaggtccccccgtagaccctgacgaagattctgataattctgctatctatgtgcagggtctcaacgatagtgttacgctggacgacctggccgatttctttaagcaatgcggggttgtgaagatgaacaagaggacagggcaaccgatgatccacatttacctggataaagaaacaggcaagcctaaaggggatgctacagtctcctatgaggacccgccaacagccaaggcagccgtcgaatggtttgacggaaaggacttccagggaagtaaactgaaggtctccctggcccgcaagaagccccctatgaattcgatgcgcggtggtcttccacctcgcgagggtcgaggtatgcctcctccgttgcgaggggggcctggaggtccaggcggacccggggggcccatggggcggatgggcgggaggggcggggaccgcggcggatttcccccgcgtgggccaagaggcagcagaggcaatcctagtgggggcggcaatgtacagcaccgagccggggattggcagtgtcccaaccccgggtgcggtaatcaaaattttgcctggcggaccgaatgtaatcagtgtaaggcgccaaagcccgaaggctttttgccgcctccattccccccacctgggggagaccgtgggcggggaggacccggcggaatgcggggcggccggggtggacttatggacagggggggcccaggcggaatgttccgcggtggaagagggggagataggggcggttttcggggcgggcgagggatggacagggggggcttcgggggcggacgccgaggaggacctggcggccctcctggacctctgatggagcagatgggaggacgaagggggggccgaggaggacctgggaaaatggataaaggcgagcatcgacaggagaggcgggacagaccctactag

SEQ ID NO: 24072 - DNA, 1968 bp, Artificial Sequence
  Description of Artificial Sequence: Synthetic coding sequence
atggccagcaccgactacagcacctacagccaggccgccgcccagcagggctactcagcatatacggctcagccaactcaggggtatgctcagacaacacaggcctacggccaacagagttatggtacgtatggccagcctacagatgtctcctatacgcaagctcagacgacggccacctacggacagactgcctatgctacctcatatggtcaaccacccacaggttataccactcctaccgctccgcaggcctacagccaacctgtccagggctatgggacaggcgcatatgacaccaccactgcgaccgtgaccacaacgcaggcgagctacgcagcccagagcgcatacggtacccaacctgcctacccagcctacgggcagcagcctgccgcgaccgccccgacaaggcctcaggacgggaataaacctactgagacatctcagccacagtccagtacaggcggctacaatcagccctccctgggctatggccaatctaactatagctatccccaggtccctggatcatacccaatgcagcctgtgaccgcacctcctagctacccgcccacgtcctactccagcactcagccaacgtcctatgaccagagcagctacagtcaacagaacacttacgggcagccgagctcatatgggcagcagtcctcctacggacagcagagctcatatggccagcagccgccaaccagctatcccccacagacaggctcatacagtcaggctccttctcagtattcccagcaatccagctcttacggccagcagtccagcttccggcaggatcacccgtcaagcatgggcgtctatggacaagaaagcggaggcttcagcggccctggcgaaaatcgctctatgagcggacccgataatcggggccggggccgaggaggctttgatagaggtggaatgtcaagggggggaagaggggggggcaggggagggatgggcgccggagaacgtggcgggtttaacaaaccaggaggtcctatggacgagggcccagatttggatctcggcccacccgtggacccagatgaggacagcgataatagcgctatatacgtgcaagggctaaatgacagtgtgacactcgatgacctggccgattttttcaaacagtgcggagttgtgaaaatgaataagagaaccggccagccaatgattcatatatatctcgataaagaaaccggaaaacccaagggcgatgccacagttagttatgaggacccacccacagccaaagcagccgtggagtggttcgacggaaaagacttccaaggcagtaagctcaaagtctcattggcacgaaaaaagccacctatgaactctatgcgtgggggactgccccccagggaggggagaggcatgccgccgccccttcgggggggacctgggggaccaggaggaccaggagggcccatggggaggatgggaggtcgtggaggagaccgcgggggcttccctccccgtggacccagggggtctagggggaacccctctggcgggggtaatgtgcagcaccgggccggcgattggcagtgcccaaaccccgggtgcggaaaccagaactttgcttggagaacggagtgtaatcagtgtaaggcaccaaaacctgagggtttccttccaccaccattcccgcctcctggaggcgataggggacgagggggcccgggggggatgagaggaggccggggcggcctcatggacaggggaggacctggcggaatgtttcgcggcggcaggggcggtgacaggggtggattccggggaggcagggggatggacagaggaggtttcggcgggggccggcgcggcggaccgggcggacctccaggaccattgatggagcaaatgggcggcagaagaggcgggaggggtggccccggcaagatggataagggcgagcacaggcaggagcgtcgggataggccctactag

SEQ ID NO: 24073 - DNA, 1986 bp, Artificial Sequence
  Description of Artificial Sequence: Synthetic coding sequence
atggccagcaccgactacagcacctacagccaggccgccgcccagcagggatacagtgcttacacggctcagccgacgcagggctatgctcagactacccaggcatatgggcagcagagttatggcacatacgggcagcccacggacgtcagttacactcaggcccagaccaccgccacatatggacagacagcctacgcaacctcttatggtcagcctcccactgtggaaggtacaagcactgggtataccacccctactgctccacaggcgtattctcagcctgtgcagggctacgggaccggtgcctatgacaccactacagccactgtaactactactcaagcttcctatgctgcgcagtcagcctacggaactcagccggcatatcccgcttacggccagcaacctgccgccaccgcccccacaaggccacaggacggcaacaagcctacggagacctcgcagcctcaaagtagcaccggcgggtataatcagcctagtctcggatacggtcagagtaactattcatatcctcaggtgccaggctcatatcccatgcaacccgtaactgcacccccatcctatccccctacctcctacagttccacccagccgaccagctatgaccagtcctcttattcccaacaaaacacatatggtcaaccatcaagttatggacaacagtccagctatggacagcagtctagctacggccagcaaccacctaccagctaccccccccagacaggatcctactcccaggctcccagccagtattcacagcagtcaagcagctacgggcagcaatcctccttccggcaagaccacccttcatcaatgggcgtttatgggcaagagagcggagggtttagtggccccggggagaatagatcgatgtcaggacccgacaacaggggacggggccgcggcggattcgacagggggggcatgtcacgcgggggacgggggggtggaaggggaggtatgggggctggagaacggggcggatttaacaagccaggcggcccaatggatgaagggcctgacctcgacctgggcccaccagtagatccagatgaggatagtgacaattctgcaatttacgtccagggtctgaatgactccgtgactctcgacgatctggcggactttttcaagcagtgtggtgtggtcaagatgaacaagaggacaggccagcccatgatccacatctatctggacaaggagactggtaaacctaaaggtgatgctaccgtgagctacgaagaccccccgactgccaaggcagcagtggagtggtttgatggcaaggattttcaggggagcaaacttaaagtcagcttggccaggaagaaacccccaatgaattccatgagaggtggattgccacctagagaggggaggggtatgcctcctcctctgcgcgggggcccagggggaccaggagggcctggaggccctatggggcggatggggggacgtggaggggacagaggcggtttcccacctcggggaccccggggctcacggggcaacccgtcgggtggtggcaatgtgcaacatagagccggggattggcaatgccctaatccgggttgtgggaaccagaacttcgcttggagaaccgagtgcaaccaatgcaaggcccctaagcccgaaggatttctcccacctccctttccccctccggggggtgatcggggcagagggggaccaggggggatgagaggaggccgaggagggctgatggatcgcggcggacccggcggaatgtttcgcggcggacggggaggagaccggggaggttttagagggggacgtggtatggaccgcggagggttcggcgggggaaggaggggcggccctggcggtccaccgggccctctgatggaacagatgggagggagacgaggagggcgcgggggaccgggaaagatggataagggcgaacatcgtcaagaaagaagggaccgtccatattag

SEQ ID NO: 24074 - DNA, 543 bp, Artificial Sequence
  Description of Artificial Sequence: Synthetic coding sequence
atggccagcaccgactacagcacctacagccaggccgccgcccagcaagggtactctgcatacaccgcccaaccgacccaaggttatgctcagacaacccaagccagctacgcagctcagagcgcatatggaacgcagccagcctacccggcctatgggcagcagcccgcagcgactgctcctacccggccacaggacgggaacaaacctactgagacatcacagccccaatcaagcactgggggttataatcagccgtccctcggctacggacagtctaactacagctacccacaggtaccagggagctatcccatgcagccagttactgctccgccaagttacccccccacatcttatagctctactcaaccgacatcttacgaccagtcatcatacagccaacagaatacatatggccaaccatcttcctacgggcaacagagcagctacgggcaacagtcctcttatggacagcaaccaccaacttcttatccgccccagacaggcagctattcacaggctcccagccagtactcttag

SEQ ID NO: 24075 - DNA, 1065 bp, Artificial Sequence
  Description of Artificial Sequence: Synthetic coding sequence
atggccagcaccgactacagcacctacagccaggccgccgcccagcaaggttattcggcatacacagcccagcccacccagggctatgcgcaaaccacccaagcatacgggcagcagtcctatggcacctacggtcagccaacagatgtatcctacactcaggctcagacaaccgcaacgtatgggcagacagcctacgcaactagctatggccagcctcccacaggatacactaccccgactgctccccaggcctactcccagcctgtgcagggttatggaactggagcttacgatacaaccacagccaccgtcaccactacccaggcctcatatgccgcccagtccgcatacggtacccagccggcgtatccggcctatgggcagcaacctgctgcaacagctccgaccagacctcaggacggaaacaagccgacagagacgagccagcctcaatcaagtacgggaggctataaccagccctccctgggctatgggcagtccaattactcataccctcaggtccccgggagttatccaatgcagcctgttacagccccccccagctatcccccaaccagttacagtagtactcaacccacttcctacgatcagtcgtcttactcccagcagaacacttacggccagccatcttcttacggacagcaaagctcttatggccaacagtcatcatacggccagcagccccctacctcctacccccctcagaccggcagctatagtcaggctccatcccagtactcccaacagtctagctcttacgggcagcaatcctcctttcggcaggatcatccctcgtccatgggagtgtacggacaggaatccggaggcttcagcggtccaggcgagaatcgcagcatgagcggcccggacaatcggggcaggggaagaggtggcttcgaccggggcggcatgtctagaggtggccgcggtggaggacgcggaggcatgggcctgcagagtgaatcacttgtgtacacttctattctgaagaagtatccttacagcgtgctctctagacagcataatgagaaatgggactag

SEQ ID NO: 24076 - DNA, 972 bp, Artificial Sequence
  Description of Artificial Sequence: Synthetic coding sequence
atggaccccggcaaggacaaggagggcgtgccccagcccagcggccctcccgcgagaaagaaattcgtgatccctctcgacgaggacgaggtgccacccggagtggctaaacccctttttcgatctacccaatcactgccaaccgtggatacctctgctcaggccgctccccagacctatgccgaatacgctatttcgcagcctctcgagggcgcaggcgccacttgtcccactggatctgagcccctcgcaggagagacacccaaccaagccctgaaacctggggccaagtccaattctattatcgtttcccccagacaacgaggtaaccctgtgctgaaattcgtgcgaaatgtgccttgggagttcggagatgtgatccctgattacgtgctagggcagtctacctgtgccctatttctttctctaaggtaccacaatctgcatcccgactacatacatggacggctgcagagcttagggaagaactttgcactgcgcgttttgcttgttcaagtggacgtcaaggacccccagcaggcgctcaaagagctggcaaaaatgtgtattctcgctgactgcacgttgattctagcctggtctccggaggaggctggcaggtacctggagacctacaaggcttacgagcagaagccggccgatctcctgatggagaaacttgaacaggacttcgtgtcaagggtgacagaatgtcttactacggtgaaaagcgtgaacaaaactgattcccagaccctactgacgacattcggcagcctggagcagttgatagccgcatccagagaggatctggccctatgccccgggctgggcccacagaaggtcagggcactgggcaaaaaccctcggagctggggaaaggagcgcgctccgaataagcataacttacgcccccagagttttaaagtcaagaaggaacctaaaacacggcattcagggttccgcctgtag

SEQ ID NO: 24077 - DNA, 894 bp, Artificial Sequence
  Description of Artificial Sequence: Synthetic coding sequence
atggaccccggcaaggacaaggagggcgtgccccagcccagcggcccgccggctcgcaaaaagtttgtcatcccccttgatgaagacgaagtaccccccggcgtggctaaaccactctttcggtctacacagtctcttcctactgtggacacatccgcgcaggctgctccgcagacgtacgctgagtacgctatttcccagccactggaaggcgcaggagccacatgcccaacaggcagtgaacctctcgctggcgagaccccgaaccaggctctgaagcccggtgctaagagcaacagtatcattgtatccccccgtcagagggggaacccagtccttaaattcgtccgtaatgttccctgggagttcggagatgtgattcccgactatgtcttggggcagtcaacctgcgctttattcctcagcctacgctaccataatcttcaccctgattacattcatggccggctccagtctttggggaagaactttgctctgcgggtgctgctcgtacaagtggatgttaaggatccccaacaggcacttaaagaactcgcaaagatgtgcatcctcgctgattgtacccttatcctagcatggagccctgaagaagccggaaggtatctcgagacgtataaagcttacgaacagaaacctgcagacctactgatggagaaactcgaacaagatttcgtgagcagagttacagaatgtctgacaacagtcaagtccgtgaacaaaactgacagtcagaccctgctgaccacctttggctcgcttgaacagctcatagcggcttcacgagaggacttagctctttgtcctggcctcggaccccagaaggctcgtagactcttcgacgtcttgcatgagcccttcctgaaggttccctag

SEQ ID NO: 24078 - DNA, 822 bp, Artificial Sequence
  Description of Artificial Sequence: Synthetic coding sequence
atggaccccggcaaggacaaggagggcgtgccccagcccagcggccccccggctagaaagaaatttgtcattccactggacgaagacgaagttccacccggtgtggcaaagccgctgttccggagtacgcagtccctccccaccgtcgacacctctgctcaggccgctcctcagacatatgcggagtatgccatcagccagcccttggagggggcaggcgcgacctgccccacaggctccgagcctctggccggagagaccccaaatcaagccctgaaacccggcgcaaagagtaattccatcatcgtgagcccccgtcagaggggaaacccagttttgaaatttgtgaggaacgtgccgtgggagttcggcgatgtaattcccgactatgtgttgggccagagtacctgtgccctttttctcagtctaagataccataacttgcacccggattacattcatgggaggttgcagtcactaggcaaaaactttgcactgcgcgttctactcgttcaggttgacgtcaaagatcctcagcaggctctgaaggaattggcaaagatgtgcatattggctgactgtacattgattttggcgtggtcccctgaggaggcagggcggtacttggaaacttataaagcgtacgaacagaaaccggcagacctcctgatggagaagctggagcaggatttcgtatctaggtcactggagcaacttatcgccgcctccagggaggatctagccttatgcccaggcttggggccccaaaaagctcgcagactgttcgatgtcctccatgaacctttccttaaggtaccatag

SEQ ID NO: 24079 - DNA, 678 bp, Artificial Sequence
  Description of Artificial Sequence: Synthetic coding sequence
atggaccccggcaaggacaaggagggcgtgccccagcccagcggccctccggcacgcaaaaaattcgtgatcccacttgacgaagacgaagtgcctccgggtgtgcgggggaaccctgtgctgaagttcgtccgtaatgttccatgggagtttggcgatgtgatccccgactatgtgcttggccagtctacatgcgctctgttcctgagtcttcggtatcataacttacaccccgattacatccatggtagacttcagagtttgggcaagaactttgcactccgcgtgttgctggtacaggtggacgttaaggatcctcagcaagcgcttaaggaactcgccaagatgtgcatcctcgcagactgtacattaatccttgcttggtccccagaggaagctggaaggtacctggaaacttataaagcttatgagcaaaaacccgcggatctgctaatggagaaactggagcaggactttgtttcacgagtcacagagtgcctaacaaccgtgaaatccgttaacaagacggatagccagactctccttacaacattcggcagtctggagcagctgattgcagccagcagagaggatctggcactttgtccaggcctgggtccccagaaagcaaggcgcctgttcgacgttctccatgagccattcctgaaagttccctag

SEQ ID NO: 24080 - DNA, 120 bp, Artificial Sequence
  Description of Artificial Sequence: Synthetic coding sequence
atggaccccggcaaggacaaggagggcgtgccccagcccagcggccctcccgcaaggaagaaattcgttatccctctggatgaggacgaggtgcctccgggggttagcaagcctctgtag

SEQ ID NO: 24081 - DNA, 726 bp, Artificial Sequence
  Description of Artificial Sequence: Synthetic coding sequence
atggccagcctgagcggcctggccagcgccctggagagctaccggggcagggaccgcttaataagagttctaggctattgttgccaactagtaggaggtgtgttagtggaacaatgtccagcccggagcgaggttggcacaaggctcctcgtggtcagtacccaacttagtcactgtaggaccatacttcgcctcttcgatgacctggccatgtttgtttataccaagcagtatggtctgggtgctcaggaggaagatgctttcgttagatgcgtgtcagtgctagggaatttggcagaccagctgtactacccttgcgagcacgtggcctgggcggccgatgcccgggtcctgcacgtggactcttcgcgatggtggacgctatcaaccactctgtgggccctctctctcctgctgggcgtggctcggagcctgtggatgttgctaaagctgcggcaaaggcttcggtctcctacagctccattcacgtcacctctcccccgcggcaagagacgggccatggaggcccagatgcagagtgaagctctgtctttgctttcaaacctagccgatctggccaatgctgtgcactggcttccgcgtggcgtgttgtgggccgggcgcttcccaccttggttggtcgggctgatgggcactatttcttcgatcctgtctatgtatcaggctgcaagagctggagggcaggctgaggccacaaccccatag

SEQ ID NO: 24082 - DNA, 1218 bp, Artificial Sequence
  Description of Artificial Sequence: Synthetic coding sequence
atgcgggagctgaagcggaccctggacgccaagggccacggcgtgttagaaatgccttcaggcaccggaaagacagtaagtctgttggcactgataatggcctaccaaagggcctacccactggaggtgaccaaacttatttactgctccaggacagtgccagagattgagaaggttatagaagagttgaggaaattgttgaacttttacgaaaagcaggagggcgagaagctccctttcttggggctggcattgtctagcagaaaaaacctctgtatccaccccgaggtcacaccgctgcgctttggaaaagacgtggatgggaagtgccactctctgacagcctcctatgttagagctcaataccagcatgacacatctctcccccattgccgattttatgaggaattcgacgctcatggacgcgaagtccccctgccagctggaatatacaaccttgatgacctcaaggcactcggaaggcggcagggttggtgcccttactttctggcccgatactctatcctgcatgccaatgttgtcgtctactcttaccattatctccttgacccaaaaatcgctgatttggtctctaaggagctggctcggaaggcagtagttgtgttcgacgaagcccacaacatcgataacgtgtgcattgattccatgtcggtgaatcttacccgaaggacactggacaggtgtcaggggaacttggagacgttacagaaaacagtcttaagaatcaaggaaaccgacgagcagaggttgcgagacgagtacaggaggctggtggagggtctccgcgaagcaagcgcggcccgagaaaccgacgcgcatctagccaatcctgtattacccgatgaagttctgcaagaggccgtgcccggatccattcgcaccgccgagcacttcctcggcttcttaagacggctcttggagtacgttaagtggcgcctacgggttcagcatgtggtacaggagtcacctcccgcctttttgagcggactggcacagcgggtctgtatccaaagaaagcctttaaggttctgtgcagagcgcctgcgctccttgctgcatacattggaaatcaccgacttggccgactttagtccgcttaccctcctagcaaattttgccactttggtgagcacctacgccaaagggcaggcccagcactgtggttcaagtcgaaatcagaagcgctcacatccatag

SEQ ID NO: 24083 - DNA, 2133 bp, Artificial Sequence
  Description of Artificial Sequence: Synthetic coding sequence
atgcgggagctgaagcggaccctggacgccaaggcctaccccctggaggtgaccaaattaatttactgtagcagaaccgtgcccgagatcgaaaaagtgatcgaagagctgcggaaattgctcaatttttacgagaagcaggaaggtgagaagctacctttcctgggactggctttgtctagccggaaaaatctgtgcatacatcctgaggtcaccccgctaaggttcggcaaggacgtggatgggaaatgtcattctttaaccgcctcttatgtgagggcccagtatcagcacgacacctcattacctcattgcagattctacgaagagtttgacgcccacggacgcgaggtcccgctccccgccggtatttacaacctcgacgatttaaaagcattgggacgccgccaagggtggtgtccctatttccttgctcggtactcgattctgcacgctaatgtagtggtctatagctaccattatctgcttgatcccaaaattgcagacctggtatccaaagagttggcgaggaaggctgtcgttgtgttcgacgaggctcacaatattgacaacgtttgtatagatagtatgtctgtgaatctgacccgcaggacacttgaccgctgtcagggaaacttagaaactttgcagaagacggttctgcggattaaagagacggacgagcagagactacgtgacgagtacagaaggctggtggaaggcctcagggaggcttcggccgccagagaaaccgacgctcatctggctaatcccgtattgccagatgaagtcctccaagaggccgtgccgggaagtatacgcacagctgagcactttctcggattcctaaggcgccttctcgagtacgttaaatggcgtctccgtgtgcaacatgttgtgcaggaaagtccgcccgcctttctttcagggcttgctcagagggtctgcatacagcggaaacctttaagattctgtgccgagcgtttgagaagcttgctgcatactctggagattaccgatttagccgatttttctcccctgacgctgctcgctaatttcgccaccctcgtcagcacctacgctaaagggtttacgatcatcatcgagccgtttgacgacaggaccccaaccatagcaaatccaatccttcatttttcttgcatggatgctagtctcgctattaagccagttttcgagcgatttcagtctgtcattatcaccagcggaaccctgtcacccctggatatttatccgaaaattctggattttcatcccgtgaccatggcgactttcacaatgactcttgctcgtgtgtgcctgtgtccaatgatcatcgggcgcggaaacgaccaagtggctatcagtagtaagttcgagacaagagaagatatcgccgtgatccggaactatggtaatcttctcttagagatgtctgcagttgtgcccgatggcattgtggcgttcttcacatcataccagtacatggagagcactgtggcttcttggtacgaacaggggattcttgaaaacatccagcgcaacaagctgctcttcatcgagacacaggacggcgccgaaacttccgtggccttagagaaatatcaggaagcttgcgagaatggcaggggcgccatactgcttagcgttgccagaggaaaggtgtctgaggggatcgattttgttcaccattacggccgcgctgttatcatgttcggcgtaccatacgtgtacacacaatcacgtatcctgaaagccagacttgaatatcttagagatcagttccagattcgagaaaatgactttttgactttcgacgccatgaggcacgctgctcaatgtgtgggacgggcaatccgcgggaaaacagactatggtttgatggtttttgccgacaaaaggttcgcacggggcgacaagcgtggaaagctcccccgatggattcaagagcacctgaccgacgccaacttaaatctcacagtcgacgagggcgtacaagttgcaaaatattttcttcgacagatggctcagccatttcaccgtgaggaccagctcgggctctcccttctgtccctcgaacagctggagagcgaggagacactgaagcggatagagcagattgcacagcagctctag

SEQ ID NO: 24084 - DNA, 2211 bp, Artificial Sequence
  Description of Artificial Sequence: Synthetic coding sequence
atgcgggagctgaagcggaccctggacgccaagggccacggcgtgttggagatgccgtcaggcaccgggaaaaccgtcagtttattggcacttataatggcctaccaacgggcctaccctcttgaggtgaccaagttgatctactgctctcggacagtgccagagatcgaaaaagtgatagaggagctcagaaagctgttaaatttttacgagaaacaggaaggggagaagctgccttttctgggcctagctctgagcagtaggaagaacttgtgtatacaccccgaggtcacgcccttaaggttcggcaaggatgtggacgggaagtgtcactcactcacagccagctatgtgagagctcaataccaacatgatacttctctcccacactgtagattctatgaggagtttgacgcccacggacgtgaagtaccactgcccgccgggatatataacttggatgacctcaaggcactcggtagaaggcagggatggtgtccatattttctagccaggtactccatcctgcacgccaatgtggtggtgtattcttaccattacctgctggaccccaagatcgcagatctggtaagcaaagaattagctagaaaggctgttgtcgtgtttgacgaggcacacaacatcgacaatgtttgtatcgacagtatgtctgtgaacctgacacggcgcaccctggatcggtgtcaggggaacctggagaccctgcagaaaacggttctgagaataaaagaaactgacgaacagcggctgcgcgatgaatatcgtagactcgtagaaggtctgagggaggcctctgccgccagggaaacagacgctcacttggctaaccccgtgctccccgacgaggttttacaggaagcagtgcccggatccatcaggacagctgaacactttctaggttttttgagaagactgctggaatacgttaagtggcggctaagagttcagcacgtagtacaagaaagccccccagcgttcctgtctggcctcgcacaacgagtttgcattcagagaaaaccattgcggttctgcgctgagcgcctcagatctctgcttcacacactggaaatcaccgacctggccgatttcagccccctcaccctcttggctaactttgccaccttagtatcaacctacgccaaaggctttaccattattatcgagccattcgacgatagaacccctacaattgctaacccgattctgcattttagttgcatggacgcatcactcgccatcaagcccgtctttgaacgatttcagtctgtaattattacaagtggaacgctgtcaccgctggatatctatcctaaaattctcgacttccatccagtgaccatggccacattcacaatgaccctggctagagtttgtctgtgcccaatgatcatcggaaggggaaatgatcaggtcgccatctctagtaaattcgagacaagggaagatatcgctgtgatccggaattacggaaatctcctgctggaaatgtctgcagttgtgccagatggtatagttgcctttttcacttcctaccagtacatggagagtactgtggcttcgtggtatgagcaaggaatcctggagaatatccagcgcaacaaactgctcttcatagagacacaggatggagccgaaacctctgtcgcactggaaaagtaccaggaagcatgtgagaacgggcgcggagccatcctgctctcagttgccagggggaaggtgtctgaaggcatcgacttcgtgcaccattatggtcgggcagtgataatgttcggcgtgccatatgtctatactcagagcaggatcctgaaagccaggttggaatatctgagggatcagtttcagatccgggaaaacgatttcctgaccttcgacgcaatgcggcacgcggctcaatgtgttgggagagctatccgtggaaagactgactacggcctgatggtgttcgctgacaaacgctttgcacggggggataagcggggaaagctgccgcgctggatccaggagcatttaacagatgctaatctgaatcttaccgtcgatgagggcgtgcaggttgcaaagtatttcctgaggcagatggcgcagcccttccatcgcgaggatcaattggggttgagcctcctgtccctggaacaactcgagagcgaggaaacactgaaacgtattgagcagatcgcacagcagctctag

SEQ ID NO: 24085 - DNA, 2049 bp, Artificial Sequence
  Description of Artificial Sequence: Synthetic coding sequence
atgaagctgaacgtggacggcctgctggtgtacttcccctacgactatatctatcctgaacaattctcctacatgagagagctcaagcgcacactcgacgctaaggggcatggagtgctggagatgccctctggtacaggcaaaacggtgtctctcctggcgctcattatggcctaccaacgggcttatccccttgaagtgaccaaactcatctactgtagcaggacagtgcctgaaattgagaaagttatcgaggaattacgaaagctgttgaatttttacgagaaacaagagggggaaaagcttccttttcttggcctggctctgtctagtaggaagaacctctgtatccatcctgagattttgcatgccaacgtcgtggtatactcctaccattatctcctcgatccaaagattgccgatctagtttcgaaggagctggcccggaaggcggttgtcgtgttcgatgaagcccataacatcgacaacgtctgcattgacagtatgagtgtcaaccttactaggcggaccttggacaggtgtcagggaaatcttgaaacactccaaaagactgtacttcgcattaaagaaacagatgaacagcggttacgcgacgagtataggcgtcttgtggagggtttgagagaggcttcggcagcacgcgaaaccgacgcccaccttgctaaccccgtgctgccagacgaggtgctgcaggaagccgtcccgggatccattcggactgccgaacacttcttgggttttctgcggagactcctagagtacgtgaaatggagactgcgagttcaacacgtggtgcaggaatcccccccagctttcttaagcggcttggctcagcgtgtgtgtattcaaagaaaaccacttaggttctgtgcggaacgactgcgatctctcctccacacacttgagattacagacctggcggacttctctcccctgactctactcgcaaactttgcaaccttagtctcaacttacgccaagggctttactatcatcatagagcccttcgacgataggacacctaccattgcaaatcccatcttgcacttttcttgtatggatgccagcctggccattaagcccgtgtttgagcgatttcagtctgtcattatcacatctgggactctgtcacctctcgatatctacccaaagattctggacttccaccccgtaaccatggccactttcacaatgacactggctcgagtgtgtctttgccctatgataatcgggcgaggcaacgaccaagtcgcgatctcatccaagttcgagacaagagaagacatcgccgtcatcagaaattacgggaacctcctgttagagatgtccgcagtcgtgcccgatggcatagtggctttcttcacttcctaccaatacatggaatccaccgtcgcctcatggtacgaacagggcatactggaaaatattcagagaaataaactgttatttatcgaaacgcaggacggagccgaaacctcagtcgcgctggagaagtatcaggaggcatgtgaaaatgggcggggcgcaatactgttgtcggtagcccgcgggaaagtgagtgagggcatcgacttcgtccatcactacggtcgcgcagttattatgtttggtgtgccttacgtgtatacccagtcgcgcattcttaaggcacggctcgaatatctgcgggaccagtttcagatccgcgagaacgactttctcacatttgatgcgatgaggcacgccgctcagtgtgtggggcgggcaattagagggaaaacggattatggcttaatggtgtttgcagacaagaggttcgcacggggagacaagcgtgggaaactgcccaggtggatccaagaacacctgaccgatgccaatctgaacttgaccgtggatgagggagtgcaggtggcaaagtacttcctacgtcaaatggctcaaccctttcaccgggaagaccagttgggtttaagtctgctctctctggagcagttggagtccgaggaaaccctgaaacgcattgagcagatcgcacaacagttgtag

SEQ ID NO: 24086 - DNA, 2283 bp, Artificial Sequence
  Description of Artificial Sequence: Synthetic coding sequence
atgaagctgaacgtggacggcctgctggtgtacttcccctacgactacatttaccctgagcagtttagctacatgcgagagctgaaacgaacgctggacgccaagggccatggagttctggagatgccttccgggaccggaaagacagtttcactgctcgcactgataatggcttatcagcgggcatatccgttagaggtcactaaactcatatactgctcccggacggtgcctgagatagaaaaagtgatcgaggaactccgaaaactgctaaacttttatgagaaacaggaaggcgagaagttgccgttcctgggacttgctctgtccagccgcaaaaacctgtgtatccatcctgaggtgacccctctgcgttttggcaaagacgtcgacggcaaatgccactctctcacagcatcctacgttcgagctcagtaccaacacgatacatcgctcccacattgccgattttatgaagagttcgatgcccacgggcgggaagtgcccctgccagcaggaatatataacctggatgacctgaaggctttgggccgccgtcagggttggtgtccatattttctggcccgttacagcatcctgcacgctaacgtagtggtctatagctaccactacctgttggatcctaagattgccgatctggtgagcaaggaacttgcccgcaaagcggtcgtggtgttcgatgaggcccacaacattgataatgtatgcattgatagtatgagcgtgaatctcacaaggaggaccctggaccggtgtcaggggaaccttgaaaccctgcaaaaaactgtgctcagaatcaaagaaactgatgagcagcggctccgggacgagtatcgccggctggtggagggcttgagggaagctagtgctgcaagggaaacagacgcccacctggccaaccccgtgctacctgatgaagtcctgcaggaggctgtgccagggagtatcaggacggcagagcactttctcgggtttcttcgccgcctgctggaatacgtgaaatggcggttgcgggtgcagcacgtcgttcaggagagccccccagcgttcctgagtggccttgcccagcgagtatgtatccagaggaaaccactgagattctgcgcggaaaggcttagaagtctgctccacactctggagataaccgacttagcagacttctcaccgctgacgttgctggccaattttgctacattagtgtcaacttatgctaaggggtttactataattatcgagccattcgatgaccgaacacctactatcgcaaatcctattctgcattttagctgtatggacgcctccctagctatcaaaccagtattcgagcgattccagtcagttattatcactagtgggaccctgtccccactggatatatatcctaaaatcttagacttccaccctgttacgatggccacctttactatgaccctagccagagtgtgcctttgccctatgattatcggtagggggaatgaccaggtggcaatttccagcaaattcgagaccagagaggatatcgctgtaataagaaactacggcaatctcctccttgagatgagcgccgtggtccctgatggcatcgtggccttctttacctcatatcagtacatggagagcaccgttgccagctggtacgaacagggaatactggaaaatatccagcgcaacaaactcctgttcatcgagacccaggacggggcggaaacatctgtggccctggagaagtaccaagaggcctgtgagaacggccgaggggccatcttgctgtctgtggctcgggggaaggtgtctgaaggcattgacttcgtgcatcactatggaagagccgtgatcatgttcggggtgccatacgtctatactcagtcgagaatcctcaaggcccgcctggagtacctgcgtgaccaatttcagattagagaaaatgattttctgaccttcgacgccatgaggcacgctgctcaatgcgtgggacgggctattagagggaaaaccgactacggcctgatggtttttgctgacaagcgcttcgcccgcggagacaagcgagggaaactcccaaggtggatccaggagcatctcaccgacgccaatctgaacctaacggtcgatgagggtgttcaggttgcaaagtatttcctgcgccagatggcccagccattccaccgggaagaccagctcggtttgtccctcctgtcattggagcaattagaaagcgaggagacactgaaacggattgaacagatcgctcagcagctgtag

SEQ ID NO: 24087 - DNA, 2751 bp, Artificial Sequence
  Description of Artificial Sequence: Synthetic coding sequence
atggagagcggccagcccgcccggcggatcgccatggcccccctgctcgagtatgaacgtcagcttgtgctggagctgttagacacagatggacttgtcgtgtgcgcccgcgggctgggagccgatcgtctgctatatcacttcttgcagttacactgccatcctgcatgcctggtcctggtgctgaacacccagccagctgaagaggaatatttcatcaatcagctgaaaatcgagggcgtggaacatctgcccagaagggttaccaatgagatcacttccaactcaagatacgaggtgtatacccagggaggtgtgatcttcgcgacctcacgaatactggtcgtggatttcctcactgacaggattccatctgacctgatcacaggcattttagtctatcgtgctcaccggatcatagagtcgtgtcaggaagcctttatcctgagacttttccgtcagaaaaataagcggggatttatcaaagccttcacagataacgcagtagcattcgatacaggtttctgccacgtcgaacgggtgatgcggaatctgttcgtgcgcaagctatatctgtggccccggtttcacgtggcagtgaatagtttcctggaacagcacaaaccggaagtagtggagattcacgtgtcgatgacccccacaatgctggctattcagactgccatcctggacattctaaacgcctgcttaaaagagctcaagtgccacaatccctcattggaggtggaggacctctccttagaaaatgccattgggaagcctttcgacaagactatccgccattatctcgaccctttatggcaccagttgggggcaaagacaaaatccctcgtgcaggatctgaagatccttcggactctgttgcaatatctttcacagtatgactgtgtgaccttcctgaacctgctcgagtcacttagagcaaccgagaaggcattcgggcaaaatagtggctggctgtttcttgactcctccacgtccatgtttatcaatgcccgggcccgtgtctatcacttaccggatgcaaaaatgtctaagaaagagaagatttcagagaagatggagatcaaagagggtgaggagactaaaaaggagctcgtgctggaatcgaacccaaagtgggaggcgctgaccgaggtgcttaaggaaatcgaggcagaaaacaaggaatccgaagctctcgggggcccaggtcaggtgctgatatgcgccagtgacgatcggacatgtagccagttgcgcgattatattaccctgggtgcggaggcattcttgctccggttataccgtaagactttcgagaaggattccaaagctgaggaagtgtggatgaaattcaggaaagaggactcttccaaacgaatccgaaagtctcacaagcgccctaaagatccccagaacaaggaaagggcaagcaccaaagagaggacactgaaaaaaaagaagcggaaacttactttaacccagatggtgggaaaacctgaggagctggaggaggagggtgacgtagaagagggttataggcgcgaaatctcctccagtccggagtcctgccctgaagaaatcaaacatgaggagttcgatgtcaatctcagctcggatgcggcatttggaatcctcaaggagcctctgacaataatacatccgctgctcgggtgctcagatccatacgccctcactcgcgttcttcatgaagtagagccgaggtacgtcgtcttatacgatgccgagttgaccttcgtgcggcagctggagatctacagagctagccgcccagggaaacctctcagggtctattttctgatttacggggggtccactgaagaacaacgatacttgaccgcactccgaaaggaaaaagaagccttcgagaaactgatacgggagaaagctagcatggtcgttcctgaggagagggaaggccgggatgaaactaatcttgaccttgtccgcggcacagcttcagctgacgtgagcacagacactcgcaaggcgggtggtcaggagcaaaatggtacccagcagtccattgtggtggacatgcgggagttccgctcagagttgccctctctgatccatcgacgcggcattgatattgagccagttactctggaggttggagattatattctcaccccagaaatgtgtgtggagaggaagtccatttcagacctgatagggtccctcaacaatggacgcttatactcacagtgcatctctatgtctcgctattacaagcgcccggttctgctgatagaatttgacccttccaaaccattttctctcacaagcagaggcgcactctttcaagagatcagttccaatgacatttcgagtaagttgactctgctgaccctgcactttcctaggcttcgcattttgtggtgtccaagtcctcatgccactgcggagctgttcgaagagctgaagcaatcaaagccccagcccgacgctgccacagctctcgccattacagcggattcagagactctgcctgaatccgaaaagtacaaccccggcccccaagacttcctactcaaaatgcccggtgtaaatgctaagaactgccgctctttgatgcatcacgtcaaaaacattgctgagttggccgcactttcccaggatgaactcacatctatcctggggaatgcagctaatgcaaaacaattatatgacttcattcacactagcttcgccgaggtcgtctccaaagggaagggtaaaaaatag

SEQ ID NO: 24088 - DNA, 2715 bp, Artificial Sequence
  Description of Artificial Sequence: Synthetic coding sequence
atggcccccctgctggagtacgagcggcagctggtgctggagctgctggatacggatggactcgttgtctgcgcccgtgggctgggggccgacagactcctataccatttcctacagctccactgccatcccgcatgcctggtcctggtgttgaatacccagccagcagaggaggaatactttatcaaccagcttaagattgagggggtcgagcatttgccaagaagagtcacaaatgagatcacttcaaacagtagatacgaagtctacacccagggaggagttattttcgccacctctcgaatcctcgtagtggacttccttaccgatcgcatcccatcagacctcattactggaattctggtgtatcgcgcacatagaatcattgaatcttgccaagaagccttcattctccgcctgtttaggcaaaagaacaaaaggggtttcattaaagcttttactgataacgccgttgcttttgataccggtttctgccacgtcgagcgagtcatgcgaaatctgttcgtgcgtaaattatacctgtggccacgattccatgtggccgtcaatagtttcctggagcaacacaaaccagaagtggtggaaattcacgtgtccatgacaccaacaatgctcgctatccaaaccgccatcctggatatcttgaatgcatgcttgaaagagctgaagtgtcacaatcccagtcttgaggtggaagatctttctctcgagaatgccatcgggaagcctttcgataagacgataaggcactatctggacccgctgtggcaccagctcggagccaagacaaagtcactggtgcaggacctgaaaatactaagaacgctgctccaatacctgtcacagtacgactgcgtaacgtttttgaatctgctagagtctctgcgagccaccgaaaaagcgtttgggcaaaattcagggtggctgtttctcgactcctctacttctatgttcatcaatgcacgagccagggtctaccacttacctgatgccaagatgagcaagaaagagaagatatcggagaaaatggaaatcaaagagggtgaggaaaccaagaaagagctggtactggagagcaacccaaaatgggaagccctgacagaggtcctcaaggaaatagaggctgagaacaaggagagcgaagctctgggaggacccgggcaggtcctgatttgcgcctccgacgatcgaacctgctcccagctccgcgactatataactctgggcgccgaggctttcctattgagactgtataggaagacattcgaaaaggatagcaaggctgaggaggtgtggatgaagttccgaaaagaggattcgtctaaacggatccggaagagtcacaaacgcccaaaagatcctcagaacaaagaacgggcctcaaccaaagagcgtaccctcaaaaagaagaaacgtaagctgacactcacacagatggttggcaaacccgaggagttggaggaagagggggacgttgaagaggggtatcgtcgcgagatctcgtcatctcctgagagctgtcctgaggagatcaaacatgaggaattcgatgtcaacctgagttctgatgccgccttcggtatattaaaggaaccattgacaataattcaccccctgctaggctgctccgacccatacgccctgacaagagtgcttcacgaagtcgagcctagatacgtggtgctctatgacgctgagctgacgtttgtgaggcagctggaaatctacagagccagtcggcctgggaagcctctgcgctacttcctgatatatggaggctcaacagaggaacagcgttacctcactgctctccgcaaagaaaaagaggctttcgaaaagctcatccgagagaaggccagcatggtggtgccagaggagagagaaggacgtgatgaaactaatttagatttagtgagaggcactgcttccgccgacgtttcgactgataccagaaaagctggcggccaggagcagaacggcacccaacagtccatagttgtcgatatgagggagtttagaagcgaactgccttctctcattcaccgtcggggcatcgacatagaaccagtgactctagaggttggagactatatcctgactccagagatgtgcgttgagcgcaaaagcatctctgacctcattggctccctgaataatggtcgactgtatagccagtgcatcagtatgagcagatactataagcggccagttttgctgatcgagttcgacccgagtaagccattctcgctgacaagccgaggcgcgttatttcaggagataagctcaaatgacatcagctccaaactgactctgctgacactgcattttcctcggctgcgcatactgtggtgcccatcaccccacgcaactgctgaacttttcgaagaactaaagcaatctaaacctcagcccgacgcagctaccgccctggccatcacagctgattctgaaacactacctgaatccgagaagtataatcctggtccccaggacttcctactgaagatgcccggcgtgaacgcgaagaactgtcggtctctcatgcatcacgtgaaaaacatcgctgagttggccgccctcagtcaagatgaactaacttccatcttggggaatgcggccaacgctaagcagttatacgatttcatccacacatcattcgcagaggtcgtatctaagggtaaagggaagaaatag

SEQ ID NO: 24089 - DNA, 1071 bp, Artificial Sequence
  Description of Artificial Sequence: Synthetic coding sequence
atggcccccctgctggagtacgagcggcagctggtgctggagctgctcgatactgatgggttggtcgtctgcgcacgcgggctgggtgcagacagactgttgtaccatttcttacagctgcattgtcaccctgcgtgtttggttctggtgctgaatacccagccagcagaggaggagtatttcattaaccaactcaaaatagaaggcgtggagcatctgccccgccgggtcaccaatgagatcacaagcaatagccggtacgaggtgtacacacagggcggtgtcatatttgcgacgtcgagaatcctggtggtggatttcctcacagataggataccatcagacctcataaccggaatcctcgtttatcgcgcgcacagaatcattgagagctgccaggaggcttttatccttcggctatttagacaaaagaataagagaggatttattaaggcttttactgacaatgccgtggcctttgatacagggttttgtcacgtggagcgcgtgatgaggaatctgtttgtgaggaaactgtacctttggcctaggttccatgtggctgttaattcattcctggaacagcataagccggaggtggtagaaatccatgtctcgatgactcctactatgctcgccatccagacagctattttagacatactcaacgcctgccttaaagaactgaagtgtcataacccctccctggaagtagaagacctgtctctcgaaaatgcaattggcaagccttttgacaagacaatcaggcattaccttgacccactttggcaccagttaggggccaagaccaagagtttggtacaggatctaaagatcctgaggaccttactccagtatctctctcaatacgattgtgttacttttctgaatttactggagtctcttagggccactgagaaagcctttgggcagaactctggatggctgttcctcgactcatcaaccagcatgtttattaatgcccgcgcacgcgtctaccatctccctgacgcaaagatgtccaagaaggagaaaatctcagaaaaaattaagaagaagaagaaaaagtag

SEQ ID NO: 24090 - DNA, 3561 bp, Artificial Sequence
  Description of Artificial Sequence: Synthetic coding sequence
atgggcgtgcagggcctgtggaagctgctggagtgcagcggccggcaggtgtccccagaggctcttgaagggaaaatcttggccgtcgacatttcaatttggctgaaccaagctttaaagggggtccgcgacagacatggcaactctattgaaaaccctcacttgcttacactgttccaccggctgtgcaagctgttgttttttagaattcggcctatctttgtattcgatggggatgcacctctgctcaaaaaacaaaccctagtgaagcgacggcagcggaaagacctggccagctccgactctaggaaaactaccgagaaacttcttaaaacattcctgaaaaggcaggctattaagactgctttccgctctaaacgggacgaagcgctcccttcactgacccaggtccgcagggaaaatgatctctacgtattgccaccactgcaggaggaggaaaaacatagcagcgaggaggaagacgagaaggagtggcaagaacggatgaatcagaaacaggcccttcaggaagaattttttcacaacccccaagccatcgatatcgagtcggaagacttttcttcactccctccagaagtgaagcacgagattctgacagatatgaaggaattcactaagaggcggcgcacccttttcgaagcgatgccagaagagtccgatgacttctcccagtatcaactgaagggtctcctgaagaagaattatctgaaccaacacattgaacatgtgcagaaagaaatgaaccagcaacacagcggacacatcagaagacagtatgaggacgagggaggtttcctgaaagaagtcgaatctcggagagttgtgtcagaagatacttctcattatatcctgattaaaggtattcaggcaaagactgttgccgaagtggacagcgagagtttgccttcgtcctccaaaatgcacggcatgtcctttgacgttaagagcagcccttgtgagaagctgaaaaccgagaaagagcctgacgctacaccgccaagcccccgaaccctgttggcaatgcaggccgcactgttgggttcaagctcggaggaggaactcgagagcgaaaacagacgtcaggctagggggagaaatgcccctgcagccgtagatgaagggtccatctctcctagaacattaagtgccataaagagggcactcgatgacgatgaggatgttaaggtctgtgctggggatgacgttcaaactgggggacccggagccgaggagatgcggatcaactcatccactgagaacagcgacgaaggactcaaagttagggatggcaagggaatccctttcacagctacgctagccagttcttccgtgaactctgcagaagagcatgttgcctctacgaacgaggggcgggagcccaccgattcggtacctaaagagcaaatgagccttgtgcatgtgggcactgaggcattccccatctctgacgagagtatgataaaggaccgcaaggaccgcctccccctggagtctgccgtcgtccgccactcggatgcccccgggctgccaaatggtcgggagctgacacctgcctcgcctacctgtaccaatagcgtcagtaaaaacgaaactcatgccgaagtactggagcagcagaacgagctgtgtccatatgaatccaagtttgatagcagtctcctgagtagcgatgacgagactaagtgtaagcctaactcggcttcagaggtgatcgggccagtatctcttcaggaaacctcatctatcgttagcgttccgagcgaagccgtcgacaatgttgaaaacgtcgtttccttcaacgccaaagagcatgagaacttcctcgagacaattcaggagcagcaaaccactgagagcgccggccaggacctgatctccatccccaaggccgtggaaccaatggaaattgactctgaggaatcagaaagcgatggtagctttattgaggtacagtctgtgatcagtgatgaagaactgcaagctgagttccctgagacatctaagccaccctcagaacaaggggaggaagaactcgtgggaactagagagggcgaagcccctgctgagtcagagagcctgctgagagataactccgaaagggatgacgtagacggcgagccgcaggaggcggagaaggacgctgaggattccttacatgaatggcaggacattaacctggaggaactggagacgctggaaagtaatttgctggcacaacaaaactcactgaaagcacagaagcaacagcaggagagaatagctgccacagttacaggccagatgtttctggagtctcaggagctgctgagactgttcggaattccctacatccaggcccccatggaggcggaagcacaatgcgcaattcttgacctgacggaccaaactagtgggacaatcaccgatgattccgatatctggctgttcggagccaggcatgtctatagaaattttttcaataagaacaaattcgtcgagtactaccagtatgtggactttcataaccaactggggctggataggaataagcttatcaacctcgcttaccttctgggaagcgattacacggaaggaattcctacggtgggctgtgttactgccatggaaatcctaaatgagttccccggccatggcttggagcctttattaaagttctcagaatggtggcatgaagcacagaagaatcctaaaattcggcccaatccacacgacactaaggtgaagaaaaaactccgcacactgcaactgactcctgggtttcccaatcctgctgtcgccgaggcctacttgaagcctgtggtcgacgattccaaaggctcgttcctttgggggaagccagatctagacaaaattagggagttttgtcaaagatactttggttggaacagaactaagaccgatgagagcttgttccctgtcttaaagcaacttgacgcgcaacagacgcaactgaggatcgactcatttttcaggctggcgcaacaggagaaggaagacgctaagcgcataaaatctcagagactgaacagggctgtgacatgtatgctacgcaaggaaaaagaagccgcggcctctgaaatcgaggcagtctcggtggccatggaaaaggagttcgagcttcttgacaaagctaagggcaagacccagaaacgcggcattactaacactcttgaagaatcatcttccctgaaacgcaagcgcctcagtgattcaaagggaaaaaacacctgcggagggttcctcggagaaacctgcctgtccgaatccagcgacggatcttccagtgaagacgcagagtccagctccctaatgaatgttcaaaggcgcactgcagcaaaagaaccaaagaccagcgcttccgacagccagaactccgtgaaggaagctccggtgaagaatggaggggcgaccacaagctcctcctcagactccgacgacgacgggggcaaagagaagatggtcttagtcacggctcgctcagtcttcggcaaaaaacgaaggaaactgcgccgcgctcggggtcgcaaaaggaagacctag

SEQ ID NO: 24091 - DNA, 1260 bp, Artificial Sequence
  Description of Artificial Sequence: Synthetic coding sequence
atgttcctggagagccaggagctgctgcggctgttcggcatcccctacatccaggccccaatggaggcagaggcccagtgcgccatcctggatttaactgaccaaacaagtggaactatcactgatgactcggacatctggttgtttggcgctagacatgtttacagaaactttttcaacaaaaataagtttgtcgaatactatcaatatgttgatttccacaatcagcttgggctcgataggaataaactcatcaacctggcgtacctgttgggatccgactacaccgagggtatcccaactgtgggttgcgtcaccgcgatggagattcttaatgagtttcccgggcacggcttagaacctctgctgaagttctcagagtggtggcacgaagcacaaaagaatccgaaaatccgacccaatccccatgatactaaggtaaagaaaaagctcaggaccctccagttaacacccggatttcccaatccagcggtcgcagaagcctacctcaaacctgtcgtggatgattccaaaggctccttcctgtggggcaagcccgacttagacaagatcagagagttctgccagcggtattttggctggaataggaccaaaactgacgagtccctcttcccggtgctgaagcagctggatgcgcaacagacccaattgcggatcgactctttttttcggttagctcagcaagagaaagaagacgctaaacgcataaaaagtcagcggctcaatcgggccgtgacatgtatgctgaggaaggagaaagaggctgccgcctccgagatagaggccgtgtctgttgctatggagaaggagttcgagctgctggacaaggccaaaggaaaaacgcaaaagagggggatcacaaacactttggaggagtcttcatcattaaagcgcaagcggctctctgatagtaaaggaaaaaatacatgtggggggtttcttggggagacttgtctgagcgaatctagcgacgggtcaagctcagaagatgcagagagctcaagcctgatgaacgtgcagcggcgtaccgccgccaaagagccaaagacttccgcttcggattcacagaactcggtgaaagaagcacccgtaaaaaatgggggcgccactacctcctcatcaagcgacagtgacgacgatggcggcaaggaaaaaatggtcctcgtgaccgctcggtccgtgttcggcaaaaaaagaagaaagctccgccgagcaagaggccgcaagcggaagacatag

SEQ ID NO: 24092 - DNA, 3057 bp, Artificial Sequence
  Description of Artificial Sequence: Synthetic coding sequence
atgaaccagaagcaggccctgcaggaggagttcttccacaacccccaagcaattgacatcgaatcagaggacttttcatcactgcccccagaagtaaagcacgaaatactcacggacatgaaggagtttactaagaggaggcgaacccttttcgaggccatgcctgaagaatccgatgacttctctcagtatcaattgaaaggcctgctcaagaagaattatctaaatcagcacatagagcatgtgcagaaagaaatgaaccagcagcattcaggacatatcaggaggcaatatgaggacgagggaggatttttaaaagaggtagaaagccgccgggtggtgagcgaagatacctctcactacattcttataaagggcattcaggccaagaccgttgccgaggttgactccgaaagcctgccaagttccagcaagatgcatggcatgtcttttgacgtcaaatcgtccccctgcgagaagctgaagactgagaaggagcctgatgccaccccaccttcaccaaggactctgctggccatgcaggcagcgttgctcggctcttccagcgaggaagaactggagagcgaaaatcggcgtcaggcaagggggcgaaatgcccccgctgccgtggacgaaggaagtatatcccctcgaactctgtcagccataaagcgagccttggatgacgacgaggacgtgaaagtgtgtgcgggcgatgatgtgcagacaggcggcccgggggcagaggagatgcgcattaacagcagtactgaaaacagcgatgaaggccttaaggttagggacggtaaagggattcccttcaccgctactctggccagctcatctgtgaatagcgcagaagagcacgtcgcctccaccaacgaaggtcgagagccgacggactcagttcccaaggaacaaatgtctcttgtgcatgttggtactgaagctttccccatcagtgacgagagtatgattaaagaccgcaaagatcgacttccgcttgaatccgctgtcgtgcgccattccgatgccccaggcctgcccaatggtcgcgagctgacgccagcttctccaacttgtacaaactctgtttccaaaaatgaaacacacgctgaagtcctggagcagcagaatgaactttgcccatacgagagtaaattcgactcaagcctgctatcgtccgacgatgagaccaaatgtaaacctaatagcgcaagcgaagtgataggcccagtgtcccttcaagagacgtcgtccatagtctccgtaccttccgaggcagtcgacaatgtggagaacgttgtcagctttaacgcaaaggagcacgagaacttcctggagactatccaggaacagcaaaccacagagtcggctggccaggacctgatctccattcctaaggctgtggaacctatggagatcgacagcgaggaatctgagagcgatgggtcttttatcgaggtgcagagcgtgatcagcgatgaggaactgcaggcagagtttcccgagacgtctaagccacccagtgaacagggagaggaagagctggttgggacacgcgagggagaggcccctgcagagtctgagagtcttctcagagacaattctgagagggatgacgtcgacggcgagccacaggaagccgagaaagatgctgaagatagcttgcatgagtggcaagatattaacttggaagagctcgaaacactcgagtctaatctgctggcccagcagaacagcctcaaagcccagaagcagcagcaggaaagaattgccgcaacggttacagggcagatgttcctggagtcccaggaacttctcaggctttttggtatcccatatattcaggcccccatggaggccgaagcacagtgtgccatcctggacttaactgaccagacgagtggaactatcaccgatgacagcgacatctggttgtttggagcacggcatgtgtatagaaacttcttcaacaaaaacaagttcgtggagtactaccaatatgtggacttccataatcagctgggcctggaccgaaacaagttgataaatctggcctacctcctgggctctgattacaccgaagggatcccaacagtcggttgtgtaacagccatggaaatcctgaacgagtttccggggcatggtctggaacctctgctgaagttcagcgaatggtggcatgaggcccagaagaatcccaagatccggccaaacccccacgacactaaggttaaaaaaaaattgcgaacgcttcaattgacccctggatttcccaatccagcagttgccgaggcctacctgaagcccgtagtggacgattctaaggggagtttcctgtggggcaaaccagacctggacaagattcgagagttttgtcagagatactttggctggaataggaccaaaacagacgagagtctatttcctgtattgaaacagttggatgcacagcagacccaactgagaatcgatagttttttccgactcgcgcagcaagagaaagaggacgctaagaggataaagtctcagaggttgaaccgagctgtgacgtgtatgctgaggaaagagaaggaggctgctgcctcggagatcgaagccgtctctgtggcaatggagaaggaatttgaattgctcgacaaggccaaaggtaagactcagaaaagagggatcaccaacacattggaggaaagttcctctctgaagagaaagcgattatctgacagtaaggggaaaaacacatgcggaggctttctcggagagacatgtctgtcggaatcatccgatgggtcctctagcgaagatgcagaaagctctagcctgatgaacgtacagcgtcggacagctgcaaaagagccaaagacctcagcctcagatagccagaattccgttaaggaagccccagttaaaaatggcggcgccactacatcatccagttctgactcagacgatgatggtggaaaggagaaaatggtcttagtgaccgctcggagcgtcttcggcaaaaagagacggaagttgcgtcgggcacgaggccgaaagcggaagacttag

SEQ ID NO: 24093 - DNA, 4836 bp, Artificial Sequence
  Description of Artificial Sequence: Synthetic coding sequence
cagggcgccgtgaagagcttctgcaccagcgccagcggcgcccccctcggcccaaaaggagatggccactatccctggtcctgccccgtaacccacacgcgggagaaaatatatgccatctgcagcgattatgcttttttaaatcaagctacctccatttataaaacccccaacccaagccgctctccttgcttgccagattctacctccctctcagctggaaataactcctcccgctatatcggaatccccacaagcacttctgaaattatttacaacgaagaaaacagcctcgagaacctgtcaaattctctaggcaagctgccgctggcgtgggagatcgataaatccgagttcgatggcgttaccactaacagcaaacacaagtctggcaacgctaagaagcaggtatctaaacgaaagacatcagataaaaaagggagatatcagaaggagtgtccacaacactccccattggaggacatcaaacagcggaaggtactcgacctgcgccggtggtattgcatcagcaggccacagtacaagactagttgcgggatatcctctctgattagctgttggaattttctgtatagtacaatgggagcaggcaacttgcccccaattacacaggaggaggcgctgcatatcctgggctttcagccgccatttgaagacattaggtttggccccttcactggtaacacgacactaatgcgttggtttcggcagatcaatgaccattttcatgtaaagggatgcagttatgttctctacaagcctcacggtaagaacaagactgctggagagactgcctcgggcgccctgtctaagctgacccgcggtctcaaggatgaaagcctcgcctacatctaccattgtcagaaccattatttttgtcctattggattcgaagccacacccgtgaaggcaaacaaagccttttctcgcggccctctcagcccccaggaggtcgaatactggatcttgattggcgaaagctctcgaaagcatcctgccattcactgtaagaaatgggcagacattgtaaccgatcttaatacacagaatcccgaatacctcgacatacgtcacctggaacggggacttcagtaccgcaaaacaaaaaaagtaggcggcaacctgcactgtataatagcatttcagcggctgaattggcagagattcggcttatggaactttccatttggcactatcaggcaggagagccaaccccccacccacgcgcaagggattgcgaagagcgaatcggaggacaacatcagcaagaagcagcatggccggcttggtcggtcttttagcgcttcatttcaccaggactctgcctggaagaaaatgtcaaatatttctatctggctgaatcaagcacttaagggtgtgagagaccgtcatgggaattctattgaaaacccccaccttcttaccctgttccacagactctgtaaactgctgttttttcggatcaggcctatctttgtcttcgacggggacgcccctctgcttaaaaagcagacactggtcaaacgaagacagagaaaagacctggcatcatcagactcaagaaaaaccacagaaaagctgctgaaaacgttcctgaaacggcaggctattaagactgccttcaggtccaaaagagacgaggccctgcccagcctgacacaggtcagacgggagaacgacctgtatgtacttccgccattacaggaggaagaaaaacacagcagcgaagaagaggatgaaaaggagtggcaggaacgaatgaaccagaaacaagccttacaggaagaattcttccataatccgcaggccatcgatatcgagtctgaggacttttcgtccttgcccccagaggtaaaacatgaaattttaacagacatgaaagaattcacaaaaaggagacgcaccctctttgaggcgatgccagaggaatctgacgatttcagccagtatcagctcaaaggtctgctgaaaaagaactacctgaatcaacacatcgagcatgtgcagaaagagatgaatcagcagcatagtggtcatattcggagacagtatgaagacgagggtggtttccttaaagaggtggagagccgacgcgtcgtgagtgaagacacttcgcactatatcctgatcaaggggattcaagcaaaaaccgtggcagaagtcgacagtgagagtctgccctctagcagcaaaatgcatggaatgagctttgatgtaaaaagttctccctgcgaaaagctgaagacagagaaagaacctgatgctacccctccttctcccagaacgctgctggcaatgcaagccgccctgctaggttcaagctcagaggaagaattggagagcgaaaaccgtaggcaggcacgcggcagaaacgctcctgcagctgtggacgaaggttcaatctccccacggaccctcagtgcaatcaagagagcgctcgacgatgatgaggacgtgaaggtgtgcgcgggcgatgacgtccagactggaggacccggcgccgaagaaatgcgtatcaactcctctacagagaattctgacgagggacttaaagtgcgagacggaaagggcattccttttaccgctactctggcaagcagcagtgtgaacagcgccgaagagcacgttgcctctactaatgaggggagggagccaaccgactccgtgcctaaggagcagatgagcctggttcacgttggcaccgaggcctttcccatttctgatgaaagtatgatcaaggatcgcaaggatcgcctgcctctcgaatcagccgtggtgcgccatagcgatgcccccggtctgccgaatggtcgcgagctcactcccgcgtcccccacctgcactaactcagttagcaagaacgagacccatgctgaagttctggaacagcagaatgagctttgtccctatgaatctaagtttgatagtagccttctgtcgtctgatgacgagacaaagtgcaaaccaaatagcgcatcagaggtcatcggccctgtctctctccaggagacttcctcaatcgtctccgtcccttccgaagccgtggacaacgtcgaaaacgttgtctcttttaatgccaaagagcatgagaattttctggaaaccattcaggagcagcagaccactgaaagcgccgggcaggatctgatatctatccccaaggctgtggagccaatggagattgactcagaggaatcagaatctgacgggtcctttatcgaagttcagagcgtcatctctgatgaggagttgcaggccgagtttccagagacctccaagcccccatccgagcagggggaggaggagcttgttgggactagggagggggaggcccccgcagaaagtgagtctctgttgcgggacaactctgagcgagatgatgtagacggggaaccacaggaggccgagaaagatgccgaagacagcttacacgaatggcaggatatcaacctggaggagctggagacactggaaagcaacctgctggctcaacagaactccctaaaagcccaaaaacagcagcaggaacggattgccgctacagtcacaggacagatgtttctggaaagtcaagagctgctgaggctgttcggcataccttacattcaggcgcctatggaggcagaggctcagtgcgctatccttgacctgaccgaccagacctctggcactatcaccgatgactccgatatatggctttttggcgccaggcacgtttatcgcaactttttcaataaaaacaagtttgtagaatattaccagtatgtggattttcacaaccagctcgggctcgatcgaaataagctcatcaacctggcgtatctgctcggaagcgattacacggagggaataccaactgttgggtgtgtaaccgccatggaaatcctgaacgaattccctggccatgggttggaaccattattaaaattctcagaatggtggcacgaggcccagaagaatcccaagatcagacccaaccctcacgacactaaagtgaaaaaaaagctccgaaccctgcagctgacccctggctttcccaatcctgctgtggctgaagcatacctgaagccagtggtggatgacagcaagggttcattcctctgggggaagcccgaccttgacaagatccgcgagttttgccagcgttacttcgggtggaaccgcacgaaaacagacgagtcattgtttccagtgttaaaacaactggacgcccagcagacgcagctccggatagattcgttttttcgactggcgcagcaggaaaaggaagatgccaaacgtatcaagtcccagagactcaaccgggcggtgacctgcatgttgcggaaagaaaaagaggctgcggccagcgagatagaagccgtttccgtggcaatggaaaaagaatttgaactcttggataaagcgaagggcaaaacacagaagaggggtatcaccaacaccctcgaggagtcctcatccctaaagcgaaagcgtctaagcgatagtaaagggaaaaatacgtgcggcggctttctcggtgaaacttgtctgtcagaatcgtctgacggctcatcttccgaagatgcagagtcttcctctcttatgaacgtccagagaagaaccgccgccaaggaacctaagacgagcgccagcgactcccaaaattctgtgaaagaagcaccagtgaaaaatggcggagcaacaacatcctcttcttctgattccgatgacgacggcggcaaggagaaaatggttctcgtgacagcgcgttctgtgttcgggaagaaaagaagaaagctgagacgagctcgcgggcgcaagaggaaaacctag

SEQ ID NO: 24094 - DNA, 699 bp, Artificial Sequence
  Description of Artificial Sequence: Synthetic coding sequence
atgggcgtgcagggcctgtggaagctgctggagtgcagcggccggcaggtgtcgcctgaggccctcgagggcaagattttggctgtcgacataagcatctggctgaaccaggcccttaaaggggtccgggatcgccatggtaactcaatcgagaatccgcatctacttactctcttccaccgtctatgcaaattgctcttcttccgaatcaggcccatattcgtgttcgacggagacgccccactgctgaagaagcagaccctcgtgaaacggcgccagagaaaagatctggcctctagcgattctcgaaagaccacagagaagcttctgaaaacctttctaaagcggcaagctatcaaaactgcctttcgctctaagagagacgaggccctgccatctctcacgcaggttagacgcgaaaatgatctgtatgtgttgccacctctgcaggaggaggagaagcattcttccgaggaagaagacgagaaggagtggcaggaaagaatgaatcagaagcaggctctgcaggaggagttttttcataacccacaggccatcgatattgagtccgaggacttcagttctctgccgccggaggtcaagcacgagatcttaaccgacatgaaggagttcaccaagcgtcgtcggaccctgttcgaggccatgcctgaagtgtacctacccttgcttcagccctag

SEQ ID NO: 24095 - DNA, 4482 bp, Artificial Sequence
  Description of Artificial Sequence: Synthetic coding sequence
atgcccaacgagggcatcccccacagcagccagacccaggagcaggactgtctgcagagccagccggtcagcaataacgaggaaatggccataaagcaggaaagtggcggagatggtgaggtggaagaatatctgtcattccgatctgttggggatggactctccacaagtgcagttggatgcgcgtctgcggccccaaggaggggtcctgccctgctccacattgaccgccaccagattcaggctgtcgaaccaagcgcccaggccctggaactccagggactgggtgttgatgtttacgatcaagatgtcctggaacagggcgtcctacagcaggtcgacaacgccatccacgaagcctccagggctagccagcttgttgacgtggagaaggagtaccgcagcgttctggacgacctcactagctgtacaacctccctaaggcagatcaacaagatcatcgaacagctgtctccccaggcagcaaccagccgcgatataaatcgaaaactggattctgtcaaacggcaaaaatacaataaagagcagcaactcaaaaagattaccgccaagcagaaacatctgcaagctatcctaggcggggcggaagtcaaaatcgaactcgaccacgcgtcccttgaagaggatgccgagcctggccccagctccctcgggagcatgctgatgccagtgcaagagacagcctgggaggagctgattcgcactggccagatgacaccattcggcactcagatccctcagaagcaggagaagaagcctcgcaaaatcatgctcaacgaagctagtgggtttgaaaagtacctcgccgaccaggctaagttaagctttgagcggaagaagcagggatgcaataaacgtgcagctagaaaagcccctgcgccagtaacaccacccgcccccgtccaaaacaagaataagccaaataaaaaggcccgcgtgctgtccaagaaggaggagcggctaaaaaagcacatcaagaaactccagaagagggcgttacaattccaaggaaaagtagggctaccaaaggctcgacgcccctgggaatccgacatgaggccagaggccgagggagacagtgagggagaggaaagcgagtacttccccactgaagaggaagaagaagaagaggacgacgaggtagaaggtgcagaggccgatctgtcaggcgacgggaccgactacgagttgaagccattgccgaagggcggcaaacgccagaagaaagtgccagttcaggaaatcgatgatgattttttcccatcctctggggaggaggcagaagcggcttcggtaggggagggtggcggtgggggccgcaaagtggggcgctatagagatgatggcgacgaagactactacaagcagagactccgcaggtggaataaattacggttgcaagataaagagaagcgcctcaagctcgaagacgattccgaagagtctgacgcagagtttgatgaagggtttaaagtcccaggattcctgtttaaaaaactatttaagtatcagcagacaggcgtgcgatggctgtgggaactacactgccagcaagccggtggcatcctcggagatgaaatgggtctaggtaaaaccatccagataatcgcattcctggccggcctctcttattcaaaaattcgcacaaggggttccaactaccggtttgagggactggggcccacggtgatcgtgtgccccaccacagtgatgcaccagtgggtcaaggagttccatacatggtggcccccatttcgcgtagccatactgcatgaaaccggatcctacacacataaaaaggaaaagctgatcagagacgtagcccattgtcacggaattctcattacctcttattcttacatcaggctcatgcaagatgacatctcacgctatgattggcactacgtgattttggacgaaggccacaaaattaggaatcctaacgcagcagtgaccctggcctgcaaacagttccggacgcctcacaggattatactctccgggtctccaatgcagaataatctgcgcgaactctggtcactcttcgatttcatattccctggcaagcttggcacactgccggtgtttatggaacagtttagtgtcccaatcacaatgggcggctatagtaatgcttctcccgtgcaggtgaagacagcatataaatgtgcatgtgtcctgagggacaccattaacccatacctcctgcgccgcatgaaaagcgacgtgaagatgtccctctccctcccggataaaaacgaacaggtgctattttgtcgattgactgatgagcagcacaaggtctatcaaaactttgtggactccaaagaggtgtatagaattctcaacggcgagatgcagatcttttctgggttaatagctctacgcaaaatttgtaaccacccagatctgtttagcggaggtcccaagaacctgaagggcctgcccgatgacgaactggaggaggatcagtttggttactggaaacgcagcggaaagatgatcgtggtggagagtctgcttaaaatttggcacaagcaaggccaacgggtgttgttgttcagtcagtccaggcaaatgctagacatacttgaggtgtttttaagggcccagaaatacacctacctaaagatggacggcactactaccatagcctcccgccagcctcttatcacccggtataacgaagacacctccatcttcgtattcctgcttaccacgagggtgggaggactgggcgtgaatttaacaggtgccaaccgggtcgtgatctatgaccctgactggaatccatccacagatacgcaagcacgagagcgcgcttggagaatcggccagaagaagcaagttacagtatatcgcctcttgaccgccggaaccattgaggagaagatttaccaccgccagatctttaagcagtttctgacgaaccgggtactcaaagatccaaagcagagaaggttttttaagtccaatgacctctacgagctatttacactgacctcccctgacgcttcccagtcgactgaaacttcagccatttttgcagggactggatctgacgtgcagaccccgaaatgccacctcaagaggcgtatacagcctgccttcggtgccgaccacgatgtacccaaaaggaaaaaatttcccgctagcaacatttccgtgaatgacgccacttcctccgaagaaaaatcggaagcgaaaggtgctgaggtgaacgccgtgacgtctaataggagtgacccgctgaaggacgatcctcacatgagctctaatgttacgagtaatgacagactgggtgaagaaacaaatgccgtgtctggtccggaagaactctcagtgatcagcggtaacggcgagtgctcaaactcctccggaacgggtaaaaccagcatgccatcaggtgatgagtctatagatgaaaagctgggcctttcctacaagcgagaaaggccctcacaggcacagactgaagcgttttgggaaaacaagcaaatggaaaacaatttttataagcacaagtccaagaccaagcaccactctgtggcagaggaagaaacgctcgagaaacatttgcgaccaaagcagaagcccaagaattctaagcattgccgggacgccaaattcgagggcacacgcatccctcatctggtgaagaaaaggagatatcaaaagcaggacagcgagaacaagagtgaggccaaagaacagtccaatgatgattatgtgctagagaagcttttcaaaaaatccgtgggagtccacagtgtcatgaaacacgacgccataatggatggagccagtcctgactacgttctcgttgaagctgaagcaaacagagtcgcccaggatgctctgaaggctctccggctgtctagacagaggtgtctgggagctgtgagtggcgtgccaacttggaccggccaccgcggtattagtggcgctcccgcagggaaaaagtcccgatttggaaagaaacgtaacagtaattttagcgtccaacaccccagcagtacaagtccaacggaaaaatgccaggatgggattatgaaaaaggagggaaaggataacgtccctgagcacttctctgggagggccgaagatgctgacagctcttcaggccccctggctagtagcagcctgctggctaagatgagagcccgtaatcacctgattctgcctgagagactggaaagcgagtcaggccatctgcaagaggcatctgctttgctcccaaccactgaacacgacgatctcttggtggaaatgcgaaatttcatagccttccaagctcatacggatggtcaggcttccactcgcgagattttgcaggaatttgagtccaaactttctgcttcccagagttgcgtgttccgagagctgctgcgcaacctgtgtacatttcataggacctccggtggggaggggatttggaagctgaagccagagtactgctag

SEQ ID NO: 24096 - DNA, 2613 bp, Artificial Sequence
  Description of Artificial Sequence: Synthetic coding sequence
cagcagcccttccaccggcacctgctgatgaccaccgccctgcactccgagaagctcatacgggacgttgcgcattgccatggaatcctgataaccagctattcttacattcgactcatgcaagatgatatcagcaggtatgattggcattatgtcattctggacgaagggcataagatcaggaaccccaacgccgctgtgacccttgcctgcaaacaattccggacgccgcatcgcattatactctccggctccccaatgcagaataatctcagagaactatggtccctgtttgattttatttttccaggcaagttagggaccttgccggttttcatggaacagttttctgtgccaataacgatgggcggatacagtaatgcgtctcctgtccaggtcaagaccgcctataagtgcgcctgcgtcctccgcgatactatcaacccttacctcctgcgcagaatgaaaagcgatgttaagatgagcttgagcttaccggataaaaatgagcagatcttctctggacttatcgcgctgcgaaaaatctgcaatcatcctgatctgtttagcggaggtccaaaaaacctcaaggggcttccagacgacgaactggaggaggaccagtttggctattggaagcgctccggtaagatgatagttgttgaaagtctcttaaagatttggcacaagcagggccaacgggtattgctgttcagtcagtcaaggcagatgctggacatactggaggtgttcctcagggcccagaaatacacgtacttgaagatggatgggaccaccacaatcgcgtccaggcagcccttaataactcgatacaacgaagatacttcaattttcgtttttctgttaactacccgggttggcggtctgggagtgaacctgactggcgctaaccgcgttgtcatttacgacccggattggaacccgtctactgacacccaggcccgcgagcgagcgtggcgaatcggacaaaaaaagcaggtgacagtgtaccgcctcttgactgcgggaaccatagaagagaagatctaccatcggcagatctttaaacaatttctgacaaaccgagtattaaaggatcctaaacagcgacgatttttcaaatctaacgatctgtacgaactgtttaccctcacctcacccgacgcaagtcagtccactgaaacatctgctattttcgctggaaccggatcagatgttcagacgccgaagtgtcacctgaagcgaaggatccagccagcctttggtgcagaccatgatgtgccaaagcgcaagaagttcccagcatcaaacatatctgtgaacgatgccaccagtagtgaggagaagagtgaggccaaaggtgctgaggtcaatgccgtcacgagtaatagatccgatcccctgaaagacgatccacacatgtcttcgaacgtgacatccaacgaccgactgggcgaagaaaccaatgccgtgtccggacccgaggaactgtcagttatctcaggtaacggggagtgcagcaatagctccggcaccgggaagacgtccatgccctctggggatgaaagcattgatgagaagttaggactgtcctataagcgcgagagacccagccaggcacagaccgaggccttctgggaaaataagcagatggagaacaacttctacaagcacaaatccaagacgaagcatcactcggtggcagaggaggaaacccttgaaaagcaccttagacctaagcagaagcccaagaactccaagcattgccgcgatgctaaattcgaaggcactcgcatccctcacctggtgaagaagcggaggtatcagaagcaggattcggagaataagagcgaggcaaaggagcagagcaacgatgattacgtactcgagaagttgttcaaaaagtccgtaggagttcactccgtgatgaagcacgatgccatcatggatggggcttcaccagactacgtcctggtagaggcagaggcaaatcgagtagctcaggatgcactgaaggcattgcgactgtccaggcagcggtgccttggagcagtcagcggcgtccccacctggacaggccaccgcggcattagcggagctcccgcaggaaagaaaagcagatttgggaaaaagagaaatagcaacttttctgtccaacatccaagctccacttctcctaccgagaaatgccaggacggcattatgaagaaagagggaaaggataatgtgcctgaacactttagtgggagggctgaagatgctgacagtagctctgggcccctggccagtagctccctccttgctaagatgagagccagaaatcatttgatactgccagaacggctcgagtcggaatcgggccatctccaagaggcttcagctctcctgcccacaaccgaacatgacgatttactggtggagatgcgtaactttatcgccttccaagcccacaccgacgggcaggcctctaccagagagattcttcaagagtttgagtccaaactgagtgctagtcagagttgtgtttttcgggagctcctgagaaatttatgcacttttcacagaacatccggaggagaagggatctggaaactgaagcctgagtactgctag

SEQ ID NO: 24097 - DNA, 540 bp, Artificial Sequence
  Description of Artificial Sequence: Synthetic coding sequence
atgcccaacgagggcatcccccacagcagccagacccaggagcaggattgcctacagagccagcctgtgtccaacaacgaggagatggcaattaagcaagaatcgggtggcgacggggaagttgaggagtacttgagctttcgttccgtgggtgacggcctgtccacctccgctgtggggtgcgcgagcgccgcgccgcgcaggggacccgcgttattgcacattgatcggcaccaaatccaagcagtcgagccaagtgctcaggctcttgagctgcagggtctgggtgtcgatgtgtacgaccaggacgtcctggaacaaggggtgctgcagcaggttgacaatgccatacatgaagcgtctcgagcctcacagcttgtggacgtagaaaaggaataccgcagtgtgctcgacgacttgaccagttgcacaacttccttgagacagatcaataaaattatcgagcagttgagccctcaagctgccacctcacgtgatatcaaccgaaaactcgattcggtgaaacggcaaaaatattag

SEQ ID NO: 24098 - DNA, 318 bp, Artificial Sequence
  Description of Artificial Sequence: Synthetic coding sequence
atgagcctgagcctgcccgacaagaacgagcaggtgctgttctgccgtttaacagacgagcaacataaagtctaccagaattttgtggacagcaaggaggtgtaccgtattttaaacggcgagatgcaggaggtcctgcagtccttcacatcaatccacctgcacgaatctcctctaaatttcttcaggagtttccaggtaagagggtcccggtcccattaccccggaaagggcatgcaaactacactaggcatcgttaacttcttggtggtaactcttaaaagaaaaaagcgtaaccgcttctcacctgatctgtag

SEQ ID NO: 24099 - DNA, 2592 bp, Artificial Sequence
  Description of Artificial Sequence: Synthetic coding sequence
atgcaggacgacatcagccggtacgactggcactacgtgatcctggatgagggccacaagatccgtaaccccaacgccgccgtgactctggcatgtaaacagttccggacaccacatcgaatcatcttatctgggtctcctatgcagaacaacctaagagagctgtggagcctctttgattttatcttccccggaaagttgggtacactccctgtgtttatggagcagttcagcgtcccaattacgatggggggctattccaacgctagccccgttcaggtcaagacagcctacaaatgcgcttgcgtgctgcgtgacaccattaacccctatctgttgcgacgcatgaaaagtgatgtcaaaatgagcctgagcctgcctgacaaaaacgaacaggtactgttctgtagactgacagatgaacagcataaggtgtaccagaacttcgtggactccaaggaagtctaccgtatactaaatggtgagatgcagatcttcagcggacttatagcgctccgtaagatctgtaaccaccctgacctctttagcgggggccccaaaaacttgaaagggttgccagacgatgaactggaagaggatcagttcggttattggaagcgatctggcaagatgatcgtggtggaatctctgcttaaaatctggcataagcagggccagagggtgcttttgtttagtcagtcccggcagatgctggatattctggaggtcttcctgagagctcagaagtatacctacctgaagatggatgggactacaaccatcgccagtaggcaaccgctaatcacacgctacaacgaagacacctccatctttgtgtttctgttaacaacccgcgtgggaggtttgggtgtgaacctcacaggggcaaatagagtggttatttatgatccagactggaacccttccaccgacactcaggcaagggagcgtgcatggagaattggccagaagaagcaggtgaccgtctacaggcttctgactgctgggaccattgaagagaagatctaccaccggcagatctttaagcaatttctgaccaatagagtgttgaaggacccgaaacagcggcgcttcttcaaatctaacgatctgtacgaactttttaccctaacaagccctgatgcaagccaatccacagaaacgtcagccattttcgccggtacagggtccgatgtgcagactcccaaatgtcatttgaaacgcagaatccagccggcatttggagcggaccatgatgttcctaagaggaaaaagttccctgccagcaatatttcagttaacgatgctacctcatccgaggagaagtctgaggctaagggagcagaggtcaacgctgtaaccagcaatcgttccgaccctctgaaggatgatcctcacatgagcagcaacgtgacctcgaatgataggctcggtgaggagaccaatgctgtgtctggaccagaggagctctccgtcatctccggtaacggagagtgctctaactcttcaggaacagggaagactagcatgcccagtggcgacgagagcattgacgagaaattgggcttgtcctacaaacgagagaggcctagtcaggcccagaccgaggcattttgggaaaataagcagatggagaacaatttttacaagcacaaaagcaaaacaaagcaccacagcgttgctgaggaggagactctggaaaagcacttaaggccaaagcagaagcccaagaacagcaagcattgccgggatgctaaattcgagggtacaaggattccccatctggtcaaaaagagacgttaccagaagcaggatagtgaaaataagagcgaggcgaaggagcaaagtaatgacgattatgtgcttgagaaacttttcaaaaagtcggtgggcgttcactcagtaatgaagcacgatgccatcatggatggggcttcaccggattatgtactagtcgaagctgaggcaaatcgggtggctcaggacgctctcaaggctctgcggctgagtaggcaacgctgccttggagctgtgtccggtgtgcccacatggaccggccacaggggcatctcaggggctccagctgggaaaaagagccggttcggtaagaagcgtaattccaattttagtgtccaacatccctctagtacttcccccacagaaaagtgtcaggacggaatcatgaagaaggaaggaaaggacaatgtacccgagcactttagcggcagagcagaagatgcagatagttccagcggccccttggcatctagttctcttttagctaagatgcgcgccaggaatcatctgatactgcctgagaggcttgagtcagagagtggacatttgcaggaggcgagtgccctcctccccacaactgagcacgacgacctcctggtggaaatgcggaacttcatcgcctttcaggctcacactgacggacaggcctcaactcgtgaaatcctacaggagtttgaatccaagctctccgcctcacagtcatgtgtgtttagggaacttctgaggaacctgtgcacctttcatagaacatccggcggagaaggtatatggaaacttaagcccgagtactgttag

SEQ ID NO: 24100 - DNA, 1191 bp, Artificial Sequence
  Description of Artificial Sequence: Synthetic coding sequence
atgctgggcttcctgagcgcccggcagaccggcctggaggaccccctgcgtctgcggcgagcagaaagtacccgcagggttctgggtttggaacttaataaggatagagacgtggagcggatacatgggggcggaatcaacactcttgatatcgagcccgttgaaggaaggtacatgctctccggagggtccgatggagtaatcgtgctctacgatctggagaattctagtagacagtcatattatacatgcaaagccgtgtgtagtattggaagggatcacccagatgtgcatagatattctgttgagaccgtccagtggtacccacatgatactggcatgttcaccagctcctcatttgataaaacactcaaagtttgggacacaaataccctgcagacagccgacgtgttcaacttcgaagaaactgtctatagtcatcatatgagtcctgttagcacaaaacactgcctcgtcgccgtcgggactcggggtccaaaagttcagctctgtgatctcaagtctggttcgtgtagccatattctacagggtcatagacaggaaattctcgctgtgagctggagtccaagatatgattacattttggcaactgcgagcgccgactcccgtgtgaagttgtgggacgtgaggagagcatcagggtgtctaattacactggaccaacacaacggtaaaaagtcccaggctgttgagtcagccaacactgcacacaacggcaaggtcaacggtctgtgctttacaagcgatggactccatcttttgacggtggggacggacaatcgtatgcggctgtggaattcttcgaacggtgagaacaccctggtaaactatggcaaagtatgtaataattctaagaaaggactcaagttcacggtgagttgcggatgtagttctgaattcgtttttgtgccatacggtagcaccatcgccgtgtatacagtttacagtggagaacagatcacgatgctcaagggtcactataagaccgtcgattgttgtgtttttcagtccaactttcaggaactatacagcggcagtagagactgcaacatccttgcctgggtaccgtctttgtatgagcctgttcccgacgatgatgagacaacaactaagtcccaactgaacccagccttcgaagacgcctggtcctcttccgatgaggaaggctag

SEQ ID NO: 24101 - DNA, 1017 bp, Artificial Sequence
  Description of Artificial Sequence: Synthetic coding sequence
atgctgagcggcggcagcgacggcgtgatcgtgctgtacgacctggaaaacagctcccgccaatcatactacacctgcaaggctgtctgttcaattgggagggaccacccggacgtccatcggtactctgtcgagactgtgcagtggtacccgcatgataccgggatgttcactagctcctcattcgataagacactaaaggtgtgggataccaacaccctgcagactgccgatgtgtttaacttcgaagagaccgtctacagccatcatatgagcccagttagcacaaaacattgcctcgtcgcagtgggaaccagagggccaaaagtgcaactctgtgatctgaagagtggctcctgctcacacatactgcagggccatcgccaggaaatcctggccgtgagctggagtcccaggtacgactatattcttgctaccgcgagcgctgatagtagggtgaagctgtgggacgtcaggagggcctcaggctgcctgattaccctcgatcagcataatggcaagaaatcccaggcggttgagtccgccaacactgcacataacgggaaggtgaacggactgtgtttcacctccgacggcctgcacctgctaaccgtcggaaccgacaacagaatgcgactgtggaattccagtaatggcgagaacaccctggtaaattacggtaaagtctgtaataacagtaaaaagggccttaagtttacagtgagttgcggatgttctagcgaatttgtgtttgtgccctacgggtccaccatagctgtgtacactgtctacagcggtgaacagatcactatgcttaagggccactacaaaacagtagattgctgtgtgtttcagagcaacttccaagaactctactcaggatcccgcgattgtaatatcctggcctgggttccctccctgtacgagcctgtgcctgacgatgatgagactacgacaaagtcacaactcaatcctgccttcgaggacgcctggtcatctagcgatgaggagggatag

SEQ ID NO: 24102 - DNA, 1188 bp, Artificial Sequence
  Description of Artificial Sequence: Synthetic coding sequence
atggccaccagcagcgcccccgccggcgtgcggacccggtacgccggcgtctttgtgaggacaccaaatggcttcggaggccccagttcaccctctgagtctcgggtaaacaccgaaagtttcggaacaggtattaacactctggacatcgagcctgtggagggacggtacatgctaagcgggggttccgatggcgtgatcgtgctctacgacctggagaacagttcacgtcaatcttactacacttgcaaagcggtctgttccataggacgagatcatcctgacgtccatcggtactcagtggagactgtgcagtggtacccacacgacactggcatgtttacgagctcctcatttgacaaaaccctcaaggtatgggataccaacacactgcaaaccgctgatgtgttcaacttcgaagagacagtgtactctcatcatatgagtcctgtttccaccaaacattgtctcgtcgccgtaggaaccagagggccgaaagttcagctgtgtgacttgaaatctggatcctgcagccatatcctgcagggccatagacaggagatcctggcagtcagctggtcaccaagatacgactatatcctggctactgcgtccgcagattcacgggtcaagctgtgggatgttagaagggcctccggatgcctgatcacattggatcaacacaatggaaaaaagtcacaggcagtggaaagcgccaataccgctcataatgggaaggtgaatggcctctgttttactagcgatggactgcaccttttaacagtgggtactgacaatcgcatgagactgtggaattctagcaacggtgaaaacacacttgtcaactacgggaaagtgtgcaacaactcaaagaaaggactgaaatttactgtctcctgtgggtgcagctccgaattcgtcttcgtgccctacggctcgacaattgcagtgtacaccgtgtattcaggtgagcagattactatgctaaaaggacattacaaaaccgtggattgctgcgtgttccaatccaacttccaggagctgtactccggaagccgtgactgtaatatcttagcatgggtcccgtcgttgtacgaacccgtccctgacgatgatgagactaccaccaaatcccagctaaatcccgcatttgaggatgcgtggtcctcatccgacgaagagggttag

SEQ ID NO: 24103 - DNA, 732 bp, Artificial Sequence
  Description of Artificial Sequence: Synthetic coding sequence
atgggctacaagtacatcaccatcggcacccggggccccaaggtgcagctgtgcgatctcaaaagcggaagctgttcccacatattgcaaggccaccgtcaggaaattctggcggtgagttggtcaccgcgttatgactatatcctggcaactgcgagcgcggacagtcgggttaagctatgggacgtgcggcgggcatccggatgcctcatcacccttgatcagcacaacgggaaaaagtcacaagccgtagagagtgccaatacggcccacaacggcaaagttaatgggctgtgtttcacttccgacgggctccatctgttgactgtcggcactgacaacagaatgcgtctatggaactcttccaatggtgagaatacccttgttaactacgggaaagtgtgtaataatagtaagaaaggtttaaagtttacagtaagttgtggctgctccagcgagtttgtgtttgtaccctacggcagtacaatcgccgtgtacaccgtgtatagtggggagcagattacaatgctgaagggacattataagaccgtcgactgttgcgtgttccagtctaattttcaggagctgtactcgggatcacgggattgtaacatccttgcatgggtgccaagcctttacgagcccgttcctgacgatgacgaaaccaccaccaaatctcagctcaacccagcctttgaggatgcctggtcaagtagcgacgaagaaggatag

SEQ ID NO: 24104 - DNA, 2541 bp, Artificial Sequence
  Description of Artificial Sequence: Synthetic coding sequence
atgggcatccagggcctgctgcagttcatcaaggaggccagcgagcccatccatgtgagaaagtacaaaggtcaagttgtcgctgtcgatacgtattgttggctgcataaaggagccatagcatgcgcagagaagctagccaaaggagaacctaccgatcggtatgtggggttttgcatgaaattcgtgaatatgctactgtctcacggtattaaacccatacttgtgttcgacggatgtacgttgcccagcaagaaggaagttgagcgttcccgccgagaaaggagacaggccaatctgctgaagggtaagcagctgctgcgggaaggcaaagtcagtgaggctcgggagtgttttaccagaagcatcaacattactcacgctatggcccacaaggtaattaaggcagcccgcagccagggagttgattgcctcgtggccccctacgaggctgatgcccagctcgcatacctgaataaggctggcattgtgcaggctatcatcacagaggattcagacctgctggccttcgggtgtaaaaaagtgatcctaaaaatggaccagttcgggaatgggctggagatcgatcaagcaaggctgggaatgtgccgccagctgggcgatgtattcacagaggagaaatttcggtacatgtgcatcctaagcggctgtgattatctctcatccctcagaggaatcggtctcgccaaggcatgcaaggtgctgcggttagccaataaccctgatattgtaaaggtcatcaaaaagattggtcattacctaaagatgaacatcaccgtgcctgaagattacattaatggcttcattagagcgaacaacacctttctttaccaactggttttcgatccaatcaagcgaaaattaatacccctgaacgcctacgaagatgacgtagatcccgaaaccttgagctacgccgggcagtatgttgacgatagcattgcgttgcagatagctctgggcaacaaagacatcaacaccttcgagcagatcgatgattataacccggatacggcaatgcccgctcactcacggagccacagctgggatgataagacatgtcaaaagtctgcaaatgtcagcagcatctggcaccggaactactcgccacggcccgagagtgggactgtgagcgatgccccacagctgaaggaaaatcctagcaccgtgggtgtggagagggtaattagtaccaaaggtttgaatctccccagaaagtctagcatcgtgaagagacctcgttccgccgagttatccgaggatgatcttttgagccagtatagcctgtctttcaccaagaagactaagaagaactcatccgaggggaacaagagcttaagcttctccgaggttttcgtccccgatctcgtgaatggaccaacaaataaaaagtcggtgtcaacacccccacggacgaggaataaattcgctacctttctccagaggaaaaatgaggagtccggcgccgtggttgtgcctggcactagatcgagatttttctgttcttcagatagcacagactgtgtatcgaataaggttagcattcagccacttgatgagacggctgtcaccgacaaggaaaataacctccatgaaagcgagtacggggatcaagaggggaaacgcttggttgataccgacgttgctagaaattcatccgatgacattcccaacaaccatattcccggggaccacataccagataaagctactgtgttcaccgatgaggagtcatattcctttgagagctcgaaatttacaaggacgatcagccctcctaccttagggactttgaggtcttgcttcagctggagcggtggactgggagatttctctcggacaccatcaccaagtcctagcaccgctctgcaacaatttcggcgaaaatctgacagcccaaccagtcttcccgagaacaacatgtcagatgtttcccagctgaagtccgaagagtcgagcgacgatgaaagccacccactgagagaggaagcatgttcatcgcaaagtcaggaatcaggcgagttctccctgcagagtagcaatgcctctaagctatcccaatgtagttccaaagatagtgactcagaggaatctgactgcaacattaagctgctggacagtcagagtgatcagacatcgaagctgcgcctgtcacatttttccaagaaagatacacccctcaggaataaggtgccaggactgtataagagctcttccgcggactccctgagtacaaccaaaataaagcccctaggaccggctagagccagtggtctgtcgaaaaaacccgccagcattcaaaagcgtaagcaccacaacgccgagaataagcccggactgcagattaaactcaatgaactgtggaaaaattttggatttaagaaagactccgagaaattgccaccttgcaagaaacccctgtcccctgtacgagataacattcagttgactcccgaagcagaggaagacatcttcaataagcccgagtgcggacgcgtgcagcgggctattttccagtag

SEQ ID NO: 24105 - DNA, 510 bp, Artificial Sequence
  Description of Artificial Sequence: Synthetic coding sequence
atgggcatccagggcctgctgcagttcatcaaggaggccagcgagcccattcacgtgagaaaatataagggccaggtagtggcagtagatacttactgctggttacataaaggtgcaatagcctgtgctgaaaagctcgccaaaggtgaaccgacagatagacggcgacaggccaacctcttgaagggcaaacagctgcttagagagggcaaagtgagcgaagcccgcgagtgctttacccgatccatcaacataacccatgccatggcccataaagtcattaaggcagcgcgatcacagggagtcgattgcctcgtggctccctatgaggctgatgcccaactggcctatctcaacaaggctggaatcgtgcaggccattatcaccgaagactcagacctgctagccttcggttgtaaaaaagtgatcctcaagatggaccagttcgggaatggacttgagatagatcaggctaggttaggaatgtgtcgccagcttggggacgtgtag

SEQ ID NO: 24106 - DNA, 2541 bp, Artificial Sequence
  Description of Artificial Sequence: Synthetic coding sequence
atgggcatccagggcctgctgcagttcatcaaggaggccagcgagccaatccacgtgcgcaaatacaaaggccaggtggtggcagtggatacctattgctggctgcacaagggggcaatcgcttgtgccgagaagctcgctaagggcgaacccactgaccgatacgtgggattttgcatgaagttcgttaatatgctactctcgcacggcatcaagccaattcttgtgttcgacggatgtactctaccttccaaaaaggaggtggagcggtctcggagggagcgcagacaagccaatttgttaaaggggaagcagctgcttcgtgagggcaaggtgagcgaagcgagggagtgctttacccggagcattaacataacgcacgccatggcacataaggtcattaaagctgctaggtcccagggcgtagactgtttagtcgctccctacgaggcagatgcccaactggcttacctgaacaaggcagggatcgtgcaggcgatcatcacggaggactccgaccttctggcgtttggatgcaaaaaggtaattctgaaaatggaccagtttgggaacggccttgaaatcgaccaggcacgactcgggatgtgccgccagctcggtgacgtgtttacggaggagaaatttaggtatatgtgtattctttccggctgtgactatctgagctccctgcgcgggatcgggctcgcgaaagcctgtaaggtgctgcgattggccaataacccggatattgtaaaggtgatcaagaagataggccattatttgaagatgaacatcacagtgccagaggactacatcaatggttttatccgggctaataataccttcttataccagctggtcttcgacccgatcaagagaaagctcatccccctgaacgcgtatgaggatgatgtggacccagaaaccctgtcctacgcaggacaatacgtcgacgattctatcgccctgcaaatcgcattgggaaataaggacataaacacgttcgagcagattgatgattataatcctgacaccgccatgcccgcacattcaaggagccactcttgggatgacaaaacctgccagaagagtgcgaacgtgagttccatctggcaccggaactacagccctaggccagagtctggcaccgtctcagatgcaccccagcttaaagagaacccttccacggttggcgtagagcgcgttatcagcacaaagggtctcaacctaccccgcaagtctagcattgtcaagcgccctcggagcgccgaattgtctgaagacgatctgctgagccagtatagtctttcttttacgaagaagaccaagaaaaattcttccgaaggcaacaaatcactctccttctccgaagtattcgttcctgacctggttaacggtccaactaacaagaagagtgtgtccacccccccacggactaggaataaattcgccacatttctgcaacggaaaaacgaagagagtggtgccgtagtggtgcctgggacccgatcacggtttttctgttcttctgatagcaccgactgtgtctctaacaaggtttcaattcagcccctggatgagacagccgtgacagacaaggagaataatttacacgaatcagaatacggcgaccaggaggggaagcgactggtagacaccgatgtggcacggaattccagcgacgacataccaaataaccacatcccaggcgaccatatcccggacaaggccacggtgtttaccgatgaggagtcctattctttcgaaagctccaagtttacaagaactatcagccctcctactcttggaacacttcggtcctgcttctcctggtctgggggtcttggagatttcagtaggactccgtcaccttcccctagtacagcactccaacaattccgaagaaagagtgacagccctacctcacttccagagaacaacatgtccgatgtctctcagttaaagagcgaggaatcatccgacgacgagtcccatcccctacgagaggaggcttgctcttcacagtcccaggaatcaggagaattctccttgcagtcatctaacgcatctaaactgtcccagtgtagctctaaggactcggatagtgaggagtcagattgtaacattaagctgttggattcccagtccgatcaaacatctaagctccgactctcccatttttcgaagaaggatacgccactgcgaaataaggtgcctggactttataagagctcctcagcggacagcctgtccactacaaaaattaaacccctcgggccggccagagcttctggactgagcaaaaaaccagcaagtattcagaagcgcaagcaccacaacgcagagaacaagcccggacttcagatcaagctgaatgaactatggaagaactttgggttcaagaaggatagcgagaaacttcccccatgcaagaaacccctgagtcccgtgagagacaacatccagttgacccccgaggcggaggaagatatttttaacaaacccgaatgcggccgggtgcagagagctatcttccagtag

SEQ ID NO: 24107 - DNA, 408 bp, Artificial Sequence
  Description of Artificial Sequence: Synthetic coding sequence
atgggcatccagggcctgctgcagttcatcaaggaggccagcgagcctatccacgtgaggaagtacaaaggacaggtcgttgctgttgacacgtactgctggctgcataagggggcaattgcctgtgcggagaaattggccaaaggcgagccgacagacaggtatgttgggttctgcatgaagtttgtcaacatgctgctttcacatggtattaagcccatcctagtcttcgatggctgcactttgccgagcaaaaaagaggtggagcgttcacgcagggaaagaagacaagcgaacctgttaaaggggaagcagctactcagagaagggaaagtgagtgaggccagagagtgcttcactcgaagcattaatattacgcatgcaatggctcacaaggtgattaagtag

SEQ ID NO: 24108 - DNA, 2412 bp, Artificial Sequence
  Description of Artificial Sequence: Synthetic coding sequence
atgggcatccagggcctgctgcagttcatcaaggaggccagcgagccaatccatgttcgcaagtataaggggcaggttgtcgctgtcgatacctactgctggttgcataagggcgcaattgcttgtgctgagaaactcgctaaaggtgaaccaaccgacaggtatgtgggcttctgcatgaaatttgtgaatatgcttctctcacacgggattaagcccatcctggtctttgacggctgcacgctcccttcgaagaaggaggtggagagaagccgcagagaacgacggcaagcaaacctcctgaaaggcaaacagctgctacgcgagggaaaggtcagcgaagcacgcgaatgttttactcgatctataaatataacacacgccatggcacacaaggtgatcaaggccgcccgcagtcaaggcgtcgattgccttgtggcaccctacgaggctgacgcccagctggcctatttgaataaggcagggatcgtccaggcgatcattaccgaagacagtgacctcttggcctttggatgtaagaaggtgatattgaaaatggatcagttcggcaatggacttgagattgatcaggcacgactgggtatgtgtcggcagttgggcgacgtctttacagaggaaaaatttaggtatatgtgcatcctctcaggatgcgattacctgtcctccctccgaggcattggactggctaaagcatgtaaagtgctcagactggcgaataatcccgacattgtcaaagtaattaagaagatagggcactatctaaagatgaatattaccgtgcccgaggattacattaatggcttcatccgcgcgaataatacctttctgtatcagctggtgttcgaccctattaaacgcaaactcattcctttgaacgcatatgaggacgatgttgacccagaaacgctgtcatatgcaggacagtatgtggatgatagtatagcgctccagatcgctctgggcaataaggatatcaacacattcgagcagattgatgactacaatccagatactgccatgcctgcccactccagaagtcattcctgggatgataaaacttgccagaagtcagctaacgtttcctctatttggcaccgaaattacagtcccaggcctgaaagcggcaccgtgtcagacgcccctcaattgaaagaaaatcctagcacggttggggtagagagggtgattagcacgaagggcctgaatttgccaaggaagagctccatcgtcaaacggcccaggagcgccgagcttagtgaagacgatcttctttcacagtactctctgtcttttactaaaaaaactaaaaagaattccagtgaaggaaataagtcccttagtttttcggaagtgttcgttcccgacctggtcaatggaccgacaaataagaaatccgtgtccacgcccccgaggactcggaataaattcgctactttcctccagcgtaagaatgaggagtctggcgccgtcgtcgtccccgggaccagatcacgctttttctgtagctcagactccacggactgtgtatccaataaagtttcgattcagcccctcgacgaaacggcagtcacagataaagagaacaacctgcacgaatcagaatacggagaccaggaaggtaaacggcttgtggatacggacgtagcccggaattcctctgacgacatcccaaataaccatatccccggcgatcacatcccagataaggccacggtgttcacagacgaagagtcctactccttcgagagctcgaagttcactcggaccatctcaccgcccaccctgggtacgctccgctcatgcttctcatggtccggcggtctgggcgacttttccagaacaccctctccatccccttctactgcactccagcagttcaggcggaagtcagacagcccaacaagcttgccagaaaacaacatgtctgacgtgagtcagctcaagagcgaggagtccagcgacgatgagagccatcctttacgagaagaggcatgcagttcccagtcacaggagagcggggagtttagccttcagtcttctaacgccagtaagctcagccagtgttccagcaaggactccgactctgaagagagcgattgtaacattaagttgcttgatagccagtcagatcagacgtctaagcttagactcagccactttagcaagaaagacaccccgctcaggaataaagttccagggctgtacaagagctccagcgcagactctctatctaccaccaagattaagccattaggacccgcccgagccagcggcctgagcaagaaacccgcctccatccagaaacggaagcaccataacgcagagaacaagccaggcctgcagatcaagttaaacgagttgtggaagaactttggttttaagaagttttag

SEQ ID NO: 24109 - DNA, 36 bp, Artificial Sequence; identical to SEQ ID NO: 10645
  Description of Artificial Sequence: Synthetic coding sequence

SEQ ID NO: 24110 - DNA, 2241 bp, Artificial Sequence
  Description of Artificial Sequence: Synthetic coding sequence
atgcaggccaagaagcggtacttcatcctgctgagcgccggcagctgcctggccctgttattctactttggaggccttcagttcagagcatcccgctctcattccagacgggaggagcactccgggagaaacggcctgcatcatccttcccccgatcatttctggcccaggtttccggatgcgctgcgaccctttgtgccttgggaccagctggagaatgaggattccagcgtgcacatcagcccacgccaaaagcgagatgccaatagcagtatctacaaagggaagaagtgccgtatggaatcttgctttgatttcaccctgtgtaagaagaacggatttaaggtctatgtttacccccagcagaaaggggagaagatcgccgagagctatcagaacattctcgccgctatagaagggtctcgcttctatacctccgacccgagccaggcctgcttattcgtgctgagccttgacactctggatagagaccagttgtcaccccagtacgtacataacctgcggtccaaagtgcagtccctccatctgtggaataatgggcgcaatcatctaatatttaacttgtacagtggcacttggcccgactatactgaggacgtggggttcgatatcggacaagctatgctcgctaaagcctccatctctacagaaaactttcgccccaattttgacgtgtcaatcccactcttttccaaggaccaccccagaaccgggggcgagaggggcttccttaaattcaatacaattccccccctccggaaatatatgctggtgtttaagggcaaaagatacctgacaggtataggctcggatacaaggaacgcgctgtatcacgtgcacaacggagaagatgtcgtcctgttgaccacttgtaagcacggcaaggactggcaaaagcataaggactcccggtgcgaccgggataacaccgagtacgagaaatatgactatcgcgaaatgcttcacaacgctaccttctgcctggtgccgcggggccgcaggctcgggtcattcaggtttctggaagcactgcaggcggcttgtgtccccgtaatgctctctaatggatgggagctgccttttagtgaggtgataaattggaaccaggctgctgtgatcggagatgaacgtctgctgctacaaattccttccacaattcggtccatccatcaggacaagatattagccctcaggcaacagactcagttcctttgggaagcctattttagctctgttgaaaagattgtcctgactaccctcgagattatccaggaccgaatttttaagcacatctcgagaaattctctcatatggaataaacaccccggcgggctgtttgtgctaccacagtactcctcatatctgggggatttcccctactattacgcaaatcttggcctaaagcctccatcaaagttcaccgcagtgattcatgccgtgactccgctggtgtctcagtcgcagcccgtgttgaagttattggtagcggctgccaagtcccaatactgtgcacagatcatcgtgctgtggaattgcgacaaacccttgcctgccaaacatcggtggccggccacagctgtgccagtagtggtaattgagggagaaagcaaggtgatgtcttcaaggttccttccatacgacaatattataacagacgctgtgctgtctttagacgaagatacagtgctgtctacaaccgaggttgatttcgctttcacagtttggcagagcttcccagagcgtatagtgggttacccagctaggagccatttctgggacaacagcaaggagcggtggggatacacctccaaatggacaaacgattatagcatggttctgacgggagccgctatctatcataagtattaccattatctgtattcccactacctcccagcaagccttaaaaacatggtggatcaacttgccaactgcgaagacatcttgatgaactttctggtctcggctgtcaccaaacttcctcccatcaaagttacacagaagaaacaatacaaagaaacaatgatgggccagaccagtagggccagtagatgggcggacccagaccacttcgcccagcgccagtcttgcatgaatacgtttgcctcctggtttgggtacatgcccctcatccattctcaaatgagattagacccagtattattcaaagatcaagtctctattctgcgcaaaaagtaccgagatattgagcgactgtag

SEQ ID NO: 24111 - DNA, 2157 bp, Artificial Sequence
  Description of Artificial Sequence: Synthetic coding sequence
atgtgcgccagcgtgaagtacaacatccggggccccgccctgatcccacggatgaaaaccaaacatcgaatctattatattaccctgttcagcattgttctcctcgggctgatcgcgactggcatgtttcaattttggccccactctatcgaatcttctaacgattggaacgttgagaaacgttcgatccgggacgtgccagtagttcggctccctgctgactcaccaattcctgaaagaggggatctaagttgccgcatgcacacctgtttcgatgtttacaggtgtggtttcaatccgaagaacaagattaaggtctacatttacgccctgaagaagtatgtcgatgacttcggagtaagcgtgtctaataccatcagtcgggaatacaacgagctcctcatggcaattagtgactctgactattacactgatgatataaatagagcttgtttgttcgtgcccagtatcgacgttctaaaccagaacactctgagaatcaaagagaccgcacaagccatggcccagctcagcaggtgggataggggtactaatcatctcctgttcaacatgctccccggaggacctcccgattataacacggcattagatgttccgcgggaccgcgcgttactggctggaggtggattcagtacctggacctacaggcaggggtatgacgtgagtatccctgtgtattcccctctttccgccgaagtggacctgcccgaaaaaggaccagggccccggcagtatttcctcctctcgagccaggtggggttgcatcctgagtacagggaggacctggaagccttgcaggtgaagcacggagagagtgtgcttgtcttggataagtgcacaaacctttccgaaggcgtgctgagtgttcgcaaacgatgccacaagcaccaggtatttgactatccgcaagtgctgcaggaagccacattttgtgtggttttgcggggagcccgattgggccaggccgtcctgagcgatgtgctccaagcaggctgcgttcctgtagtgattgcagactcatacatcctgccattttccgaagtgcttgactggaagagagctagcgtcgtagtgccggaggaaaagatgtccgacgtgtactctatcctgcagtcaatccctcagcgacagatcgaggaaatgcagcggcaagcccggtggttttgggaggcctactttcagagcatcaaggccatcgctctcgccaccctgcagatcattaatgatcggatttatccttatgctgctatttcctacgaagaatggaacgatccacctgctgtcaagtggggttccgtgtccaacccactgttcctgcccctgatccctccacaatcccagggattcaccgccatcgtgttgacgtatgatcgagtggagagcctcttccgcgtgattaccgaggtaagcaaggtgcctagcctgtcaaagctgctagtggtctggaacaatcagaataaaaacccacctgaggacagtctctggcccaagatacgggttcccctgaaggtggtgagaaccgccgagaacaaactttccaaccggttctttccctacgatgagatagagaccgaggccgtgctggcaatcgacgacgatatcatcatgctgacatcagacgagctgcagtttggttatgaagtctggagagagtttccagacaggcttgtgggctatcccggtaggctccacctgtgggatcacgaaatgaacaaatggaaatatgaaagtgaatggaccaatgaggtgtccatggtgctcacgggggccgccttttaccataagtatttcaattatctgtacacatacaagatgccaggcgacatcaaaaattgggttgacgcgcacatgaactgcgaggatatcgccatgaactttctggtagctaatgtgaccggaaaagctgtgatcaaggtcacgccaaggaagaagttcaagtgccccgaatgcacagcaattgacggactatctctcgaccagactcatatggtggaacgcagcgagtgcatcaataaattcgcgtccgtcttcggcacaatgccactaaaggtggtggaacatcgggcggacccagtgctgtacaaagatgacttccccgagaagctgaaatcctttcccaacattggcagcctgtag

SEQ ID NO: 24112 - DNA, 2187 bp, Artificial Sequence
  Description of Artificial Sequence: Synthetic coding sequence
atgtgcgccagcgtgaagtacaacatccggggccccgccctgatcccaaggatgaaaacaaagcacaggatttactatattacactatttagcatcgtgttgcttggcctgatagctaccggaatgttccaattctggccacactctatcgaatccagcaacgattggaatgtggaaaagcggtctatcagggacgtgcctgttgtccgcttgcccgcagactccccgatcccagaaagaggggacctgagctgcagaatgcacacctgctttgatgtgtatcggtgcggattcaaccctaaaaacaagatcaaggtgtacatctacgcccttaagaagtacgtggacgacttcggcgtatcggtgtccaacaccatttcacgagagtacaacgagttgttgatggccatttctgatagcgattactacaccgatgacatcaaccgggcttgcttgtttgtgccttcgatcgacgtgctcaaccagaatacattgaggattaaagagacggctcaggccatggcccagctatctagatgggaccgggggacaaaccaccttctgtttaacatgctgccaggggggccccccgattataacacagcgttggatgtgccaagggaccgggctctcttagccggggggggattcagcacctggacgtaccgacagggatacgatgtatctatacccgtgtactctcctctgagcgctgaggtcgacctgcctgagaagggccctgggcctcgacagtattttctcctatcttcccaggtcggccttcatccagagtaccgtgaggatctcgaagccctgcaagtgaagcacggcgagagcgttctcgtgctggataaatgcacaaatctatccgagggagttttaagcgtgcgtaagcgctgccacaagcaccaggttttcgactatccccaagtgcttcaagaggccactttctgtgttgtcctgagaggtgcgagactgggacaagcagtcctgtcggatgtgttacaggccggctgtgttccagtggttatcgcagattcctacattctcccattctcagaagtattggattggaagagggcaagcgttgtggtgccggaggagaaaatgtcagacgtctattcgatcttgcagtcaatcccccaacggcaaatcgaagagatgcagcgacagctgtttatggaacctgcacgacgggagaactggtccgccgcaaatcaccagatgaatagtctcatctggccacgggagcagtgggatagtcagattatcaacgatcgtatatacccgtatgccgccataagctatgaagagtggaacgacccccccgccgtgaagtggggctcagtcagcaatcccctctttcttccactgatacctccacaatcgcagggcttcactgctatcgtcctaacatacgaccgagtagagtctttgttccgggtgatcaccgaggtgagtaaagtacccagcctgtctaaactgctggttgtgtggaacaaccagaacaagaacccaccggaagactcgctgtggcctaagataagagtgcctctcaaggtggtgcgcaccgctgaaaacaaactcagtaaccgtttcttcccttatgatgaaattgagactgaagcagtcctggcaattgatgatgacatcattatgctgacatccgacgaacttcagttcggttacgaagtgtggagagagtttccagatcggctcgtgggctaccccgggagactccatctgtgggaccatgaaatgaacaaatggaagtacgagagtgagtggacaaacgaagtctctatggtgctaacaggagctgccttttatcacaagtatttcaactacttgtatacatataagatgccgggtgatataaagaattgggtcgatgcccacatgaattgcgaagacatcgctatgaatttcttggtggctaacgtcaccggcaaggcagtcataaaggtcacgcctaggaagaagtttaagtgcccagagtgcaccgcaatagacggcttgtcactggaccaaacccatatggttgagcgttccgaatgcatcaataagtttgcctcagtcttcgggactatgcccctcaaagttgtggagcaccgcgctgatccagtcctgtataaagatgattttcctgaaaaactgaaatcgttcccgaacatcggctccctttag

SEQ ID NO: 24113 - DNA, 2256 bp, Artificial Sequence
  Description of Artificial Sequence: Synthetic coding sequence
atgagctgcgccagcggcagcggcggcggcctgcggcaccccctgagatgtcagaaaccatgggatgaagaatgtgaagaagaggctgtttgcgtcatcatgtgcgcgtcggttaagtataatatccgtggtccggctctgatcccacggatgaagacaaagcaccgcatctattatattacactgtttagcattgtgcttctgggattgattgccacaggaatgttccagttttggcctcactctattgagtctagcaacgactggaacgtcgagaagcggtccatccgggatgtgccagtggttcgcctgccagccgactccccgatacctgagcgtggggacctgtcctgccggatgcatacatgcttcgacgtttatcgctgtggcttcaatcctaaaaacaaaattaaggtgtatatttatgctctcaagaagtacgttgacgactttggtgttagcgtgtcaaacacgattagtagagaatacaatgaactgctcatggcgatctccgatagcgactactacaccgacgacatcaaccgcgcatgtctatttgtgcctagcatcgatgtcttaaatcaaaacacgctgaggatcaaagagaccgcacaggctatggcccagctgtctagatgggatagaggcacgaaccatctgctcttcaacatgctccccggaggcccccctgattacaacactgcactggatgttccccgcgatcgggctctcttggcaggcggaggcttttccacctggacatatcgccagggctatgacgtctctattccagtgtattctcccctctctgccgaagttgacttacctgagaaggggcccggacccagacagtacttcctgcttagtagccaggtggggctccatcctgaataccgggaagacctggaagccctacaggttaagcacggggagtcggttttagtcctggacaaatgtactaatctttcggagggggtgctcagcgtccggaagcggtgtcataagcaccaggtttttgactatcctcaagtgttacaggaggccactttctgcgtggtcctccgaggggctaggctggggcaagctgtgctgtctgacgtgctacaggctgggtgcgttcccgttgtgatcgcagactcttatatcttaccgtttagtgaagtgctggattggaaacgtgcctcggtcgtagtgccagaggagaagatgagcgatgtttactccatcctgcaatcaatcccccaacggcagatagaagaaatgcaaagacaggctaggtggttctgggaggcctacttccagagcatcaaggccatagcgctggccaccctccagatcattaacgatcggatctacccctacgctgccattagctatgaggagtggaacgacccaccagccgtgaaatggggttctgtcagtaatcctctttttcttccactcatcccacctcaatctcagggctttacagctatcgtcctgacatacgatagggtcgagtctctgttcagggtcataacagaagtatcaaaagtgccctcactttctaagcttctggtagtttggaataaccagaacaaaaacccccccgaggatagtctgtggccgaaaattcgggtgcctcttaaagtagtacgaaccgcagagaataagctttctaaccgcttcttcccatacgatgagattgagaccgaggccgttttagctattgacgatgatattatcatgcttacctccgacgagttgcagttcgggtacgaagtgtggcgcgagttccccgataggctggtgggatacccgggccggttgcacctgtgggaccacgaaatgaataagtggaaatacgagtctgagtggacaaacgaagttagtatggtacttaccggagcagcgttttatcacaagtatttcaattatctgtacacctacaaaatgccaggagatattaagaattgggtcgatgcgcatatgaattgtgaggacatagccatgaactttctagtcgctaacgttaccggaaaagctgtgattaaagtgacaccacgcaaaaagttcaaatgtcctgaatgtacagccatagatggtctgtcattggaccagacacacatggtggagcgatcagagtgtatcaacaaatttgcatccgtgtttggcaccatgccactcaaagtggtggaacatcgcgctgacccggtcctgtacaaggatgactttcccgagaaactcaaaagcttccctaacatcgggagcctttag

SEQ ID NO: 24114 - DNA, 339 bp, Artificial Sequence
  Description of Artificial Sequence: Synthetic coding sequence
atgtgcgccagcgtgaagtacaacatccggggccccgccctgatcccccgaatgaagactaagcatcggatttattacattactctcttctcgattgtactgctgggattaatcgcaaccggtatgttccagttctggccacacagcatcgagagttccaatgactggaacgtggaaaagcgctctatccgggacgtccctgtcgtgaggctgcccgccgacagccccatcccagagcggggcgatctgtcttgccgtatgcatacatgttttgacgtctacagatgcgggttcaaccctaagaataaaattaaggtgtatatctacgcattaaagtag

SEQ ID NO: 24115 - DNA, 150 bp, Artificial Sequence
  Description of Artificial Sequence: Synthetic coding sequence
atgtgcgccagcgtgaagtacaacatccggggccccgccctgatccctagaatgaagacaaaacacagaatctattacatcacattgttctctattgtgctcctaggtctgatcgctactggcatgttccagttttggccacactcttag

SEQ ID NO: 24116 - DNA, 2157 bp, Artificial Sequence
  Description of Artificial Sequence: Synthetic coding sequence
atgtgcgccagcgtgaagtacaacatccggggccccgccctgatcccgaggatgaaaactaaacataggatctattacattacgttattctcgattgtgctgctgggcctgatcgcgactggtatgttccaattttggcctcactccattgagtctagtaatgattggaacgtcgagaaacgatccattcgggatgtgcccgtggtacgactgcccgcggatagccccatcccagaaagaggggacctctcttgtagaatgcatacctgctttgatgtataccggtgtggcttcaaccctaagaacaagattaaagtctacatctatgcactgaagaaatatgtcgatgattttggggttagcgtatcaaacactattagccgagaatataatgagctgctgatggctatctcagattcagattactataccgacgacattaatagggcctgccttttcgtcccctctatcgatgtgcttaatcaaaacactctgagaatcaaagaaacggctcaggcaatggcccagttaagtcggtgggatagaggaactaaccacttgctgtttaacatgcttccagggggaccaccggattacaacaccgcactggacgtaccaagggaccgtgccctgctggcggggggtggctttagtacttggacttacaggcagggctacgacgtgtccatacccgtttactctccattgtccgccgaagttgatctgccagaaaaggggccaggtccacgacagtatttcctgttgagcagccaggtgggcctccatcccgagtatcgtgaggatcttgaagctctgcaagttaaacacggtgaatccgtcctggtcctggacaagtgtacaaatctgtccgaaggagtgttgagcgtcagaaagaggtgtcataagcaccaggtgttcgactacccccaagtcctgcaagaggccacattctgcgtcgtcctcaggggggcccggctcgggcaggcagtgctgagcgacgtgctccaggcggggtgtgtgccagtagtgatcgcagacagctacattctcccgttctccgaggtgctggattggaaacgagcctcagtcgtggtccccgaggaaaaaatgagcgacgtgtattctatactgcagtccatcccgcaaaggcagattgaggagatgcaacgccaagccagatggttttgggaggcctacttccagtccatcaaggccatcgcactagcaaccctccagatcatcaatgaccgcatctatccgtacgccgctatctcctacgaggaatggaatgatcctccggctgtgaagtggggttcggtgagtaatccattgttcctgcccctcattccaccacagtcccagggatttactgccatagttctgacttacgacagggtggaatctctctttcgggtgataacagaagtgtccaaagtcccaagtctgagcaagctgctcgtcgtgtggaataatcagaacaaaaatccccctgaggatagcctctggcccaaaattagggtgcccctaaaggtagtacgcactgcagaaaataagctgtctaacaggttctttccctatgatgaaatagagacagaggcagtgctggctatcgacgacgacattatcatgctgacaagcgatgaactgcagttcggctacgaagtgtggcgggaattccctgaccgcctggtgggatatcctggcagactccacctgtgggatcacgagatgaacaagtggaaatacgagtccgagtggaccaacgaagttagtatggtgctaaccggcgctgctttctaccacaaatacttcaactacctctacacttataagatgccaggtgatatcaaaaactgggttgacgcgcatatgaactgcgaggacattgccatgaattttttggtagcgaatgtcacaggtaaggctgtgatcaaggttaccccccgcaaaaagtttaagtgtcccgagtgcacggccatcgacgggctatccttggaccaaactcatatggtagagaggtctgaatgcatcaataaatttgcatcagtgttcggaaccatgcccctgaaagtggtggaacatcgcgccgacccagttctttataaagatgacttccctgagaagctgaaaagtttccccaacatcgggtctttgtag

SEQ ID NO: 24117 - DNA, 1761 bp, Artificial Sequence
  Description of Artificial Sequence: Synthetic coding sequence
atgcccaagcccatcaacgtgcgggtgaccaccatggacgccgagctggagtttgctatccagccgaataccacgggaaaacaactgtttgatcaagtggtcaagaccatcggattgcgggaagtgtggtactttggtcttcattacgtggacaacaagggctttcctacctggctcaagctcgacaagaaagtctctgcgcaagaggtgagaaaggagaaccccctgcagttcaaattcagggctaagttttaccctgaggatgtggccgaagagcttatccaggatataacacagaaactgttctttcttcaggtcaaggaaggaatcttgtcagacgagatttactgtccacctgagactgccgtgcttttggggtcctacgctgtccaggcaaaatttggagattataacaaagaggtccacaaatccggatacctgtccagcgagagactgattccacagagggttatggaccagcataagttaactagggatcagtgggaggatcgaatccaggtgtggcacgccgagcacagagggatgctgaaagacaacgccatgctagagtatctaaagattgcccaggatcttgaaatgtatggtataaattacttcgagatcaagaataagaaaggcacggacttgtggttaggtgtagatgctttaggactgaacatctatgagaaagacgacaaattgacacccaagatagggttcccttggtcggaaatccgaaatatcagcttcaacgacaaaaaattcgttatcaaaccgatcgacaaaaaagctcctgacttcgtcttctatgctcctaggctgagaataaataaaagaatacttcagctgtgtatggggaaccacgaactttacatgcgtagacggaagcctgatacaatcgaagtccaacaaatgaaggcccaagctagggaagagaagcaccaaaaacagttagagcggcagcagctggaaactgaaaaaaagagaagggaaactgtcgagcgcgagaaagaacagatgatgagagagaaggaggaactcatgctccggctgcaggactacgaggagaaaactaaaaaagcagagagggaactgtctgagcagatacagcgcgcacttcaactcgaggaggagagaaaacgcgctcaggaagaggcagaacggctggaagctgataggatggccgctttaagagccaaggaggagctcgaacgccaggcagtggatcaaatcaaatctcaggagcagctggccgccgagttagctgaatatactgccaagatcgcattgcttgaagaggcacgtcggaggaaagaggatgaggtagaagaatggcagcaccgcgctaaagaggcccaggacgacctagttaaaactaaggaggagctgcacctggttatgaccgctccacctccacctccacctccggtctatgagccagtctcatatcacgtgcaggagtctctgcaggatgaaggagcagagcccaccgggtactcagccgagctgtctagcgaaggcatcagagatgataggaacgaagaaaagagaattacagaggcagagaagaacgagcgcgtccagcgacagctgctaacactgtcatcggagctctctcaggcacgggacgaaaacaagcgcacccacaacgatatcatacataatgagaacatgcgccagggccgggacaagtacaaaaccctgagacagattagacaggggaataccaaacagcgaatagacgaatttgaagccctgtag

SEQ ID NO: 24118 - DNA, 1761 bp, Artificial Sequence
  Description of Artificial Sequence: Synthetic coding sequence
atgcccaagcccatcaacgtgcgggtgaccaccatggacgccgagcttgagttcgcgatccaaccaaacacaacagggaagcaactattcgaccaggtagtgaaaaccatcggtttgagagaggtctggtacttcgggctacactacgtcgacaacaaaggtttcccgacctggttgaagttagacaagaaggtgtccgcgcaagaggttcgaaaagagaatcctctccagtttaaattccgcgctaagttctaccccgaggatgtggctgaggaattgatacaggacataactcagaagctcttcttcttacaggtgaaggagggcattctgtccgacgagatatactgcccgccagagacggccgtcctgctggggagctacgcggtgcaggccaaatttggcgattacaataaggaggttcataaaagcggctacctctcttcagaacgtcttatcccgcagagagtgatggaccagcacaagctcaccagagaccagtgggaggaccgcatacaggtatggcacgccgagcacagaggtatgctgaaggataacgccatgcttgaatatctcaagatagcccaggaccttgagatgtacggcatcaactactttgagatcaagaataagaagggtactgatttgtggctgggcgtcgatgcactgggtcttaacatctatgagaaggatgacaagctgactccgaaaatcgggttcccatggagcgagatcaggaatataagcttcaatgataaaaaatttgtcatcaagcccatagacaagaaagctccagattttgtcttttatgctccacgcctgcggatcaacaagaggatacttcagctgtgcatgggcaaccatgaactttatatgcgccggcgcaagcctgacaccatcgaggtgcagcagatgaaagctcaggctagagaagagaaacaccagaaacagctggaaagacagcagctggagactgaaaaaaagaggagggaaacagtcgagcgcgagaaagagcagatgatgagggagaaggaagagttgatgcttagactccaggactacgaagaaaagactaagaaggcggagagagagttgtccgagcaaatccagagagccctacagctggaagaagaacgcaaaagggcccaagaggaagcggaacgacttgaggcggatcgcatggccgcactccgcgccaaggaggaactggaacggcaggcagtggatcagataaagagccaggaacagttggccgctgaactggctgagtacacagccaagatagccctgttagaagaggcacggaggagaaaggaggacgaggttgaggaatggcagcatcgggcaaaggaggctcaagacgatctggtgaaaaccaaagaagagttgcacttggtgatgacagctccaccaccgccccccccacccgtctacgagcccgtcagttatcatgtgcaggaatctttgcaggacgagggtgcagaacccactggctactctgccgaactgtctagtgagggcattcgagatgacaggaatgaggaaaagcgaatcaccgaggccgaaaagaacgagcgggtgcagagacaactgttgaccttgtccagcgagctgtcccaagctcgtgatgagaataaacggacccacaatgacataattcacaatgagaacatgagacagggcagggataaatataaaacactgcgacagatccggcagggcaataccaaacagcggatcgacgagtttgaggctctatag

SEQ ID NO: 24119 - DNA, 1665 bp, Artificial Sequence
  Description of Artificial Sequence: Synthetic coding sequence
atgcccaagcccatcaacgtgcgggtgaccaccatggacgccgagctggagtttgcaatccagccaaacacaaccgggaaacagctctttgatcaggtcagcgcacaggaagtgcgaaaggagaatcctctgcagttcaagtttcgggcgaagttttatccagaggatgtggccgaggaactgattcaggacatcacccagaagctcttcttcttgcaggtcaaggagggcattctatcagatgaaatctattgtcccccggagacggccgtcctgctggggtcttatgcagtacaggctaaattcggcgattataataaggaagtgcacaaatccggataccttagcagcgaacggctcatacctcagcgcgttatggatcaacacaaactgacccgggaccaatgggaggaccggattcaggtttggcacgccgaacaccgaggcatgctgaaggataacgccatgctggaatacctgaagatcgctcaagatctcgaaatgtatggaatcaactactttgagattaaaaataaaaaaggaaccgatctgtggttgggcgtcgacgccctgggcctgaatatttacgaaaaggacgataagctgacgcctaaaattggcttcccctggtccgaaattcgcaatattagtttcaacgacaaaaagttcgtgatcaaacctatcgataagaaggcacccgactttgttttttacgcacccaggttacgcattaacaagagaatactgcagctgtgtatggggaatcacgagctgtatatgcggcgccgaaagccagatacaatcgaagtgcaacagatgaaggctcaggcacgcgaggagaaacaccaaaaacagctggaacgtcagcagctggagacggaaaagaagcggcgtgagaccgtggaaagagaaaaggaacagatgatgcgggaaaaagaggagctaatgctacgcctgcaggattacgaagagaagactaagaaggcagagagggaacttagcgaacagattcagcgcgctcttcagcttgaagaagaacgaaaaagggctcaagaggaggcagagaggttggaagcagacagaatggcagctttaagggcaaaagaggagctcgagcgtcaagccgtggatcaaatcaaaagccaggagcagctggccgccgagttagcagagtatacggctaagatcgcactcctggaagaagcaagacggcgtaaagaggatgaagtggaagagtggcagcaccgggccaaggaggcccaggatgacctggtaaagactaaggaagagctgcatcttgtcatgaccgcgccacccccccccccaccaccagtgtacgaaccagtgagttaccacgttcaagagtctctgcaggacgagggtgccgaacccaccggctacagtgccgaactgagctctgagggaatccgggatgatcgcaacgaggagaagcgaatcaccgaggcagaaaaaaacgagcgcgtccagaggcagctcttgactctgtcttctgaactgtcacaagcgcgcgacgagaataaacgcacacacaatgacatcatacataacgagaacatgcgccaagggcgcgataaatataagacactcaggcaaattcggcagggtaatacgaaacagcggattgatgaattcgaggctctgtag

SEQ ID NO: 24120 - DNA, 900 bp, Artificial Sequence
  Description of Artificial Sequence: Synthetic coding sequence
atgggcaccaaggcccaggtggagcggaagctgctgtgcctgttcatcctcgctatccttctctgcagtttagccctggggtccgtcaccgtgcattcgtccgaacctgaggtgaggattcctgaaaacaatcccgtgaagctaagctgtgcctattctgggttcagctcccccagagtcgaatggaaattcgatcaaggggatacaacccgcctggtttgctacaacaataaaattacagcttcatacgaggaccgggtcaccttcctgcccaccggcattacattcaagagtgtcactcgagaggatacaggcacttacacttgcatggtctctgaggagggggggaacagttatggggaggtcaaagtgaaactcattgtcctagtgccaccaagtaaacccacagtgaacatcccttcatccgcaacaatcggaaaccgggccgttctgacctgttcagagcaggatggatcccctccatcagagtacacctggttcaaagatggtatagtgatgcctacaaaccctaaatccaccagagctttttcaaactcctcttacgtgctcaaccccaccaccggcgaattggtcttcgaccctctgagcgcgtcggacaccggagagtattcctgcgaagcccggaatggatatggcacaccaatgacaagcaacgcggtgagaatggaggccgtggagcgaaatgtcggtgtgatagtggcagcggttttggtgacccttatcctgctcggcatcctggtctttggcatttggtttgcttactctaggggccactttgaccggactaagaagggcacatcatcaaagaaagttatctacagccagcccagtgcacggagtgagggcgagttcaaacagacctcctccttcctcgtctag

SEQ ID NO: 24121 - DNA, 900 bp, Artificial Sequence
  Description of Artificial Sequence: Synthetic coding sequence
atgggcaccaaggcccaggtggagcggaagctgctgtgcctgttcattctggccatactgttatgcagccttgccttaggttcagtgacagtgcacagctccgaacctgaggtgcgtatcccagaaaacaatcctgtgaaactgtcttgtgcctacagcggattctcatctcctcgagttgaatggaaattcgatcagggcgacaccactcggttggtttgctataataacaaaataaccgcttcctacgaggatcgagtcacatttttgcccacaggcatcactttcaaaagcgtgacccgagaggataccgggacatacacctgcatggtttcagaagaaggtggtaatagctatggagaggtgaaggtgaagctaattgttctcgtacccccatctaaacctactgtgaacatcccctcaagcgctaccataggaaatcgggctgtactcacttgcagcgagcaggatggttccccccctagcgaatacacctggtttaaggacggcatcgtgatgcccactaacccaaaatctacacgtgctttctcaaattcatcttacgtgctgaaccctacgaccggggagcttgtatttgacccgctgagcgcctcagatacgggggagtattcttgtgaggcaagaaatggctacggaactccaatgacttctaacgccgtgagaatggaagcggttgagcgcaacgtcggcgtgatagtagccgctgtgttagttacactgatccttctgggcattctggtctttgggatttggttcgcatatagcagaggccacttcgaccggaccaaaaaggggactagtagcaagaaagtcatatactctcagccttcggcgaggtcagaaggggaattcaagcagacatctagctttttagtttag

SEQ ID NO: 24122 - DNA, 900 bp, Artificial Sequence
  Description of Artificial Sequence: Synthetic coding sequence
atgggcaccaaggcccaggtggagcggaagctgctgtgcctgttcattcttgctatactattgtgtagcctcgccctcggcagtgttacagtacactcaagcgagcccgaagttcgcattccagagaacaacccagtaaagctatcatgtgcttatagtgggttttcgtctccccgtgtagagtggaagtttgatcaaggtgacactactcggctggtgtgttacaataacaagattaccgcctcttacgaagatcgtgtgacgttccttcctacaggtattacattcaagagcgttacaagagaagacactggaacttacacctgcatggtctctgaagaaggcggcaattcatacggtgaagtgaaggtcaagctcattgtgttggtgccaccctcaaaaccgacagtgaatatcccttcctccgcgacaattggcaatcgggctgttctcacgtgttcagaacaagacgggtcccctccatccgaatacacttggttcaaggatggcatcgtgatgcctacaaaccctaagagtacacgcgcattctctaactcaagttacgtgcttaaccccactactggggagctggtgtttgatcctcttagcgcctcagatactggggagtattcgtgcgaggcaaggaacggctacggaacaccgatgacctccaatgcggttcgcatggaggccgtagaacgcaacgttggggttatagtcgccgccgttcttgttacacttatcctgttaggcattcttgtgtttggcatctggttcgcatatagcagaggtcattttgataggaccaagaaaggcacctcctccaagaaagttatctacagccagccatccgctaggagtgaaggcgaattcaagcagacaagctctttcctggtttag

SEQ ID NO: 24123 - DNA, 912 bp, Artificial Sequence
  Description of Artificial Sequence: Synthetic coding sequence
atgctgcaggccccccggggccgggcccgggccgccctgcggcggctcgccgtggccacgagaactatggcagggggcagcttggccctgggaagcgtaacagtgcactcaagcgaaccagaggtgcgaatccctgagaacaacccagtgaagctgtcctgtgcttattccggctttagctctcctagagttgagtggaaattcgatcagggggacacaacacgacttgtgtgttacaacaacaaaataacagccagctatgaagaccgggttacattcctgccgacaggaataactttcaagtcagtgactcgagaagacactggcacctacacatgtatggtgagtgaagaggggggcaactcttacggcgaggtcaaagtaaaactcattgtgttagttccaccaagcaagcctacagtgaacatcccatcaagcgctaccattggtaaccgggctgttcttacttgcagcgagcaagacggatctccacctagcgagtacacatggttcaaggacggtatagtgatgcctactaaccctaagagtaccagagcattctctaactccagttacgtgctgaaccctacgaccggcgagcttgtgtttgaccccctctccgcaagtgacaccggcgagtattcgtgcgaggctcgaaacgggtatggcacccccatgaccagcaatgccgtgcgcatggaagccgtggaaaggaatgtgggcgtgatcgtggccgctgtcctggttaccttgatcctgctgggcatcctcgttttcggtatctggtttgcctattcccggggacactttgatcggacaaagaagggcacatccagcaagaaggtgatatattcccaaccgagcgctaggtccgagggggaatttaaacagacgtcttcgtttctcgtctag

SEQ ID NO: 24124 - DNA, 753 bp, Artificial Sequence
  Description of Artificial Sequence: Synthetic coding sequence
atgggcaccaaggcccaggtggagcggaagctgctgtgcctgttcatcctggcgattctgctgtgcagcctggccctgggcagtgtgacggtgcactcttccgagccggaggtgaggatcccagagaataaccctgttaagttgtcatgtgcttattccggcttctcaagcccccgcgtggagtggaagtttgaccagggcgacaccacacgattggtgtgctacaataacaagattactgtacctccaagcaagccaaccgtgaatataccctccagcgcgaccatcgggaaccgcgcagtcctgacctgtagtgagcaggacggatccccccccagcgagtacacatggtttaaagatggcatagtaatgccgaccaatccaaagtccacccgggctttttccaatagctcttatgtgctgaatcccacaacgggagagcttgtttttgaccctctcagcgcctctgataccggtgagtatagttgtgaagctcgtaatgggtacggcacacccatgacttcaaacgctgtgcggatggaggctgtagagagaaatgtcggcgtgatcgtggctgccgtcctagtgaccctcatactgctgggaattcttgtatttggcatctggttcgcatacagcaggggacacttcgataggacaaagaaaggcacgtcctccaaaaaggtgatctactcacagcctagcgctcggagtgaaggtgagttcaaacaaacgagctcatttcttgtctag

SEQ ID NO: 24125 - DNA, 3357 bp, Artificial Sequence
  Description of Artificial Sequence: Synthetic coding sequence
atgggcgtgcagggcttccaggactacatcgagaagcactgcccctcggcggtggttccggtggaactgcagaaactggctagaggaagcttggtgggcggtggcaggcagcggcccccacagaccccccttcggcttttggtagacgccgacaattgcttgcatcgattatacggcggcttttacaccgattgggtgtcaggaggacagtggaaccacatgctggggtacttagccgcattggcgaaggcctgcttcgggggaaacatagagctgttcgtcttcttcaatggtgccttggagaaggcaagactacacgagtgggtcaagagacagggcaatgagcgacagaccgcacaacagatcgtcagccatgtgcagaacaaggggactcccccacctaaggtgtggttcctgccacccgtgtgcatggcacattgtatcaggcttgctctcatcaggttccatgttaaggtggcccagtctatcgaagatcatcatcaggaggtcataggattttgtcgcgaaaatgggttccatggcctggtcgcatacgacagcgattatgcactgtgcaacattccatactacttctccgcccatgctctaaagttgtcccgaaatggaaagtctcttaccacaagccagtacttgatgcacgaggtggctaagcagctggacctgaaccccaatcggtttcctattttcgcagctcttcttgggaatcacattctaccagacgaggacctggcctctttccattggagtctcctcgggcccgaacatcctttagcttccctcaaggtgagagctcaccaattggtccttcctccttgtgatgttgtgattaaggccgttgccgactatgtgcgaaacatacaggatacctccgacttagatgcaatcgccaaggacgtgttccagcactctcagagcagaaccgacgacaaggtaattcgcttcaaaagagccattgggtactattcggccacgtccaaacctatgagcttccatccaccacattacctagcggcgcgacccggacctttcggtatgcccggcatggtgccgcctcatgtgccaccacaaatgctgaatattccacagacatctctacaggcgaaacctgtggcccctcaggtgccatctccagggggcgcaccaggtcagggaccatatccctattctttatctgaaccagcaccactaacactcgacacctccggcaagaacctgaccgagcaaaattcctacagcaacataccccacgaaggaaaacacacccccctatatgagaggagtagtccaattaaccctgcacaatctgggtcgccaaaccacgttgactctgcatatttccccggcagtagcacttccagtagctccgacaacgacgaaggttctgggggagcaacaaatcacatctccgggaacaaaatcggatgggaaaagaccgggtcacacagtgaacctcaggccaggggcgatccgggagatcaaacaaaagccgaaggaagttctaccgcctctagtggttcccagctggccgagggcaaggggagccagatgggcaccgtgcaacccatcccgtgcctattgtctatgcctaccagaaaccatatggacataactactccccctttacctcccgtcgcaccagaggtactacgagtagcagaacacaggcacaagaaagggttgatgtacccttacatttttcacgttttaacgaaaggcgagatcaagattgccgtgtccatcgaggatgaagccaacaaggatctgccacctgcagcccttctgtatcgacccgtgcgacagtacgtttacggggtgcttttctccctggctgaatcaagaaagaagaccgaacgactggcttttcggaagaacagactccctccagaattcagtccagtcattatcaaagaatgggctgcatacaaaggcaagtccccacaaaccccagagttggtggaggctttagcctttagggaatggacctgtcccaacctaaaaaggttatggctcggaaaagctgttgaggacaaaaataggcggatgcgcgccttcctagcatgcatgagatcagacactcctgctatgctgaaccccgctaatgttccaactcacctcatggtgttatgctgtgtgctgcgttatatggtacagtggccaggagcgcgcatcctaagaagacaggaactcgatgcattcctggcccaagccttaagcccaaagctctatgaacccgatcaactacaggagttaaagattgaaaatttggaccctaggggcatacagctgtctgcattgtttatgagtggtgtagacatggccttatttgcaaatgatgcatgcggccagcccatcccttgggaacactgctgtccttggatgtacttcgatgggaagctatttcagtccaagctcctcaaggcctcaagggagaaaactcctcttatcgacctgtgcgatggacaagctgaccaggctgccaaagtggaaaaaatgagacagtccgtgctggaaggactttccttcagcaggcagagtcacactctaccttttccaccaccccctgctctgccgttttatccggcttcagcctacccacgacacttcggccccgtcccaccaagtcaggggagagggcgtggcttcgcgggtgtgtgcgggttcggcgggccatacggcgagaccgttgccactggcccttatagagccttccgtgtcgctgccgcttccggccactgtggtgccttctctgggtcagattctagtcggacgtcgaaaagtcaaggtggagtacagccaatcccttcccagggcggaaagctcgagattgcgggcacagtcgtaggtcactgggctggatcccggagaggacgtgggggcagaggacccttccctctgcaggtggtttccgtcggtggccctgcgagagggagacctcggggagtgatctccactccagttatccgtacatttggtcgcggaggaagatactatggcagggggtataaaaatcaggccgcaatccaggggcgaccaccttatgctgcctcagctgaggaagtggctaaggagctgaagtccaagtctggggaatccaagtcctccgccatgtcgtccgatggctccctggctgaaaacggggtgatggcagaagaaaagccggctccacaaatgaacggctctactggtgacgctagagcccccagtcatagcgaatctgccctgaacaacgactcaaagacgtgtaataccaacccccatttgaatgctctgtccaccgactctgcatgccggcgagaagctgctcttgaggctgccgtgctcaacaaagaagagtag

SEQ ID NO: 24126 - DNA, 3441 bp, Artificial Sequence
  Description of Artificial Sequence: Synthetic coding sequence
atgggcgtgcagggcttccaggactacatcgagaagcactgcccctccgccgtggtgcctgttgaacttcagaagttggcccggggttccctagttggcgggggacggcagaggcctcctcagacaccacttagacttctggtagacgcggacaactgtctccatcgcctgtatggtggcttttatactgactgggtatccggtgggcagtggaaccatatgctgggctatctggcagccctcgctaaagcctgcttcggcggcaatattgagctcttcgtgttttttaacggcgcactggagaaggctcgcctgcatgagtgggtgaaacggcagggaaacgaaaggcagacagcccagcagattgtcagccacgttcaaaataaggggaccccaccccctaaggtctggttcttaccgccagtctgtatggcccactgcattcggttggcattaatccggtttcacgtcaaggttgctcaatctatcgaggaccaccaccaagaagtgatcggcttttgtagagagaatggattccacggattggtagcctacgacagcgactatgccttgtgtaacatcccctactacttctccgcccatgcactgaagctgagtaggaatggaaagagcctgacaacttctcagtacctgatgcacgaggtggctaagcagctggatctgaacccaaatcgattcccgattttcgcagcactcctaggtaatcacattctcccagatgaagacttggctagtttccactggtcactgctcggccccgagcaccctctcgcctctttgaaggtcagagcccaccagcttgtactaccaccttgtgacgtggtcattaaagcggtggccgactatgtgcggaacattcaggacacctccgatttggacgcgattgcgaaagacgtgtttcagcatagccagagtagaacagacgacaaagtgattcggttcaagagggccatcgggtactacagtgccacttccaagcctatgtccttccatcctccacactaccttgctgcgcgtcctggaccgtttggaatgcccggcatggtccccccacacgtgccaccacaaatgctcaatatcccccagacttctcttcaggcaaagcccgttgcacctcaggtccccagcccagggggcgcaccaggacagggaccttatccttactcactttctgagcccgctcccctgaccctggacaccagtggtaagaatctcacggaacaaaacagttattccaatatcccccacgaggggaaacacactccgctgtatgaacgctccagcccaatcaatcccgcccagtctggatccccaaaccacgtcgacagcgcatacttccccggcagttctacatcttcgtcctccgacaacgatgaggggagtggcggggctacaaagccattccagctgtatctccaaaaaaatttcgtcttccacaaggagaactctatcgttttatgctccaggatcctgcggcacggtcatatatcaggtaacaagattggatgggaaaaaactggatcacatagcgagccccaggccaggggagatcccggggaccagaccaaggctgaagggtcttccaccgcttctagcgggtctcagctggcggaggggaagggctcacaaatgggcacagtgcagcctatcccttgcctgctctcaatgcctacccgcaatcatatggacattaccaccccgcccctcccgcccgttgcgcctgaggtcctgagggtcgcggaacaccggcataaaaaaggcctcatgtacccttatatctttcacgtgctgacaaaaggtgaaatcaagattgcagtgtcgatagaggacgaggctaacaaggacctgccccctgcggcgctgctgtaccgcccggtaagacagtacgtttacggggtgctgttctccctagccgaaagtcgcaaaaaaaccgagaggctggcgttcagaaaaaatcggctgcctcctgaattctcccctgtgatcattaaggaatgggccgcctataaaggtaagtctccacagacacccgagctggttgaagccttggcctttagggagtggacatgcccaaacctgaagcgtctgtggctggggaaggctgtcgaagataagaatcggagaatgcgcgcttttctcgcttgcatgcgtagcgacacccctgcaatgctgaatcccgcaaatgtcccaacgcatttaatggtcctgtgctgtgtgctgaggtacatggttcagtggcctggcgcgcggatccttcgcaggcaggaactggatgccttcctggcccaagctctgtctcctaaactctatgagcctgaccagctacaggagttgaagatcgaaaatctggaccctcggggaatccagttgagtgctctgttcatgagcggcgtagacatggctcttttcgcaaatgacgcatgcggtcagcccatcccctgggaacactgctgcccatggatgtacttcgacggcaaattgttccagtcaaagttgctgaaggcctcccgtgaaaaaacacctctgatcgatctgtgtgatgggcaggctgaccaggctgctaaagtagaaaagatgaggcagagcgtgctcgagggactgtccttttctcggcagtctcacaccctgcctttcccacctccaccagcactaccattctaccctgccagcgcttaccctagacactttggaccggtgccgccatcccaaggcagagggcgtggatttgcaggggtctgtggttttgggggtccctacggggaaacagtggctacaggaccctaccgagcgtttcgggtcgccgcagcgagcgggcattgtggtgctttctccggatcggactcttcccggactagcaaaagtcaggggggagtgcaacctattccgtcccaaggaggaaagctggagatcgccggaaccgtggttggccattgggccgggtccagaagaggccgcggcggtagaggacctttcccactgcaggtggtgtctgtgggcggtcccgcgagaggacggcctcggggagttataagcaccccggttatccgcaccttcggcagggggggccgatactatggaaggggctataagaatcaggctgcgatacaggggagaccgccttacgctgcctccgccgaggaggtggccaaggaattaaaatcaaaatcaggagagagtaagagctccgctatgagttctgacgggagcctggccgaaaacggtgtgatggccgaagagaagcccgcccctcagatgaatggctccaccggagacgccagggctccgtctcattcagagtccgctcttaacaatgacagcaagacatgtaacactaacccacacttaaatgctttgtccacggattcagcgtgcagacgggaggcagctctggaggccgctgtgcttaataaggaggagtag

SEQ ID NO: 24127 - DNA, 3219 bp, Artificial Sequence
  Description of Artificial Sequence: Synthetic coding sequence
atgggcgtgcagggcttccaggactacatcgagaagcactgcccctccgcggttgtgcctgtggagctccaaaaacttgctagggggtccctggtgggcggagggcgccaaaggcccccccagacgcctctgagactcctggtcgatgccgacaattgcctgcaccggttatatgggggcttttacacagattgggtgagtggtggacaatggaatcacatgcttggatacctagctgccctggcgaaggcctgctttggcggcaacatagaactcttcgtattttttaacggggctcttgaaaaggcccggctccacgaatgggtaaaacgacagggcaatgagcgacagacggcgcaacaaattgtcagtcacgtgcagaacaaaggaactccgccccccaaagtgtggttcttaccacccgtatgcatggctcactgtattcggctggcactcatacgatttcatgttaaggtggctcaatctattgaggatcaccaccaagaggtcattggcttttgcagggaaaatggttttcacggtttagtagcctacgactccgactacgcactgtgcaatatcccttactacttttccgcccacgccctaaagctgagtagaaatggtaagagcttaaccacatctcaatatttgatgcacgaggtcgcgaagcagctggatttgaaccccaaccggttcccaatctttgctgccctgcttgggaaccacatcctacctgacgaggatctcgcctctttccactggagtctgttgggaccagagcaccccctcgcatccctgaaagtaagagcccatcagctggtccttcctccctgtgacgtggttatcaaggccgtggccgactatgtgcgaaatatacaggacacttctgatctggacgccatcgctaaagatgtctttcaacattcacaaagtagaactgacgataaggtcataaggtttaaacgcgcaattggatattatagtgcaaccagcaaacccatgagctttcatccccctcactaccttgcagcacgcccaggcccattcggaatgcctggcatggtgcctccacatgtgccacctcagatgctcaacatcccccagacgtccctgcaggctaagcccgttgcacctcaagtccccagccccggcggggcccctggtcagggtccctacccgtattccctttccgagccagcaccactgacgctggacactagcggtaaaaacctcaccgagcaaaacagctatagtaatattccacatgagggaaagcatacccctctgtacgaaaggagttcacctatcaaccctgcgcagtcaggatctcctaatcatgtagactccgcttattttccgggctcctccacctccagcagttcagacaacgatgagggatctgggggggccaccaatcacatttcagggaataagatcgggtgggagaaaaccggctctcatagcgaaccccaggccagaggcgatcctggcgaccagaccaaggcggaaggaagtagtactgcctccagcggctcccagctggcggagggcaagggctcacagatgggtacagtgcagcccatcccttgtttattgagcatgcctacacggaatcatatggacataaccactcccccccttcccccggtagctcctgaagtgctcagggttgcagagcatcgccacaagaaaggccttatgtacccctatatttttcatgttctcaccaagggagaaataaagatcgcagtaagcattgaagacgaggccaataaggatctgccccctgctgctttgctataccggcccgtaagacaatacgtttacggcgtgctctttagcctggctgagtcaagaaaaaagacagagcgccttgccttccgaaagaaccgtctgcctcctgagttcagcccagtgattatcaaagaatgggccgcctataaaggaaagtcccctcaaacaccagagctcgtggaggctctggcatttcgggagtggacctgtcccaacctaaagagactgtggctgggcaaggcagttgaagataagaatcgacgcatgagagcgtttctggcctgcatgagaagcgacactccagccatgttgaatccagcaaatgtccccacccacttgatggtgctgtgctgcgtgctgagatacatggtgcaatggcctggtgccaggatattacgcagacaggaacttgatgcctttctggcccaggcattgagccctaagctttatgagcccgatcagctgcaagagctcaaaatcgaaaacctcgaccctaggggaatccagctgtctgcactgttcatgtcaggcgtggacatggctctctttgccaatgacgcatgtgggcagccaatcccctgggagcactgctgtccttggatgtacttcgacgggaaactgttccagtctaaactgctgaaggcttcaagggagaagacgccattgatcgacctgtgcgacgggcaggccgatcaggcggcaaaagttgagaagatgaggcagtcagtactggagggactcagttttagtaggcaaagtcatactctccccttcccacctcctccagccttgcccttttaccccgccagtgcatacccgagacattttggccccgtccccccctcacaaggccgcggtaggggatttgctggcgtgcagccaataccgagtcaggggggtaaactggaaattgccggcactgttgttggccattgggctggcagccggcgcgggaggggtggaagagggccatttcctctgcaggtagtctcagtgggcggaccagccagaggacgccctcggggtgtcatcagcactcccgtcatcagaacattcggtaggggtggccgatattacgggcgagggtataagaaccaggctgccatccaggggcgtcctccgtatgctgcatccgccgaggaggtcgcaaaggaactcaagtctaaaagcggcgaatccaaaagtagcgccatgtcctcagacgggagtctggccgagaatggggtgatggccgaggagaagcccgctccacagatgaacggatctacgggggatgcgcgggccccttcgcacagtgagagtgcgctgaacaacgactccaagacatgtaataccaacccccacctgaacgcactttccaccgacagcgcctgtagaagggaagcggccctggaggccgccgtcttgaacaaggaagagtag

SEQ ID NO: 24128 - DNA, 1887 bp, Artificial Sequence
  Description of Artificial Sequence: Synthetic coding sequence
atgggcgtgcagggcttccaggactacatcgagaagcactgcccctccgcggtggtgcctgtcgaattacagaagcttgcacggggcagcctggtcggcggaggacggcagcgccctccacagacccctctgcgactcctggtcgacgctgacaattgcctgcaccgtttgtacgggggattctatacggactgggtgagcggaggccagtggaaccacatgctgggttatctggccgcactagccaaagcgtgtttcggcggaaatatcgaacttttcgtgttttttaatggcgcgttggagaaggcccgcctacatgagtgggtgaaacggcagggcaacgaacgtcagacagctcaacaaatcgtgagccacgttcagaataaaggaacaccacccccgaaggtctggttcctgcccccagtgtgcatggcccactgtattcgccttgctctgatcaggtttcatgtgaaagtggcacagtccatcgaggatcatcaccaggaggtgattggtttttgcagggaaaacggattccacggcctggtggcatacgattctgactacgccttatgtaacattccttactatttttctgcacatgctttgaaactgtcacgaaacggcaaaagcctgacaacctctcagtatctgatgcatgaggtggctaagcagctggatctaaaccccaaccgattccctatctttgcagccctgctcggcaatcacattctcccagacgaagatctggcttcatttcactggtccctgctcggtccagagcacccacttgctagcttaaaggtgcgggcacaccagcttgtgttgccaccctgcgacgtagtgatcaaggcagtggcagattatgtacgtaacatccaggacacatccgacctcgatgccatagcgaaggatgtctttcagcatagtcaatcacggacagatgataaggtgatccgcttcaagagagccatcgggtactactctgccacttccaaacccatgagctttcatcccccacactatctggcagcccggcccggacctttcggtatgcctggaatggtccccccccacgtgcctccacagatgctgaatattcctcaaacttcccttcaggcaaaacctgtcgccccccaggtgcctagtcctggaggcgctcccggccagggcccctatccatattccctttccgagcccgcccccctgactctagacaccagcggaaagaatctgacagagcaaaacagctactccaatataccacacgaaggaaaacacacacctttgtacgaaaggtcaagccccatcaatcctgcacagagtgggtctcccaatcatgtagacagcgcctatttccctggctcttccacctcctcctcctcagacaatgatgagggatcaggtggggcaacaaatcatattagcggcaataagattggctgggaaaagaccgggtcacattcagagccccaggccagaggggatcccggcgaccagaccaaagctgagggctcaagcaccgcatcatccggaagccagttggcggagggaaagggatctcagatgggcaccgttcaaccaatcccctgcctgctgtcaatgcctacccgcaatcacatggatatcactacccccccactcccacctgtggcccccgaagttctccgcgtagccgagcatcgccataaaaaaggactgatgtatccctacatcttccatgtgttgactaaagttctcagcaaaggcccctggtccggattctgttatctgatgtcgggacacagttacggctgttttgtgctcctgagcttcttcgaacctttcttctgtctcactaacctgctggagacaaaattcacgtttccttttcttaatatcgagtag

SEQ ID NO: 24129 - DNA, 1485 bp, Artificial Sequence
  Description of Artificial Sequence: Synthetic coding sequence
ggcgagatcaagatcgccgtgagcatcgaggacgaggccaacaaggacctgccacctgcggcactactttacagacccgtccgtcagtatgtgtatggggtcctgttttccctagccgagtccaggaaaaagaccgagagactggcctttaggaagaaccgactaccccccgaattcagtccggtaatcatcaaagagtgggcggcttacaaggggaagtcaccacaaacaccagaactggtcgaagcactcgcctttcgggaatggacatgccctaatctgaaacgactgtggctgggaaaagccgttgaagataagaatcgcagaatgcgggcctttcttgcatgcatgaggtctgatacccctgccatgctcaaccctgcaaacgtcccaacacatttgatggtgctgtgctgtgtgctgaggtacatggtccagtggcccggggcccggattctgcgcagacaggaactggacgcatttctggcgcaagcgctctctcctaagctgtacgaacccgaccagctccaggaactcaaaattgagaacttggatccaagggggattcagctcagcgccctgttcatgtctggtgtggatatggcactcttcgcgaatgacgcgtgcggccagcccattccgtgggaacactgctgcccatggatgtatttcgacggcaagttatttcaatccaagttactcaaagcatcaagagaaaagacccctctgatcgacctctgcgatgggcaagccgatcaggcagccaaagtggaaaaaatgaggcagtccgttctcgaaggtcttagcttttctcgtcagtctcatacactaccctttccccccccgcctgccctccccttctaccccgctagcgcctatcctagacacttcgggccagtcccaccctctcaggggcggggaagaggcttcgccggcgttcagccgatcccaagtcaaggagggaagttggagatcgccggcactgtggtggggcactgggcaggcagtcgccgggggcgaggcggcagaggcccattccctctgcaggtggtgagtgtgggtggtcctgcccgagggagaccccgaggggtcatttcaacaccagttatacgcacctttggacgtgggggccgctattacggaaggggctacaaaaaccaagcagccatccaaggacggcccccttacgcggcctcagctgaagaggtggctaaggagctgaaaagcaagtctggtgagagtaaaagcagcgctatgtcaagcgatggctcactggcagagaacggcgtgatggctgaggagaagcctgcgccacaaatgaatggcagtaccggagacgcccgcgcgccatcccatagcgagagtgctctcaacaatgactctaagacgtgcaacaccaacccgcatctcaatgcactgagtacggattcagcatgccggagagaagcagccctggaggctgcggtcctgaacaaggaggaatag

SEQ ID NO: 24130 - DNA, 1485 bp, Artificial Sequence
  Description of Artificial Sequence: Synthetic coding sequence
tgagtggcccagagcatcgaggaccaccaccaggaggtgatcggcttctgtcgggaaaacggctttcatggcctcgttgcttatgactctgactacgccctctgcaacattccatactatttttctgcccacgccctgaaacttagccgcaatgggaaaagcctgacaacatctcagtacctgatgcatgaagtagcaaagcagctggatcttaaccctaatcggtttcccattttcgccgcgctgctcggaaatcatattctgcccgatgaagatttggcatcctttcactggtccctgcttggtccggagcatcctctcgccagtctgaaagtgagagcccaccagctggtgctcccaccatgcgatgtggttatcaaggccgtggccgactacgtgaggaacatccaggacacatctgatcttgatgcgattgctaaagacgtgttccagcactcccaatcacgtaccgacgacaaagtgataaggttcaagcgagcaatcggctactacagtgcaactagcaaaccgatgagtttccatccgccgcactatcttgctgcgagacccgggccattcgggatgccggggatggtgccaccacacgtgccccctcagatgctcaatatcccacaaacaagccttcaagccaaacctgtcgctcctcaggtgccttctcccgggggcgcacctgggcaaggcccttatccctactctctgtctgaaccagcaccactgactctggataccagcggtaagaacctaaccgaacagaattcctattccaacatacctcacgagggcaagcacacacccttgtacgaacgtagcagtccaattaaccctgcacaatccggcagtcctaaccacgtggattcagcttactttccgggttcaagtacaagtagttctagcgataacgacgaaggctctgggggtgctacaaatcatatttcaggcaacaagataggctgggagaagactgggtcccacagcgagccccaggcccggggggatccaggcgaccagactaaagccgaaggcagcagcactgcgtcctctggatcccaactggcggaaggaaagggctctcaaatgggcacagtgcagcccatcccctgcctactgagtatgcctacccgaaaccacatggacatcaccacgcccccactgccgcctgttgcacctgaagtcctacgagtcgccgaacacaggcataaaaagggcctgatgtacccctatatctttcatgttctcacgaagggggaaatcaagatcgccgtttctatcgaagacgaagctaacaaagatcttccccctgccgcgttattgtataggcccgtcaggcagtatgtttatggtgtcttgttttcactggccgagagtagaaaaaagactgaaagattggccttcagaaaaaataggttgcccccagagtgcatgtactgcaataatcccctgttcgtcttcctggggacatcttag

SEQ ID NO: 24131 - DNA, 969 bp, Artificial Sequence
  Description of Artificial Sequence: Synthetic coding sequence
atggtggccgacctggagctgcagcaggacctgatcgtgcccctgggtcacacacccagccaagaacacttcctcttcgagatttttcgccgaaggttgcaagctctcacaagtggctggtcagtcgccgcttctctgcagcgccagcgcgagttactcatgtataagagaattttgttgcgactgcccagcagcgtcctctgtggctcatcatttcaggccgagcagccaattaccgcccgatgtgagcagtttttccacctggtcaactctgaaatgcggaatttctgcagccacggcggagcactgacacaggatatcacagctcactttttcagaggcctgctgaatgcctgcttacggtcacgtgacccatctctcatggtcgactttattctggctaagtgtcagacgaagtgccctctgatcctcacctccgctcttgtgtggtggccatctcttgagcccgtgttgctgtgtaggtggcggcgacactgtcagagccccttaccaagggaattgcagaagctacaggaaggcaggcagtttgcctccgatttcttatcccccgaggctgctagtccagcccccaatcccgattggctttcggctgctgccctgcattttgcaattcagcaggtaagagaagagaatatacggaagcagcttaaaaagttggattgtgagcgcgaggagcttctggtgttcctcttcttcttctcccttatgggattgctgtcttcccacttgacctcgaattccaccacagatctgccgaaggcgttccacgtgtgcgctgccatcttggagtgtttggagaaacggaagatcagctggctggctctattccaacttactgagtctgggaaaaaacacgccgcagaggcccagatgaggcgagctgccctgttcaggggtatcctgcagatggtgaagaacgagccctccctgcgattcctggcaaaatag

SEQ ID NO: 24132 - DNA, 4368 bp, Artificial Sequence
  Description of Artificial Sequence: Synthetic coding sequence
atgagcgacagctgggtgcccaacagcgccagcggccaggaccccgggggtcgccgcagggcttgggctgaactccttgctgggagagtgaagcgcgagaagtataacccagagcgagcgcagaaattaaaggaaagcgcggtacgcctcctcagatcccaccaagatctcaacgccctgctcctggaagtggagggccctctgtgcaagaagctatccctgtccaaggttatcgactgtgatagcagtgaggcatacgccaaccactcctcaagttttattgggagcgctttacaggatcaagcttctcgattgggggtccctgtgggtattctttcagcagggatggttgcaagctctgtgggacagatctgcaccgcccccgccgaaacttctcatccggtgcttctgacagtcgaacagagaaaaaagctttcttcattactggaattcgctcagtatctgctggcccacagcatgttctcgcgtctgtccttctgtcaagagctgtggaagatccaaagttccctacttctagaagctgtctggcatttacacgtgcagggcatagtgtctttgcaggaattgttagagagtcacccagacatgcacgccgtggggagctggctcttcaggaatctttgttgtttgtgtgaacagatggaagccagttgtcagcacgctgatgtcgcccgagcaatgttgagtgattttgtacagatgttcgtcctgaggggatttcagaaaaactccgatttgaggagaacagtcgaacctgagaagatgccacaagtaacagtggacgtcctgcaaaggatgctgattttcgcactggacgctcttgcagcaggagtacaagaggagtcttctacacacaagattgttcgctgctggtttggtgttttttctggacatactcttggttccgttatctctacagaccctctgaagcggtttttctcccataccctgacgcagattctgacgcactcgccagtgttgaaggcctctgacgctgttcagatgcagcgcgagtggagtttcgctcgcacccaccctcttctgacatccttatacaggcgcctatttgtgatgctgtcagctgaagagctggtgggccacttacaagaagttctggagactcaggaggtccactggcagcgcgtcctctcattcgtctcagcactcgtggtatgttttcctgaggctcagcagctcctggaagattgggtggcaagactgatggcacaggcctttgagtcttgccagctcgattcaatggtgacggccttcctggttgtccggcaggccgctcttgaaggaccctctgccttcctgtcttacgcagattggttcaaggcctcctttgggagcacgaggggataccacggatgctccaagaaggcactggtgtttctgtttacatttttatccgagctcgtgccattcgagtcccccaggtatctccaagtgcacatcctgcaccccccgcttgtgcccggcaaatatcggagtctgctaacagactacataagccttgcgaagacccggctagccgatctcaaagtctcaatcgagaacatggggctttatgaagatctttcctccgcaggcgacatcaccgaaccccatagtcaagccctgcaagacgtggaaaaggctataatggtatttgagcacacaggaaacattccagtgacagtgatggaggcaagtatatttaggcgcccctattatgttagccactttctgccagcgttgcttaccccccgggtgctgcccaaggttccggattcaagggttgccttcatagaatctctgaaaagggcagataaaatcccccctagcctatattccacctactgccaggcttgcagtgcggcggaagagaaacctgaagacgctgccctcggagttagagcagaacctaactctgccgaagaacctctcgggcagctcactgccgcacttggagaactgcgggcctctatgaccgatccgtcacaaagggacgttatctccgcacaggttgcagtgatttcggagcggctgagggctgtcctaggacacaatgaagatgattcaagcgtggagatcagcaagattcagctctccataaacactcctcgcctggaacccagggagcatatggctgtggacctgctactgaccagcttttgtcaaaacttgatggctgcttcttctgtcgctccccctgaacggcagggaccctgggccgcgcttttcgttcgtacgatgtgtggccgagttctgcctgctgtactcacacggttgtgtcagctgcttagacaccaaggccctagtctaagtgcccctcacgtgctgggcctggctgctcttgccgtgcatctgggcgagagtcgtagcgcattacctgaggtggatgttggccctcccgcccccggggcgggactgcccgtgcctgccctgtttgatagtctgctaacctgtcgaactcgggacagtttattcttttgcttgaagttctgtacagctgcaattagctacagcctgtgcaagtttagcagtcagtcaagggacactctctgttcctgtctgagtccaggtcttatcaaaaagtttcagtttctgatgtttagacttttttccgaggcgcggcagcccctgtccgaggaggacgttgctagtctttcttggaggccactgcatctcccctctgcggactggcagcgcgctgcgctgagtctgtggactcatagaaccttcagagaagtgctgaaggaggaagatgtccacctgacctaccaggattggcttcatctcgagctggaaattcagccagaggccgatgccctgagtgatactgagcggcaggacttccaccagtgggccatccatgaacactttttgcctgaatcatccgcgagcggcggctgtgacggcgatctccaggccgcctgcactattcttgtaaatgccctcatggattttcatcagagttcgaggagctacgaccacagtgaaaacagtgacctggtgttcggaggccgcactgggaatgaggacattatctctcggctccaagaaatggtggctgatctggagttacaacaggacctgattgtgccgcttggccacactccttcccaggaacatttcttgttcgagatttttaggagacggttgcaggccctcaccagcggctggtccgtcgcagcctcccttcagcgccagcgcgagcttctgatgtacaagagaatcttgctgaggctgccttctagtgtgctgtgtggctcttcctttcaggccgaacagcccataaccgcacgctgcgaacagttcttccacttagtgaacagcgagatgcgtaacttttgttctcacggtggggccctcacacaagacatcacagcacacttctttcgaggactacttaatgcttgtctgcgaagtcgcgacccaagcttaatggttgacttcattctggccaagtgccaaaccaagtgtcccctgatccttacaagcgccctggtctggtggcccagcctggaaccagtcctgctgtgcagatggagacggcactgtcagtcccctcttccaagggagctgcaaaagttgcaggagggtcgtcagttcgcctccgattttttgtctcctgaggccgcctctcccgcccccaatccagactggctgtccgcagctgccctgcactttgcgatccagcaggtccgcgaagagaatattcgcaaacagctgaaaaagctggattgtgagcgagaggaactgctggtgttcctcttcttttttagcctgatggggctgcttagttctcatctgacatccaatagcaccactgatctccccaaggccttccacgtgtgcgcggccatccttgaatgtctggagaagcgcaaaattagctggctggctctcttccagcttaccgagagtgatctgcgcctcggacgacttctgctgcgggtggctcccgaccagcatacccgactcctgccctttgcgttttacagcctgctgtcctactttcatgaggacgctgctatacgtgaggaagccttcctgcacgtcgcggtcgacatgtacctgaagttagtccagctgttcgttgcaggcgacacatcgacggtaagccctcccgccggccgatcactggagcttaaagggcagggtaacccagtggagctgataaccaaggcccgcctgttcttgctccagctgattcccagatgtccgaagaaatccttcagccacgttgccgagcttctagccgacaggggagattgtgatcctgaggtcagcgccgcactacaatctcgtcagcaggcagcgcctgacgcagacctaagccaggaaccccaccttttctag

SEQ ID NO: 24133 - DNA, 894 bp, Artificial Sequence
  Description of Artificial Sequence: Synthetic coding sequence
atgagcgacagctgggtgcccaacagcgccagcggccaggaccccggggggagaaggcgcgcctgggccgaattgctcgccggccgagtgaagcgggagaagtataatccagaaagagcccagaagctcaaagagtccgctgtgcggctgctgcggagccaccaggatttgaacgccctgctgctggaagtggaaggaccgctgtgtaagaagttgagtctttctaaagtaatagattgcgacagttctgaggcctacgcgaatcactcaagcagtttcatcgggagcgccctccaagaccaggcctctcgcttgggggttcccgtgggaatactcagtgccggcatggtggcttcatctgtgggtcagatctgtactgccccagccgagaccagccaccccgtgcttctgacagtggagcagcgcaaaaagctgagctctctgctcgaattcgcccagtatttgctggcacactctatgttcagccggctttctttttgccaggagctgtggaagattcagagcagtctgctgctggaggcagtgtggcatctgcacgtgcagggtattgtgtcacttcaggagttactggaatctcaccccgacatgcatgccgtgggttcctggctgttccgcaacctttgctgtctctgcgaacagatggaagcttcgtgtcagcacgctgacgtggcccgggcgatgctgtcagacttcgtgcagatgtttgtactgcggggattccagaaaaatagcgacctgcgacggacagttgaacctgagaaaatgccacaggtgacagtggacgtgctgcagcggatgttgattttcgcactcgacgcattggccgccggggtgcaggaagaaagctctacacacaagatcgtgagatgctag

SEQ ID NO: 24134 - DNA, 909 bp, Artificial Sequence
  Description of Artificial Sequence: Synthetic coding sequence
atgagcgacagctgggtgcccaacagcgccagcggccaggaccccgggggtcgacgcagagcttgggctgagcttctggccggtagggttaagcgcgaaaagtacaaccccgagcgggcacagaaactgaaagagtcagcagtgcgtctcttgaggtcacatcaggaccttaatgctcttctcttggaagtagaaggcccgctctgcaagaagctgtccctgtccaaggtcatcgattgtgattcttcggaggcatacgctaatcactcctccagctttatagggtctgctcttcaggaccaggcaagtcggctcggagtgcccgtgggaatcttatccgctgggatggtggctagctcagtgggccaaatctgcaccgcccccgccgagacctcacatcctgtgttgctgactgtcgagcagagaaagaagctctccagtctgctcgagtttgcccagtacttgttggcccacagcatgtttagcaggcttagtttttgtcaggaactgtggaaaattcagtcatccctgctgttagaagcagtttggcacctgcatgtgcagggtatcgtgtctctgcaggagcttcttgagtcccatccagacatgcatgccgtgggcagctggctgttccgtaatctctgctgtctatgcgagcagatggaggcttcttgtcagcacgcagatgtcgccagggccatgctaagcgactttgtccagatgtttgtcttgcgaggatttcagaagaactctgacctgagacgcacggtcgaacccgaaaaaatgccccaggtgactgtggatgtactgcagaggatgctgatcttcgctctagacgcattggccgccggcgtgcaagaagaatcaagcactcacaagatcgtgcgagcttctgcagccaggtcatag

SEQ ID NO: 24135 - DNA, 798 bp, Artificial Sequence
  Description of Artificial Sequence: Synthetic coding sequence
atgagcgacagctgggtgcccaacagcgccagcggccaggaccccggagggcgccgcagggcctgggctgagctgctcgccggtagggtgaagagggaaaagtacaaccccgagagggcacagaagttaaaagagtctgctgttcggttgcttaggagtcaccaggacctgaatgcactgctccttgaggtggaaggacccctgtgcaaaaagctgtccctgtctaaggtgatagactgtgattcctctgaggcttatgccaaccacagcagcagcttcatcgggtcagcactgcaggaccaggccagccggctaggcgtgccagtgggaatcttgagcgctggaatggtcgcctcctcagtgggtcaaatctgtaccgcacccgctgagacttcacaccctgtgttattaactgtcgaacagagaagcagtctgttactggaagccgtgtggcaccttcatgtgcaggggatagtgagtcttcaggagctgctggagtcccatcctgatatgcatgccgtagggagctggctcttcagaaatctgtgctgcctgtgcgagcagatggaagcctcctgccagcatgcagacgttgcccgtgctatgctgtctgactttgtccagatgttcgtgttaagaggcttccagaagaattcggacctgaggcgcacagttgagccggaaaagatgcctcaggtaacagtcgacgtcctgcaacggatgctgatcttcgcgctggatgcgctggcagctggggtccaggaagaatcaagcactcacaagatcgtcaggtgttag

SEQ ID NO: 24136 - DNA, 1869 bp, Artificial Sequence
  Description of Artificial Sequence: Synthetic coding sequence
atgagccggcagaccaccagcgtgggcagcagctgcctggacctgtggagggagaagaacgatcggcttgtgagacaagcaaaagttgcccagaactctgggctgaccctgcgaagacaacagctggcccaggacgcgctcgagggactgagaggattgctgcactcgctgcaaggtctgccagccgcagtgcctgtactgcctcttgagcttaccgtgacctgcaactttatcatactccgagccagcctggcccaggggttcactgaagatcaggctcaggacatccagcggagtcttgagagagtcttggagacccaggagcagcagggacccagactggagcaaggacttcgggaattgtgggacagcgtgcttagagccagctgtttgctccctgaattattgtcagcccttcatcggctcgttggtctgcaagctgcgctgtggctgagcgccgacaggctaggcgaccttgcactgctcctagagactctgaacggatcccaatctggagcgagcaaggatcttctgctcttgctgaaaacttggagtccaccagctgaggaactggacgctccacttacattgcaggacgcccaggggcttaaagatgtcctgttgactgctttcgcttacaggcagggcctccaagaattaatcacggggaacccagacaaagccctgagcagtttacacgaggccgcctctgggctgtgcccaaggcccgtgctggtgcaagtgtacaccgcattgggatcctgtcataggaaaatgggaaatccccagcgcgccttgttatacctggttgccgcactcaaagaaggctctgcttggggaccacctctcctggaagcatcaaggctgtaccagcagttgggagataccaccgctgaactcgaatccttagagcttttggtcgaggcactgaacgtaccctgctcttccaaagcacctcaatttctaatcgaggtcgaactcctgctgcctcctcccgatctcgcttcaccactgcactgcgggacccagagtcagacaaaacacattctggcctctcgttgtttgcaaacagggcgggccggcgatgccgcagagcactatctggacctactggccctgctgctggatagttctgaaccccgcttttcccccccacccagcccccccgggccctgcatgcccgaagtatttctggaggccgccgtggcattgatacaggccggacgggcacaggacgcattgacactttgcgaagaactcctcagtcgtacatcttccctgctgcctaaaatgtcccgcctgtgggaggatgccagaaagggcacgaaggaactgccatactgtcccctgtgggtctcagccacccacctgttgcaggggcaggcctgggtgcagctgggagcccaaaaggttgccatctctgagttctcacgctgcctggaactgctgttcagggccacacccgaggagaaggagcagggcgccgcgttcaactgtgagcagggatgcaaatccgatgcagctctacagcagctacgggctgccgccctgatatcccggggcctagaatgggtggcatcaggccaggataccaaggccttgcaggacttccttctctcagtacagatgtgtcctggtaacagagacacttattttcatctcctgcagacccttaagcgtctggacaggagagacgaggctacggctctgtggtggaggcttgaggcgcagacaaaggggtcccacgaagacgcactgtggagcctgccactgtacctcgagtcgtatctaagttggattagaccctccgaccgagacgcatttctcgaggaatttagaaccagcctccctaagtcatgcgacctttag

SEQ ID NO: 24137 - DNA, 648 bp, Artificial Sequence
  Description of Artificial Sequence: Synthetic coding sequence
atgagccggcagaccaccagcgtgggcagcagctgcctggacctgtggagagagaagaacgataggctggtgcggcaggcgaaggtggcgcagaattccggcctgacactccggagacaacagctggcacaagatgcgctcgaagggctcagaggactgctgcactctttacaggggctcccggctgcagtacccgtcctgcccctggagttaacagtcacatgtaacttcatcatccttcgtgccagcctggcccaggggttcactgaggaccaggcccaagatatccagcgaagtctggagagggtgcttgaaacacaggagcaacagggcccgcgcctggagcaagggttgcgggaactgtgggacagcgttttaagggcaagttgtctgttgccagaactccttagtgctctgcacaggcttgttggcctccaggccgcactgtggctgtctgcagaccgcttaggggacctggcactgttgctggaaaccctgaacggctctcagtccggggcctctaaggatttgctactcctgttaaagacctggagcccacccgccgaagaattagacgcgccactgacgctgcaggacgcccagggcctgaaagacgttctgctgactgctttcgcgtaccgccagtag

SEQ ID NO: 24138 - DNA, 1347 bp, Artificial Sequence
  Description of Artificial Sequence: Synthetic coding sequence
atgagccggcagaccaccagcgtgggcagcagctgcctggacctgtggcgcgagaagaatgataggctcgtacgtcaggctaaggtagctcaaaacagcggccttaccctgaggcgacagcagttagcgcaggatgctctagaagggctaagaggtctgctccactcactccagggtctccctgccgcagtaccagtcctacccctggagctcactgtgacctgtaacttcattatccttcgggcaagccttgcgcaggggtttacagaagaccaggcccaggacatccagaggtccctggaacgagtactggagacacaagagcaacagggacccagactcgagcaggggttgagggagctgtgggactccgtgttgcgggccagctgtcttttgcctgagttgttaagtgccttgcacaggctggtgggcctccaggcagccctgtggctatcagctgacaggcttggagacctcgcgttgctgctggagacattaaatgggagccagtcgggcgcgagcaaagatctgctcttgctgctgaagacctggtctccccccgccgaagagctcgatgcccccttgactttgcaggatgcccagggtctgaaagatgtcctgctcacggcctttgcatacaggcaggggctgcaggagctgatcacaggtaatcctgataaagcactgtcctccttgcatgaggcagctagtggtctgtgtccaagaccagttctcgtccaagtttacactgcactcggctcgtgtcacaggaaaatggggaatcctcagcgagcattgctatacctcgttgcagccctgaaagagggaagcgcatggggaccgccattgctggaggccagtcgcctgtaccaacaactaggagacacgactgcggaactggagagcttggagctgttagttgaggctctgaatgtcccctgcagctccaaggctccccagttccttatcgaagtggagctgttgctgccacctccagacctcgcgtccccacttcattgcggaacgcagtcacagactaaacacatcctggccagtcgatgcctacagacagggcgggccggcgatgccgcagagcattacctggatttgctagctctgctgttggattctagcgaacctcggttttcaccccccccctccccacctggaccatgtatgccagaagtgtttcttgaggctgctgttgcgctaattcaagcgggcagggctcaggacgctctgactctctgcgaggagttattatctcgtacctcaagtctccttcccaagatgtccaggttatgggaagacgctaggaagcggaccagggggagctttcagctgtag

SEQ ID NO: 24139 - DNA, 663 bp, Artificial Sequence
  Description of Artificial Sequence: Synthetic coding sequence
atgctgggcatctggaccctgctgcccctggtgctgaccagcgtggctcggctctcgagtaagtccgtcaacgcgcaagtcacagatatcaattctaaggggctggaacttaggaaaaccgtaactacagtggagacccagaatctggagggcctccaccacgacgggcagttttgtcacaagccatgtccaccgggagagagaaaggctagagactgcactgtgaatggcgacgagccagattgcgtgccatgccaggagggaaaggaatataccgacaaggcccacttcagctccaaatgccggaggtgcagattgtgcgatgagggtcatgggctagaagtcgagatcaactgcactaggacgcaaaacaccaaatgccgctgtaagccaaacttcttctgtaattcaaccgtgtgcgagcattgcgatccatgtacgaaatgcgagcatggaatcattaaggaatgcacacttacttccaacaccaagtgtaaagaggaggggtcaaggtcaaatctgggatggctgtgcttgctcttgcttcccattcctttaatcgtttgggtgaaacgtaaggaagtccaaaagacttgtcggaagcatcggaaagagaaccagggctctcacgaaagtcccactctgaatcccatgctcacatag

SEQ ID NO: 24140 - DNA, 1008 bp, Artificial Sequence
  Description of Artificial Sequence: Synthetic coding sequence
atgctgggcatctggaccctgctgcccctggtgctgaccagcgtggcccgcctctcgagcaaatctgtgaatgcccaggtgaccgacattaactctaaggggcttgaattgcgaaaaaccgtgaccaccgtcgagacccagaacctggaaggactgcatcatgatggtcaattctgtcacaagccgtgcccccctggggaacgcaaagctcgtgattgtactgtgaatggggacgagcctgactgtgtgccttgccaggaaggcaaggagtacaccgacaaagctcatttttcatctaaatgcagaaggtgccgcctgtgtgacgaaggccacggcctggaggtggagataaattgtacgcgtacgcagaacaccaaatgtaggtgcaagcccaacttcttttgtaatagtaccgtctgcgaacactgcgacccctgtactaagtgcgagcacgggatcatcaaggagtgcaccctgacgagcaacaccaagtgcaaggaagagggatcccggtccaacctgggttggctttgcctgctcttgctccccatccccctgatcgtttgggtgaagcgcaaagaggtccagaaaacctgtaggaagcacagaaaagagaatcaaggcagtcacgagtcccccacccttaaccctgaaacggtcgctatcaacctgagcgatgttgacttatctaaatacatcacaaccatcgctggtgttatgactctctctcaggtaaagggttttgtgcgcaaaaacggggtaaacgaagcgaagatcgatgagatcaagaatgataacgtgcaggacacagcagagcagaaagtccagctgctgcggaattggcaccaactgcatggcaaaaaggaggcttacgacacactaatcaaggacttaaaaaaagccaatttgtgcactttggcagagaagatccagacaatcatcctcaaggacattacatctgacagtgaaaactcaaactttcggaacgaaatacagtcactggtatag

SEQ ID NO: 24141 - DNA, 945 bp, Artificial Sequence
  Description of Artificial Sequence: Synthetic coding sequence
atgctgggcatctggaccctgctgcccctggtgctgaccagcgtggccagactttctagtaaatcggtgaacgctcaggtcaccgatatcaacagcaagggactggaactccggaagactgtaacaactgtcgaaacgcagaacctggagggcctccaccatgatggtcagttttgtcacaagccctgtccacctggggagaggaaagctagggactgcacagtaaacggtgacgagcctgactgtgttccctgccaagaagggaaagagtataccgataaagcccacttctcaagcaagtgccgcagatgtagattgtgcgatgagggccatggtttagaagtagagataaactgcacacgcacccagaatacaaagtgtagatgtaaaccgaactttttttgcaactctactgtttgcgagcactgcgatccttgcacgaaatgtgaacacggaatcattaaggagtgcaccctaacctcaaacaccaaatgcaaagaagaagttaagcgcaaggaggtgcagaagacatgtaggaagcatcgcaaggaaaatcagggctctcatgagtctcctacattgaatccagagaccgtggctatcaatctgagtgatgtcgacctctccaagtacataaccacaattgcgggcgtcatgaccttgtcccaggtcaaaggcttcgtgcggaagaacggcgtgaatgaggccaagatcgacgaaataaaaaacgacaacgtgcaggatactgcagagcagaaagttcaactcttgcggaattggcaccagcttcacggcaaaaaggaggcatatgacacactgattaaagacctcaagaaagccaatctttgtacactcgctgagaagatccagaccataatcctgaaagacatcacaagcgattcagaaaattcgaatttcaggaatgaaattcagtctctggtttag

SEQ ID NO: 24142 - DNA, 735 bp, Artificial Sequence
  Description of Artificial Sequence: Synthetic coding sequence
atgctgggcatctggaccctgctgcccctggtgctgaccagcgtggccagattgtcttccaaaagcgtgaatgcacaggtgactgacattaactctaaaggtctggagcttcggaaaaccgttaccaccgtggaaactcagaatctagaagggttgcaccatgacgggcagttctgtcataagccatgcccccccggcgagaggaaagctagagactgcaccgtgaacggcgatgagcctgactgtgtaccctgccaggagggaaaagagtatactgacaaggctcacttcagctctaagtgtcgacgttgccgtctctgcgatgaaggccacggtctggaagtggaaattaactgtaccagaacacagaacactaagtgccgctgcaaacctaattttttctgtaactcaacagtgtgtgagcattgtgatccctgcaccaagtgtgagcacggcattattaaagagtgcacactgacttccaataccaagtgtaaagaggagggcagccgctccaatcttggttggctctgcctccttctcctccccattcccctcattgtctgggtgaagcgcaaggaggtacagaaaacgtgcaggaagcacagaaaggagaaccagggcagccacgagagccccacccttaatccagaaacagtagcgatcaatctgtccgatgtcgacctatcaaagtatcatcattactgctggagtcacgacaccaagtcctcctag

SEQ ID NO: 24143 - DNA, 1089 bp, Artificial Sequence
  Description of Artificial Sequence: Synthetic coding sequence
atgctgcgggtgtgcgcccagggctggcacgcccagggcctgccccatggtacgaactctttactgaaaggaggaacagaaacaagcctgtccacccctaccagattagtcgtgttgacatctgtggcccgcctctcatcgaagtctgtgaatgcccaggtgactgacattaattctaaggggcttgagctgcggaaaaccgtgaccaccgtggaaacccagaatctggaaggactccaccatgatggccagttttgccacaagccatgcccgcctggagagcgcaaagctcgggattgtaccgttaacggcgatgaacctgactgtgtcccttgtcaagaaggaaaggagtacacagataaggcccacttttcctctaagtgcagacgctgccgcctctgcgacgaagggcatgggctcgaggtcgagattaattgtacaagaacacagaatactaagtgccgatgtaagcccaactttttctgcaatagcacagtatgtgaacactgcgacccgtgtactaagtgcgagcacggtattatcaaggaatgcacgctgaccagcaacacgaaatgcaaagaggagggaagtaggtctaacttggggtggctgtgtctccttctgttgcccattcccctgatagtgtgggtgaagaggaaagaagttcaaaaaacttgtcgcaaacatcggaaggaaaaccagggcagtcatgaatctcctaccttgaaccccgtgggcatagagatcgacttctccgacgtggacctgtccaagtacattactaccattgcaggggtcatgacactgtcgcaagtaaaaggattcgtgaggaaaaacggcgtaaacgaggcgaagattgatgagatcaaaaacgataatgttcaagatacagctgagcagaaggtgcagctgcttagaaattggcaccaactccacgggaagaaggaggcatacgatacactgatcaaagaccttaaaaaggctaatctctgcaccttggcggaaaaaattcagacgattattctaaaagatatcacctctgattccgaaaactctaacttccgtaatgagatccaatctcttgtctag

SEQ ID NO: 24144 - DNA, 627 bp, Artificial Sequence
  Description of Artificial Sequence: Synthetic coding sequence
atggaccccttcctggtgctgctgcacagcgtgagcagcagcctgtcttcttccgaactgaccgaacttaagttcctttgcctaggaagggtggggaaacggaaactggagcgagtgcagtcagggctagaccttttctctatgctgctagagcagaacgacctggaacctgggcataccgaactgctaagagaactgctggcatctttgcgcaggcatgatcttctgagaagggttgacgacttcgaggctggcgccgcggccggggctgcgcccggtgaggaagacctctgcgctgcttttaacgtgatctgtgacaacgtcgggaaggactggaggcgtctggccagacagttgaaggtctccgatactaaaatcgacagcatagaggatcgttaccctagaaatctaacggagagagtgagggagagcctgcgaatctggaagaacaccgagaaagagaacgcaacagtggcgcacctcgtgggcgccttacgctcatgtcaaatgaatttagtggccgacctagtgcaggaggtccaacaagcacgcgacctgcagaatcggtctggagccatgagccccatgtcctggaattccgacgcctcaacaagtgaggccagctag

SEQ ID NO: 24145 - DNA, 384 bp, Artificial Sequence
  Description of Artificial Sequence: Synthetic coding sequence
atgcagcagcccttcaactacccctacccccagatctactgggtggactcttctgcttccagtccttgggccccccccggaactgtactcccctgccccacttctgtgcctagacgcccagggcaaaggcgtccaccccctccgccgcccccacctccactgcctccgccccctcccccaccacctttaccgcctttacccttgccaccactgaaaaagcggggtaaccacagtacagggttgtgtctactcgtgatgttttttatggtgttggtggccttagtggggctcgggctgggaatgttccagcttttccacctgcaaaaggagttggccgagctgagagaggccactccggtgcatccgcttaagaagagaagctag

SEQ ID NO: 24146 - DNA, 846 bp, Artificial Sequence
  Description of Artificial Sequence: Synthetic coding sequence
atgcagcagcccttcaactacccctacccccagatctactgggtggactcctcagcatcttctccgtgggcaccgccagggactgtgttgccctgccccacgtcagtccccagaagacctggtcagcggcgaccgccccctccccctcctccaccacctctgccgccccctcctcctccgcctcccctacctcccctcccgctccccccgctgaaaaagcgaggtaaccacagtaccggtctctgcttacttgtcatgttttttatggtgttagtcgccctggtgggcctcggtctggggatgttccagctattccatctacaaaaggagctggccgaactccgcgaaagcaccagccaaatgcacacagcatcctctttggaaaagcagatcgggcacccctctccacctccagagaagaaggagctcaggaaggtggctcaccttaccggcaagtccaactctcgaagcatgcctctcgaatgggaagacacatacggtatagtgttgctcagtggggttaagtacaagaagggcggcctagtgattaacgagactgggttgtactttgtgtacagcaaagtctatttccggggacagagttgcaacaatctcccactcagtcataaggtgtatatgcgcaattccaagtacccacaggacctggtaatgatggagggcaagatgatgtcttactgcaccaccggtcagatgtgggctaggagtagctacctcggtgccgtatttaacttgacctccgcggaccacctgtacgtgaatgtgagcgaactctccctggtgaacttcgaggaaagtcaaacatttttcgggctctataagctctag

SEQ ID NO: 24147 - DNA, 13773 bp, Artificial Sequence
  Description of Artificial Sequence: Synthetic coding sequence
atgggccggcacctggccctgctgctgctgctgctgctgctgttccaacactttggagattcagatgggagtcagaggttggagcagacccccctgcagttcacgcatctggaatacaatgtgaccgttcaagaaaattccgcggcgaagacttacgtgggccacccggttaaaatgggggtgtacatcacgcacccagcttgggaagtcaggtacaagatcgtctctggcgacagcgagaacctcttcaaggccgaagagtacatactaggcgatttttgctttctgcgtatccgaactaagggaggtaatactgcaattcttaaccgtgaggtcaaagatcactatactttaatcgtaaaagctctggagaagaacaccaacgtcgaagccagaactaaagtgagagtgcaggtgcttgacacaaacgatctccggcctctgttttctccaacaagttactcagtgagtttacctgagaacactgccatcagaacctctattgccagagtctccgcaacagatgccgacatcggaactaacggcgaattctattactcattcaaggacagaacagacatgtttgcgatccaccctacatccggcgtgattgtgttgacaggcagactggattatctggaaacgaagctgtatgaaatggagattttggctgcagataggggcatgaagctctacgggagtagtggcatttcttcgatggcgaagctgacagtgcatattgaacaggcaaatgagtgcgctcctgtaattaccgccgttacgctgtcaccaagcgagctggatagggaccctgcctacgccatagtcacagtggacgactgcgatcagggtgcaaacggagatatcgctagtctgtccattgtcgcgggtgatttgttacaacagttcaggacagttagaagcttccccggcagcaaagagtacaaggttaaagctatcgggggcatcgattgggactcacaccctttcggctacaatctgacacttcaggctaaggataagggcacacctcctcagttcagctcggtcaaggtaatccatgtaacaagtccacaatttaaggcgggcccagtaaagttcgagaaggacgtgtatcgggccgaaatcagtgagttcgcgcctcctaacactcccgtggtgatggtgaaagctattccagcttacagccaccttcgctatgtctttaaaagcacccccggaaaagcaaaattttccttaaactataatacaggcctcatttcgatcctggaacccgtcaaacggcagcaggctgctcattttgaactcgaggtgactacttctgatagaaaagcaagtaccaaagtcttagtgaaagtacttggagctaacagcaacccacccgaattcacacagacagcatacaaggcagccttcgatgagaacgtacctatcggcactaccgtcatgagtctatccgccgtggacccagacgagggggagaacgggtacgttacctattcgatcgctaacttgaaccacgtaccctttgcgatcgatcatttcacgggtgccgtatctacctccgaaaacttggactacgagctaatgcctcgcgtctataccctgcgcattagggccagtgattggggcctgccttataggcgcgaggtggaggtcttggcgactatcacattaaacaatttgaatgataataccccactgtttgaaaaaatcaactgcgagggtaccattccacgtgacctgggagtcggcgagcaaattactaccgtaagcgccatcgatgcagacgaactacaactcgtgcagtaccagatcgaggccggcaacgagttggattttttttcgttgaatcccaacagcggcgttctctccttaaaacgcagtctgatggacggcctgggagctaaagtctcattccattccctgcggattacagctacagatggagagaactttgcaacccccctatatatcaacattaccgttgcggcatcacacaagctagtgaacctgcagtgcgaggaaacaggagttgcaaagatgctggcagaaaaactcctacaagccaataaattgcacaaccaaggagaggtggaagacatttttttcgattcccacagcgttaacgcccacattccacaatttcggagcaccctgccaaccggaattcaagttaaggagaatcaacccgtgggcagttcagtcatattcatgaattctaccgatttagacaccggattcaacgggaaattagtctatgccgtgtccggagggaatgaagattcttgctttatgattgatatggagacagggatgctaaagatcttgtcaccacttgacagagaaacaactgataaatacaccctcaacataacagtgtatgacctcggcattccccagaaagctgcatggagactgcttcatgtcgtcgtcgtcgatgccaatgacaatccgcctgaatttctccaggagtcctacttcgtagaggtgtctgaggataaggaagtgcactctgaaattatccaggtggaggccactgacaaggacctgggacctaacggccacgtgacatacagcatagtcactgatactgatacatttagcattgacagtgtgactggagtggtgaacatagcacgtcctttggaccgcgaacttcagcatgagcactcccttaaaatcgaagccagagaccaggcacgggaggaaccacagctgttctccacagtggtagtgaaggtaagcctcgaggatgtgaatgacaaccccccgacattcatcccacccaactatcgagttaaggtgcgagaggatctgcccgagggaacagtcatcatgtggcttgaagcacacgatccagacttggggcagtccggtcaagtgaggtatagtctccttgatcatggagagggaaactttgacgtcgataaactgtctggagctgtcagaatcgtgcagcagttggacttcgagaaaaagcaggtgtacaatcttacagtaagggcaaaggacaaaggaaaacctgtatccctgtcgagtacatgttacgtcgaagttgaagtcgtggacgttaatgaaaatctgcaccccccagtcttttcctctttcgtggaaaaagggaccgtcaaagaagatgcaccagtcgggtctctcgtcatgacggtcagcgcacacgatgaggacgccaggagggacggcgaaatacggtactccatccgcgatgggtccggcgttggtgtcttcaagatcggcgaggagacaggggtgattgaaacaagcgatcgactcgatcgtgagtctacaagccattactggctgaccgtttttgctaccgatcagggagtggttccattgtcttcatttattgagatctacattgaggtagaggatgtgaacgacaacgctccgcagacctcggaaccagtctactatcccgagataatggagaattcaccaaaagatgtgtcggttgtacagattgaggcttttgaccccgatagtagctctaacgacaaactgatgtacaaaatcaccagtgggaaccctcagggctttttttccatccatcctaagactggcctgataacaactacgtcccgtaagttagaccgagagcagcaggacgaacacatcctggaagtgacagttactgataacggatcgccaccaaaatccaccattgctagggtgatcgtaaagatccttgacgaaaatgataataaacctcagtttctacaaaaattctacaaaattaggctacctgagcgtgaaaaacctgatcgggagcggaatgccaggcgtgaaccactctaccatgttatcgcaacagataaggatgaagggcctaatgccgaaatttcctatagtatcgaagatgggaatgaacatggcaagttcttcattgaacctaagaccggtgttgtcagtagcaaaagatttagtgccgccggtgagtatgacatactaagtatcaaagccgtggataacggccggccacagaagtcttccaccaccagactgcacattgaatggatcagtaagcctaagccctctctggagccaattagctttgaggagagttttttcaccttcactgttatggagagcgaccctgttgcacacatgattggggtcatatctgtggagccaccaggtatacctctctggtttgatatcacaggtgggaactacgattcccactttgatgtcgataaagggaccggtacgattatagtggcaaagcccctggatgcagaacagaagtcgaattataatttgaccgtcgaagctaccgacggaaccacgacgattctgacccaagtgtttattaaagtcatagataccaatgaccaccgacctcagttttctacctccaaatacgaggtggtgatcccagaagatacagcacccgagacagagattcttcaaattagcgctgtagatcaagacgagaaaaataaacttatatatacgttgcaaagtagcagagaccctctgagcctgaagaagttcaggctcgaccccgctaccgggagcctatacacatctgaaaaactcgatcatgaagctgtgccagcccacctcacagtgatggtgcgtgaccaggacgtccccgtgaagcgcaattttgccagaatcgttgttaacgtctctgacactaacgaccatgccccatggtttaccgcctcctcttataagggtcgggtctatgagtctgcggctgttggatctgttgtgctgcaagttacggcactagacaaagacaaaggaaagaatgcggaggtgttgtacagcattgagagtggaacttttggcaatattggcaattcattcatgatagatccagtgctcggcagcattaaaactgccaaagagttagatcgatccaaccaggcagaatatgaccttatggtcaaggcaacggacaaagggtctcccccaatgagcgaaattacatcagtgcggattttcgtcactattgccgataacgcatcacccaagttcacctcaaaggagtactccgtagagctctcggagacagtttcaattggctcttttgttggtatggtcacggcccacagtcagtcttcagtggtatacgaaatcaaggatggaaacactggagacgctttcgatatcaatccacacagcggcaccattataactcagaaggccctcgactttgagaccttgccaatttatacacttattatccagggtacaaacatggctgggctgagcactaatactaccgtgctggtgcatctgcaagacgagaatgataatgcgccggtgttcatgcaagctgagtataccggactgatctctgaatcagcaagcattaactcagttgtgcttacagacagaaacgtgccgctggttatccgggcagccgatgctgataaagactcaaacgctcttctggtgtatcatatagtcgagcctagcgtgcacacttatttcgccattgattcgtccacaggggctatccatactgtgcttagtctcgattacgaggaaacgagcatcttccattttacggtccaggtacacgacatggggacccccagactgttcgccgaatatgctgccaatgtgacggtccacgttatcgacatcaacgactgccccccagtgtttgccaagcctttgtacgaggcctccctgctgctccccacctacaagggggtcaaagtcatcaccgtgaacgcaacggatgccgatagttcagccttctcacagctaatttatagtataaccgagggcaatatcggagagaaattcagcatggattacaaaaccggagcattgaccgtgcaaaataccacacaactcagatcccgatacgagctgactgtaagggcctccgacggccggttcgctgggctgactagcgtgaaaatcaatgtcaaagagtccaaagagagccatttgaaatttactcaagacgtatactcagctgtggtcaaggaaaacagtacggaggccgagacccttgccgttattacagccattggcaaccctattaacgagccactgttttaccacatattaaatccagacagaaggttcaagatctctcgtacatctggagtgttgtcgactaccggcaccccttttgatcgtgagcagcaggaagctttcgacgtggtagtcgaggtgaccgaagagcataaacctagtgccgtggctcatgtggtagtaaaagtaatagtggaggaccaaaatgacaacgccccagtgtttgtaaacctgccttattatgcagtggttaaagtggacacagaggtcgggcacgtcataaggtatgtcaccgctgtcgatcgagactccgggcggaatggcgaggtacattattacctgaaggagcatcacgaacatttccagattggccccctgggtgaaatttcattaaaaaaacaattcgagctggacacgctgaacaaagaatacctggtgacagtggtggctaaggacggtggcaatccagcctttagtgctgaagtgattgtgcccatcaccgtcatgaataaagctatgcccgttttcgagaaacccttctactccgctgagatagccgaatccatccaggtacactctccagtagtgcacgtgcaggcaaattcacccgagggactcaaagtgttctactctattacggacggggaccctttctcacaatttacaataaactttaatacgggggttatcaacgtgatcgcacccttagactttgaagcccatcctgcttataagctgagtatacgggccacagacagcctaaccggcgcacacgctgaggtcttcgtcgacatcatagttgacgacatcaatgataacccccctgtctttgcgcagcagtcctacgccgtgaccctgtccgaagcaagcgttatcggaactagtgtcgtgcaggtgcgggcaactgactccgattccgaacctaaccggggtatttcctatcaaatgtttgggaaccactcaaaatcccatgatcactttcacgtggattctagcacaggcctcatctctctgctaagaaccttagattatgagcagtctcgacagcatactatattcgttagggccgtcgatggagggatgcccactctcagctccgacgtgattgtgaccgtagacgtaactgatcttaatgataatcctcctctatttgaacagcaaatatacgaggcacgaatcagcgagcatgcccctcatggccactttgtaacatgtgttaaagcgtacgatgccgatagtagcgatattgacaaactccaatactcaattctatctgggaacgatcacaagcactttgtgatcgactccgctactggcattatcactctgagtaacctccacaggcatgcccttaaaccgttctatagtctgaatctgagtgtgtccgacggcgtgttccggagctccacccaggtgcatgtaacagtgatcggcggcaacctgcattcccccgccttcttacagaacgagtacgaagtggagctggccgagaatgcccctctgcataccttagtgatggaggtcaaaaccactgacggagacagtggaatctacggccacgtgacataccatatagtgaatgacttcgcgaaagacaggttctacatcaatgaacgcggacagatctttactctcgagaaactggaccgcgagactcctgctgaaaaggtcatcagcgttcgcctgatggccaaagatgctggcggtaaagtggcattttgcacagtgaatgtcatactcacagatgataacgacaacgctcctcaattcagagccactaaatatgaggtcaatataggaagctccgctgccaagggcacatccgtggtgaaggtactcgcctcagatgcagatgagggaagtaacgccgatatcacatatgcaatcgaggcagactcagagagcgttaaggagaacctagagatcaacaagttgtctggggtaataactactaaggaaagcctgattggacttgaaaatgagttcttcacattctttgttcgcgccgtggataacgggtcaccttccaaagagtcggtggttttggtttatgtgaaaatcctgccgccagagatgcagctgccaaaatttagcgaaccattttacacattcacggtgtcagaagatgttccgatcgggactgaaattgacctgattagagctgagcacagtggtacagtcttgtacagcttggttaaaggcaataccccagaaagcaaccgcgacgagagtttcgttattgatcggcagtctggaagactgaagttggagaagtccttggatcatgagaccactaagtggtaccagttttccattctggcccgttgtacacaggacgatcacgagatggtcgcttccgtcgatgtcagcatccaggtgaaagacgcaaacgataatagtccagtatttgaatcctcaccctacgaggcctttattgttgaaaatttacccggaggtagccgcgtcatccaaatcagagcgagtgatgcagattcagggactaacgggcaggtcatgtactctttggatcagagtcagagcgtggaagtgatcgaaagctttgctattaatatggagaccggctggatcaccacattgaaagagctcgatcatgagaagagagacaactatcagatcaaagtggtagcctctgaccatggggagaagattcagctgtcgagcacagcgattgtagatgtgactgtcacagatgtcaacgacagccctccaaggtttaccgcagagatctataagggcaccgtctctgaagatgatccccagggaggcgtgatcgcgattctatccaccaccgacgccgactcagaggagattaaccggcaggttacttacttcatcaccggtggcgaccccctgggacagttcgccgtggagactatccagaacgaatggaaggtctacgtgaagaaaccacttgacagagaaaagcgggacaattatcttctcactattactgccacggatggaaccttcagctccaaagctatcgtggaagtgaaagtcctggacgctaatgataattcgccagtgtgcgagaaaactctgtattccgacacaatcccagaagacgtcctgccaggaaagctgatcatgcagatttcagccaccgatgcggacattcgttctaatgccgagattacttatacattactgggttctggcgccgaaaagtttaagctgaatccagacactggagaactcaaaacctcgaccccactggacagagaggagcaggcagtctatcatctgctggttagagccacggacggcggtgggcgattttgtcaggcctctatagtgctgacgctggaagatgttaatgacaacgccccagagttcagtgccgatccttatgcaattacagttttcgagaatacggagccaggcaccctgctcactagggtgcaggccactgacgccgacgcaggtcttaacaggaagattctttatagccttatcgattctgccgacggtcagttttccatcaatgaactgtcggggatcatacagttagaaaagcccctggaccgcgagttgcaggccgtttacaccctgtccctgaaggctgttgatcagggacttcctaggcgcctgaccgccaccggtaccgttatagtgtccgttctagacatcaatgacaaccctcctgtctttgagtatagggagtatggggccactgtgagcgaagacatactcgtgggtaccgaggtcctccaggtttatgcagcgagccgtgacatcgaggctaatgctgaaatcacgtactccataatctccggaaacgaacacggaaaattcagtatcgacagtaaaacaggtgcggtcttcatcatagagaatctggactacgagagttcgcacgagtattatctaaccgtggaagccactgatggaggcactccctccctgagtgatgtcgccacagtgaatgtgaacgtgacggatattaacgacaacaccccagttttctcccaggacacatacacgacagtgatctctgaggacgctgtccttgagcaatccgtgatcaccgtgatggcagacgacgccgatggccctagtaactcccatatccactacagcatcattgacggcaaccaaggctctagcttcactattgacccagtccggggcgaggttaaagtgaccaaactattggacagggaaacgatcagtggctatactctgacagtgcaagcatccgataatggcagtccgccacgcgtcaacactaccactgtaaacattgacgtctccgatgttaacgacaacgcccccgtgttctcgcgtggtaattattcagtcattattcaggagaataaaccggtgggattttctgtgctgcagctggtggtcaccgatgaagacagctcccataatggaccacccttttttttcactattgtgacgggaaatgatgagaaagctttcgaggtgaacccacagggcgtcctactgacatcgagcgccatcaaacgcaaggagaaggatcactatttacttcaagtgaaggtcgcagataatggtaagcctcagctgtcttcactcacctatattgacatccgcgtgatcgaagaatcaatttatccgcctgccatactgcctcttgagattttcatcacaagctccggggaagagtacagcggaggagtgatcggaaaaatccacgccacggaccaagacgtatatgacaccctgacttactccctggacccccagatggacaacctgttctctgtctcctcaacaggcggcaagcttatcgcacacaagaagctggatatcgggcagtacctgctcaacgtcagcgtaacagacggcaaatttaccactgtcgccgatattaccgtccacataagacaagttactcaggaaatgctcaaccacactattgccatcaggttcgcgaatctcacacctgaggagttcgtgggcgactactggaggaatttccaaagggcgcttcggaatattctcggagtccgcaggaatgacatccaaatcgttagcctccagagctccgaaccccaccctcacctggacgtgctcctgtttgtagaaaagcctggcagcgctcaaattagcaccaaacagctgctgcacaagattaactcctccgtgacagacattgaagaaatcattggcgtccgcatcctgaacgtctttcagaaactctgcgccgggctcgactgcccgtggaagttctgtgatgaaaaagtctccgtggacgaatccgtgatgagtacccactctaccgctcgcctgtctttcgtcaccccaagacaccacagagctgccgtatgtctgtgtaaggaaggacgctgtccaccagtacatcacggttgcgaggatgacccttgcccagaaggaagcgagtgcgtctcggacccatgggaggaaaaacatacatgcgtgtgtcccagcgggcgctttggccagtgcccgggaagttctagtatgacactcactgggaattcatatgtaaagtatcggctgaccgaaaatgaaaataaactcgagatgaaattaactatgaggctgagaacatacagcacccatgccgtggtgatgtacgccagggggacggactactctattctcgagatccaccatggaaggctgcagtataaatttgattgcggcagcgggcctggtatagtcagtgtgcagtccatccaagttaatgacggacaatggcacgcagttgctttagaagtcaacggaaactacgccagactggtattggaccaagtgcacacggcaagcggcacggccccaggaacccttaaaacactcaacctggataactatgtcttcttcggcggccacatacgccagcaaggcacccgccatggccggtctccgcaagtgggcaacgggttcaggggctgcatggattccatttacctgaacgggcaggaactgccgctaaactccaagcccaggtcatatgctcacatagaggaaagcgtagatgtgtcccccggttgctttttgactgcgacagaagactgcgctagcaatccttgccaaaatggtggtgtttgtaatccctcgccagcggggggctattattgtaagtgctccgctctgtatataggcacacattgcgagatctcagttaacccctgttcatcaaaaccttgtctgtatggcggtacttgtgtcgtagacaacggaggattcgtgtgtcaatgtcgcgggctctacaccggtcagagatgccagcttagtccttactgcaaagacgagccttgtaaaaacggcggaacctgcttcgatagcttggacggagccgtatgtcagtgtgatagcgggtttcgaggggaaaggtgtcaatcagatatcgacgaatgctccggcaacccatgcctgcacggagcactatgcgaaaacactcatggcagttatcactgtaactgctcacatgaatacagaggccgacattgcgaggatgcagcccctaaccaatatgtctccacgccctggaatattgggctcgctgagggcattggtattgttgtgttcgttgctggtatctttctgctggtggtcgttttcgtgctgtgcagaaaaatgataagccgcaaaaagaagcatcaggcagaacctaaggacaagcatctaggccctgccacagctttcctccagaggccttactttgattcgaaactgaacaaaaatatttactccgacatacctccacaggtccctgtaaggccaatctcctacaccccctctatcccctctgattcccgcaataatcttgaccgtaactccttcgagggcagcgctatccccgagcaccccgagttcagcacattcaatcccgaatccgtccatgggcaccgaaaggcagttgctgtatgctccgtcgcacccaacctgccccctccgcccccaagcaacagcccgagtgactctgacagcatccagaaaccttcctgggactttgattacgatacgaaggtggttgatctggatccctgcctcagcaaaaaacccctggaggaaaaaccctcccaaccatactcagcacgcgagtctctatcagaggtgcagagcctctcttcatttcagagcgaaagttgtgacgacaacgggtaccattgggacacctcagactggatgccgtctgtaccactgccagacattcaggaattcccgaattacgaggttattgacgagcagacccccctctatagtgcagatccaaatgcgatcgataccgattactacccaggcggctacgacatcgaatcagattttcctcccccccccgaggattttcccgccgccgacgagctgcctcccctgccgcccgagtttagcaaccagttcgagagtattcacccaccgagggacatgcccgcggctggctcactgggatcctccagcaggaaccgtcagcgttttaacctgaatcagtacttacctaatttctaccccttagatatgagtgagccacagaccaagggaaccggggagaattcaacctgtcgtgaacctcatgccccataccctcctggctaccaacggcacttcgaagcccctgcagtggagagtatgccaatgtcagtatatgcttcaactgcaagctgctctgacgtaagcgcctgctgcgaggtagagtccgaggtgatgatgtctgactacgagtcgggggatgatgggcactttgaagaggttacaatccctcctctggattctcagcagcacacagaagtgtag

SEQ ID NO: 24148 - DNA, 13767 bp, Artificial Sequence
  Description of Artificial Sequence: Synthetic coding sequence
atgggccggcacctggccctgctgctgctgctgctgctgctgttccaacactttggggatagcgatggctctcaacggcttgagcagacccctctccaatttacccacctagaatataatgtgacggttcaagaaaactccgctgcaaagacatacgttggacatccagtgaagatgggagtctacatcactcacccagcgtgggaggtgaggtataaaatagtgtcaggagatagtgagaatttgttcaaggcagaagaatacatcctgggggacttctgtttcttgcgcatcagaactaagggaggcaatactgccatccttaatagagaggtcaaggaccactacacactgatagtgaaggcattggagaagaatacgaatgtcgaggctcgcacgaaggtccgggtgcaggtgctagacactaacgacttacgtcccttgtttagtcccactagttactccgtctcactacccgagaatacagctattagaaccagcatcgccagggtaagcgctactgacgcagacatcgggactaacggggagttttattactcgttcaaagatcggacagacatgttcgccatccaccccacatcaggggtcatcgtgctgaccggacggctggattatcttgagaccaaactgtatgaaatggaaatcctggccgcggaccgcggaatgaaattgtatggttcttctggaattagctccatggccaagcttacggtccacattgaacaggccaacgaatgtgctcccgttatcacagcagtgacgttgagccctagcgaactcgacagagatccggcctatgccatcgtgacagtggacgactgcgaccagggcgcaaatggggatatcgccagcctgtccattgtggccggtgacctccttcagcagtttagaaccgttcggtcctttccgggctccaaagagtacaaggtaaaagcaatcgggggaatcgattgggatagtcatcctttcggatataacttaactttacaggctaaggataaggggactccaccccaattctcaagtgtgaaagtcatccacgtgacatccccccagttcaaggcggggcccgtcaagttcgagaaggacgtttaccgagctgaaatctccgagtttgccccaccaaatacccctgttgtgatggtcaaagcaataccagcctattctcacctccgatacgtcttcaagagcacaccaggcaaagcgaagttctctctgaactataacacgggccttataagtatcctggaacccgtgaagcgccagcaagccgctcactttgaactggaagtaactacttccgatcggaaagcctccacaaaagtgttagttaaagtcctgggtgcgaattcaaacccccctgagtttacacagactgcctacaaagcagccttcgacgagaatgttcctattgggaccaccgtgatgagcctctctgctgtggatcccgacgagggggaaaatggctacgtaacctatagcatcgcgaaccttaaccacgtgccattcgcaattgatcactttacaggagcggtgtcaacctcagaaaaccttgactatgaactgatgccaagggtatataccctaagaattcgcgctagcgattggggcctgccctacaggagagaagtagaggtgctcgccactataactcttaataatctgaatgacaacacccccctgtttgagaagattaattgtgaaggcactataccgagggatttgggagtgggagagcagatcactaccgtgtctgccattgatgccgacgagctccaattggtgcagtatcagattgaagccggtaatgagctggatttttttagtctcaacccgaatagcggggtgctgtctctgaaaagatctcttatggatggattgggagcaaaggtctcatttcactccttgaggatcactgctaccgacggggagaattttgctaccccgctgtatataaacattacagttgccgccagccataaactggtcaacctccagtgcgaagagactggagtcgctaagatgctggctgagaagctgctccaggccaacaagttgcacaaccagggtgaggtggaggacatcttcttcgattcccattcagtgaatgcacacattccacagtttcgttctactcttcctacgggcatccaggtgaaggagaaccagcctgtgggcagcagcgtcatattcatgaattcaactgatctggatacaggctttaacgggaagctggtgtacgcggtttccggggggaacgaggactcttgttttatgatcgatatggagacggggatgctaaagatcctttcaccactggaccgagagactaccgacaaatacaccttaaacatcaccgtgtacgatcttggtataccccaaaaggctgcgtggcgactcctgcacgtcgtcgtcgttgacgccaatgataatccaccagaatttctgcaagaaagttactttgtggaggtgagtgaagacaaggaggttcacagtgagataatacaagtggaagcaaccgacaaggatctagggccgaacggtcacgtgacatattcgatagtgaccgacaccgatacttttagtattgactcagtgactggtgtggtgaatattgcaaggcctctggatcgtgagctgcaacacgagcattccctcaaaatcgaagctagagatcaggctagggaggaaccccagctattcagcactgtcgtggtcaaagtgtctctggaagacgttaacgataaccctccaaccttcatcccccccaattatagagtcaaagtgagagaagacctccccgaaggaacggtgatcatgtggctcgaagcacatgacccggatctggggcaaagtggccaggtgagatacagcctattagaccacggagaggggaactttgatgtggacaagctgagcggggcagtgagaatagtgcaacagctggacttcgaaaagaaacaggtctacaatctcaccgttagggccaaggacaaaggtaaacctgtttctctctctagtacttgctacgtcgaagtggaggtggtcgatgtaaatgaaaaccttcatcctccagtgttcagtagctttgtggaaaaaggcaccgtaaaggaagatgccccagttgggtcattggttatgaccgtgtcggctcatgatgaggacgctcggagagacggggagatccgctactctatcagggacgggagtggggtcggtgtattcaagatcggtgaagaaactggtgtgatcgagacatctgaccgactggaccgcgaaagcacttcacattattggctgaccgtgttcgctacagatcagggggtagtcccactgtctagcttcatcgagatctacatcgaagtggaagatgtgaatgacaacgctccgcagacatcagaaccagtgtattatcccgagattatggaaaacagccccaaagatgtgtctgtggtccaaattgaagctttcgacccagactctagttccaacgataagttgatgtataagattacctctgggaatccacagggattcttttccattcacccaaagacgggtttgattacaacgaccagccgcaagctagaccgcgagcagcaggacgagcacatactggaggtgactgtcaccgacaatggcagtccacccaagagtactatcgctcgggtgattgtaaagattctggatgagaatgataataaaccacagtttttgcaaaaattttataaaatccgtctgcccgaacgtgagaagccagatagagaacgcaacgcgcggagagaaccactgtatcacgtaattgcgaccgacaaagatgagggacccaacgctgagatctcttacagcatcgaggacgggaacgagcatgggaagtttttcattgagccaaaaaccggggttgtgtcgtcaaaacggtttagtgcagcaggagaatatgatatcctcagcattaaggcagtggataacggacggccccaaaaaagctctacaactagactccatatcgagtggattagcaagcctaaaccaagcttggagccaatctcgtttgaggaatcgtttttcacgttcactgtgatggagtcagaccctgtggctcacatgattggcgtcatctccgtcgagccaccaggcatccccttatggtttgacatcactggcggcaattacgactcacattttgacgtcgacaaggggacaggaaccataatcgtagctaaacccttggatgcagaacaaaaatccaattacaacctcacggtggaggccaccgatgggacgaccacgattctgacccaggtgtttatcaaggtcatcgataccaatgatcacaggccccagttttccacatccaagtacgaggtcgtgattccggaagatacagcacccgaaactgagatccttcagatctctgcagtcgaccaggacgaaaagaacaagcttatttatacacttcagagctccagagacccattgtcattgaagaaattcagattagatcccgctactggtagtctttatactagcgaaaagttggaccacgaggccgttcatcaacatacactgaccgtaatggtgcgcgatcaggacgttcctgtcaaaagaaattttgccaggatcgttgtgaatgtttcagacaccaatgaccacgcaccctggtttaccgcctccagttacaaaggtagagtgtacgaaagtgcggccgtgggatccgtagtccttcaggtcactgcccttgataaggacaagggaaagaacgcagaagtgctgtattcaatagagtcaggtaatatcggcaattcattcatgatcgatccagtgctgggatccatcaaaaccgctaaagagctggacaggagcaaccaggccgaatatgacctgatggtgaaggccactgataagggttcacccccaatgagcgagataacatccgtgaggatatttgtaaccatcgcagacaatgcaagtccgaagttcacctccaaggaatacagtgtcgagctttcagaaacagtttccattggctcgtttgttggtatggtgacggctcactctcagagtagtgtggtttatgagattaaggacggaaacactggagatgccttcgacattaatccccattctggaacgattataacccaaaaggcactggactttgagacgctcccaatttatactctcatcattcaagggaccaacatggccggactatccactaataccacagttcttgttcacctccaggacgagaacgataacgcccctgtatttatgcaggctgagtatacaggcctgatctcagaaagtgccagtatcaatagtgtggtcttgaccgatagaaatgtgccacttgtgattcgggcagctgacgctgacaaagattcgaacgctctgcttgtctaccacatcgtggagccgtctgtgcatacatacttcgccattgactcgtctaccggcgcaatccacaccgtcctgagcctggactatgaagagacatctatctttcatttcaccgtgcaggtgcacgatatgggcacacccagactgtttgcagagtatgccgcaaacgttactgtgcacgtgattgatatcaacgactgcccccctgtgttcgcgaaaccattatacgaggcctcgctccttctccccacttacaagggagttaaggtcataacagtcaacgcaacagatgcagactcaagcgccttttcccagctcatctactccattactgagggtaacataggggagaagttttcaatggattacaaaacgggtgcccttaccgtgcagaataccacccaactgaggtccagatacgaattaaccgttcgggccagcgacggaagattcgcgggccttacaagcgttaagattaatgtaaaagaaagcaaggaatctcacttaaaattcacacaagacgtgtattccgccgtggtcaaggagaactctaccgaggccgagacgctggcggtgatcactgccatcggtaaccctataaatgagccactcttttatcatatactgaaccctgatcgccggtttaaaatttcaaggacttcgggtgttctgtccactaccggcacaccgttcgaccgtgagcagcaagaggcttttgatgttgtcgtcgaggtcaccgaggagcataaaccgtctgcagtcgcccatgttgtagtgaaggtgatcgttgaagatcagaacgacaatgctcccgtattcgtcaaccttccttactatgcggtcgtgaaggtggacacggaggtcgggcatgttatcagatatgtaaccgccgtggatagagatagcggacggaatggtgaagtccactactatttgaaagaacatcatgagcattttcagattggaccacttggagagattagtctcaaaaaacagttcgaactggacacactcaacaaagagtacctcgtcactgtcgttgccaaagacgggggtaatccagctttttctgcggaagtgatagtaccaatcacggtcatgaacaaggcaatgccagtgttcgaaaaaccgttttacagcgccgagattgccgagagtatccaggttcacagccctgtggtgcacgtgcaggccaactctccagagggactgaaggtgttttactccattactgacggcgatccattcagtcagttcaccatcaatttcaacacgggggttatcaacgttattgcgcctctggacttcgaggcacatcccgcctacaagctatcaattagggcaaccgactccttgactggggcccacgctgaagtgttcgtcgacataattgttgacgatatcaacgacaacccgcccgttttcgctcagcaatcctatgccgtcacacttagcgaggcatcagtgatcgggacatcagtcgtgcaggtgagggctacagattctgactccgagcccaacagagggatatcataccaaatgtttgggaatcatagcaagtcacacgaccacttccatgtcgattcgtctactggactgatatcgttattgcgtaccctggattacgagcagtccagacagcatactatctttgtccgggctgtcgatggcggaatgcccaccctaagttccgatgttattgtcaccgtcgatgtgacagatctgaacgacaatccacccctatttgaacagcagatctatgaagcgcgcattagtgagcatgcaccccatggtcatttcgtcacctgtgtgaaggcttatgatgcagatagctctgacatcgataaactgcagtacagcattctttctggaaatgatcacaagcattttgtgatcgatagtgcaactggtatcatcaccctgtctaacctacatcgccacgccctgaagcccttctattccctcaacctgagcgtcagcgacggagtgttccggtcatctactcaggtccatgtgactgtgatcggaggtaatctgcacagccccgcttttctgcaaaatgaatatgaggtggaattggccgaaaacgcccccctccataccctggtcatggaagtgaaaacgactgatggcgattccggaatctatgggcacgtcacctaccacatagtaaacgactttgctaaagacaggttctacatcaatgaacgtggtcagatatttacactcgaaaagctcgatcgggaaacccctgccgagaaagtaatcagcgtccgtctcatggcaaaggatgccggaggaaaagttgctttttgcactgttaatgtgatactgacggatgataatgataatgccccgcagtttcgcgctactaagtacgaagtcaacattgggtctagtgcagctaaaggtacgtcggtagtgaaggtgttggcaagcgacgccgatgagggaagcaacgccgacatcacatacgcaattgaggcggattcagaatctgtgaaggagaacctagagatcaataaactctcaggtgtcattaccaccaaggaatctctaatagggctggagaatgaatttttcaccttctttgttcgggctgtcgacaatggcagcccttctaaagagtcagtcgtgctggtgtacgttaaaattctccccccggaaatgcaactgcctaaatttagtgaacctttctacacatttacagtgtccgaagatgtccctatcggcacggagatcgaccttattagagctgaacactccggcacggtcttgtattctcttgtgaaaggaaatacacctgagtctaatagggatgaaagttttgtgatcgatcgccagtctgggaggctgaagctggaaaaatcgttggaccatgagacaaccaaatggtatcagttcagtatactcgcacggtgtacacaggacgaccacgaaatggtcgcatcagtggacgtgtcaattcaggttaaagatgccaatgacaattcgccagtctttgaatcatcaccttatgaggcgttcattgttgaaaatctgcccggtggctcccgtgtcatccagatccgcgcgtccgacgctgattccggcaccaatggacaagtgatgtacagcttagaccagagtcagagcgtagaggtcatcgaaagtttcgcaataaacatggagacgggttggattacaacactcaaggagctcgaccacgaaaagcgagacaattaccagattaaggtggtggcatcggatcacggagagaagatccagctgagctctacagcaatcgtcgatgtgactgtgactgatgttaacgactcaccgcctcgattcaccgccgagatctataaaggcacagtgtccgaagacgacccacaggggggcgtgatcgctattttgagcactactgatgcggattccgaggagattaatcggcaggtgacatacttcatcaccggcggagatccgctcggacaatttgccgtggaaacaatccagaatgagtggaaggtgtatgtgaaaaaacccctggatagagagaagcgagacaattacctcctcaccattactgccacggatggaaccttttccagtaaggctatcgtggaggtgaaagtgcttgatgctaacgacaatagccccgtctgtgagaaaaccctgtatagtgacaccattcccgaggacgtccttcccggcaaactgattatgcagatttcagctacagatgcagacattcgttccaatgccgagattacttataccctgctagggtccggggccgaaaagttcaagctgaaccccgatacgggagaattaaagacttcaaccccgctggacagagaggagcaggctgtctatcacctcctggtgagggccacagacggtggaggtagattttgtcaggcgagtatagtgctcaccttggaggacgtgaacgacaacgcacctgagttttccgctgacccctacgcaataaccgtgtttgagaacaccgagccaggaaccctgctaacaagagtacaggctacagatgcagatgcagggctgaatcgaaagatcctctattccctgattgattctgccgacggtcaattttccatcaatgagctatcagggataatccagctagagaagcctcttgatcgagaattgcaagctgtgtatactctcagtctcaaagcagttgaccaaggccttcctcgaaggctgacagctactgggaccgtaatcgtctctgtgctagacattaacgataacccccctgtgttcgaatatcgtgaatatggcgctactgtcagtgaggacatcctggtaggaaccgaagtcctgcaggtgtacgctgcttctcgggacattgaggcgaacgcggaaatcacatactccattatttccggaaacgaacacggaaagttctctatcgatagtaaaaccggggcggttttcattatcgaaaacttggactatgagtcaagccatgaatattatctcacagttgaggctaccgacgggggcactccctcgttgtcagacgttgctacagtgaacgtcaatgtgaccgatatcaatgacaacaccccggtgttttctcaggatacctacacgaccgtgatctcggaggacgctgtgctagagcagagcgtcatcaccgtcatggcagacgatgcagatgggccctccaactcccatattcactatagtatcattgatggcaaccagggctcctccttcacgatcgacccagtgcgcggcgaggtcaaggttactaagttgctggatcgtgaaaccattagcggctacacactcacagtgcaggcttcagacaatggatccccccccagggtgaatacgactacagtcaacatcgatgtgtcggatgtaaacgacaacgctccagtttttagcagggggaattactctgtgattattcaggaaaataagcccgtagggttcagcgtgctccagctggtagtgaccgacgaggattctagccacaacggaccaccattcttctttaccattgttaccggcaacgacgagaaggcttttgaggtgaatccacaaggggtgctgcttactagttccgcaattaaaaggaaagaaaaggatcattacctgctccaggttaaagtggctgacaacggtaaaccacagttgagctccttgacttatattgatatcagggtaattgaggaatcgatctacccacctgctattctgcctcttgaaatcttcatcacctcctccggagaggaatatagcggaggcgttatcggcaagattcatgcaaccgatcaggatgtgtatgacactttaacatactctctggacccgcaaatggacaacctgttttctgtgagctccaccggaggcaagctgatcgcccacaagaagctagatatcgggcagtatctgctaaatgtatccgtgactgacgggaaatttaccacagtggcagacatcacggtacacatccgccaggtgactcaggaaatgctgaatcacacaatcgccatacggttcgccaaccttacgccagaggaatttgtgggcgactattggaggaatttccagagagccctgagaaacattctgggcgtgcgacgtaacgacatccaaattgtgagtctgcagtcctccgagccccacccacacctggacgtgcttctgtttgtcgagaagcccggcagtgcacaaatctccacaaagcagcttcttcacaaaatcaactccagcgttaccgacattgaggaaatcattggcgtacggatcctaaatgtattccaaaaactgtgcgccggattggattgtccatggaagttttgcgacgaaaaggtgtctgtcgatgaatctgtgatgtccacccatagcacagctcgccttagcttcgtgactccgaggcaccaccgagcagctgtctgtctctgtaaggagggtcgctgccccccagtgcaccacggctgtgaagatgatccatgtccggaggggtccgagtgcgtgtcggacccatgggaggaaaagcacacatgcgtctgcccctctggtcggtttgggcagtgtccgggaagctcatctatgaccctaacagggaactcctacgtgaaataccgcctgacggaaaacgaaaataaactcgagatgaagcttacaatgcgcttgcgcacatattccacacacgcagttgtgatgtacgctcgaggaaccgactattccatcctagaaattcatcacggacgcctccagtataagttcgactgcgggtccggacccggtatcgtgagtgtccagtccatccaggttaatgatggacagtggcacgctgtggccttggaagtgaacggtaattacgccagactagtgctggatcaggtgcacacagcgtctgggacggctccaggcacactcaaaacactgaacttagacaattacgtgttctttggaggtcacattcgacagcagggaacccgccacggccggtcaccacaagtggggaatggcttcagggggtgtatggacagcatctatttgaacggccaagagctgccactgaatagcaaaccaagatcctacgcccacattgaggaatctgttgacgtgtcccccggttgctttttgactgcaacagaagactgcgctagtaacccttgccaaaacggaggcgtgtgcaacccctctccggccggcggttactattgtaagtgttccgctctgtatataggtacacactgtgagatttctgtgaatccatgtagcagcaaaccgtgtctctacggtggcacgtgcgtcgtggacaatggggggtttgtatgtcagtgcagagggctttacaccggccagaggtgtcagctctctccctactgtaaggatgagccttgcaaaaacggcggtacatgctttgatagtttggatggagcggtctgtcagtgcgatagcggattcaggggagagcggtgccaaagtgacattgacgagtgtagtggaaatccttgccttcacggagccctctgtgaaaatacacacggttcgtatcattgtaattgcagccacgagtatcgcggtcgccattgcgaagacgcagctccaaaccagtacgtatcaaccccttggaacattggcctggcggaaggcatcggcatagtagtcttcgtggccggcatcttcctgctcgtggttgttttcgtgttatgtcgcaaaatgataagccgaaagaaaaagcaccaggctgaacctaaagataagcatctgggcccagccacggctttcctgcaacgcccatactttgactcaaaacttaacaaaaacatctacagcgacatcccgcctcaggtgcctgtgcgtccaattagctataccccctctatcccgtcagacagccggaataatctggatcgaaattccttcgaaggctctgctatcccagaacatccagaatttagcacttttaaccccgagtccgtgcacggccaccgaaaagctgtggctgtgtgcagcgtcgcgccaaacctaccgcctcctcccccgagcaattcaccttcagatagtgattctattcagaagccttcttgggacttcgattacgataccaaagtagtcgacctagatccctgtctgtccaaaaagccgctggaagagaagcctagccaaccttacagtgcaagggagagcttgtccgaagtccaaagcctgagctcattccaatcagaaagctgcgacgacaatgggtatcactgggataccagtgactggatgccatccgtgccactccccgacatccaggagtttcctaattatgaggtcatcgacgagcaaacccccctctattcagccgaccccaacgccatcgatacagattactaccctggaggttacgacatcgagtccgacttcccaccaccacctgaagatttccccgctgccgacgaactcccaccactccctccagaattctccaatcaatttgaatctattcacccaccaagggacatgccagctgccgggagcctgggcagttctagcagaaaccgccagcgcttcaatctcaaccagtatctgcccaatttttaccctctagatatgtccgagccccagacaaaaggaactggagagaactcaacctgccgcgaacctcacgctccgtatccgccagggtaccaacgccactttgaggcaccggctgtagagagcatgccaatgtctgtgtatgccagcactgcaagctgtagcgacgtgtcagcttgctgtgaagtcgaatccgaagtcatgatgtcggactacgagagtggagatgacggccatttcgaggaggtgactatcccccccctcgacagtcagcagcatacggaagtctag

SEQ ID NO: 24149 - DNA, 1467 bp, Artificial Sequence
  Description of Artificial Sequence: Synthetic coding sequence
atgggccggcacctggccctgctgctgctgctgctgctgctgttccaacatttcggcgacagtgacggatcccaaagactagaacagacccccctccagtttacacacctggagtataatgttactgtgcaggagaattccgcagccaagacctacgtcggacatcccgtgaagatgggtgtttacattacacacccagcctgggaagtaagatataagattgtgagcggagatagcgagaatctgttcaaggcagaagagtatatactgggcgacttttgcttcttaagaatccgaacaaagggaggtaacacagcaatcctgaatcgggaggtaaaggatcattacactctgatcgtcaaggccctagaaaaaaatactaacgtcgaagcacgcaccaaggttcgcgtgcaggtactggatactaatgacctaagacccctgttttctcccacatcttattcagtgtccctccccgaaaatacagccatacgcacgtctattgctcgggtgagtgcaacggatgccgacatagggaccaatggcgagttctattatagttttaaggatcgtaccgacatgttcgccattcaccctacctcaggggtaattgtgctgaccgggcgtctggactacctcgaaactaagttgtacgagatggagatcctggccgccgatcgggggatgaagctctatgggagcagtggaatctccagtatggcaaaactgaccgtgcatatcgaacaagccaatgaatgcgccccagtgattaccgccgtaactctcagtccttcagaactggatagggatcccgcctacgctattgtaaccgtggacgattgtgatcagggcgctaacggggatattgccagtctttccatcgtggcaggagatctcctgcagcagttcagaactgtgcgtagttttcctgggagcaaagaatacaaggtgaaggctatcggggggatcgactgggattcacaccctttcggatacaatttaaccctccaggctaaagataagggaaccccgcctcagtttagctcagtgaaagtgatccacgtgacaagccctcagtttaaggctgggcccgtaaaatttgagaaagacgtctatcgagcagaaattagcgaattcgccccccccaacactcctgtggtaatggttaaggccatccctgcctactctcacctccgttacgtgttcaaaagtacaccaggcaaagcaaaattctccctgaactacaacactggactgataagcatcctcgaacccgtcaagaggcagcaggccgcccacttcgagctagaggttacgaccagtgacaggaaggcgtctaccaaggttctggtaaaggtcttgggtgctaactccaatccgccggaatttacccaaacagcctataaagctgctttcgatgagaatgtcccaatcggtacgaccgttatgtccctgtctgccgtttag

SEQ ID NO: 24150 - DNA, 399 bp, Artificial Sequence
  Description of Artificial Sequence: Synthetic coding sequence
atgtgcgacgccttcgtgggcacctggaagctggtgagcagcgagaattttgatgactacatgaaagaagtgggggtgggctttgcaactcgaaaggtggccggaatggccaaacccaatatgataatttccgtgaacggcgacgtcattacgatcaaatccgagtccacttttaagaataccgagatctcatttattctgggtcaagagttcgacgaagtaacagcagacgacagaaaagtgaagagtacaattacattggacgggggagtcctggtgcacgtgcagaagtgggacgggaaatctactaccatcaaaaggaaaagagaggatgacaaactggttgtcgagtgtgtcatgaaaggcgtgacctccacccgcgtgtacgagagagcctag

SEQ ID NO: 24151 - DNA, 7536 bp, Artificial Sequence
  Description of Artificial Sequence: Synthetic coding sequence
atggaggaggtggtgatcgccggcatgagcggcaagctgcccgagagtgaaaacttgcaggagttctgggacaacctcattggcggagtcgacatggtgacagacgacgatcgcagatggaaggcgggcctctacggactccctaggcggtcggggaaactcaaggacctgtcccggttcgacgcctcattcttcggcgtccacccaaaacaggcacacacgatggatcctcaacttagactgttgctggaggtgacatatgaggccatcgtggacgggggaatcaaccccgactctctgcgcgggacccacacaggagtgtgggtgggggtgtccggctctgagacttccgaagccctgtcacgcgatcctgaaacattggtgggatacagcatggtcgggtgtcagcgagcgatgatggctaatagactgagcttcttctttgattttcgtggaccgtcaatcgcactggataccgcttgtagcagttcactgatggccctgcagaacgcctaccaggcgattcattcgggtcagtgtcccgcagccatcgtgggcgggatcaatgtactcctgaagcctaacacgagtgtccaattcctgcgcctgggtatgttatcaccggagggtacatgtaaagctttcgacacagctgggaacgggtattgcagaagcgaaggggtcgtggcagtgctgctgactaagaagagcctggcgcgtcgcgtatacgccacaatccttaatgccgggactaacaccgatgggtttaaggaacagggggtgactttcccatctggcgatattcaggaacagctgattcgtagtctgtatcagtccgccggtgtcgcgccagaatccttcgagtacatcgaagcacacggtactgggaccaaggttggcgatccacaggaactcaatggaataaccagagcgctgtgcgccactaggcaggaacctctgctcattggcagcacgaaaagcaacatggggcaccccgagcccgcctcaggcttagcagccctcgccaaagtgttactgagtttagagcacggcctctgggcaccaaacctgcactttcacagtcctaaccctgagattccggctctgcttgacggtaggcttcaggtcgtggaccaacctctccctgttcgggggggaaatgttggtattaatagcttcgggtttggcgggtcaaacgtccatataatccttaggccaaatacccagcctccacccgccccagctccgcacgccacattgcccaggcttctcagggcatccggacgcactcctgaggctgttcagaaattactcgaacaggggcttcggcacagccaggatctggcttttctgtccatgctgaacgatatcgcagctgtgcctgcaacagccatgccatttcgcggctatgccgtgctcgggggtgagcgcgggggacccgaagtgcagcaggtcccggctggagagcgtcctctctggttcatctgttcaggtatgggcacccaatggcggggaatggggctgtctctcatgagacttgatcggtttcgggatagcattcttagaagtgacgaagccgtgaaaccctttggcctgaaggtaagtcagctcctgttatccactgacgagtccacatttgacgacattgttcatagctttgtaagcctcacagccatccagatcggtcttatagacctgctctcctgtatgggcctccggcccgacggcattgtgggacattccttaggagaggtggcctgcggctatgccgacggctgtctcagccaggaggaagctgtgctggcagcctattggcgtgggcagtgcatcaaggaagctcacctgccccccggggccatggcagcagtggggctgtcctgggaggagtgcaagcagcggtgtccaccaggggtcgtcccagcctgtcacaactctaaagacacagtgacgatttctgggccacaagcccctgtcttcgagttcgtggagcagctaaggaaggagggggtgttcgccaaagaagtgcggacaggcgggatggccttccactcttatttcatggaagccatcgctcctcctctgcttcaggagctgaaaaaagtcatcagagaaccaaagccccgctctgcacggtggttgtctacatccatccccgaggcacaatggcacagctccttggccaggacgagctctgctgaatacaatgtgaacaacctagtaagtcctgtgctgttccaggaggctctttggcacgtgcccgaacacgccgtggtccttgaaatcgccccccatgctcttctgcaagcagtattgaaacgcggactgaaaccatcctgcacaatcattccactcatgaaaaaagaccaccgagataacctggaattcttcctggctggcataggacgattgcacctatcaggcattgatgcaaacccaaacgctctgttcccacccgtagaatttcctgcacctaggggcacgcctctgatttccccactgatcaagtgggatcattctctggcgtgggacgtccccgccgccgaagattttccaaacggtagcgggtcgccgtccgcggccatttacaacatcgacacctcgtccgagtcacccgaccactatttggtggatcatacactggatggacgcgtacttttcccagctactggatacctgagtatcgtttggaaaactctcgcaagggctctcggacttggcgtggagcagttgcccgtggtatttgaggacgtagtcttacaccaggccaccatactgccaaaaactgggacagtttcactcgaggtgaggctgctcgaagcctcacgggctttcgaagtgtccgagaacggtaacctcgtggtttccggaaaggtgtatcagtgggatgaccctgatcctaggttattcgaccacccagagtcgcccacgccgaaccctaccgagcccctcttcctggcccaagcagaggtgtacaaggaactccgactgcggggctatgactacggcccccattttcagggcatactcgaggcttcgctggaaggcgattctggcaggctgctttggaaggataattgggtgtctttcatggacactatgctgcagatgtcgattttagggagcgctaaacacggcctgtacctgcccacaagggtcactgccatccacatagaccctgcaacacatcggcagaagttgtatactctacaggacaaggcgcaggtggcagatgtggtggtttctagatggctgagagtcaccgtagccggtggcgtccacataagcggactgcatacagagtccgcgcctaggcgccaacaagagcagcaggtccctatcctggaaaaattttgctttaccccccacaccgaagagggttgtctgtccgagcgagcggcactgcaagaagagctccagctgtgtaagggcctggtgcaggccctccagacaaaagtgacacagcagggtcttaagatggtggttccaggcctcgatggtgcccagattccgcgggatcccagtcaacaggagctccccagactgctgagtgccgcttgcagactgcagctgaatggtaacctgcagctagagctggcacaggtactggcccaggagcggccaaaactccctgaggatccgcttctttctggtctcctggatagcccagccctgaaggcttgtcttgacactgccgtcgaaaacatgccaagtcttaagatgaaagtagttgaagtgctggctggacatggacatctgtatagccgaatcccaggcctgctgtctccacatcctctgcttcaactgtcttacaccgctactgatcggcatccgcaggccctagaggcagcacaagccgaactgcaacagcacgacgtggcacagggacagtgggaccccgccgatccagcaccatctgcactgggatctgcagacttgctggtttgtaattgcgcagtcgctgccttgggcgaccctgccagtgccctgtccaacatggtcgctgcccttcgggagggggggttccttctcctgcacacccttctgagggggcatcccctgggggacatcgtggcatttctgacttccacagaaccacagtacggtcagggcatcttgtcacaggatgcgtgggaatccctgttcagtcgggtctcacttcggctcgtgggcctgaagaagtccttctatggttccaccctgttcctgtgccgcaggccaacaccccaggactccccaatatttcttccggtggacgacactagcttccgctgggtggagtccctgaagggaatactcgcggatgaggactccagccggcccgtgtggctgaaggcaatcaactgtgccacgtccggagttgtgggactggtcaattgccttcgacgagaaccggggggaaataggctgagatgtgttctgctgtcgaatttgagctctacgtcccatgtcccggaagtggacccagggtctgctgaactgcagaaagtccttcagggcgatctagttatgaacgtatacagagatggagcctggggggctttcagacattttctgctggaggaggacaagcctgaagaaccaaccgcccacgcctttgtctccactttaaccagaggggaccttagttcaatccggtgggtgtgctcatctctgaggcacgcccagcccacgtgccccggagcgcagttatgtactgtatattatgcatctcttaacttcagggatattatgctcgccaccggaaaactgtcccctgacgctattcccggtaagtggacaagccaggacagcttgttaggaatggagttcagcggaagggacgcatctggcaagcgcgtgatgggccttgttccagctaaagggcttgccaccagcgttctcctcagtcccgattttctgtgggatgtgccatcgaattggactctagaggaggctgctagcgtgcccgttgtgtacagcacggcttactatgccttggtagtgcgggggagagttagacccggtgaaaccttacttatccacagcgggtcggggggtgtggggcaggccgccatcgcgatcgcgctctcccttggatgccgcgtgttcacgacggtaggcagtgccgagaagcgggcctatctacaggcgcgttttccccagttggattccacttctttcgcgaactcacgagacacttcatttgagcaacatgtcttatggcataccggtggaaaaggagtggatttggtgctgaattccctagcggaagagaagctgcaagcctctgtgcggtgtcttgcgacacacggaaggttcttggagatagggaaatttgatttgagccagaatcaccctctcgggatggcaattttccttaaaaatgtgactttccacggcgtactccttgatgccttcttcaacgaaagcagcgccgactggagggaggtttgggcattagtgcaggctggcattcgtgacggggttgttaggccccttaagtgcaccgttttccatggcgcccaagtagaggatgcatttcgctatatggctcaggggaagcatattggaaaagtagtggtgcaagtgctggcagaagagccggaagctgtacttaaaggagcaaagccaaaactgatgtctgccatctccaaaactttttgcccagcccacaagagctacatcatcgccggcgggctagggggtttcggactcgagctggcacagtggctcatccaacggggggtgcagaagcttgttctgacctcacgttccggaatacggaccgggtatcaagccaaacaggtcaggcgttggcgacgccagggcgtccaagtacaagtgtctacatccaacatttcaagtcttgagggtgcacgggggctcatcgcggaagctgcacagttaggtccagtcggcggcgtcttcaaccttgcagtcgttctgagggatggactcctggagaatcagactcctgaattctttcaggatgtgtgcaaaccaaagtattctggtacgctgaatctggaccgcgtaaccagagaagcatgtcccgagctggactactttgtggttttctcatccgtgtcttgtggtcgcggaaacgcaggacagagtaactacggtttcgcaaacagcgccatggaaaggatctgtgagaagcggcgccatgagggactgcctggcctggcagtgcaatggggtgccataggtgacgttggaatcctcgtcgagaccatgtctacaaacgacactatcgtcagcggcactcttcctcagcgcatggctagctgtctggaagtgctggatttgtttctcaaccagccccatatggtgctgagtagttttgttttggcagagaaagctgccgcgtatcgcgatagggactcacagcgggacttagtagaggccgttgcacacatcttgggcataagggaccttgcggcagtgaacctcgactctagcctggctgacctggggttggattctctcatgagtgtggaggttcgccagaccctggagcgggagctgaaccttgtgcttagcgtccgagaagtgaggcagcttaccctgaggaagctgcaggagttgagctctaaagctgatgaagcaagtgaactcgcctgtccaactcctaaggaagacggtcttgcacagcagcaaacgcagcttaatttacggtctttactggtgaaccccgagggccctacgctcatgcgtctaaattccgtgcagagtagtgaacgccctctgttcctcgtacatcccattgagggttctaccacggtctttcattcacttgcctctcgactgtcaatcccaacttacggtcttcagtgcacacgtgcggcccctctggattctatccacagcctagcagcgtattacattgattgcattaggcaggtgcaaccagagggcccttaccgcgttgcgggatactcatacggggcctgcgttgcttttgaaatgtgctcacagctgcaggcccaacagagtcccgcccctacacataattcgctgtttctgttcgacgggagtcctacttacgtattggcatatacgcagtcctaccgcgccaagttaaccccgggctgcgaggccgaggctgagaccgaagcaatttgtttcttcgtccaacagtttacggacatggaacataacagggtcttggaagctctcctacccctgaaaggccttgaggagagagtggccgccgcggtggacctgatcatcaagagccaccaagggctcgaccggcaggagctgtcttttgcagcaaggagcttttattacaaattacgagcagctgaacaatatacccccaaggccaagtaccacggaaacgtgatgctgctgcgggccaagacgggaggcgcctatggggaagacctgggagccgactacaacctgagtcaggtctgcgacgggaaggtctcagtgcacgtgatagaaggagatcaccggaccctcttagagggatcgggcctcgaatctataatcagcatcattcacagctccttggcagagccaagagtgagcgtgcgtgagggctag

SEQ ID NO: 24152 - DNA, 2502 bp, Artificial Sequence
  Description of Artificial Sequence: Synthetic coding sequence
atgagcatcctgggcagcgccaagcacggcctgtacctgcccaccagagtgacagcaatccacattgatccagccacccatagacagaagctttacactctgcaggacaaagcccaggtggcggatgtggtcgtgtcaagatggcttcgggttaccgtggcaggcggagtgcacatttccgggttgcacaccgagtcagccccgcgaaggcaacaggagcaacaagtcccgatactggaaaaattctgtttcacccctcatacagaggaggggtgtctgtcggaacgcgctgcccttcaggaggagttgcagctgtgcaaaggcttggtccaggccctgcagaccaaggtaacgcagcagggcttaaaaatggtcgttcccggattagacggggcccagatccctcgcgacccatctcaacaggagctcccacgtctactgtccgcagcttgtaggcttcagctgaatgggaacttgcagttagagctggcccaggtgcttgctcaggagaggccaaaactcccagaagatccgttgctcagtggactgctcgattctcccgcgctgaaagcttgtcttgacactgcagtcgagaacatgccaagcctgaaaatgaaggttgtcgaggtgctggctgggcacggtcacctatattccagaatccccggactgttgagcccccaccccctgctccagctatcctatactgctacagaccgacatccccaggccttagaagcggctcaagccgaactccagcaacatgatgtggcacaggggcaatgggatcctgccgaccctgcacccagtgcgctgggctccgcagatctgctcgtgtgtaactgtgccgtggctgcgctgggcgatccagcctccgcactgtccaatatggtcgccgccctgagggaaggaggatttcttctgttacacacactcctccgcggccacccgctcggcgatatcgtggcttttctcacatctaccgaaccacagtatggtcaggggattctgtcccaggatgcctgggagtcactattctctagggtatctttgcgcttagttgggcttaaaaagagcttctacggatcgacgctctttctgtgccggcgaccgaccccccaagactcacctattttcctgccagtggatgatacaagctttcggtgggtagagtcgctcaaaggaattctggcagatgaggacagtagtcgccctgtgtggctgaaggcaattaactgtgctacctcaggtgtggtagggctggttaactgtcttcgacgagagcccggcgggaatcgcctgaggtgtgtcctgttgtccaaccttagcagcacgtcccacgttccggaagtcgacccggggtcggccgagctccagaaggtcctccagggggacctcgtcatgaatgtgtatagagatggcgcatggggggcattccggcactttctcctggaggaggataagcccgaggagcccactgcacacgccttcgtctcaaccctcaccagaggagatctgtcgtcaattagatgggtgtgcagttccctgagacacgcccagcctacctgcccaggggcacagttgtgtacagtctactatgcctccctgaattttcgggacattatgctcgccaccgggaaacttagtcccgacgccatacctgggaaatggacaagccaggatagtctgttgggaatggagtttagcggccgcgatgctagcgggaagcgcgtgatgggcttggtgccggcaaagggactggctactagcgttctcttgtctcctgactttttgtgggacgtgccaagcaattggacccttgaagaggccgcctccgttcccgtcgtgtatagtactgcatactacgcgctggttgtgagaggccgggtgcgccccggggagaccttgctgatacattccggcagcggaggggtggggcaggctgcgatagctattgccctaagcctcggatgcagggtgtttacaactgtgggttccgcagaaaagagagcctaccttcaggcgcgattcccgcagctagattccacttcatttgccaattcacgggatacatctttcgagcaacacgtactttggcacacaggcgggaagggtgtggaccttgttctgaattccctggcagaggagaagctccaggcgtccgtgagatgcctggccactcacgggcgctttctcgaaattggaaagttcgacctgagccagaatcacccgctcgggatggccatttttcttaagaacgtgacattccacggggtacttctggatgcattctttaacgagagcagtgccgattggcgcgaagtgtgggctctcgtacaggcaggaattagggacggggttgtgcgcccactcaagtgtactgttttccatggagctcaagtcgaggatgcgttcagatacatggctcaagctaaggccagccaagcatggccgtgctctggggccccaagtgccacatgggccttctggtggcgtaggtag

SEQ ID NO: 24153 - DNA, 1143 bp, Artificial Sequence
  Description of Artificial Sequence: Synthetic coding sequence
atgatgttcagcggcttcaacgccgactacgaggccagcagcagcagatgctcttcagccagccctgcaggagatagcctctcctattatcatagcccagccgacagtttctccagcatggggtctcccgtaaacgcacaggacttctgcactgatctggccgtgtcctccgctaattttattcctaccgtcactgcgatctcgacctcgccagacctgcaatggctcgtacagcctgctctggtgagctctgttgcacctagtcagacaagagcacctcatccctttggagtgccagccccatccgcgggcgcttattcccgcgccggcgtggtgaaaactatgacgggcggacgggcccagtcaatcggacgacggggcaaagtagagcagctgtctcccgaggaggaagaaaagcgacgaattcggagggaacgcaataagatggccgctgcaaaatgtcgaaatagacggagggagcttaccgatacactccaggctgaaacagaccagttagaggatgagaagtccgccctgcagacagagattgccaatctgcttaaagagaaagaaaagctggagtttattctggccgcccaccgaccagcctgcaaaatcccagacgatctggggtttccggaggaaatgtcggtggcatccctggatctaacaggcggtttaccggaggttgccactcctgagagtgaggaggccttcacactgcccttgcttaacgatccagagcctaaaccctccgtcgagcccgtcaagtccatcagttctatggagctcaaaactgagccttttgatgactttctgttcccagctagtagccgaccaagtggctcggagacagctcggtctgtgccagacatggacctttccggctccttctacgcggcggattgggagcccttgcattctgggagcctgggcatgggcccgatggcaactgagttagagcctctgtgcacaccagtggtgacttgcaccccttcttgtaccgcttacacgtccagttttgtcttcacataccctgaagccgactccttcccatcttgcgccgctgcccaccgaaaaggatcttcatctaacgagccctccagcgactcactgagttcgcctaccttgttggcgttgtag

SEQ ID NO: 24154 - DNA, 966 bp, Artificial Sequence
  Description of Artificial Sequence: Synthetic coding sequence
atggaggagggccagtacagcgagatcgaggagctgccccggcggcggtgttgtcggaggggaactcagattgttctgctgggcctcgttacagcagccctgtgggcaggtctgctaactcttttgctactgtggcactgggacacgacccaatcactgaaacagctagaagagagagcagcgcgaaacgtttctcaagtgtcaaaaaacctggagtcccaccacggagaccaaatggcccagaaaagccagtcaacccagatcagtcaagaactcgaggagctgcgggccgaacagcagagactgaagtcccaggacctggagctatcttggaacctgaatggactacaggccgacctgagctcctttaagtcccaggagctaaacgagcggaatgaggcttcggatctacttgagcgattacgtgaggaggtgaccaagctccggatggaactgcaggtgtccagcgggttcgtgtgtaatacatgtccggaaaagtggattaacttccagagaaagtgctattactttggaaaaggaacaaagcagtgggtacacgcccgttacgcctgtgacgatatggagggccagctggttagcatacactctccagaggaacaggacttccttacaaaacatgctagtcataccggctcatggatcggcttgaggaacttggatctgaaaggggaattcatctgggtcgatggttcccatgtcgactattctaactgggccccgggcgaacctacctccagaagccagggtgaagattgtgttatgatgaggggaagtggcaggtggaatgacgcattctgcgaccgcaagctgggcgcatgggtgtgtgaccggttggccacctgcacacctccagcctcggaggggagtgcagagtccatgggccccgactcccgcccagatcctgacggacggttgccaacaccttctgccccactgcattcttag

SEQ ID NO: 24155 - DNA, 963 bp, Artificial Sequence
  Description of Artificial Sequence: Synthetic coding sequence
atgaacccccccagccaggagatcgaggagctgccccggcggcggtgctgccgcagaggaactcagatcgtcctgctgggtttagtgacagcagccctatgggcaggattactcacactgttgctgctgtggcactgggacaccacacagtccctgaagcagctcgaggagagggccgcaagaaacgtctctcaggtttctaagaatttggagtctcaccatggcgaccaaatggcacaaaagtcccagtccacccagatctctcaggaacttgaggaattaagagccgagcagcagaggctgaagagtcaagacctggaactatcgtggaacctgaatggtctccaagcagatctgagcagcttcaagtcccaggaactgaacgagaggaatgaagcatccgacctgctggaacgtctccgcgaggaagtgacgaagcttaggatggagctccaggtttcgagcggtttcgtgtgcaatacctgccccgaaaagtggatcaacttccaaagaaagtgctactatttcggtaagggaaccaagcagtgggtccatgcccgctatgcctgtgatgatatggagggccagctggtatcaatccactccccagaggaacaggactttctcactaagcacgcttctcataccggctcatggatcggtttaaggaatcttgatcttaaaggcgagtttatttgggtggatgggtctcacgtggattattctaattgggcgcccggagaacccacttcccgcagccaaggggaggactgtgttatgatgaggggaagcggtcgctggaatgatgcattttgtgaccgcaagctgggtgcttgggtatgtgacagactcgccacttgcacaccacccgccagtgaaggttcggctgagagcatgggccccgattcgcgaccagacccagacggccgcctgccgactccttcggccccgcttcatagctag

SEQ ID NO: 24156 - DNA, 1125 bp, Artificial Sequence
  Description of Artificial Sequence: Synthetic coding sequence
atgtggttcctgaccaccctgctgctgtgggtgcccgtggacggccaggtggacaccacaaaggccgtgatcacactccagcctccttgggtaagtgtatttcaagaggaaacagttactctgcactgcgaagttttgcacctgcctggctcatccagtactcaatggtttctgaacggaacagctacccagacgtcaaccccgtcctatcgtattacttccgcctccgtgaatgatagtggcgagtaccgatgccagcgcggattgagcggtaggagcgatcccatccaactcgagattcataggggttggctgctgttgcaagtgtcctccagagtcttcaccgaaggagagcctctggcactgcggtgccacgcctggaaggataagctggtgtacaacgtactttattatcgcaacgggaaggcattcaaattcttccactggaatagtaacctgaccatcttgaagacaaatatctcccataacggcacttatcactgtagtggaatgggtaaacatcggtacacgtcagccggcatctccgtgaccgtaaaagaactgtttccagcccccgtgcttaacgccagcgtgaccagcccactgcttgagggtaacctggtgacgctttcctgtgagaccaagttgttactccaaaggccggggctccaattgtactttagcttttacatgggcagcaagacccttcgcggaaggaacacatctagcgaataccagatcctcaccgcccggcgcgaggacagtggcctctactggtgtgaagcagctacggaggatggaaatgtgctgaagagatctcccgagttggagttgcaagtgctgggtctgcagctgcctacccccgtgtggtttcacgtgttgttttatctggcagtcgggataatgttcctggtcaatacagtactctgggtaaccattagaaaagagctgaaacgtaagaaaaaatgggatctggaaattagcctggatagtggccatgagaagaaagtaatctcgtcactccaagaggacaggcacctggaagaggaattaaaatgtcaggaacagaaggaagaacagctgcaggaaggcgtccacaggaaggaacctcaaggcgctacttag

SEQ ID NO: 24157 - DNA, 723 bp, Artificial Sequence
  Description of Artificial Sequence: Synthetic coding sequence
atgtggttcctgaccaccctgctgctgtggggctggctgctgctgcaggtcagctcccgcgtgtttacagagggagagcccttagccttgaggtgtcatgcttggaaggacaagctcgtctacaatgtcctttactaccgcaacggtaaagccttcaaattttttcactggaactctaatctgacgatcctgaagacgaatatctcacacaacggaacataccactgtagtggtatggggaaacataggtacacttcagccgggattagcgtgaccgtgaaagaattgttccctgcacccgtgctcaatgcgtctgttacatcaccgctcctcgagggcaatttggtgaccctaagctgcgaaactaagctgctcctccagcgtcctggtttgcagctgtatttcagtttttacatgggatcaaagacactgcgaggtagaaacacttcaagcgagtaccagatcttaacggcaagacgcgaggacagtgggctctactggtgcgaagccgctacagaagacggtaatgtgctaaagagatctcccgagctggaactccaggtactcggcttgcagttgcctacaccagtttggttccacgttctgttctatctggccgtgggcatcatgtttctggtcaatacagtcttatgggtgacaattcggaaagagctcaaacgcaaaaaaaagtgggatttggagatttcgctggactccggctag

SEQ ID NO: 24158 - DNA, 2469 bp, Artificial Sequence
  Description of Artificial Sequence: Synthetic coding sequence
atgggcttcagcagcgagctgtgcagcccccagggccacggcgtgctgcagcagatgcaggaggccgagttacgtctgctagaggggatgcggaaatggatggcgcaacgggtgaagtcagatcgcgagtatgctggactgctgcatcacatgtccttacaggatagcggcggccagtcacgcgccatcagtcctgatagtccaatctcccagtcttgggcagaaattactagccaaaccgagggtctttcacgattactgaggcaacatgctgaagacttgaattcaggaccactcagtaaactgtccctgctgattagggagagacagcagcttcgaaagacatattcagagcaatggcagcagcttcagcaggaactcacaaagactcactcgcaggatatcgaaaagctcaagtcacagtaccgcgcactggccagggacagcgcccaggctaagagaaagtaccaggaagcatccaaggacaaagaccgcgacaaagcaaaggataagtacgtgaggagcttgtggaaactgttcgctcaccataacagatatgtgctaggcgtcagggctgcccagctccaccatcagcatcatcatcagctgctattgcctggcctgttaagaagtcttcaggatctgcacgaggaaatggcctgcattctcaaggagattctgcaggagtacctggaaatttcatctctggtacaagacgaggtcgtcgcaatccatagagaaatggcagctgcggccgcacgaattcaacccgaggcagaataccaaggcttcttacgccagtatggaagtgctcccgatgttccaccatgtgttacctttgacgaatctcttttggaggagggcgagccactggaaccaggcgaactgcagctgaacgaattgactgtggagtcggtccagcacaccctgacaagcgttactgacgagctggcagtggctacagaaatggtgtttcgccggcaagagatggtgactcagctgcagcaggaattgcgcaatgaggaggaaaatactcacccaagggagcgagtccagctgttaggcaaacggcaggtgctacaggaggcactgcaaggcctgcaggtagcactgtgctcccaggctaaactgcaagctcagcaagagctcctgcaaacaaaattggagcacttgggtccaggtgaaccacctcccgtgctcctcctacaggacgatcgccactctacatcttcaagtgagcaggagcgcgaggggggaagaacacctacgcttgagattttgaagtcgcatatctcgggcatctttcgtcctaaattcagcctgcctccgcccctacagcttatccccgaagtgcagaagccccttcacgagcagctgtggtaccatggagctatcccaagagccgaggttgccgagttgctggttcactccggggatttcctggtccgggagtctcaggggaaacaggagtacgttttgagcgtcctttgggatgggctcccacggcattttatcatccagtccctggataacttgtaccgccttgaaggggaggggttcccttccatccccctgctgatcgatcatctgctgtccacgcaacaacccctgacgaagaagtccggagtggtactgcatagggctgtgccaaaagacaaatgggtgctaaatcacgaggatctggtcctgggggagcagatcggcaggggaaactttggagaggtcttctctgggcgcctccgcgcggacaacacactagtggctgttaaatcctgccgcgaaacactgccgcccgacctcaaggccaaatttctccaggaagctaggatcctgaaacagtattcgcatcccaatatcgtgcgcttgatcggtgtctgcacccagaagcagcctatttatattgtgatggagttagtgcaaggcggcgactttctaacattcctgaggactgagggggctagactccgagtcaaaacactcctccagatggtcggggacgccgccgcaggtatggaatacttggagtcaaagtgctgcattcaccgtgatctggccgcccggaattgcctggtgacagaaaaaaatgttctgaagatcagcgacttcggcatgtcaagggaagaggcggacggggtgtatgccgcttctggcggcctgagacaggtccccgttaaatggacagccccggaagccttgaactatgggcgctattcttcagagtcggatgtctggagtttcggaatcctgttgtgggagaccttctctttgggcgcaagtccatacccaaacctgtcgaatcaacagacacgggaatttgtggagaagggagggagactcccatgtcccgaactgtgtccagacgctgtgttcagactgatggagcagtgttgggcttatgagcccggtcagcgcccttccttttccacaatctatcaagagttgcaatccatccgaaaacgccacaggtag

SEQ ID NO: 24159 - DNA, 2295 bp, Artificial Sequence
  Description of Artificial Sequence: Synthetic coding sequence
atgggcttcagcagcgagctgtgcagcccccagggccacggcgtgctgcagcaaatgcaagaggccgagctgagattactggagggcatgagaaaatggatggcacagagggtcaaatcagaccgcgagtacgccggactgttacaccacatgtctttacaggacagcggaggacaaagtagagcaatctcacctgatagccccatttcccaaacgcacagccaggatatcgagaagttgaaatcccaatatagagcgttagccagggactctgctcaggctaagcgaaagtaccaggaagcaagcaaggataaggatagggataaagccaaggacaaatacgtgagaagtctgtggaaactgttcgctcaccacaatagatatgtgctgggcgtccgcgcggcgcagctccatcaccagcatcaccaccaactgctgctgccgggccttcttcggtctctccaggacttgcatgaggaaatggcctgtatcttgaaggagatcctgcaagagtacttggaaatttctagtttagtgcaggatgaagtcgtggccattcaccgtgagatggcggctgccgcggctcgcatccagcccgaggccgaataccaagggtttctaaggcagtatggcagcgctcctgatgtacccccatgcgtaacattcgacgagtccctgctcgaggagggcgagcccctggaacccggggaactacaactgaatgaattgactgtggagtccgttcagcacactctgacttctgttaccgacgaattggcggtcgcgacagaaatggtcttccgaagacaggagatggtaacccaacttcagcaagagttacgcaatgaagaggaaaacactcaccctagggaacgggtccagctcctgggaaagcgtcaggtccttcaagaggccctacagggactccaagtggctttgtgcagccaggctaagctccaggcccagcaggagctgcttcagacaaagttggaacatctcggtcctggtgagcctccacctgtgttgctcttgcaggacgacaggcacagcacctcatcttccgagcaggaaagggaaggaggcaggacccctactcttgaaatcctaaagtcccacatcagtggcatttttcgtccgaagttctctttaccacctccactccagttaatccctgaggtgcaaaaacctctgcatgaacaattatggtatcacggagcaatccctagggccgaggtagcagagctgcttgtgcactcgggggacttcctcgtgcgcgagtcccagggaaagcaggaatacgtattaagtgtgctgtgggatgggctgccgaggcatttcataattcagagtctggataacctgtaccgcttggagggcgaaggattccccagcatacccctcctcatcgatcatctgctcagtactcagcaaccattgaccaagaagagtggagtggtgctgcatcgcgctgtcccaaaagacaaatgggttctcaaccacgaagacttagttttgggagaacagatcggccggggcaatttcggtgaggtcttctcagggagactccgggcagataacacacttgtcgcggtgaagtcctgtcgggagactcttcccccagacttaaaggcgaaattcctgcaggaagcgaggattctgaagcagtactcacaccctaacattgtgcgtctcatcggcgtctgtacccagaagcagcctatctatatcgtgatggagctggttcaaggcggggatttcctgaccttcctgcgaacagaaggagccagactcagagtgaaaacactgctccaaatggtgggcgatgctgccgcaggtatggagtatctggagtctaagtgctgtatccatcgcgacctcgctgccagaaactgtctggtcacagagaagaatgtgctaaagattagcgattttggaatgtcccgagaggaggccgacggggtctacgctgcatcaggaggacttagacaggtaccggtgaaatggaccgcgcctgaggccctcaactatgggcgatatagttccgaatccgacgtttggtcatttggcatactactatgggagactttctccctgggcgcgtctccttatcctaatctgagcaaccaacaaacaagagagtttgtggagaagggaggacggctcccatgtcccgaactctgtcccgatgcagtgtttcgtcttatggaacaatgctgggcctacgagcccggacagcggccttctttctccactatctaccaggagctccagagcatcagaaaacgccaccgttag

SEQ ID NO: 24160 - DNA, 2046 bp, Artificial Sequence
  Description of Artificial Sequence: Synthetic coding sequence
atgggcttcagcagcgagctgtgcagcccccagggccacggcgtgcttcagcagatgcaggaggcagagctcagactgctcgaaggcatgcgaaaatggatggcccagcgcgttaaaagcgatcgcgaatatgcaggtcttctccaccacatgtctcttcaagattcaggggggcagtctagagcaataagtcctgattctcccataagtcaaacgcacagccaggacattgagaagctcaagagccaatatagagccctcgctcgagattccgcacaggctaaacgtaagtaccaagaggcttccaaagataaagatcgcgacaaagcaaaagataaatacgttcgatccctttggaagctgttcgcccatcacaatcgctacgtgttaggcgtacgagctgcccagctgcatcatcagcaccaccatcaattactgctgcccgggctgttgcgctcactacaggatctgcacgaagaaatggcctgcatcctgaaggaaattctgcaggagtacctcgaaatatcatccctcgtgcaggatgaggtggtcgcaatccatagagaaatggccgccgccgccgcacggatacaaccagaggcagaataccaaggcttcctacggcagtatgggtctgcaccagacgtgcccccttgtgtgaccttcgatgagtccctcctagaagaaggcgagccactggagccaggtgagcttcagctgaacgagctcacggtggaatccgtgcagcacaccttgacctccgtgactgatgagctcgccgtggccaccgaaatggtctttagacgtcaagaaatggtcacgcagctgcagcaggaactgagaaacgaggaagagaacacccatccgcgggagagggtgcagctccttggaaaacggcaggtccttcaagaggccctgcagggactacaggtggcactgtgttcacaggcaaagctccaggcccagcaggagctgcttcagacaaagctcgaacacctcgggcccggcgagccgcctccggttctattgctgcaagacgatagacacagcacttctagctcggaacaggaaagagaaggcggtcgcacccctacactggagatcctcaagagccacatatcaggcatcttcagaccaaagttctccaatctctatcggctggagggtgaggggtttcctagcatccctctgctgattgaccacctactttcgacgcagcagccccttacaaagaagtctggcgttgtcctgcaccgtgcagtgccgaaggacaagtgggttttaaaccacgaagacttggtgctgggggagcaaattggccgaggaaatttcggcgaagttttttcaggccgcctccgagcagacaataccttggtggccgtcaagagctgtcgggaaacattaccacctgatttaaaagcaaaattcttgcaggaggcccgttccagcccatcgacgtcctcctggagtctctgccgtggatcctctcccccagccggaggagattttctgacttttttgcggactgaaggagcccggctgagagtcaagaccctgctgcagatggtcggtgacgccgccgccggaatggagtaccttgaatcaaaatgctgtattcacagggatctcgcagcaaggaactgcttagttacagaaaaaaatgtcttaaagattagtgatttcgggatgagcagagaggaggcagacggagtgtatgctgcctctggaggactgaggcaggttcccgtaaaatggaccgcacccgaggccctcaactacggaagatacagttcggagagcgacgtctggagtttcggcattctgctgtgggaaacattttccctgggggcctccccctaccccaatcttagcaaccaacaaacccgagagtttgtagaaaagggaggcagattgccttgtcctgagctgtgtcccgatgccgttttccgattgatggaacagtgctgggcgtacgagccaggccagagaccctctttcagcacaatttaccaggagctgcagtctatcagaaaaagacaccgatag

SEQ ID NO: 24161 - DNA, 2085 bp, Artificial Sequence
  Description of Artificial Sequence: Synthetic coding sequence
atgggcttcagcagcgagctgtgcagcccccagggccacggcgtgttgcagcagatgcaggaggcagaacttaggctactggaaggcatgagaaagtggatggcccagcgtgttaagtcagaccgcgagtacgcagggctgttgcaccacatgagcctgcaggattccggaggccagtccagagcgatctcccctgacagccctatctctcagacgcattctcaggacattgagaaacttaaaagccagtacagagccttggccagagatagtgcccaagccaagaggaaatatcaagaggcctctaaagataaagatcgggacaaggctaaggacaaatacgttcgatcgctctggaaattgtttgcccatcacaaccgctacgtgttgggcgtgcgcgcggcgcagctgcatcatcagcaccatcatcagctgctgctccccggacttctaaggtcactccaagatctgcacgaagagatggcctgcatcctcaaggagatacttcaagagtaccttgagattagcagtctcgtgcaggatgaggtggtggccattcatcgcgagatggcagcagctgccgccaggatacaacctgaggcagagtaccaaggattcctccggcaatatgggtctgcaccagatgttccaccctgcgtcacttttgacgagagtctacttgaggaaggcgagcccctggaacccggggaattgcagctgaacgaactgactgtcgaatctgtgcagcatactctcacttcagtaaccgatgaactggccgtggccacagaaatggtcttccgacgccaagaaatggttactcagcttcagcaggagctgcgcaatgaggaggagaacacccatccccgggagagagttcagttgctagggaagagacaggtgctgcaggaggccctgcagggactgcaggtggccctttgctcccaagctaagttgcaggctcagcaggagcttctgcagaccaagcttgagcacttagggcccggagagccaccacctgtcttgctgctgcaagatgaccggcacagcaccagttcttcagagcaagagcgggaaggcggccgcactcccaccctcgagatactcaaatcccatatcagcggcatatttcgtccaaaattctctaatctataccgcttggaaggcgagggatttccctccattccactacttattgatcacctgctgtcaacacagcagccactaacaaagaagtccggcgtagtgttgcaccgtgctgtacctaaggacaagtgggtcctcaatcacgaagaccttgtgctcggagaacagatcgggagaggtaattttggggaggtgttttcagggcgccttcgggcagataacacccttgttgccgtcaaatcctgcagggaaaccctgcccccggaccttaaagccaagtttctgcaggaggccaggatcttaaagcaatatagccacccaaacattgtgcgcctgataggcgtctgcactcagaaacagccgatctacatagttatggaactagtgcaagggggcgacttcctgacttttctgcggactgagggtgctcgcctgcgggttaagacccttctgcaaatggtgggtgacgctgccgcagggatggaatatttggagtccaaatgctgtattcaccgcgacttggccgccagaaattgcctggttacagaaaaaaatgtccttaagatttctgacttcggtatgtctagagaagaggctgatggcgtttacgcagccagcggtggcctgcgccaggtccccgtgaaatggaccgcacccgaagccctgaactatggcagatacagtagcgagtccgatgtctggagctttggcatcctgctctgggagactttctccctgggtgcatccccctatcctaatctgagcaatcagcagacgcgcgaattcgtagaaaagggtgggagactgccttgtccagagctttgtccagacgccgtgtttcgactgatggagcagtgctgggcctacgagccagggcagagacctagctttagcactatctatcaagagctccaaagcatccgtaagaggcatagatag

SEQ ID NO: 24162 - DNA, 129 bp, Artificial Sequence
  Description of Artificial Sequence: Synthetic coding sequence
atgggcttcagcagcgagctgtgcagcccccagggccacggcgtgctccagcaaatgcaagaggccgagctccgactcctcgaggggatgcggaagtggatggcgcaaagggtaaagtctgatcgctag

SEQ ID NO: 24163 - DNA, 348 bp, Artificial Sequence
  Description of Artificial Sequence: Synthetic coding sequence
atgggcttcagcagcgagctgtgcagcccccagggccacggcgtgctacagcagatgcaggaagccgagctgagactgctcgagggaatgagaaagtggatggctcagcgggtgaagagcgatcgcgagtatgctgggctcctgcaccacatgtccctacaggatagtggtgggcaatccagagccatttcacccgacagccctatctcacagagctgggctgagatcaccagccagaccgaggggctttctagactcctgcgccagcacgccgaggacctgaactcagggcccctgtcaaagttgagcctgctgatcagggagagacaacagctgcggaaaacttag

SEQ ID NO: 24164 - DNA, 2259 bp, Artificial Sequence
  Description of Artificial Sequence: Synthetic coding sequence
atgggcttcagcagcgagctgtgcagcccccagggccacggcgtgcttcaacagatgcaggaggctgaacttaggctgctggagggcatgcggaaatggatggcccagcgagtcaagagcgatagagagtacgccgggcttctacaccacatgtctctccaggactcaggcgggcagtcccgggctatcagtcctgactcaccgatcagccaaagctgggctgagatcacatcccagaccgaggggttatcccgcctcctgcggcagcatgcagaggatttgaactctggtcctctctcaaagctttcccttttaatcagggagcgccagcagttaagaaaaacgtattcagaacaatggcagcagctgcagcaggagttgacaaaaacacacagccaagatatagaaaagttaaagtcacagtaccgagcactcgcccgcgactccgcacaggcaaaaagaaagtatcaagaagcaagtaaggataaagatcgcgataaagctaaggataagtacgttcgcagcctttggaagctgtttgcccaccacaatcgctatgtgctgggtgtgcgcgccgcacagttgcaccaccaacatcaccaccagttgttactaccaggactgcttcgctccttgcaagaccttcatgaggaaatggcttgcatactcaaggagattctccaggaatacctggaaatctcctccttggtacaggacgaagttgtggcaatccacagggagatggccgccgcggccgcacgcattcagccagaagcggaataccaaggatttctccgccagtacggctctgcaccggacgttccaccatgcgtcacgttcgatgagtctctgctggaggagggagagccgcttgagcctggcgaactgcaattgaatgaattaaccgtcgaaagcgtgcagcacaccctcacctctgtgaccgatgagctggctgtggctactgaaatggtgttccggcgccaggagatggttacccagctgcaacaagagttgcggaacgaagaggaaaacacacatccacgggaacgggttcaactcctaggtaaacgtcaagtgctgcaggaagcccttcagggccttcaggttgccctgtgtagtcaggcaaaactgcaagcccaacaggaactgctgcaaaccaaactcgagcacctcggacctggtgaacctcctccagtccttctgctgcaggatgaccgtcactcaaccagtagtagcgagcaggaacgcgaagggggaaggactccaaccctggaaattttgaagtcccacatttccgggatctttcgccccaagttcagtaacctgtaccgcttggaaggcgaggggtttccaagcatccccctgctaatcgaccacctattgtctactcaacagccactgaccaagaagtctggagtcgtgctccatcgagcagtccccaaggataagtgggtgctgaatcacgaagacctcgttctgggcgaacaaataggacggggcaattttggtgaagtcttttccggtcgcttgcgggccgacaatacccttgtggccgtgaagtcttgcagagagaccctgccacccgacttaaaagcaaagttcctgcaggaggcgcggatcttgaagcagtactctcatccaaacatcgtgcgactgataggcgtatgtacccagaaacagcccatctatatcgtcatggaactggtgcaggggggagatttcctcacattcctccgaacggagggagcaagactcagagtaaagactctgctacaaatggtaggtgatgctgctgccgggatggagtatctggagtcaaagtgttgcatccaccgcgacctagctgccaggaactgtttggttactgaaaagaacgtgctgaagatttcagactttggtatgagtagggaagaggctgacggcgtctacgccgctagcggcggcctccggcaggtgcccgtcaagtggaccgctccggaagccctcaattatggtagatacagctctgagtcggatgtgtggtccttcggcattcttctgtgggagactttttctctgggcgcatccccttatccaaacttgtctaatcaacaaacacgggaattcgtcgagaagggaggtcggcttccgtgtcctgaactgtgtccggacgctgtctttcgacttatggaacagtgctgggcatacgagcctggccagagaccgtcatttagcactatctaccaggagctgcagagcatacggaaacggcaccgttag

SEQ ID NO: 24165 - DNA, 2085 bp, Artificial Sequence
  Description of Artificial Sequence: Synthetic coding sequence
atgggcttcagcagcgagctgtgcagcccccagggccacggcgtgctgcaacagatgcaagaagctgaactgaggctcctggagggcatgaggaaatggatggctcagagggtgaagtcagatcgggagtatgctgggctactccatcacatgagccttcaggattcagggggccagtcgagggctataagccccgattctccaatctcacaaacacactcccaggacatcgagaaattaaaatcgcaatacagagcattggcaagagatagcgcacaagctaaaaggaagtaccaagaagcttctaaggataaagatcgagacaaagctaaggacaaatatgtccggtccctgtggaaactttttgcccatcacaatcgttatgtgctaggagtacgcgccgctcaactacaccaccagcaccaccatcagctgctcctccccgggttactcaggtcactgcaggatctccacgaagaaatggcctgtatactcaaggagattttgcaagaatacctcgaaattagctctctggtgcaggacgaagtggtggcaattcaccgagaaatggctgcagccgccgctcgaatacaaccagaagcagagtaccaggggttcctgcgccaatacgggtctgcccctgatgttcccccctgcgtgacctttgacgagagcctcttggaagagggagagcccctggagcccggagagttgcaactcaacgaactcactgtagaatctgtgcagcatacattgacgtctgtcaccgacgaactggccgtggctacggagatggtgtttaggcggcaggaaatggttacacagctgcagcaggagctcagaaacgaggaggagaatactcatcctcgggaaagggttcagctcctgggcaagcgccaggtgctgcaggaagctctgcagggactgcaagttgccctctgctcccaagctaaactacaagcgcagcaggagctgttacagactaaactcgagcacctggggccgggcgagccacctcccgtccttctcctgcaggatgacagacatagcacatcctcttctgagcaggagagggagggcggtagaacaccgaccctcgagattttgaagtcccacatttcagggatctttcgtcctaagttttctaatctataccggcttgagggcgagggattccccagcattccactgctgattgatcacttactcagcactcagcagcccttaacgaaaaagagcggagttgtgctgcaccgggctgtcccaaaggacaagtgggttttaaatcacgaggatttagtcttgggcgaacaaattggacgggggaacttcggggaagtgtttagcgggagactgagagccgacaacaccctcgtggctgtgaagtcatgccgtgaaactttaccccctgacctgaaagccaaatttctacaggaggctagaatcctgaagcagtactcgcaccctaatatcgtcagactgatcggagtgtgcacccagaaacaaccaatatatatcgtgatggagcttgttcaaggaggcgatttccttacttttctgaggaccgaaggtgctagactgcgggtgaagactctgttgcagatggtgggagatgcggcggctggaatggagtatttagagagtaaatgctgcattcatcgggacctcgccgcccggaattgtctggtgacagagaagaacgtgctcaagatatctgatttcggcatgtcgcgcgaggaagctgacggggtgtacgctgctagcggcggcctgcgccaggtgcccgtgaagtggacggctcccgaggctctcaattacgggaggtactcctccgagagtgacgtttggagtttcggtattcttttgtgggagacatttagcctgggcgcttccccctacccaaatctaagtaaccagcagacccgcgagtttgtggagaagggaggacggcttccctgtcccgagttgtgcccggacgctgtcttccgcctgatggagcagtgttgggcttacgaaccaggtcagcgaccaagtttctcaactatctaccaagaacttcagtccattcgcaaaaggcaccgctag

SEQ ID NO: 24166 - DNA, 444 bp, Artificial Sequence
  Description of Artificial Sequence: Synthetic coding sequence
atgggcttcagcagcgagctgtgcagcccccagggccacggcgtgctccaacaaatgcaggaggcggagttacgtcttctcgaggggatgcggaagtggatggcccagcgggttaaaagtgacagggagtacgcaggcttattacaccatatgtctcttcaagacagcggtggtcagagcagagcaatctctcctgatagtcctatctctcagtcctgggccgagataacaagccaaaccgaagggctaagccgacttttacggcagcacgcagaggatctgaatagcggtcctctgtccaaattatccctcctgatcagggaaaggcagcaactgcggaagacatatagcgagcaatggcagcagctgcaacaagaactcaccaaaacacatagccaggacatcgagaagttgaagtcccagtaccgcgccttggccagatag

SEQ ID NO: 24167 - DNA, 1638 bp, Artificial Sequence
  Description of Artificial Sequence: Synthetic coding sequence
atgggcttcagcagcgagctgtgcagcccccagggccacggcgtgctccagcaaatgcaagaagcagagctgcgtcttctggaaggcatgcgcaaatggatggctcagcgagttaaaagcgatagggaatatgcggggctcttgcaccatatgtctctgcaggacagtggcggacaatctagggcaattagtcctgatagcccgatctcgcaatcatgggcagaaataaccagtcagacagaaggtctatccagactcctcaggcagcatgctgaggatctgaactctggaccacttagcaaactgtcgcttctgattcgggagaggcagcaacttaggaagacttactccgagcagtggcaacagctgcaacaggagctcactaagacccatagccaggacatcgaaaaactcaagtcacaatatcgagcccttgcaagggacagtgcccaggccaaacgcaaataccaggaggccagtaaggacaaagaccgcgataaggcgaaagataagtacgtccgtagcctgtggaagcttttcgcacaccataataggtatgttcttggggtaagggctgcccagctgcaccatcaacaccatcaccagctcctattgccgggactactccgctccttgcaggacttgcatgaggaaatggcgtgtatccttaaggaaattctccaggaatatctggaaataagctctctagttcaggacgaggtggtcgctattcacagagaaatggctgccgccgccgcccgcatccagcccgaggccgagtaccagggctttttacggcagtacggcagtgcccctgatgtacccccttgtgtgacgttcgacgaatctctgcttgaggagggcgagccccttgaacctggtgaattgcaacttaacgaacttactgttgagtcagtgcaacatactctgacctccgtgaccgatgagctcgccgtggctaccgaaatggtgttcaggcgacaggagatggtcacacagctacaacaggagcttagaaatgaggaggaaaacactcatccgcgagagcgcgtgcagctgctgggaaaaaggcaggtgttacaagaagcactgcagggtctccaagtcgcgctgtgttcccaggccaagctccaagcccagcaggagctgctccagaccaagttggagcatctgggaccgggcgaacccccccccgtgctgcttctgcaagatgacaggcacagcacctcctccagcgagcaagaaagggaaggcggccgcacacctactctagagatactcaagtcccacatcagcggtatcttccgaccaaaattctccttgcccccaccactgcagttaataccagaggtgcaaaaacctttgcacgagcagctgtggtatcatggagccatcccacgggcagaagtggccgagctgctggtccatagcggcgattttctggtgcgcgaatcccaaggaaagcaggaatacgtgcttagcgtgctgtgggacgggttaccgaggcacttcattatccaagcccatgcgcctagtgaatggcgtcttttgacacccgggccactaccctgccggacatgcaccgattggaagggcaaggctttcctggcttttctgtgctcgagcaccacttactag

SEQ ID NO: 24168 - DNA, 366 bp, Artificial Sequence
  Description of Artificial Sequence: Synthetic coding sequence
atgggcttcagcagcgagctgtgcagcccccagggccacggcgtgctgcagcagatgcaggaagccgagcttcgactcctggaaggtatgcgtaagtggatggcgcagagggtaaaatctgatagagaatacgctgggttactgcatcacatgagtctccaggattccggcgggcagtcccgagccatcagccctgacagcccaatttcacaagtcggtctgtacgggacactggtcggcgcaggatgcatctgtttgctgctgcctctgctcggagccttatggggctcaggctggcggtctggtcgtccaatgctgggaagccactgtgcccccctgccagcctcccctatttgcgccgtatag

SEQ ID NO: 24169 - DNA, 510 bp, Artificial Sequence
  Description of Artificial Sequence: Synthetic coding sequence
atgggcttcagcagcgagctgtgcagcccccagggccacggcgtgctgcagcagatgcaggaagctgagctcaggctactggaaggcatgagaaaatggatggcacagagggtaaagtccgaccgtgagtacgcgggcctgctgcaccacatgagtctgcaggacagcggcggccagagtagggcgatttctccagacagcccgataagtcagagctgggccgaaattacatcacagaccgaggggctatcccggctcttgagacagcatgctgaggatttaaacagcggcccactttcaaaactctctctacttattagagagcgtcagcagctaagaaaaacatactctgagcaatggcagcagctccagcaagaactgacaaagactcactctcaagacatcgaaaagcttaaatcgcagtacagggccttagcgcgagactctgcacaggccaaaaggaaatatcaggaagcctccaaagacaaagatcgcgataaagccaaatag

SEQ ID NO: 24170 - DNA, 2283 bp, Artificial Sequence
  Description of Artificial Sequence: Synthetic coding sequence
atgaagacctgggtgaagatcgtgttcggcgtggccaccagcgccgtgttggctcttctcgtcatgtgtatcgtacttaggcctagccgtgttcataactcggaggagaatactatgagggctttaactctgaaagatatcctcaacggaacgttttcctataagacgtttttccctaactggattagcgggcaggagtatctgcaccagagcgcagataataacattgtattgtacaacatagagactggacagagctatacaatcttgtccaacaggactatgaaatcagtaaacgcaagcaactatggactttcccctgataggcagtttgtctatctcgaatcggattattctaagctatggcggtacagctatactgctacctattacatttacgatttatctaatggggagttcgttaggggaaacgagctccctcggcctattcagtatctctgttggtcacctgtggggagcaaattagcctacgtttatcagaataatatataccttaaacaacgaccaggggacccaccctttcagatcacatttaacggccgagaaaataaaatctttaacgggatccctgactgggtctatgaagaggagatgctagccactaagtatgcactatggtggagtcccaacggtaagttcctggcctatgccgagtttaatgataccgatatccccgtgatcgcctactcctactacggagatgaacagtaccccaggacaataaatattccctatcctaaggctggggccaagaatccagtcgttcgtatttttattatcgacaccacatatcccgcctacgtggggccccaggaggtgcccgtgcccgcgatgatagcttcatccgactattacttttcctggttaacttgggtgaccgacgagagggtgtgcctgcagtggctgaagcgagtccagaatgtgagcgtgcttagcatttgcgacttcagagaagactggcagacgtgggactgcccaaaaacccaggaacatatagaggaatcaagaaccggctgggcagggggatttttcgttagtaccccagttttctcttacgacgcaatcagctactacaagattttttccgacaaggatggatacaagcatattcattatattaaagacacggttgaaaacgccatccaaataacgtctggcaaatgggaggctatcaatattttcagggtcacacaggactctttgttttattccagcaatgagttcgaggagtaccctgggcgccggaacatctatagaatatcaatcggaagctacccccccagcaagaagtgcgtgacttgtcacctgcggaaagagcgctgccaatactataccgcttccttcagtgactatgccaagtactatgctttagtgtgctacgggccaggtattccgatctccacattgcatgatgggcggacggaccaggagatcaagattttagaggagaataaagagcttgaaaatgctctgaagaatatccagttgcctaaggaggagataaaaaaattagaggtggatgagatcacattgtggtataagatgatcttaccaccccaatttgatcgctccaaaaaatatccactgcttatccaggtctacggaggtccctgtagtcaaagcgtgcgatccgtattcgcagtcaattggatcagctatctggcctctaaagaagggatggtaatagcattggttgacggcagaggcacagcctttcagggcgacaagcttctttacgctgtgtaccggaagctgggcgtgtatgaggttgaggaccaaattacagcagtgcgcaaatttattgagatggggtttattgacgaaaagcggatcgcaatatggggctggtcctacggcggatatgtgtcctccctggccctggctagcggcactggcttatttaaatgcgggatagccgtggcccccgtaagttcgtgggagtattacgcctcagtgtacacagagagattcatgggcctccccactaaggacgacaacctagagcattataagaattctactgtgatggcccgcgccgagtatttcaggaatgtggattacctactcatccatggcaccgcagacgataatgtccacttccagaactccgcccagattgcaaaagcgctggtcaacgcccaggtggattttcaggccatgtggtactccgatcagaatcacgggctctcaggactctccaccaaccatctttacactcacatgacccactttttgaagcaatgtttctccctgtctgactag

SEQ ID NO: 24171 - DNA, 2208 bp, Artificial Sequence
  Description of Artificial Sequence: Synthetic coding sequence
atgaagacctgggtgaagatcgtgttcggcgtggccaccagcgccgtgttggcactactggttatgtgcatcgtgctgcgcccctctagagtgcacaattccgaggagaacacaatgagggccctcacactgaaagatattctgaacggaacattttcatacaaaacattttttccaaattggatctcaggccaggagtacctacatcaatctgctgacaacaatatagtcctttataatattgaaaccggacagtcatatacaatcctgtctaatagaacaatgctgtggcggtatagttacacagctacatattacatatacgatctctccaatggagagttcgttcgaggaaacgagctgccaaggcccattcagtatctctgttggtcccccgtcgggagcaagcttgcttacgtgtatcagaataacatatacctgaagcagcgtcctggcgacccacccttccagattacattcaacggccgcgagaacaaaatctttaacggaatacccgactgggtgtatgaagaggaaatgcttgctactaagtatgctctgtggtggagcccaaatgggaaattcctcgcatatgcggaatttaatgataccgacatccccgttatagcgtattcatactacggggatgaacagtaccctaggaccataaacattccatacccgaaagctggtgctaagaaccctgtggtgagaatattcatcatagacaccacttaccccgcatacgttgggccacaggaagttcccgttccagcaatgattgcttcaagtgactactacttttcctggctcacctgggttacagacgaacgggtctgcttgcaatggctgaagcgcgtccagaatgtttccgtattgtccatctgcgatttccgggaggactggcagacctgggactgccccaagacgcaggagcacatcgaggagtcacgaaccggatgggctgggggatttttcgtcagcactccagtgttctcgtacgacgcaatttcttattacaaaattttttccgacaaagatggatacaagcatattcattacatcaaggacacagttgaaaacgccattcagatcaccagtggcaagtgggaagcaatcaacattttccgcgtcacacaggattcgctgttctatagcagtaacgagttcgaggaataccctgggagacggaacatttacaggatatctatcggtagctacccaccaagcaagaaatgtgtgacatgtcacttaagaaaagaaaggtgtcagtactataccgcgtctttctcagattacgctaagtactacgctttagtgtgctacgggcccggaatccctataagcaccttgcatgatgggcgcacagatcaagagataaaaatcttggaggaaaataaggagcttgagaacgctctgaagaacatccaactgcccaaggaggaaatcaaaaaactggaagtagatgagattactctctggtataagatgatactgcccccccaatttgaccgaagcaaaaagtaccctctgctgatacaggtgtacggcgggccatgttcccaatctgtgcgtagtgtattcgccgtgaactggatttcttaccttgccagcaaggaggggatggtgatagctttggtggatgggagaggaaccgctttccagggcgataagctgctgtacgcggtgtatcgtaaactgggagtatatgaagtggaggaccagattacagccgtgcgtaaatttatcgagatggggttcatcgacgaaaagcgaatagcaatatggggctggagctatggtggctacgtgtcaagcctagccttggcatcgggtaccggcctctttaagtgcggaatcgccgtggcgcccgtcagctcttgggaatattatgcatccgtctacaccgaacggttcatggggctgccgaccaaggacgataacctggaacactataaaaactcaacagtaatggcgcgggctgaatactttaggaatgttgattacctcttgatacacggcaccgccgacgataacgtgcattttcaaaatagtgcccagatcgctaaagcccttgtgaatgcgcaggtggatttccaggccatgtggtatagcgaccagaaccacggcctgtcgggacttagcacaaatcatctgtacactcacatgacccacttcctaaagcagtgcttttctcttagcgattag

SEQ ID NO: 24172 - DNA, 468 bp, Artificial Sequence
  Description of Artificial Sequence: Synthetic coding sequence
atggccgagggcgagatcaccaccttcaccgccctgaccgagaagttcaacctcccccctggtaactacaagaaacccaaattactatactgctccaatggcggtcatttcttgcggatcttgcctgatggaacggtggacggcacgagagaccgaagtgatcagcatatacaactgcagctttccgccgagtcagttggggaggtgtacatcaaatcgacggaaacagggcaatatttggccatggataccgatggtctgctatacggttcccagacaccaaacgaggaatgcctgttcttggaaagactcgaggagaatcactacaatacatacatctccaaaaagcatgccgaaaagaactggtttgtgggtctcaaaaagaacgggagttgcaaaagaggtcctcggacacactacggtcagaaagccatcctgtttctccctctgcccgtatcctctgactag

SEQ ID NO: 24173 - DNA, 468 bp, Artificial Sequence
  Description of Artificial Sequence: Synthetic coding sequence
atggccgagggcgagatcaccaccttcaccgccctgaccgagaagtttaatcttcctccaggcaactacaaaaaacctaaacttctgtattgcagtaatggagggcacttccttagaatcctgcctgatggaacagtggatgggactcgcgatcgttccgaccaacatattcaactccagctcagcgcagaatctgtaggtgaagtgtacatcaagtcaacagagacgggccagtatctggccatggacactgatggtctgctgtacggcagccagaccccaaacgaggagtgcctgttcttagagcgcttagaagaaaaccactacaacacctatatctctaaaaagcatgccgaaaagaactggttcgtcggcctgaaaaagaatgggtcttgcaaacgggggccccgaactcactacggccagaaggccatcctttttctgcctctcccggtctcctctgattag

SEQ ID NO: 24174 - DNA, 468 bp, Artificial Sequence
  Description of Artificial Sequence: Synthetic coding sequence
atggccgagggcgagatcaccaccttcaccgccctgaccgagaagttcaatcttcccccgggcaactacaaaaagcctaagctgctgtactgctccaatggagggcactttctgcgaattcttcctgatggtaccgttgatggcactcgtgatcggagtgaccagcatatccaactccagttgagcgccgaatcagtgggcgaggtgtacatcaagtctactgagacgggccaatacctggccatggataccgatgggctgctgtacgggtcccagactccgaacgaagagtgtctgttcctggagaggctggaagagaaccattataacacttacataagtaaaaaacatgctgagaaaaattggttcgtgggtctgaagaagaatgggtcttgcaagcgagggcccaggacgcattacgggcaaaaggccatcctgttcttacccctgccagtgtcatccgactag

SEQ ID NO: 24175 - DNA, 177 bp, Artificial Sequence
  Description of Artificial Sequence: Synthetic coding sequence
atggccgagggcgagatcaccaccttcaccgccctgaccgagaagtttaatttgcctccgggcaactacaagaaacccaaactgctgtactgttctaatggcggacacttcctgagaattctcccagatgggacggtggatggcacccgcgataggtcggaccagcacatccagtag

SEQ ID NO: 24176 - DNA, 126 bp, Artificial Sequence
  Description of Artificial Sequence: Synthetic coding sequence
atggccgagggcgagatcaccaccttcaccgccctgaccgagaagttcaatctgcctccgggcaactataagaagcccaagctgctatattgtagcaatggggggcacttccttagaattttgtag

SEQ ID NO: 24177 - DNA, 468 bp, Artificial Sequence
  Description of Artificial Sequence: Synthetic coding sequence
atggccgagggcgagatcaccaccttcaccgccctgaccgagaagtttaatctgccccccggtaattataagaaaccaaaattgctctattgctcgaacggaggtcacttcttgagaatcttacccgacggcaccgttgatgggacaagggacaggagcgaccaacacatccagctgcagctcagcgcagaatctgtcggcgaggtgtacataaagtctaccgagaccggtcaatatttagcaatggacacagacgggttgttatatgggtctcagactcctaatgaagagtgcctgttcctcgagcgactggaagaaaaccattataacacttacataagcaagaagcacgccgaaaagaattggttcgtagggctgaaaaaaaacggtagctgcaagcgcgggccacggacccactacggacaaaaggccatattattcctgcccctccccgtgtccagcgactag

SEQ ID NO: 24178 - DNA, 468 bp, Artificial Sequence
  Description of Artificial Sequence: Synthetic coding sequence
atggccgagggcgagatcaccaccttcaccgccctgaccgagaagttcaacttgccacccgggaactacaagaaacctaagcttctctattgttccaacggcggacatttcctgcgtattcttccggatggtacagtggatggaacccgcgatcggtccgaccaacacatccaactgcagctaagcgcagaatctgtgggcgaagtttatataaagagtacggaaactggccaatacctcgctatggataccgacggtttgctatacggctcacagacccccaacgaggaatgtctcttcctcgaacggcttgaagaaaaccactacaatacctatatttctaagaagcacgctgaaaagaattggttcgtgggactcaaaaaaaatggctcatgcaaaagggggcctcggacccattacggtcagaaggccatcttgtttctgccactgcccgtttcatccgattag

SEQ ID NO: 24179 - DNA, 183 bp, Artificial Sequence
  Description of Artificial Sequence: Synthetic coding sequence
atggccgagggcgagatcaccaccttcaccgccctgaccgagaagttcaatcttcctccaggcaactataagaaacccaaattgctctactgttctaatggtggacacttccttagaatacttcccgatgggaccgtcgacggcacgcgtgacaggagtgatcaacatacagacacaaagtag

SEQ ID NO: 24180 - DNA, 627 bp, Artificial Sequence
  Description of Artificial Sequence: Synthetic coding sequence
atgtggaagtggatcctgacccactgcgccagcgccttcccccacctgccgggctgttgctgctgctgttttttgctcctgttcttggtgtcctccgttcccgtgacttgccaggcactcggccaagatatggtcagccccgaggctacaaactcttcgtcctcatccttctcgtcaccatcctccgctggtcgccatgtgcggtcctacaatcacttgcagggagacgtgagatggaggaagcttttttccttcacgaaatattttctgaagatcgaaaagaatgggaaagtgagcggaaccaagaaggaaaattgcccatattctatcctggaaattacttcagtggagatcggagtcgtggccgtgaaggccattaactctaactattaccttgcaatgaacaaaaagggcaagctttacggttccaaggagttcaataacgactgcaaattgaaggagcgcatcgaggaaaatggttataacacctacgctagcttcaattggcaacacaatggacggcagatgtatgtagctttaaacggcaaaggcgccccgagaagaggacagaaaacacgtcggaaaaatactagcgcacatttcttgcctatggttgtgcattcttag

SEQ ID NO: 24181 - DNA, 201 bp, Artificial Sequence
  Description of Artificial Sequence: Synthetic coding sequence
atgtggaagtggatcctgacccactgcgccagcgccttcccccacctgccagggtgttgttgttgctgcttcctgctgctcttcctggtgagctctgtccccgtgacttgtcaggcattgggacaggacatggtgtcgcctgaggcgacgaatagttcttcgtcctcattctctagcccttcctccgcagggcgacattag

SEQ ID NO: 24182 - DNA, 867 bp, Artificial Sequence
  Description of Artificial Sequence: Synthetic coding sequence
ctggtgggcgtgggcggcggcgacgtggaggacgtgaccccccggcccggcggctgccagatttcaggtaggggagcaagggggtgtaacggcatccctggcgcagccgcatgggaagccgctctgccgagacgcaggcccaggagacacccatccgtcaatcctagaagtcgcgcagccggctccccacggacaaggggccgacgaacggaggagaggccctccgggtcaaggctcggcgatagagggagaggaagggccctaccaggcggcagattgggagggcggggcagagggagggctcccgaacgcgtgggcggtagaggcagaggaagggggacggccgcgcctcgcgccgcacctgcagcaaggggctctcggcctggaccagcagggactatggccgctggctctatcacaactctaccagctctcccggaggacggtggatcaggggcatttccacctggccattttaaggaccctaaaagactttattgtaagaacggcggtttctttctccggatccatcctgatggccgcgttgacggtgtgagagaaaagagtgaccctcatattaaactgcaattgcaagccgaggaacggggcgtggtcagcatcaaaggtgtgtgtgccaatcgctacttggctatgaaagaagatggtcggcttcttgcgagcaaatgcgtgaccgatgagtgtttttttttcgagaggctggaaagcaacaattacaacacgtatcggtcacgcaaatacacatcttggtatgtggcccttaaacgcacaggtcaatacaaattggggtctaagacaggccctggccagaaggcaattctttttttgcctatgtcagccaagtcctag

SEQ ID NO: 24183 - DNA, 585 bp, Artificial Sequence
  Description of Artificial Sequence: Synthetic coding sequence
atgcacaagtggatcctgacctggatcctgcccaccctgctgtacaggtcatgcttccacataatatgcttagtcggaaccatttctcttgcctgcaacgatatgacaccagaacagatggccactaacgttaactgtagcagtccagaaagacacacccggagttatgattatatggaaggaggtgatatcagagtacgccggctcttttgtcgaacccagtggtatctacggatcgacaaacggggcaaggtgaagggtacccaggaaatgaagaacaactacaacataatggaaattaggacggtggcggtaggcatcgtggcaatcaagggggtggagagtgaattttatcttgccatgaacaaggaaggtaaattgtacgccaaaaaggagtgtaacgaagactgcaactttaaagagctcatcctagaaaaccattataacacgtatgcctcagcgaaatggactcataacggcggcgagatgttcgttgctctgaaccagaaaggtattcccgtccggggaaagaaaaccaagaaggagcagaaaaccgctcactttctgccaatggctatcacatag

SEQ ID NO: 24184 - DNA, 585 bp, Artificial Sequence
  Description of Artificial Sequence: Synthetic coding sequence
atgcacaagtggatcctgacctggatcctgcccaccctgctgtaccgcagctgctttcatatcatctgcctagtggggactatctctttggcctgcaacgatatgacccccgagcaaatggctactaacgtcaactgttccagcccagaacgtcatactaggagctacgactacatggaagggggagacatccgggtcagaaggttattctgccggactcagtggtacctgaggatagataaacgggggaaggtcaaaggcactcaagaaatgaagaataactacaatatcatggagatcaggactgtggctgttggcatcgtagccatcaaaggggttgaatccgaattctacttggcgatgaacaaagaaggcaagctatacgcaaaaaaagagtgcaatgaagattgcaacttcaaggaactcattctcgaaaatcattacaacacatatgcgtctgcaaaatggacccacaacggcggggagatgtttgtggccctgaaccagaaaggaattccagtgaggggcaagaaaacgaagaaagaacagaaaaccgctcactttctccccatggcaataacatag

SEQ ID NO: 24185 - DNA, 705 bp, Artificial Sequence
  Description of Artificial Sequence: Synthetic coding sequence
atgaagatctgcagcctgaccctgctgagcttcctgctgctggccgcccaagtgttactggtggaaggtaaaaagaaggtgaaaaacggtcttcactcgaaggtggtgagcgagcaaaaggacaccttggggaatacccagattaaacagaaatcccggccaggaaataagggtaaattcgtgaccaaggaccaggccaattgcagatgggcagctaccgagcaagaggaagggatttccctgaaggtggaatgcacccagcttgaccacgagttttcatgcgtgtttgctggtaaccccacctcatgcctcaaactcaaggacgaacgcgtctactggaaacaggtcgctcgcaacctgagatcccagaaggatatctgtcgctatagcaaaacagccgtgaaaactagagtgtgccgcaaggatttccccgaatctagcctgaaactagtgtcgtcaacgttgtttggcaataccaaaccaagaaaggagaaaacggaaatgtctccacgggagcatatcaaggggaaggagaccaccccatcttcattggcggttactcagaccatggccaccaaagctcccgaatgcgtcgaggaccccgatatggcaaaccagcggaagaccgctctcgaattctgcggcgagacttggagtagtctgtgtacatttttcctctcaatcgtgcaggatacaagctgctag

SEQ ID NO: 24186 - DNA, 705 bp, Artificial Sequence
  Description of Artificial Sequence: Synthetic coding sequence
atgaagatctgcagcctgaccctgctgagcttcctgctgctggccgcccaggtgctgctggtggagggaaagaagaaggtcaaaaatgggctgcacagcaaggtcgtctcggagcagaaagacacactcggcaatacgcagattaagcaaaagtcccgaccaggtaacaagggaaagtttgtaacgaaggaccaagcaaattgccggtgggccgctacagagcaggaggaagggatctcccttaaggtggaatgtacccagctggatcacgagttttcatgtgtcttcgccggcaacccaacctcatgtctaaagttgaaggacgagcgcgtttactggaagcaggtggcgaggaacctgcgatctcaaaaggacatatgcaggtactcgaaaaccgccgtgaaaacaagagtgtgcagaaaagactttcctgagagctctctgaaacttgtgtccagtaccctcttcgggaacactaagccccgaaaggaaaagacagaaatgagtccccgcgagcacattaagggtaaggagaccactccaagctctctcgccgtgactcagacaatggccactaaagcgccagagtgcgtggaagatccagatatggcaaaccagaggaaaaccgcgttagaattctgtggtgaaacctggagctccttgtgcacattctttttatcaatcgtgcaggataccagttgttag

SEQ ID NO: 24187 - DNA, 2421 bp, Artificial Sequence
  Description of Artificial Sequence: Synthetic coding sequence
atgggcgcccccgcctgcgccctggccctgtgcgtggccgtggccattgtggcaggagcttcctccgagtctctcgggactgaacagcgcgtagtgggccgagccgctgaggttcctggtccagaacccggtcagcaggaacagctggtgtttggcagtggcgacgctgtcgagctgtcttgtccaccgcccggaggcgggcccatggggccaaccgtttgggtgaaggacggaactggcctcgtccctagcgagcgagtactggtgggaccccagcggctccaagtcctgaatgcctcacatgaggactccggcgcttattcctgccggcagagactcacacaacgggtcctgtgccacttcagcgtgcgcgtaactgatgcccccagcagtggcgatgacgaggatggggaggacgaagccgaagatactggcgtggatacgggggctccgtactggacaaggccggagcgcatggacaagaagctactggcggtgcccgctgctaacaccgtccggttccgctgtcctgctgcgggaaacccgacacctagcatcagttggctgaagaatggccgcgaattccggggcgaacacagaatagggggcataaaactgcgccaccagcagtggtccctcgtgatggaatcagtagtgcccagtgatcgcggcaactacacctgcgtggtcgagaacaagttcggaagcattcggcagacatataccctcgatgtacttgaaaggtccccccacaggcctatcctccaggcgggattgccagcaaatcagaccgcggtgctcggatctgatgtggagtttcattgtaaagtgtatagcgacgcgcagccacatatacagtggctcaagcatgtggaagtgaacggtagtaaggtgggcccagatgggacaccctacgtcacggtgctgaaaacggcaggtgcaaacacgactgataaagagctggaggtattatcactgcacaacgtaactttcgaagacgctggcgagtacacatgcctggcgggcaattccatcggattttcccaccactcagcttggctggtggttctcccggcagaagaggagcttgtggaggcggatgaagccggctcggtttatgctggcatactgtcatacggcgttggctttttcctgttcattctggtagtagccgctgtcactttgtgtaggttgagatcaccccctaaaaaaggcttagggtctccaactgtccacaagatttcccgcttccctttgaaaagacaggttagccttgaatctaacgcctcaatgagctccaacactcccctggtgcggattgcccgcttgtcgagcggcgaaggtcctactcttgcgaatgtgagcgagctagagctgcccgcagacccaaagtgggagttatcccgagctaggctgacgctgggcaaaccgctgggagagggctgtttcgggcaggtggtcatggccgaagcaataggcatcgacaaagaccgcgccgccaagcccgtgacggtagcagttaagatgctcaaggatgatgccacggacaaggacttgagtgatctggtgtccgaaatggaaatgatgaagatgatcgggaaacacaaaaacatcattaatctgctgggggcctgtacacagggaggtccgctgtacgtcctcgtagagtatgccgcaaaaggcaatctacgcgagtttctccgcgcccgtcgaccccccgggcttgattactcatttgatacatgtaaaccaccagaggaacagctcacattcaaggacttggtaagttgcgcataccaggtggccaggggcatggaatatcttgctagtcaaaaatgtattcatcgtgacttggccgctcggaacgtactggtcacagaagacaacgtgatgaagatagccgactttgggctcgcccgtgatgtgcacaatttagactattacaaaaaaacaaccaatggtcggcttccggttaagtggatggccccggaggctctatttgatcgcgtgtacacccatcagagtgacgtgtggtctttcggcgttctcctgtgggagattttcactctgggaggctctccgtatccaggcatccctgttgaggagctgttcaaacttctcaaggaggggcaccgaatggacaagcccgccaactgcacacatgatctttacatgataatgcgggagtgctggcacgcagctccgtcacaacggcccacttttaagcagctcgtagaggatttggaccgagtgcttacggttacctcaaccgacgagtacttagacctttccgctccatttgagcagtattctcccggaggacaagacaccccatcttcatcctctagtggagacgattccgtctttgcgcatgacctgctgcccccggccccccccagtagcggcggctccagaacgtag

SEQ ID NO: 24188 - DNA, 513 bp, Artificial Sequence
  Description of Artificial Sequence: Synthetic coding sequence
gagtacctggacctgagcgcccccttcgagcagtacagccccggcgggcaggacacaccttcctcctcttcctctggtgatgactcagttttcgcccacgatctactcgccacagggcctcagcagtgtgaaggttccttagccgcccatccagcagccggagctcagccattgccgggaatgagactgtcagccgatggggaaactgctacacaatcgttcggcctgtgcgtgtgtgtgtgcgtgtgtgtgtgttgtacatccgcttgtgcctgtgttcgcgcccacttagcctcccgatgtcggggcacactgggggttccggccgcagtgcaacgctcaccagattggtgctgttctaccgaagggcccctgttctggggggaccctgttcagaatgtgagtgggccgactagatgggaccccggacagggagccggccccgacatgaggcccctgccactgcaccatggaacctcacagggtctggggccatcgcacacccagtcgtag

SEQ ID NO: 24189 - DNA, 2427 bp, Artificial Sequence
  Description of Artificial Sequence: Synthetic coding sequence
atgggcgcccccgcctgcgccctggccctgtgcgtggccgtggccatcgtagctggagctagcagcgaaagcctgggtaccgagcagcgagtagtgggccgggccgcggaggtgccaggtcccgagccggggcagcaggagcagctcgtgtttggatctggcgacgccgtcgagctctcttgtccacctcccggtggaggtcccatggggccaactgtgtgggtaaaggacggaactggcctggttcctagtgaacgggtgctggtgggcccccaacgactgcaggtgctgaatgcatcacacgaggattccggggcttactcctgtagacagagattgacacagcgtgttctgtgccatttctccgtgagagtcaccgacgcaccatcgtcaggcgatgatgaagacggagaggacgaagcggaggatacgggagtagatacaggagcaccatattggacgagacctgaaagaatggacaagaagctcctggcagttccggccgctaacaccgttagattcagatgccctgccgccggcaatcccacaccctcaatttcctggctgaaaaacggacgagagttccgaggagagcatagaataggggggattaagctgagacaccaacagtggtcgcttgtgatggagtccgtggtcccaagtgatcgggggaattatacctgtgttgtcgaaaacaagtttgggtcaattcggcaaacctataccctggatgtcctggaaaggtccccccataggcctatcctgcaggcggggttgcccgcaaaccaaacagctgtactgggatccgacgtggaattccactgcaaggtgtatagcgacgcacagccccatatccagtggctcaaacacgtcgaggtgaacgggtcaaaagtaggcccagacggcaccccttatgtgacagtgctgaaaagttggataagtgagtcagtcgaagccgatgtacggctccggctagcaaatgtgagcgaacgagacggcggggaatatctgtgcagggccacgaactttattggagttgcagagaaagccttctggctctctgtgcatggcccacgcgctgccgaggaagaactggtagaggccgacgaagccgggagtgtgtacgcgggtatcctgtcatatggagtgggctttttcctgttcatcctggtggtggcagcagttaccctgtgtcgcctgcgctcgccaccaaaaaagggtctcggaagtccgaccgtccataagatttcacggtttcccctcaagaggcaggtgagtctggaatcgaacgcctctatgtccagtaacacaccccttgttagaatagcgcgcctctcctctggggaaggcccaactcttgctaatgtgagcgaactggagcttcccgcggatccaaaatgggaactgtcaagggcgcgcctgacactcgggaagcccctgggggagggttgtttcggccaggtggtgatggctgaggccatcggaattgataaagatcgggctgccaagcctgtgaccgtcgcagttaagatgctgaaggatgacgccaccgataaagacctcagcgacttagtgtccgaaatggagatgatgaagatgatcggaaagcacaagaatattatcaaccttctgggtgcttgcactcaaggagggccactgtatgtgcttgtcgaatacgcagctaaggggaatttacgagaatttcttcgggctagacgaccccctgggctggattatagtttcgacacctgtaagcccccagaagaacagctgactttcaaggatctggtgtcttgtgcctaccaggtcgctaggggcatggagtatctggctagccagaaatgcatccatagggacctcgctgcccgtaatgtccttgtaaccgaggacaacgtcatgaaaatcgctgacttcgggctagctagagatgtccacaaccttgactattacaagaagaccaccaacggccgcttacctgtgaagtggatggcccccgaggcgctcttcgatagggtctacacccaccagtcagacgtctggtcatttggtgtcttgttatgggaaatattcaccctgggcggctcaccataccctgggattccggttgaggagctgtttaagttactcaaagagggccaccgcatggacaagcccgcaaactgtactcacgacctgtacatgattatgagggagtgttggcatgctgctccctctcaacgccctactttcaaacaactggtcgaggacttggacagggtcctgaccgtcacttccaccgacgaatacctggacctgtcagcgccctttgagcagtatagtccgggtggccaggacacgccctctagtagctcttccggcgatgacagcgtcttcgcacacgacttgctcccacccgctccaccttcgagtggaggctcccgcacatag

SEQ ID NO: 24190 - DNA, 2085 bp, Artificial Sequence
  Description of Artificial Sequence: Synthetic coding sequence
atgggcgcccccgcctgcgccctggccctgtgcgtggccgtggccattgtagccggggcctcttcagagagcctgggcacagagcagagggttgtgggacgggccgcagaagtgcccggacctgagcccggtcaacaagagcagctagtttttgggagcggcgatgccgtggagctgtcctgcccccctcccggaggtggacctatgggcccgactgtttgggttaaggacggaactggcctggtgccgtcagagcgggtgctggttggcccccagagactacaagtcctgaacgcatcccatgaggattcgggggcttattcatgcagacagcggctaacacaacgcgtgctttgtcatttttcagtgagggtgaccgacgcccctagctccggagacgacgaagacggcgaggatgaggcggaggatacaggcgtggacaccggcgcaccctattggacccgacctgagagaatggacaaaaagctcctagctgttccagcagctaacactgtgcggtttcgctgccctgcagcaggcaatccaaccccctcaatttcctggttaaagaacggacgagagttccgcggcgaacataggattggcgggataaaactgcgtcatcagcagtggtcactggtgatggagagcgtagtgcccagtgaccggggaaactatacatgtgttgttgagaacaagtttggatccatacggcagacgtatacccttgacgttcttgagcggtcccctcatagacccatccttcaggccgggttacctgctaaccaaactgccgtgcttggaagcgacgtggagttccattgcaaagtctactccgacgcacagccccatatccagtggttaaaacacgtcgaggtcaatggatctaaggtcggccctgacggtaccccatatgttacggtgttgaaggtgagtcttgaatccaacgctagtatgtccagcaacaccccactcgtacgcatcgccaggctatcctctggcgagggccctactcttgccaatgtcagcgaattagagctgcctgctgatcccaagtgggaactctcacgggcaaggctgaccctgggtaagcctttgggggaagggtgcttcggtcaggtggtgatggccgaggccataggcatcgataaagaccgggcagctaagcccgtgacggtggcagttaagatgcttaaggacgatgccacagataaggatctttcagatctggtgagtgaaatggaaatgatgaagatgataggtaagcataagaacatcattaacctcctgggggcctgcacccagggtggtcctttgtacgttctggtggagtacgcagcgaaaggtaacctgagagagttccttcgggctagacggcctcccggactggactacagttttgatacttgtaaaccaccagaggaacagctgacattcaaggacctggtgtcctgcgcctatcaggtcgcaaggggcatggagtacctcgctagccaaaaatgcattcaccgcgatttagcggccaggaacgtgttggtgaccgaggacaatgtaatgaaaattgccgacttcgggctggcccgtgatgtgcacaatctagactactacaagaagaccactaacgggcgactgcctgtgaaatggatggcccccgaagcgctgttcgacagagtctatactcaccaatccgacgtttggagtttcggcgtcttgctttgggaaatatttacactgggtggaagcccttacccaggcatccctgtcgaagagctattcaaacttttgaaggaaggacaccggatggataagcctgctaactgcacacacgacctatatatgattatgagagagtgttggcatgccgcaccgtcacagcgacccacctttaaacagctggtggaggatttggacagggtactgacagttacttcaactgacgagtacttagacctcagcgctccattcgaacagtattctcccggcggtcaggacaccccttcctcttcttcaagtggagacgattctgtatttgcgcatgacctcctaccccctgctccccctagcagcgggggttccagaacttag

SEQ ID NO: 24191 - DNA, 2421 bp, Artificial Sequence
  Description of Artificial Sequence: Synthetic coding sequence
atgggcgcccccgcctgcgccctggccctgtgcgtggccgtggccattgtggccggcgcttcctccgaatcactggggaccgagcagcgcgtggtcggtcgagctgcggaggtgcccggacctgagcccggacaacaggagcagcttgtgtttggctctggcgacgcagttgagcttagctgccctcctccaggtggcggacccatgggccctactgtgtgggtgaaggatggcaccggtctggtaccctcagagcgcgtcctcgtaggcccgcaacgcctacaggtgctgaacgcatcacatgaggatagtggagcctattcttgtcgacaaagactgacccagagagtgctctgccacttcagtgtcagggtgaccgatgctccaagcagtggcgatgacgaagacggagaagacgaagccgaggacaccggcgtcgatacaggcgctccctactggactagacctgaaagaatggataagaagctgttggctgtgccagcggccaataccgtgcgctttcgatgtcctgccgcgggaaatccaacccccagcatctcttggcttaaaaacgggagagagtttcggggggagcataggattggcgggattaagcttcgacaccagcagtggtccttggtaatggagtccgtggtcccaagcgaccgggggaattatacatgtgtggtcgagaacaagtttgggagcatccggcagacatacacactggacgtgctggaaagatccccccacaggccaattttgcaggccggcctaccggcaaatcagaccgcggtcttaggaagtgatgtggaatttcactgcaaggtctactcggacgcgcagccacacattcagtggctgaagcatgtagaggtcaatggatccaaggtcggcccagatggtacgccctacgtgaccgttctcaagacggctggtgccaatacgaccgacaaggaactggaggttctgtcactccacaatgtgacattcgaagatgcaggagaatatacgtgccttgctggcaattccatcggcttttcgcatcactctgcctggcttgtcgtccttcctgccgaagaggaactcgtcgaagccgatgaggccggcagcgtttacgctggcatactaagttatggagtcggtttcttcctgtttattcttgtggtggcagctgtgaccctatgtcggctacgaagcccccccaagaagggcttggggtctccaaccgttcacaagatttctagattcccactcaaacgccaggtctctctggaaagcaacgcttcaatgagctcaaatactccgttggttcgtatcgcccgccttagttcaggggaaggaccgaccctcgccaacgttagtgaactggaattgccggcagatccaaaatgggaactgagccgagcccggcttacactcggcaaaccactaggggagggctgcttcggtcaggtggtgatggctgaggcgatcgggatcgataaggatagggcagcaaagccggtcaccgtagccgtcaagatgctgaaagacgacgccaccgacaaggatctgagtgatctcgttagtgagatggaaatgatgaaaatgatcggcaagcacaagaacatcatcaatctgctgggggcatgtacgcagggaggccctttgtatgtgctggtagaatacgcagcaaaggggaacttacgcgagttcctgagagcaagacgccccccaggccttgactactccttcgatacttgcaagccgccagaggagcagctgacatttaaggacctggtaagttgcgcctaccaggtggccaggggcatggaatacctcgcctcacaaaagtgtatccaccgcgacctggctgctaggaatgtgctggtaaccgaagataatgtgatgaaaatcgccgattttggcctggctcgtgatgtgcacaacctggattactacaaaaaaactaccaacgggagactgccagtcaagtggatggcccctgaagctctgttcgaccgggtgtacactcaccagagcgatgtttggtcttttggcgtgctcctgtgggaaatctttacactcggcggttctccatatcctggcattcccgtggaagagctctttaagctgctcaaagagggacatcgcatggacaaacccgccaactgcacccacgacctatatatgatcatgcgggagtgctggcatgccgctccctcgcagcgcccgaccttcaaacagctggtcgaggacctggaccgggtcctgacggtgacttccactgacgagtatctcgacctatctgcacccttcgagcagtactcacctggcggccaggacacaccctcttcatcttcatcgggcgacgattccgtattcgcccacgacttacttccacccgctccacctagctctggaggaagtcggacctag

SEQ ID NO: 24192 - DNA, 2379 bp, Artificial Sequence
  Description of Artificial Sequence: Synthetic coding sequence
atgggcgcccccgcctgcgccctggccctgtgcgtggccgtggccattgtggccggtgcgagttcagagtccctgggcacagagcagagggtggtcggtagggcggcggaggtgccgggtccagaacccggccaacaggagcaattggtgttcggctcaggcgatgccgtggaattatcctgcccgccacccggtggcggccccatgggacctacggtgtgggtcaaagacggcaccggcttggtgccctccgagcgggtgttggtggggccccagcgactgcaggtgctcaatgcttcccacgaggactctggtgcctactcctgccgacagcgcctgacacaaagagtcctgtgccacttcagcgtgcgggtgaccgatgcaccaagctccggggatgacgaagatggggaagacgaggccgaggacacgggagttgatacaggggctccatattggacaaggccggaaagaatggataaaaaacttctggccgtccctgcggcaaataccgtgcgctttaggtgccctgcagccggaaaccccacgcccagtataagctggcttaagaatgggcgcgaatttagaggcgagcaccgcatcggaggtatcaagcttcggcatcagcagtggagcttggttatggagtcagtagtgccaagcgatcgtgggaactatacctgtgttgtggaaaataaattcggctccatccgccagacttacacacttgacgttttggaaagatccccacatcgtcccattttgcaggccggtctccccgccaaccagaccgctgtgctggggtctgacgtggaatttcactgcaaggtgtactcagacgcacaacctcatattcagtggttgaagcatgtggaagttaatgggtcgaaggtcggcccggacggcacaccatacgtgacagtgttgaagactgccggggcgaacactacagacaaagaacttgaagtactgtcactgcacaatgtcactttcgaggacgctggtgagtatacatgcttggccggaaactctattgggtttagccatcactcggcctggttggtggtgttgccggccgaagaggagttggtagaagctgacgaggctggtagcgtctatgccggcattttaagttatggagtaggcttctttctcttcatcctcgtcgtggcggccgtcactctctgccgcctccgctcacctcccaagaaggggctggggtctcccacggtgcataagattagcaggttccctttgaagcggcagcaggtttcactggagagtaacgcatctatgtcctcaaataccccgctggtgaggatcgctcgcctgagctccggtgagggcccaactttggccaacgttagcgaactggagctgcctgcagaccccaaatgggaactgtctcgtgccagactcacactgggtaagcctttgggggagggatgcttcggacaggttgtgatggcagaagcaatcgggattgacaaggaccgagcagccaaacccgtaactgtggcagtgaagatgctcaaagacgacgctaccgataaggatctcagtgacctcgtcagcgagatggagatgatgaaaatgataggtaagcacaaaaatattatcaacctgcttggagcctgtacccaaggcgggcctttatacgtccttgtcgaatacgctgctaaggggaatctgagggagttcctgagagcgagaagaccacctggccttgattatagcttcgacacttgtaagccccccgaagagcagctgaccttcaaggacctggtttcttgtgcctaccaagtggctcgtggcatggaatatttggcaagtcagaaatgcattcaccgtgacctcgctgccaggaacgtcctggtgactgaggacaacgtcatgaagatcgctgactttgggcttgcccgcgacgtgcataatttggattactataaaaaaaccacaaatctggtactttggggacctgcacttggagacctgcacgcaggggggctacccgtccctagacacccttgtggtggcgccttgcaggctgctgaagggggaccaccccacgggcaggcccggcaactccacacaagacctgttcacgaccatgcaggggtgctggcatgtcgagctttgccagaggcgcatctgcaggccgccgggggtgggccaggtccatgcccttaccgggatgtgcacagacgcgtccccggcccggttggagctttcagggctgtgctgcccgggtggcctggccatccccagctgcaattgctaagaggtagattgcgagtgtgccccagacccgctgcacctggcccgacgcagcagtgggggttggcggacgttaaagggcactggtcccccactatgtag

SEQ ID NO: 24193 - DNA, 2409 bp, Artificial Sequence
  Description of Artificial Sequence: Synthetic coding sequence
atgcggctgctgctggccctgctgggcgtgctgctgagcgtgcccggtccacccgtgttgagtcttgaagcttctgaggaagtagagctggagccctgcctggcgccaagcctggaacaacaggaacaggaacttactgttgcccttggccagcccgtgcgcttatgttgcggaagagccgaacgaggcggacattggtataaagagggctctaggttggcccctgccgggcgtgtgaggggctggcgtggaagactcgaaatcgcttcctttctgccagaggacgctggcagatacctgtgcctggcgagaggatcaatgatcgtcctgcagaacctgacgctgattactggggactccctaacatctagcaatgacgatgaagacccgaaaagccaccgcgacccaagcaataggcattcctacccgcagcaagctccatactggactcacccacagaggatggagaagaagctgcatgctgtgccagcggggaacactgttaagttcagatgccccgccgctggtaaccccactcctaccatccgctggctgaaagacggtcaggccttccatggggagaacaggatcggcggaatacggttacggcaccagcattggagcctcgtgatggaaagtgtggttcccagtgatcggggtacctacacatgcctcgttgaaaacgcagtgggaagtattaggtacaactatctcctcgacgtgctggagcgctctccacacaggcctatactgcaagcaggcttgcctgcgaatactacagctgtggtcggtagcgatgttgagcttctgtgtaaggtctatagtgacgcccaaccccacattcagtggctgaagcatattgtcatcaacggtagttcttttggggcagatggttttccatatgtgcaggtgcttaaaactgctgatatcaattccagtgaggttgaagtactatacctccgcaatgtatcggctgaggacgccggtgagtacacctgcttggctggaaattctattgggctatcttaccaatcagcatggctcaccgtacttccagaagaagatccgacttggaccgcagctgccccggaggccaggtatacagatattatcctctacgcgtcgggtagcctcgccttagcagtgctcctcctgttagcaggtttgtatcggggacaagcactgcacggtaggcacccgagaccacctgcaaccgttcaaaagctgtctcgcttcccgttggccaggcagttctcgctggaatctggtagctctggcaagtccagttcttccctggttcgcggcgtgcggctgtcaagtagtgggcccgccctgttagcaggcctggtctctcttgatctcccactggatcccctgtgggagttccctagagataggctcgtattgggcaagccattgggcgaaggctgcttcgggcaggttgtgagagcggaagcttttggcatggacccagcccggcccgaccaggccagtacagttgccgtaaagatgctcaaagacaacgcatctgacaaggacctggccgacctggtctcggagatggaggtaatgaaactgatcggacgccacaaaaacatcatcaacctgctgggggtgtgtacgcaggagggaccattgtacgtaattgtcgagtgtgccgcaaaaggtaatttgagggagtttctgagggcccgccgcccacccggtcctgacctgtctcctgacggtccaagaagtagcgaggggcccctgagttttcctgtgctggtcagctgtgcgtaccaggtggcgcgaggcatgcagtacttggagtctcgtaaatgcatccatcgcgatctggccgcccgcaatgtcctggttaccgaggacaatgttatgaagatcgcggatttcgggcttgcaaggggcgttcaccatatagactactataagaagacatccaacggcaggcttcccgtgaagtggatggcacctgaagctctattcgatcgggtctatacacaccaatctgatgtgtggtcatttggaatcctgttatgggaaattttcactctgggtgggtccccctatcccggcatccctgttgaagaattattcagcctcctgagggagggccacagaatggatagacctccacactgtccgcctgagttgtacggcttgatgagagagtgttggcacgccgcccccagccagaggccaactttcaagcagctggttgaagccttggataaagttttgttagccgtgtccgaggaatacctagaccttcgtttaacgtttggaccctattctcctagcgggggagacgcatcttccacatgttcttcctctgactcagtattttcccacgatccactgcccctgggctcgagcagctttccatttggcagcggtgtccagacttag

SEQ ID NO: 24194 - DNA, 2289 bp, Artificial Sequence
  Description of Artificial Sequence: Synthetic coding sequence
atgcggctgctgctggccctgctgggcgtgctgctgagcgtgcccggcccccctgtgctgtcattggaagcaagcgaagaggtggagctcgagccatgcctggccccgagccttgaacagcaggaacaagagctaacggtcgcccttggtcaacctgtgagattgtgttgtggcagggcagagcgaggaggccactggtacaaagagggctccagactcgcccctgcaggcagagtccggggctggaggggccggcttgaaatcgctagtttcctccccgaagacgccggacggtatctgtgtctggcccggggctctatgattgtcctccaaaatttgacactgattacgggggattcactgactagttcaaacgacgatgaggaccctaagagccatcgtgatccaagtaataggcacagctacccgcagcaggctccctattggacccacccacagaggatggagaaaaagctgcatgcggttccagccggcaatacggtgaaattccggtgtccagcagcaggcaatcctaccccaactatccggtggcttaaggatggtcaggcgttccatggggaaaaccggataggaggaatcaggttacggcaccagcactggagtttggtcatggaatctgtcgtgccatcggaccgaggcacatacacatgtttggtggagaacgccgtcggcagcataagatacaattacctgctggatgttttggaacgctcacctcaccgcccgatcttgcaggcaggactcccagcgaacacgactgccgttgttggatccgatgtagagctgttgtgtaaagtgtactccgacgcacagcctcacatccagtggctcaaacacattgtaattaacggttctagttttggcgcagatggattcccctacgtgcaagtgctgaaaaccgcagacatcaattcaagcgaagtcgaggttctttacctaaggaacgtctcagccgaggatgctggtgaatacacgtgcctagcagggaattcaataggcctcagctaccagtcagcctggcttaccgttttgcctgggaccggtcgcattcctcacctcacctgcgattctctcaccccagcaggacgaaccaaatctccaaccttgcagtttagccttgaatccgggtccagcggcaaaagcagctccagcctcgtgagaggagtaaggctctcaagcagcggccccgcgctcctggccggccttgtttcactggacctgccgctcgaccccctgtgggaattcccaagggatcggctcgtgttggggaagcctttgggcgaagggtgttttggtcaggtcgttcgcgccgaagcatttgggatggatccggcacgccccgaccaggcctcgacggtggctgttaagatgctgaaggataatgcctccgataaggatctcgccgatcttgtgagtgaaatggaggtgatgaaactaattggccggcataagaacattatcaatctcctgggggtgtgtacccaggaggggcccttgtatgtcatcgtagagtgcgctgccaagggcaatctcagggaatttctgagagcaaggcgtcccccagggccggacttgagccccgacggtccacggagcagtgagggaccattatccttcccggtgcttgtgtcctgcgcatatcaggtcgcacgaggcatgcagtatctggagagccgcaagtgcatccatagggacctggccgctcgtaacgtgctcgtgactgaggacaacgttatgaagattgctgatttcggcttggcaagaggagtgcatcatattgactactataaaaagacaagtaacggcagattgcctgtaaagtggatggccccagaagcactctttgacagggtgtatacccaccagtctgatgtgtggtccttcgggattcttctgtgggagatattcaccctgggcggaagcccctatcccggaattccagttgaggaactgttttccctgctgcgggagggtcatcggatggacaggcctcctcactgtcctcctgaactctacggactcatgagagagtgctggcacgctgccccatcccagagacctactttcaagcagctggtggaagccttggataaagtgctccttgcagtgagcgaagagtaccttgaccttcgcttgacttttggcccttactcaccctccgggggcgacgctagctccacatgctctagttctgactctgtcttttctcatgatcctctgcccttaggcagctcctcatttccgttcgggtctggtgttcagacgtag

SEQ ID NO: 24195 - DNA, 3093 bp, Artificial Sequence
  Description of Artificial Sequence: Synthetic coding sequence
ccctgcatgtggcaccagcagcacgtgccctgcgtgtgcgtgtgcccctacgtgtgcgtctgtatgagagtgtgcgtgtgcgtctgctggccccttagctgcgctcttaacgccgtgtgtgttacctgtccaaagagcgtggctttcgccttgggcgtcgctagtgctgcgtgcgggtgcgtgggcgtgaaagaatggtggctgcttcagcacgccctgcagtctgcatgtgccctgcatgtgaggtgcgttttgtgcactcaggaggcagctagcgacggagccgcgggatctgccgacctctgtcctctcccgaccgaaccgtgtctggctcctagtctggaacaacaggaacaggaactcaccgtcgcactgggccagcccgtgcgattatgctgcggcagagctgaacgggggggtcattggtacaaagagggtagccggctcgcacccgcggggcgggtacggggctggagaggccgactggagattgcttccttcctccctgaggacgccggcaggtatctgtgcttagccagaggatccatgatcgtgctccagaatctgaccttgataactggagattcccccccagccaccatgatgcgcaccccttcccctataggcactcctaggatcggcacggtcacaccaagtaaggttagccggtccccccggacttgtgtccctgccgcagcacaccttattaccgagaaaaggaggcccgtgtgggagcatacagtgatattgggagcttttccatgccccccagccccctattggacccacccgcagcgcatggagaagaagctccacgctgtccccgcaggaaatactgtcaaatttagatgtccggctgctgggaacccaactcccaccatccgatggcttaaagacggtcaggcgtttcacggtgagaaccggataggtggaatccgcctccgtcaccagcactggagcctggtcatggagtccgtggtcccatcagaccgcggaacatacacatgcttggtcgagaatgcagtgggatccatccgatataattatttgctagatgtgttggaaaggagcccacaccgacctatcctgcaggctggcctgcccgcaaataccacagccgttgttggctccgatgtggagctgctgtgcaaagtatattccgatgctcagccacacatccagtggctgaaacatattgtgatcaatgggagctcctttggggctgacggattcccgtacgtccaagtgctaaagacagcagatataaatagtagcgaagtggaggttctctatttgcgcaacgtgtccgctgaagacgcaggagagtacacatgtctggccgggaatagtataggtctgtcctatcaaagcgcatggctgaccgtcctccccggcgagcatctcaagggacaggagatgctgcgcgatgctcccctgggccagcagtggggcctgtggcctgtgggctggtccgtcagtgtgggtctgtggggattggcctggggggccgtctgtgggtttgtgggcctgtcctgtatgacggcaccgttgtgtctcagcacccgcggtcgcccgtgcgataggctgctccgatgtggttgcctaggactcggcatcaccaccgcgagttctgtgtgtgtccccacatatgtggggtcttgggagggcctaggttgtactgggcgtcctgtgtcccccttgacatcactgtcagtctgcgtgtgcccttgcgctcgagcggaggaagaccctacctggaccgccgcggcccccgaggcaagatatactgacatcatcctgtacgccagcgggtccttggccttagcggtactgctgctgcttgccgggttgtatcgcggacaagcactgcatggccgccaccctagaccgccagccacagtgcagaaactgagccgctttcctctggcaagacagttcagtctggagagtgggagctcaggaaagtcgagctcctccctggtccgaggggtccgactcagcagcagcggccctgccttgctggctgggctcgtctcattggacctcccgctcgacccgctctgggaattccctcgcgaccgcttagtactgggaaaacccctcggagaggggtgttttggacaggtggtcagagcagaggcgtttgggatggatcctgctcgccccgaccaggccagcactgtggcggtaaaaatgcttaaggataatgcgagcgacaaagatctagcggacctggtttcagaaatggaggtgatgaagctaataggcaggcataagaatattattaacttgctcggcgtttgtacccaggaaggacccctgtacgtgattgtggaatgtgccgccaaggggaacctacgcgagtttctgagagcccggagacctccgggcccggacctatcacctgatggcccccggtcgtccgaggggccactgtcatttccagtgctggtctcttgtgcttatcaggtggcccgcggcatgcagtacctggagagccgaaaatgtattcatcgcgatctggcagcgcgcaacgtactagtgaccgaggacaacgttatgaagattgccgattttgggctggcacgtggggtgcaccatatagactactacaaaaagacttcaaatggtagactccctgtgaagtggatggcaccggaagccctttttgaccgcgtctacacacaccagagcgacgtttggtcctttggcatccttctgtgggaaattttcaccttgggagggagcccttaccctgggatcccagtcgaggagcttttctccctccttcgcgaagggcataggatggataggcccccccattgtccacctgagctctacgggctcatgcgggagtgctggcacgctgcccccagtcaacggccaactttcaagcagctggttgaagcgttggacaaggtgctgctggccgtgtcagaggaatacctggatctgcgtctcaccttcggcccttatagcccctctggtggagacgcctcaagtacttgttcttcctcagacagtgtgttttctcacgaccctctcccactcgggagctcatcattccccttcggctctggagtgcagacatag

SEQ ID NO: 24196 - DNA, 2289 bp, Artificial Sequence
  Description of Artificial Sequence: Synthetic coding sequence
atgcggctgctgctggccctgctgggcgtgctgctgagcgtgcccggacctcccgtccttagccttgaggcttccgaggaggtcgagttggagccttgcctggcaccatctctcgaacagcaagagcaggagcttaccgtagcactggggcagcccgtcaggttgtgctgtggaagagcggagcgaggaggacattggtataaagaaggatcccgcctggcgccagccggaagggttaggggttggcgtggacgacttgagattgccagttttctccccgaagatgccggaaggtacctctgcctcgctagggggtccatgatcgtgctccaaaatctgactctgattaccggagactccctgacgagttccaatgatgacgaggatcccaaaagtcatagggacccctcaaataggcactcgtatccgcagcaggctccatactggacccacccgcagcggatggagaaaaaactgcacgcggtacctgccggcaataccgtgaagttcagatgccccgccgctgggaacccaacacctaccataagatggcttaaggatgggcaagctttccatggggaaaatcgaattggagggatccggctgcgacaccagcactggtcccttgtgatggaaagtgtcgtaccctccgaccggggcacatatacctgcctggtggaaaacgcagtggggtccatcaggtataattacttattggacgtgctggaaaggtccccacataggcctattctccaggccgggctgcccgcgaacacaaccgcagtggtcggcagcgatgtggaactactgtgtaaggtttattccgatgcgcagccacacatccaatggctgaagcatatcgtgattaatggatcatcctttggagccgacgggtttccatacgtgcaggttcttaagacagccgatatcaactccagtgaagtcgaggtgctttatctccggaatgtttctgcagaggatgctggggaatatacctgtctggctggcaacagcattgggctttcctaccagtcggcatggctcaccgtgctgccaggaactggccgcatcccgcacctaacatgcgattctttaacgcccgcaggtcggactaaaagcccgactcttcagttttctctggagagtgggagttcaggtaaatccagctcttctctggttagaggggttcgcctgtcatcatccgggcccgcgctgcttgccggacttgtgtccctggatctgcccctggatcccttatgggagtttccgcgggaccggctggtgttaggaaagcccctgggcgaagggtgcttcggtcaggtggtgagagccgaagcctttggtatggatccggccaggccagaccaagcttctactgtcgcagtgaagatgctaaaggataatgcctcagataaggacctggccgacctggtttctgagatggaggtgatgaagttaataggccgacacaagaacataattaacctcctgggcgtatgcacccaggagggccccctgtacgttattgttgagtgtgcggccaaaggaaatttacgtgagtttttacgagctcgtcggcctccgggcccggatctgagccccgacggcccaaggtcctccgaaggcccactgagttttcctgtgctagtgagctgcgcttaccaggtagcccgcgggatgcagtaccttgagagcaggaagtgtatccacagagatctggctgcccggaatgtcctggtgacagaagataatgtaatgaagattgctgactttggcctcgctcggggggtgcaccatattgactactacaagaagacctcaaacggccggctgcccgttaagtggatggccccggaggccctttttgaccgggtgtatacccaccaaagcgatgtgtggtccttcgggattttgctctgggaaatcttcactctgggtggttccccgtaccctgggattcccgtcgaggaactcttcagtcttttgagggaggggcacagaatggatagaccgcctcactgtccacccgaactctacgggctgatgagagaatgctggcatgctgctcctagccagcgacctacctttaaacagcttgtggaggccctggacaaggtactgctcgctgtttccgaagagtatctggatttgaggttgacatttgggccatactccccaagtggcggagacgcctcctccacatgctcatcctctgacagtgtctttagccacgatcccctaccgttgggttccagttcatttcctttcggctctggcgtacagacttag

SEQ ID NO: 24197 - DNA, 2409 bp, Artificial Sequence
  Description of Artificial Sequence: Synthetic coding sequence
atgcggctgctgctggccctgctgggcgtgctgctgagcgtgcccggccctcctgtgctcagtctcgaggctagcgaggaggtagagctggagccttgtttggcaccttctctggagcagcaggagcaagagcttaccgtggccttgggccagcctgtgagactgtgctgtggaagggcagaacgtggcggccactggtataaggaaggctcacggctcgcaccagctggaagagtgcgcgggtggcgagggcggttagagatcgcatcattcctgcccgaggatgcgggtagatacctttgcctggccagaggctccatgattgttctgcagaatcttactctgataactggcgactcgttgaccagtagcaatgacgacgaagatccgaagtctcatcgggatccttccaataggcactcctatccccaacaagccccctactggacgcacccacaacggatggagaaaaagctacatgcagtccctgccgggaacactgttaaattccgatgtcccgccgctggtaatccaacacccaccatcagatggttgaaggatggccaggccttccacggcgagaacagaattgggggcatccgcctgcggcaccaacattggtcccttgtaatggagtcagtcgtaccaagcgatcgtgggacatatacatgccttgtggagaacgcggttggtagcatacgctataactacctgttagacgtattggagcggagcccccaccgtccaatcctacaggcgggtctgccggctaataccactgcagtggtcggtagcgacgttgagctgctttgcaaggtctattcagatgcacagccgcacatccaatggctcaagcacatcgttattaatggaagctcgtttggtgccgacggctttccttatgtccaagttttaaagaccgcagacattaacagttcagaagttgaagtcctctaccttagaaatgtcagcgccgaggacgccggcgaatacacatgcttggccggaaattcaatcggacttagctatcagagtgcatggctgaccgtgctgcctgaggaggatcccacatggacagccgccgcccctgaagcacgatatacagatatcattctttacgccagcggttctcttgctctcgccgtactactgctgttggccggtctgtatcgcggccaggctttgcacggacgacatccccgaccgcctgctacagtgcagaaactgtctcgattccctttagcccgacagtttagcctggagtccgggtctagcgggaagagttcaagctccctggtgagaggtgtgcggctctcatcctccggccccgcgcttctggcaggtctggtgtcgctggatctgccgctcgaccctctttgggagtttccacgagacaggctcgtgcttgggaagccgctgggcgaaggctgctttggtcaggtggtgagagcagaggcgttcggcatggatccagcgcgccccgaccaggcctctacggtggcagttaagatgttaaaggataacgcatctgacaaggacttagctgatctcgtaagcgaaatggaagtgatgaagcttatcgggcgtcataaaaatataatcaatctcttgggagtatgtactcaagaagggccattgtacgtgatcgtggagtgtgcagctaagggcaacctcagagagtttctccgcgcaaggcgccctcccgggccggatctctctccagatggaccccggtcatccgaaggaccactgtcctttcccgtacttgtgagttgtgcctatcaggtggcaaggggtatgcagtacctcgaatcccggaagtgtattcatcgggatctcgcagctcgcaatgtgctcgtaacagaagacaatgtaatgaagatcgccgatttcggcctggcacggggcgtccaccacattgattactataaaaagacgtcaaacggcaggctgccagtgaagtggatggctcccgaggcactgtttgaccgcgtgtatacacaccagtcagatgtatggagttttggtattttgttgtgggagattttcaccctggggggatccccctaccccggcattccagtggaggagctgttttctctgctgagagaaggacatcgcatggataggccaccacactgcccccctgagctttatggcctcatgagggaatgctggcacgctgcccccagccagcggcccactttcaaacaactggtcgaagcgctagataaggtgctccttgcagtgagtgaagaatacctggacctcagactgacatttggaccttatagtccgagtggtggtgacgcctcttcaacttgttccagcagtgattcagtgtttagccacgaccccttgccgctcggatccagctcattcccgttcggcagtggcgtgcagacatag

SEQ ID NO: 24198 - DNA, 606 bp, Artificial Sequence
  Description of Artificial Sequence: Synthetic coding sequence
atgcggctgctgctggccctgctgggcgtgctgctgagcgtgcccggcccacctgtcttgtctcttgaagcctctgaggaggtcgagcttgagccatgccttgcaccttcattagagcagcaggagcaggaactcactgtcgccctcgggcagcccgtgcgactgtgctgtgggcgggccgagagaggtggccattggtacaaggaagggtcgcgtctggcaccagctggccgggtgcgcgggtggaggggtcgtctggagatcgcctcttttctgcctgaggatgctggtaggtatctgtgcctggctaggggatcaatgatagtgctgcagaacttgactctgattaccggcgatagtctaacttccagcaatgacgatgaggatcccaagtcccatcgggaccctagcaatcgtcattcttacccccagcaggcgccatactggacccatcctcagcgcatggaaaagaagttgcacgcagtaccagccggaaatacagtaaagtttaggtgtccagcggccggcaacccgacacctactattcgctggctcaaggatggccaggcatttcacggggaaaataggattggggggataagatag

SEQ ID NO: 24199 - DNA, 264 bp, Artificial Sequence
  Description of Artificial Sequence: Synthetic coding sequence
atgcggctgctgctggccctgctgggcgtgctgctgagcgtgcccgggcctccagtgctgtcgctggaggctagtgaggaagtcgagctggagccctgcctcgccccctcactggagcagcaggagcaggagctgactgtggccttgggtcagccggtaagattatgttgcggacgggctgagagaggtggtcactggtacaaggaagggagtaggttggcgccggccggcagggtgcgaggatggcgaggccgtttggagtag

SEQ ID NO: 24200 - DNA, 327 bp, Artificial Sequence
  Description of Artificial Sequence: Synthetic coding sequence
atgcggctgctgctggccctgctgggcgtgctgctgagcgtgcccggacccccagtgctgtctctggaggcctcagaggaggttgaattagaaccatgcctggccccctccctcgaacagcaagagcaggaactcacagtcgcactgggacagcccgtgcggctgtgttgtggaagggcggaacgtggcggtcattggtataaagagggatcacgtcttgcaccagctgggcgcgtgcggggatggcgtgggagactcgagattgcaagctttctcccagaggatgcgggaagatatctctgccttgcaaggggtagtatgatttag

SEQ ID NO: 24201 - DNA, 345 bp, Artificial Sequence
  Description of Artificial Sequence: Synthetic coding sequence
atgcggctgctgctggccctgctgggcgtgctgctgagcgtgcccggtccgccagtactatctctagaggcctctgaggaggtcgaactggaaccgtgtttagccccttccttggagcagcaggagcaggagctgacagtagctctcgggcagccagtccgcctgtgctgcggaagggcggagcgaggcggccactggtacaaagagggaagtagattggctcctgccggtagagtgagagggtggagagggagacttgagatcgcaagcttcctgcccgaggatgccggacgctatctgtgcctggcccggggctctatgatcgtgctacaaaatttgacctag

SEQ ID NO: 24202 - DNA, 7164 bp, Artificial Sequence
  Description of Artificial Sequence: Synthetic coding sequence
atgctgcggggccccggccccggcctgctgctgctggccgtgcagtgcctggggacggctgttcccagtactggcgcatccaaaagtaaacgccaggcacagcagatggtccagccccagtctcccgtggcagtcagtcaaagtaagcccggttgctatgacaatggaaagcattatcagatcaatcagcagtgggaacgaacatatctcggcaacgccctggtctgtacctgttatggtggctctcgtggatttaactgtgagtcaaagccggaagcagaagaaacgtgctttgacaaatatacaggaaacacatacagagtgggagacacatacgagagacctaaggatagcatgatatgggactgtacatgcatcggagcgggccgcggccgcatttcttgtaccattgctaacagatgtcacgaaggaggacagtcttacaagatcggagacacctggcgcagaccccatgaaactggcggttacatgctggaatgtgtgtgtctggggaacggcaagggagaatggacatgtaagccaatcgctgaaaagtgtttcgaccacgccgccggaacctcctatgttgtcggcgagacatgggaaaagccctaccaggggtggatgatggtggactgcacctgcttgggagagggtagcggacgaatcacttgcacaagcagaaatcgctgtaacgaccaggacacccggacctcgtatcgcatcggagacacctggtctaagaaggacaatcggggaaacctcctgcaatgcatttgtaccggcaacggacggggcgaatggaagtgtgagcgccatacaagtgtgcagactacaagctccggatccggtcctttcaccgatgtgagggcagctgtctatcagccccagcctcaccctcagcctccaccctacgggcattgtgttaccgattctggcgtcgtatatagtgtagggatgcaatggctcaagacacagggaaacaaacagatgctctgtacctgcttgggaaacggggtcagctgccaggagactgccgtgactcagacctacggcggcaattccaacggtgaaccttgtgtgctgcccttcacctacaacggacggaccttttactcctgcacaacagaggggagacaggacggccacctctggtgtagcaccacatccaactatgagcaggatcagaagtacagcttctgtacagaccacacagtcctcgtgcaaacacgaggtggcaacagtaacggagcactgtgtcactttcccttcctgtataacaaccataattacacagattgcaccagcgaagggcgccgggataatatgaagtggtgcggaacaacgcagaactacgacgctgaccaaaagtttgggttctgtccgatggccgctcatgaagagatttgtaccacaaacgaaggtgtgatgtatcgcatcggtgatcaatgggataagcagcatgatatgggccatatgatgaggtgcacatgcgtcggtaatggaagaggggaatggacatgcatcgcatatagtcagctgagagaccagtgcatcgtcgacgacattacctataatgtgaacgacacgtttcataaacgacatgaggagggtcatatgcttaactgtacttgcttcggccaagggagaggccgttggaagtgcgatcccgtggaccaatgccaggactccgagactggcacattttaccagattggggactcatgggagaagtacgtgcacggcgtaaggtatcaatgttattgttatggccgaggcattggcgagtggcactgccagcccctgcagacttacccctcctctagcggtccggtcgaggtgtttatcactgaaacgccctcccagcctaactcacatcccatccagtggaatgccccacagccatctcatattagtaaatacattttaagatggagaccaaaaaacagcgtgggaaggtggaaagaagccacgattccaggtcacttgaattcttacaccattaaaggactcaaacctggggtagtctatgagggccagctgatcagcatccagcagtacggccaccaggaggtgaccaggtttgatttcaccacaacctctacttctactcccgttaccagcaacaccgtcaccggagaaaccactccatttagcccacttgttgccacctcggagagcgtcaccgagattaccgcttctagtttcgtggtaagctgggtgtccgctagtgatacagtgagtggctttcgtgtcgaatatgagctctccgaggagggggatgagccccagtacctggacctaccaagcaccgcgacaagtgtcaatattcccgatcttctgccaggacggaaatatattgtcaacgtgtatcaaatttcggaagacggcgagcagagcctgattctgtccacttcccagacgacggcccccgatgcccctccagacacgacggtggatcaggtcgacgacacaagtatcgttgtcaggtggtccagacctcaagcccctataacggggtacaggattgtctactcaccctccgtggagggctctagcaccgagctgaacctgcccgagacagcaaactctgtgacactaagcgatcttcagccaggggtccaatacaacataacaatctatgcggtagaggaaaatcaggaatccactcccgtggtcattcaacaggagacaacgggaaccccaaggagcgacactgtgccttccccgcgggatttacagtttgtcgaagttaccgacgtgaaagtcactataatgtggacaccccccgagagcgccgttaccgggtatcgggtagacgtgattcctgtcaacctgccaggggaacatggtcagcgcttaccaatttcccgcaatacatttgctgaggtgactggcttgtcgcctggagtcacctactattttaaagtcttcgctgtttcgcacggtagggagagtaaacctctcacagcccagcagaccactaaactggacgctcccactaacttgcaattcgtcaacgagacggactcaaccgtgttagttaggtggacccctccccgcgctcaaatcacaggctaccgactgactgtggggcttactagacgcggccagccccggcagtacaacgtcggtccatctgtcagcaagtatccgctgagaaacctgcagccagccagtgagtacaccgtcagtttagtggccatcaaaggaaatcaggaatcccccaaggctacaggggtgtttactaccttacagccgggcagttcaatcccaccctacaacaccgaggttaccgagaccacaattgtcatcacatggactcctgcacctcgaatcgggtttaaacttggagtacggcccagccaggggggtgaggcaccacgcgaggtaacaagcgattcgggttcaatcgtggtctctggactgacccctggcgttgagtacgtgtataccattcaggtgctccgtgacggccaagaacgggatgctccaatcgtgaataaagtagtcaccccactgagcccacctacaaacctgcacctggaggctaatccagacacgggggtattgaccgtgtcctgggaacgttccactaccccagatatcacaggctaccgcattacgactacaccaaccaacggccagcagggcaatagtctggaagaggtggtccatgcagaccaatcatcatgtacgttcgacaatctgtcaccaggtttggagtacaacgtctcggtttacacagtcaaggacgacaaggagtcagtaccaatttctgatactattattcccgaggtgccccaactaacggacctgtcgttcgtggatataaccgactccagcattggattacgctggactccacttaactctagcacaattattggatatagaatcaccgttgtggcggcaggtgaaggcattccaatctttgaggatttcgtggattcttcagtcggatactacactgtgacgggcctagagcctggcatcgattacgacatttccgtgatcacactcataaatggcggcgaatccgctcccacaaccttaactcaacaaacagccgtgcctccccccacggacctcaggttcttcagtgacatcactgcaaactccttcaccgtgcactggattgccccccgggcaacgatcacaggttaccgcattcgacatcaccctgaacacttttctgggcgtccccgggaggatcgcgtgccacattcgcggaattcgatcaccctgacaaatctgacacctggaactgaatacgtggtttccattgtggcactgaacgggcgggaagaaagtccgctcctgatcggccagcaatccaccgtcagtgatgtgccaagggatctggaagtggttgccgctacacccactagcttgctcatctcctgggatgcgcccgcagtgaccgtgcgctactaccgcataacctacggggagaccggagggaacagccctgttcaggaatttaccgttcccggcagcaagtccacagctactatctccggcctgaagcccggcgtcgactacaccattactgtctacgctgtgacaggtagaggagactcaccggctagctccaaaccaatatccatcaattacaggacagaaatagataaacctagccagatgcaggtgaccgatgtacaggacaatagcattagcgtgaagtggctccctagcagctcccccgtcacggggtatcgtgtcacaactacgccaaaaaatggacccggtccgaccaaaaccaagactgccgggcctgaccagaccgagatgacaatagagggcttgcagccgacagtggaatacgtggtgtcagtgtatgcccagaacccctccggggagagccagcccttagtgcagaccgccgttacaaacatagaccgacctaaaggtctggcgtttacggatgttgatgtggactccattaagattgcatgggagagtcctcagggtcaggtttctcgttatagggtcacgtactcctctcccgaggacgggatccacgagctctttcctgccccagacggcgaggaggacactgcagaattgcagggtttgaggcctggttccgaatacaccgtgagcgtggttgcattacacgatgacatggagtctcagcctctgatcgggacacagagtactgcaattcctgcccctacagacctgaagtttacccaggtgacccccacctctctgtctgcacaatggacgcctccgaacgtccaattgactggctacagggtgcgggtgactccaaaggagaagacgggaccaatgaaggaaatcaatcttgctcccgattcctccagtgtggttgtttccggacttatggttgccacaaagtacgaagtgagcgtctacgccctgaaagacacacttacatcgaggcccgctcagggagttgtgacgacccttgaaaatgtgtcccctccccggagggcccgcgtcaccgacgcgaccgagaccaccatcacaatcagctggcggacaaaaaccgagaccataaccgggttccaggtggacgccgtaccggctaacggccagacccctatccagcggaccattaaacctgatgtcaggagttatacaatcaccgggctccaacctgggacagattataaaatatatctctataccttgaacgacaacgcccggtcgtcaccagtggttattgatgcctccaccgctatagatgccccatccaacctcagattcctggctactactcctaactccctgctggtgtcgtggcagcccccgagagcaaggattaccggttacatcatcaaatacgagaagcccggaagcccccctagagaagtggtccccaggcccagacccggcgtgactgaagccaccattaccggtttggaacctggaactgagtataccatctatgtcattgccctcaaaaacaaccagaagtctgagcctctcatcggaagaaagaaaacagatgagcttccccagctcgttaccctgccccaccctaatctgcacggtccagaaatcctggacgtgccatctactgtgcagaagacccctttcgttacccacccgggctatgatactgggaatgggatccagctgccaggtacctctggtcagcaacctagtgtaggccagcagatgatcttcgaagaacacggcttcagaagaactacaccccccacaaccgccacccctattcgtcacagacccaggccttatcccccaaatgtcggagaggagatccagattggtcacatccctcgagaggacgtggattaccacctatacccgcatgggccaggtctgaatcctaatgcttctactggacaggaagccttgagccagacaactattagctgggcaccattccaggacacctccgagtacataattagctgccacccagtcgggaccgacgaagaacctctgcagtttcgagtacctggaacctctacaagtgccacactgaccggcctgactcgcggcgcgacctataatgttatagtggaggctctcaaggaccagcaacgacataaggtgcgggaagaagttgtgactgttggtaactccgtcaacgaggggctgaaccaacccacagacgactcctgctttgacccctacacggtgtcccactatgcggtaggggatgagtgggagagaatgtctgaaagtggctttaagctgctctgtcagtgccttggctttggctctgggcactttcgctgcgacagctcccgatggtgccatgacaacggtgtgaattacaagatcggtgaaaagtgggaccgccaaggggaaaacggacaaatgatgagctgtacgtgtctggggaacggcaagggagagttcaaatgcgatcctcacgaggccacatgctacgacgatgggaaaacataccacgtgggagagcaatggcagaaggagtatttgggagccatttgctcctgtacttgcttcggcggacagagggggtggcggtgtgacaactgccggaggcccggcggcgagcctagccctgagggcacaaccggccaatcttacaaccaatattctcagagatatcaccagaggaccaacacaaacgtgaactgtcccatcgagtgttttatgccactggatgttcaggcagatagagaagattctcgagaatag

SEQ ID NO: 24203 - DNA, 7341 bp, Artificial Sequence
  Description of Artificial Sequence: Synthetic coding sequence
atgctgcggggccccggccccggcctgctgctgctggccgtgcagtgcctcggcactgcagtgccaagcactggagcttcaaagagcaagaggcaagcacagcagatggtccagccccagtccccagtggctgtgagccaaagcaagcccggctgttacgacaatggtaaacactatcaaattaatcagcagtgggagaggacatatttaggcaacgccctcgtatgtacctgttatggcggaagccgaggcttcaattgtgagtctaagccggaggccgaagagacttgttttgacaagtatacgggtaacacttatagagtgggagatacctacgagcgccccaaagactcaatgatttgggattgtacctgcatcggcgctggacgaggacggattagttgcaccatcgccaataggtgtcacgagggcggccagtcttataagattggcgatacttggagaagaccccacgagaccggtggctatatgttggaatgcgtctgcctgggtaatggtaagggcgagtggacctgcaagcccattgcagagaaatgctttgatcatgccgccgggacctcatacgtcgtgggggagacatgggaaaagccgtatcaaggttggatgatggtcgactgcacttgcttgggtgagggtagcggccgaatcacttgtacatcacggaaccgttgcaacgaccaggacaccagaacctcttaccgcatcggcgacacttggtctaaaaaagataatcggggaaaccttctgcagtgcatatgtacgggaaacgggcggggagagtggaaatgtgaacggcacaccagcgtccagactacatcaagtggatccggcccctttacagatgtgcgagccgctgtttaccagcctcaaccccacccacagcctccaccatacggccactgtgtaacagactctggcgtcgtttactcggtcggaatgcagtggttgaaaacccagggtaataaacagatgctgtgtacttgtttaggcaacggagtgtcttgtcaagagaccgccgttacccagacatatggcggcaacagcaatggcgagccatgcgtcctgccctttacatataatggtaggacattttactcctgcaccactgaagggagacaggatggccacctgtggtgctcaactaccagcaattacgaacaggatcagaagtacagcttttgtacggaccacacagtgctggtgcagactcggggaggtaattcaaacggtgctctttgccactttccgtttctctataacaaccataactataccgattgtactagcgaaggtcgtcgggataacatgaaatggtgcggcacaactcagaactacgacgctgatcagaaatttgggttttgcccaatggcagcacacgaggagatctgtaccacgaacgagggcgttatgtacaggattggcgaccagtgggacaagcagcatgatatgggccatatgatgcgctgcacatgcgtaggcaatggacgtggcgaatggacttgcatcgcctacagtcaactgagagatcagtgtattgtggacgatattacttataatgtgaatgacacctttcacaagcggcacgaagagggccacatgctgaactgcacctgtttcggtcagggccgcggaaggtggaagtgtgatccagtcgaccaatgccaggattcagagactgggaccttttatcagatcggggatagctgggagaaatatgtgcacggtgtgaggtaccagtgttattgttacggaagaggtataggcgaatggcattgccaacctctgcaaacatacccttcatcctccggccccgttgaggtttttataaccgagaccccatcacagcccaactcccaccctattcagtggaacgcgcctcagcctagccatatctcgaagtacattttaagatggagacccaagaacagtgtaggacgatggaaggaggctactattccagggcatttgaactcctataccatcaaaggactcaagccaggggtggtctacgagggacaactcatttctattcaacagtatggccatcaagaagtgacccgattcgattttactacaactagtacctccacgcctgtgacctccaacaccgttacaggcgagacgacaccgttttcccctttggtggccacaagcgagagcgtgacggaaatcaccgccagttcgttcgtagtgagttgggtttcagctagcgacacagtttccggtttccgggtggagtacgagttgagtgaagagggcgatgagccccagtatctagacttgccttccactgcaaccagcgtgaatattccagacctgttgcccgggagaaagtatatcgttaacgtttatcagatttccgaagacggtgagcagtcgcttattctgagcacctcacagactactgcgcccgacgctccaccggataccacggtggaccaggttgacgacacatctatcgtcgtacgttggagtaggcctcaggccccgatcacgggctacaggatcgtgtatagcccatccgtggagggctctagcaccgagttgaacctgcccgagactgctaatagcgtcactcttagcgatctgcaaccgggagttcaatacaacatcaccatttacgcagttgaagagaatcaagagtcaaccccagtcgtgattcagcaggagacaactggaaccccaaggtcagacaccgtgccttctccaagagatttgcagttcgttgaggttaccgacgtgaaggtgaccatcatgtggacaccaccggaatccgcggtaactgggtatcgcgtggatgttatcccggtgaatttaccaggagaacacggtcaacggctccctatctctagaaatacgttcgctgaagtgaccggactgtcaccaggcgtaacatactatttcaaagtgtttgctgtgtcgcatggccgtgagtccaagccccttaccgcacagcagacaaccaagctggatgcccccactaacctgcaatttgtcaatgagactgactccactgtgttggtacgatggactccaccaagagcccagataactggctaccgccttacggtgggcctgacccggcggggacagcctagacagtacaatgtggggccttcggtgtcaaagtatccactaaggaacctgcagcctgcttcagaatataccgtgtcactggtggcaattaaaggtaatcaggagagcccaaaagcgacgggagtgttcacaactctgcagcccggaagctccattcctccttataacacagaggtaaccgagactacgatcgtgataacttggacacccgctccaaggataggcttcaagctgggcgtgaggccaagccagggaggagaagccccccgcgaagtgacatctgacagcgggagcattgttgtcagcggccttaccccaggggtggaatacgtgtacaccatccaggtgctcagggatgggcaggaacgagacgcccccatcgtcaacaaagtggtcacacccctgagtccccctaccaacctccacctggaagcgaaccccgacaccggagtactgacggttagctgggagcgtagtaccaccccagacattaccggatacaggataactactacccccacgaatggacaacagggtaacagtctggaagaggtagtgcatgctgatcaaagctcttgcaccttcgacaatttgtctccaggcctggagtacaatgtgtccgtatatactgtgaaggacgataaggaaagcgttcctattagcgatacaattattccggaggtccctcagctcacagacctgagtttcgtggacattaccgactccagcattggattaagatggactcctttgaatagcagtaccatcattggctaccgtattaccgtggtcgccgccggcgaaggaattcccatcttcgaagattttgttgacagctccgtgggctactacacagtaacaggtctggagcctgggatcgattacgacatctctgtcataactctgatcaacgggggcgaaagtgccccgaccacattaacacaacagacagcggtcccacctcccaccgatctccggttcacaaatattggtccagatacgatgagagtgacatgggctccacctccctcaatcgacttgaccaatttccttgtgagatacagtccggtcaaaaatgaagaggatgtcgcggagcttagtatttctccatctgataatgccgttgtcctcaccaaccttcttcctggtaccgaatatgtggttagcgtctcgtctgtttacgaacagcacgagagtacaccgttacgggggcgacaaaaaaccggacttgattcccccacagggattgatttcagtgacatcacagcaaatagtttcacagtgcattggattgctcctcgggccactatcactggctatcggattcgccatcacccggagcatttctccggcaggccgcgcgaagacagggtgccccactcccgcaatagtatcaccttaactaacttgactcccgggacggagtatgtcgtgagtattgtggcactgaacggccgagaggaatcccctctgctgattggtcagcagtccaccgtgtctgacgtgcccagagacctggaggtagttgccgccactccaaccagcctgctgattagctgggacgctcctgctgtgacagtgcgatactacaggataacctacggtgaaaccgggggcaacagtccggtccaagaattcaccgtcccaggatcaaagtcaacagctacaatctccggattgaaacccggagtggactatacgattaccgtgtatgctgtgactgggcgtggggacagcccggctagttcaaaaccaattagtattaactaccgaacagaaattgataaaccatcccagatgcaggtgacggacgtccaggataattctattagcgtcaagtggctgccatcctcaagtcctgtgactggatatcgcgtaactacaacaccaaaaaacggtcctgggcccacaaagacaaagacagccggtcctgaccaaaccgaaatgacaatcgagggactacagccgacggtggagtacgtagtttccgtatacgcgcaaaatccatccggtgagtcccagcctctggtccaaaccgcagtcactaatattgatcgccccaaaggtcttgctttcacagacgtagacgtggactcaatcaagatcgcatgggaatcccctcaggggcaggtgagcagatatagggtgacctacagctcacccgaagacggcatccatgagctgtttcccgctcccgacggagaggaggatactgccgaacttcagggcttgaggcccggatcagagtatacagtttccgtggtggcactccatgacgacatggaatctcagccactgatcggcactcagtcaacagctatccccgcaccaaccgacctgaagttcacacaggtgactcctacgagcctttcagcacaatggacccccccaaacgttcaattaacgggctatagggtccgcgtgacacccaaggagaaaacaggccctatgaaggagatcaacctggcaccagacagttcaagcgttgtcgtctctggactaatggttgctactaagtacgaagtgagcgtgtatgccctgaaagacacactcacatcccgacctgcacagggagtagtaactactctcgaaaacgtcagccccccacggagagcacgcgttacagatgccaccgaaactacaataactatttcttggcggactaaaactgagacaattaccgggtttcaagttgatgctgtgcccgccaacggccagactcctatacaaagaacaattaaaccagatgtccgcagctatactattacagggctgcagccgggaactgattacaaaatatacttgtacacactgaatgacaacgctaggtcttcccccgtagttatcgacgctagtaccgccatcgacgctccatctaatctccggttcctcgctaccacccctaattcattgctcgtaagctggcagcctcccagggcaaggattaccggatacattatcaaatacgagaagccaggatcaccgcctcgcgaagtcgtgccgaggcccaggccaggcgttacagaagcaacaattaccggcttagagccgggtacagaatatactatctacgttattgctctgaaaaataatcagaagtccgagccactgattggacgcaagaagaccgatgagttgcctcaactggtgaccttacctcatccaaatttgcatggcccggagatcctggacgtcccctccactgtacagaaaaccccattcgtaacccaccccggctacgacactggtaacgggatccagttgccgggcacctcagggcaacagcctagtgtaggacagcaaatgatctttgaagagcatggatttcggcgcaccacccctcctaccacagccacccccataaggcatcgaccaagaccctacccacctaatgtgggacaggaagcacttagccagacaaccatctcatgggcacccttccaggacacttccgaatatatcattagctgccatcctgtcggcaccgacgaggaacccttacagtttcgagtacccggcaccagcacctctgccactctaacgggcttgacaaggggagctacttacaatgtcattgtcgaggccctgaaggaccaacagcggcacaaggtgagggaggaggtggtgactgtgggaaatagtgtcaatgagggtcttaatcagccaacagatgacagctgctttgatccatatacagtttcacattacgccgtgggtgacgagtgggagaggatgtcagagtctggatttaagctactgtgtcaatgcctgggcttcggtagtggccattttcgctgcgattcatcccgatggtgtcatgataacggggtgaactataaaattggcgaaaagtgggatcgccagggagaaaacggacagatgatgtcctgtacttgtctcgggaacggaaagggcgaatttaaatgtgaccctcacgaggctacatgctatgatgacggcaaaacataccatgtcggtgagcagtggcagaaagaataccttggggccatctgcagttgcacctgtttcggagggcagcgcggatggaggtgcgataattgccgtcgaccaggcggagaaccctcccctgaaggaactacgggccagtcttataaccagtacagtcaacgttaccaccagaggacgaacaccaatgtaaactgccctattgaatgctttatgccactggatgtgcaggcagatcgagaggatagcagggaatag

SEQ ID NO: 24204 - DNA, 7068 bp, Artificial Sequence
  Description of Artificial Sequence: Synthetic coding sequence
atgctgcggggccccggccccggcctgctgctgctggccgtgcagtgcttgggcactgccgtgcctagtacaggcgcgtccaaatcaaagcggcaggcccagcaaatggttcagcctcagagcccagtggccgtttcccagtcgaagcctgggtgctacgacaacggaaagcattatcagattaatcagcaatgggaaaggacatacttggggaacgctctcgtgtgcacatgttatggaggttcgagggggtttaactgtgaatccaaaccagaggccgaggagacctgctttgataagtacacaggaaatacctacagggtcggagatacatacgagagaccaaaggactcgatgatctgggactgcacttgcattggagcagggaggggtaggatatcttgtactatcgcgaaccgatgccatgagggaggacagtcgtacaaaattggcgacacctggcgcaggccacacgaaactggcggctatatgctagaatgcgtctgtctcggtaatgggaaaggcgagtggacctgcaaaccaattgctgagaagtgttttgaccatgctgctgggactagttacgtggtaggagagacatgggaaaagccataccaggggtggatgatggtggattgtacttgcttgggtgaagggtcaggtcgcataacctgcacatctcgaaatcgctgcaatgaccaagatacaaggacgagctatcggattggggacacatggagcaagaaggacaaccgcggcaatcttcttcagtgcatctgtacaggaaatgggcgcggcgagtggaaatgtgagagacatacaagcgtccagacaacatcctcaggctctggcccctttaccgatgtacgggccgccgtctatcaaccccagccccacccgcagccaccaccttacgggcactgcgtcacggattccggcgtggtctatagcgttgggatgcagtggctgaagacacagggaaacaaacaaatgctctgtacatgcctaggaaacggtgtatcatgccaggaaactgcagtgacccagacgtatgggggaaattctaatggtgaaccgtgcgtgctgccttttacctataatggaaggacattctacagctgcacaacagaaggccgacaggacgggcacctttggtgcagtactaccagtaattatgaacaggatcagaagtacagcttctgcactgatcacacagtactggtgcagacacgtggggggaactcgaacggagctctatgtcactttcccttcctgtacaacaaccataactatacagactgtacatctgaaggcaggcgggacaacatgaagtggtgtggcacgacccaaaactacgacgccgaccaaaaattcggcttttgtcctatggccgcccacgaagagatttgcaccactaacgaaggtgtaatgtaccgcatcggcgatcagtgggataagcaacacgacatgggccatatgatgagatgtacgtgtgtgggaaatgggcgcggcgagtggacctgcattgcctactcccagctgcgggaccaatgcattgtggacgacatcacttacaacgtgaacgatacttttcacaagagacacgaggaaggtcacatgctgaattgtacctgctttgggcaggggagaggtcggtggaaatgtgatccagttgaccagtgtcaggacagcgaaacgggaacattttaccagattggggactcatgggagaagtacgttcacggtgtgaggtaccaatgttattgctacgggcgcggcattggcgagtggcactgccagccattgcaaacctacccaagctctagcgggcccgtggaagtgttcatcactgaaaccccttcccagcccaactcacatcctatacagtggaatgccccccagccctcccacattagtaagtatatcttgagatggcgccctaaaaacagtgtgggcagatggaaggaagcgaccattcctgggcacctcaactcctatactataaaggggctcaaacctggcgtagtgtacgaggggcagctcattagcatccagcagtatggccaccaagaagtgaccaggttcgattttactacaacctccacttccacaccagtgaccagcaataccgttacaggagagacaacgcccttttcacctttagttgctaccagtgagtccgtcaccgagattacagccagctctttcgtcgtgtcctgggtgagcgctagcgacaccgtaagcggtttccgcgtggaatacgaactgtctgaggaaggagatgaacctcagtatctggatctaccatcaactgctacttccgtcaacattccagatttactgcccggcaggaaatatatcgtcaacgtttaccaaatctctgaggatggggagcaaagcttgatattaagtacaagccagaccactgctccagatgctcccccagataccacagtcgatcaggttgacgatacaagcatagtagtgcggtggagtcgcccccaggccccgataaccggctaccgcattgtctattctccatctgtggagggttcatcgaccgagctgaatttacctgaaacagcaaatagtgtgacactgtctgatttacagccaggggtgcaatacaacattacaatttatgctgtcgaggaaaaccaggagtctaccccagttgtgattcagcaggagaccaccggaacccccagatccgatacagtgccatctccccgggatctgcagtttgttgaagtgacagatgtgaaggtgaccattatgtggacaccgcctgagtctgcagtgacgggctatcgggtggacgtgatacctgtcaacttgccaggtgagcatgggcaaaggctgcccatctcccgtaataccttcgctgaggtgacaggattaagcccgggagtcacttactacttcaaggtcttcgctgtctcccacggccgagagtctaaaccgctgactgcccagcagactaccaagcttgatgcccctaccaatctacaattcgtgaatgagactgatagtactgtgctcgttcggtggacaccccctcgggcgcagattacaggttatagactcacagtcggtttgactcggagaggtcagccacgccagtacaacgtggggccttccgttagcaaataccctctgagaaaccttcaaccggcctctgagtacactgtgagccttgtggcaataaagggcaatcaagaatcccctaaggcaactggtgtgttcacaactctgcagcctggatcttctattcctccatataacacagaggtgaccgaaacaacgatcgtgattacgtggacaccggctccgagaattggattcaagctgggcgttaggccgagtcagggcggtgaggccccccgcgaagtgacctccgacagtggttctatcgtagtgtccggcctcactccgggcgtggagtatgtatataccattcaggtactcagagacggccaggaacgggatgcgccaatcgtcaataaggtggtcactccactgtcaccacccacaaatctgcacctggaagcaaatccagacactggagtgctgaccgtcagttgggaaaggtcaaccacgcctgatatcacaggctatagaataaccaccacccctacaaatggccagcaaggaaactcacttgaagaggtagttcacgcggaccagagctcttgcacttttgacaatctgagtcctggcctggagtataacgtgtccgtgtatactgtgaaagatgataaggaaagcgtcccaatctccgacacaatcatccccgccgtaccccccccaactgatctgagattcaccaatattgggcctgacactatgcgcgtgacttgggcccctccaccctctattgacctcaccaattttcttgttcggtactcccccgtgaaaaatgaagaggatgtcgcagaattgtcgatctccccatcggacaacgcagttgtccttactaatttgctgcctggaactgagtatgtggtgtccgtgtccagcgtgtatgagcaacatgagtccactccactgagaggccggcagaaaaccggcctcgacagccccaccggcatcgactttagcgacattaccgcaaactcgtttaccgtgcactggatcgcacccagagcaacgatcactggctatcgtatccggcaccaccccgaacacttttctgggcgacctagggaggaccgggtgccccactctcgaaatagcattacccttaccaacctgacccctggcactgagtatgtggtctctattgtcgcactgaacggacgcgaagagtccccacttttgatcggacagcaaagtaccgtgtccgatgtgccgagggacctagaggtagtggctgctactcctacaagtctcctgatcagttgggacgcccctgcggtgaccgtccggtactacaggatcacttatggagagaccggaggcaactcccctgtgcaggagttcactgttcccggcagtaaatcaaccgcaacaatctccggcctcaaaccgggtgtcgattatacgattacagtatacgcagttacgggccggggggactcccccgcatcatccaaaccgatctcgattaactacaggaccgagatagataaaccttctcagatgcaggttacagacgtccaggataattctatcagtgttaaatggcttcctagctctagtcccgtcaccggctatagggtaaccaccactcccaagaacggcccaggcccaaccaaaactaaaacagcggggccggaccagaccgaaatgactattgagggccttcagccaaccgtggaatacgtcgtctcagtgtacgcccaaaacccttctggcgagtcccagccgctggttcaaacagctgtgacaaacatcgataggcctaaaggccttgcttttacggatgtggatgtggattcaatcaaaattgcctgggagtctcctcagggccaagttagccgatatcgggtgacgtattcgtctcctgaagatgggattcacgagctatttcctgccccagatggcgaagaggacacggctgaactccagggcctgcggcccgggtcagagtataccgtctcggtggtggccctgcacgacgacatggaaagccagcccctaattggcacgcagtcaaccgctattcctgcgcccacagatctgaagtttacccaggtgacacctacctctttgtccgcacaatggacgccgcctaacgtccaactcactgggtacagagtcagagtgacacccaaagaaaagactggcccaatgaaggagatcaacctcgccccagattccagttcagtggttgtgagtggcctaatggtggccacaaaatacgaggtgtctgtgtatgcactaaaagatacacttaccagccgccctgcgcaaggtgtggtgactacactcgaaaatgtttctcccccaaggcgcgccagagtcaccgacgcaacggaaacaactatcactatctcctggcggacgaaaaccgaaacaatcacagggttccaagttgacgccgtacccgcaaatggtcaaacccccatacaacggaccatcaaacctgacgtgaggtcctatactattaccggtctccaaccaggcacagactataagatctacttatataccctgaatgacaatgcccggagtagcccggtggtcattgacgcttcgacagctatcgatgcaccttcgaatttgagatttcttgctaccacgcctaatagtctgcttgtcagttggcagcctcctagagcccgcattaccgggtatatcatcaaatacgagaaacctggatcacctccccgggaggtagtcccccggccaaggcccggggttactgaggcaaccatcactggcctagaacccgggactgagtatacgatctacgtaatagccctgaagaataatcagaagtctgaacccctgatcggaaggaagaaaaccgatgagttaccacaactcgttactctgcctcaccccaatttacacgggccggagatacttgacgtcccgagcaccgtgcaaaaaactccatttgtcacccacccaggttacgacacgggcaacggaatccaattgcccgggaccagcggacagcaaccttcggtaggacaacagatgatttttgaggagcatgggttcagacgcaccactccacccacaactgctacaccaattcgacacagaccaagaccctatcctcccaatgtcggccaggaagctcttagccaaaccactatttcctgggctcccttccaggatactagcgaatacatcataagttgtcacccagttggcacagatgaagaaccgctccagttcagagtccctggcacttcaacaagtgcgaccctgacaggcctcacccgcggagccacatataatgtcatcgtggaggctctgaaggaccaacaacgccacaaagtcagagaggaggtggtgactgtaggtaatagcgtgaacgagggtttgaatcagccaaccgatgactcttgtttcgatccatatacggtatcccattatgctgtgggagacgaatgggaacggatgtctgagtccgggttcaaattgctttgccagtgcctaggcttcggctcgggtcacttcagatgcgactcatctagatggtgccatgacaacggggtcaactacaagatcggcgagaaatgggataggcaaggtgagaacgggcaaatgatgtcctgtacttgcttgggtaatggaaagggcgagtttaaatgcgaccctcatgaagccacatgctacgacgacggtaagacctaccacgtcggcgaacagtggcagaaggaatatttaggcgccatttgtagttgcacttgcttcggaggacagcgggggtggcggtgtgacaactgcaggcgcccagggggcgagccctcccctgagggcacaacgggtcaatcttacaaccagtactcgcagcggtaccatcagcgtaccaacacaaacgtcaattgtcccatagagtgctttatgccccttgatgtgcaggctgaccgggaagatagccgggaatag

SEQ ID NO: 24205 - DNA, 6555 bp, Artificial Sequence
  Description of Artificial Sequence: Synthetic coding sequence
atgctgcggggccccggccccggcctgctgctgctggccgtgcagtgcctggggaccgccgttccttctactggagcctcaaaatccaaacggcaagcacagcagatggtgcaaccccagtccccagtggctgtaagtcagagcaaacctggatgttacgacaatggcaagcactaccagataaatcaacagtgggagaggacctacttgggaaatgcacttgtctgcacgtgttacggcggctcacggggtttcaactgtgaatctaagccggaggcggaggaaacttgttttgataaatacactgggaatacctatcgggtcggagacacatatgagcgccctaaagactccatgatttgggattgtacctgtatcggagctggacgaggccggatcagctgcacgattgccaaccggtgtcatgagggcggtcagtcctacaagattggggacacctggcgtcggcctcacgaaaccggaggctatatgcttgaatgcgtgtgtttggggaatggcaaaggagaatggacctgtaaacctattgccgagaaatgtttcgaccacgcggctggaacatcctacgtggtgggtgagacctgggagaagccctaccaaggttggatgatggtggactgtacctgcttgggcgaggggagcggtaggatcacatgtactagccgcaaccgctgcaacgaccaggatacccgaacatcctaccggataggtgatacttggtctaagaaagacaatcgggggaacctcctgcagtgtatctgtaccgggaacgggcgtggtgaatggaagtgtgaaaggcacacctccgttcaaaccacatctagtgggtccgggcctttcaccgacgtccgcgctgccgtataccagcctcagccgcatccccagcccccgccttacggccactgtgtgactgattcaggggtggtgtacagcgttggtatgcagtggctcaagacccagggcaataaacagatgctttgcacatgtttagggaatggagtaagttgccaagagacagcagtaacgcagacctacggtggcaattctaatggggagccatgtgttctgcctttcacctacaatggtcggactttctacagctgtaccacagaggggagacaggacggccatctgtggtgcagtactacatccaactatgagcaagaccagaaatattctttctgtacagatcataccgttttagtccaaacccggggggggaacagcaatggtgccctgtgccatttcccgtttctgtacaacaaccacaactataccgattgcacaagtgaaggtaggcgtgacaatatgaagtggtgcggtacaactcagaactacgatgcggaccagaagttcggtttctgccctatggccgctcacgaggagatttgcactaccaacgagggcgtgatgtatcgcatcggtgatcagtgggacaagcaacacgatatgggccatatgatgcgatgtacttgtgtgggcaatgggcggggggagtggacatgcatcgcctactctcagctgcgggatcagtgcattgtagacgatataacatacaacgtcaatgatacttttcacaagaggcacgaggaaggccacatgcttaactgtacttgcttcggccagggacgggggcgatggaagtgcgaccctgttgaccagtgccaagactctgagaccggtacattctatcaaatcggagattcatgggagaagtatgtgcacggagtgcggtatcaatgctattgttacggtcgcggtatcggagaatggcactgtcagcctttacagacctatccgagcagctctgggcctgtggaggtgtttatcacggaaacgccctcccagccgaatagccaccccatccaatggaacgcaccccaaccgtctcatattagcaagtatattctccggtggcgcccaaaaaacagcgtcggacgctggaaggaggcaacaattcctggccacctcaatagttatacaataaagggtcttaagcctggtgtggtatacgaggggcagctcatttccattcaacagtacggccaccaggaggtcactcgcttcgatttcaccactacttcgacctcaactccagtaacaagcaatacagtaaccggagagaccactcctttttctcccctggtggctacaagtgaatccgtgacagagatcactgcgagctcatttgttgtctcctgggtcagcgctagtgacaccgtgtcaggcttccgagttgagtatgaactctccgaggagggcgatgagccgcagtacctcgatctgccctcaaccgccactagcgtcaatatccctgatctcctgcccggacgaaaatatattgtgaatgtatatcaaatttccgaggatggagagcaatcgcttatcttgtccacttctcagaccaccgcaccggacgctccaccggacactacagtcgaccaggtagatgacaccagcattgtggtgaggtggtccaggccgcaggccccaatcactgggtatcgtattgtgtatagcccttcagtcgaaggatccagcaccgaactaaatttaccagagacagctaatagcgtgacactgtcggatctccagccaggtgtgcagtataatatcactatctatgctgttgaggaaaaccaagagtcaacgcctgtagtcattcagcaagaaacaacgggcaccccccggagcgatacggtgccgagcccgagggaccttcagttcgtggaagttaccgacgttaaggtgacgatcatgtggactcctcctgagtcagctgtgactgggtatcgtgtagatgtgattccagtcaatctgccgggggaacatgggcaaagactcccaatttctaggaatacgttcgcggaagtgactggtctgtctcccggagtcacttactattttaaggtgttcgctgtttcacatggccgcgaatcaaagcctttgaccgcccagcagacaactaagctggacgctccaaccaatttgcagttcgtaaatgaaacagactccactgtgctggttcggtggacaccgccaagggcccaaatcacaggttatcgactgaccgttgggctgactcggcgggggcaacctaggcagtataacgtgggaccatccgtttctaaatatcctttgcgaaatctccagcctgctagtgaatacactgtaagtcttgtggccattaagggtaatcaggagagccccaaggccacaggggtgtttacgacactgcaaccaggatccagtatccctccgtacaataccgaggtgaccgaaacaactattgtaatcacatggacacccgccccccgtatcgggttcaagttgggcgtcagacccagccagggcggggaggccccacgcgaggtcacaagcgattctggatctattgtggtgtccggtttaacacctggggtcgaatacgtgtacaccatacaagttctgcgggacggtcaggaacgtgatgcacctatagttaataaagtcgtgacaccactgagcccccctaccaatctccatcttgaagccaatcccgatacaggagtgcttaccgtgtcatgggagagaagtactactcctgatataaccggctatagaattacaactacccccacaaacggccagcaagggaattccctcgaagaagtggtgcacgcagaccagagctcttgtacattcgacaacctatcccccggtttggagtacaacgtgagtgtgtatactgtgaaagacgataaggagtctgtgcccatctctgatacaatcatcccagccgtcccgcctcctacagacctccgcttcactaatatagggcctgatacaatgagggtgacatgggccccgccccctagcatcgatctgacgaacttcctggtccgctattcacctgtcaagaatgaagaggacgtagcagagctcagtatttcacctagtgataacgcagtggttctgaccaatctgttacccggaacagagtacgtcgtctctgtgtcttcggtttacgagcagcacgaatctactcccctgaggggcagacagaaaaccggcctggattcccctaccggcatcgacttctccgatatcactgcaaacagtttcaccgtgcattggattgcccccagggcgactattactgggtatcggatccgccatcatcctgaacatttctctggcagacctcgggaggaccgtgttccccactcacgcaatagcatcaccctgactaatctgaccccgggcaccgaatacgtcgtgagtatcgtggctctgaacggcagggaagaaagtcctttacttattggtcagcaatccaccgtgagcgacgttccacgcgatctggaggtggttgccgctacccccacgtcacttcttatctcttgggatgcgccagccgttacagtgagatattatcgcatcacgtacggagaaaccggtggcaactcacctgttcaggagttcactgtgccggggagcaaatcaacagctacaatctccggcctcaagccaggcgtggactatactataactgtgtatgctgtcacggggaggggggactcaccagcttcctcgaagcctatttccattaattatcgcaccgaaatagacaagccttcccagatgcaagtgacagatgtgcaggacaacagtattagtgtcaaatggctcccctccagttcgcctgtgacgggctatagagtgaccactacgcccaaaaacggacctgggcccaccaagacaaagacagccgggccagaccagactgaaatgacaatcgagggcttgcaacccaccgtggaatatgtggtctctgtctacgcacaaaacccgtccggagagtcccagcccctggtacagactgcggtgactaacatcgatcgccctaaaggacttgccttcaccgatgttgatgtcgactctattaagatcgcttgggaatccccacaaggccaggttagtcgatatcgggtaacttacagttcacccgaggacggaattcacgagctctttcccgcccccgatggggaagaggacacggctgaacttcaggggctccgccccggtagcgagtatactgtgagtgtggtcgcactgcatgatgacatggagtctcaacctttgatcgggactcagtctaccgccattcctgccccgacggacctgaagttcacgcaggttacccctacctcattgtcagcacaatggaccccccccaatgttcagttaactgggtatcgcgtgcgggtcactcccaaagagaaaactggtcctatgaaggaaattaacctggcccctgactccagcagcgtagtcgtgagcgggcttatggtcgccacaaagtacgaggtgagtgtgtatgcactgaaagacactctgaccagtcggcccgctcagggagtggtgaccacactggagaatgtgagcccacctcgcagggcccgggtgactgatgctactgaaaccaccattacgatctcctggcggaccaagactgaaaccatcacaggattccaggtcgacgccgtgcctgccaatggccagacccctatccagaggaccatcaagccagacgtgagatcatacacaatcaccggattgcaacccggcacggactacaaaatatatttatataccctcaatgataatgctaggagctcccccgtcgtaatcgacgccagtactgccatagatgctccgtctaacctgagatttttggccaccaccccaaatagcctgctggtgagctggcagcctcccagggcgaggatcaccggctacatcatcaaatacgaaaaaccagggtcccctccccgggaagtcgtgccaaggcctcgtcctggtgtgactgaggccactatcaccggcctagaacccggtacagagtatactatttatgtcatcgccctgaagaacaaccagaaatccgaaccgcttattggtcgcaagaaaaccgttaacgagggactcaaccaacctaccgatgacagctgcttcgatccttataccgtttcccactacgccgttggcgacgaatgggagaggatgtccgaatccggttttaaattactgtgccaatgtctaggatttggatcagggcatttccggtgcgactcttcacgctggtgccacgacaacggcgtgaactataagatcggtgaaaagtgggacaggcagggtgaaaacggacagatgatgtcctgcacctgcctcggaaacggaaaaggggaattcaaatgcgacccccacgaggccacatgttatgacgacggaaagacatatcatgtgggcgaacagtggcagaaggaatacctgggtgcaatctgtagctgcacgtgcttcggaggacagagggggtggcgctgtgataattgtagaagacccggcggggaaccgtccccagaaggtacaaccggccagtcctacaatcagtatagccaaaggtaccatcagcgtaccaacacgaatgttaactgtcccatcgaatgtttcatgccgctggatgtgcaggcagatcgggaggattcacgcgaatag

SEQ ID NO: 24206 - DNA, 6636 bp, Artificial Sequence
  Description of Artificial Sequence: Synthetic coding sequence
atgctgcggggccccggccccggcctgctgctgctggccgtgcagtgcctgggaaccgccgtaccatctacgggtgcatccaaaagtaagcgccaggcccagcagatggtgcagcctcagtcacctgtggcggtgtctcaaagtaaacctggatgttatgacaatggcaagcactaccaaatcaatcagcagtgggagcggacgtatctcggtaatgccctcgtttgcacttgctacgggggatcaaggggctttaactgtgagtccaagcctgaagctgaggagacttgtttcgacaagtacactgggaacacctatagagtgggcgacacgtatgagaggccaaaggacagcatgatatgggattgcacatgtatcggggcgggccggggtaggatctcctgcacaattgcaaataggtgccatgaggggggccagtcttacaagattggtgacacttggcgcaggccccatgagaccggcggttatatgttggagtgcgtctgcctgggaaatggtaagggcgaatggacatgtaagcccattgccgaaaagtgcttcgaccacgccgccggcacgtcctatgtggttggtgagacctgggaaaagccctaccaggggtggatgatggttgattgcacctgcctcggcgaagggtctggtcggatcacctgtacgtcccgtaatcgatgtaacgatcaggacacaagaacctcctaccgtatcggggatacctggtctaaaaaagacaacagagggaacctgctgcaatgtatctgcacaggcaatgggagaggtgaatggaaatgtgagcgacataccagcgtgcagacaaccagcagcggatcaggaccattcacggacgtgagggccgctgtataccagcctcagcctcatccacagcctcctccatatggacattgcgttactgacagtggggtagtttactccgtggggatgcagtggcttaagacacagggcaataaacagatgctatgcacatgtctagggaatggagtcagttgtcaggagaccgccgtgacccagacttatggcgggaactccaatggcgaaccttgcgttttgccatttacatacaatggtcgtaccttttactcttgcactaccgaggggcgtcaggatggacacctgtggtgtagcactacaagcaactatgagcaagatcaaaagtattccttctgtactgaccacaccgtgctagtccagacacgcggaggcaacagtaacggggcgctctgccatttccccttcctctataacaatcataactacacagattgcacctcagaaggaaggcgagacaacatgaaatggtgtgggaccacccaaaactacgacgccgaccagaagttcgggttctgtcctatggccgcacatgaggagatctgtaccaccaacgagggagtaatgtatcgaatcggagatcaatgggataaacagcacgatatggggcatatgatgagatgtacttgtgtgggtaatgggcgcggtgagtggacatgtattgcctattcccagctgcgcgaccagtgtatcgtggacgacatcacatacaatgtcaatgacacatttcacaagagacacgaggagggccacatgctgaactgcacatgttttggtcaggggcggggtcgctggaaatgcgatcctgtcgatcagtgtcaagactctgagactgggacgttttatcaaataggagactcatgggaaaagtacgtgcacggagtgcggtatcaatgctattgctatggacgaggaataggcgagtggcactgtcaacccttgcagacatacccatcctcctcgggccccgtggaagtgttcatcaccgaaacacctagtcagcccaattctcaccctatccagtggaacgctccacagccttcgcacatctccaagtacatactcaggtggcggcccaaaaattccgtcggccggtggaaggaagcgacaatcccagggcatctcaactcctatacaattaaaggactgaaaccaggagtagtgtacgagggccagctgatctccattcagcagtatgggcatcaggaagtgacacgcttcgacttcactaccacctctacatccactcctgtgacctcgaataccgtcaccggcgaaactacccctttctcgccactggtggccacttcagaaagtgtcaccgaaattaccgctagctcattcgtagtaagctgggtgagcgcctctgataccgttagtggatttagagtggagtacgagttgagcgaagaaggggatgagccccagtacttggacctgccatctacagcaacatctgtgaacatcccagatcttctgcccggtcgcaagtatattgtaaacgtgtaccagatttcagaagatggagaacagtctctgattttatccacctcccagacaactgctccagatgcacctcccgacaccacagtcgaccaggtcgacgacacatcgatcgtcgtgagatggtcccgaccacaagctccaatcactggctatagaattgtgtatagtccatctgttgagggaagctccacagaactcaacctcccagaaaccgccaactctgtgactctttctgaccttcagcctggcgtacaatataatatcacaatatacgcagtcgaagaaaaccaagagtctacccccgtcgtgatacagcaggaaaccactggcaccccgcggagcgatactgtgccatcccccagagacctgcagttcgtggaggtgactgatgtcaaggtaactatcatgtggaccccacccgagtccgcggtcacgggataccgggtcgatgtcattcctgtgaatctgccgggagagcacggtcagcggctgccaatcagccgcaatacttttgccgaggtgacagggttgtctccgggcgttacctactattttaaggtgttcgccgtctcccacggcagggagtctaagcccctgacagcgcagcagactactaagctagatgcaccaacaaatcttcagttcgtgaacgagacggattctacggtgttggttcgctggacaccgcctcgcgctcagattacgggctatagactcaccgtggggctgactcgcagaggccaacccagacaatataacgtaggtccatctgtatccaagtatccactgcggaatctccaacccgcgagtgagtacaccgtttccctggtggctattaagggtaatcaggagtcccccaaggcaaccggggtatttactactctccaaccaggaagcagtatcccaccatacaacaccgaagtgaccgagacaaccatcgtgattacgtggaccccagcgccaaggataggctttaagctcggtgtgcgcccttctcagggcggggaggccccccgtgaggtgacatctgactccggaagcattgttgttagcggcctcacaccgggggtggaatatgtctacactatccaggtgttacgtgatgggcaggaacgggatgcacctatcgttaataaggtggtgacgcctctgagtccacccactaacctgcacctagaagctaatcccgacaccggcgtgctcactgtctcttgggagagatctactaccccagatatcactggctaccggatcacaactacacccacaaatgggcaacagggcaactcacttgaggaggtggtacacgcagatcagagttcctgcaccttcgacaatctgagtcccgggctcgaatataacgtgtccgtgtatacagtaaaagatgacaaagagagtgtgcctatcagcgacaccataattcctgctgtgcccccacccaccgacttgcgcttcaccaacattgggcccgatactatgcgtgtgacatgggcacctcccccttccatcgacctcactaacttcctcgtgcgatactcgcctgtgaaaaatgaggaggacgtagccgaactctctatcagtccttccgataacgcggttgtgttgaccaatctgcttcctggaactgagtacgtagtctctgtgagcagcgtgtacgaacagcacgagtctaccccactgcgcgggcgacagaagaccgggctcgacagtccaactgggattgactttagtgacattaccgccaactccttcacagtccactggatcgcgccacgggcgactatcactggatataggattagacaccaccctgaacatttctccggaagacctagggaggaccgagtccctcactccagaaatagcattacacttacgaatctcacacccggtaccgaatacgtagtgtcgatcgtggcgcttaacggcagggaggaaagcccccttttaatcgggcagcagtctaccgtttcggacgtacctcgtgatttagaggtcgtcgcggctacgcccacatctttgttgatcagctgggatgcacctgcagtcaccgtgcgctactaccgcattacatacggcgagacgggcggaaactctcccgtgcaggagtttacggtgcccggcagcaagtccaccgcgactattagtggcctcaaaccaggcgtggactatacgataacagtttacgccgtgaccggcaggggagattcccctgcgagtagcaaaccgatcagtatcaattaccggacagagattgacaagccatcccagatgcaggtgacagatgtgcaagacaattccatctccgtcaaatggctgccaagcagctctcctgtgaccggctacagggtaaccactaccccaaaaaatggccctggccctaccaagacaaagacagcagggccggaccagaccgagatgactattgaaggacttcagcccacggtggagtacgtggtcagtgtgtacgcccagaacccatccggagaaagccagcccctcgtccaaaccgccgtgaccaacatagacaggccgaaggggctggcattcaccgacgtggacgttgatagtataaaaatcgcgtgggagagtccacaggggcaggtctctagataccgggtaacctactcttctcccgaggacgggatccacgaattgttccccgcccctgatggcgaagaagatacggccgaacttcaaggactccgccccgggtctgaatacaccgttagtgtcgtggcactccatgatgacatggagtcccaaccactgatcggcacccaatccacagcaatcccagcccccaccgatctgaaattcacccaggtaactcccacttccctgtccgcgcaatggaccccccctaatgtgcagctgacgggttacagggtcagagtaacgccgaaggagaagactgggccaatgaaagaaataaacctggctcccgatagcagctccgttgtagtgagtggcctgatggtcgccactaagtacgaggtgtccgtgtacgctctaaaggacaccctcacgtcccgtcctgcccagggtgtggtgacaaccctcgagaacgtctccccaccacgccgagcgcgggtgaccgatgctactgagaccactatcactatttcctggcggacaaaaacggaaaccataacaggttttcaggttgatgccgtcccagctaatgggcaaaccccaattcaacgcacgattaaaccagatgtgcgttcatacactataaccgggctgcagcccgggaccgattacaaaatttatctgtacacactgaacgacaacgcccggtcctccccggtcgtgatcgacgccagcaccgccatcgacgcccccagtaacctgcgcttcctcgcaacgacgcctaacagcctgctggtaagttggcaacctcctcgggcacgtatcacagggtatattattaagtacgaaaaaccagggagccccccccgggaggtagtgccaagacccagacccggcgttaccgaggccacaatcacaggactggagccaggcacagagtataccatttacgttatagccctgaagaacaaccagaagtctgagccactaatcggtcgaaaaaagaccgggcaagaggctctttctcagactacaattagttgggcaccttttcaggacacgtccgagtatatcatttcttgccaccctgttgggaccgacgaagagcctcttcagtttagagtccccggaacctctacaagcgcaaccctgacaggattgaccagaggcgccacatacaatgtgatcgtagaggcactgaaggatcagcaacggcataaagtgcgtgaggaagtagtgaccgtgggcaattcgggatggtgccatgataacggagtgaactacaaaatcggcgaaaagtgggaccgccagggggaaaacggtcagatgatgtcatgtacttgtctgggaaacggcaagggcgagttcaagtgcgaccctcacgaggcgacgtgttacgatgacggcaaaacttatcatgtgggtgaacagtggcaaaaggagtacctcggggccatttgttcttgtacctgctttggcggccagcgcggatggcgatgcgataattgccggcgccccgggggcgagccaagtcccgaggggacaacaggccagtcttacaaccagtatagccagcgctatcaccagcgtaccaacacaaatgtgaactgtcctatcgagtgttttatgccacttgatgtccaagccgacagggaagattcccgcgaatag

SEQ ID NO: 24207 - DNA, 7434 bp, Artificial Sequence
  Description of Artificial Sequence: Synthetic coding sequence
atgctgcggggccccggccccggcctgctgctgctggccgtgcagtgcctgggtacagccgtgccaagcacgggagcgtctaaatccaaacgccaggcccaacagatggtgcaaccacagtccccagtcgccgtttcgcagtccaaacctggatgctatgataacggcaagcattaccagattaaccaacagtgggaaagaacatacctgggcaatgcactggtctgtacatgttatggcgggagccgcgggtttaattgtgaaagcaagccagaggcagaagaaacctgcttcgacaagtacaccggcaacacatacagagtcggagacacatacgaacgaccaaaggactccatgatctgggactgtacctgcattggggccggccgcgggaggatctcttgtaccattgctaaccggtgtcacgagggaggtcagtcctataagatcggcgatacatggcgccgtccacatgagaccggaggatatatgttagagtgcgtatgtctggggaatggcaaaggggagtggacctgcaagcccatagccgaaaaatgtttcgatcacgctgccggtacctcttatgttgttggagagacatgggagaaaccttaccaaggctggatgatggtagattgcacatgcctgggtgagggaagcggcaggattacttgtacgagccgaaaccggtgcaatgatcaagatacgcgaactagctatcggattggagatacttggtctaaaaaagacaatcgcgggaacctgttacaatgtatctgcacagggaacggtagaggagaatggaaatgtgagcgacataccagcgtccagactacctcaagtggctccggaccttttaccgatgttagagccgcagtttatcagccgcaacctcatccacaacctcccccatatggtcactgtgttactgattcaggggtggtctattccgtcgggatgcagtggctgaaaactcaggggaacaagcaaatgctttgtacctgcctgggaaatggagtttcttgtcaggaaactgctgtgacacagacttatgggggaaacagcaacggagagccgtgtgtgctccccttcacctacaatggacggaccttttactcatgtactacagaaggcaggcaggatggacacctttggtgttctacaacttcgaactacgaacaggaccaaaagtatagcttctgcactgatcacacagtgctggtacagacacggggaggcaacagtaacggggcactgtgccattttcctttcctgtataacaatcataactacacagactgtacatccgagggccgacgcgacaatatgaagtggtgcggtaccacacagaactatgacgccgatcaaaagttcggcttttgtcccatggccgcccatgaagagatttgcacaaccaacgagggcgtgatgtacagaatcggcgaccagtgggataaacagcacgacatgggacacatgatgaggtgcacatgtgtcggaaacggtaggggcgagtggacttgtatcgcttactcccagttaagggaccagtgcatcgttgatgatattacttataatgtcaacgacaccttccacaagcgccacgaagaaggacatatgctgaattgtacgtgttttggccagggccggggtcgttggaaatgtgaccccgtggatcagtgccaggacagcgaaactgggacattttaccagatcggagatagttgggaaaagtatgtccatggtgttagataccagtgttactgctacgggcgtggaattggagagtggcactgccagccgctacaaacgtaccccagttcctctggtccagtggaagtcttcattacagagaccccttcgcagccgaatagccatcccatacagtggaatgcacctcaaccctcacacatcagcaaatacatcttgaggtggaggcccaagaattcagtaggcaggtggaaagaagcgaccattccgggacatctgaactcgtacacaattaaaggccttaagccaggcgtggtgtatgaaggccagctcatctcaattcagcaatacggccatcaggaggtgacccgatttgattttaccaccacatccacatctacaccagtgaccagcaacaccgtgaccggagagactacacccttctctcctctcgtggctacctccgagtcagtcaccgaaatcacagcatcttccttcgtggtcagctgggtgtccgcctcagacactgtaagcggcttccgggtggagtacgaactgagcgaagagggggacgagccgcaatacttagatctcccttccactgccacatcggttaacatccccgatctactcccaggtcgcaagtacatagtgaatgtctaccagatcagcgaagacggagaacagtctctgattctgtctaccagtcagacgaccgccccggacgctcctcccgacactaccgtggatcaggtggacgatacatccatagtcgttcgctggagtagaccgcaagcccccatcaccgggtacagaattgtatattccccgtccgttgaaggcagcagtacagaactgaatctgcccgagactgctaattcagtcaccctctccgacctgcaacctggcgtgcagtataacatcactatttatgccgttgaggagaatcaggagtccacccccgtggtcatccagcaggagacaaccggcacaccgcgcagcgacaccgtgcctagtccaagggacctgcagttcgtagaagtgactgatgtcaaggtgacaattatgtggacacccccagagagcgcagtgaccggctaccgagttgacgtaattcccgtcaatctgcccggggagcacggacagagactccccatctcgcgaaatactttcgctgaggtcacgggcttgagtccaggcgtgacttactatttcaaagttttcgcggtgtcgcatggtcgcgagagtaaacctcttactgctcagcaaacgactaaacttgacgccccaaccaacctgcagttcgttaatgagactgattccacggttctggtgcgatggacccccccgagggcccagattaccggctataggctcacagttgggctaactagaaggggtcagcctagacagtataacgtaggaccatccgtcagtaagtatccactcaggaacctgcagccggcctctgagtatacagtgtccctggtggctattaaaggcaatcaggaaagtcctaaggccacaggggttttcacgacactccagcctggatcgtccatccccccctataacaccgaggttactgagaccaccatagtgataacttggacaccggcccctcggatcggttttaaactgggcgtgcgaccctctcagggcggcgaagcaccccgggaggtcacgagtgattcaggcagtattgtggtgtcgggcctaacacccggcgttgagtacgtttataccatccaggtgttgcgagacgggcaagagagggatgcaccaatcgttaacaaggtggtcactccactctctccacccaccaacctgcacctggaggccaatcccgatacaggggtgctcactgttagctgggagcggagtaccactccagacattaccggctaccggattacaacgacacctacaaatggtcagcagggtaacagcttggaggaagttgtgcatgccgatcagtcctcttgcacatttgacaacctttctccaggcctggaatacaacgtgtctgtttatactgtgaaagacgacaaggagtcagttccgatttcagatacaattatcccagaggtgccacagctgaccgacctctcatttgtggacataaccgattctagtattggcctccggtggacacctcttaattcgagcaccattatcggctatagaatcacggtggtagccgctggagaaggaattcccatattcgaagactttgttgattctagcgtggggtactacaccgtgacgggactggaacccgggatcgactacgacatttccgtcattaccctgatcaacggaggggagagcgcaccaacgactctaactcagcagaccgctgtcccacccccaaccgacctgcggttcacgaatatcggacccgataccatgcgagttacatgggctcctcccccctccattgatttgacaaacttcttggtccggtattccccggtcaagaatgaggaagacgttgccgaacttagcatttccccatcggacaacgccgtggttctgaccaacctgttgcctgggacagaatacgtcgtgagcgtgtcttcagtatatgaacagcatgagtctacccccctaagaggacggcagaagacaggcctggatagtcccactggcatagatttcagcgatatcactgcgaatagtttcacggtccattggatcgccccaagggcaaccataacaggatacaggattaggcaccatcccgaacatttctccggacggccgagagaagatcgagttccccatagcagaaattcgattaccctgacaaacttaacccctggaaccgagtacgtggtgagtatcgttgctctgaatggcagagaagaatctcccctgctaattggtcaacagagcaccgtcagtgacgtcccccgagatctggaggtggtggcagcaactcctacgagtctgctgataagctgggatgcgcctgcagtcaccgtacgttattaccggatcacttatggagaaaccggcggcaattcccctgtgcaagagttcacagtgcccgggagcaaatccacggcaaccatctccggcctgaaacctggcgtagactatacgattaccgtatacgccgtgactggccgaggagacagccctgcctctagtaaacccataagcattaactatcgcactgaaatcgacaaacctagtcagatgcaggtgactgatgtccaggataactcgatatctgttaagtggctgccctcttcttccccggttaccggctaccgggttactactacgccaaagaacgggccaggccctacgaaaacaaagacggcgggtccagaccaaacggagatgacgatcgaaggacttcaacctactgtggaatatgttgtttctgtgtatgcccaaaatcccagtggcgagtcccagccacttgttcagactgctgttacgaacatcgacaggccgaaaggactggcctttaccgacgtcgacgtagactctattaaaattgcctgggagtcgccacagggacaggtgtcccgctacagagtgacatatagctcccccgaggatggcatccacgaattatttcctgcccctgatggcgaggaggatactgcagaactccaggggttaaggcccggatcagaatacactgtcagcgtggttgccctgcatgatgacatggaaagtcaaccgcttatcgggacccagagcactgctattcccgcacctactgacctgaaatttacccaggtgacacctacaagcctcagtgcccaatggactcctcctaatgtccagctgaccgggtaccgagtccgggtgacccccaaagagaagactggaccgatgaaagaaattaacctcgccccagattcctccagcgtggtagtgagcgggctcatggttgctaccaaatacgaagtttccgtctacgccttgaaagatacactaacatccaggcctgcacagggagtggtgaccaccttagagaacgtctcacccccccgcagagccagagtgacagacgcgacagaaaccaccatcaccattagttggagaacaaaaacggaaacgattactggtttccaggtagacgccgtgccagcaaacggccagactccgatacagaggacaatcaagcctgacgtgaggtcctacacgatcacagggctgcagccgggaaccgactataagatttacctgtacaccctaaacgataacgcaaggtcatcccccgttgtcatagatgctagtactgcgatagacgccccgagtaacctgcggtttcttgctaccacacccaactctttactcgtttcctggcaaccacctcgagcacgaatcaccgggtacattataaagtacgaaaaacccggctctcccccaagagaggttgtgcccagacctaggccaggggtgacagaagccacaatcaccggtctggagccaggcaccgagtacaccatctatgtcattgccctgaagaacaatcaaaagagtgagcctttgatcggcaggaagaagacagatgaattgccacagttggtaactctcccacacccaaacttacatgggcctgagattcttgacgtaccgagtactgtgcaaaaaactccatttgtcacccatcctggctacgacaccggaaacggcatccagcttcctgggacctccggacaacagccgtctgtgggccagcagatgatattcgaagagcatggatttagacggaccacaccacctactacagcaacgccgattagacacaggccgagaccttatccacctaacgtgggggaggagattcagattgggcacatcccccgggaagacgtcgattaccacctctaccctcacgggcccggtttgaaccccaacgcttcaacaggccaggaggctttatcacagaccacaatttcatgggccccctttcaggataccagtgagtacatcatctcctgccacccagtgggcacagatgaagaaccgctgcagttccgagtgccaggaacttctacgtcagccaccctgacaggtctgacaaggggtgccacgtataatgtgattgtggaggccctaaaggaccagcagcgtcataaagtgcgcgaggaggtcgttactgtgggcaactccgttaatgaaggactgaaccagccaaccgatgactcctgcttcgacccatataccgtcagtcactacgctgtaggggacgagtgggaaaggatgtcagaatcaggcttcaaactcttgtgccagtgcctaggtttcggatctggccatttccgatgcgactctagccggtggtgtcacgacaatggcgtgaactacaaaattggagagaaatgggaccggcagggggagaatgggcagatgatgtcctgcacttgcctgggcaacggcaaaggcgagttcaagtgcgacccacacgaagcaacctgctatgacgatgggaagacttatcacgtcggcgagcagtggcagaaagaatacctcggcgctatatgctcgtgcacctgcttcgggggacagcgcggttggcgctgcgacaactgtcgccggcctggtggagagccatctcccgaggggacaaccgggcagtcctacaaccagtacagccaacggtaccaccagaggaccaacacgaacgtaaactgcccgatagagtgcttcatgcctctcgatgtgcaagccgacagagaggatagccgggaatag

SEQ ID NO: 24208 - DNA, 6891 bp, Artificial Sequence
  Description of Artificial Sequence: Synthetic coding sequence
atgctgcggggccccggccccggcctgctgctgctggccgtgcagtgtctggggactgccgtgccatcaaccggggcgagcaagtctaagcggcaagcgcaacaaatggtccagccccagtctcctgtggccgtttctcagtctaaacctggttgttatgataacggtaagcactaccagattaaccagcagtgggagaggacctatttagggaacgcgctcgtttgcacgtgctacggcggctctcgcgggtttaactgtgaaagcaaaccagaagccgaggagacctgtttcgacaagtacactggaaatacataccgagttggggacacatatgagcgtcccaaagactctatgatctgggattgtacctgtattggcgctggacgggggcggatttcatgcaccatcgccaatcgatgtcatgagggcgggcagagctacaaaattggcgacacatggcgcagacctcatgagacaggtggttatatgctcgagtgcgtatgcctgggcaatggaaagggggagtggacgtgtaagcctatagctgagaagtgttttgaccatgccgctggcaccagctacgtcgtgggagagacatgggaaaagccttaccagggatggatgatggttgattgcacttgtctgggcgagggctcaggccgaatcacgtgcacatctaggaacagatgtaatgaccaggatacccgcacaagctacagaattggcgacacttggagtaaaaaagacaacagaggtaatctcctccaatgtatctgcaccggaaacggtcgtggggaatggaaatgcgaacgccatacgagtgtccagactacttcatcgggctcaggccccttcacagatgtaagagctgccgtctaccaaccacagccacacccacagccccccccttacgggcactgcgttacagacagtggcgtcgtgtattctgtgggaatgcagtggctaaagacccagggaaacaaacaaatgctgtgcacatgcctgggcaatggcgtgagctgtcaggagactgccgtaacccagacgtacggtgggaattctaacggcgaaccttgtgtcctgccattcacctacaacgggcgcaccttttatagttgcaccactgaaggccgccaggatgggcacctatggtgttcaacgaccagtaactatgagcaggaccagaaatactcattttgcaccgatcatacggttctggtgcaaacgcgcggtgggaactcaaacggcgccctatgtcattttccctttctgtacaataaccacaattacacagattgcacaagcgaggggcgccgcgataatatgaaatggtgcgggaccacccagaactatgacgccgaccaaaagtttggattttgcccgatggccgcccatgaggagatttgtacaacaaacgagggtgtgatgtaccgaatcggcgatcagtgggacaaacagcatgatatgggccacatgatgagatgtacatgcgtgggaaatggaagaggcgagtggacttgtatcgcttacagtcagctgagagaccagtgtatcgttgatgacattacttacaatgtcaatgatacattccacaaacggcatgaagagggtcatatgctgaactgtacctgtttcgggcaggggcgaggaaggtggaaatgcgaccccgttgaccaatgtcaagactctgagaccggaactttctatcaaataggtgattcttgggagaaatacgtccatggagtccgatatcagtgctactgctacggccgaggtattggcgaatggcactgtcaaccattacaaacttatccatcgtcaagcgggcccgttgaggtattcatcacggagacacctagtcagcctaattctcatcctattcagtggaacgccccccagccttcacatatttctaaatacatccttaggtggcgcccgaagaattccgtggggcggtggaaagaggctactattccaggtcatctgaactcttacacaattaagggtctgaagccaggcgtggtctatgagggtcagctgatatcaattcagcagtacggccatcaggaggtgacccggttcgactttacaacaaccagcacttctacgccagtcacttccaatacagttacaggagaaactaccccatttagccctcttgtcgctacatccgagtcggtcactgagattaccgcttcctctttcgttgtctcctgggtgtccgcctctgacaccgtgtccgggttccgcgttgaatatgagctaagcgaagagggcgatgagccccagtatctggacctcccctccacagcaacgagcgtgaatattcctgacctcctacctgggagaaagtatatcgtcaatgtctatcagatttcagaggatggcgagcaatccctgatcctgtcaacttctcagacaaccgctccagatgctcccccggacacaaccgtagaccaagtagatgacacttccatagtcgtccgctggtctaggcctcaagccccaataacaggttataggatcgtctacagccccagcgtggagggctcgagtaccgaactgaatcttccagaaaccgcaaacagtgtgactctcagtgatctgcagcccggggttcagtataacatcactatctatgccgtggaggaaaatcaagagtccacgccagtagtcatacaacaggagactactgggacccctcggtccgacaccgttcctagccccagagacttacagttcgtggaagtgactgacgttaaggtgacgataatgtggaccccccccgaaagtgccgtgacagggtacagagtggacgtgattcctgtgaatcttcccggggaacacggccaaaggctccctatcagccggaacacctttgccgaagtgaccggattatctcctggcgtcacttactacttcaaggtcttcgctgttagtcacggccgcgagagcaaaccacttaccgcacagcaaacaacgaaactggatgcacctaccaatctccagtttgtgaatgagaccgactccaccgttctcgtgaggtggacccctccaagggcgcagatcactgggtacaggctcaccgtgggattaacacggagagggcagcctcgccagtataatgttggacccagtgtgagcaagtaccccctacgcaatctgcagccagcaagtgagtacacagtatcactagtggctatcaaaggcaaccaggaatctccaaaagccaccggcgtgtttacaactctccagccaggaagctctatcccgccctataacaccgaggtgaccgagaccacaattgtcattacatggaccccagcccctagaatcggatttaagctgggcgtgcgaccctcccagggcggcgaggcccctagagaagtcaccagtgattcagggagcatagttgtttctggattgactccgggagttgagtacgtttacactatccaggtgttaagggacggtcaggaacgagatgctccaattgtgaacaaagttgtgacaccactcagtccacccactaatctccatttagaggccaatcccgacacaggggtgcttaccgtgtcctgggagagaagcacaacccctgatataaccggataccgtatcacaacaacacctacaaatggtcaacaaggcaactctttggaggaggtggtgcatgcggaccagagctcgtgcactttcgataatctgagcccgggtctcgagtacaatgtttcagtctacacagtcaaggatgataaggagtcagttccaatctcagacaccattattcccgccgtaccacccccgactgacctcaggttcaccaacataggtcccgatacaatgagagtgacatgggctccacctccatctatcgacctgacaaatttcctggttcgctactctcctgtaaagaatgaggaggatgtcgccgagttgtcgatcagtccctctgacaacgctgtggtgctcacgaatctcctccctggtactgagtacgtagtatcagtgagctccgtttatgagcagcacgagtcaactccactcagagggagacagaagacaggcctcgacagcccaaccggcattgacttcagcgacattacagcgaacagctttacggtccactggatcgcacccagagcaacgattaccgggtatcggattcgccaccatcctgagcatttttccgggcggcccagagaggacagagtgcctcacagtaggaattcgatcacactgacaaacctgacgccaggcactgaatacgtcgtgtcaattgtggccctgaacggacgggaagaatccccattgttaatcggccagcaaagtactgtttcggatgtgccaagggatcttgaggtggttgccgccacgccgacatcattgctcatcagttgggatgcacctgccgtgaccgtacggtattaccgaattacctacggcgaaaccgggggaaactcccccgttcaggaattcaccgtgccaggttcaaagtcaacagccaccatcagcggactcaagcccggcgtggactacaccatcacagtgtatgccgtaactgggcgcggggattcccctgcatcttcgaaaccaataagtatcaactatcgcacagaaatcgacaaacccagtcagatgcaggtgaccgacgtacaggacaacagcatttctgtaaagtggctgccatctagctcccccgttaccggttatagagtgacaactacccccaaaaatggtccaggtccgacaaagactaagaccgccggacctgaccagacagagatgactatcgaaggcctacagccgaccgtagagtacgttgtatcagtctacgcccagaatcccagcggagaaagtcagccgctggtgcagactgctgtaacaacaatccctgcaccaacggacctgaagttcactcaagtcaccccaacgtctctctccgcccagtggacaccaccaaacgttcagctgacaggttaccgtgtgcgcgtcacgcccaaagaaaaaaccggccccatgaaagagataaacctggcaccggacagctcctcggtggttgtgtccggattgatggtcgcgacaaaatacgaggtaagcgtttacgccctgaaggacacgcttaccagccggccagcacagggggttgttacaacgctcgaaaacgtttcccctccacgccgggctagggtgaccgacgcaactgagaccacaataacaataagctggagaactaagacagaaaccatcaccggctttcaggtggacgccgtgccagccaacggccaaacacctatccagcggactatcaaaccagatgttcgcagctacacaataacagggctgcagccaggtaccgattacaagatctacctctatacgctgaatgacaatgctaggtcctctcctgtggtcattgatgcgtcaactgcaattgacgccccttctaacctgagattccttgcaacgacccccaatagcctgctggttagctggcaacctccaagagctcggatcacgggatacattatcaaatacgagaagcccggcagccctccgcgggaggtagtgcctcggcctcgaccaggcgtcacagaggctaccatcactggactagagcctggcactgagtacacaatttatgtcatcgctctgaagaacaatcaaaagtctgaacctctgattggccggaagaagactgatgaactcccacagttggtgactctcccccatccgaacttgcatgggcccgagatactcgacgtaccgtccaccgtccaaaagacaccatttgtcacccatccagggtatgacacaggaaacgggatacagctgccggggactagtggccaacagcccagcgtggggcagcaaatgatattcgaagaacatggatttcgcagaacaacaccacctaccacagccactcccatacgtcacaggcccaggccctaccctcctaatgtaggcgaagaaattcaaattggccatataccacgagaagacgtggattaccacctgtacccacacgggcccggcctgaaccccaatgctagcaccgggcaggaagcccttagccagacaaccattagttgggccccattccaagatacaagtgaatatatcatatcatgtcaccccgtagggactgatgaagagcccctgcaattccgggtgcctgggacctccacctccgcaacattgactgggttgacccgaggcgccacttacaacgttatagtcgaggcgttgaaagaccagcagagacacaaagtgagggaggaggtggtgactgttggcaacagcgtgaatgaggggctcaaccagccaacagacgattcctgtttcgacccgtatacagtgtcccactacgcggtgggagacgaatgggagcgaatgagtgaatcggggtttaagttgttatgccagtgccttggcttcggctctggtcactttcggtgcgacagcagccggtggtgccatgacaacggggtgaattataaaatcggggaaaaatgggaccgtcaaggagagaacggacagatgatgtcatgtacctgtctgggcaacggaaagggtgagttcaaatgtgacccgcacgaggccacatgctacgacgacggtaagacatatcatgtgggtgagcagtggcagaaggagtacctgggggcgatttgctcatgcacatgcttcggcggacagcgtgggtggcggtgcgacaattgccgacgccctggcggtgagccctctcccgaggggacaactggtcagagctataaccaatacagccagcggtaccaccagcgtactaataccaatgtgaattgtcctatcgagtgcttcatgccgctggatgtccaggccgatcgggaagactctagagagtag

SEQ ID NO: 24209 - DNA, 6096 bp, Artificial Sequence
  Description of Artificial Sequence: Synthetic coding sequence
atgctgcggggccccggccccggcctgctgctgctggccgtgcagtgcctgggaaccgcagttcccagtactggcgcctcgaaatctaagaggcaggctcagcaaatggtgcaacctcagagccctgtggccgtgagtcagtctaaacccgggtgctacgataatggcaaacattaccagatcaatcaacagtgggagcgcacttaccttgggaacgccctggtctgtacctgctatggaggcagccgggggttcaattgcgagagcaagccagaggctgaagaaacgtgcttcgacaagtatactggcaatacataccgcgtgggtgatacctatgagagacccaaagactctatgatctgggactgcacttgtattggagccggccggggtagaatttcctgcaccatcgcaaaccggtgtcacgagggcggccaaagctacaagatcggagacacctggagacgtcctcatgagacaggaggctatatgttagagtgcgtttgcttagggaatggtaaaggcgagtggacttgcaagcccatagccgaaaagtgcttcgaccatgccgccggcacaagctatgtggtgggcgaaacatgggagaagccttatcagggttggatgatggtggactgtacttgtttaggtgaaggatctgggaggatcacatgcacatcccgaaataggtgtaacgatcaagacacaagaaccagctatagaatcggggatacttggagcaagaaggataaccgtggaaacctcctgcagtgtatatgcaccggtaacgggagaggtgagtggaaatgtgagaggcacacgtctgtccagaccacttcgagtgggtctgggcccttcactgatgtgcgcgctgctgtctaccagccgcagccacatccccagccccctccatacggtcactgtgtcaccgacagtggggtcgtgtactcagtggggatgcagtggttgaagacacagggcaataaacagatgttatgtacatgtctgggaaacggggtgtcttgtcaggagacggctgtgacccagacctacggcggaaattctaatggtgaaccttgtgttttaccatttacctataacggccgaaccttctactcctgcacaaccgagggacgtcaggatggacacctgtggtgttccaccacctctaactacgaacaggaccaaaagtactcattctgtaccgatcataccgtgttggtgcaaactcggggagggaatagcaatggagccctatgtcactttccgttcttgtataacaaccataactacaccgattgcacaagcgagggcaggagggataacatgaagtggtgcggcaccacccagaactacgacgctgatcagaaattcggtttttgccctatggcagcccatgaagagatttgcaccactaatgagggcgttatgtaccgcattggcgaccagtgggacaaacagcacgacatgggtcacatgatgcggtgcacatgtgtgggtaatggaaggggcgaatggacatgcatagcatattcccagctgcgggatcagtgcatcgttgacgatatcacatataacgttaacgataccttccataagcggcacgaggagggacacatgctgaattgtacttgcttcggacaggggaggggccgctggaaatgtgatcctgttgaccagtgtcaggatagtgaaactgggaccttctatcaaattggggactcatgggagaagtacgtgcatggagtgcgctatcaatgctattgctacggccggggaatcggagagtggcattgccaacctctgcagacttacccatcatctagcggacccgtggaagtattcattacagagacccctagccagccaaattctcatcccatccaatggaatgcccctcagcctagtcatatctctaagtatattttgcggtggaggccgaaaaattccgtgggcaggtggaaggaggcaaccatcccaggccatttaaatagctacacaattaaagggcttaaacccggagttgtttatgagggacagctgatttcaattcagcagtacggacatcaggaggttactaggttcgacttcactactactagtacaagtacgcctgtgacctctaatacggtgaccggagaaacgacaccatttagccctttggtcgctactagcgagtctgtgacagagatcacagcgagttcttttgttgtcagttgggtgtcagctagcgacaccgtgagtgggttcagagtcgagtatgaactctctgaggaaggggatgagccacagtatctcgacttgccttcgacagcgacgagcgtgaatattcccgaccttctgccaggacgaaaatacatagttaatgtctaccaaatttcagaggatggagagcagtccttaattctaagtacctctcaaactaccgcccccgacgccccacccgatacgacagtggaccaggttgacgacactagcatcgtggtgaggtggtctcggccacaggccccaatcacaggttatcggattgtctacagtcctagcgtggagggcagctcaactgaactgaatttgcctgaaactgccaacagcgtaaccctgtccgaccttcaacctggggtgcaatacaacatcactatttacgcagtagaggaaaatcaggaatcaaccccagtggtaatacaacaggaaactactgggaccccccgttcagacacggtacctagcccacgcgacctccagtttgttgaggttaccgacgtcaaggtgacaataatgtggaccccccctgagtctgctgttactggctaccgggtcgatgtgatccctgttaacctgccaggagagcatgggcagaggttgcctatctcccgaaatactttcgccgaggtcacgggtctgtctccaggggtcacctactattttaaggtttttgctgtatcccatggccgcgagtccaagccactgacagctcagcagaccaccaagctggatgcgccaaccaacttgcagttcgtcaatgaaactgacagcaccgttctcgtccgatggacccctcctcgggcacaaatcacaggatatcgcctgactgtcggcctgaccaggcgtggccagccccgacaatacaacgtcggcccttccgtcagtaaataccccttacggaacctgcagccagcatccgagtacacagtttctctcgtcgctattaaggggaaccaggaatcccctaaggcaaccggcgtcttcactaccttacagcctggctcctcgatccccccttataatactgaggtcactgaaaccactatcgtcatcacgtggaccccagcgccccggattggcttcaaactgggcgtgcggccatctcagggtggtgaggcgcctagagaagtgacgtcggattccgggtcaatcgtggtgtccggactcacgcccggagtcgagtatgtgtataccatccaggtattacgtgatggccaggagagggacgctccaattgtgaacaaggtcgtgacacctctcagcccccccacgaacctccatctcgaagcaaacccggataccggcgtgcttacagtgagctgggagcgctccaccactccagatatcaccggataccgcattacgactaccccgaccaacgggcagcaagggaacagcttggaagaggtggtccatgctgaccagagtagttgtacttttgacaatttgtctccagggttggagtacaacgtctcggtctatactgtcaaggacgacaaggaaagcgtgcccatcagcgacacaataatcccggcagtccctccgccgaccgatctgaggttcacaaatatcggacccgatacaatgcgagtgacctgggccccaccaccgtccattgacctgacgaattttttggtccggtatagtcccgttaagaatgaagaagatgtggccgaactgtctatcagcccgagtgacaatgccgttgtactgaccaaccttcttcctggtacagagtacgtggttagtgtctcctcagtatatgaacaacatgaatcaactccacttcgaggccggcagaaaaccggtctcgattccccaaccggtatcgacttctcggacattacagcaaattcatttaccgtgcattggattgctccccgcgcgaccatcacgggatatagaattcggcaccaccctgagcatttttccggccgcccccgggaagaccgggtgccccacagtaggaattcaatcactctgacaaacttaactcctggtactgagtacgtggttagcattgtagctctaaatggccgtgaggaatctccactccttatcggacagcagagcactgtcagcgacgttccccgcgaccttgaggtggtggcagcgactccaactagtctgcttatttcatgggatgctccagcagtgaccgtgcggtattaccgtataacttacggggaaaccggagggaattcacctgtgcaggagttcacagtccccggaagtaaatcaacagcaacaatctccggactgaagcccggagttgactacaccatcactgtctatgcggtgactggcagaggcgactctcccgcaagcagcaaaccaattagtatcaactaccgtacggagattgataaaccgtcccagatgcaggtgactgacgtacaggacaacagcatctccgttaagtggcttccttcctcatcgccggtcacaggataccgggtaaccactacacccaagaacggtcccgggcccaccaaaaccaaaactgccggtcccgaccaaacagagatgacgatcgagggactgcagcccaccgtagagtacgtagtgagtgtctatgctcagaacccaagtggcgagagtcagcctctggtgcagaccgctgtcacaaacatcgatagaccaaaaggcctggcatttacggacgtagatgttgattccattaaaattgcctgggaatctccacaagggcaggtgtctcgataccgagtcacttattcgagcccggaggacgggattcatgaactcttccccgctcctgacggcgaggaggacactgcagagttgcaggggctgcggccaggcagtgagtatacagtgtccgttgttgctctccatgacgatatggaatcacaacctctcattgggactcagtctactgccatcccagccccaactgacctgaaatttacacaagtaactcccacttcgctgtctgcccaatggactccacccaatgtccagctcacagggtacagagtgcgcgtgactccaaaagaaaagaccggccccatgaaggaaattaacctggctccagactcctcgagtgtggtggtatcaggccttatggtggctactaagtatgaggtctccgtgtatgcacttaaagatacactgacatcacgccccgcccaaggagtcgtgaccactcttgagaatgtgagccctccccggcgagctagagttaccgatgccacagagaccaccatcactatatcttggagaacaaaaaccgagaccatcactgggtttcaagttgacgcagtgcctgccaatgggcagacccccattcagcggacgatcaaaccagacgtgaggtcctacaccataaccggcttacagcctggaaccgactataaaatatatctctacacactcaacgacaacgctcgctctagccccgtcgtcatcgatgcatcaacagcaattgacgctccttccaaccttcggtttctggcgactactccaaactctctccttgtgtcatggcaacccccaagagcgagaattacaggctacatcattaagtacgaaaaacctgggtcccccccccgggaggtggtcccacgtcctagaccaggtgtgactgaggccaccatcacaggcctagaacccgggaccgagtacactatatacgtgattgcattaaaaaacaaccagaagtctgaaccccttattggtcggaaaaagacaggacaggaggcgttgagccaaaccacaatctcttgggctccattccaggacacgtcagaatatataatcagctgtcatccagtcggcaccgatgaggaacccttacagtctacaaaagcatag

SEQ ID NO: 24210 - DNA, 6531 bp, Artificial Sequence
  Description of Artificial Sequence: Synthetic coding sequence
atgctgcggggccccggccccggcctgctgctgctggccgtgcagtgcctgggtacagctgttccgagcaccggcgcctcaaaaagtaagcgacaggcgcagcaaatggtgcaaccccagtctcccgtcgctgtctctcaatccaaacccggatgctatgataatggcaagcactaccagatcaaccagcaatgggagcggacctatctcgggaatgccctggtctgtacatgttacggaggatcccgtggatttaattgtgaatctaaacctgaggcagaagaaacatgcttcgataagtataccgggaacacatatagagtgggggatacatacgagagaccaaaggacagcatgatctgggactgcacctgcatcggcgctggaagggggagaatctcttgtactatcgcaaaccgctgtcatgagggtggccagagctacaaaattggagatacatggcggcgccctcacgagactggcggttacatgctggagtgtgtttgcttggggaacgggaagggcgagtggacgtgcaagccgatcgctgagaaatgttttgatcacgctgctggcacctcatacgtagttggagagacatgggaaaagccctaccagggttggatgatggtcgactgcacctgtttgggcgagggctcaggacgaattacctgtacctcacggaaccggtgtaacgatcaggacacacgtaccagctaccggatcggcgatacatggagcaaaaaggacaataggggtaatctgctgcagtgtatctgcaccggcaatggacggggagagtggaaatgcgaacggcatacaagcgtacagacgacatcttccggcagcgggccatttaccgatgttcgtgcagccgtgtatcagccacagcctcatccccagcctcctccatacgggcattgcgtgactgactccggggtagtgtatagcgtcggaatgcagtggctgaagacgcagggtaacaagcagatgctctgtacgtgtcttggaaacggggtcagttgtcaggagacagccgtgacccagacctatggcgggaattccaacggcgagccgtgcgttttacccttcacatacaatggacgaactttctactcatgtaccactgaggggcgccaggacggtcatttgtggtgttcaacaacaagcaattacgagcaagaccagaaatactctttctgcactgatcacaccgtgttagtgcagaccaggggagggaatagcaatggggcgttgtgtcattttccatttctgtacaataaccacaattatacagattgtacttctgagggcaggcgcgataacatgaagtggtgtggcacaactcaaaactatgacgccgaccagaagtttggtttctgccctatggctgcccatgaagaaatatgcacgaccaatgagggagtcatgtatagaatcggggatcagtgggacaagcagcacgatatggggcatatgatgcgctgcacctgcgtggggaatggcagaggcgaatggacctgtatagcgtacagccagctcagggaccagtgtatagtggatgacattacttataacgtcaacgatactttccacaagcgccacgaagagggacacatgctcaactgtacttgctttggacagggccggggtaggtggaagtgtgaccccgtcgatcagtgccaggatagtgagaccggcacattctaccaaatcggggactcttgggagaaatacgtccacggggttcggtatcagtgctactgctatggccgagggataggcgagtggcattgtcagcctctccagacttacccaagcagctctggcccagtcgaggtttttattacggagaccccctctcagcccaactcccaccccatccagtggaatgctcctcagccttcgcatattagcaaatatattctcaggtggaggcccaagaattccgtcgggcgttggaaagaggcaactatacccggccacctaaattcatacacgatcaaaggtctcaagcccggggtggtgtatgagggacaactgatcagcatccagcaatatggacatcaagaggtgacgagattcgattttacgacgacttcaacatctactcctgtcacttcaaatacagtgacaggcgaaacaaccccgtttagccccttagtggctacctcggagtcggtaaccgaaataacggctagcagttttgttgtctcgtgggtcagcgcatcggatactgtctctgggtttagggtggagtacgaactctctgaagaaggtgatgaaccccaatacctcgatctgcctagcactgccacttcggtaaacatacctgacctgctgcctgggcgcaaatatatcgtgaatgtgtatcagatctcagaagacggggaacagtccctaatcctctccacttcacagactactgctcctgatgctccaccagatacaacagtagaccaggtggacgatacgtcaatagtagtccggtggtcccggcctcaggctccaatcaccgggtatcggatagtgtattctccctctgtggaaggatcatctacagagctcaatttgcccgagactgccaacagcgttaccttgtctgacctgcagccgggtgtccaatataatataactatatacgctgtggaagagaaccaagagagcacacctgtggttatccagcaagagacaacagggacccctagatcagacacggtcccgtcacctcgggatctgcaatttgtggaggtgactgatgttaaagtcactattatgtggactcctccagagagcgccgttactgggtacagagtcgacgtgattcccgtgaacctgcccggggagcatgggcagcgcctccccataagccgcaacacctttgcggaggtgactgggcttagccccggcgtgacatattacttcaaagtgttcgcagtctcacatggtcgcgagagcaagcccctcacagctcaacaaacaactaaactcgatgctccaaccaacctgcaatttgtgaatgagacagactctactgtgctcgtgagatggacccctccaagagctcagatcactgggtatagattgactgttgggcttactaggcgcggccagccgagacaatacaacgtgggacctagtgtctcgaagtatccccttaggaatctccagcccgcatccgaatatacggtgagcctggtggccatcaagggtaaccaagagtccccaaaggcaacaggcgtgtttactactctgcagccggggagctctatccctccttacaatacggaggtgacggaaactaccatagtaataacgtggaccccagccccccggatcgggttcaaactgggtgtccgcccgtcccagggaggagaggcccctcgggaggtgacatccgatagcggcagtatagtcgtgtctgggctgaccccaggggtggagtacgtctacacgatccaggtgctgcgcgacgggcaggaacgcgacgcgccgattgtgaataaggtggtgactcctctttctcccccaactaaccttcatctggaggctaatcctgacaccggagtattgaccgtgtcttgggaacggtcgactacacccgatattaccggatatcggatcaccacaactccaaccaacggacagcaggggaactccctggaagaagtggtccatgccgatcagtccagctgtacttttgacaacctgagcccgggcctggagtataacgtgtcagtgtacacagtaaaggatgacaaggaaagtgtgccaatctctgacaccatcataccagccgtgcccccaccaaccgatctccgattcacaaatatcgggcccgatactatgcgcgtcacatgggcaccgccgccctctatcgatctgacgaactttctagtccggtactcacccgtcaaaaacgaagaggacgtcgccgaactgtccatttctccatctgacaatgccgtggtcttaaccaatttactgccaggcacagagtacgtggtatctgtctcttcggtctatgagcaacacgagagcacccccctgcgcggccggcagaagaccgggttggattcccctacagggattgacttttccgatataaccgctaacagttttaccgtccactggatcgcccccagagcaaccattacgggatataggatccggcatcatccagaacacttctccggccgaccccgggaagaccgcgtaccacacagtcggaatagcattaccctgacaaacctgacaccgggcaccgagtacgtcgtgtcaattgttgccctcaacggccgagaggagagcccacttctgataggccagcaatcgacagtttcagacgtgcctagagatctggaagtggttgcggctacacccacttccttgttaatctcctgggatgcccctgctgtaacagttcgctactatcgcatcacctatggagagactggcggaaactcacctgtgcaagagtttaccgtgcccggtagcaagtccacggctaccatctcaggccttaagccgggtgtggactatacgatcacggtatacgcggtgaccggccgcggggattcccctgccagctccaaacctataagcattaactatagaacagaaattgacaaaccttctcagatgcaggtgactgacgtgcaggacaactctatcagtgtgaaatggcttccttccagtagtcccgtcacgggctaccgtgttacaaccactcccaagaacggcccgggtcccactaaaactaaaaccgccggcccagatcagactgaaatgaccatagaaggacttcagccgacggtagaatatgtagtaagtgtgtatgcccagaatccatctggcgagtcccaaccattggtccagactgccgtgaccaccatccctgcgccaacagatctgaagtttacccaagttacccctacgagtctcagtgcgcagtggactcctcccaacgtgcagctcacaggatatagagtgcgcgtgactcctaaagagaagaccggtccgatgaaggaaatcaaccttgcgcctgactcaagctctgttgtcgtgagtggactgatggtcgcaactaaatatgaagtgagcgtgtatgcccttaaagatacattaacctccagaccggcccagggcgtggtcaccaccctcgagaatgtatcaccaccgcggagagctcgggtgactgacgccaccgaaactacaatcactataagctggcgcacaaaaacagagacaatcacaggttttcaagtagatgcagtccccgctaatgggcaaaccccaatccagcgtacaatcaagccggacgtccggagttacactattaccgggttacagccagggaccgactacaagatctatctatacactctcaacgacaacgcgaggagctcaccagtggtgattgacgcttccacggccatcgacgccccaagcaacctgcggttcctggcgactacacccaattcccttttggtgtcctggcagccccctagggctcggatcaccgggtacatcattaagtatgagaagcccggtagtcccccacgagaggttgttccaaggccaaggcctggagtgactgaggctaccatcaccggattggagcctggtactgagtataccatctacgtaatcgcattgaagaacaaccagaaatcggagcccctgatcgggaggaaaaagacgggccaagaggctctcagccagaccactatcagctgggcgccattccaggatactagtgagtacatcatctcctgtcaccctgtcggtaccgatgaggaaccattgcaattcagagtgcccggtacttctacctcagccaccctgactggtttaactaggggggccacttacaatgttattgtggaagcactcaaggaccagcagaggcataaagtgagagaagaggtggtgactgtaggcaacagcgtgaacgagggcctgaatcagcccacagatgattcttgtttcgacccttatacagtgagccactatgcagtaggcgatgaatgggagagaatgtccgaatcaggttttaagctgctctgccagtgtcttgggttcggttctgggcactttagatgtgacagctcaagatggtgtcacgacaacggtgttaattacaagataggtgaaaaatgggatcgccagggcgagaacggccagatgatgagctgcacctgtttgggcaacggaaagggtgaattcaaatgcgatccacatgaagccacctgttacgatgacggtaaaacctatcacgttggagagcagtggcagaaagaatatttgggggctatttgctcttgcacctgttttggtgggcagcggggctggcggtgcgataactgcaggaggcctggcggagagcccagtccagaaggtaccaccggtcaatcctataatcaatattcccaaaggtatcaccaacgcactaataccaatgtgaactgccccatcgagtgcttcatgccactggacgtgcaggcagacagggaggacagccgggagtag

SEQ ID NO: 24211 - DNA, 7161 bp, Artificial Sequence
  Description of Artificial Sequence: Synthetic coding sequence
atgctgcggggccccggccccggcctgctgctgctggccgtgcagtgtctcggtactgctgtgccgagcacaggggcttcgaagtcaaaaaggcaagcccagcagatggtgcagccgcagagccccgtcgcagtgagccagagcaagcctggatgctatgataatgggaagcattaccagattaaccagcagtgggagaggacctacttgggaaatgccctggtctgtacatgttacggaggctcaagaggattcaattgtgagagcaagccagaggcagaggagacgtgttttgacaaatatactggtaacacataccgggtgggggacacctatgagagaccaaaggattccatgatctgggactgtacttgcatcggggccggcagaggcagaattagttgcacgatagcaaatagatgccacgagggagggcagtcctacaagataggcgacacatggcggcgaccacatgagaccggtggatatatgttggaatgtgtttgtcttgggaacggaaagggagaatggacctgtaaaccaatcgccgagaaatgctttgatcacgctgcaggcacctcctacgttgttggtgaaacttgggagaaaccataccaggggtggatgatggtcgactgtacctgcctgggagaggggtctggccggatcacctgcacctcccgcaataggtgcaatgatcaagatacacgcacatcttaccgcattggcgacacatggagcaagaaggacaataggggtaacctactgcagtgtatatgcacaggaaatgggagaggtgagtggaagtgcgaacggcacacctctgttcagacgacctccagtgggtccggtccattcaccgacgtccgtgcggctgtgtaccagccccagccccatccgcagccgcccccctatggccattgtgtgacggactctggcgtggtttattcagtaggaatgcagtggcttaaaactcagggaaataagcagatgctgtgtacgtgtttgggcaatggcgtttcctgccaagaaactgcagtaacccagacatacggagggaattccaatggtgaaccttgtgtgctcccattcacatataatggccgtaccttctactcttgcaccacagaagggcgacaagacgggcacctatggtgttcaactacaagcaattatgagcaagatcagaaatatagcttctgcacagatcatactgtgttagtccagactcggggtggcaactctaacggcgctctgtgtcactttcccttcctctacaataatcacaactatacagactgtacctccgagggtagacgggacaatatgaaatggtgcggtaccacccagaattacgacgccgaccagaaatttggattttgccccatggccgcccatgaggagatttgcaccaccaatgaaggcgtaatgtataggatcggagaccagtgggacaaacaacatgacatggggcatatgatgcgatgtacatgcgttggtaacggtagaggcgaatggacatgtatcgcctattcccagctcagggaccagtgtattgttgacgacatcacgtataacgtgaacgacacgttccacaagaggcacgaagaagggcatatgctcaactgtacttgtttcgggcaggggagagggcgctggaagtgtgatccggtcgaccagtgtcaggactcggagactggcacattttaccagatcggtgactcctgggagaaatatgtgcatggtgtacgttatcaatgctactgttatggccgaggcatcggagaatggcattgtcagcccctccaaacctatccttcctcaagcggccctgtggaggtatttataaccgagacccctagtcaacctaactcccatcctattcaatggaatgctccccagccttcccacatttcaaaatacattctcaggtggcgccccaagaactcagtaggccgatggaaagaagccacaatcccgggccacttgaactcctacaccattaaagggctgaagccgggagtcgtctacgagggtcaactgatttccattcagcagtatgggcaccaggaagtgaccagattcgattttacaacaacatcaacttcgacaccagtcacatcgaatacagtgaccggcgaaaccactccgtttagtccactagtggcaacgagcgagagcgtcacagaaatcacggcgtcttcgtttgtcgtgagctgggtgagcgccagtgacaccgtatctgggttccgcgtggagtacgagttatcagaagagggagatgaaccacagtacctcgatctcccttctacagcaacgtccgtcaacatccccgatctgctgccaggccggaaatacatcgtcaacgtgtatcagatctcagaggatggggaacaatccttaattctttccactagtcagaccacagcgcctgacgcaccaccggatacaaccgtcgatcaagtggatgatactagtatagtggtgcggtggtcccgcccacaggctccgatcaccggttacagaattgtatactccccctcagtagaagggtcaagtactgaactcaaccttcctgagacagccaacagcgtcacactgagcgacctgcagcccggcgtgcagtacaatattacaatttatgccgtcgaagagaaccaagagtccacacccgtggtaattcagcaggagacaaccggcactcctcgttcagataccgttcctagcccccgtgacctgcagtttgtggaagtgaccgatgtgaaggtgaccataatgtggactcccccagagagtgcagtcaccgggtatcgtgttgacgtgatacctgtgaacttgcctggagaacacggccagagactgccaatctcccggaatacatttgcagaagtcacaggcctttctcccggggtgacatactactttaaagtgtttgctgtctcccacggcagggaatccaaacctctcaccgcacaacagacaaccaaactggacgcaccaacaaacctgcagttcgtcaatgaaacagattctacagtgctcgtgcggtggactcctcctagagcccaaattacaggctacaggcttacggtcggactgacgcggcggggccagccacgacaatacaatgtgggtccctcggtgagtaagtacccactgagaaatcttcagcctgcttctgagtacactgtgtctctggtggccattaagggcaatcaagagtccccaaaagccacaggagtgtttacaactctacagccaggatcctccattccgccttacaataccgaggtgactgagaccacaatcgtgattacctggactcccgctccccgcattgggtttaaattgggggtgagaccttcccaggggggtgaggctccacgggaagtgacatcggatagtgggtccatcgttgtgagtggcctgacccccggtgtcgaatacgtgtatactatccaggtgctaagggatgggcaagagcgggacgctcccatcgtgaacaaggtagtgacaccactgtcaccgccaacaaaccttcatcttgaagccaatcctgacacaggagtactgactgtgtcctgggagaggtcaacaactcctgacatcacaggctatagaattactactacccccacaaacgggcaacagggtaactcactcgaagaagtcgttcacgccgatcagtcaagctgcacattcgataacttgagcccaggcttggagtacaacgtttcagtttataccgtgaaggatgacaaggagtccgtccccatttccgatacaatcatccccgctgtgccccccccaaccgatcttagatttacaaatatcggccccgacacgatgcgagtcacgtgggcccctcctccgagtatagacctgacaaattttctggttcgctactccccggtcaaaaatgaggaagacgtcgctgaactttccatcagtccaagcgacaatgcagtcgtgcttactaatctgctccctggcacggaatacgtggtgtcagtgagctcagtgtatgaacagcacgagagtacgccactgagagggcgacagaaaactgggcttgacagccctacaggcatagacttttctgatatcactgccaatagttttactgtgcattggattgcaccaagagcgaccatcaccggctaccggataaggcaccatccagagcacttttccggacgaccgagagaagacagagttccccacagcagaaattctataacactcaccaatctaacacccggaaccgagtacgtcgtcagcattgtggctctcaacgggcgagaagagtcaccccttctgattgggcagcagagcacggtgagcgatgtccccagagatctggaggtggtcgctgcaacccctaccagtctgctcatttcatgggatgcaccagccgtaaccgtgcgttattatagaatcacttacggtgagaccggcgggaattcacctgtgcaagagttcaccgtccccgggagcaagtccaccgccacaatctcagggcttaagcccggtgttgactacaccattacagtgtatgccgttaccggtcgcggcgattctcctgctagttctaagccaatctcgatcaattaccgtacagaaatcgataagccgagccagatgcaggtgaccgatgtccaggacaactcaatcagtgtgaagtggctgccatctagctctcccgtcacaggttacagggtcactacaaccccaaagaacgggcccggccctaccaagaccaaaaccgctggacctgatcagactgagatgacgatcgaaggcctgcagccgacagttgaatatgtggtgagcgtctacgcacaaaacccttccggcgagtcccagccgttggtccagacagctgtgaccaatatagatcggcccaagggactggctttcacggacgtagacgtggactcgataaaaatcgcctgggagtcacctcagggccaggtgtcgaggtatagagttacctattcctctcccgaagatggcatacatgaactcttccccgcaccagatggcgaggaagatacggcggagctgcaggggcttcgacccggctccgaatacacagtctcggtggttgctctgcatgacgatatggaaagccagccactcattgggacacagagcacggccatcccggctcctaccgaccttaaatttacccaggtaacacctaccagcctgagtgcgcaatggaccccacctaatgtccagttgactgggtatagagtccgtgtgactcctaaggaaaagacagggcccatgaaagagattaacctggctcccgacagcagctctgtggtggtttcaggcctcatggttgcgacaaagtacgaggtgagtgtatatgccttaaaggacactctgacgtcgcgccctgctcaaggcgtcgtgactacactagagaatgtctctcccccgcgacgtgcacgcgttacagatgccacggagaccacaatcactatttcctggcgaaccaagacagagacaataaccgggttccaagtggacgccgttcccgcaaacgggcagacacctatccaacggacaatcaaacccgacgtgcggtcctacacgattacaggtctccagcccggcactgactacaaaatctatctctacaccctgaacgacaatgcaaggtcatcccctgtggttatcgatgcatcgactgcaattgatgcgccctcaaaccttaggttcctggccacaacccccaatagcctactggtcagttggcagccccccagagcccgcatcacggggtacattattaaatatgagaagccggggagcccgcccagagaggtcgtcccccggcctaggccaggcgtaacagaagccactataacaggattggagcctggaactgaatataccatctacgtcatagccctgaaaaataaccagaagagcgagccacttattgggaggaagaaaaccgacgagttgcctcaactggtaactctgccccacccaaacttacacgggcctgaaattctagatgtcccctctaccgtgcagaaaacaccatttgtaacgcaccctggctatgataccgggaacggaatccagctccccggaacatccggtcagcagccctcagtggggcaacagatgatcttcgaagaacacggcttcaggcgcaccaccccaccaactaccgctacccctatccgccataggcctcgaccctatccacctaacgtgggcgaagagatccagatcggacatatccccagggaggatgtcgattaccatctctaccctcacgggccgggactcaatccaaacgcttctactggccaggaagccctgtctcaaacaacgatcagctgggcccctttccaggacacctccgagtatattatttcttgtcaccccgtgggaaccgatgaggaacctctccagttcagagtgcccggaacaagcaccagcgccacactgactgggctgacacggggtgcaacctacaacgtaatagtagaagccctcaaggaccagcagcgccacaaggtgagggaggaggtggtgacggtgggaaactcagtgaacgaaggactcaatcaacccacagacgattcctgcttcgatccctacaccgtgtcccactacgctgtgggggatgaatgggagagaatgtcagaatctggcttcaaactgctatgccagtgccttggcttcggaagcggccattttcgctgtgacagttcacgttggtgtcacgataatggcgtgaactataaaatcggcgaaaaatgggaccgccagggggaaaatggccagatgatgtcatgtacatgtctaggaaacggcaagggcgagttcaagtgcgacccgcatgaagctacctgctacgacgatggcaaaacctaccacgtaggggagcagtggcagaaggagtatctgggagcgatctgctcatgcacctgtttcggcggtcaaagaggatggcgatgtgataactgtcgtcggcccggcggagagccaagcccagaaggaaccactgggcagagctataaccagtacagtcagcgctaccaccagaggaccaataccaacgtcaattgtcctattgagtgcttcatgcctctagatgtccaggcagaccgggaggatagtcgtgagtag

SEQ ID NO: 24212 - DNA, 6723 bp, Artificial Sequence
  Description of Artificial Sequence: Synthetic coding sequence
atgctgcggggccccggccccggcctgctgctgctggccgtgcagtgcctgggtacggccgtgcccagcaccggtgcttccaagtcaaaaagacaggcgcagcaaatggtgcagccccagtcccccgtcgccgtaagccagagtaaaccaggatgttatgacaatggcaagcattaccagataaatcagcagtgggagagaacatacttgggcaatgccttagtttgtacttgctacgggggatctcggggattcaattgtgaatcaaagcctgaagccgaagaaacttgctttgacaaatacaccggcaatacatatagggtgggagacacctacgagaggcctaaggactcaatgatctgggattgcacatgcattggcgcaggtcggggaaggatcagctgtaccattgccaaccgttgtcacgaaggcgggcaaagttataaaattggagacacctggaggcggcctcacgaaaccggtgggtatatgttggaatgcgtttgtctgggaaacggaaagggcgaatggacttgcaaacccatagcggagaaatgttttgaccatgctgccggaacttcctacgtggtcggtgaaacatgggagaaaccttaccagggatggatgatggtcgactgtacttgcctgggagaggggagcggtcggatcacctgtacttcccggaacagatgcaatgaccaggacacaagaacttcttatcggattggggacacatggtcgaaaaaggacaatcgtggcaacctgttacaatgtatttgtaccggcaacggtcgcggcgagtggaaatgtgaacgccacacaagtgtccagactactagctctggcagcggccccttcactgacgtgagggcagctgtttaccagcctcagcctcacccgcaaccccctccctatggacattgtgtgaccgatagtggggtggtgtactctgttggcatgcaatggctgaaaactcagggcaataagcagatgctctgtacctgcctaggcaatggagtttcttgccaggagaccgccgtgacacaaacgtacggaggcaatagtaacggcgaaccttgtgttctccccttcacctacaatggccggacattttatagctgtaccaccgaaggtcgacaggatggccacctgtggtgttctaccacgtccaactacgagcaggaccaaaagtattccttttgcactgaccatactgtccttgtccaaacaagggggggcaatagcaatggagcactgtgccacttcccctttctatataataatcacaactacacagactgtacttccgagggacggcgtgacaatatgaaatggtgtggcacgacgcaaaactacgacgccgatcagaaattcggcttttgcccgatggcagctcacgaggaaatctgcacgacaaacgagggcgtgatgtataggataggcgaccaatgggacaagcagcacgacatgggtcacatgatgagatgcacctgcgtcgggaatggcagaggcgagtggacttgcatagcatattctcagcttagggatcagtgtatagtggatgacatcacatacaatgtaaacgacactttccacaagaggcatgaggaaggacacatgttgaattgtacctgtttcggacagggccgcggacgatggaagtgtgatcctgtggatcagtgccaggactccgaaaccgggactttttaccagatcggagatagctgggaaaaatacgtgcacggcgtgcgctatcaatgttattgttacgggcgtggcatcggggagtggcattgtcagccactgcagacctatccctcatctagcggccccgtcgaggtcttcatcacggagaccccgagccagccaaattctcacccgattcaatggaatgcgccacagccttcacatatctctaagtacatactaagatggcggcctaaaaactctgttggccggtggaaggaggccacaatccccggtcacctgaacagttatactatcaaggggctaaaaccaggggttgtgtacgaaggtcagctcatttccatacagcagtatgggcaccaggaggttacccggtttgacttcacaactacttccacttctaccccagtgacttcaaataccgtaactggcgaaaccaccccattttcacccctggtggctacaagtgagagtgtaacagaaatcacagcttctagttttgttgtcagctgggtgtcggcgtctgacaccgttagcggttttagggtcgaatacgagctgtctgaggagggcgacgagccacaataccttgatctcccatccaccgccacctcagtcaacattccagatctgctgccagggcggaagtacattgttaatgtctatcagatttccgaggacggggaacaatccctcatcctgtctacgtcccagactacagcccctgacgcccctccggatactacagtagatcaggtggatgacaccagcatcgtggtccggtggtcacgcccacaggcccccattaccgggtaccggatagtgtacagcccttccgtagagggctccagtacggagctgaaccttcctgaaacagcgaatagcgtgaccctgtccgatttgcaacccggcgtacaatacaacatcacaatttatgccgtagaggaaaatcaggagagcacccccgttgtgatccagcaagagaccacaggaacccctaggagcgatacagtccccagcccccgggacctacaatttgtcgaggtgacagatgttaaagtgacaataatgtggaccccaccagagtctgcagtaacgggatatcgggtcgatgtcatcccagtcaacctcccgggggaacatggccagaggctccccatttcccgtaacacttttgcagaagtcactggccttagtcctggagtcacatactacttcaaggtgtttgccgtgtcgcatgggcgggagtctaaacctttgaccgcacagcaaaccaccaagctcgacgcacccactaacttacagttcgtgaacgaaactgacagtacggtgttggttcggtggaccccacccagggctcaaatcaccggctatagactgacagtgggactcacaagacgtggccaaccccgtcagtataatgtgggcccctccgtttccaaataccccctccggaatctgcaacccgccagcgagtacaccgtctctctcgtcgccattaaaggaaatcaggagtcacctaaagcaaccggcgtcttcaccactttacagcccggctcaagcattccgccgtacaacaccgaggtgaccgagactactatcgtcataacctggacccccgcaccccggattggattcaaactaggggtgagaccctctcagggtggagaggctcccagagaggtgacctccgatagcggatcaattgtcgtgagcggcctcaccccaggtgtggaatatgtctatactatccaggtgttgagggacggccaggagcgggatgctccaatcgtgaataaggtggtgactccccttagtcccccaaccaacctacacttggaggcaaacccggatactggggtacttaccgtgagctgggaacggagtacaactcctgatattacgggctatcggatcacgacaacgcctaccaacggacaacagggcaatagcctcgaggaggtggtgcacgccgatcagagctcctgtacctttgacaatctgagccctggtttagagtataacgtgtctgtgtatacagtcaaagacgacaaggagtcagtcccaatttctgatacgataatcccggcagttcctccaccgaccgacctgaggtttactaacatcggccctgacaccatgcgagtgacttgggcccctcccccttccatcgatctgacaaattttttggtacgatattcccccgtgaaaaacgaggaggacgtggcagaactttcgatctcaccctcggataatgctgtggtgctcaccaatctgctcccgggaaccgagtacgtcgttagcgttagcagtgtatacgagcaacacgagagcacacctctccgtggcaggcagaaaaccggactggactcaccaacgggcatagatttttcagacataacggcaaattcttttacagtgcactggattgcccccagagcaactattaccgggtaccgaatccgacaccatccagaacatttcagtggacgaccacgcgaggatcgagttccccactcgcgaaactcaattaccctgactaatctgacacctggaacagagtacgttgtcagcatcgtggctctgaacggccgtgaagaaagccctctcctcattgggcagcaaagcacagtgtctgacgtgccccgtgacctcgaagtcgtggccgccaccccaacatcattgctgatctcgtgggatgctcctgctgttaccgttcgctattaccgaattacgtatggtgaaactggaggcaacagcccggtgcaggaatttacggtccctggaagcaaatctacagctaccatttcgggcttaaaacccggggtggattatacaatcacagtgtatgctgtgactggacgaggtgatagtcccgcaagctctaagcccatctcaataaattatcgaacggagattgataaacctagccaaatgcaagtgaccgacgttcaggataattctatcagcgtcaagtggctgccttcctctagccctgtaactgggtatcgcgtgactaccacccccaagaatggaccaggtcccaccaaaacaaaaacagccggccctgaccagacagaaatgactattgaggggctgcagcctaccgtagaatacgtagtgagcgtgtacgctcaaaatccttcgggcgagtctcaacccctcgtgcagacagccgtcaccacaatccccgccccaaccgatttaaaattcacgcaagttactccaacatcactttccgcccagtggacacccccaaacgtacagctgacaggttaccgcgtacgagtaacaccgaaggagaagacagggcccatgaaagaaattaatttggccccagacagctcctctgtggtcgtgtctggacttatggtcgccaccaagtatgaggtaagtgtctatgctctcaaggatactttgacaagcagacccgcgcagggggtggtcaccaccctggagaacgtctcccctcctcgacgtgctagagtgaccgacgcaaccgagaccactatcaccataagttggaggactaagacagaaaccatcaccggattccaggtggacgcggttcccgctaacggccaaaccccaattcagagaacaattaaacctgatgtccggagctacaccattactggcctgcagcctgggaccgactacaagatttacctgtacaccctgaacgataacgctagaagctcccctgtggtgatcgacgcatccaccgctatagacgctccttccaatctccgcttcttggccacaactcccaatagcttgctcgttagttggcagccaccccgcgcccgcattacagggtatattataaagtacgaaaagcctggctccccaccccgagaggtcgtgccccggccaagaccaggtgtcaccgaggctactattaccgggctggaaccagggacggagtacactatttacgttatcgcattgaagaataaccagaagagcgagccccttatcggacggaagaaaacagtacaaaagaccccttttgtcactcacccaggctacgatacaggcaacggtatccagttgcccggcacatctgggcagcagccgtctgtggggcagcagatgatctttgaagaacacggtttcagaagaaccacaccgccaaccacggccacccccatcaggcatcggcctaggccctaccctcccaacgtcgggcaagaagccttgtctcagaccacaattagttgggccccattccaagatacttcagagtacataatttcctgccatccagtgggaacggatgaggagcccctgcagttccgggttccaggtacgagtacatctgcaactttgaccggtctgaccagaggcgccacatacaacgttatcgtagaggccctaaaggaccagcagaggcataaagtgcgcgaggaggttgttactgtgggtaactcagtcaacgagggactcaaccagcccaccgacgatagctgttttgacccatatactgtgtcacactacgccgtcggagatgagtgggagagaatgtcagaatccggattcaaactcctgtgtcaatgtttgggcttcgggagcggacatttccgatgtgatagttcacgttggtgccacgataatggagtgaattataagattggagagaaatgggacaggcagggtgagaatggacaaatgatgagctgtacctgcttgggaaatggaaaaggagaatttaaatgcgatccccacgaagcgacctgctacgatgacggcaaaacctatcacgtaggcgagcagtggcagaaggagtacctgggcgcgatctgctcctgcacgtgttttggaggtcaacgtggttggcgatgcgataactgccgcagacccggcggcgagccatctcccgaaggaacgactgggcagagctacaatcagtactcacaaagatatcaccagcggactaataccaacgtgaactgccccatcgagtgctttatgcctctagatgtgcaggccgatcgggaggactcccgagagtag

SEQ ID NO: 24213 - DNA, 1974 bp, Artificial Sequence
  Description of Artificial Sequence: Synthetic coding sequence
atgctgcggggccccggccccggcctgctgctgctggccgtgcagtgtctcggtactgctgttcccagcaccggcgctagcaagtcaaagaggcaagcccaacagatggttcaaccacagagtcccgtggccgtgtcccagtccaagccagggtgctatgacaacggcaaacactatcagatcaaccaacagtgggagcggacctacttggggaatgccctagtgtgcacatgctacggcggctccagagggtttaactgcgagagtaagccagaagccgaggagacatgcttcgataagtacaccggcaatacttatcgggtcggagatacatatgagcggccgaaggactccatgatctgggactgtacgtgcatcggcgcagggcggggcagaataagttgcactattgccaatagatgccacgagggcggtcaatcctataagatcggagacacctggcggaggccccacgagacaggaggctatatgttagagtgtgtgtgtctggggaacggaaaaggagaatggacatgtaagccaatcgcagaaaaatgtttcgaccatgccgcaggaacttcgtacgttgttggcgaaacatgggaaaagccctaccaggggtggatgatggtggattgcacatgtttaggtgaaggcagcggccgaattacgtgtactagcagaaataggtgcaacgaccaggatacgcgcactagttaccgcataggagacacatggagtaaaaaagataatagagggaacctgttacagtgtatatgcacaggaaacggacgaggcgagtggaaatgcgaaaggcacacttcagtgcagaccaccagctccggcagcgggcccttcacagacgtccgcgctgccgtgtatcagccccagcctcatccacagccgccaccttatgggcactgtgttactgatagcggcgtggtgtattctgttggcatgcaatggctcaagacacagggaaacaaacaaatgctctgcacatgtctcggtaatggtgtaagctgtcaggaaaccgccgtcacgcagacctatggtgggaatagcaatggcgagccctgcgtgctccctttcacatataacgggagaactttctactcctgtactacggaaggacggcaggacggtcatctctggtgttcaacaacatccaattatgaacaggatcaaaaatactccttctgtaccgaccacactgtgctcgtccagaccagaggtggcaactcgaatggggcgctttgtcattttccctttctgtataataatcataactatacggactgtacgtccgaaggacggagagataatatgaagtggtgtgggacaactcaaaattatgacgccgatcagaaattcggattttgtcctatggctgcccatgaggagatttgcaccacgaacgagggagtgatgtatcgaatcggggatcagtgggacaagcagcacgacatgggacatatgatgcggtgtacttgtgtggggaacggtcgtggcgaatggacctgtattgcttatagtcagctacgcgatcagtgtattgtggacgatataacatataatgtgaatgatacctttcacaagcgccacgaagaaggccacatgctcaattgcacttgtttcggtcaggggcgaggccggtggaagtgtgatcctgtcgaccagtgtcaggactcagaaacaggaactttctatcagattggtgacagttgggagaagtatgtgcacggagtccgttaccaatgttactgctacggccgtggcattggcgagtggcattgccagcccctgcagacataccctagcagttccggacctgtggaggtgttcataactgaaaccccctcccagcctaactcacaccctattcagtggaacgcgcctcagccttcacacatctctaaatatattctgaggtggcgcccagtgtccatccccccccggaacctcggttattag

SEQ ID NO: 24214 - DNA, 6804 bp, Artificial Sequence
  Description of Artificial Sequence: Synthetic coding sequence
atgctgcggggccccggccccggcctgctgctgctggccgtgcagtgcctcgggaccgctgtacctagcacaggtgcatctaaaagcaagcggcaggcacagcaaatggttcagcctcaaagtccggtagctgtcagccagagtaaacctgggtgttacgacaatggaaagcactatcagatcaaccagcagtgggaacgcacatacctcggcaatgccctcgtttgcacctgctatggcggcagtagaggatttaattgtgaaagtaaacccgaggccgaagagacatgtttcgataagtatactggaaatacttatcgggtgggtgacacctatgaaagaccaaaagatagtatgatttgggactgcacctgcataggggccggccgcggtcggatcagctgcacaattgccaataggtgccacgaaggtgggcaaagctataagatcggagacacgtggcggcggcctcatgagactggtggctacatgctggagtgcgtctgcctggggaatggaaagggtgaatggacctgcaaaccgatcgctgaaaaatgttttgaccacgccgccgggaccagctacgtggtgggagagacttgggaaaaaccctatcagggctggatgatggttgactgtacctgtctcggagagggaagcggaaggatcacgtgcacttcacgaaaccgctgcaatgatcaggacaccagaacgtcatatcgcattggcgacacatggagcaagaaagacaatagaggcaatctgttgcagtgcatctgcacaggcaatggaagaggcgagtggaaatgtgagcggcacacttcagtccaaacaacctcatcgggcagcgggccatttaccgatgtaagggctgcagtctatcagccacaaccccacccgcagccccctccctacggccattgcgtgactgatagcggtgtggtgtacagcgtgggcatgcagtggctgaagactcaggggaataagcagatgttatgcacgtgtttaggcaatggggtgtcttgtcaggaaaccgcagtgacccaaacatatgggggaaacagcaatggcgagccgtgtgtgctaccgttcacatataatggaaggactttttattcgtgtactaccgaaggaagacaggacggccacctttggtgcagtactaccagtaactatgaacaagatcagaaatattcattctgcaccgatcacacggtcctagtccagactagaggcggaaatagcaatggcgccctatgccattttcccttcttgtacaacaaccacaattacacagattgcaccagcgagggtcgcagagacaacatgaagtggtgcggaactactcagaattacgacgccgaccagaaattcggcttttgccccatggcggcacacgaggagatttgcaccactaacgaaggggtaatgtaccgaatcggggatcagtgggataaacagcacgatatggggcacatgatgcggtgcacctgcgtcgggaatgggcgcggagaatggacatgcatagcttacagtcagctgcgggaccagtgtatcgtggacgacataacttataatgtgaatgacacatttcataaacgacatgaggaggggcatatgctaaactgcacctgtttcggtcaggggcgtgggcgatggaaatgtgaccctgtggaccagtgtcaggactccgaaacagggaccttctaccagattggcgacagctgggaaaaatacgtgcatggagttcgctaccagtgctactgctacgggcggggtattggtgagtggcactgccaaccgctgcagacatacccaagctcgagcggccccgttgaggtgttcattacagaaactccgtctcagccaaacagccacccgatccaatggaatgcacctcagccttctcatatttctaagtatatcctcaggtggagacccaagaattccgtgggtcgctggaaagaagccacaattcctggccaccttaattcgtacactatcaagggactgaaacccggggtggtgtacgaaggacaactcatctctatccaacaatatggtcaccaagaggttacacgcttcgattttacgaccaccagtacatccactcctgtaacttctaacacagtgacaggggagactacaccattttcccccctggtcgccactagtgaaagcgtcactgagattacagcctcgagcttcgtggtgtcttgggtctccgcaagtgataccgttagtggctttagggtggagtacgagctgtccgaagaaggagacgagcctcagtacctggaccttccgtccacagctacttctgttaacatcccagacttgctgcctggtagaaagtacattgtgaatgtatatcagattagcgaggacggagagcaatccctgattttatctacttctcaaacgactgcgccagacgccccacctgatacaactgttgatcaggttgatgacacttcaatcgttgtgcgttggagcaggccacaggctccaataacgggctatagaatcgtatacagtcccagtgttgagggttccagcacggagttgaatttaccagagactgccaacagcgtgaccctttccgatctccagccaggcgttcaatacaacattactatttacgccgtcgaagagaatcaggagtcgacccccgtggtaattcaacaggagaccacaggaactccgcgcagtgacaccgttcccagccctagggatcttcagttcgtagaagtgaccgatgtgaaagtgaccatcatgtggactccaccagagagcgcggtgacgggctatcgggttgatgtaattcccgtcaacctaccaggggagcatggccagcgcctcccaatttcaaggaacacgtttgctgaggttacaggactcagccctggcgtgacgtactactttaaggtgttcgccgtctcccacgggcgggaatccaagcccctgacggctcagcagaccactaagctggatgcccctactaacttgcagttcgtgaacgaaacagacagtaccgttctcgtgcgttggacccctcctagagcacagattaccggataccggttgactgtaggactcacccgcaggggtcaacccagacagtacaatgtagggcctagcgtttccaagtatccactgagaaacttacagcccgcaagcgagtatacagtgtccctggtcgccatcaaggggaaccaagaatcacctaaagctactggcgtgtttacaactctccaacccggctcttcaatccccccatacaatacagaggttaccgagacaactatcgttattacgtggacccccgctccaagaatcgggttcaaactcggagtacgcccaagccagggcggagaggctccacgtgaagtcacttctgattccggctcaatagttgtgagtggactgacacctggagtagagtacgtgtacactatccaggtactccgggacgggcaagagagggatgcaccaattgtgaataaagtcgtaacaccactctcccccccgactaacttacaccttgaagctaatccagacacaggtgtgctaacagtgtcatgggagcggtccacaactccagatatcacaggatatagaatcacaaccactccaaccaacggacagcagggtaacagtctggaagaagtcgtgcatgctgaccagtctagttgcaccttcgataatctgagccctggactagaatacaacgtttctgtctataccgtgaaagacgataaagagtcggtaccgatcagcgacacaatcatcccagaagttccacagctaaccgaccttagctttgtcgatatcacagattcctctattggactcaggtggacacctttgaacagctccacgattatcggttaccgcattaccgtggtagctgccggcgagggtattcccattttcgaagacttcgtggatagcagcgttggatattatactgtgactggccttgaaccaggtattgactacgacattagcgtgataacactgataaatgggggggagagtgcgcccaccaccctcacccagcaaacagctgttccacccccgacagacttgcggttcactaacattggaccggacacaatgcgggtgacctgggcacctccaccttctatcgacctcaccaacttcctcgtgcggtattccccagtgaagaatgaggaagacgttgccgagctgtcaatctccccttcagataatgcagtcgtgctcactaaccttctgcctggtaccgagtatgtagtgtccgtcagctccgtttatgaacagcatgagtccacgcccctcagagggagacagaagactggcttggatagcccaaccggaatagatttctccgatattactgcaaatagctttactgtacactggatcgcccctcgcgccacgatcactggctacagaattagacatcacccagagcatttctccggcaggccccgggaggaccgggttccccacagccgaaactccattacattgactaatttaactcccggaacggagtacgtggtgtctatcgtggccctaaatggtcgggaagagagtcctctactgattggccagcagtcaacagtctccgacgtccctagagatttggaggtcgtcgcagccactcctacatccctgctgattagctgggatgctcccgctgttaccgttcggtattacagaattacatacggggaaaccgggggcaactcgcccgtgcaggaattcaccgtgcccggaagcaagtccaccgctactatctctggcctcaagcccggagttgattataccatcacagtctacgctgtgacaggtcggggggattccccagcctcatccaagccaatttcaattaattaccgcaccgaaatcgataagccaagtcagatgcaggtgacggacgtgcaggacaacagcatctccgttaagtggctgccatccagtagtccagttactggttaccgggtcaccacaactccgaagaacgggcctgggcctacaaaaaccaaaactgcaggccccgatcagaccgagatgacgatcgaaggtcttcagccaactgtggaatacgtcgtttccgtttatgcgcaaaatcccagcggagagagccagcccctagtgcagactgccgttacaacgatccccgcgcctaccgatctcaaatttacacaggtcaccccgacatccctatcagcacaatggacacccccgaacgtgcagctcaccgggtatagagttagagttaccccaaaggagaagaccggtcccatgaaagagatcaatctggctcccgactcatcttcggtggtcgttagcggcctgatggtggcgacaaaatacgaggtgagtgtttacgccctgaaggataccctgacgtcacgccctgctcaaggcgttgtcactaccttagaaaacgtatctcctcccaggcgcgcgagagtgaccgacgccaccgagaccactatcaccatttcgtggcgcacaaagactgagacaattaccggtttccaggtggatgccgttcctgccaacgggcagacgccaattcagcggactattaagcccgacgtgcgtagctatacaataactggactccagccaggcactgattacaagatctacctgtacacactcaacgacaacgccagatcctccccagtcgttatcgatgcttctacggctatagatgctcctagtaacttacggtttctggctacaacacccaattcactgcttgtctcatggcaaccaccaagagcccgaattactggctacattatcaagtatgaaaagccgggatctcctccacgggaagttgtgccccggcctcgccccggggtgacggaggcgaccataacagggctggaacctggaaccgaatacaccatttatgtgatcgctctcaagaacaaccagaagtccgaaccgctgatcggccgcaagaagaccggccaagaagccctttcccaaacaaccatttcgtgggccccattccaggatacatcagaatatatcatttcatgtcatcccgtcggaactgatgaagaaccattgcagtttcgcgtccctggtacctccacctccgcgactcttaccggacttactaggggcgccacatacaacgttatcgtggaggcccttaaagatcagcagagacacaaggtacgggaggaagtcgtgacagtgggcaactccgtcaacgaaggtcttaaccaacccactgacgactcctgcttcgacccttacactgtctcccactacgcagtcggcgacgagtgggagagaatgtcagagtcaggctttaagctgctgtgtcagtgtctgggcttcggcagcgggcattttcgatgcgacagtagccggtggtgtcatgataatggtgtgaactacaaaattggagagaaatgggacagacaaggcgaaaatggtcagatgatgagttgcacctgccttgggaacggcaagggcgaatttaagtgtgatccacatgaggctacttgttacgatgacggcaaaacatatcatgtgggtgaacagtggcagaaggaatacctcggggctatttgctcctgtacctgcttcggagggcagcgcgggtggaggtgcgataattgtcgacgaccaggtggtgagcccagtcctgagggcacaaccgggcaatcctacaatcagtactctcaaagataccaccagcgaactaatacaaacgtgaactgtcccatcgagtgcttcatgcccttggatgtccaggctgatagagaggatagccgagaatag

SEQ ID NO: 24215 - DNA, 6798 bp, Artificial Sequence
  Description of Artificial Sequence: Synthetic coding sequence
atgctgcggggccccggccccggcctgctgctgctggccgtgcagtgtcttggcaccgcggtgccttctaccggtgctagtaaatctaaaagacaggcacagcaaatggttcagccacagtccccggttgctgtgagtcagtcaaagccaggatgttacgataacgggaagcattaccagatcaaccagcagtgggaacggacgtatctgggaaatgctctggtgtgtacctgctatggcggttcacggggctttaattgtgagagcaaacccgaagcggaggaaacttgcttcgacaagtacaccggcaacacgtatagagtcggggatacgtacgaacgccctaaagactcgatgatctgggattgtacctgcatcggcgccggcaggggcagaatcagctgtacaattgcaaacagatgccacgagggcggccaaagctataaaattggggacacctggagaaggccccacgaaaccggaggctacatgctcgaatgcgtgtgtttggggaatggtaagggcgagtggacatgtaagccgatcgcagagaagtgcttcgatcacgccgctggaactagctacgttgtaggggagacatgggaaaagccttatcaagggtggatgatggtggactgtacgtgcctgggagagggttcaggtaggatcacctgcactagccgtaaccggtgtaacgaccaggataccagaacttcttacagaattggggacacatggtcaaagaaagataaccgtggcaacctactccaatgtatctgcacaggcaatgggaggggtgagtggaaatgtgaacggcacactagcgtgcagaccacctcctctggttctgggccattcacagacgtgagagcggcagtgtaccagccacaaccacatccccagcctccaccctatggccactgtgtcactgactccggagtggtctatagtgttggtatgcagtggctcaagactcaggggaacaagcagatgctctgtacatgtctgggtaacggcgtaagctgtcaggagactgccgtgactcagacttatggcggcaattcaaatggtgagccctgcgtgttaccattcacctataatggccgcaccttttactcctgcactactgagggtaggcaggatgggcacctgtggtgttctactaccagcaattatgaacaggaccagaagtattccttctgcaccgatcatacggtcctggtgcagacccgcggagggaatagtaatggagcgctctgtcatttcccattcctgtacaataatcacaattacactgactgcacctctgaaggcagacgtgacaatatgaagtggtgcggtactacccaaaactacgatgccgatcagaaattcgggttctgccccatggccgcacatgaggaaatatgcacgaccaatgagggtgttatgtatcgtattggcgatcagtgggataaacaacatgacatgggtcacatgatgaggtgcacatgcgtcggaaacgggagaggggagtggacatgtattgcttattctcagctgcgggatcagtgtatagtggacgacataacctataatgtaaacgatacgtttcataaaagacacgaggaaggtcacatgctcaactgcacctgctttggtcaaggcaggggccgatggaagtgcgaccccgttgaccagtgtcaagacagcgagacggggactttctaccaaattggcgacagttgggagaaatacgtgcatggagtgagataccagtgttactgttatggccgcggcattggagagtggcattgccagccactgcaaacatacccctctagttcaggaccagtcgaggtgttcatcaccgaaacaccctcccagccaaacagtcatcccattcagtggaatgccccacaaccgagtcatatcagcaagtacatcctcagatggcggcccaagaactctgtgggaagatggaaggaagccaccattcctggtcacttaaactcttacacaatcaagggcctcaaaccgggtgtggtatacgaggggcagctcatctcaatacagcagtacggtcaccaggaggtaaccagattcgactttacaaccactagtacatctacccccgtgaccagcaatacggtgactggcgaaaccactcccttttcaccattggtggcaacatccgagtcagtgacagagatcactgcctcttcgtttgttgtgtcgtgggtgagtgccagcgataccgtgtctggcttccgggtggagtacgagctgagtgaagagggtgacgagcctcagtaccttgacctgccaagcacagccacatccgtcaacatcccagatctgctccctgggagaaagtacatcgtgaacgtataccagatctctgaagacggggagcagagcttgattctgtccacgagccagaccaccgctcctgacgctccgccggacactacagtagaccaagtggacgacacgagtattgtggtcaggtggtcccgcccccaagctccaatcactggatatcgtattgtctacagtcccagcgtggagggcagtagcaccgagctgaatctgcctgaaactgccaatagcgtgactctctctgacctccaacctggggttcaatacaacattacgatctacgcggtggaagagaatcaggaaagtacccccgttgtgatccagcaagagactacaggcactcctcgatctgacacagtgccctcaccaagggatctgcagtttgtcgaggttaccgatgtgaaagtcactattatgtggacgcctccagaatcggctgttaccggttacagggtggatgtcatccctgtcaatctccctggagagcacggacagaggcttcctatcagccgaaatactttcgcagaggtgactggcctttctccaggcgtaacctattattttaaagtattcgctgtgtctcatgggagagaaagcaagcctctgactgcccagcaaactaccaagctggatgcaccaaccaacctgcaatttgtgaacgagaccgattcaacagtgttggtgcggtggacaccacctcgggcgcagataacagggtacagactcactgtagggctcacccgccgcggccagccaagacagtacaatgtcggcccgtcagtctccaagtatccattacggaacctgcagccggcctccgaatatactgtgtctctcgtcgctattaaggggaaccaggaatcccctaaagctaccggagtgtttacaacgctgcaacccggcagctccattccaccttataataccgaagtcaccgaaacaaccattgtcatcacctggactcccgcaccccggattgggtttaaactgggcgtcaggcctagccagggaggcgaggcaccccgggaagtcacctccgattctggctcgattgtggtatcgggcctgacacccggagtggagtatgtgtatacaattcaggtgcttagagatggacaggaaagagatgcgccaatagttaacaaggtcgttactcccctgtcaccccctaccaatctgcatctagaggctaatccggacactggcgtcttgacggtgagctgggagagaagtacgacacccgacatcactggctaccggataaccactaccccaacaaatgggcagcagggaaacagtctcgaggaggtggtgcacgctgaccagagttcttgcacgtttgacaacctctctcctgggctggaatataacgtgagcgtgtacaccgtgaaggatgacaaagagtcggttcctattagcgataccatcattcctgcagtccctccaccaacggatctgcgcttcaccaatatagggcctgatactatgagagtaacctgggcgcctcctccctcaattgatctgactaatttcctggtgcgctactcccctgtgaagaacgaggaagatgtcgccgagctcagtattagtccttccgacaacgcagttgttctaacgaacctgctgccaggcacagaatatgttgtctctgtcagcagcgtgtatgagcagcatgagagcacacctcttagaggtcggcagaaaaccgggctggattctcccactggtattgatttcagtgacatcacagccaacagcttcactgtccactggatcgccccaagagccacaattaccggataccgaatcagacaccatccggaacacttctccggccggccgagagaagacagggtgccgcattctagaaactccatcacactcacaaatttaacaccgggaacagagtacgtggtgtccatcgttgctctcaacggccgcgaagagtcacctcttctcatcggccagcagtctaccgtctctgatgtacctcgggatttggaggtggttgctgccactcctactagcctgctgataagttgggacgccccagcagtgactgtgcgatactatcggatcacctacggagagacaggcggcaactcccctgtccaggagttcacagtgccagggtcgaagtctacagcaaccatcagcggactcaaaccaggcgtggactacacaataactgtgtatgctgtgactggcagaggtgattctcccgcaagctctaagccgattagcattaactatcgtacggagatcgataagccatcccagatgcaagttacagatgtgcaggataactctatcagtgtgaaatggcttccatcatcttcacctgtgactggttatagggtgacaacaacacctaaaaacggacccggcccgaccaagacgaagactgctggtcccgatcagacagaaatgaccatcgagggcctacagcccactgtggagtacgtcgtgtcagtttacgcacagaatccgtccggcgagtcacagccacttgtccagacggccgttaccacaattccagctccgaccgatctcaagttcacccaggtcacaccaactagtttatcggcccagtggactcccccgaatgtgcaactgactgggtatcgggtcagggttactcccaaggagaaaacgggtcccatgaaagagattaacctcgctccggattctagctcagtggtggtatccggcctgatggtagccacaaaatatgaagtatcagtgtacgctctaaaggacactctaactagccgccctgcacagggggttgtgacgactcttgagaatgtatctccgccgagacgagcacgagttaccgatgccaccgaaaccactatcactattagctggaggactaagactgaaaccattaccggtttccaggtggacgctgtccccgctaatggccagacgcctattcagcggactattaaacccgacgtcaggtcttacactatcaccggcctgcaaccagggactgattacaagatctatctgtacaccctcaatgacaatgctagatcatcgcctgtggtaatcgacgccagtactgctatagatgcgccctcaaacctacgctttctcgcaacaactcccaacagcctcctcgtcagctggcaacctccacgcgccaggataaccggctacattattaagtatgaaaagcctgggtccccccctcgggaggtggtcccaaggccaaggcccggagtcaccgaagccacgatcacagggttggagcccggaacagagtacaccatttacgttatcgccttaaagaacaatcagaagagcgagcccctgattggaaggaagaaaacagatgaactaccacaactggttactcttccacacccaaatctccatgggcccgaaatactggatgtcccctctacagtgcagaaaacacctttcgtgacacaccccggctacgataccgggaatggaatccaactccctgggacttccggacagcagccatctgtaggtcaacagatgattttcgaggagcacggattccgtcggactactcccccgaccactgcaaccccaatccgccacaggccgaggccctatccgcctaacgtgggccaggaagctctgtcccagaccacaatttcttgggccccttttcaggatactagcgaatatattattagctgccatcctgtgggcactgacgaggagccactccagtttagagtccccggaacttcaacgagtgccacactgactggtctgacgaggggagctacgtacaacgtcatcgttgaagccctgaaagaccagcagcgacacaaggttcgcgaggaagttgtaaccgtaggcaattctgtgaacgaggggttaaaccaacctacggatgatagctgtttcgatccatacaccgtgtctcactacgccgtgggagacgaatgggaacggatgagtgagtcagggtttaaacttctgtgccagtgtctgggcttcggcagcggccactttaggtgcgattcctcacggtggtgtcatgataacggagtgaattacaaaattggcgagaagtgggataggcaaggggagaacggccagatgatgagctgtacgtgcctcgggaacggtaaaggagagtttaagtgcgaccctcacgaggctacctgctatgatgatggcaagacatatcacgtgggtgaacagtggcaaaaggaataccttggcgcaatttgcagctgtacttgtttcggcgggcaacgcggttggaggtgcgacaactgcagacggcccgggggcgagccttcccctgagggtactaccggccaaagctacaaccaatattctcagaggtaccaccaacgcacaaataccaacgtcaattgtcctattgaatgtttcatgcctcttgacgtgcaagcagatcgggaagacagccgggagtag

SEQ ID NO: 24216 - DNA, 6993 bp, Artificial Sequence
  Description of Artificial Sequence: Synthetic coding sequence
atgctgcggggccccggccccggcctgctgctgctggccgtgcagtgtttagggacagctgttcctagtaccggagcctccaagtctaagcgccaagcccagcagatggtgcagccacagtcccctgtcgctgtttcacaaagtaagccaggttgttatgacaatggcaaacattaccagataaaccaacaatgggagagaacttacttagggaacgccctcgtgtgcacgtgttacggcggcagccgcgggttcaattgtgaaagcaaaccggaagccgaggagacatgttttgataagtacacaggcaacacatatagggtgggcgatacctacgaaaggccgaaagacagcatgatttgggattgcacatgtatcggagcaggacgcggccggatctcttgcaccatcgctaatcgctgccatgagggagggcagagttacaagatcggagatacgtggcggcggccgcatgaaaccggtggttatatgctagaatgcgtgtgcttaggaaatggcaagggggagtggacatgcaagccaatagcggaaaagtgcttcgatcacgccgccggcacttcttacgtggtgggggaaacatgggagaaaccctaccagggctggatgatggtggactgcacctgcctgggggaaggttccggccgtatcacttgtacatccaggaaccgctgtaacgaccaggataccaggacctcataccggataggtgatacgtggtccaagaaggataatagggggaatttgctacaatgtatctgcacagggaatggccgcggcgagtggaaatgcgaaaggcacacctcagttcagacaacaagcagcgggtctggaccattcactgacgtgcgggctgctgtttaccagccacagccacaccctcagcccccaccatacgggcactgtgtcactgatagtggagtggtctactctgtgggaatgcaatggttgaagactcaggggaacaagcaaatgctgtgcacatgtcttggcaatggggtgtcctgtcaagaaaccgccgtgacacaaacttatggcggcaattccaacggggagccatgtgtcttgcccttcacttataatggaaggaccttctatagttgtactacagagggcaggcaggatgggcatctttggtgctctaccaccagcaactacgagcaagatcagaagtacagtttttgcactgatcatactgttctcgtccagactcggggggggaacagtaatggcgcgttgtgccatttcccctttttatataataatcacaattatacagactgcacttctgaaggaaggcgggacaacatgaagtggtgcggcactacacagaattacgatgccgatcagaaattcggtttctgtcccatggcagcacatgaggagatttgtactactaacgagggcgttatgtacagaataggtgaccagtgggataaacaacacgacatgggacacatgatgaggtgtacctgtgtgggaaatggtaggggagagtggacatgtatcgcatactcccagcttcgagaccagtgcattgtggacgatataacctacaacgtaaatgataccttccacaaaagacacgaggaagggcatatgctgaactgcacctgtttcgggcaggggcgggggcgatggaagtgcgacccggtggaccagtgtcaggatagcgaaacaggaacattttaccagattggagactcttgggagaagtatgttcacggtgtgaggtatcagtgttattgctatgggagaggcatcggtgagtggcactgccagccactgcagacatatcctagcagctctggccccgttgaggtcttcatcaccgagacgccatcccagcctaattcacaccccattcaatggaacgccccacaaccttcgcacatcagtaaatacatcctcagatggcgcccaaagaattctgttgggcgatggaaggaggcaaccattccaggacaccttaactcctataccatcaaaggactcaagcccggtgtagtttacgagggccaactcatctcaattcagcagtatgggcaccaggaggtgactagattcgatttcaccacaacaagtacaagtactcctgttacttctaatacagtgaccggagaaaccaccccgtttagccctttagtcgcgactagcgaatccgtgactgagattactgcctcctccttcgtcgtgtcttgggtctccgcgtcggatactgtctccggctttcgcgtggagtacgaactcagtgaggaaggtgacgaaccacagtacctggatctaccctctactgcaacatctgttaacatacccgatctgctgccaggacgcaagtatatcgtgaacgtctatcagatttccgaggacggagaacagagcttgatactgagtaccagtcagacgacggctccagacgcgccacctgatacgaccgtggatcaagtggatgatacatctatcgtggtccggtggagtagaccacaggctccaattaccggataccgtatcgtgtatagccccagtgttgagggttcctccactgagctgaacctgcctgagacagcaaatagcgtgaccctgtccgatttacaacccggtgttcaatataatataacaatttacgccgttgaggagaatcaggaaagtaccccggtggttatccagcaggagacaactggaactccccgatctgataccgtcccgtctccacgcgacttacagtttgttgaagtgacggacgtgaaggtcactatcatgtggactcctcctgagagcgccgtaacagggtatcgcgtggatgtaatcccagttaacctacccggtgaacatggtcagaggctccccatatcgcggaacactttcgccgaggttaccggcctgtcccctggggttacctattactttaaagtttttgcagtctcgcacggccgtgaatctaaaccactgaccgcccagcagaccacaaagcttgacgccccaactaacttgcagttcgtgaatgagaccgacagcaccgtcctggtgcgttggactccaccacgcgcccagatcacggggtataggctaacagtgggactcacgcgtcggggccaaccccgacagtacaatgtcggaccttctgtgagcaagtaccctctgcgcaatctccagccggccagcgaatacacagtttccctagtagcgatcaagggtaatcaggaatccccaaaagctacaggcgtgtttactacccttcagcctgggtcctctattccaccatacaacacagaggtcacagagaccaccattgtgatcacgtggacgcctgccccccggattggttttaaactcggtgtcaggcctagccaaggcggggaagcccctcgggaagtcacatctgactctggcagcattgttgtcagcggattgacaccaggggtagaatacgtttacaccatccaggtgctccgggatggacaggagagggacgcaccaatcgtgaacaaagtcgtcactccactttctccccctactaacctccacctggaggcgaaccccgacaccggcgttttgactgtttcctgggagcgctccacaacccccgacatcaccggctaccgcattacgaccacacctacaaatgggcagcagggcaactcattagaggaggtagtccacgccgaccagagctcttgtacatttgacaacctgtcccccgggcttgagtacaacgtgtctgtgtacaccgtcaaggacgataaagaatctgtgcctattagtgacaccatcattccggccgttccacctcccacggacctccgtttcactaatatcggccctgacacaatgcgggtgacatgggcgcctcctccctctattgacctgactaactttctcgtcaggtacagcccagtcaagaacgaagaagatgtggccgagctgtctatatccccttcggataatgccgtcgtgcttaccaacctgctcccaggaacggaatatgttgtgagtgtatcaagtgtgtacgagcagcacgagagtactcctctgagagggcgccagaaaaccggccttgattcacctacgggcatcgattttagcgatattaccgccaatagctttacagtgcattggatagcaccacgggctactattacggggtatcgcatcaggcatcatcccgagcatttttccgggcgtccacgcgaagaccgcgtacctcattctaggaacagcatcacattaacaaacctgactcccggcacggagtacgtggtttctatcgttgctctgaatggtagagaggagagtccactgctgattggccagcagtccacagtgtcagatgttccccgggacctggaggtagtcgctgctacacccaccagtctgctaattagttgggacgcacccgctgtgacagtgaggtattatcgtatcacatacggtgaaacgggcggcaacagccccgtacaagagttcaccgttccggggagtaagagcacagcaactatcagcggcctgaagcctggggtggattacactatcactgtatacgctgtgacaggacgtggtgacagcccagccagtagtaagcctatctctatcaactatcgaaccgaaatcgacaaaccctcccaaatgcaggtgaccgatgtgcaggacaactccatatcagtgaaatggctaccaagtagctctccagtcaccggatatcgtgttacaacgacacctaaaaatggacccggacccactaaaactaagacagcaggccctgaccagacagagatgacaatcgaggggctccagccgactgtcgagtacgtcgtgtcagtctatgctcagaatccttcaggagagtcgcagccccttgttcagaccgccgttacaaatatcgatcggcctaaaggcttggcgtttacagacgttgatgttgattcaatcaagattgcctgggaatcccctcagggccaggtcagtcggtatagagttacatactcatctcccgaagatggaatccatgaactgttccctgcaccagatggagaggaggataccgccgaactgcagggcttacggccgggcagtgagtatacggtcagtgtcgtggccttacatgatgacatggagagtcaacctctcatcggcactcaatcaactgcaattccagcacccacagacctcaagtttacacaggtcacacccacgtccctgagtgcacagtggacccctccaaacgtccagctgaccggatatagagtaagagtgacgcccaaagagaagactgggccaatgaaagagattaacctagccccagacagcagcagtgtggtcgtgagcggcctgatggtcgcgaccaagtatgaggtatccgtgtacgccctgaaagacaccctgacaagtagacccgcccagggagtggtcacaactttagagaatgtcagcccccctcggcgggcaagagtgacagacgccactgagaccaccatcaccatcagctggagaaccaagacggaaacaatcaccggatttcaggtggatgcagtcccggctaatgggcagacgccgatccagagaacgattaaacccgatgtgagatcatatactatcaccgggcttcaaccagggaccgactacaagatctacctgtatacattaaacgacaatgcgcgctccagcccagtggtgatcgacgcttccacagctatagatgctcccagcaacctgaggtttttagccacaacacctaactccctcctcgtgtcctggcagccccctagagcccgaatcacgggttacataattaagtacgaaaagcccggctcacctccccgggaagtggtgcctcgcccaagacctggggtaactgaggccaccataaccggtcttgagcccggcaccgagtacacaatatatgtgatcgctctgaagaacaaccaaaagagcgagcccctgatcggccgcaagaagacagtgcagaagactccattcgtaactcacccgggctatgataccgggaacggcattcagctcccaggtacaagcggccagcagcctagcgtaggccagcagatgatctttgaggaacacggctttcgccggacaactcctccaactaccgctaccccaatccggcaccgtcccaggccatatccacctaatgtgggacaggaggcactatctcaaaccacgatctcctgggctcccttccaggataccagtgaatacattatatcttgtcatcctgttgggacagatgaagagcccctccagttcagggtacccgggacatctacatctgctacgctgaccggcctcaccaggggggcaacctacaacgtgattgttgaggccctcaaggatcagcagcgtcacaaagtgagggaagaggtggtcacagtgggaaattccgtgaatgaaggactcaaccagcccaccgatgattcctgcttcgatccctatactgtctcgcactacgccgtgggagacgagtgggagcgaatgtccgaatcggggttcaaattgctgtgtcaatgcttgggcttcggcagcggtcattttagatgcgactcatcacggtggtgccacgataacggggttaactacaaaattggcgaaaaatgggatcggcaaggagagaatgggcagatgatgtcatgtacgtgcctcggaaacggcaagggggaatttaaatgcgatccacatgaggctacgtgttacgatgatggtaagacttaccacgtgggagagcagtggcagaaggagtacttgggggcaatctgttcatgtacctgtttcggcggccaacgcgggtggcggtgcgataactgtaggcgacccggcggcgaaccctcacctgaggggaccactggccagagctacaaccagtactcccaacgataccaccagagaaccaacaccaatgtgaactgccccatcgagtgttttatgcctctagatgttcaggctgatcgtgaggatagccgggagtag

SEQ ID NO: 24217 - DNA, 3312 bp, Artificial Sequence
  Description of Artificial Sequence: Synthetic coding sequence
ctgcggtggacccccctgaacagcagcaccatcatcggctaccggattaccgttgtggctgctggggaaggcattccaatattcgaagatttcgttgattcttctgtgggctattatacagtcacagggctcgaaccggggatcgattacgatatatctgttataacactgataaatggcggggaaagcgcacccaccactttgacccagcagacagcggtgccgcctccaaccgatctgcggtttacaaacatcggaccggacaccatgcgcgttacctgggctcctccccctagcatcgacctcacaaacttcctggtgcgatactcgccggttaagaacgaagaagatgtggccgaactctcgatctcaccctccgacaacgcggtggttttgacaaacctgttgccgggaactgagtacgtggtctctgtctcgagtgtatatgaacagcacgaaagtacaccactcaggggtcggcagaagacaggccttgacagccccacgggaattgacttctctgatattaccgcaaacagcttcaccgtgcattggatcgctccgcgcgctaccatcacagggtacaggataaggcaccatccagaacattttagtggccgcccaagggaggatcgggtcccacattctcgaaatagcataaccttaacaaatttgacccctggaactgagtacgttgtctcaatcgtggctcttaacggcagagaggaaagcccgttgttgataggacagcagagcactgtgagcgacgtgcctcgagatctagaggtggttgctgcaacacccacatctctgctgatttcgtgggatgcacccgccgtcaccgttagatattacagaatcacctacggcgaaacaggtggtaactcacccgtacaggaatttactgtcccaggcagtaaatcaaccgccaccatctcgggtcttaagccaggcgttgattacacgatcaccgtctatgccgtgacgggtcgtggcgactccccagccagctcgaagccaatttccattaactatcgcacagagattgataagccctctcagatgcaggtgacggatgttcaggacaattccatatcagttaagtggctgccctcgtcctcaccagtcacagggtatcgggtgaccactacccccaaaaatggacctggccctacaaagaccaaaactgccggccccgatcagacggaaatgaccatagaagggctccagcctacagtggagtatgtggtaagtgtgtacgctcagaatccctcaggagaatcacaacccttggttcagaccgcagtcacgaccattcctgcacccacagatcttaagttcactcaggtcacacctacctccctctcagcccaatggacaccaccaaacgttcagcttaccggatatagagtcagggttactccaaaggaaaagactggtcctatgaaagaaattaacctggcgcccgattcctctagcgtcgtcgtctccgggctcatggtggctaccaaatatgaagtctcagtgtacgcattgaaagacaccctcacaagtcgcccggctcagggagtggttacaacccttgaaaacgtgagtcctcccagacgggcccgtgtgaccgatgccactgagaccacaataacaatatcttggaggacaaagacagaaactataacaggattccaggtggatgctgtccccgctaatgggcagacaccaattcaaagaacaattaaaccggacgtaagaagctatactataacaggcctccagcccggcacagactacaagatctacctctacaccctgaacgacaacgcgcgatcctccccagttgtgatagatgcatccacagcaattgacgccccatctaacctgagattcctggctactacaccaaatagcctactggtctcctggcagcctccccgggctcggatcaccggctacatcatcaagtatgaaaaacccggctcacctcctagagaagttgtgccccggccacggcccggggtgacagaggccaccataaccggtctcgagcccggtaccgaatatacaatttatgtgatagccctcaaaaacaaccagaaatcggagccgctgatagggcgaaaaaaaaccgacgagctaccccagctggtcacactgccacaccccaacttacatggacctgagatactggacgtacccagcacggtccagaagaccccatttgtcactcatcctggatatgatacgggaaatggcatccagctaccagggacatctggccagcaaccaagcgttgggcagcagatgatctttgaggaacacggattccgtcgcactactccacctaccacggcaacccccattaggcacaggccaagaccttacccaccaaatgtcggggaagagatccagatcggccacatccctagagaagacgtggactaccatctttaccctcatggacctgggttgaatcccaacgctagcactggccaagaggccctgtctcaaacgacaatctcctgggcgcctttccaggacactagtgaatacatcatctcttgccacccagtgggaactgacgaggagcctctgcagttcagggtaccgggtaccagcaccagtgccaccctcaccgggctcacacgaggagctacttataatgtgatcgtcgaggccttaaaagatcagcagcgacacaaggtgcgagaggaggtcgttacggttggcaactccgtcaacgaaggcctgaaccagcccaccgatgattcttgcttcgatccctacaccgtttcacactacgctgtcggagatgaatgggagaggatgagcgagtctggatttaaactgctttgccagtgcttggggtttggctcagggcacttccgatgtgacagttcccggtggtgccacgacaacggggtgaattacaagatcggcgaaaaatgggatagacagggcgaaaatgggcagatgatgtcttgcacctgtctaggaaacgggaaaggtgaatttaaatgtgaccctcacgaagcaacatgctacgacgacgggaagacgtaccacgttggggaacaatggcagaaggagtatctgggagccatctgcagttgtacttgttttggaggacagcgcggctggaggtgcgacaattgcaggcggcccggaggggagcccagccccgaaggtaccaccggccaatcctacaatcagtactcccagcgctaccaccagcgtaccaacactaatgtgaattgtcccatagaatgtttcatgcccttggacgtgcaggcagacagagaggactccagggagtag

SEQ ID NO: 24218 - DNA, 312 bp, Artificial Sequence
  Description of Artificial Sequence: Synthetic coding sequence
atgcccgtgagcgtgagcagcggccggaccttccccaagcggggccagacttgcgttgtccactacaccggcatgctggaggatggtaagaagttcgattcctccagagaccgcaataaaccgttcaagtttatgcttggcaaacaggaagtgatccgaggatgggaggagggggtggcacagatgtctgtgggtcagcgagcaaaacttacaatctcccctgattatgcctacggcgctaccgggcatcccggcattataccccctcatgcaacactggttttcgatgtcgagttgctgaagctggagtag

SEQ ID NO: 24219 - DNA, 327 bp, Artificial Sequence
  Description of Artificial Sequence: Synthetic coding sequence
atgggcgtgcaggtggagaccatcagccccggcgacggccggacctttcctaaacgtggccagacctgtgtagtccactacaccggtatgctggaggatggtaaaaaattcgactcctctcgggacaggaacaagcccttcaagtttatgctgggcaagcaggaagtcatacggggatgggaggagggcgtcgctcagatgagtgtgggtcagcgcgctaagctgaccatcagccctgattatgcgtacggtgctaccgggcaccctgggatcataccccctcacgcaactttagtgttcgatgtggaattgcttaaacttgaatag

SEQ ID NO: 24220 - DNA, 312 bp, Artificial Sequence
  Description of Artificial Sequence: Synthetic coding sequence
atgcccgtgagcgtgagcagcggccggaccttccccaagcggggccaaacctgcgtcgtgcattacaccgggatgcttgaagatgggaagaagttcgacagcagtagagacagaaacaaaccttttaaattcatgctcgggaagcaggaggtgatccgcggttgggaagaaggtgtggcacagatgtctgtggggcaacgcgctaagttgacaatctcccctgattatgcatatggagctactggacatccgggtatcatcccaccccacgctactctagtctttgatgtcgaactcttgaaattagaatag

SEQ ID NO: 24221 - DNA, 327 bp, Artificial Sequence
  Description of Artificial Sequence: Synthetic coding sequence
atgggcgtgcaggtggagaccatcagccccggcgacggccggaccttccctaaaaggggtcagacatgcgtcgtgcattacaccggcatgctggaggacggcaaaaagttcgattcaagccgagacagaaacaaaccattcaaattcatgttgggaaagcaggaggttatcagaggctgggaagaaggcgtggctcagatgagtgtggggcagcgcgccaagctgactatctcaccagactacgcttacggagcgactggccaccccggcatcatcccccctcacgctacgctcgtttttgatgtcgagctgctgaagctggaatag

SEQ ID NO: 24222 - DNA, 279 bp, Artificial Sequence
  Description of Artificial Sequence: Synthetic coding sequence
atgggcgtgcaggtggagaccatcagccccggcgacggcatgctggaggatgggaagaagtttgactcctctcgcgataggaataagccattcaagttcatgctgggcaagcaggaagtcataagaggctgggaggaaggcgtggcccagatgagtgtcgggcaacgtgctaaactgacaataagccctgactatgcttatggggcgaccgggcatcctggtatcatcccccctcatgctaccttggtttttgacgttgaactgctgaaactggaatag

SEQ ID NO: 24223 - DNA, 1143 bp, Artificial Sequence
  Description of Artificial Sequence: Synthetic coding sequence
atgggcatccagggcctggccaagctgatcgccgacgtggccccctctgcaattcgagagaacgatatcaagtcttatttcggtcggaaggtggcaatcgatgcttctatgtctatataccagtttctcatcgcggtgagacagggaggtgatgtactccagaacgaggaaggagagacaaccagccatcttatgggcatgttttataggaccatcagaatgatggaaaacggaataaaacctgtttatgtatttgacgggaagcctccccagctgaagagcggagaactcgcaaagcggagcgagcggagggctgaagcggaaaagcaactgcaacaggctcaggcagcgggagcggagcaagaagtagagaagttcacgaaacgattagtcaaggttaccaaacagcacaatgacgagtgtaaacacctgctgagcctaatgggtattccttacctggacgctccctcagaagccgaggccagctgcgctgcccttgtgaaagccggcaaagtgtacgcggccgcaacagaggacatggactgtctgacgttcggcagccccgtgctaatgcgtcacctcactgcgtctgaggccaagaaactacccatccaggagtttcatttaagccggatcctgcaagaactgggactaaatcaggaacagttcgttgacttatgtatcctgctcggaagtgactactgtgagtccattaggggaataggtcccaaaagggccgttgatttgatccagaaacataagagtatagaagaaatagtccgtcggctggaccccaacaagtatcccgtcccggagaactggctccataaagaggcgcatcaacttttcctcgagcctgaggtcctcgatccggagagcgtggagctgaaatggtcagagcctaatgaggaagagctgatcaaattcatgtgtggcgaaaagcagtttagcgaggagcgtatacgcagcggtgttaagaggctctccaagagccgccagggttcgacacaaggccggctcgacgacttcttcaaagtcaccgggagtctcagtagcgccaaacgtaaggaacccgaaccaaagggcagcaccaagaaaaaggctaaaacaggtgccgccggtaagttcaagcggggaaagtag

SEQ ID NO: 24224 - DNA, 498 bp, Artificial Sequence
  Description of Artificial Sequence: Synthetic coding sequence
atgggcatccagggcctggccaagctgatcgccgacgtggccccctccgctattcgggagaacgacattaagagctattttggcaggaaggtggctatagacgcatccatgagcatttaccagttcctaattgcagttagacagggtggagatgtattgcagaacgaggagggagagaccacctctcaccttatgggtatgttctatcggaccatccggatgatggagaatgggattaagcccgtttacgtgttcgatggaaagccacctcagttaaaatccggcgaattggcaaaacgctctgaacgtagggcagaggctgagaagcaactccagcaggctcaggccgcgggtgccgagcaagaggtcgagaagtttactaagcgcttggtgaaggtgacgaaacagcacaatgatgagtgtaaacacctcctgtcactcatggggatcccatacctcgacgctccctctgaagccgaggcatcttgtgcggcctag

SEQ ID NO: 24225 - DNA, 4017 bp, Artificial Sequence
  Description of Artificial Sequence: Synthetic coding sequence
atggtgagctactgggacaccggcgtgctgctgtgcgccctgctgagttgtctgctgcttacaggatcttcttcgggatctaagctgaaagaccccgagctgtcactcaaaggcacacagcacattatgcaagcaggacagacgttgcacttgcaatgccgaggcgaagcagcccataaatggagcctgccagaaatggtgtccaaggagagcgaacggctctctatcaccaagtccgcatgtggccggaacggtaagcaattttgttccactttgaccctgaacacggcccaggccaaccacacggggttttacagttgcaaatatctggccgtgcccaccagcaaaaaaaaagagactgaaagtgcaatatacatttttatcagcgataccgggcgcccatttgttgagatgtacagtgagattcccgaaataatccatatgaccgaaggaagggaactggtcatcccgtgcagggtcaccagtccgaatataacagtgactctcaagaaatttcccttggataccctcatcccagatggaaagagaataatctgggactctcggaagggctttatcatctctaatgccacctacaaagagataggcctcctcacctgtgaagcgacagtcaatggacatctgtataagacaaactaccttacccatcgccagacaaatacaatcatagatgtgcagattagcaccccccgccctgtcaaattgctgcgtgggcacaccctggtcctcaactgcaccgcaactactcccctcaatactagagtccagatgacatggtcctaccctgatgagaaaaataagcgggctagtgtaagaagacgaatcgatcagtctaatagccacgctaacatcttctacagcgtgctgaccatcgataaaatgcagaacaaggacaaaggactctatacctgccgagtcagatccgggccatcattcaaatcggttaatacgtctgtgcatatttatgacaaggcgtttataactgtgaagcataggaagcagcaagtgctggagactgtggcaggcaagagaagttacagactctccatgaaggtcaaggcgttcccctcccctgaagtggtgtggctgaaggatggtctccccgccaccgagaagtctgctcgctatctgacgcgaggctatagcctgattatcaaagacgtgactgaagaagacgctgggaactatactatactgctgtcgatcaagcagagtaacgtcttcaagaacttgactgccaccctgatcgtgaatgtcaaaccacagatctatgagaaggcagttagttccttccccgacccagccctctacccactcgggtctcgccagattttgacctgcacggcatatgggataccgcagccaacaattaaatggttttggcatccttgtaatcataatcacagcgaggcacggtgcgacttctgcagtaacaatgaagagagttttattctggacgctgattcgaatatgggtaatagaattgagtctattacccagaggatggccatcatagagggaaaaaacaagatggcatctacactcgttgtcgccgatagtagaataagcggaatatatatctgcatagctagcaacaaggtcggcaccgtggggcgtaatataagcttctacatcacggatgtgcctaacgggttccacgtaaatctggaaaaaatgcctaccgaaggggaggatctcaagttgagttgtaccgtgaataagttcctgtatcgtgacgtgacgtggatcctcttaaggaccgtcaacaataggacaatgcattacagtatctctaagcaaaagatggccattactaaggaacactccattacgctgaatctgacgatcatgaatgtatctcttcaggactcaggaacctatgcctgcagagcaagaaatgtatacaccggagaggagatccttcaaaaaaaagagattacaattcgagaccaggaggccccctatttactgcgtaatctctccgaccataccgtggccatatcatcctccaccactctcgactgccacgccaacggagtacctgaaccccagattacttggtttaaaaacaatcacaagatacaacaggagcctgggataattttggggcctggaagctctacactgttcatcgaaagggtgactgaagaagatgagggagtgtatcattgtaaagctaccaaccagaaaggcagtgtcgaatctagcgcatacctgactgttcaaggaaccagcgataagtcaaacttggaattgattaccctcacttgcacatgtgttgcggcaacgctcttttggctgctgctgaccctcttcatcaggaagatgaagcggagctccagcgaaattaaaaccgattatctgtccattataatggacccagacgaggtccctcttgacgagcagtgtgagcgcctgccctatgatgcctccaaatgggaattcgccagagaaagacttaaactgggcaaaagtttggggcgaggcgcctttggcaaagtcgtgcaggcttccgccttcggcataaaaaagtctcccacctgtcgaacagttgcagtgaaaatgctgaaggagggggctaccgctagcgagtacaaggctcttatgactgaactgaagatcctgacacacatcggccaccatctgaacgtggtgaacctccttggtgcatgcaccaaacaggggggacctcttatggttattgttgaatactgtaagtacggaaacctgtccaattatctcaagagtaaaagggacctgtttttcctgaacaaggacgcagccctgcacatggaaccaaagaaagaaaagatggagcctggcctggagcagggtaagaaacctagactggattccgtgacttccagcgagtcctttgcctcttctgggttccaagaggataagtcactctcggatgtggaggaagaagaggactccgacggattctataaggaacccatcacaatggaggaccttatttcatactcatttcaggtcgcacgcggaatggagttcctgagttctcgcaaatgcattcaccgcgatctggctgcgcggaacatactcctaagcgagaacaacgttgtgaagatctgtgattttggcctcgccagagatatttacaagaatccagattacgttcggaagggggacaccagactacctctaaaatggatggcccctgagtccatttttgataagatatatagcaccaagtcagacgtctggtcctatggggtgctgctctgggaaattttctctcttggcggctctccttaccctggagtgcagatggacgaggacttctgttcgaggctaagggagggcatgcgaatgcgagcccccgaatactctacacccgagatctatcagataatgctggattgttggcacagggaccctaaagaacgcccccggttcgccgagcttgtcgaaaagttaggggatcttttgcaggctaacgtgcagcaagacggcaaggactacatccccataaacgccatactgaccggaaattccggttttacttattctacaccggcttttagcgaagatttttttaaagaatccatttccgcaccaaaattcaatagcggaagctccgacgacgtgcgctacgtgaacgcgttcaagtttatgagccttgaaaggatcaagacatttgaggagttgctgcccaacgccacttcaatgttcgatgactaccaaggtgattcctcgacgttgctggcatctccgatgctgaagaggtttacatggactgatagcaagccaaaggctagccttaaaatagatctgagggtgacctcaaagagcaaagaaagcggactttccgacgttagtaggccatccttttgccatagttcttgcgggcatgtttccgaggggaagcgcaggtttacttatgaccatgcggaactagaaaggaagatcgcttgttgcagcccacctcctgactacaatagcgtcgtgttgtactccacacctccaatctag

SEQ ID NO: 24226 - DNA, 531 bp, Artificial Sequence
  Description of Artificial Sequence: Synthetic coding sequence
atggtgagctactgggacaccggcgtgctgctgtgcgccctgctgtcctgtctgctgctgactggtagttctagcggctccaaactcaaggaccctgaattgtcacttaaagggacgcagcacatcatgcaggccggtcagaccctacatctgcagtgccgcggcgaagctgcgcacaaatggagtctccccgagatggtgtcaaaggagtcagagcggttgtccattactaaatccgcctgtggcagaaatgggaagcagttttgtagcacattgactctgaacaccgcacaagcaaatcataccggattttacagttgcaagtacttagcagtgcccacctcaaaaaaaaaggagacagagagtgctatatatatcttcattagcgacaccggacgtcctttcgttgagatgtattcagagatcccggaaattatccacatgaccgagggacgagagttggtgatcccatgccgggtcacatccccaaacataactgtcactctaaagaagaagaataaacgcgcctag

SEQ ID NO: 24227 - DNA, 1626 bp, Artificial Sequence
  Description of Artificial Sequence: Synthetic coding sequence
atggtgagctactgggacaccggcgtgctgctgtgcgccctgctgagttgcttactgctgacaggatcttcatccggatctaaactgaaggaccctgagttgtccctgaaaggtactcagcacattatgcaagctggccagacactgcatcttcagtgtcgcggagaggcggcacacaagtggtcgctgcccgagatggtgtcgaaggaaagcgaacggttgagcataactaagtccgcttgcgggcgaaatggcaagcagttctgctctacattaaccctgaacaccgcacaagctaatcacacggggttctattcatgtaagtatctcgctgtgcccactagcaaaaagaaagagacagagagtgctatttatatctttatcagtgacaccggcagaccttttgtggagatgtattctgaaattcctgagattatccatatgactgaggggcgggagctggttataccctgccgcgtcactagccctaatattacagtgaccctgaagaagttccctctggatacactgatccccgacggtaaaagaatcatttgggacagtagaaaaggcttcatcattagtaatgccacgtacaaggagatagggctgttgacgtgcgaagcgaccgtcaatggccacctctataaaaccaactacctaacacacagacagaccaatacgatcatcgacgtgcagattagtacccctcggcctgtaaagttactcagaggccatactctggttttgaactgcaccgccaccacaccgttgaataccagggttcagatgacctggtcttatcccgacgagaagaacaagagagctagtgttcgtcggcggatagaccagagtaattctcatgccaatatattttactctgtcctcaccatcgacaagatgcagaataaagataaaggactgtacacttgcagagtcagatcgggtcctagttttaagagcgtgaacacctcagtacatatttatgacaaggcgttcattaccgtgaagcacaggaagcaacaggtgcttgaaacggtggccggaaagcggtcataccgcttgagtatgaaagtaaaagcatttcccagcccagaggtggtttggctgaaagacggcctgccggccacagaaaagagcgctcggtatctgactcgtggttacagcctgatcatcaaggacgtcaccgaggaggacgccggaaactataccatcctgctttccataaagcagagcaatgtcttcaagaatctcaccgccaccctcatcgtcaacgtaaaaccccagatatatgaaaaagccgtatccagcttccccgacccagcactttatccgctagggtcccggcagattctcacgtgtacggcctacggcattcctcagcctacaataaaatggttctggcatccttgtaaccacaaccactctgaggctcgctgtgacttctgctctaacaacgaggaatccttcatcttggatgcagatagcaacatggggaatagaatcgaatctattacccagcggatggcaattattgagggcaagaacaaactgccccccgccaatagttcttttatgttgccccctactagcttcagctcaaattatttccattttctaccatag

SEQ ID NO: 24228 - DNA, 1671 bp, Artificial Sequence
  Description of Artificial Sequence: Synthetic coding sequence
atgaagcggagcagcagcgagatcaagaccgactacctgagcatcatcatggacccagatgaagtaccgctcgacgagcaatgcgagagactcccctatgatgcatcgaagtgggagttcgccagggagcgcctgaaactgggcaagagtctaggtaggggggctttcggcaaggtggttcaagcttctgccttcgggattaaaaagtccccgacatgtcgaaccgtggctgtgaaaatgctgaaggaaggggctacggccagtgaatacaaggctctcatgacggaactgaagatattaacacacatcggtcaccatctcaacgtcgtgaacctcttgggagcttgcactaaacagggaggtcccctgatggtgattgtggagtactgcaagtacggcaatcttagcaattacctgaaatccaagagagatctgttttttttaaacaaggacgccgcactgcatatggagcccaaaaaagagaagatggaacccggcctggagcaaggtaaaaaacccaggctggacagcgtgaccagcagtgagtcttttgctagctctggatttcaggaggataaatccttgtccgatgtcgaggaagaagaagattccgacgggttttacaaagagcctataacaatggaggacctgattagctatagcttccaggttgcccgcgggatggagtttctctcctctaggaagtgcatccacagggacctcgcagctagaaatatcctactcagcgagaataacgtagtgaagatctgtgacttcggccttgcacgggacatttacaagaatcctgattatgtccgaaaaggcgacacccgtctccccctcaaatggatggcccccgaaagcattttcgataaaatctattcgacaaagtctgacgtgtggagttatggcgtcctcctgtgggagattttttctcttggaggctccccatatcccggggtgcagatggatgaagatttctgttccaggcttcgcgagggaatgaggatgagagccccggagtattccacccccgagatatatcaaatcatgctagattgttggcacagagatcccaaagagcgaccccgctttgccgaactggtggaaaagttgggcgatctcctgcaggctaacgtacagcaggatggcaaggactacatcccaatcaatgccatcttgactggtaatagcggatttacttattcaactccagcattttctgaagacttctttaaggagtctatttcggcgccaaagttcaactcagggtcttccgacgacgtgcgctatgtgaatgcctttaagtttatgtccctcgagagaatcaagacctttgaggagcttctcccaaacgcgacctctatgttcgacgattatcagggcgactcttcgaccttgttagcctctcctatgctgaagaggttcacttggaccgacagcaagccaaaggcatccctgaagatcgacctgcgcgttacttccaagtcgaaagaaagcggtctttctgacgtaagcaggcccagtttctgtcacagttcttgtggacacgtctcagagggcaagcgacgcttcacttatgatcacgccgaactggaaaggaagattgcatgctgcagtccccctcccgactacaattccgttgtgctgtactccacaccgcccatctag

SEQ ID NO: 24229 - DNA, 45 bp, Artificial Sequence; identical to SEQ ID NO: 10765
  Description of Artificial Sequence: Synthetic coding sequence

SEQ ID NO: 24230 - DNA, 2202 bp, Artificial Sequence
  Description of Artificial Sequence: Synthetic coding sequence
atggtgagctactgggacaccggcgtgctgctgtgcgccctgctgagttgtttgcttctgactggcagcagttctggttctaagcttaaagaccccgagttaagtctgaagggaacccaacacatcatgcaggcaggccagacactgcacctccagtgcagaggcgaagccgcccacaaatggtccctgcccgaaatggtcagtaaagagtcagaaaggctttctattacaaaatctgcttgtggacgcaacggcaagcagttctgtagtaccctcacacttaataccgcccaggcaaatcacactggattttactcatgcaaatacctggctgtgcccacaagtaaaaagaaagagacggaaagtgccatctatatattcatcagcgataccggtagaccatttgttgagatgtactctgagatcccggagataattcatatgacggaggggagggaattggtcatcccatgcagagttacgtccccaaatataacagttacactaaagaagtttccgctcgatacgctgattccagatgggaaacgcatcatctgggactctcggaaaggattcatcatttcaaatgccacgtacaaggaaattggcctactgacctgtgaggcaaccgtaaatggtcacctgtataagacaaattatctcacccaccgccagacaaacacaattatcgatgtacagatctctactccacgccccgtgaaactgctgagagggcatactttggtactgaactgtacagcaaccacacctctcaatactcgcgtacaaatgacctggtcctacccagatgagaaaaacaagcgggcgagtgtcaggcggcggatcgaccagtccaattcacacgcaaacattttctactctgttctgaccattgacaaaatgcagaacaaagacaaaggactttatacttgcagagtccgcagcggtccctcatttaaaagcgtcaacacatcagtccacatctatgacaaagcctttataaccgtcaagcaccggaagcaacaagtgcttgagacggtcgccggaaagcgatcataccgcctgtcaatgaaggtgaaggccttcccatcacccgaagtcgtctggctcaaagacggtctgccagccacagagaaatccgcacgatatcttacaagagggtactctctgataatcaaggacgttaccgaagaagatgccggcaattataccatcttgctgtccattaaacaatccaatgtgtttaagaacctgacagcgactttgattgtcaatgttaaaccacagatttatgaaaaagccgtctcttcctttccagacccggcactttatccactggggtccaggcagattctgacctgcactgcttacggcattcctcaaccaacgatcaagtggttttggcacccgtgtaaccataaccacagcgaggccaggtgtgatttctgctctaataatgaggaatcattcatcttagatgccgatagcaacatgggtaacagaatcgaatctatcacccagaggatggctatcattgaaggcaaaaataaaatggcttctaccctcgttgtggcggattcaagaatatccgggatctacatctgtatagcttcaaacaaagtggggaccgtgggccggaacatttcattttacattacggatgttcccaatggattccacgtgaacctggagaaaatgcccacagagggcgaagatctgaagctctcctgcactgtgaacaaattcctgtatagagacgtcacttggattttgctcaggactgtcaacaaccggactatgcattactcaatctccaaacagaagatggccattacaaaggagcacagtatcactctcaaccttactatcatgaacgtgtccctgcaggactccggcacctatgcttgtagggcacgtaatgtgtacacaggtgaagagatattgcagaaaaaagaaatcacgatccgagaccaggaagccccgtatctgctgcgcaatcttagcgatcacaccgtggccatttcttcttctacaacactcgattgtcatgctaacggagtgcccgagccacaaatcacatggttcaaaaacaaccacaagattcagcaggaaccagagctgtacacaagtacatctcctagttccagttccagttcacccctgtcttccagttcctcctccagtagttcaagcagtagctag

SEQ ID NO: 24231 - DNA, 1086 bp, Artificial Sequence
  Description of Artificial Sequence: Synthetic coding sequence
atgaacagcgacctgctggtggacagcgacggcttctacaaggagcccatcactatggaggacctcattagctactcgttccaagtagcccggggcatggaatttctttccagtaggaagtgcatccatagagacctggccgcacgcaatatactgctgagcgaaaacaacgttgtcaaaatttgcgatttcgggctggctagggatatatataagaatcccgactacgtcaggaaaggggacactcgtcttccgcttaaatggatggctcctgaaagtatatttgataagatatactcaaccaagtccgacgtgtggagctatggtgtcctcctgtgggaaatttttagtttagggggatccccttaccctggggtgcagatggatgaggatttttgcagccgtctgagggagggcatgaggatgcgggcaccagaatacagcacaccagagatctaccagatcatgctcgactgttggcatagagacccaaaggagagacctcgattcgcagagctcgtagaaaaattaggcgatttgcttcaagcaaacgtacaacaggacggtaaagactatataccgatcaacgccattctgacaggcaactcagggtttacttactccacgcctgcatttagcgaggatttttttaaggagagtattagtgctccaaaattcaactccgggagttcggacgatgttagatacgtgaatgccttcaaattcatgtccctggaacgcatcaagacgttcgaagaattattgccaaatgctaccagtatgtttgacgactaccagggagattccagcacgttactagcatccccaatgctcaagaggtttacctggactgattcaaagcctaaggcgtctctcaaaatcgacctacgggtgaccagcaagtctaaggagtcaggtctgtcagacgttagcaggccctcattttgccatagttcatgtggccatgttagcgaaggaaagcgacgtttcacgtacgatcacgcagagctagaaaggaaaatcgcgtgctgttcacctcctccggattataactccgttgtgctgtattctaccccgcccatctag

SEQ ID NO: 24232 - DNA, 75 bp, Artificial Sequence
  Description of Artificial Sequence: Synthetic coding sequence
ctgccccccgccaacagcagcttcatgctgccccccaccagcttctcctctaactatttccattttctgccctag

SEQ ID NO: 24233 - DNA, 1062 bp, Artificial Sequence
  Description of Artificial Sequence: Synthetic coding sequence
atggagctgaccgagctgctgctggtggtgatgctgctgctgaccgccaggctgacattatcatcacctgcgccgcctgcctgcgacttgagagtgctgtctaagttgctgcgggactcccacgttctgcacagccgcctctcccaatgtcctgaggttcacccccttccaacccccgtgctactgcctgccgtggactttagtctgggagaatggaagacacagatggaggaaacgaaggcacaggatatcttaggcgccgtgaccctcctgctggagggagtgatggccgcccgaggccaactcggtccaacttgcctgtcctcactgctcggccagctgagcggccaagtccgcttgctccttggggctctccagagtctgctcgggacgcagctccccccccagggtcgaaccactgcccataaggatcctaatgccatttttctgtcatttcagcatcttctgagaggtaaagtcagattcctgatgttggttggtggcagcacactgtgcgtgaggcgggccccgcctaccacggccgttcctagtcggacctccctggtgctcacgttgaatgagctaccaaatcgtacatcagggctccttgaaacaaatttcaccgccagcgctagaactacaggcagcggcctcctcaaatggcagcagggttttagagctaaaatccccggactgttgaatcagacctcccgctccctcgaccagatcccaggttacctgaataggatacatgagctcttgaatggaactagaggtctgtttccagggccaagtagacggacactgggagcccctgacatctcttctggaacttcagatacggggagcctcccgccaaatcttcagcccggctattctccctctcctacgcaccccccaaccggacagtacacattattcccgctgcctccgaccctaccaaccccagtggtccagctccaccccctactcccagatccttcagcccccaccccgacacctacgtcccccctgctgaacacctcatacactcactcacagaatcttagtcaggaagggtag

SEQ ID NO: 24234 - DNA, 537 bp, Artificial Sequence
  Description of Artificial Sequence: Synthetic coding sequence
atgaccgtgctggcccccgcctggagccccaccacctacctgctgctcctgctgctgctcagcagtggcctctcaggcacccaagactgttcttttcagcattcaccaattagttcagattttgctgtgaaaattcgggagcttagcgactatctgctccaggactatccagtcaccgtcgctagtaatctgcaggatgaagaattgtgcggcggactgtggcgcctcgtgttagctcagcgttggatggagcggctcaagacagtggccggttcaaagatgcagggcctgctggagcgggtgaacacagaaatccactttgtgaccaaatgtgcctttcagcctcccccatcatgcttgcggttcgtccaaacaaacatttcaaggctgttacaggaaacgtcagagcaactggtcgctctgaaaccatggatcactcgtcagaacttttctaggtgtctcgaactccagtgccagccagttgaaaccgtctttcatcgagtctctcaggacggcctggacctactgacttcgtag

SEQ ID NO: 24235 - DNA, 708 bp, Artificial Sequence
  Description of Artificial Sequence: Synthetic coding sequence
atgaccgtgctggcccccgcctggagccccaccacctacctgctgcttttactcctcctgtcttcaggtctgagcggcacccaggattgtagctttcaacactctccaatcagctccgattttgccgtgaagatcagagagctgagtgattacctcctgcaagactatcccgtgacagttgcgtcaaatctgcaggacgaagaactttgcggggggctctggaggctggtgcttgctcaaagatggatggagcgactcaaaaccgtcgcgggctcaaagatgcaggggctcctggagagagtcaacaccgagatccacttcgtgaccaagtgtgcattccagcctcccccttcatgtctccgcttcgtgcagaccaacatcagtaggctcctccaagaaacatcagaacaactggtggctctaaaaccctggatcactcgccagaacttctctagatgtcttgagctgcaatgccagcctgattcatccacccttcctcctccatggagtccgcggcccttggaggcaactgcccccacagctccccagcctccattgctgttgctcctccttctccctgttggcttactcttgctggccgccgcatggtgtctgcattggcagcgaacccgtagaaggaccccgagaccaggcgagcaggtgcctcctgtgcccagtcctcaggacctccttcttgttgaacattag

SEQ ID NO: 24236 - DNA, 4092 bp, Artificial Sequence
  Description of Artificial Sequence: Synthetic coding sequence
atgcagcggggcgccgccctgtgcctgcggctgtggctgtgcctgggactgctggatggactagtctctggatactccatgaccccaccgacgctgaatatcacggaagagtcccacgtgattgacactggggacagcctaagtatctcttgccgtggacagcatcccctggagtgggcttggcccggggctcaggaagcaccagccaccggcgataaggattccgaggacacaggcgtggttcgagactgtgaaggaacagacgcgcgaccgtattgtaaggtcctgttactccacgaggttcatgcgaatgatacagggtcctacgtgtgctactataaatatattaaagctcgtattgaaggcaccactgccgcaagctcttacgtgtttgtcagggactttgagcagccatttatcaacaagcccgataccctgctggtgaataggaaagatgcgatgtgggttccctgcctggtctccatccctggacttaacgtgactttaaggtctcaatccagcgtcctgtggcctgatggccaggaggtggtgtgggacgaccgccgtggcatgctagtgtcaacgcccctcttacatgatgctctgtatctgcagtgcgagacaacctggggagatcaggactttctgtctaatccatttctggttcacatcactggcaacgagctgtatgatatccagctgctgccaaggaaaagcctcgaactacttgttggagagaaactcgttctgaactgcactgtgtgggctgaatttaactctggtgtgacttttgattgggactatcctggtaaacaggccgagcgcgggaaatgggtgccggagaggaggagtcagcagacccataccgaattatcaagtattctgactatccacaacgtatcccaacacgacttgggcagttacgtttgcaaggcaaacaacggcattcaacggttccgcgagagcacagaggtgatcgtgcatgagaaccccttcatctcagtagagtggcttaagggccccattcttgaagccaccgctggggatgaactcgtgaagttacctgtgaagttagccgcttacccccccccagagtttcaatggtacaaagatgggaaagctttatcaggccggcatagccctcacgcactggtccttaaggaggttacggaagcatctactgggacatataccctcgctctctggaatagtgcagctggcttaaggaggaatatctccctagagctagttgttaatgtacctcctcagatccatgagaaagaggcttcctccccatccatctacagtaggcactcccggcaagccctgacctgtactgcctatggggtgcccttgccactgagtatccagtggcactggaggccttggaccccatgcaaaatgttcgctcagcgatccctcaggcggagacaacaacaggatctgatgccccaatgtcgtgactggagagccgtcactacacaggatgcggtgaatcctattgagagtctggacacttggaccgaattcgtcgaagggaaaaataaaaccgtctctaagctagtgatccagaatgctaatgtgtcggctatgtacaaatgtgtggtgtctaataaagttgggcaggatgaacgtctgatttatttctacgtaaccaccatcccagatgggttcacaatcgagtcaaaaccttcggaagaactgttggaagggcagcctgtcctgctgtcctgccaggccgattcttataagtacgagcacctccggtggtacaggctgaacctgagcacacttcacgatgcgcacggaaatccactcctgctggactgtaagaatgtccacctttttgccaccccccttgccgcttctctagaggaggtggcgccgggcgcacgccacgcaacactgagcctctcaataccccgggttgccccagaacacgaggggcattacgtatgcgaggtccaagaccggaggagtcatgataagcactgtcacaagaaatacctgagtgttcaggccctcgaagcccctcgcctcactcagaatctgactgacctgcttgtcaatgtcagcgactccctggagatgcagtgtctcgtcgcaggtgcccacgcgccgtctattgtctggtacaaagatgaacggctccttgaagaaaagtctggagttgacctggccgattccaaccagaaattatcaatccagcgggtgcgggaagaggatgcgggacggtacctgtgcagtgtttgtaacgctaaaggatgtgtcaattctagtgccagtgtagctgtcgagggttccgaggacaagggctctatggaaatagtgatcttggtgggtacaggagtcattgctgtgttcttctgggttctgctcttgctgattttctgcaacatgcgccggcccgcccacgctgacattaagacaggctacctgtccataatcatggacccgggagaagtcccactggaagaacagtgtgagtacctgtcttacgacgcctcgcagtgggaattcccacgagagcggttacatctcggacgtgtgctggggtacggcgccttcggaaaagtcgtggaggcatccgcattcgggatccataagggatcctcatgtgacactgtagctgtcaagatgttgaaggagggcgccaccgcaagcgaacaccgagcactgatgagtgagctgaagatcctgatccacattggcaatcacctcaacgtagtgaacctccttggtgcctgcaccaagccccaaggccctttgatggtgatcgtcgaattttgtaaatatggaaacctctccaatttcctcagggccaaaagggatgcattttcaccttgcgctgagaaaagcccagaacaacgaggacggttccgggccatggtggagctcgcacgacttgacaggaggaggccgggatcctctgatcgtgtgctattcgctcggttcagcaaaactgaaggaggggccagaagggcatctcctgaccaggaggcggaagatttatggctatccccacttacaatggaggacctggtatgttactcgttccaagtcgctcgcggtatggaatttctggccagtcgcaagtgtatacaccgcgatttagctgcacgaaacattctcctgagcgaaagcgacgttgtgaagatctgtgactttggcctagctcgtgatatctataaggatcccgactatgtgcggaagggttccgctcgcctgcctctgaagtggatggcccccgagtccatctttgataaggtgtatacaacccagtccgacgtctggtcgttcggggtgctgctctgggaaatattcagtcttggcgcctccccctaccctggtgtgcagattaacgaggaattctgccagcgcttgagagacgggactcggatgcgggctccagaactcgcaactccggcgattcgccgtatcatgctcaattgttggtccggagatccaaaagccaggccagctttctccgagctggttgagatccttggggacctgcttcagggtagaggcttgcaggaagaagaggaggtttgtatggctccgcgcagcagccagtcctctgaggaaggaagcttcagtcaggtgagtaccatggctctgcacattgctcaagctgacgcagaagattctccaccttcgctgcaacggcatagcctcgccgccagatattataattgggtcagcttcccaggctgtcttgcccgaggcgccgagacgagaggctcttccaggatgaagacctttgaggaatttccaatgacgccaaccacgtataaaggatccgtggataaccaaacagattccgggatggtgctcgccagtgaagaatttgagcagatcgagagccgtcacaggcaggaatcaggcttttcctgcaaagggccgggtcagaacgtggctgtcacccgggcccaccctgatagccaggggcgccgtagaaggcctgaacggggcgcccgaggaggacaagtcttctataattccgagtacggcgagttgtctgagccatccgaggaggatcattgctcgccctccgctcgcgttactttctttacagacaatagttactag

SEQ ID NO: 24237 - DNA, 2283 bp, Artificial Sequence
  Description of Artificial Sequence: Synthetic coding sequence
atgctggtgagcacccccctgctgcacgacgccctgtacctgcagtgcgagactacatggggagatcaggattttctcagtaatccttttttggtccacattaccggtaacgagctttatgacatccagctcctcccccgtaaaagtctcgagctgctggtgggtgagaaacttgtactgaactgcacagtgtgggcagaattcaattccggagtcaccttcgattgggactatcctgggaaacaggctgaaaggggtaagtgggttcctgagaggcggagtcagcagacacacacagaactatctagcattctcaccatccacaacgtctcccagcacgacttagggtcttacgtatgcaaggccaacaatgggatccaacgcttcagggaaagcaccgaggttattgtgcatgagaatccttttatctcagtcgagtggctcaaaggaccaattttggaggcaactgccggggacgagctcgttaagttgccggtcaagctggccgcttaccccccgccagagtttcagtggtacaaggatggcaaggccctatctggacgccactctccccacgcgctcgtcttgaaagaagtaaccgaagccagtacggggacttataccctcgccctttggaatagcgctgctggcctccggcgcaacatttcgctcgagctcgtggtcaacgtaccacctcagatccatgagaaagaggcttctagtccctccatttattctcggcattctaggcaggcactgacttgcactgcttatggtgtgccactaccactctcgatacaatggcattggcgaccttggacaccttgcaagatgttcgctcagcgctctttacggcgacgccagcagcaggacttaatgcctcagtgccgggactggagagccgttaccacccaggacgcagtcaacccaattgagagcctggatacttggacggagtttgtcgaggggaaaaacaaaacagtttcgaagttggtcattcagaatgccaacgtaagcgccatgtacaagtgcgtggtgtcgaacaaagtggggcaggacgaacgactgatctacttttatgtcaccaccataccagacggtttcacaatcgagagtaaaccttcagaggagcttttagaggggcagccagtgcttctttcctgccaggccgatagttacaaatatgagcacctgcggtggtatcggctgaacctttcaaccctgcatgatgcacatggcaacccccttctgttggactgtaaaaacgttcacctgttcgcgacaccgttggccgcctcacttgaagaagtggcaccaggggcaagacatgcaaccctttctctgtcaatcccccgagtggcgcctgaacatgaaggtcactatgtctgcgaagtgcaagaccgaaggtcacacgacaagcattgccataagaagtatcttagtgtgcaggcactcgaggccccaagactaactcagaatctgaccgatttgcttgtgaacgttagtgactcattggagatgcaatgcctggtggcaggggcgcatgcccccagcattgtgtggtataaggacgagcgcttattggaggagaagtctggagtggacttggcagacagtaaccagaagttgagcatccagcgcgttcgcgaggaggatgctggccggtatctatgctccgtatgcaacgctaaaggttgcgtgaacagcagtgcctctgtggccgttgaggggtccgaggataaaggctcaatggaaatcgtgatcctggtgggaacaggagtgatagccgtgttcttctgggtacttctgctgctcatattctgcaacatgcgtcgccccgcacacgccgatattaagaccggctacctgagcattatcatggacccaggggaagtgccgcttgaggagcagtgcgaatatctgagttacgacgcatcccaatgggaatttcctagagagaggctgcatctgggccgcgttctggggtatggtgccttcggaaaagttgtggaagcctctgcgtttggcatccacaaggggagcagctgcgatacggtggccgtcaaaatgctaaagggagtgggatctgctggagggagaggttcgctggcaggtgaagagcaacagttaggtgttggccggtgggatgggaattccggtagggaaaccgaagctgggtcgcaatctcatcccaggttttatcgtgaggcagctggatttcgcgccgaaggtcctccagagcctccttctgtgggacctgctggctgtcccgggggcccctag

SEQ ID NO: 24238 - DNA, 3897 bp, Artificial Sequence
  Description of Artificial Sequence: Synthetic coding sequence
atgcagcggggcgccgccctgtgcctgcggctgtggctgtgcctggggctgctcgacggcctggtgtcaggctactcaatgacgccccctacactgaacattaccgaggaatcccatgtgatagatacgggagacagcctgtccatatcatgcaggggccagcaccctttggaatgggcctggcccggcgcgcaggaggcacccgccacaggagacaaagacagcgaggatacaggagtggtgcgtgattgcgaaggaaccgatgcgcggccctactgtaaggtgcttcttctgcatgaggtgcatgctaatgacacagggtcttatgtgtgttattataagtatattaaagcccgcatcgaaggtactaccgcagccagcagctacgtcttcgtgagggatttcgaacagccctttattaacaaaccagacaccctcctcgtgaatagaaaggatgcgatgtgggttccttgtttggtctccatcccgggccttaacgtcaccctgaggtctcaatcatcggtgctgtggcctgatgggcaggaggtcgtatgggatgacagacgagggatgctcgtgagcactcctctgctgcatgacgccctgtacttgcagtgtgaaacaacctggggggatcaggatttcctatctaaccccttcctggtgcacataacaggaaatgagctctacgatattcaattgttgccccgaaagagtctggagctgctggtgggagagaaactggtacttaattgtaccgtgtgggctgagttcaacagtggcgtgactttcgactgggattaccctggcaagcaagccgaacggggcaagtgggttccagaacgcaggtcacagcagacacacacggagctgagttctattcttacaatccataacgtgagccagcacgatctgggcagctacgtctgtaaggcgaataatgggattcaacgcttcagagaaagcacagaggtgatcgtgcacgagaatccattcatttcagtggagtggctcaagggccctatccttgaggccaccgcaggcgatgagctagttaagctgcccgtgaaactcgcggcctatcctccccccgagttccagtggtacaaggatgggaaagcccttagcgggagacattccccccacgctctggtccttaaggaggtgaccgaggcatccacaggcacctatacattggccttgtggaattcagcagccggcttacggcgtaacataagtctcgaacttgtggtgaatgtgcctccccaaatccacgagaaagaggctagttctccttctatatactccagacactcgcgccaagctttgacctgcaccgcctacggggtcccactcccactgagcattcagtggcactggcgcccctggaccccctgcaagatgttcgcacaacgcagtcttcgcaggagacagcaacaggacctaatgccccaatgccgagactggcgggctgtgactacacaggacgcggtcaatccaattgaatcactcgatacttggactgagttcgtggagggtaaaaataagacagtttctaagctagtaattcagaatgctaatgtttccgctatgtacaagtgtgtggtgagcaacaaagtcgggcaggacgaacgcctaatttatttctacgtgactacaatccccgatggttttacaattgagagcaaaccaagcgaggagctcctcgagggacagcctgttctgttgtcctgccaggcggatagctacaaatatgagcacttgagatggtatagactgaatctgtctacattgcatgacgcccatggaaaccccctcctgttggactgtaaaaatgtgcatcttttcgcaacaccactggcagcatcattggaggaggttgctccgggggctaggcacgcaactctttcactttcaatccctagggtggccccagagcacgagggccactacgtatgcgaggtacaggatcgtcggtctcatgacaaacactgccataaaaaatatttatccgttcaggctctggaagctccccgactgacccagaacctaactgatttgctggtgaatgtgtcagacagcttggagatgcagtgcctcgttgcaggcgcccacgccccaagcatcgtctggtataaagacgaaaggctacttgaggagaagagcggagtcgacctagccgacagcaaccagaagttaagtatacagagagtgcgggaggaagacgctgggcgatatctatgtagcgtctgtaacgctaagggttgcgttaacagcagtgcaagtgtagctgtagagggatcggaggacaaaggatctatggagatcgtcattttagttggcacgggtgtgattgccgtctttttttgggtattactactgcttatcttttgtaatatgcgcaggccagcccacgccgatatcaagactggctacttgagcataattatggatcccggagaagtcccgctggaagaacagtgtgaatacctcagttatgatgcttcgcaatgggagttccccagggaacggcttcacctcggtcgtgttctgggatacggtgcctttggaaaagttgtggaggctagcgcatttggaattcacaaaggttcctcctgtgacaccgtcgctgtcaagatgctgaaagagggagccacagcctcagaacatagagctctgatgagcgagctgaagatcctcattcatatcggcaaccatttgaacgtcgttaacctgctgggcgcttgcaccaagcctcagggcccattgatggtcatagttgagttttgcaaatatggaaatcttagcaattttctgcgggccaagcgggacgccttcagcccttgcgcagagaagtcccctgaacagcgggggagattcagagctatggttgagttggcaagactggatcgtagacggcctggaagcagtgaccgcgtgctgttcgccagattctcaaagaccgagggaggtgccagacgggccagccccgaccaggaggccgaggacttgtggctttcaccactgacaatggaagacctggtgtgctatagcttccaggttgccaggggcatggagttcctggcaagccgcaagtgcatacacagagatctggcagctcgcaacattctcttaagtgaaagcgacgtagtcaaaatttgtgacttcgggctggcccgggacatatataaggacccagactatgtccgaaaagggtctgcgaggctgcctctgaagtggatggctccagagtccatctttgataaggtttatacaacccagtccgacgtgtggtccttcggagttctcctctgggagatctttagtctgggagcctcaccatatcctggagtgcagattaacgaggaattctgtcagaggttacgcgacgggacacgcatgcgagctcctgaacttgccactccggctattcgccgaatcatgctcaactgttggagcggagacccaaaagcccggcccgctttttctgagctggtagaaatcctcggggatctgttacagggaaggggcctgcaggaggaagaggaggtctgcatggcccctagaagctctcagagctctgaggagggctcgttctctcaggtgtcaaccatggcactccatattgcccaggccgacgcggaagacagtccaccaagcctccagcgacatagcctcgccgcaaggtactataactgggtgagttttcctggttgcctggctcgcggagctgagaccaggggcagttcccgaatgaagacctttgaagaatttcctatgaccccgactacttacaaagggagcgtggataatcagaccgatagtggaatggtcctcgcttccgaagagtttgaacaaatcgaatcacgacaccgccaagagtctgggtttcgctag

SEQ ID NO: 24239 - DNA, 3921 bp, Artificial Sequence
  Description of Artificial Sequence: Synthetic coding sequence
atgcagcggggcgccgccctgtgcctgcggctgtggctgtgcctgggcctactggatgggttagtgtctggatacagcatgacaccacccacacttaatattacagaggagtctcacgtgatcgacaccggcgattccttgtcaatctcctgcagagggcaacaccctctcgaatgggcctggccaggtgcacaggaagccccagccactggcgacaaggactctgaagacaccggcgtggtgagggactgcgaggggactgacgcccgcccctattgcaaggtgctccttctacacgaagtacacgctaatgacacaggcagttacgtgtgctattacaaatacataaaggctagaatcgaggggaccacagcagcaagctcctacgtcttcgttagagattttgagcagccattcattaataagcccgacacactccttgtcaatcggaaggacgccatgtgggtgccatgcctggtgagcatcccaggacttaatgtgaccctgcggagtcagagctctgtcctctggccggacggacaggaggtcgtttgggacgacaggcgcggaatgcttgtttcaactcccctcctgcacgacgctttgtaccttcaatgcgaaacgacgtggggagatcaggattttctgtctaatcctttcctggttcacatcaccggcaacgaactgtacgatatccagctcctgccaagaaaatctctcgagctcctcgtaggtgagaagctggtccttaactgtactgtgtgggccgagttcaactcaggtgtaaccttcgactgggattaccctgggaaacaggctgagcgtggcaagtgggtcccagagcgccgtagtcagcagacccatacggaactcagttccatcctgacaatacacaacgtgagccaacacgatttaggatcatacgtatgtaaggcaaacaatggtattcagagatttagggaatctacagaggttatcgtgcacgaaaatcccttcatctcagtcgagtggctgaaaggcccgattctggaagcaaccgcaggtgatgagctggtgaagcttcccgttaagctcgctgcgtatccacctcctgagttccagtggtacaaagatggaaaggccttgtcaggacggcacagcccccatgccttggtactgaaggaagtgacagaagcctccaccggcacatacacattagctctctggaatagcgccgcggggttgagaaggaatatttccctcgagctggtcgtcaacgtgccacctcaaatacatgagaaggaagcaagcagcccatctatttacagccggcacagtcggcaagccttgacatgtaccgcctatggagtgccactccctctgtccatccagtggcattggaggccatggacaccatgtaaaatgtttgcccaacgatcattgcgccggagacagcagcaggatctgatgccccagtgtcgggattggcgggccgtaactactcaggacgcagtgaatcccattgagtcattggatacctggactgagtttgttgaaggcaagaacaagactgtgagcaagctggttatccagaacgccaatgtgagcgcgatgtataagtgtgttgtgtccaacaaggttggtcaggatgaacgattgatctatttttatgtgaccacgatccccgacggcttcaccatagagagcaaaccttctgaggagctcctggagggtcagccagtcctgttaagctgccaggcagactcttacaagtacgagcaccttcgatggtaccgcctaaacctgagtacactgcacgacgctcacggcaaccctctactgttggattgcaagaatgtacatctttttgccaccccattagcagcaagcctggaagaagtggccccaggtgcccggcatgctacactgtccctaagcataccgagagttgctcccgaacacgagggacactacgtgtgtgaggtgcaggaccggaggtcccatgataagcattgccataaaaagtacctgagcgtgcaggcactggaagccccccgcttgacgcagaacttaacggatcttctggtgaatgtgtcagacagccttgagatgcagtgcctggtggccggtgctcacgcaccttctatcgtgtggtacaaagatgagagactgctggaagaaaaatcaggtgtggacctggcagacagcaatcaaaagctttctattcagcgggttagagaagaggacgcgggccgatatctttgctcagtgtgtaacgcaaaggggtgtgtcaacagctcagcctcggtggcagtggagggaagtgaagacaaaggctcaatggagatcgtgattttagttggcaccggcgtgattgcagttttcttctgggtgttactcctgctaatcttctgcaatatgcgtagacctgcccatgccgacataaaaaccggctatctaagcattatcatggatccaggtgaagtgcctctcgaggagcagtgtgaatacctgagttatgacgcctcgcagtgggaatttcccagagaacggctgcacctcgggcgggtgctgggttacggagcatttggtaaggttgtcgaggcctcagccttcggtattcataaaggctcctcttgtgatacagtggctgttaagatgctaaaagagggtgccaccgccagcgaacacagggcacttatgagcgaactgaagatccttatacacatcggtaaccaccttaacgtggtgaatctgctgggggcttgtactaagccccaagggccactgatggtgatagtggagttttgtaagtacggcaatctctctaattttttgcgcgccaagcgcgacgcttttagcccatgtgcagagaagtcacccgagcagcgtggccgtttcagggccatggtagagctggcacggctggaccgtcgccgacccggatccagcgatcgggtcctattcgcccggttttccaaaactgaaggaggggctagacgcgccagccccgaccaggaagctgaagatctgtggctctcgccactgaccatggaggacttggtgtgttattccttccaagtcgctcggggtatggagtttctggccagtagaaaatgtatccatcgcgacttagccgccaggaatatcctgctcagcgagtcagatgtcgtgaaaatctgtgactttggccttgcccgtgatatctacaaggacccagattatgtgcgcaagggctccgcccgcctcccactgaagtggatggctccagagagtatcttcgataaggtgtataccactcagtccgatgtgtggtcgtttggggtcctattgtgggagatcttctcgctaggcgcttcaccctaccctggcgttcagataaacgaggagttttgtcagcggctgagagacggcacacgaatgcgcgcccccgagctcgctactcctgcaatcaggagaattatgctcaattgctggagcggtgacccgaaagctcgccctgcattcagcgagctggtggagatactcggtgacctcctccagggtaggggacttcaggaggaggaagaggtgtgcatggcccccaggagtagccaatcatccgaagagggcagcttctcgcaggtctcaaccatggccctgcatattgcacaggccgacgccgaggactctcctcctagcctacagcgtcacagtctcgcagcaaggtactataattgggtctcatttcctggctgtcttgccagaggcgcagagaccagaggctcttctagaatgaaaaccttcgaggaattcccaatgaccccgaccacgtacaagggcagcgtcgataaccaaaccgatagtgggatggtgctcgcgagcgaagagtttgagcagattgagagccgccatcgccaagagagcggttttagggggactcggcgcacacgcggggcttag

SEQ ID NO: 24240 - DNA, 1740 bp, Artificial Sequence
  Description of Artificial Sequence: Synthetic coding sequence
atgaacgccatcgtggccctgtgccacttctgcgagctgcacggcccaagaactttgttctgtaccgaggtgttgcacgccccactgccccagggggatggaaacgaggattctccaggtcagggcgagcaggccgaagaagaagaaggagggattcaaatgaatagccgaatgagggcacattccccagcggaaggcgcgtcagtggaatcctcatcccctggccctaaaaagagcgatatgtgcgagggctgtcgcagcctcgccgctggacatccaggctacatttctcacgacaaagagaccagtatcaaatatgtgtcccatcagcatccttcacatccgcaattgtttagcattgtcagacaagcctgcgttcggtctctcagctgtgaggtgtgtccaggacgagaaggaccaattttttttggtgatgagcagcacgggttcgtgttttcgcatactttttttattaaagatagtctggccagggggttccagcgctggtacagcattatcacgataatgatggacagaatctatcttatcaattcatggccctttctgctaggaaaagtaagaggtataattgacgaactgcagggcaaggcccttaaagtattcgaggcagaacaattcggatgccctcagcgcgctcagagaatgaataccgccttcacacccttccttcaccagcggaacggcaatgcagcaagatctttaactagtctaacttctgatgataacctctgggcctgtctgcacactagcttcgcgtggctgcttaaggcttgtggatcgcgtctcacagaaaagttgctggagggagcaccaactgaggatactctggtgcagatggaaaaattggcagacttggaagaagaatccgaaagctgggataattcagaagctgaagaagaggagaaggccccagtactgcccgaatcaacggagggtcgcgagcttacgcagggaccagcagagtcttcttcactgagcggttgtggctcctggcagcctcgcaagctgcccgtctttaaaagcctgcgccacatgcgacaagtacttggcgccccctcttttagaatgctcgcatggcatgtcctgatgggaaaccaagttatttggaaatctagggacgtcgacttagtccagtcagccttcgaggtgctaaggaccatgctccccgtcggctgcgttaggatcatcccgtattcaagccagtatgaagaagcctacagatgtaatttcctgggactgagccctcatgtgcagatccctcctcacgtgctgtcctcagagttcgctgttattgtggaggtccacgcagcagcccgcagcacactgcatccggtcggttgtgaagacgaccagtcgctcagcaagtatgagtttgtggtgacgtccggatctccagtagccgctgaccgcgttggacctaccatcttgaataagatcgaggcagcactgacaaaccaaaacctgtctgtggacgtggtggatcagtgcctggtctgtcttaaggaagagtggatgaacaaggtcaaagtgctgtttaaattcactaaggtggatagtagacccaaggaggatactcaaaaactgttatccatcctgggagcaagtgaggaggataatgtgaagctgctgaagttctggatgaccgggttatccaagacttataaatcacacctgatgtccacggtccgttccccaacagccagcgagtctcgcaactag

SEQ ID NO: 24241 - DNA, 594 bp, Artificial Sequence
  Description of Artificial Sequence: Synthetic coding sequence
atgaacgccatcgtggccctgtgccacttctgcgagctgcacggccccagaactcttttttgcacagaggtcctgcacgctcccctccctcagggcgatggcaacgaggatagccccggacaaggcgagcaggctgaagaagaggaaggtgggatccagatgaactcaaggatgagggcacattccccggctgagggtgcgagtgtggagagctccagtccgggcccaaagaagtccgacatgtgtgagggctgtcgatccctcgcggccgggcatccaggatacataagtcatgacaaggaaacaagcattaaatatgtatcccaccagcacccatcacatccgcagctattttccatcgtccgccaggcttgcgtccggtcactgagctgcgaggtgtccttagtagctactgaaccagtctcggttggcgcccacatgctccctggagcactgggtggactgggtgccagtatcgcccagggtggtcgccattggagctcactcagggccgatccacagatatctaccgcccaaggcactggccgactgccgtgtcccgagctcagggaggaatcctgttggacttgttag

SEQ ID NO: 24242 - DNA, 1029 bp, Artificial Sequence
  Description of Artificial Sequence: Synthetic coding sequence
atgaacgccatcgtggccctgtgccacttctgcgagctgcacggccctcgcacactcttctgtactgaggtgctgcacgctcctcttcctcagggagacggtaacgaggatagccctggccagggggagcaggccgaagaggaggaaggcggaatccaaatgaactctaggatgagggcccactctcccgctgaaggagcctcagtcgagtcttcctctcctggcccgaagaagagcgacatgtgcgaaggttgtagatctctggcagccggccatccaggttacatctcacatgataaagagacttccatcaagtacgtgtcccatcagcatccatcccacccccagctgtttagcatcgtgcgccaggcttgcgtcagaagtctgtcctgtgaagtgtgtcctggacgagaaggcccaatctttttcggcgatgagcagcacggatttgtgttttcccatacctttttcattaaagactctctggctcggggtttccagagatggtattctattatcactattatgatggaccggatttatctgatcaactcttggccgtttctgctcggaaaagttagaggaattatcgacgagctccaggggaaggctctgaaggtgttcgaagcagagcaattcggctgcccacagagggctcagagaatgaacacagctttcacaccattcctccatcagcgcaatggaaatgcagccagaagcctgacaagcctgaccagcgatgataacttatgggcttgtctccacaccagtttcgcttggcttctgaaagcctgcggaagccgcctgaccgaaaagctcctcgaaggcgccccaactgaagatacactagtccagatggagaaactggccggcgaagccggcgttttactgcccggcccctggcccgggtggccctggggcggaacctcatgtctgctctcatggcaggagtctctccgtgaaggaaatgccgctttgaaccaaccacggacaagtctgcgcgaggctcatcctcccataagtgtctag

SEQ ID NO: 24243 - DNA, 594 bp, Artificial Sequence
  Description of Artificial Sequence: Synthetic coding sequence
atgaacgccatcgtggccctgtgccacttctgcgagctgcacggccctcggaccctgttttgtactgaggtgcttcatgcccctctgcctcagggcgacggtaatgaagattcacccggacaaggagagcaagccgaagaggaagaggggggcattcaaatgaattcccgcatgcgggctcatagtccggctgagggagcctctgtggaaagcagttcccccggcccgaagaaaagcgatatgtgtgagggatgcaggtccttagctgccgggcatcccgggtatatcagccacgacaaagagacgtcaatcaaatacgtgagccatcagcatccatcgcatccacagctcttttctatcgtgcgccaggcttgcgtgcggtccctgtcctgtgaggtgtccttggtggcaacagagccagtaagcgtgggtgctcatatgctcccgggcgctctgggaggcctcggagcttctatcgctcagggcggcagacattggtcctctctgagggcggatccacagatttcaacggcccaggggaccggacggctcccttgtcctgagctcagagaagagtcatgctggacatgctag

SEQ ID NO: 24244 - DNA, 462 bp, Artificial Sequence
  Description of Artificial Sequence: Synthetic coding sequence
atgaacagccggatgcgggcccacagccccgccgagggcgccagcgtagagagtagcagcccaggccccaagaagtctgacatgtgcgaaggatgcaggtccctggccgcagggcacccaggctatatctcacatgacaaggagaccagcattaagtatgtaagccaccagcatccttcacatcctcagctgttctctatagttaggcaggcctgtgtgagatccctatcctgtgaggtttgtcctgggcgagagggccctattttcttcggcgacgaacaacacggcttcgtgttctcccatacattcttcatcaaagactcgctcgcccgagggtttcagagatggtattctattattactattatgatggaccgcatatatctcattaactcttggccttttctgcttggaaaggtgcgcgggatcattgatgaacttcagggcaaggccttgaagtag

SEQ ID NO: 24245 - DNA, 1419 bp, Artificial Sequence
  Description of Artificial Sequence: Synthetic coding sequence
atgctgggcaccgtgaagatggagggccacgagaccagcgactggaattcctactacgcagacacacaagaggcttactcatctgtgcccgtgagcaatatgaattctgggctaggttcgatgaactctatgaacacctacatgaccatgaataccatgactacatcagggaacatgaccccagcgagctttaacatgtcatatgccaacccggggctcggcgccggactttcacctggagctgtagctggaatgcctggtgggagcgcgggggcaatgaattctatgaccgctgccggtgtgacagcaatgggcacagcactgtctcccagcgggatgggcgctatgggggcccagcaggctgcgagcatgaatggtctgggaccgtatgctgctgccatgaacccttgcatgtctcccatggcctatgccccatctaatcttgggaggtctagggcggggggaggcggcgatgccaagacttttaaaaggtcttatccccacgccaaaccaccatactcttatatcagccttatcactatggccatccagcaggctccaagcaaaatgcttacactgtcggagatctaccagtggataatggatcttttcccctattatcgccagaatcaacaaaggtggcagaactcaattaggcatagcctctctttcaacgactgctttgtcaaagtggccagaagccctgacaagccaggtaagggaagctattggactctgcatcctgactccgggaatatgttcgagaatggctgttacttgcgtagacagaagagattcaagtgcgagaaacagccgggcgccggcggcggtgggggaagtggaagcggcgggtcaggcgccaagggtgggccagagtcccgcaaagatccaagcggggcctccaatccctccgccgattcccccctgcatcgaggcgtgcatggtaaaaccgggcaactggaaggggcacccgcccccggaccagctgccagcccgcagacgctagaccatagtggcgccaccgcaaccggtggagccagcgagctgaaaaccccagccagctccacagccccccccatcagtagcggcccgggcgccctagcttctgtccctgcctcacatcccgctcatggtctggctccacacgagtcgcagcttcacctaaaaggcgaccctcattactcattcaatcacccgttctctattaataatctcatgtcttcttcggagcagcagcacaagctggactttaaggcctacgaacaggcgttacagtattccccgtacggatctacacttcctgctagtctgccactcggtagcgcgagcgtaacaacaaggagtccgatcgaaccttccgctcttgagccggcatactaccagggagtgtatagtaggccggtcctcaacaccagttag

SEQ ID NO: 24246 - DNA, 1320 bp, Artificial Sequence
  Description of Artificial Sequence: Synthetic coding sequence
atgaacagcggcctgggcagcatgaacagcatgaacacctacatgacaatgaacacaatgaccacatctggcaacatgaccccagcctccttcaacatgtcttatgctaatcccggactgggggccggactctcacctggcgcggtcgccggaatgccaggcggctcagctggagctatgaatagcatgacggccgctggcgtcacagctatggggacagcattaagccctagtgggatgggggccatgggagcgcagcaggctgcctcaatgaatggcttggggccatacgctgccgccatgaatccctgcatgtcccctatggcctacgctcccagtaatttggggcgaagccgggcagggggagggggggacgcaaagacgttcaagcggagctaccctcatgctaagcctccctacagttacatcagccttataactatggccatacagcaagcgccatcaaagatgctgacacttagcgagatctatcagtggattatggatctcttcccctattaccgccaaaaccagcagagatggcagaactccattcggcactccttgagttttaacgactgcttcgtcaaagttgcgcgcagccccgacaagcctggaaagggttcctactggacactccatcccgattctggaaacatgttcgagaacgggtgctatctccgacggcagaagaggtttaaatgtgaaaaacagccaggagctggaggggggggaggcagtggctccggcggatccggcgctaagggaggccctgaatctcgaaaggacccaagtggggcatctaacccatctgccgacagtcccctgcataggggcgtgcacggtaagaccggtcaactcgagggcgcacctgctccagggcctgctgcatctcctcagactctggatcactcaggcgcaacagccaccgggggcgcatccgaactcaagactcccgccagctcaaccgcccccccaatttcttcaggcccaggagccctggcctccgtgcccgcatctcacccggcccacggccttgctccccacgaatcccagttacacttgaagggcgatccacattacagtttcaatcatccattctccataaacaacctgatgtccagttccgaacaacagcacaagctggactttaaagcttatgaacaagcactgcagtactctccttacggatcgactttgccagctagccttcccctcggatccgcctccgtgacaacccgaagtcctatagagccctcagcacttgagcctgcttactaccagggagtctattccaggccagtccttaatacttcatag

SEQ ID NO: 24247 - DNA, 1506 bp, Artificial Sequence
  Description of Artificial Sequence: Synthetic coding sequence
atgcaggcccggtacagcgtgagcgaccccaacgccctgggcgtggtcccctacctttcagagcaaaattactatagagctgcagggtcttatgggggaatggcctcccccatgggagtctactcaggtcaccctgaacaatacagtgcaggtatgggccggagctacgctccataccatcaccaccagcccgccgctcccaaagacctggtgaaaccaccatactcctatattgcactgattactatggccattcagaacgcccccgaaaaaaaaattacgcttaatggtatttatcaatttatcatggaccgcttcccgttctaccgcgagaacaagcaggggtggcaaaacagtatacgccataatttgtctctgaacgaatgtttcgtgaaagttcccagagatgacaagaagcctggaaaaggaagttattggactctggatcctgactcctacaacatgtttgagaacggcagctttcttcgtcgccggaggcgatttaagaagaaggatgtgtcaaaagagaaggaggagagagcacacctgaaggagcccccaccagcagcctctaaaggggcaccagcaaccccacacctggctgacgcccccaaagaagctgagaagaaggtggttatcaagagtgaagctgcttcacccgcactacccgtgatcacaaaagtcgaaacgctatcccctgaatctgccctccaaggctctcctagatccgcagcgtcaacccctgcaggcagcccagacggctcattacctgaacatcatgctgccgcccccaacggccttcctggattttccgtggagaacatcatgaccctgagaacgagcccacccggaggcgaattgtcaccgggcgctgggcgggccgggctggtagtgccacctctagcgctgccatacgcagcagccccaccggcggcatacggtcagccatgtgcccagggtttggaagccggggccgctggaggctatcagtgctcaatgcgggccatgtcactgtacactggggccgagcgtcccgctcacatgtgcgtgccgccagccctggatgaggcgttgagtgaccacccctcgggtcccactagcccactcagcgcgctcaacctggctgccggacaggaaggtgcgcttgctgcaaccgggcatcaccaccagcaccatgggcaccaccatccacaggcgcctcctccaccacctgcaccccagccccagccgactccccagccaggcgcagcggcggcgcaggctgccagctggtacctgaatcatagcggcgacttgaatcatctgcccgggcataccttcgctgcccagcagcaaacttttccgaatgtgcgtgagatgtttaactcccacaggctgggaattgagaacagcaccctgggtgagtcgcaagtcagtgggaacgctagctgtcagctcccttatagatccaccccccccctctatcggcacgccgcgccctattcctacgactgtaccaaatactag

SEQ ID NO: 24248 - DNA, 1968 bp, Artificial Sequence
  Description of Artificial Sequence: Synthetic coding sequence
atggccgaggccccccaggtggtggagatcgaccccgacttcgagccccttccccggcctagatcctgtacctggcctctgccaagaccagaatttagtcagagcaactcagccacgtcaagcccagcaccttccgggtccgccgcagctaatccagatgccgccgcgggactgcccagcgccagcgccgccgcggtgtctgctgacttcatgtcaaacctgagcctattagaagaaagcgaggatttccctcaagcgccagggtccgtcgcagcagcggtcgctgccgccgcagcagcggcggccacaggagggctttgcggtgactttcagggtccggaggccggttgcctgcacccggctcccccccagcctcctccccctgggcccctcagccagcaccctccagtgccaccagctgccgcaggccccctggctggacagcctagaaaatcttcctcaagtaggaggaatgcctggggtaacctatcctacgctgatttaatcaccaaagccattgagtcctctgccgagaaacgcctgactctttcccagatatatgagtggatggttaaatccgtgccatactttaaggacaagggtgactccaatagctctgctggctggaaaaattctattagacataacctctctcttcacagtaagttcataagagtccagaatgaaggtaccggcaaaagtagttggtggatgctaaaccctgagggaggaaaaagcggcaaaagccctagacgacgcgctgcaagcatggataataattctaaatttgccaaatcgcgctcaagggcagctaagaagaaggcttctctgcagtctggccaagagggcgccggcgattctcccggctcccagttcagcaagtggcccgccagccctggtagccattctaatgacgatttcgacaactggagcacctttcggccacgtacaagttcaaacgcctctactattagtggcagactgtccccgattatgacagaacaagatgacttaggggagggcgacgtccatagcatggtctaccccccatcggccgccaaaatggcctctaccctgccttcactttccgagatcagcaatcctgaaaatatggaaaaccttctcgacaaccttaatttgctctctagccccacctccctgactgtgtccacccagagtagcccaggcacaatgatgcagcagactccttgttatagttttgcgcctcctaacaccagccttaatagcccatctccgaattaccagaaatacacctacggacaaagttcgatgtctcctttaccacagatgcccatacaaaccctccaggacaataagtctagctatggggggatgtcccaatataattgtgccccgggattgctgaaagagctgcttacttctgattctccacctcacaacgacattatgacgcctgtagacccgggggtcgcccaaccaaacagtagggtactaggacagaacgtcatgatgggtcccaattctgtgatgtcaacttatgggtcccaggcgtcccataataaaatgatgaacccgtcaagccacacacatcccggtcatgcccagcagacatctgcagtcaacgggagaccattgccccacacagttagcaccatgcctcacacatccggaatgaatcgcctgacgcaggttaagactcccgtgcaggtgcccctccctcaccctatgcagatgtccgctcttggcggctactcgtcggtgtcgtcttgcaatggctacggcaggatggggctgttacaccaagaaaaattgcctagcgatctcgatggcatgttcattgaaagattagactgtgacatggagtcaattataaggaacgacctgatggacggcgataccctggacttcaactttgacaatgttttgcctaaccagagcttccctcactctgttaagactaccacccactcctgggtatcaggttag

SEQ ID NO: 24249 - DNA, 2022 bp, Artificial Sequence
  Description of Artificial Sequence: Synthetic coding sequence
atggccgaggcccccgccagccccgcccccctgagccccctggaggttgaattagatcctgaattcgagccgcagagtaggccaaggagctgcacttggcctctccaacgtcctgagctgcaagcctctccagccaaacccagcggtgagacggccgcagattccatgattcccgaggaggaggacgatgaggatgacgaggacgggggcggcagggccggtagcgcaatggcaattgggggcgggggtggttccggtaccttaggcagtggcctgctcctcgaagacagcgcaagagtgctggccccagggggacaggacccaggaagtggtccagccaccgccgccggagggctgagcggggggacgcaagcgctgcttcagccacagcagcccctaccgccccctcagcctggcgccgccggtggatctgggcaaccacggaaatgctcctcacgcagaaatgcttggggaaatttgtcatatgctgacttgattacccgggccattgagagcagccccgataaaagattaactctcagtcagatatacgaatggatggtgaggtgtgtgccatactttaaggataaaggcgacagtaacagttcagccggttggaagaatagcattcgccacaacctgtccctacactcacgttttatgcgcgttcaaaacgaaggaactggaaagtcctcatggtggattattaatccagacggcggaaaaagtggcaaagctccacgtcggcgggccgtgtctatggacaactccaataaatatacgaagagtcgggggcgtgctgcaaagaaaaaggcggcattgcagacagctcccgaaagcgctgacgactctcctagccagctgtcaaaatggcctgggtctcccactagcaggtctagcgatgagttagacgcttggacagacttccggagccgaacaaattctaacgcatctaccgtatcaggaagattgtctccaataatggcttccacagagctggatgaggtgcaggatgacgacgccccactgtcaccaatgctgtactcaagctctgcttctttatccccaagcgtgtctaagccatgcacagtggaactgccaagacttactgatatggccggtacaatgaacctgaacgatggtctgacagagaatctaatggacgacctgttggataatattaccttgcccccctcacagccctctcctactggcgggctgatgcagcggtctagtagcttcccctacaccactaagggtagtggactcggaagcccgacaagcagcttcaactctacggtctttggcccctcttctttgaacagcttgaggcagtcaccgatgcagacaatccaggagaataagccagcaacattctccagcatgtcgcactatggcaaccaaacactgcaagacctgctgaccagtgacagtctaagtcattcagatgttatgatgacccagtccgaccccctaatgtcacaggcctcaacagccgtatctgctcagaacagtcggagaaacgtaatgcttaggaatgatcctatgatgtcttttgctgcgcaacccaatcagggatctctggttaatcaaaacctgctgcaccatcagcaccaaactcagggcgccctgggaggcagtcgggcactgtccaactccgtctcgaacatggggctttctgagtcatccagtctgggatccgcaaaacaccagcagcagtcacccgtgagccaatctatgcagacattgtcggatagcctcagcggtagttcgctttacagtacttctgcgaatctgcctgttatgggacacgagaaattcccatcagacttggatttagatatgtttaacggtagcctggagtgcgatatggagtctattatcaggtctgaactaatggatgccgacggactagatttcaatttcgacagcctgatcagcacacagaacgtggtgggcctgaacgtgggaaattttactggcgccaaacaggcttcatcccagtcctgggtgccaggttag

SEQ ID NO: 24250 - DNA, 2022 bp, Artificial Sequence
  Description of Artificial Sequence: Synthetic coding sequence
atggccgaggcccccgccagccccgcccccctgagccccctggaggtggagctggatcctgaattcgagccccagagcaggcccagatcatgcacctggcccctccagcgccccgaactgcaggcctcacccgccaagccaagcggtgagaccgccgccgacagtatgatacccgaggaagaagacgatgaggatgatgaagacggtggaggacgggcaggctccgctatggccatcggtggtggggggggttcaggaacactggggagtggcctcctgttggaagactctgcccgagtgcttgcaccgggaggacaagacccaggcagtgggcccgcaaccgcagctgggggtctctcggggggcacccaggccctcctgcagccgcagcaacccttgcctcccccacagcccggagcggcgggaggctctgggcagccacgaaagtgcagctctaggcgtaacgcatggggcaatctcagctatgctgaccttatcacgagagctatcgagtcctctcccgacaaacgcctgactctttcccagatctatgaatggatggtgaggtgtgtcccttacttcaaggataaaggcgactctaactcaagcgcaggctggaagaacagcattcgacacaacctctcactgcacagtcggtttatgagggtgcagaacgaaggcacaggcaagagttcctggtggattatcaatcctgatggcggaaaaagcggcaaggcacctagacgtcgggccgtgtcaatggataactctaacaagtacaccaagagtcgcggaagagctgccaagaagaaggcagctttgcagaccgctcccgaaagcgctgacgactctcccagccagctctcaaagtggccaggatctccaacatcccgaagtagtgatgagctcgacgcctggacggactttcgatcacggaccaacagtaacgcgtcaactgtctcaggaagactttcccctatcatggcctctaccgagttggatgaagtccaggacgatgatgcgccattgtctccaatgttatactcctccagtgccagtttgtccccatcagtgtctaagccatgcaccgttgaactgcccaggctcaccgatatggcggggaccatgaacttaaatgacggtttgaccgagaacctcatggatgacttgcttgataatattacactgccacccagccaacctagccctacgggaggtcttatgcagagaagcagctcatttccgtacacgacaaagggaagcggactcggctctcccacctcatcctttaattccacggtcttcggcccttcttctctgaactctttgcgccaatccccaatgcaaactattcaggagaacaaacctgcaacgttcagcagcatgtctcactatggcaaccagactctgcaggatttgttaacatccgattcgttatcccacagcgacgtgatgatgacgcagagcgaccccttgatgtctcaagcgtctaccgccgtctctgcacagaattcaagaagaaacgtgatgctgcggaacgatccgatgatgagcttcgccgcccaaccaaaccagggatccttggtcaaccagaacctactgcatcaccagcatcaaacccaaggggccttaggagggtctcgtgcactgagtaatagtgtgtccaatatgggattatccgagagctctagcctgggttcagccaagcatcagcagcagtctcctgtgagccagtcaatgcagacactgtcagattctctgtctgggagctccttatacagcaccagtgctaacctgccagtgatgggccatgaaaagtttccttcagatctggatctggacatgtttaacgggtctcttgagtgtgacatggagtctatcatccggtctgagctgatggacgcggatggactggacttcaatttcgactctttgatttccacgcagaacgtggtcgggttgaatgtcggtaactttacaggcgcaaagcaagcttccagccaatcctgggtgcccgggtag

SEQ ID NO: 24251 - DNA, 1302 bp, Artificial Sequence
  Description of Artificial Sequence: Synthetic coding sequence
atgcgggtgcagaacgagggcaccggcaagagcagctggtggatcataaacccagatgggggtaagtcaggcaaagctccacgcagacgagctgtttcgatggacaactccaataagtacaccaagtcccgcggcagagccgctaagaagaaggcagcgttgcagaccgcccctgagtccgcagatgactctcccagtcagttgagcaaatggcctggatcccccactagcagatcatccgacgaactcgatgcatggacagacttccgctcaaggacaaattccaacgctagtaccgtcagcggaagactgagccccataatggcctctacagagctagacgaggtgcaggatgacgacgcacctctttctcccatgctttacagctcgtcggccagcctctcgccatcggtttctaagccttgcacagtcgaactgcccagattgacagatatggccggcaccatgaatctaaatgacggcctgaccgagaatcttatggatgatctgctggacaatatcactctccctccctcccagcctagccccacaggcgggctgatgcaaaggtcaagttcattcccttacacaacaaaagggtcggggctggggagcccgaccagcagtttcaatagtaccgtatttggtccttcatctctgaactcccttcggcagtcgcccatgcaaaccatccaagagaacaagccggcgaccttctcctcaatgagccactacggaaaccaaactcttcaggacctgctaaccagtgattccctgtcccactcagacgtgatgatgactcagtctgatccactcatgtctcaggcttcgacagctgtgtccgcacagaattccaggaggaacgttatgttgcggaatgatccaatgatgtcatttgcagctcagcctaatcagggttcgttagtcaatcagaacctgctgcaccatcagcatcagacgcagggagctctcgggggctcacgcgccttaagcaatagcgtgagtaacatgggcctgagtgagtcttcctctctggggagcgcaaagcaccagcagcagtctccggtgtctcagtctatgcagactctgtccgattcactttccggatccagtctgtattccaccagcgcgaatttgcccgttatgggccacgaaaagttcccatctgacctcgacctagatatgtctatgggagcctggaatgtcacgtggagtcccctgtctgtcgttaacagttggatgctgatgggctggattctgactctaatcccttcttccccccatcggatgctactggtgtag

SEQ ID NO: 24252 - DNA, 1362 bp, Artificial Sequence
  Description of Artificial Sequence: Synthetic coding sequence
atgcgggtgcagaacgagggcaccggcaagagcagctggtggatcattaaccctgatggtggcaaaagtggcaaggccccccgtcgtcgcgcagtatccatggacaactcgaacaaatacacaaaatccaggggcagggctgccaagaaaaaggccgcccttcagaccgctcccgagtctgcggacgacagcccctcccagctcagtaaatggccaggttcaccgacctcccggtcctcagatgaactcgatgcatggacggacttcaggtcgaggacaaacagcaatgccagtaccgtgtcgggtagactgagccctatcatggccagcacggagctggatgaggtgcaggatgacgacgcacctctgagcccaatgctgtatagctcttctgcctccctgtctcctagcgtaagtaaaccatgcactgtagaattaccgagacttacagacatggccggcaccatgaatttgaatgacggcttgactgagaacctcatggatgacctattggacaatattacattgcctcctagtcagccgtcccccaccggtgggctgatgcagagaagctctagttttccctatactaccaaaggaagtggtttaggctctccaactagctcctttaactccaccgtgtttggccctagctctcttaactccttgcgacagagccctatgcagaccatccaggagaacaaaccagcgacttttagcagcatgagccattacgggaaccagactttgcaggaccttctgacgagtgatagcctttcccactcagatgttatgatgacccagtccgatcctttgatgtcccaggcctctaccgccgtgagcgcccaaaatagtcggcgtaatgttatgctgcgaaacgacccaatgatgtcttttgctgcgcagcccaaccagggatccctcgtcaatcagaacctgctgcatcatcagcaccagacacaaggcgctctggggggatctagagctctgagcaactcagtatcgaacatgggtctgtctgagtcttccagtctcggatccgccaaacaccagcagcagagccccgtgagtcagtcaatgcaaacgctttccgactcgctgtctggtagctccttatacagcacttccgcaaacctgcctgttatgggacatgaaaaattcccatcagatctcgatttggacatgttcaacggcagccttgaatgcgatatggagtcaatcatccgctcggagttgatggacgccgacggactggatttcaacttcgattccctcattagtactcagaatgtcgtgggcctgaacgtcggaaactttacaggcgcaaagcaggcctctagccagtcttgggtccctggatag

SEQ ID NO: 24253 - DNA, 444 bp, Artificial Sequence
  Description of Artificial Sequence: Synthetic coding sequence
atgagcttccggttcggccagcacctgatcaagcccagcgtggtgtttctcaagacagagctttcttttgctttggttaacaggaagcccgtagtgccaggccacgtgttggtttgtccgctccgacctgtcgagcgatttcacgatctccgaccagatgaagtggccgatctctttcaaacgacacagcgagtggggaccgttgtggaaaaacatttccatggaaccagcctcaccttctcaatgcaggacgggcctgaggccggccagaccgtaaagcatgtgcacgtgcacgtgcttccacgcaaagcgggagattttcaccgtaatgactcaatctacgaagaattgcagaagcatgataaggaggatttcccggcctcttggcggagcgaggaggaaatggctgcagaggcagccgccctgagggtttatttccagtag

SEQ ID NO: 24254 - DNA, 444 bp, Artificial Sequence
  Description of Artificial Sequence: Synthetic coding sequence
atgagcttccggttcggccagcacctgatcaagcccagcgtggtgttcctcaagacagaactgtctttcgccctggtgaacaggaagccggtggtgcctggtcatgtgctcgtgtgcccactcagacctgttgaaaggttccatgatctccgaccagatgaggtcgccgacctgttccagactacacagcgggtggggacggttgttgagaagcatttccacggcacctccttgacttttagcatgcaagacgggcccgaagccggtcagacggtgaagcatgtgcacgtgcacgtattgcccagaaaggccggagactttcacagaaacgatagtatctacgaggagctgcagaagcacgacaaggaggattttcccgcgagttggcgctccgaagaggagatggctgccgaggccgccgccttgagagtctacttccaatag

SEQ ID NO: 24255 - DNA, 444 bp, Artificial Sequence
  Description of Artificial Sequence: Synthetic coding sequence
atgagcttccggttcggccagcacctgatcaagcccagcgtggtgttcctaaagactgaattaagcttcgccctcgtaaacaggaaaccagtggttcccggtcatgtgttagtgtgcccgcttaggccagtggaaaggttccatgacctccggcctgacgaggtcgcggaccttttccagaccacccagagagtagggacagtggtcgaaaaacattttcatggcacttctctgaccttcagcatgcaagacggccccgaggcaggacagactgttaagcatgtgcacgttcatgtcctgccgcgtaaagctggtgattttcatcgaaatgacagtatctatgaagaactgcagaagcacgacaaggaggactttcccgcctcctggaggagtgaagaggagatggccgccgaggccgcggcactgagggtgtacttccagtag

SEQ ID NO: 24256 - DNA, 240 bp, Artificial Sequence
  Description of Artificial Sequence: Synthetic coding sequence
atgagcttccggttcggccagcacctgatcaagcccagcgtggtgtttctcaaaaccgagctcagttttgcgctggtaaatagaaaaccagtcgttccaggacacgtcctggtgtgcccactgaggccagtcgagcgtttccacgatctgagacccgacgaggtggcggatctgtttcagaccacacagagggtaggtactgtcgttgagaagcacttccatggtacatctctgacctag

SEQ ID NO: 24257 - DNA, 444 bp, Artificial Sequence
  Description of Artificial Sequence: Synthetic coding sequence
atgagcttccggttcggccagcacctgatcaagcccagcgtggtgtttctgaaaacagaactctcatttgctttagttaatcggaagcccgttgtgcctgggcacgtcctcgtttgccccctgagacccgtggagcgatttcacgacctcagacctgacgaggtcgccgacttatttcagacgacccagagagtgggcactgtggtggaaaaacattttcacggcacctcacttacgttttccatgcaagacgggccggaggccgggcagacggtcaagcacgtgcacgttcacgtcctccccagaaaggccggagacttccataggaatgattctatctacgaggagctgcagaaacacgataaggaggacttccctgcctcatggcggagcgaggaggaaatggctgcggaagctgccgctctgagggtatacttccagtag

SEQ ID NO: 24258 - DNA, 1725 bp, Artificial Sequence
  Description of Artificial Sequence: Synthetic coding sequence
atgcgggaccccggcgccgccgcccccctgagcagcctgggcctgtgcgctctcgtcctggctctccttggagcgctctcagctggcgctggcgcccagccataccatggtgaaaagggcatttctgtgccggaccacggcttctgtcagcctatatccataccactatgcacagacatagcatacaaccaaaccatcctacctaacctcctggggcacacaaaccaggaggacgcaggccttgaggttcatcagttctacccccttgtgaaagtgcagtgtagccctgaactgagattttttctgtgctcaatgtatgctcccgtgtgtactgtgttagatcaagcaattcctccgtgtcggtcgctgtgcgaaagggctcggcaagggtgcgaggccctgatgaacaaatttgggttccagtggcccgagcgtctgcggtgtgaaaactttccggtacacggggccggcgagatctgtgtcggccagaatacttccgacgggagtgggggcccggggggaggacccacagcatatcccacagccccatacctgccggaccttcctttcacagcactacccccgggcgctagcgatgggcgtggacgaccagccttcccattctcttgcccaaggcagctgaaggttccgccctatctcggttatagatttctcggggagagagactgtggcgcaccgtgcgagcctggccgggcgaatggcctcatgtacttcaaggaagaagaacgaaggtttgcccggctttgggttggcgtgtggtcagttttgtgctgtgcctcaacactattcaccgtactaacttaccttgtggatatgcgcaggttctcctaccccgagcggccaatcatattcttaagcggatgctattttatggtcgctgtggcccacgtcgctggctttctgctagaggacagagccgtgtgcgttgagaggttcagcgatgatgggtatagaacagtggcccaaggaaccaagaaggagggatgcactatcttgtttatggtcctctatttcttcgggatggcctcctctatctggtgggttattttatctctgacctggttcttggccgcaggcatgaagtggggacatgaggctatcgaagcaaattcccagtacttccacctagccgcgtgggccgtgcctgcagtgaagacaattaccattctggctatgggccaggtggatggcgacctcctaagcggggtgtgttatgtcggtctcagctcggttgatgcgcttcggggattcgtgttagccccactgtttgtttacttgtttatcgggacaagctttctgttagccgggtttgtgagcctctttagaatacggacgattatgaaacatgacggcacaaagaccgaaaaactggagaagctcatggtgaggataggtgtcttttccgttctctacaccgtccccgctactatcgtattagcttgctacttttacgaacaagcattcagagaacactgggaaagaacatggctgctgcagacatgcaagtcctatgccgttccctgccccccaggacacttccctcccatgtccccagactttacagtttttatgattaagtacctcatgacaatgattgttggaattaccacaggattttggatttggagcggaaagaccttgcaatcatggcgtcgattctaccaccggctgagccattcatctaaaggggagacagcggtctag

SEQ ID NO: 24259 - DNA, 654 bp, Artificial Sequence
  Description of Artificial Sequence: Synthetic coding sequence
atgagcttccggggcggcggccggggcggcttcaaccggggcggcggtggcgggggctttaatagaggtgggagcagcaaccatttcagaggggggggtgggggcggaggtggcgggaatttccgcggtggcggccggggggggtttgggagaggtggagggcggggcggattcaacaagggccaggaccagggaccgcctgaaagggttgtactgttgggtgagtttctgcatccatgtgaagatgacattgtatgcaaatgtacaaccgacgaaaacaaagtgccgtatttcaatgctcctgtgtatctggaaaacaaggaacagatagggaaagtggatgaaatcttcggccagctgcgcgacttttacttctccgtcaaattaagtgagaacatgaaagcctccagttttaaaaagttacagaagttttatatagatccctacaagctgttgccactgcaacggttccttccacggcctcccggcgagaaaggaccacctcgcggcgggggtcgaggggggcgcggcggtgggcgcgggggtggcggcagagggggcggccggggtggcggctttcgcggcggaaggggaggcgggggcggaggctttagggggggacggggcggtggttttcgcggccggggacactag

SEQ ID NO: 24260 - DNA, 1533 bp, Artificial Sequence
  Description of Artificial Sequence: Synthetic coding sequence
atgtaccgggccctgcggctgctggcccggagccggcccctggtgagggcccctgccgcagccctggcctcagcccctgggctgggtggcgccgccgtcccctctttttggcctccaaacgcagcgaggatggcatctcaaaacagcttccgcattgagtatgatacattcggggaattgaaagtgcccaatgataagtactacggggcgcagacggtgcgcagcacaatgaactttaagatcggcggggtcacagaacgcatgccaacacccgtgatcaaagcctttggaatcttgaaaagggccgctgccgaggtgaatcaagattacggacttgatccaaagatagcaaatgccataatgaaagctgccgatgaagtagccgaaggtaagctgaatgatcatttccccctcgttgtctggcaaactggatccggaacccaaactaacatgaacgttaatgaggtgatcagcaatagagccatcgaaatgttaggcggagaacttgggtcaaaaatccccgtgcatccaaacgatcacgtgaacaagtcccagagctctaacgacacatttcctaccgctatgcatatcgctgccgctattgaggtgcacgaagtgctgctccctgggttgcaaaagcttcacgacgctttggatgcaaaaagcaaggaattcgcccagatcataaaaatcggcaggacccatacacaggatgcagtccccctgaccctcgggcaagagtttagcggatatgttcagcaggtcaagtatgcaatgactcgcatcaaggcagccatgccaaggatctatgagttggcagctggcggaaccgccgttggcactggattgaacactaggatcggctttgccgagaaggtggccgcaaaggtcgccgcattaacaggactgcctttcgtgacagcacccaacaaattcgaagctctggctgctcatgacgccttagtcgaactgtctggcgcaatgaataccaccgcctgttctcttatgaagatcgcaaatgacatcaggtttctcggcagcggccccagatctggactgggcgagctcattctccctgagaacgaacctggcagtagtatcatgcctggcaaggttaaccccacacagtgtgaggcaatgaccatggttgcggcccaagtgatgggaaatcacgtggccgttaccgttggtgggagcaacggtcacttcgaactgaacgttttcaagccaatgatgatcaagaacgttctccactcggccagacttctcggggacgcaagcgtgtctttcaccgagaattgcgtggtgggcattcaagccaatacggagaggattaataaactgatgaacgagtcacttatgctggtgacagctcttaacccgcatatcggttacgacaaagccgccaagattgccaagaccgcacataagaatggatctacgctcaaagagactgctattgaactcggctacttgaccgccgaacagttcgatgaatgggtgaaaccaaaggatatgctgggaccaaagtag

SEQ ID NO: 24261 - DNA, 537 bp, Artificial Sequence
  Description of Artificial Sequence: Synthetic coding sequence
atgagccccagcggccggctgtgcctgctgaccatcgtgggcctgattctccctaccagaggacagacactcaaagataccactagttcctcctcagcagattcgacaataatggatattcaggtcccgacgcgtgctcccgacgcggtttatacagagctacagccgacctcccctacccctacgtggccggcagacgagaccccccaaccgcagacacaaacccagcaactcgaaggtaccgatggtcccctcgtgactgaccccgagacacataagtcgacgaaggccgcacaccccaccgatgacacaactacactgtccgaacggccttcaccttccaccgacgtgcagacagatcctcagacccttaagccgtccggcttccacgaggatgaccctttcttttacgatgagcatacacttcgaaagaggggcctccttgtcgccgccgtgctgttcattacgggaatcataatcctcactagtgggaagtgccgacagctttctcgcctgtgccgtaaccgatgcaggtag

SEQ ID NO: 24262 - DNA, 324 bp, Artificial Sequence
  Description of Artificial Sequence: Synthetic coding sequence
atgcagaccctgagcaacatcccctgcttctgcctgcacggcagcttactgccgtcgaccgatctggcgaccctcagcgctcatccaactgatgacacgactactctcagcgaacggccttccccaagcacagatgtacagacagacccacagactcttaagccttctggcttccacgaagacgatccattcttctatgatgaacacactctgaggaaaagaggcctcctcgttgcagcggtgctttttattacgggtattataatcctgacctcaggaaaatgcaggcagctgtcccgcttgtgcagaaacagatgccgatag

SEQ ID NO: 24263 - DNA, 291 bp, Artificial Sequence
  Description of Artificial Sequence: Synthetic coding sequence
atgagccccagcggccggctgtgcctgctgaccatcgtgggcctgatcctgccaactcgaggacagactctgaaagatacaacctctagttcctccgctgactccacaattatggacattcaggtccctacccgagcacccgacgccgtgtacactgagctccaaccaactagccccacccctacctggcctgccgacggcgcctacattaccgcttacggtgtcacgcacttcctgatgaacatgctggccgtgagcagcttcttttgcttgcatacagccccacagtag

SEQ ID NO: 24264 - DNA, 537 bp, Artificial Sequence
  Description of Artificial Sequence: Synthetic coding sequence
atgagccccagcggccggctgtgcctgctgaccatcgtgggcctgatccttccaactcgaggacagactctgaaagacacaacctcctcgagttctgccgatagcacaataatggatatccaggttcccacaagggctcccgacgcagtgtacaccgaactacagccgacctcacccacccctacctggccagcggatgaaaccccgcagccccagactcaaacccagcagcttgaggggactgacggaccgttagttaccgatcccgaaacacataagagtacaaaagctgctcatccaaccgatgatacaaccacactgagcgagcggccatccccatctacagacgtgcagacagacccccaaacgcttaagccatcgggtttccacgaagacgaccctttcttttacgatgaacatacactgcgaaagcgggggttgctggtggctgctgtgctgtttattactggcatcattatcctgacatccggtaaatgtcggcaactgtctcgcctttgtcgcaatcggtgccggtag

SEQ ID NO: 24265 - DNA, 537 bp, Artificial Sequence
  Description of Artificial Sequence: Synthetic coding sequence
atgagccccagcggccggctgtgcctgctgaccatcgtgggcctgatccttccaacaagaggccagacactcaaggacactacctcatcttcctcagcagattctaccatcatggatattcaggtgccaaccagagcccccgacgctgtgtacacagagctccagcctacatcaccgactcctacatggcccgctgacgaaacaccacaaccgcagactcaaacgcagcagcttgaaggaactgacggccccctcgtgaccgatcccgagactcacaagtctaccaaagcagcccaccctacagacgacacaacgaccctgagtgagcgcccctcaccaagcaccgatgtgcagacagacccgcagactctaaaaccttccgggttccatgaggacgacccgttcttctacgatgagcacacattgaggaaacgtggcctcttggtagccgcagttttgttcatcacaggcattattattctcacttcaggcaaatgccgccagttgtccaggctgtgccgtaataggtgcaggtag

SEQ ID NO: 24266 - DNA, 537 bp, Artificial Sequence
  Description of Artificial Sequence: Synthetic coding sequence
atgagccccagcggccggctgtgcctgctgaccatcgtgggcctgatcctgcctacacggggccaaaccctcaaagacactacctcatcctcctccgccgacagtacaataatggatatccaggtcccaactagagcccccgacgccgtttatactgagctgcagccaactagccctacgccgacttggcccgccgatgagacaccgcaaccgcagacacaaacccaacagctggaaggtaccgatgggcccctggttacagatcccgagactcacaagtccactaaagccgcccatccaactgatgacaccaccaccctgtccgagcgaccttctccaagcaccgacgtgcaaaccgatcctcagacattgaagcccagtgggtttcatgaagatgacccctttttctacgatgagcacacgttgagaaagaggggcttgttggtagccgccgtgctgttcatcacaggaatcatcattctgacaagcgggaagtgtcggcagttgtcgagattatgccgcaacaggtgccgctag

SEQ ID NO: 24267 - DNA, 585 bp, Artificial Sequence
  Description of Artificial Sequence: Synthetic coding sequence
atgagccccagcggccggctgtgcctgctgaccatcgtgggcctgatactgccaacacgaggccagaccctgaaagacaccacctcaagctcatccgccgactctaccatcatggacatccaggtgcctacccgggccccagacgcggtctacaccgaactgcagccaacgagccccacccccacgtggccggccgacgagactcctcagccacagactcaaacccagcaactggaaggcaccgacggtccactggtgacagacccagagacgcacaagagtactaaggccgctcacccgacagatgataccactaccctctccgagcggccctccccctctactgatgtgcaaaccgatcctcaaacattaaagccttctggatttcatgaggacgacccatttttctacgacgagcatacactgcgtaagcggggtctgctggtcgctgccgtcctcttcatcacgggaattatcatactgaccagtgaaaactggggctgggtgggtcgaacaccccgcccaggggggggactcatgacagaaggatgggtgctaaaggggccatgggccatcctgttttag

SEQ ID NO: 24268 - DNA, 1518 bp, Artificial Sequence
  Description of Artificial Sequence: Synthetic coding sequence
atgagcaacatctgccagcggctgtgggagtacctggagccctaccttccctgtctttcaacagaggcagataagtccacggtgatagaaaaccccggagcactgtgctccccccagtcccaaagacacggccactattttgtggcattattcgattatcaggctagaactgccgaagacctgagcttccgggccggggataaattgcaggtattggacacgctccatgaaggctggtggtttgcacgacacctggaaaaacgcagggacgggtcgtcacagcagctccaaggttatattccttcgaactacgtcgctgaggaccggtcgctgcaagctgagccatggttctttggagccatcggaaggtccgacgctgaaaagcagttactgtattcagagaacaagactggaagcttcctgattagggagagtgagtctcagaagggagagttctccctgtccgtgctggacggggcggtcgtaaagcactatcgaatcaagcggctggacgagggcggctttttcctgacacgtagacgtattttttctactctgaacgaatttgtgagccactacactaagacgagtgatggcctgtgtgtaaaactcggaaagccatgtcttaaaatccaggtgccagccccatttgacttgagttacaagaccgtggatcagtgggagattgacagaaattcaatccaactactcaaaaggctgggatctggtcagtttggggaggtgtgggagggcctgtggaataacaccactccagtggcagtgaaaacccttaaacctggatccatggatccaaacgatttcctgcgggaagcccaaattatgaagaatctccgccaccccaagctgatacagctgtatgccgtctgcacccttgaggatccaatctatattatcacagagctcatgagacacggcagtctacaggagtaccttcagaacgatacaggcagcaagatccatctcacacaacaggttgacatggctgcacaggtagctagcggtatggcctatctcgaatcccgcaactatatccacagggacctggcagccaggaacgttttagttggcgagcacaacatatataaggtggctgattttgggctggcaagagtgttcaaggttgataacgaagacatctatgagagcaggcacgagatcaagctacctgtgaaatggacagcacctgaagccatacgctcgaacaaattttcgatcaaatctgatgtatggagctttggcattctgttgtatgagattattacttatggaaaaatgccctattctggcatgaccggggcacaagttattcagatgcttgcacagaactacaggctcccgcagccctccaattgcccacagcagttttacaacattatgctggaatgttggaacgctgaacccaaggaacgcccaacatttgagaccctcaggtggaaactggaagactactttgagaccgattcttcatactctgatgccaataacttcatacggtag

SEQ ID NO: 24269 - DNA, 1092 bp, Artificial Sequence
  Description of Artificial Sequence: Synthetic coding sequence
atggacagcaccagcctgctgcccaacccctggatccgggtgctggacggtgccgtggtgaaacattatcgcatcaaaaggttagacgaaggaggcttcttcctgacaagaaggcggatcttttcaacactgaatgaatttgtcagccactacactaagaccagcgacggtctctgtgtgaagttggggaagccctgtcttaagattcaagtgcccgctccattcgatctaagctataagaccgtggaccagtgggagatcgatagaaacagcatccagctccttaagcggctgggcagcggacagtttggggaagtctgggagggcctgtggaataacaccactcccgtcgccgtgaagaccctgaagcctgggtccatggacccgaatgacttcttgcgggaggctcagattatgaagaatctcaggcaccccaagcttatacagctatacgctgtttgcacgctcgaagaccctatttatattattacagagctcatgcgtcacggatccctgcaggaatatctgcagaatgatacgggcagcaaaatacacctgacccagcaagtggacatggccgctcaggttgcttccggcatggcctacttggagtctagaaactacattcaccgggacctggccgcccgcaacgtactcgttggtgaacataacatctataaggtcgccgattttggcctcgcccgtgtgtttaaggtggataacgaggatatctacgagtctaggcacgaaatcaagctgcccgtaaaatggactgcacccgaagctatccgctccaataagttcagcatcaagtccgatgtgtggagcttcggaattctgctgtacgaaattatcacctatgggaagatgccatactcaggcatgacaggtgcccaagtgattcaaatgttagcccaaaattatagactcccgcagccctccaactgtcctcagcagttctataatataatgctggagtgctggaacgccgaacctaaggagaggcctactttcgaaaccctgcgttggaagttagaagactacttcgagacagactcttcttactctgacgcaaataattttattcgatag

SEQ ID NO: 24270 - DNA, 1128 bp, Artificial Sequence
  Description of Artificial Sequence: Synthetic coding sequence
atgcggagcgtggcccccagcggccccaagatgggcaacatcaccgccgataattccagcatgagctgtaccatcgaccacactatccaccagacgttggccccggtagtgtatgtgacagtgctcgttgttggttttccagctaattgtctttcactttacttcgggtatctgcagatcaaagcaagaaatgagctgggcgtgtatctttgcaatttaaccgtggccgaccttttttacatctgttcgctgccattctggcttcaatatgttctccagcacgataactggtctcacggagatctcagttgccaggtgtgtggtatcctattgtacgaaaacatctacatttccgtcggcttcctgtgttgtatatctgttgacagataccttgccgtcgcacacccattccgattccaccaatttcgcacccttaaggctgcggtcggggtgtctgttgtaatctgggcaaaggagctgctgaccagcatctattttctgatgcatgaagaggtcattgaagacgaaaaccagcatagggtctgtttcgaacattaccccattcaagcctggcagcgtgcaatcaactactatcggttcctggtgggttttcttttccctatttgcctactcctcgcctcataccaggggatcctcagagcagtcagacggtctcacgggacacagaaatctcgtaaggatcagatccagcgcctcgtgctttcaacagttgtcattttcctcgcttgttttctgccctaccatgtgctcctgctggtccgaagtgtttgggaagccagttgcgattttgcaaaaggggtttttaacgcttaccacttcagtttattgttaactagctttaactgcgtcgctgaccccgttttgtactgttttgtcagcgaaaccacacatagggatctcgctagactgcgcggagcctgcttagcctttctgacatgttctaggacagggcgggcccgggaagcatatcccctgggtgcccccgaagcctccgggaagtccggtgcgcagggcgaggagccagaattattgacaaaactgcacccagctttccagactccaaactcgcccggatccggcggttttccaactggaaggctggcttag

SEQ ID NO: 24271 - DNA, 1017 bp, Artificial Sequence
  Description of Artificial Sequence: Synthetic coding sequence
atgggcaacatcaccgccgacaacagcagcatgagctgcaccatcgatcacaccatacatcagactctggccccagtggtgtatgtgaccgtgctggtcgttgggttcccagcaaactgtctgtcattatactttggctacctacaaattaaagctagaaatgaactaggagtatatctgtgtaacctaacagtcgcagatcttttttatatctgttctttgcccttctggctccaatatgtgctgcaacatgataactggagccatggagatttgtcctgtcaagtctgcggcatactgttgtacgagaatatctatatcagtgtgggttttctctgctgcatctctgttgatcggtatctcgccgttgctcatcccttccgctttcatcagtttcgcaccctgaaagcagcagtcggtgtgagtgttgtgatatgggccaaagaacttttaaccagcatctacttccttatgcacgaggaggtcattgaagacgagaaccaacacagagtctgcttcgaacattaccctatccaagcttggcagcgcgccataaactattacaggttcctcgtaggctttctgtttcccatctgcctactcttggcgtcctaccaggggattcttagagccgttcggcgctcccatggcacccagaaaagtagaaaagaccagattcaaagactggtgttatccacagtggtgatttttctggcatgctttcttccctatcacgtcctgctgctcgtccggtccgtttgggaggccagctgtgactttgccaagggggtctttaacgcgtaccatttttcgctcctgctaacttcattcaactgcgtggccgatccagtgctttattgcttcgtttcagaaacaactcacagagatcttgccaggctgcgcggcgcttgtttggccttcctgacatgctcaaggacaggccgggcccgggaagcctacccattgggcgctccggaggcctccgggaagagtggggcacagggcgaggagccttag

SEQ ID NO: 24272 - DNA, 1098 bp, Artificial Sequence
  Description of Artificial Sequence: Synthetic coding sequence
atgggcaacatcaccgccgacaacagcagcatgagctgcaccatcgaccataccattcatcagacattggcacctgttgtctacgtaaccgtgctcgtggtggggtttcctgccaactgcctctcactatatttcgggtacctgcagatcaaggctaggaacgaactgggggtatacttgtgtaacctcacagtggcagatcttttttacatctgcagtttgcccttctggctccagtatgtgttgcagcacgacaactggtctcacggtgatctgagctgccaggtgtgtgggattctgctttatgagaatatttacattagtgtcggattcctgtgttgcattagcgtggatagatacctagccgttgcccacccgttccgcttccatcaattccgtaccctgaaagcagctgtcggggtctcagttgtcatttgggccaaggaactgctaactagcatttattttctcatgcacgaagaagtgatagaagacgagaatcagcaccgagtttgtttcgaacactatccgatacaggcttggcagagagctataaattactaccgatttctggttgggttcctgttccccatatgtcttctgcttgcgagctatcaggggatattgcgtgctgttcgaaggagccacgggacccagaaaagccggaaggatcagatacaaaggcttgtgctcagtaccgtggttatcttcttggcttgtttcctgccataccacgtcctgctgctagtcagaagtgtttgggaagcgagctgcgatttcgccaaaggtgttttcaatgcataccatttcagcctgctccttacttcattcaattgtgtagcagaccccgtgttgtattgcttcgtttccgagaccacacaccgcgacttagctcggctgcgtggggcttgcctggccttcctgacgtgctcacgtaccggacgcgcacgggaagcctatcccttaggagccccggaagccagcggcaaaagcggtgctcaaggagaagagccggagctgctgacaaaactgcatcctgcatttcagacacctaatagcccagggtccggcggtttccccaccggtcgtctggcgtag

SEQ ID NO: 24273 - DNA, 1098 bp, Artificial Sequence
  Description of Artificial Sequence: Synthetic coding sequence
atgggcaacatcaccgccgacaacagcagcatgagctgcaccatcgatcacaccattcaccaaacactggcgcccgtggtatacgttactgtgttggtggtaggcttcccagcaaattgcctgtccctctactttggctatctccagataaaggccaggaatgagttaggcgtgtatctgtgtaatctgaccgtggctgaccttttttacatatgcagcttacctttctggctacagtacgtgctccaacatgataactggtctcatggagatctttcctgtcaggtgtgtggaatccttttatacgagaatatctatattagtgtaggattcctttgctgcataagtgttgatagatatttagccgtggcgcatccgttcagattccatcaatttagaacactgaaagccgccgtgggggtgtctgtcgtgatttgggctaaagagctgctcacttccatttattttctcatgcacgaagaggttatagaagatgagaaccagcatcgggtgtgctttgaacattatccgatacaagcatggcagcgggcaataaactattacagatttctggtgggctttctgttccccatctgtttactgctagcttcttatcagggcatattgcgcgctgtgcggaggtcccacggaacccaaaagtccaggaaagaccagatccagagactggtcctgtctaccgtcgttatcttcctggcgtgtttcctaccctaccacgttttgttacttgttagaagtgtgtgggaggctagttgtgattttgctaagggagtgtttaacgcatatcatttcagcctcttattgacctcatttaattgtgttgctgaccccgtgctgtactgcttcgtctcagagactacgcaccgggatctggccagacttcggggtgcctgtttagcttttcttacctgctcccggacaggaagagccagggaggcttaccctcttggtgccccagaggccagcggcaaaagtggtgcccaaggcgaagagccagagctcctgaccaagctgcacccagcatttcagacaccaaattcaccggggagcggcggcttccctaccgggcggcttgcttag

SEQ ID NO: 24274 - DNA, 2100 bp, Artificial Sequence
  Description of Artificial Sequence: Synthetic coding sequence
atgaccctgcggcggaagtgcaacgaggacgacgaggtgttcttcgggccttttggacacaaagagaggtgtatagctgccagcttagagctgaataatcccgtgccggaacagccaccactgcctacaagcgaaagccctttcgcctggagccctcttgctggcgagaaattcgtggaagtgtataaagaagcccacctgctcgccctgcacattgagagtagctctagaaatcaggccgcacaggctgccaagccagaagatccgcgcagccagggagtggagcggtttatccaggagagtaaactcaagatcaatcttttcgagaaggaaaaggaaatgaagaagtcaccaacctcgcttaaaagggagacctactacctgagcgactcccccctgctgggaccacctgtaggggaacccaggctgctggcatctagtccagcccttccctcatccggagcccaggcgcgactgacacgggcacctggccccccacattcagcgcacgccctcccgagggagtcgtgcaccgcacacgctgcatcccaggcagcaactcagcgcaagccaggcaccaagctgctgctgcccagggctgcatcagtgagaggccgaagcatccctggggcagcagaaaagcccaagaaggagatccccgcaagtccatcgcgcaccaaaattccagcagaaaaggagagccacagggatgtcctgccagacaaacctgctccaggcgccgtaaatgtgccagccgcaggaagccacctagggcaggggaaaagggccattccagtacctaacaaactagggctgaagaagactttgcttaaagctcccgggagcacaagtaatctcgccaggaagtcttcctccggtccggtgtggtccggggcctcctccgcttgcactagcccagctgtgggcaaggctaagagttccgagttcgcttctattccggctaatagttcccggcctctttccaacatctccaagtccgggcgcatgggccccgcaatgctgcggcctgccctgccggctgggcctgtaggagcatcaagctggcaggctaagcgggtcgatgtgagcgagctggccgctgaacaactgaccgccccaccatcagccagcccaacccagcctcagactccagagggcggggggcagtggctgaatagttcatgcgcatggtctgagagttcacagctcaataagactaggtccatcagaaggagggactcatgcctgaactctaaaacgaaggttatgcccactcctactaatcaattcaagatccctaaattcagtattggggactccccagactcatctacaccaaagctatctcgggcccagcggcctcagtcttgcaccagtgttggccgggtgacagttcactctactcctgtgaggcgcagttcaggcccggccccccagagtctgctctcagcctggagagtctcagcgctcccaaccccggccagccgtcgatgttccgggctgccacctatgacacctaagacaatgccgcgcgccgtcggctctccgctgtgtgtcccagcaaggaggcggtcatcagaaccccggaagaacagtgccatgcggactgaacctacgcgtgagtcgaatcgaaagaccgactctagattggtcgatgtgtcaccggaccgcggcagccctccatctcgggtgccacaagccctgaactttagtcccgaagagagcgacagcacctttagcaagtcaacggccactgaagtggcacgcgaagaagcaaagcctggtggagatgcggcaccaagcgaggccctgctcgtggatataaaactggagccactggcagtgactccagacgccgcttctcagcctctgatcgaccttcctttaatagacttttgtgacacaccagaagcccatgtggctgtcggctctgagtctcgccccctgatcgacctaatgacgaacacaccagatatgaataagaatgtggccaaaccatcacccgtcgttggtcagctgatcgatttgagcagccctttaatccagctgtcccccgaagccgacaaggaaaacgtcgatagccccctgcttaaattttag

SEQ ID NO: 24275 - DNA, 2220 bp, Artificial Sequence
  Description of Artificial Sequence: Synthetic coding sequence
atggagggcggcggcggccgggacgagcccagcgcctgccgggccggggacgttaatatggatgatccaaaaaaggaggacatactgcttttggccgacgagaaatttgacttcgatctgagtctgtcctcgtcatcagccaacgaagatgacgaggtgttcttcggcccattcggccataaggagcggtgtattgccgcaagcttggagttgaacaatcctgtccctgagcagcctcctctgcctacgtcagagagccctttcgcatggtcccctttggcaggcgagaagttcgttgaagtgtataaggaggcacacctcctggcccttcatatagagtccagctcccggaatcaggcagcgcaagccgctaaacctgaagatcctcgtagccagggcgtagagcgcttcatccaagaaagtaagctgaagatcaacctgtttgagaaggagaaagagatgaagaaaagccccacttcactgaaacgggaaacatactacctctcagactcccctcttctgggacccccggtgggagagcctaggcttctggcctcctcacctgccctcccatcttcaggcgctcaggcccggctgaccagagctcctgggcccccgcattccgctcacgccctgcctcgcgaatcctgcacggctcacgcagcctcccaggcggccacgcaacgcaaacccggcactaaactgctcctgccccgcgcagcaagcgtccggggccgttcaatcccgggagccgcggaaaagcctaagaaggaaatccctgcctctccaagtcgtactaaaatcccagccgaaaaagagtctcaccgtgacgtcctgcccgataaaccggcccccggcgcagtgaatgttcctgccgcaggtagccacctcggacagggaaaaagagctataccagtgcccaacaaactgggtcttaaaaaaacactcctgaaagctcccggctctaccagcaatctggctcggaaaagttcctcgggccctgtctggtccggagcttccagcgcctgtacttctcccgctgtggggaaagccaaaagcagcgaatttgctagcattccagcaaactcgagccgacctctgtccaatatctccaagagcggaagaatggggccagccatgctgagacccgccttaccagccgggccagttggcgcgagtagctggcaagccaagagagtagatgtctctgagttggctgccgagcagttgacagcccccccatctgccagccccactcagccccagacccctgagggaggcggccagtggttaaactcttcatgtgcttggtcggaatcctcccagcttaacaagaccaggtccatcagacggagggactcctgtctgaattctaaaacaaaggtgatgcctacgccgacaaaccagtttaagatccccaaattttctatcggcgattcccccgattctagtacccctaagctatccagagctcagcggccacagtcctgcacttctgtgggtagagtcactgtccatagtacgcctgtaaggcggtcgtctggtccggccccccagagcttgctgtccgcctggcgagtgtcagctctccccacgcccgcaagccgacggtgctcaggattgcctcccatgacaccaaagacaatgccccgggctgttgggagcccattgtgcgtgccagctcggagacggtcaagcgagccacggaagaattcagcaatgcgcaccgaaccaacccgtgaatccaacaggaagactgattcccgcctggtggatgtgtccccagaccgggggtcaccaccgtcaagggtgccccaggctctgaacttcagccccgaggagtcagattccacattcagtaagagcaccgctacagaagtggcacgggaggaagctaagcctggcggcgacgctgccccaagtgaggcccttctggtggatatcaagcttgagccactcgccgtgacacccgacgcggcctcgcagcccttgattgacctgcccttgatcgacttttgcgacacccctgaagcccacgtagcagtaggaagcgaatcacgccctctgatcgacctgatgaccaatactcctgacatgaataaaaacgttgcgaagccctcccccgtggtgggccagcttatcgatctctcctctccacttattcagctctctcctgaggccgacaaggagaacgtagactccccgctgctgaagttctag

SEQ ID NO: 24276 - DNA, 1149 bp, Artificial Sequence
  Description of Artificial Sequence: Synthetic coding sequence
atgggcgactggagcgccctgggcaagctgctggacaaggtgcaggcgtacagcacagccggtggaaaagtgtggctttccgtgctgtttattttccgcatcctattacttggcaccgccgtggagtccgcctggggggacgagcagtccgccttcagatgtaacacacagcaaccaggttgcgagaatgtgtgttatgataagagtttccccatcagtcatgtgaggttctgggtcctccagataatatttgtgagtgtgccaaccctgctgtacctagctcacgtgttctatgtcatgcggaaggaggagaagcttaacaagaaggaggaagagctgaaagttgcacagactgatggagttaacgttgatatgcatctgaaacagattgaaataaagaaattcaagtatggaatcgaggaacatgggaaggtcaagatgcgtggagggcttttgcggacttacataatttcgatactcttcaagtctatatttgaggttgcttttctactgattcagtggtatatctatggtttctccctgagcgctgtctacacctgcaaacgcgatccttgtccacaccaggtggactgctttttatctcgccctaccgaaaagacaatctttatcatcttcatgcttgtggtcagtctggtttccttggctttgaatataatcgaactcttctacgtgttctttaagggagtcaaggaccgggtgaagggcaagtctgacccataccatgcaacatctggggccctctctccagccaaagattgtggcagtcagaaatacgcttatttcaatggctgtagctcgccaaccgctcccctctctcccatgtcccccccagggtataagttggttaccggggatcgcaacaacagtagttgccggaactataacaaacaggcgtctgagcaaaactgggcaaactacagcgccgaacaaaatagaatgggccaagccggttcaactatctccaattctcatgcccagcctttcgatttcccagatgataaccagaacagcaaaaagttggcggccggacacgaacttcaacccctggccatcgtagatcagagaccatctagcagagcctctagccgggcatctagtagaccaagacctgacgacctggaaatctag

SEQ ID NO: 24277 - DNA, 1101 bp, Artificial Sequence
  Description of Artificial Sequence: Synthetic coding sequence
atgggcgactggagcgccctgggcaagctgctggacaaggtgcaggcatactctacagctggcggcaaagtgtggctgtccgcgtggggtgatgaacaaagcgctttccgctgtaacacacaacagcctggatgtgaaaatgtgtgttacgacaagagctttccgataagccacgtgcgcttctgggtcttgcagataatttttgtgtcagtacctaccctgttatatctcgcacatgtgttttatgtaatgcgaaaagaggagaaattaaacaaaaaggaggaagaactcaaggttgcacagaccgacggggtgaacgtggacatgcaccttaagcaaattgagataaagaagttcaagtacggcatcgaggaacatggaaaggtgaagatgcgcggcgggctactgcgaacctatatcatctccattttgtttaagtctatctttgaggtggccttcctgttgattcagtggtacatttacgggttctcgctcagtgccgtgtatacttgcaagcgagatccttgcccgcaccaggtggactgctttttatcgcgcccgacggagaaaactatttttatcatttttatgcttgtggtgtcgctcgtttctctagctcttaacatcattgaactcttttacgtcttctttaaaggagtgaaagatagggtcaaggggaagtccgacccgtaccacgccacctcaggcgccctgtctcctgctaaggattgtggaagtcagaagtatgcttatttcaacggttgctcaagccctacggccccattgtccccaatgtcaccacccggttataagttagtgacaggtgataggaataatagcagctgtcggaattacaataaacaggcctccgaacagaattgggccaattattcagctgagcagaataggatgggacaagctggttctacgatctccaactcgcacgcacaaccatttgatttccccgacgacaatcagaatagtaaaaagctagctgcaggacacgagttgcagcccctggccatagtcgatcaacgaccgtcgagccgagcctccagtagagccagcagccgacctcgtcctgacgacctcgaaatttag

SEQ ID NO: 24278 - DNA, 2673 bp, Artificial Sequence
  Description of Artificial Sequence: Synthetic coding sequence
atggacagcaacaccgcccccctgggccccagctgcccccagccccctcccgctcctcagcctcaggctagatcccgtctaaacgcgacggcttccctagagcaggagagaagtgaaagaccccgagctccaggtccgcaggccggccctggccccggtgtgcgggacgcggccgcccctgcagagccacaggctcaacatacccgttctagggagcgtgccgacgggaccgggcctactaaaggagacatggagattccatttgaggaggtgctggaacgcgccaaggctggcgatcccaaagcccagaccgaagttgggaaacattatctccagctagctggggataccgacgaggagctgaatagctgcacagccgtggactggctggtgctggctgcaaaacaaggaaggcgcgaggccgttaagttgctccggaggtgtctggccgacagaaggggtataacaagtgagaatgagcgggaggttcgtcagttatcgtcagaaacggacctggagcgggcggtgcggaaagccgccctcgtgatgtactggaaattgaacccaaagaagaaaaagcaggtggctgttgcggagttactcgaaaacgttggacaagtgaacgaacacgacggtggcgcgcagcctgggccagtcccgaagtctctgcaaaaacagagacgcatgctggaacgcctggtgagcagtgaatcaaagaattacatcgccctagatgattttgttgagatcacaaagaaatatgcgaaaggggtcattccctctagtcttttcctccaagatgatgaggatgacgatgaactcgccgggaagtctccggaggatcttccacttcggcttaaagtcgtgaaatatcctctccatgctattatggagattaaggagtacttgatagacatggcctcgcgcgctggcatgcactggttatctacgatcattccaacccaccatatcaacgctttgattttttttttcattgtttcaaatttaacaatcgacttcttcgcattctttatccctctcgtaatcttttatctgtcctttatatctatggtgatctgtacattgaaggtgttccaagacagtaaggcctgggagaacttcagaactctgaccgacctgcttctccggtttgagccgaacctggacgttgaacaggcagaagttaatttcggctggaaccacttggagccgtatgcccatttcttactgagcgtcttcttcgtgatcttttcttttccgatcgcttccaaggactgcattccttgcagcgagctagcggtgataacaggctttttcacagtcacatcatatttgtccctgtccacccacgcagagccatacactaggcgggcgctggcaacggaagtcactgcaggtttgctgagcctgctcccatcaatgccccttaattggccctacctgaaggtattaggacaaacgtttatcactgtgccagtggggcatctggtggtcctcaacgtttctgtgccatgtctgctgtatgtatacctgttatacctctttttcaggatggctcagctgaggaattttaaggggacatactgctatctggttccctaccttgtgtgctttatgtggtgcgagctgagtgtcgttattctgctggaaagcaccgggctgggtcttctgagagcatccatcggatattttctttttcttttcgccttgccaattctggttgcggggttagccttggtcggagtgctccaatttgccagatggtttacatccctcgaactcaccaagatcgctgtgacagtggccgtgtgttcagtgccacttttgcttagatggtggacgaaggcctccttttccgtagtgggaatggtgaagtctttgacccgatccagtatggtgaagctgatcctagtctggctcaccgcaatcgtcctgttctgttggttctatgtctatagatctgaaggcatgaaggtatacaattcgaccctcacctggcagcagtacggcgcactttgcggtccaagggcgtggaaggaaaccaatatggcaaggacccagatcctctgctcccatctggagggccaccgggtgacatggacagggagattcaagtacgtgcgcgtaactgacattgacaatagtgccgagagcgccatcaatatgctgccattctttatcggcgattggatgcggtgcctctacggcgaagcatacccagcctgttccccaggaaacacatcaacagccgaggaggaactgtgtcgactgaagcttctagctaaacatccatgccacatcaaaaaatttgatagatataagtttgagatcacggtaggtatgccattctcttccggcgctgacggatcacgaagtagagaagaagacgacgtcactaaggatatagttctccgtgcatcctcagagtttaaaagtgtgttactgtccctccgtcagggcagcctgatcgaatttagcaccattcttgaaggacggctgggaagcaaatggccagtttttgaattaaaagccatttcctgcctgaattgcatggctcagctcagccctacccgacgtcacgtgaaaatagaacatgattggcgtagtaccgtccacggagcagtaaaattcgccttcgacttctttttctttccatttctgtcggcggcttag

SEQ ID NO: 24279 - DNA, 654 bp, Artificial Sequence
  Description of Artificial Sequence: Synthetic coding sequence
atgagcttccggggcggcggccggggcggcttcaaccggggcggcggcggagggggattcaatagaggggggagtagcaatcattttcgagggggtggaggcgggggcgggggggggaacttccggggaggtgggcgggggggttttggccgggggggtggcaggggtggcttcaataaggggcaggaccaaggaccacctgaaagggtggtccttctgggagaatttctgcatccatgcgaggacgacattgtttgtaagtgcaccaccgacgagaacaaagtgccatacttcaatgcgccggtctaccttgagaataaggaacaaattgggaaggtggacgagattttcggacaactgcgcgacttctatttctcggtcaagctgagcgaaaacatgaaggcatcgagcttcaagaagcttcagaagttctatatcgacccttataagctcctgcctctgcaacgatttctcccacgacctcctggggaaaaaggcccaccccggggtggtggcagagggggccgcggtgggggccgcggcggcgggggacgcgggggcgggcggggcggaggcttcagaggaggcagaggtggcggaggtggcggattcagaggaggtaggggcggcggctttagaggccgcgggcattag

SEQ ID NO: 24280 - DNA, 1590 bp, Artificial Sequence
  Description of Artificial Sequence: Synthetic coding sequence
atgggctgcgtgttctgcaagaagctggagcccgtggccaccgccaaggaagacgccggcttggaaggggacttccgatcttacggagccgcagaccactatggtccggacccaaccaaagcaagacctgcatcctcatttgctcacattcctaactattctaatttcagcagtcaggcaatcaatcccggatttctcgactcgggaacgatccggggtgttagcgggatcggcgtgaccctgttcattgccctctatgactatgaagctcggacggaggatgatctgacatttactaaaggggagaaatttcatatccttaacaataccgaaggtgactggtgggaggcacgctctttgagctctggtaaaacagggtgtatccctagtaattatgtggcacctgttgattctatacaggccgaagagtggtactttggaaagatcggccggaaagacgccgagcgtcagctcttatccccgggaaatccacagggggcctttctaataagggaaagtgaaaccacgaaaggtgcttattccttgtccatcagggactgggaccagactcggggcgaccacgttaagcactacaaaatcagaaaattggatatgggaggctactacattacaactagggtccagttcaatagcgtacaggaactggtgcagcactacatggaggtcaatgatgggctgtgcaatctgttgattgccccctgtacgattatgaagcctcagaccctgggacttgctaaggatgcttgggagatttcacggagttccataaccctcgagaggcgactcggcaccggctgttttggggacgtctggctcggcacatggaatggctcaacgaaagtggccgtcaagacactcaaaccaggcactatgtctccgaaggccttcttagaagaggcccaggtgatgaaactgctgcgtcacgacaaactagtccaattgtacgctgtcgtgagtgaagagcctatttatatcgtgactgaattcatgtgtcatgggtccctgcttgattttctgaagaaccccgagggccaggaccttagactaccacagttggtggacatggccgctcaagtcgcggaagggatggcttacatggaacgcatgaactatatccatagagaccttagagcagctaacatcctggtcggggagagactggcttgcaaaattgctgactttggccttgccaggttgataaaggacgacgagtataatccctgccaggggtctaagttccccattaaatggacagccccagaggcggccctgttcggccggtttacaataaagtcagatgtctggtcatttggcatcctcctgactgaactcatcactaaaggacgcattccctacccgggcatgaacaaaagagaggttctcgaacaggtcgagcaggggtaccacatgccatgtcctcccggatgtccggcatccctgtacgaagccatggagcagacttggaggctcgatccggaagagaggcccacatttgagtatctgcagtccttcctcgaggactactttacatccgcggagcctcaataccagcctggcgaccagacttag

SEQ ID NO: 24281 - DNA, 1590 bp, Artificial Sequence
  Description of Artificial Sequence: Synthetic coding sequence
atgggctgcgtgttctgcaagaagctggagcccgtggccaccgccaaggaggacgccggcctcgagggcgactttcgcagctatggcgcggccgatcactacgggccggatccgacaaaggcacgaccagcttcttctttcgcccacattcccaattattctaatttttcttctcaggccatcaatcccggcttccttgattcaggcaccataagaggggtttcagggatcggcgtgacacttttcatagctctgtacgactacgaagcacggaccgaagatgacctaacattcacaaaaggagaaaaatttcacattcttaacaataccgagggcgactggtgggaggctaggtcactgagctccggcaagactgggtgtattccttccaactatgtggcacccgtggatagcattcaggctgaggaatggtattttggcaaaattggcagaaaggacgccgagaggcagctgctatctccagggaacccgcagggcgcctttctgattagagaatctgaaaccacaaaaggggcctacagtctgtccatacgcgactgggaccagacacgaggggatcatgttaagcattacaaaatccggaaattagacatgggcggttactacattacaacaagggtgcagttcaactccgtgcaggaactggtgcaacactacatggaagtcaatgatggactttgtaacctactgatcgctccatgcaccattatgaagccccagactctgggattagccaaggatgcatgggagatttcccggagttcaattacgctggaaaggagattggggacagggtgcttcggtgatgtttggcttgggacctggaatggcagtactaaggtggccgtgaagactctgaaaccgggcacaatgtctcctaaagcttttctggaggaggcgcaggttatgaagctgctgagacacgacaagctggtccaactgtacgccgttgtcagcgaagagcctatttacatcgttaccgagtttatgtgccacgggtcactgcttgacttccttaaaaaccccgagggacaggatttgcgcctgcctcagctggtcgacatggctgctcaagttgccgaggggatggcgtacatggaacggatgaactatattcacagggatcttcgagccgccaacattcttgttggagagcgtctggcttgtaagattgctgactttggcctggcccggctgatcaaagacgatgagtacaatccatgccagggttccaagttcccgattaaatggacagcccccgaagccgccttattcggcagatttacaatcaaatccgatgtttggtcttttggcatcctgctcactgaactgatcaccaaaggccgcattccatatcccggcatgaataagagggaagtgctcgagcaagttgaacagggctatcacatgccgtgcccgccagggtgccccgcaagtctatatgaagcaatggagcagacgtggagactggacccggaagaacgccctaccttcgaatatctccagtctttcctagaggactacttcacaagcgcagagccacagtaccagcctggtgaccagacctag

SEQ ID NO: 24282 - DNA, 1590 bp, Artificial Sequence
  Description of Artificial Sequence: Synthetic coding sequence
atgggctgcgtgttctgcaagaagctggagcccgtggccaccgccaaggaagacgcaggtttagagggggacttcaggagctatggcgccgctgatcattacggccccgatccaaccaaggctagacccgcttccagctttgctcatatccccaactatagcaacttttcaagtcaggccattaatcccggcttcttggacagcggcaccattcgaggagtaagtggcattggcgtcaccctatttattgccctgtacgactacgaggctcgaaccgaggatgatctgacattcaccaaaggggaaaaattccacatccttaacaacaccgagggggactggtgggaagctcgctctctgtcctccgggaagacaggttgcatcccaagtaattacgtcgctcctgtggacagcatccaggctgaagagtggtacttcggaaagattgggagaaaggatgctgagcgacagctgcttagtccaggcaatcctcagggagccttccttatacgagagtctgagactactaaaggagcatattccctgtcaatcagagactgggaccagactagaggagaccatgtgaagcactataagatccgtaaactggatatgggtggctattacattaccacccgggtccaatttaactccgtccaagagctagtgcaacactatatggaggtaaatgatggcctttgtaacctgctaattgcgccctgtactattatgaagccgcagactttgggactggctaaggatgcctgggagatcagtcggtctagcatcacactcgagcgccgcctgggcaccggctgtttcggtgatgtgtggctgggaacttggaacgggtctaccaaggtggccgtcaaaactctcaagcctgggactatgagtcccaaggcctttctagaggaggcacaagtcatgaagcttttgcgacatgacaagttagtgcagctctatgccgtagtgagcgaggaacctatttatattgtcactgaattcatgtgccacggtagcctgctcgatttcctgaaaaacccagaaggacaggatctccgcctgccccagctagttgacatggcagcccaggtggctgagggcatggcctacatggaaaggatgaattacatccaccgggatctcagggctgccaatatacttgtcggcgaaaggctggcatgcaagattgccgactttggcctcgcaagactcattaaagatgatgagtataatccttgtcaggggagcaagttccccattaaatggaccgctcccgaagcagcccttttcggcaggtttacaattaagtcagacgtgtggtccttcgggatccttctgacagaactcataaccaaggggcgcatcccctacccgggcatgaacaagcgggaagttctggagcaggtggagcagggttaccacatgccgtgtccccctggctgtccagcatcactctacgaagccatggagcagacgtggagactcgaccccgaagaacgcccgacattcgagtatttgcagtcattccttgaagactactttactagtgcggaaccacagtatcagcccggcgaccagacatag

SEQ ID NO: 24283 - DNA, 1590 bp, Artificial Sequence
  Description of Artificial Sequence: Synthetic coding sequence
atgggctgcgtgttctgcaagaagctggagcccgtggccaccgccaaggaggatgcgggactagaaggcgacttccgatcttatggcgcagcggaccactacggccctgatcctaccaaggctagaccagcatcttcttttgctcatatccccaattacagcaatttctcgtctcaggcgatcaatcccggctttttggatagtgggacaattcggggggtgtccggtattggggtgactctgttcatcgctctgtacgactatgaggcacggactgaagacgacttaaccttcacaaaaggggaaaagttccatatcctgaacaatacggagggcgactggtgggaagcacggagtctgtcatccgggaagactggatgcattccttcaaactatgtggcccccgtcgactctatccaggccgaggaatggtactttggtaagattggcagaaaggatgccgaacggcaacttcttagccctggcaatccacagggtgcttttttgatccgggaatctgagactaccaagggcgcctattccctgagtattagagactgggaccaaactagaggcgatcacgtgaaacattacaaaattaggaagctcgatatgggaggttactacatcacaacccgagttcagttcaacagcgtgcaggaattagtgcaacactatatggaagttaatgacggcttatgtaacctcctaatagcaccatgcaccattatgaagccgcaaaccttaggactagccaaagacgcctgggagatctcacggagtagcatcaccctggagaggcgtctcggaaccggctgcttcggggacgtttggctgggtacatggaatgggtccacgaaggtggccgtcaaaacccttaaacctggaactatgagccccaaggcattccttgaggaagcccaggtgatgaaactgctgagacacgataaactggtgcaattatacgcggtcgtcagtgaagagccgatttacattgtaactgaatttatgtgtcacggaagccttttagactttctgaaaaaccccgagggtcaggacttacgacttccacagttagtcgatatggcagcccaagtcgctgaagggatggcatatatggagcgtatgaactatatacaccgcgacctcagggccgccaatatcttagttggcgagaggctcgcatgcaagattgccgatttcggccttgcccgtttgattaaggatgacgagtacaatccctgccagggaagtaagttccccatcaagtggaccgctcccgaagcagccttatttggtcggttcaccatcaaaagcgacgtatggtcgttcggtatactgttgacagagctgattactaaaggccgaattccataccccggcatgaacaagcgcgaggttctggaacaggtggagcaggggtaccacatgccctgtccgcccggatgccccgccagtctctatgaggccatggaacaaacttggagactggacccagaggagagaccgaccttcgaatatcttcagagcttcttggaggattatttcacttcggctgagcctcaataccaacccggagaccagacctag

SEQ ID NO: 24284 - DNA, 942 bp, Artificial Sequence
  Description of Artificial Sequence: Synthetic coding sequence
atgggctgcgtgttctgcaagaagctggagcccgtggccaccgccaaagaggatgccggacttgagggcgacttccgctcatatggagcagccgatcactacggtccggacccgactaaagctcggcctgccagcagctttgctcacattccaaactattcaaatttttcaagccaagccattaatcccgggttcctggacagtggcactataaggggcgtgtccggcatcggcgtgactctatttatcgccctatatgattacgaggcccggaccgaagatgacctgacgttcacaaaaggcgagaaattccacatcttgaataatacagaaggtgactggtgggaggcgaggagccttagctcaggcaaaacaggatgtataccctccaattatgtagcccccgtggactcaatccaggccgaggagtggtattttggaaaaataggaagaaaggacgccgaaaggcagctgctgtcacccgggaacccccagggcgctttcctgattcgcgaatcagaaactacaaagggcgcttattcactatcaataagggattgggaccaaactagaggggaccatgtcaagcattataaaattcgcaagctggatatgggcggatattacatcacaactagggttcagttcaattcagttcaagaattagtccagcattatatggaggtcaacgatgggctgtgcaatttgttgatagcaccgtgcacaattatgaaacctcagacacttggcctcgcaaaggatgcatgggagatctcccgatcctccatcacccttgagcgaagattaggtacaggttgttttggagacgtttggctgggtacttggaacggttctacaaaagttgccgtgaagaccctcaagcctggaacgatgtctcctaaagcttttctggaggaagcacaggtgatgaaactgctgtag

SEQ ID NO: 24285 - DNA, 1392 bp, Artificial Sequence
  Description of Artificial Sequence: Synthetic coding sequence
atgggctgcgtgttctgcaagaagctggagcccgtggccaccgccaaagaggacgccggactcgaaggggattttaggtcctacggagccgctgatcattatggtcccgatcccactaaggcacggccagcaagcagtttcgctcacattcctaattattcaaacttctctagccaggctatcaacccggggtttttggacagtggcactatcagaggagtgtccggcattggcgtcaccctctttattgctctgtatgactatgaagccagaacggaggacgacttgacgttcacaaaaggggagaagttccacatactgaataacactgaaggagcctatagcctctccatccgcgactgggaccagacccggggagatcacgtcaagcattacaaaatccggaaacttgacatgggaggatattacataacaacccgagttcagtttaacagtgtgcaggagttggtgcagcattatatggaggtgaacgacggtctatgcaacttgcttatcgcaccgtgtacaattatgaaaccacaaaccctgggccttgcaaaagacgcatgggaaatcagccgcagcagcatcaccctggagcggcgcctaggaacaggctgctttggcgatgtgtggctgggcacttggaatgggtccactaaggtggctgtaaaaacactgaaacctggtaccatgtctccaaaggcgtttctcgaagaggctcaagtaatgaagcttttgcgccacgacaagcttgtgcagttgtacgcggtggtgtccgaggaaccaatatatattgtcaccgaatttatgtgccacgggagcctgctcgactttctgaaaaaccctgagggccaagatctacggctgccacagttagtcgatatggcagcccaagtggccgaaggcatggcttacatggagaggatgaactatattcatcgcgatctgagagccgcgaacatcctcgttggcgagcgtttggcgtgtaagatcgccgactttggactcgctaggctgatcaaggacgacgagtacaacccatgtcagggcagcaaatttcccattaagtggacagccccagaagccgctctcttcggaagattcaccataaagagtgatgtgtggagttttgggatcctgctcaccgaactcatcactaaaggtaggatcccctatccgggaatgaacaagcgtgaagtcttagaacaggtggaacaggggtatcacatgccctgcccccctggctgcccagcgtccttgtatgaagccatggaacaaacctggagattggaccccgaggagcgcccaacatttgagtatctgcagtccttcctcgaggactacttcacttctgctgaaccccaatatcagcctggcgatcagacctag

SEQ ID NO: 24286 - DNA, 1005 bp, Artificial Sequence
  Description of Artificial Sequence: Synthetic coding sequence
atggagttccccggcctgggcagcctgggcaccagcgagcccctgccccagtttgtagatcctgccctggtttcttcaacacctgaatctggcgtgttttttccaagtggtccagagggcctagacgctgccgccagcagtaccgcccctagcacggccacagccgccgccgctgctctggcatattatagggacgctgaggcctatcggcactctcctgtgtttcaagtctacccactactcaattgcatggaggggattccagggggaagcccatacgctgggtgggcctacgggaaaacaggcctgtatcccgctagcacagtgtgcccaacaagagaggactcccctccccaagctgtcgaggatctggacggtaaaggcagcacttccttcctcgaaactttgaagaccgaacggctgagtcctgacctactcacactcggcccagccctccctagtagcttgccggttccaaattcagcctacggaggaccagacttcagctccactttttttagcccaacaggaagtcccctgaatagcgccgcatacagctctccaaagttgagggggactctccccctgcctccatgcgaggcacgggaatgcgtcaattgtggggcaacagcaacccccctgtggcgtagagataggaccggtcactacctgtgtaatgcctgcggtctgtatcataagatgaacggccagaatagacctcttatcagacctaagaaaaggctgattgtcagcaagcgggcaggtacccagtgcacaaactgccaaactactacgacgactttgtggcgccgcaatgcaagcggcgaccctgtctgtaatgcctgcgggctgtactacaagcttcaccagcattattgtgggggtagcgcgcaattaatgagggctcaatccatggccagccgagggggagttgtctcatttagttcatgttcccagaattccgggcagccaaagagtctggggccccgtcaccccttggcttag

SEQ ID NO: 24287 - DNA, 1242 bp, Artificial Sequence
  Description of Artificial Sequence: Synthetic coding sequence
atggagttccccggcctgggcagcctgggcaccagcgagcccctgcctcagttcgtcgacccagctcttgtcagctcaactccggaatcaggggtgtttttcccaagcggcccagaaggtttagacgcagctgcatcttcaacagcaccatccactgcaacagctgcagcagcggcactcgcatattatagagacgcggaagcctacagacattctcctgtcttccaggtttatcccctgcttaattgcatggagggaatccctggaggctccccttacgctggttgggcatatggtaaaaccggtctgtatcccgccagcaccgtgtgtcccacccgcgaagatagcccccctcaggccgttgaggacctagacgggaagggcagcacatcattcctcgaaaccttaaagactgagcgtctgtctcccgatctactgactctgggcccagctttaccatccagtttaccagttccaaactctgcctacgggggacccgatttttcctccacttttttttcccccacaggctcacccttaaattcggcggcctactcaagccccaagttgagaggaaccctgcctttacctccctgcgaagcccgtgaatgcgtgaattgtggcgctacggcaacccccttgtggagacgcgatcgcaccggccattatctctgtaacgcttgtggactgtaccataaaatgaatggtcagaacaggcccctcatccggccaaagaagcgcctcattgtcagtaagagagcaggtacacagtgtactaactgtcagaccactactactacgctgtggagaaggaatgccagtggtgatccagtttgtaatgcatgtgggctctattacaagctccatcaggtgaaccgcccgctgacaatgcgcaaggatggcattcagacaagaaatagaaaggctagcggtaaaggtaagaaaaaaaggggaagctccttgggggggactggcgctgcagagggacccgcaggtggtttcatggtagttgccgggggcagtggtagtgggaactgcggagaggttgcctccggtctcacactaggaccgcccggtaccgcgcatctttaccagggtctggggcccgtggtgctgagtggtccagtctcccacctgatgccattccctggtcctcttttagggtctcctacaggctcattcccaacagggcctatgccacccacaacttcaactactgtcgtcgcccctctctctagctag

SEQ ID NO: 24288 - DNA, 369 bp, Artificial Sequence
  Description of Artificial Sequence: Synthetic coding sequence
tgacagaaccggcccctgatccggcccaagaagcggctgatcgtgagtaagagggcaggcacacaatgcacgaattgccagaccacaactactacgctgtggagaaggaacgcgtccggcgaccccgtgtgcaacgcctgtggactatactacaagctacaccaagtgaatcgacctcttacaatgcggaaggatggaatacaaaccaggaatcgaaaggcttcaggcaaaggcaaaaaaaaacgagggtctagtctgggaggtactggcgcggccgaggggcctgccctcctgtggtggcttaggtctgctcatgagggcacagaacatggcctacagaggaggggaggcgtgctgctgctgctgtag

SEQ ID NO: 24289 - DNA, 1332 bp, Artificial Sequence
  Description of Artificial Sequence: Synthetic coding sequence
atggaggtgaccgccgaccagccccggtgggtgagccaccaccaccccgcagtgttaaatggacaacatcccgacacacaccatcccggcctttctcacagttacatggacgctgcacagtatcctctacctgaggaagtggacgtcctgtttaatattgatgggcagggaaatcatgtgcccccatattatggcaacagcgtgagagctaccgtgcaaagatacccacccacccaccatggcagccaggtgtgccgcccgccactgctgcacggctctcttccttggctagacggcggcaaggccttgggatcccatcacactgcaagtccatggaatttatcacctttcagcaaaacttccattcatcacgggagtcctgggcctctgagtgtgtatcctcctgcctcttcctcaagtctgtctggagggcacgcgagcccccaccttttcacgtttcctccaaccccacccaaagatgtttcacctgatccatctctcagtactcccggaagcgccggcagtgctcgccaggatgagaaagaatgtctaaaatatcaggtccctcttcccgactccatgaagctagagtctagtcatagtcgcggcagcatgacagcattgggtggcgcgagctcaagtacccaccatcccattacaacttatccaccgtatgtacctgagtactcctctggactcttccctccctcctccctgctgggtggcagcccaaccgggttcggatgtaaatctcgcccaaaagcgcggtcatccaccggccgagagtgcgttaactgcggggcgacttccactccgctgtggaggcgtgatggaactggccattatctgtgtaacgcctgtgggctctaccacaaaatgaacggacagaatcgcccgctgattaaacccaagcggaggctgtccgccgctcggagggcaggtacctcctgtgccaattgtcagaccacgaccacgacactgtggaggcgtaatgccaacggggacccagtgtgcaatgcttgcggtctgtactacaagctacacaatatcaatcggccgctcacaatgaagaaagagggcatacagactcgcaaccgcaagatgtcttctaagtctaagaagtgcaaaaaggttcacgacagcctggaggatttccccaaaaatagctctttcaacccagctgctctctctagacacatgtcttccctttcccatatcagccctttttcacacagctcccacatgctgaccacacctactcctatgcatccgccatcttctttgagtttcggaccacaccacccatcatctatggtgacagcaatgggctag

SEQ ID NO: 24290 - DNA, 1335 bp, Artificial Sequence
  Description of Artificial Sequence: Synthetic coding sequence
atggaggtgaccgccgaccagccccggtgggtgagccaccaccacccagcggtcttgaacggtcaacacccagatacgcatcatccagggctctcccattcttatatggacgctgctcagtacccgctcccagaagaggtagacgtgctgttcaacattgacgggcagggtaaccacgtccccccttactatggtaattcagtgagagccacagtgcagcggtacccacccacccatcatgggtctcaggtgtgcagacccccccttctgcatgggagcctgccctggctcgacggtggaaaagccctggggagtcatcatacagcctcaccctggaacttgtccccatttagtaagacctcaattcatcatggctctcctggtcccctcagtgtctaccctccggctagtagctcatctctctccggcggacacgccagcccccacctcttcacttttcccccaacaccccccaaggacgtcagtcccgacccctccctgtccacgcctgggagcgccggatcagcgaggcaggacgaaaaagaatgccttaagtatcaggtgcccctcccagattcaatgaaattggaatctagtcactctaggggaagcatgacagcattaggaggagcttcttccagcacacaccacccaatcacaacttaccctccatatgtgcctgagtacagtagtggtttgtttccgcctagttccctgctgggcggaagccctacgggcttcggctgcaagtcccggccaaaggcacggagctccactgagggcagagaatgtgtcaactgcggggcaacgtccacgcccctctggcgcagggatggaaccggccactacctgtgcaatgcctgtgggttgtaccacaagatgaatggacagaacaggcctttgattaagcctaaacgccggcttagcgctgcaaggagagctggcacaagctgtgcgaactgccagaccacaacaactacattgtggcggcgaaatgcgaatggcgatccagtgtgcaatgcatgtggactgtattataagctgcacaacattaatagacccctgaccatgaaaaaagaaggcatccaaaccagaaataggaaaatgagttccaagtcaaaaaagtgtaagaaagtccacgattctctggaagacttcccgaagaacagctctttcaacccagctgctctgagcagacatatgagctcactcagtcacatcagcccatttagtcacagcagccacatgctgacaaccccaactcccatgcacccgccctccagtctgagttttggtcctcatcaccctagttctatggtgacagctatgggatag

SEQ ID NO: 24291 - DNA, 393 bp, Artificial Sequence
  Description of Artificial Sequence: Synthetic coding sequence
atggaggtgaccgccgaccagccccggtgggtgagccaccaccaccctgctgtgctgaatggtcagcacccagacacccaccatcccggcttgtcacacagctatatggatgcagctcagtacccattacctgaagaggtggacgtactgttcaacattgacggtcaggggaatcacgtgccaccctattacggaaacagcgttcgagcaaccgtccagaggtaccccccaacccatcatgggagtcaagtttgtaggcccccgctcttgcacggatccctgccatggcttgatggaggcaaagctttggggtcacatcataccgcctctccttggaatctcagaccttgcctgcaatgtctgtgggccctgctgcaggcctctcaatgttag

SEQ ID NO: 24292 - DNA, 798 bp, Artificial Sequence
  Description of Artificial Sequence: Synthetic coding sequence
atgcggcgggccgagctggccggcctgaagaccatggcctgggtgccagctgaaagcgccgtagaggaactgatgccgcgattgttaccggtggaaccctgcgaccttacagagggctttgatccatctgtgcccccccggacccctcaagagtacctcagaagagtgcagattgaggctgcccagtgcccagatgtggtggttgcccagatagatccaaagaaactcaaaagaaagcagtcagtgaacatctcactctctggatgccagccggcacccgaaggctatagcccaacgttacagtggcagcagcaacaggtagctcagttcagcactgtgcgacagaacgtgaacaagcataggagccattggaaatcccaacagttggactcgaatgtcactatgcccaaaagcgaagacgaagagggatggaagaaattctgcttgggagaaaagctctgtgccgacggtgccgtaggtcccgctaccaatgaatcgcctggcatcgattacgtgcaggctaccgttacttctgtactggagtatctgtctaactggttcggagagcgggatttcacccccgaactaggtcgctggctctatgccctgttggcttgcctagaaaagcccctgctgcccgaggcacatagtctgatccggcagctggcccggcgctgtagtgaggtccgactccttgttgattccaaggacgacgaaagggttccagccctgaatctgctgatctgtctggtgtcgcgctattttgaccagcgggatctggcggacgagccttcctag

SEQ ID NO: 24293 - DNA, 843 bp, Artificial Sequence
  Description of Artificial Sequence: Synthetic coding sequence
atgcggcgggccgagctggccggcctgaagaccatggcctgggtgcctgctgaatctgctgttgaagaactgatgccacggcttttgccagtggaaccatgcgacctaactgagggcttcgacccaagcgttccccctagaacacctcaagaatacctccgaagggttcagatcgaagccgcgcaatgccccgatgtggtggtggcccaaatcgatcctaagaaactgaagcgcaagcagagcgtgaacatctcattgtccggttgccaacccgctccagaaggctactctcctactctgcagtggcagcagcagcaagttgcccaattcagtaccgtcagacagaacgtgaacaagcaccgttctcactggaagtctcagcagctcgattctaacgtgacaatgccaaaaagtgaagatgaggagggctggaaaaagttttgcttgggggaaaagctctgtgccgatggggcggtcgggccagccaccaacgagtctcccggaattgactacgtccagatcgggttccctcccctcttgtctattgtcagcagaatgaaccaggcaactgtgacaagcgtgctggagtacttgtctaactggtttggtgagcgcgacttcacgcctgaacttggacggtggctatacgctttactggcttgcctggagaagccattgctgcccgaagcccatagcctcatcaggcagctggccaggaggtgtagcgaggtccggctactggtcgatagcaaagatgatgaacgggttcctgcacttaatctgctcatctgtcttgtgtctcgatacttcgaccaaagagacctggctgatgaaccatcttag

SEQ ID NO: 24294 - DNA, 753 bp, Artificial Sequence
  Description of Artificial Sequence: Synthetic coding sequence
atgcggcgggccgagctggccggcctgaagaccatggcctgggtgcctgctgaatcagcggtggaggagctgatgccacgactgctcccagtagaaccatgcgatctcactgaaggttttgacccgagcgtgccccctcgcacccctcaggagtacttgcggagggtccagattgaagcagcacagtgcccagacgttgtagtggctcaaatcgaccccaaaaagctcaagaggaagcaatcagtcaatatttccctcagcggctgtcagcctgcccctgaaggctactcgcctacgttgcagtggcagcagcaacaggtggctcagttcagcacggtcaggcagaacgttaacaagcaccggtcccactggaagagtcagcagctggattctaacgtcaccatgccaaagtcagaagatgaggagggctggaagaagttttgcctcggcgagaaattgtgtgctgacggtgcggtcggcccagctacaaatgagtcccctggcatcgattatgtgcagattggctttccgccattgctgagtattgtaagccgaatgaatcaagccacggtgacgtccgttctggaatatctgtctaattggttcggtgaacgcgacttcactccggagctgggccgatggctctatgccctgcttgcgtgtttagaaaaacccctgcttccggaggctcacagccttatcagacagctggcccgccggtgctcagaggtcaggctcctcgtggtgttctag

SEQ ID NO: 24295 - DNA, 768 bp, Artificial Sequence
  Description of Artificial Sequence: Synthetic coding sequence
atggacgtgatggacggctgccagttcagccccagcgagtacttctatgacggctcctgcattccatctccggaaggagagtttggcgacgaatttgtgcccagggtagctgcgtttggagcccataaggcggagttgcaagggtcagatgaggatgaacatgtgagagctcctaccggccatcatcaggccggacattgcttgatgtgggcttgcaaggcgtgtaaaaggaaaagcactactatggataggagaaaggctgccaccatgcgggagcgtaggaggctgaagaaggtaaaccaagcattcgaaaccctaaagcgctgtacaaccacaaatcctaatcagcgtttacccaaggtggagatacttcgcaacgccataaggtatatcgagtccctccaggagctgctccgcgagcaggtcgagaactactacagcctccctggacaatcatgctctgaacctacatcccccacctccaactgcagtgatggaatgcctgagtgcaatagccctgtctggtcaagaaaatcttccacattcgactccatctactgccccgatgtttccaatgtctacgccaccgacaaaaactccttgagctcccttgactgcttatctaatatcgtggacagaataacctccagtgaacagcccgggctccctctgcaagacttggctagcctcagccctgtggccagcacagacagccagcccgccaccccgggggcgtcctctagtaggttaatatatcacgtgctgtag

SEQ ID NO: 24296 - DNA, 1725 bp, Artificial Sequence
  Description of Artificial Sequence: Synthetic coding sequence
ctgagccccagcctgggcttccccgcccagatgaaccaccagaagggtccctctccgtccttcggggtccagccgtgcgggcctcatgattctgccaggggtggtatgataccacatccacagtctcgcggtccgttcccgacctgtcagctgaagtccgaacttgacatgttagtgggaaagtgtagggaggaacccttagagggggatatgagcagtccgaactccaccgggatccaagaccctctgctgggcatgctcgacggccgcgaggatttggagcgggaagagaaacgtgaacctgaaagcgtttacgaaaccgactgtcggtgggatgggtgttcccaggagtttgactcccaggaacaactggtgcaccatattaattctgagcatattcacggagagagaaaagaattcgtgtgccactggggcggctgctcccgagagttgcggcccttcaaagctcagtacatgctggtagtgcacatgaggcgtcacacaggggagaagcctcacaaatgtactttcgaaggctgcaggaagtcctattcacgccttgagaacttaaagacgcacttgcgatctcatacaggggaaaagccctatatgtgtgagcacgaaggctgctccaaggcgttcagcaatgcctccgaccgcgccaaacaccagaacagaacacattccaacgagaaaccatacgtgtgcaagctcccaggatgcactaagcggtatactgatccaagttccctgaggaaacacgtgaaaactgttcacggccctgacgcccacgtaaccaagcggcatcggggtgacgggcccttaccccgggcaccttccatcagcacggtggaacccaagcgagagagggaaggcgggcctatcagagaggaatcacggctgacggttcccgagggagccatgcccccacatccccagccccttttttctcattatccacagcccagtccaccacagtacctgcaaagcgggccatatactcagccccctcctgattacctcccatccgaaccccgaccatgccttgactttgactcaccaacccatagtaccggacagcttaaggcgcagctcgtctgcaattatgtccaatcccagcaggagttgctgtgggaaggaggagggcgcgaggacgctcccgcccaggaaccaagctaccagagtcccaaattcttagggggatcacaggtttctccatctcgggccaaagcgccagtgaacacatacggacccggattcggtccaaatctgcccaatcacaagtcaggcagctaccccaccccttctccctgccacgagaactttgtggtgggcgcaaatcgagcttcccacagggctgctgcaccacctcgcctgcttccacctcttccaacgtgctacggacccctgaaggtcggcggcacgaacccctcctgcggacatcctgaggtgggccgcctgggcggagggcctgccttatatccaccccctgagggtcaggtgtgtaaccccctggactccctcgatctcgacaacacccaacttgactttgttgccattctcgacgagccacagggcctttcacccccgccctcgcatgatcaacggggatcaagcgggcataccccccccccttccggtccccccaatatggccgtcggcaacatgtccgtcctcttgaggtccctcccaggagaaaccgaattcctgaactcctccgcatag

SEQ ID NO: 24297 - DNA, 390 bp, Artificial Sequence
  Description of Artificial Sequence: Synthetic coding sequence
atgttcaacagcatgacccccccccccatcagcagctacggcgagccctgttgcctacgccccctgccaagccaaggagccccaagcgtaggcactgaaggcctgtctggaccaccattctgccaccaagctaacctgatgtctggaccccactcttacggacccgctcgtgagactaatagctgtaccgaagggcctttgttttcatcgccaagatctgccgtcaaactgacaaaaaagcgcgccttgagtatcagcccactcagcgatgcctctttggacctccaaacggtgattcgtacttccccatcatcacttgtcgccttcatcaatagccgctgtacctctcctggcgggtcttatggccatctgagcataggaactatgtag

SEQ ID NO: 24298 - DNA, 3198 bp, Artificial Sequence
  Description of Artificial Sequence: Synthetic coding sequence
atgttcaacagcatgacccccccccccatcagcagctacggcgagccttgctgcctccgccccctaccatcccagggcgcaccgtcagtggggactgaggtgaaactcacgaaaaaacgtgcattgtctatcagccctctctctgatgcctctctggatttgcagactgtgattaggactagccctagctcactggttgcgtttataaattctaggtgtacaagtcccggcggcagctatggtcatctctccatcggtacaatgagcccttccctagggtttcctgcccaaatgaatcaccagaagggtcccagcccgtctttcggcgttcagccctgtggcccccacgactctgcccggggtggcatgattcctcacccccaaagccggggaccattcccaacctgccagctgaaaagcgagcttgacatgctagtgggcaagtgccgggaagaacccctggagggagacatgagttcacccaatagcaccggaattcaggatcccttattagggatgctggacggacgtgaggacctcgaacgtgaggaaaagcgagaacccgagtctgtgtatgagacggactgtaggtgggatgggtgttctcaagaattcgactctcaggagcagctcgtgcatcacatcaacagcgagcacatccatggagagcggaaagaattcgtctgtcattggggggggtgcagtagagagctgcgtccattcaaagcacagtatatgctggtggtccatatgagacgccacaccggtgagaagccacataaatgtacgttcgaaggatgtcggaagagctacagccgcctagagaacctgaagacacacctgagatcacacaccggggaaaagccatacatgtgcgagcatgaaggatgctctaaggccttttcaaatgcatctgatcgcgcgaagcatcagaataggacccattctaacgaaaagccctatgtgtgcaagttaccgggctgtactaagcgctatacagacccttcaagccttaggaaacacgtgaaaacggtccacggacctgatgcacatgtgacgaaaagacatcgtggagatggcccgctgcccagggctccatctataagtaccgtcgagcccaagcgggaacgcgagggcggtcctattagagaggagagcagactcacagtgccggaaggggctatgaagccccaaccatcacccggcgcccagtcctcctgttcctctgatcactctcctgccgggagcgccgcaaatacagattccggcgttgagatgaccggcaacgccggcggcagcacggaggacctgtcttctctggatgagggcccctgtatcgctggcactggactctcaacgcttcgaaggctggagaacttacgactggatcagttgcatcagctgcggcccattgggactcgagggcttaagctcccctcccttagtcacaccggcacaacagttagcaggagagtggggccaccggtaagtctcgagaggagaagctcctccagttcctccatttccagcgcatacaccgtgagcagacgttctagtctagctagccccttcccgccgggcagtccaccagagaatggcgcatcttccttgccaggactgatgcccgcccagcactacctgctgcgggccaggtacgcttctgcccggggaggcggcaccagcccgacggccgcctccagtttagatcggatcggcggactgccgatgcccccttggcgaagccgggccgagtaccctggctacaatccgaatgctggtgttacccgtcgcgcttcagatcctgcccaggcggccgatcgccccgctcctgcaagggtgcaacggtttaagtcgttgggctgcgttcatacccccccaacagtcgcaggcggtggacagaacttcgatccctatctacctactagcgtctattcaccacagccaccatcaataaccgagaacgccgcgatggacgcccgcggactgcaggaggaaccggaggtagggacatcaatggtgggatctggattgaacccctacatggatttcccacccaccgacaccttaggctacggggggcctgagggcgcggccgcagaaccatatggcgcccgcggcccgggctccttgcctcttggtccaggccctcctacaaactatggaccaaatccatgtccacaacaggcaagttatccggatcccacacaggagacttggggggaattcccttcacatagcgggctgtaccccggtccaaaggctttgggcggcacatactcacaatgcccgagactggagcactacggccaggtccaggtcaagcccgagcaagggtgccctgtgggtagcgatagcaccgggctcgcgccttgcttgaacgcccatcctagcgagggccctcctcatccccagcctctgttcagccactacccgcaaccttctcctccgcagtatctgcagtccggcccctacacacagccaccccccgactacctgccaagcgaaccccgcccctgtctggacttcgactcacccacccattctaccggccagctgaaggcccagttggtgtgtaactacgtgcagagtcagcaggagcttctgtgggagggcgggggccgtgaggatgctccagcccaggagccttcatatcaatcgccaaagttcctgggcgggtcacaagttagccccagtcgtgcaaaagcccctgtaaacacctacgggcctggcttcggacctaatcttcccaaccacaaaagcggatcctatcctacgccctccccatgccacgaaaattttgtggtgggcgccaaccgagcttcccacagggcggccgcgccgcccagactactccctccgttgccaacctgctacggccccctgaaggttggcgggaccaatcctagctgtggtcacccagaggtggggcgcctgggaggcggaccggccctatatccaccccctgaaggccaggtttgcaaccccttggatagcctagacctggacaacacacagttggattttgtggcaattttggacgaaccccagggcctgtcaccccccccatctcacgaccaaaggggctcttctggccacactccacctcctagtggccctcccaatatggccgttggcaatatgtccgtcctgctcaggtccttgccaggcgagaccgaatttctgaatagctccgcttag

SEQ ID NO: 24299 - DNA, 528 bp, Artificial Sequence
  Description of Artificial Sequence: Synthetic coding sequence
atgagccccagcctgggcttccccgcccagatgaaccaccagaagggcccttcacccagctttggcgtccagccttgtggaccgcatgatagcgcaagggggggtatgatcccacacccccagtccagaggacccttcccaacatgccaactgaagtctgagctggatatgttggtgggcaaatgccgcgaagaaccgctggagggagacatgagctcaccaaatagtaccggtatccaggacccactacttggtatgttagacggccgggaggatctggaacgcgaagagaagagagaaccagagagcgtctatgaaaccgactgccgttgggacgggtgcagccaggaatttgactcccaggagcagttagtgcaccacatcaatagcgagcacatacatggcgagagaaaggagtttgtgtgccactgggggggctgctccagagagctgcgaccttttaaggctcagtatatgttggttgtgcacatgcgtcggcacacaggcgagaagccgcacaaatgttag

SEQ ID NO: 24300 - DNA, 2937 bp, Artificial Sequence
  Description of Artificial Sequence: Synthetic coding sequence
atgagccccagcctgggcttccccgcccagatgaaccaccagaaggggccctccccttcatttggagtgcagccgtgtggcccccacgactctgcacgaggagggatgattccacatccacagtccaggggcccttttccgacatgtcagctgaagtcagaactcgacatgttggtaggaaagtgccgtgaagagcccttggaaggggatatgagttctcccaacagcactggaatccaggatcccctgcttggaatgctggacggccgagaggacctggagagggaagaaaaacgcgaacccgagagcgtttacgagacagactgcaggtgggatggctgttcgcaggagtttgactctcaggagcaactggtgcaccacattaattctgaacatatccacggcgaaagaaaggagttcgtatgccactggggcgggtgctcacgagaactgcggccttttaaagcacaatatatgctcgtggtccatatgcgtcggcacacaggcgaaaagccgcacaaatgcacatttgagggctgtagaaagagctattctcggctggagaatctgaagacacacttgagaagccacacaggagaaaagccctatatgtgcgagcacgaggggtgtagcaaggcctttagtaacgctagtgatcgcgctaagcaccagaaccgcacacactccaacgagaaaccatacgtgtgtaaactgccgggctgcactaagcgttacacagatccctcctccttgcggaaacatgtgaagacggtgcatggtcctgacgctcatgtaactaagcggcatcggggggacggcccactccctagagccccatccattagcacagtggagcctaaaagggaacgggaaggcgggccaattcgagaagagtcccggctgacagtaccagagggagcgatgaagcctcaaccaagcccgggtgcccagtccagctgttccagtgaccacagcccagccggtagcgcagctaatactgactctggggtagaaatgaccggaaatgcagggggatctacagaagacctctcatcgcttgatgaaggaccctgcatcgccgggactggattgtctacgctaaggcgtctggagaatctccgtttggaccagctccatcagcttcggccgatcggtacccgtgggcttaaactgcctagcctgagccacacaggaacaactgtgtcgcgtcgtgtcgggccacctgtgtccctggaaagacggtccagttcaagctctagtatcagttctgcctacaccgtgagtagaaggagttcccttgcatctccgtttcctcccggatcaccccccgaaaacggtgccagctctttgccaggactcatgcccgctcagcattacttgcttcgggcccggtatgcctcggcaaggggtggcggcacaagccctacggccgcctcttctcttgacaggatcggcggactccccatgccgccatggcggtcacgagctgagtatcctggatacaaccccaatgctggtgtcaccagacgggcgagcgatccagcccaggcggcagatagaccagcccccgcccgggtccagcggttcaagtcactcggctgtgtccatacaccccccacagttgcaggaggaggccagaactttgacccttatctacctacctctgtgtacagcccacaacccccatccatcaccgaaaacgcagcaatggatgcccgaggcttgcaggaagagccagaagtgggcactagcatggtcgggagtggtctcaatccctatatggactttccccccacggataccctagggtacggtggccctgagggcgccgccgcagaaccgtacggcgcacggggccccgggagccttcctctaggtccagggccacctacaaactacgggccaaatccctgcccccaacaggcgtcttacccagatcctacccaggaaacgtggggtgaatttcccagccacagtggactgtacccggggcccaaggccctcggaggaacttattcccagtgcccccgacttgaacattatggccaggtgcaggtcaagccggaacagggctgccccgttgggagcgactcgaccggccttgccccatgtctcaatgcccacccgtccgagggacctccccatcctcagccattgttcagccattaccctcaaccatcaccaccccagtacctgcagtctgggccatacacccaaccacccccagattatttgccctctgaaccccgcccttgtttggatttcgattcacctacccattccaccggacagttaaaggcccagctggtttgcaactacgtccagtcacagcaggaacttctttgggaaggcggtggccgtgaagacgctcctgcccaggagccttcctatcaatctccaaagtttctaggtgggagtcaggtcagcccatctagagccaaggctcccgtgaatacttacggaccaggcttcgggcctaacttgcccaaccacaagtcagggagttaccctacaccttccccatgccacgaaaatttcgtcgttggagctaatagggccagccaccgcgccgccgcacccccgaggcttctgccccccttgccaacttgttacggtccattgaaggtggggggcaccaaccccagctgcgggcatcccgaggtgggcagactgggaggtgggcccgctctgtacccgccacccgaggggcaggtctgtaaccccctggattcacttgacctggacaacactcagctggactttgtggccattctcgatgaaccacagggcctctctccccctccttcacacgaccagcgggggagcagcggccatactccacccccatcaggaccaccaaacatggccgtggggaacatgagtgtgctgctcaggagtctccccggcgaaaccgagttcctgaatagttccgcgtag

SEQ ID NO: 24301 - DNA, 135 bp, Artificial Sequence
  Description of Artificial Sequence: Synthetic coding sequence
atgagcggcccccacagctacggccccgcccgggagaccaacagctgtacagagggaccgctattcagctcaccccgaagcgccgtgaagctgaccaaaaaacgcgctctgtcgatttctcctctttccgattag

SEQ ID NO: 24302 - DNA, 3198 bp, Artificial Sequence
  Description of Artificial Sequence: Synthetic coding sequence
atgttcaacagcatgacccccccccccatcagcagctacggcgagccttgttgcctgcgccccctaccttcacagggcgcgccatcagtggggacggaggtgaagctcactaagaagagggcgttatccatttctccactctctgacgcttctttggatctccagactgtgatccgaacctctccaagcagtctggtcgcctttattaattctcggtgcacaagtccaggcgggtcttacggccatttgtcaatcgggaccatgagcccaagcttgggattccccgcccagatgaaccaccagaaagggccctcaccttccttcggcgtgcagccatgtggcccccatgacagtgcccgcggaggcatgataccacaccctcagtctagaggcccctttccgacctgtcagctgaagtccgagctggacatgttggtgggcaaatgccgagaggagcctttggagggggatatgtccagccctaatagcacagggattcaggaccctttgttgggaatgcttgatggccgggaagacctggagcgggaagagaaacgagagccagagagtgtgtacgagacagactgcaggtgggacggatgctcccaggaatttgatagtcaggagcagctggtgcaccatatcaactctgagcacattcacggtgaacgaaaagaattcgtgtgtcactggggtggttgcagcagggaactgcgaccgttcaaagcccaatacatgttggtcgtgcacatgagaaggcacaccggcgagaaaccccataagtgcacgtttgaggggtgccgtaagagctattcccgactagagaatttgaagacccatttacggtcccatacgggggaaaagccctacatgtgtgaacacgagggatgctcgaaggctttcagcaacgcatctgaccgtgctaagcatcaaaatagaacccactctaacgaaaagccctatgtgtgcaaactcccgggatgtaccaagcggtacacagatccctcaagccttaggaaacatgttaaaacagtgcatgggccagacgcccacgtgacgaagcgccaccgaggggacggaccactgcccagggcaccttccatcagcacagttgagcccaaacgagagagagagggtggtccaattcgagaggaaagtcggctcacagttcctgaaggggccatgaagccacagccgtcaccaggagctcagtcttcttgttcctcagatcacagcccagccggcagcgccgcaaacacagatagcggtgtggagatgacgggtaatgcgggcggatccactgaagacctgagcagcctggacgagggcccttgtatcgcgggtacgggactctctacactgagacggctggagaaccttcgcctggaccagcttcaccagctgagacccatcgggactagaggcctcaagctgccatcgcttagtcacacaggcaccacagtatctcgcagggtaggaccacccgtgagtcttgaacggcgttcttccagctcgtcgagcatctcgtcagcctatacagtttccaggcgatcctccctggcatccccattccctcctggctctccccccgaaaacggcgcttctagcttgccaggattaatgccagctcagcactacttgttgcgggcaaggtacgcttctgcgcgcgggggggggacctccccgacagctgcgagctctctggataggatcggcggacttcccatgcccccttggcgaagtcgtgcagagtatccagggtataaccctaacgctggtgtcactagacgggcctcagatcccgcacaagccgccgatcgcccagcgcccgcacgggtccaacgtttcaagtcgttggggtgcgtgcacacaccacccacagttgctggcgggggtcagaacttcgacccatatctccctacatcagtctattctccgcagcctccatcaattaccgagaacgccgccatggacgctcgaggactgcaggaggaacctgaggtgggtacctctatggtggggtcagggctgaatccctacatggactttcccccgacagatacactgggctacgggggaccagagggagccgcggcagagccttatggggccagggggccaggatcgctgcccttaggtcctgggcctcctacgaactatggtccaaacccatgtcctcagcaggcatcctatcccgatccgacccaggaaacctggggtgaatttccaagccactctgggctttatcccggcccaaaagccctgggcggcacttactcccagtgcccgaggcttgagcactacgggcaggttcaggtgaaacccgagcagggttgtcccgtggggagcgattctaccggtctggcaccctgcctgaatgcgcacccatctgagggacctccacacccccagccccttttcagtcactatccccagccatccccgcctcagtaccttcaatccgggccttacacacaaccaccacctgattacctcccctctgagccccgtccttgcttagatttcgatagcccgacgcattccaccggccagttgaaggcccagctggtgtgcaattacgtgcagagtcagcaggagctactgtgggagggaggaggaagagaagatgctccagcacaagaaccttcataccagtcacccaagttcctgggcggatcacaggtgtccccaagtcgggccaaagcacctgttaacacctacggcccaggatttggccctaacctgcccaatcataagtcgggatcctatcccaccccttcgccgtgtcacgagaatttcgtcgtgggtgccaatcgtgcctctcatcgcgccgcggcccccccgcggctgctgccccctctgcccacctgttatggcccccttaaagtgggcgggactaacccaagttgtggacaccccgaggttggacgacttggcggtgggccagctctgtacccaccccccgaagggcaagtatgtaaccctctcgactccctggacctcgataatactcagctggacttcgtggcaattctcgatgagccacagggtctgtctccgcccccctcccatgaccagcgaggctcctctggccatacaccacccccatcaggaccacccaacatggccgtgggaaatatgtcagtgctcctgcgctcactgcctggtgaaactgagtttttaaattcctcagcttag

SEQ ID NO: 24303 - DNA, 1548 bp, Artificial Sequence
  Description of Artificial Sequence: Synthetic coding sequence
atggccgagcaggtggccctgagccggacccaggtgtgcggcatcctgagggaggagctctttcaaggggatgcattccaccagtccgatacgcacatcttcattatcatgggagcgagcggggacctggcgaagaagaaaatctacccgactatttggtggctgtttcgggatggactcctgccggagaacacattcattgtaggctacgccagatccaggctaactgtcgccgacatccggaagcagagcgagcccttctttaaagctaccccggaagagaagctcaaactggaagacttctttgcacgcaatagctacgtggcaggacagtacgatgatgcagcatcataccagaggctgaacagccatatgaacgccttgcatttagggagccaggccaacagactgttctatttggctctcccacctaccgtgtacgaggctgtcaccaaaaatatccacgagtcatgcatgtcccagatcggatggaacagaatcatcgttgaaaaaccgtttgggcgagatttgcagtcttcggaccggctttccaatcatatcagctctctcttccgtgaggaccaaatttatcgaattgatcattacctagggaaagaaatggtccagaacctcatggttctgaggttcgcaaacagaatctttggacctatctggaaccgcgataatatcgcttgcgtgattctcacttttaaagagccttttggaacagagggaagaggcggatattttgatgaattcggcatcatacgtgatgtgatgcaaaatcatcttctccagatgttatgcttggtcgctatggaaaagccagccagtacaaacagcgatgacgtgagggacgaaaaggtcaaagtgctcaagtgtattagtgaggtgcaagctaacaacgtggtgctcgggcagtatgtgggcaaccccgatggggagggtgaggccaccaaaggctatctggacgaccccacagtccctagaggctcaaccacagctacttttgcggcagtcgtgctgtacgtggagaatgaacgctgggacggggtgccatttatccttcgctgtggcaaggccctgaacgaaagaaaggccgaggtgcgcttacagtttcatgatgtcgccggcgacatattccatcagcagtgcaagaggaatgaattggtgatcagagtacagcccaatgaagctgtgtataccaagatgatgaccaaaaagccggggatgttctttaatcccgaggagtccgaactcgacctcacttacggcaaccgctacaaaaacgtcaagcttccggatgcatacgagaggctgattcttgacgtattctgtggctcccaaatgcactttgtcagatcagacgaattaagagaggcctggcgcatcttcacaccactgctgcatcagatcgagctggagaaacccaagccaataccatacatttacggctcaaggggtcctactgaagccgatgagctcatgaagcgtgtgggatttcaatatgagggcacctacaaatgggtgaaccctcacaagctttag

SEQ ID NO: 24304 - DNA, 1686 bp, Artificial Sequence
  Description of Artificial Sequence: Synthetic coding sequence
atggccgagcaggtggccctgagccggacccaggtgtgcggcatcctgcgagaagagttgttccagggggatgcgttccatcaatcagatactcatatattcattattatgggagcctccggcgatctcgctaaaaaaaaaatttatcctactatttggtggttatttcgggacgggctgcttcccgagaataccttcatagtcgggtacgccaggagccggctcactgtcgccgacatccgcaaacagtctgaacccttcttcaaagcaacccccgaagaaaagctgaagcttgaggatttcttcgcccggaactcttacgtggcaggacaatacgacgatgcggccagctatcagcggcttaatagtcatatgaatgctttgcatctcgggtcacaagcaaaccgactgttctatctggcactcccaccgacagtgtatgaggccgtgactaaaaatatccatgagagctgcatgagccagatcgggtggaaccgcattatagtagagaaacctttcggcagagacctacagagctccgatagactgagtaaccacatctcaagtctctttagggaggaccagatttacagaattgaccactacttgggtaaggaaatggtgcagaacctcatggtgttgcggtttgctaaccgtatttttgggccaatttggaaccgggacaatatcgcgtgtgtcatcttgacattcaaggagccgttcggaacagagggtcgaggtggatatttcgatgaatttgggattatccgcggacccgggaggcagggtggatctggatccgagagctgttcgcttagtcttggtagcctggtttggggaccccatgcactggagccaggcgaacaggggggggagctgaggagggccttagcatcatccgttccgcgcgatgttatgcagaaccatttgctccagatgctttgccttgtggctatggagaagcccgcctcaactaactctgatgacgtgagagacgagaaggtgaaggtattaaagtgtatttcagaagtgcaggccaataacgttgtcttgggacagtatgtgggtaaccctgatggcgagggagaggcgacgaaagggtatctcgacgatccgaccgtgccgcgggggtccaccactgccacttttgctgctgtggtcctgtacgttgagaacgagcgttgggacggcgtacctttcatcctgagatgcgggaaagcactgaacgaacggaaggctgaagttcgactgcagttccacgatgtggctggagacatcttccatcagcagtgcaagaggaacgagctcgtgatccgcgttcagccaaatgaggctgtttacacaaaaatgatgaccaaaaaacccggaatgttcttcaacccggaggaaagcgaactggatctaacctacggaaacagatataaaaacgtgaagctgcctgatgcatacgagagactgatcctagacgtgttctgcggcagtcagatgcacttcgtgagatccgacgagctgcgcgaggcctggcgcatatttaccccactgttgcaccagattgagctggaaaaacctaaaccgataccttatatctacggctccaggggacccactgaagcagatgaactgatgaagcgggtgggcttccagtacgagggaacctataagtgggtaaacccacacaaactgtag

SEQ ID NO: 24305 - DNA, 1638 bp, Artificial Sequence
  Description of Artificial Sequence: Synthetic coding sequence
atgggccggcggggcagcgcccccggcaacggccggaccctgcgggggtgcgaacgtgggggcagaagaagaaggagtgcggacagcgtaatggcagaacaggtcgcactttcccgaactcaggtatgtgggattctgagggaggaactgttccaaggggatgcttttcaccagagcgacacacacattttcattataatgggagcgtctggggacctggcaaagaagaaaatttacccgacaatatggtggctctttagggacggccttctgccagagaatacctttattgtaggctatgctcgcagtcggctcaccgtcgccgacatacgcaagcagtcagaaccgttcttcaaagcaacccccgaggagaagctgaagctcgaggatttcttcgcccggaactcgtatgtagctgggcagtatgatgacgcggcgtcttaccaacggctgaattcgcatatgaacgctctccacctggggtcccaagctaatcggctgttttatctggctttacctcccaccgtctatgaagctgtaaccaagaatatccatgagagctgtatgagccagattggctggaaccggatcatagttgagaaacctttcggtagggatctccagagctccgataggctgtctaaccatatcagctctctgtttagagaagatcagatttatagaatcgatcattacttgggtaaggagatggtccagaacttgatggttctccggtttgcaaatcgcatatttggcccgatttggaaccgcgacaatattgcgtgtgtcatccttaccttcaaggaaccttttggaaccgaaggccgcggcggatatttcgatgagttcggaataatcagggacgtaatgcagaatcacctgttacaaatgttatgcctcgttgccatggagaaaccagcctctaccaatagcgacgacgtccgggacgagaaggtgaaagttctgaaatgtatctcggaagtgcaagccaataacgttgtgttaggacaatacgtgggcaatccagatggtgaaggcgaagcaaccaaggggtatctcgatgatcctaccgtgcccagaggatccaccaccgctacctttgcagccgtcgtgctgtacgttgaaaacgaacggtgggacggggtcccattcattctgagatgcggtaaagccttaaatgagaggaaagccgaggtaagactgcagttccacgatgtcgccggcgatatcttccaccagcaatgcaaaagaaacgaactggttatccgtgtacaaccaaacgaggcagtttataccaaaatgatgacaaagaaacccggcatgttctttaaccccgaggagagtgagttggacttaacatacggcaatcggtacaaaaatgtcaaactccccgacgcctacgaaagactgatactcgatgtgttttgtgggtcccaaatgcacttcgtgcgcagtgacgagctgcgggaggcttggcggatttttactcccctgttacatcagattgaactggaaaagcccaagcctatcccttatatttatggcagcagggggcctacggaggccgacgagcttatgaagcgcgtgggattccagtacgaaggtacttataagtgggttaatccccacaaactctag

SEQ ID NO: 24306 - DNA, 1548 bp, Artificial Sequence
  Description of Artificial Sequence: Synthetic coding sequence
atggccgagcaggtggccctgagccggacccaggtgtgcggcatcctgagggaagagcttttccaaggtgatgccttccatcagtcagatacgcacatatttattattatgggtgcctctggtgacctggcgaaaaagaagatctatcccactatttggtggctgttccgagatggcttactcccagaaaatacgtttattgtcggctatgctaggagtagacttaccgtggctgacatccgaaagcagagtgaaccattttttaaagctactcccgaggagaagttaaagctggaggacttctttgcacggaattcttacgttgccgggcaatatgatgatgccgcttcataccagcgcttgaactctcacatgaatgcgttgcacctgggtagtcaggccaacagactcttctacttggctctgcctcctacagtctatgaagcagttactaagaatattcacgaaagctgtatgagccagattggatggaataggataattgtggaaaagccatttgggcgagacctgcaatccagcgatcgcctatccaatcatattagctccctgttccgggaggaccagatctatagaatcgatcattatcttggaaaagaaatggtccaaaatcttatggtccttcggtttgcaaaccggatcttcggcccaatctggaatagggataacattgcctgcgtaatcctgacctttaaggagcctttcgggactgagggcagagggggatactttgatgagttcgggattattcgcgacgtgatgcagaatcacctgcttcagatgttatgcttggtggccatggaaaaacctgccagtaccaacagcgatgatgtgcgtgacgagaaagttaaggtcctcaagtgcatttcagaagttcaagccaataacgtggtgctggggcagtacgttggaaacccagatggcgaaggcgaagccacaaagggctacctggacgacccaacagtacctcgaggtagcacaaccgcaaccttcgccgcagtggtcctgtatgtggaaaacgagcggtgggatggcgtcccattcatcctgcgttgtggaaaggccttaaatgagagaaaggcagaggtcaggctccagttccatgacgttgctggagatatatttcaccaacaatgtaaacgaaacgaactggttatcagagtacaacctaatgaggccgtatatacaaagatgatgacgaagaaacctggtatgttcttcaacccagaggagtctgagctggacctaacctatggtaacaggtacaagaacgtgaaattgccagatgcctatgaaagattgatcctggatgtattctgtggtagtcagatgcactttgtgcggtctgacgagctaagagaggcctggcgcatttttacccccctacttcatcagatcgagttagagaagcccaagcctatcccttacatctatgggagccggggccctacggaagctgacgagctcatgaagcgtgtggggtttcagtatgagggcacgtacaagtgggtcaatccccacaagctttag

SEQ ID NO: 24307 - DNA, 771 bp, Artificial Sequence
  Description of Artificial Sequence: Synthetic coding sequence
atggccgagcaggtggccctgagccggacccaggtgtgcggcatcctccgggaggagctttttcaaggcgatgcctttcatcagagcgatacacatatttttattatcatgggggcttcaggggatctcgcgaagaagaagatctatccgacgatttggtggctgttccgggatggtttgctccccgagaatacgttcattgtgggttatgctagaagtcgtttaacagtggccgatataaggaaacaaagcgaaccctttttcaaggcaactccggaagagaaactgaaactggaggactttttcgcccggaattcctacgtggccggacagtacgacgatgcagcgtcataccaaaggctgaattcccatatgaatgcccttcacctggggtcccaggccaatcgacttttttatttggcgctgcctcccactgtgtacgaggccgtgactaagaatatacacgagtcttgtatgagccagattggatggaaccgaattattgttgagaaaccctttggacgggatctccagagctcggatcgtcttagcaatcatatcagttcactcttccgagaggaccaaatttatcgcatcgaccactaccttggcaaggagatggtacagaacttaatggtacttaggttcgctaatcggatattcggaccgatatggaatagggacaacatcgcttgcgtaatcttaaccttcaaagaacccttcgggactgaaggccgcggcgggtactttgatgaattcgggattatctag

SEQ ID NO: 24308 - DNA, 681 bp, Artificial Sequence
  Description of Artificial Sequence: Synthetic coding sequence
atggcccggctgctgcaggccagctgcctgctgagcctgctgctggccgggtttgtgagccagagcagaggtcaagagaaaagcaagatggattgtcatggcgggatctctggcaccatttatgagtacggcgccctgaccatcgacggggaggaatatattcctttcaaacagtacgctggaaaatacgtgctgtttgtgaatgtggccagctacugaggactcacgggacagtatatcgaattgaatgctctgcaagaagaactggcaccattcggtctcgtgatccttggctttccttgcaatcaatttggaaagcaggagcctggggaaaattcagaaatcctcccaaccctaaaatatgtccgccctggggggggatttgtgccaaatttccagctgttcgagaagggagatgtgaatggcgagaaagagcagaagttctatactttcctgaaaaactcatgtcccccaacctctgagctgctgggcacctcagaccgattattttgggagcctatgaaggtgcacgatatcaggtggaatttcgagaagttcctcgtgggtcccgatggcattcccattatgagatggcatcacagaaccactgtgtcaaacgtcaaaatggacattctgtcctatatgaggcgccaggccgcactcggtgtaaagcggaaatag

SEQ ID NO: 24309 - DNA, 219 bp, Artificial Sequence
  Description of Artificial Sequence: Synthetic coding sequence
atggcccggctgctgcaggccagctgcctgctgagcctgctgctggcgggctttgtatctcagtcccggggacaggaaaagtcaaagatggattgccatgggggcatttcaggaacgatctatgagtacggcgcactgacgatcgacggagaggaatatatcccttttaaacagtacgctggaaaatacgtgctgttcgtgaatgtggccagctactag

SEQ ID NO: 24310 - DNA, 633 bp, Artificial Sequence
  Description of Artificial Sequence: Synthetic coding sequence
atgcccccctacaccgtggtgtacttccccgtgcggggccggtgcgcagccctgcggatgttactggcagaccagggtcagagctggaaagaggaagttgtgaccgttgagacttggcaggaaggatctctgaaggcctcctgtctgtacggccagttgcctaaatttcaggacggagatctcaccctgtaccaatccaataccatcttaaggcatctcggcagaacactgggtctctatgggaaggaccaacaagaagcggccctggtggatatggtcaacgatggcgtggaggacctccgctgcaagtacatcagcctgatctacaccaactacgaggccggtaaagatgactatgttaaggccttacctggacagctcaagccattcgaaactctgctgagtcagaaccaagggggcaaaacattcattgtgggagaccaaatttccttcgctgattacaatctgctggatttgctgctaattcatgaggtgctcgccccaggttgcctcgatgccttcccactgttgtccgcctatgtgggcagactatccgcgcgccccaaactgaaagctttcctggcctcaccagagtatgttaatttgcctattaacggaaatggaaaacagtag

SEQ ID NO: 24311 - DNA, 2184 bp, Artificial Sequence
  Description of Artificial Sequence: Synthetic coding sequence
atggccttccagaaggccgtgaagggcaccatcctggtgggcggcggagccctggcgaccgtgctggggctcagtcagttcgcccactatcgtcggaaacaaatgaaccttgcatatgtgaaagctgctgactgtatcagtgaacccgttaatagggagcctccctctagagaggcccagctcttaactttacagaacacctctgagtttgatattctggtcatcggaggcggcgccacaggtagtgggtgcgccctggatgcagtaacacggggtctcaaaacagctcttgtggagcgagacgacttctcgagtggaaccagctccagatccactaagcttatccacggtggcgtgaggtatttgcaaaaagcaattatgaagctggatattgaacaataccgaatggtgaaggaggccttacacgagagggctaacctgctcgagatcgctccacacttgtcagctcctttgccaattatgttacctgtgtacaagtggtggcagctgccgtattactgggtgggtatcaagttgtatgatttagtggcaggtagtaactgcctaaaaagctcatacgtgctgtctaagtcgcgggctctagagcactttcccatgctgcagaaggataagctagtgggagccatcgtttattatgatggccagcataacgacgcaaggatgaatttggcgatagctctgacagcagcacggtacggtgccgctactgcgaactacatggaggtcgtgtcactgctcaagaagaccgatccccaaactggtaaggttcgcgttagcggggctagatgtaaagatgtgctgaccggccaggaattcgacgtgagagcaaagtgtgttataaacgctacgggcccttttaccgactctgtacgtaaaatggacgataaggacgctgcagcaatttgtcagccatctgccggcgttcacatcgttatgccagggtactattctccagaaagtatgggtctgttagatcctgcaacgtctgatggccgggttatcttttttctaccatggcagaaaatgacgatagccggaaccacggacaccccaaccgacgtgacacaccacccaatcccgtctgaagaggacatcaattttattctgaatgaggttcgaaattatctgtcgtgcgatgtcgaagtcagaaggggcgatgtacttgccgcatggagcggcattaggcctctggtgaccgaccctaaatccgccgacacccagtccataagccggaaccacgttgttgacataagcgagagtggcctaataacaatagcaggaggcaagtggaccacctacagatcaatggccgaagatactatcaatgctgcagtgaagacccataacctgaaagccggcccttcgcggaccgtggggctcttcctgcaaggcggcaaggactggtcccccactctgtatattcgcctggtgcaggactatggcctcgagagcgaagtagctcagcatcttgctgcaacctacggagacaaggcttttgaagtcgccaaaatggcgagtgtgaccggaaaaaggtggccaattgtaggagtgcgcctggtgtccgaattcccatatatcgaagcagaggttaagtacggcatcaaagagtacgcctgtaccgctgtggatatgatatcacgtcgaacacgactggctttcctgaatgtccaggccgccgaagaggccctgcctcgcattgtcgaactgatggggcgagagctcaactgggacgattataagaaacaggagcagctggaaaccgctcgcaagttcctctattacgagatggggtacaaaagccgctccgagcagttgacagacagatccgagatatccctgctgccctctgatatcgatcggtacaaaaagcggttccataaatttgatgcagaccagaaaggcttcattaccattgtagacgttcagagggttcttgagagtatcaatgtgcagatggatgaaaatacattacatgagatcctaaacgaggtggacctcaacaaaaacggccaggttgagcttaatgagtttctgcaactcatgtcagctatccagaagggccgtgtgtccggttcaaggctggcaatcctaatgaagactgcagaagagaaccttgatagacgagtccctatacccgtcgaccggagctgcggcggcctgtag

SEQ ID NO: 24312 - DNA, 1503 bp, Artificial Sequence
  Description of Artificial Sequence: Synthetic coding sequence
atgaacctggccatcgccctgaccgccgcccggtacggcgccgccacagcaaactatatggaagtggtgagtttgttaaaaaagacggatcctcagacagggaaggttagggtgtctggtgcccgatgtaaagacgttctaacgggtcaggagttcgatgtgcgcgcaaagtgtgtcatcaatgctacaggcccatttacagacagcgtgcgaaagatggacgacaaggatgcggctgccatctgtcaaccctccgccggcgtgcatattgtaatgcccggatattactcccccgaatctatgggcctcttggacccagccacatccgatggcagagtgatttttttcctgccatggcagaagatgacgatcgcaggcaccaccgacactcccaccgatgtcactcatcatcccatacccagcgaggaagacataaatttcattctgaacgaggtgaggaactacctgtcttgcgatgtggaggtgagacgaggggatgtccttgcggcttggtccggaataagacccctggtgactgaccccaaatctgccgacacacagagtatttcccggaatcatgtggtagacatttcagagtctggcctgatcacaatcgccggggggaaatggactacctaccgctctatggcagaggacacaatcaatgccgctgtgaagacacataatcttaaggcagggccgtcacggacagtgggcttattcttgcagggcggtaaagattggtctcccacactctacattcgattagtgcaagattacgggctggaatcggaggtggcacagcatttagccgcgacctacggcgataaagctttcgaggtggccaagatggcatccgtcactgggaagagatggcccattgtaggagtgcggcttgtgtctgagtttccctatattgaggcagaggtaaaatacgggataaaagagtatgcctgcacagctgtcgacatgatttcaaggcggaccagattagcctttctgaacgtccaggctgcggaagaagccctcccccgtatcgtagaactgatgggaagggagctcaactgggatgactacaagaaacaagagcagctagagactgccaggaagttcctgtattacgagatgggctacaagagccgctctgagcagctcactgaccgtagcgaaatttctcttctccctagcgatatcgatcgatacaagaagagatttcataagttcgatgctgaccagaaggggttcatcaccatagtggacgtccagcgggtgcttgagagtatcaacgttcagatggacgaaaacaccctgcacgagatactaaacgaggtggacctcaacaagaacggccaagtcgaactgaatgaatttctccaactcatgtcagccatacagaaggggagagtaagcgggtcacggctggccattctaatgaaaactgcagaggaaaaccttgatcggagagtgcccattccagttgatcgcagctgcgggggcttatag

SEQ ID NO: 24313 - DNA, 2184 bp, Artificial Sequence
  Description of Artificial Sequence: Synthetic coding sequence
atggccttccagaaggccgtgaagggcaccatcctggtgggcggcggcgcgcttgctacagtgcttggattgtctcagttcgctcactaccggcgtaagcaaatgaatcttgcatacgtgaaagccgctgactgtatttccgagcctgtgaatagagaaccaccttctcgggaagcgcagctccttaccctccaaaatacgtctgaattcgacatacttgtgattggcgggggtgccaccggctccggatgcgccttagatgccgtcacccggggcctgaaaacagccctggttgagagggatgatttcagctccgggacctcaagccgttctactaagctcatacacggaggcgtgcgctacctccaaaaagccattatgaagctggacattgagcagtaccgaatggtgaaggaggcgctccacgaacgggcaaatctgctggaaatcgcccctcatctctcagcaccgttaccgataatgctgcctgtctacaaatggtggcagttgccttactattgggttggcattaaactatacgaccttgtggccggaagcaactgcttaaagtcatcatatgttctgagtaaaagtagagccttagaacacttccccatgctacagaaagacaaacttgtcggggcgatcgtttattacgacggtcagcataacgatgccaggatgaacttggctatcgcgttaactgcagccaggtacggcgctgctacagccaattatatggaagtagttagtctcctgaaaaagacggaccctcagaccggaaaagtgagagtgtcgggggccagatgtaaagacgtgctcactggccaagagttcgatgtcagggcaaaatgtgtgatcaatgcgactgggccctttaccgattccgtgcggaagatggacgacaaagatgccgccgcgatttgccaacccagcgcaggagtgcacatcgttatgccaggctattattccccagaatccatgggcctgttagaccccgcaacttctgatggaagagtgatattcttcctaccatggcaaaagatgactatagctgggactacggatactcccaccgacgtgactcaccatccaataccgtccgaggaggatattaattttattcttaatgaggtgagaaactatctttcctgcgacgtggaagtgcgtcggggagacgtgttggctgcctggtctggtattaggcctctggtgaccgaccctaagtcggcagatacacaatctattagtagaaaccacgtcgtggacatttcagagtctggtctcatcactattgcagggggaaagtggacgacatacaggtcaatggctgaggatactattaatgctgcagtgaagactcataacctcaaggcaggcccatcccggaccgttggactgtttttacagggcgggaaagattggtccccgacgctttatatccgactcgtacaagattatggcttggaatccgaggtcgcacagcacctggcagctacgtacggcgacaaggctttcgaggtggcaaagatggcctcagtcactggcaaacgctggccaatcgtgggtgttagattagtcagtgaattcccatacatcgaggcagaggtcaaatacggaataaaagagtacgcatgtacagcggtggatatgatcagccggagaacccggttggcttttctcaacgtccaggcagccgaagaggcactccccaggatcgtggagctgatgggaagggagttaaattgggacgattataaaaaacaggagcagctggaaactgccaggaaatttttatactacgagatgggctataaaagccgaagcgagcagttgacggatcgttcggagattagcttgcttccatcggacatcgaccgctataagaagcgatttcataagttcgatgccgatcagaagggttttattacaattgtggacgtccagcgagtcctggaaagcatcaatgtgcagatggacgaaaataccttgcacgagatactgaacgaggtcgacctcaataagaacgggcaggtagagctcaacgagtttctgcaattaatgagtgctatccagaagggtagggtttctggcagccgcctcgcgatacttatgaagaccgccgaagagaacctagaccggagagtgccaatacctgtcgatcggtcatgcggtggtctctag

SEQ ID NO: 24314 - DNA, 2184 bp, Artificial Sequence
  Description of Artificial Sequence: Synthetic coding sequence
atggccttccagaaggccgtgaagggcaccatcctggtgggcggcggggctttagctactgtgttgggtcttagccagtttgcgcactacaggagaaaacaaatgaatcttgcctatgtcaaggcagccgactgcatttccgaacccgtgaaccgcgagcctcccagtcgcgaagcccaactgctcactttacaaaatacgtctgaatttgatatcctggtaatcgggggcggagctactggttccggatgcgcactggatgccgtgacaagaggccttaagacagcactggtcgaacgagatgatttctccagtggcacgtcaagccggagcacaaagctgatacatggtggcgtcaggtacttgcaaaaggccatcatgaagctggacattgagcagtaccgaatggttaaagaggccctccatgagcgggcaaacctgctggaaatagcccctcatctgagcgctcccttgccaatcatgctgcccgtttacaagtggtggcagctgccatactactgggtgggaattaagttatacgatctcgtggcaggatctaactgcctcaaaagcagctacgtgctgtccaagtctagggctttagaacacttcccaatgctgcaaaaggacaaactcgtgggtgccattgtctactacgacggacaacataatgacgcccgcatgaatctggccatagccctgaccgcagctcgatacggtgctgcgacagccaattacatggaagtcgtgagtctgttaaaaaaaaccgaccctcagaccggaaaggtacgggtctccggcgctaggtgtaaggacgtgctcaccggacaggagtttgatgtgcgcgccaaatgcgtgataaacgctaccggcccctttactgattccgtgcggaagatggatgacaaagacgctgccgcaatctgccaaccttcagctggagttcatattgtgatgcccggctactactcacccgagagcatggggctgttggacccggccacatcagatggccgggtaatatttttccttccatggcagaagatgacgattgccggtaccacagatacacccacagacgtgacgcaccaccccataccttctgaagaagacattaatttcatcttgaatgaggtacggaattatctttcctgcgacgtcgaggtccggagaggtgatgtcctcgctgcctggtccggaattcgccctctggtgacagatcccaaatcagccgacacccaaagcattagtagaaaccatgtcgtcgatatcagtgagagcggcttaattaccattgctggcggtaagtggacgacataccgttcgatggccgaagatacaataaatgccgctgtgaaaacacacaacttgaaggccggaccctccagaacagtcggcctgttcctgcaaggcggcaaggactggtctcctacgctctacattagacttgttcaggattatggattggaaagtgaagtggctcagcacctggcggccacttacggtgacaaggccttcgaagttgctaagatggccagcgtgacaggaaagcgctggcccatagtaggcgtgagattagtttcagagttcccctacatcgaggcggaggtgaaatatgggataaaggaatacgcatgcaccgcagtggatatgatctctaggaggacaaggctggccttcctcaacgtacaggcggccgaagaagccttgccaaggatagttgaactcatgggccgcgagttgaactgggatgactacaaaaaacaggagcaattagaaactgcccgcaaatttttgtattatgaaatggggtataaatctcgcagcgaacaactgacggaccgcagcgaaataagtcttctgccatccgacatagaccgatacaaaaagaggtttcacaaattcgacgctgaccagaaagggttcattaccattgtcgatgtgcaaagggttttggagagtataaacgtccagatggacgagaatactctgcacgagatacttaacgaggtggacctgaacaagaacgggcaggtggaattgaatgaattcctgcagctcatgtccgctatccagaaggggcgtgtctctggctcaagactggccatcctgatgaaaacagctgaagagaatctggacagaagggtgcctattcccgtggatcggagttgtggaggcctgtag

SEQ ID NO: 24315 - DNA, 330 bp, Artificial Sequence
  Description of Artificial Sequence: Synthetic coding sequence
atggccttccagaaggccgtgaagggcaccatcctggtgggcggcggtgccttagctaccgttcttggcctttcacagttcgctcactataggcgcaagcagatgaacctagcgtatgtcaaagctgctgattgcatcagcgaaccggtaaaccgggaacctccaagtcgcgaagcccaactgctgactctccagaatacctctgagttcgacatccttgttattgggggcggcgctaccggatcgggatgtgccctcgacgctgtcactagaggattgaagactgccctcgtagagagggatgacttctcctccggaacttccagctag

SEQ ID NO: 24316 - DNA, 2184 bp, Artificial Sequence
  Description of Artificial Sequence: Synthetic coding sequence
atggccttccagaaggccgtgaagggcaccatcctggtgggcggcggagcattggcaacagtccttggtttgtcccaattcgcccactatcgccgtaaacagatgaatctcgcttacgtgaaggccgctgactgtatcagcgagcctgtaaaccgtgagcctccatctcgagaggcgcagctcctgacattgcagaacactagcgagtttgacatcttggtgatcggcggaggggccacaggaagcgggtgcgctctggatgcagttacccgtggcctgaaaactgcactggtggaacgggacgatttttcaagtgggacgagctcccgctccactaaacttatccacggaggggtgcgatatctgcagaaggcgataatgaaactggacatagagcaatatcgcatggtaaaggaggctctgcacgagcgtgcaaacttgctggagatcgccccacacttatctgcccccctgcctatcatgctgcccgtttacaaatggtggcagctgccttactactgggtgggaataaaattgtatgacctggtagctggaagtaattgtctgaaatcgtcttacgttctgtcgaaatcccgggccctggagcacttccccatgcttcaaaaagataagcttgttggtgccatcgtatactacgacggtcagcataatgatgcccggatgaacctcgccatcgcactgaccgctgcccgctacggagctgccacagcaaattacatggaagtagtgtccctactgaaaaaaaccgacccccagaccggaaaagtacgagtcagtggagctcgatgtaaagatgtgctaactggccaggaattcgatgtgcgcgccaaatgcgtgataaacgccaccggtcccttcaccgatagtgtacgaaagatggacgataaagacgccgcagctatctgccagccctccgctggggtccacattgtgatgccagggtattacagcccggagtcaatggggctactcgatcccgccacaagtgacggcagggtgatttttttcctgccatggcagaagatgaccatcgccgggactacggacacgcccactgatgtgacgcaccacccaatccccagcgaagaagatataaactttatactgaatgaggtcaggaattacctgtcctgtgatgttgaagttaggagaggcgacgtgctcgccgcttggtccggaatcagaccgttggtgactgacccaaaaagcgccgacacccagtcgatcagccgcaaccacgtcgttgacatatccgagtcagggctgatcacaatagcaggaggtaagtggacaacataccgttctatggcagaggacaccataaatgccgccgtgaaaactcataatttaaaagctgggccttctcgcactgtcggactttttctgcagggcggcaaggactggtctcctaccctgtacattcgtctcgtccaggactatggattggagagtgaggtggcccagcatttggcagctacttacggagacaaagcctttgaggttgctaaaatggctagtgtgaccggcaagagatggccgattgtgggtgtgcgcttagtaagcgagttcccctacattgaggctgaggttaaatacggaattaaagaatacgcctgcacagctgtcgatatgatttccaggagaacccgcctggcgttcctgaacgtgcaagccgcagaggaggcattacctcggattgtggagctcatgggaagagaattaaattgggatgactataaaaagcaagagcagctcgaaacggccagaaagtttttgtattatgagatgggctataagagtcgatccgagcagctgaccgataggtcagagatctcactccttccctccgatattgaccgatataaaaagcggttccacaagttcgatgcggaccagaagggatttatcacgattgttgatgtgcagcgtgttcttgagagcattaacgttcagatggatgagaatactttacatgaaatcctgaacgaggtggacctaaataagaacggccaagtagaacttaatgagttcctgcaacttatgtccgcaattcagaagggcagggtgagtggtagtcggctagcaatcctgatgaagacggcagaggaaaatcttgaccgtagggtaccaattccagttgaccggtcctgcggagggctgtag

SEQ ID NO: 24317 - DNA, 1140 bp, Artificial Sequence
  Description of Artificial Sequence: Synthetic coding sequence
atggccttccagaaggccgtgaagggcaccatcctggtgggcggcggtgctctcgctaccgtgctgggcctttcacagtttgcccactacaggagaaagcagatgaaccttgcctatgtgaaggcagccgactgcatctccgaaccagtgaacagggaaccccctagcagagaagcacagctgctcacacttcaaaatacatctgaatttgacattctggtgatcggcgggggagctacaggcagcggctgtgccctggacgccgtgactagaggcctgaaaactgccctagtcgagagagacgactttagctcagggacctcctctcggtctactaaattaattcacggcggcgttcgctacctgcaaaaggctatcatgaaacttgacatcgagcagtataggatggtgaaagaggcattgcatgaacgggccaatttgttagagattgctccgcatctgtctgcgccactgcctatcatgctgcctgtgtataagtggtggcagcttccctactattgggttggcatcaaactctatgacctggtcgcaggctccaattgtttgaaaagctcctacgttttgtccaagagcagggctctggagcactttccaatgctgcaaaaagataaactagttggggctatcgtctattacgatggccagcacaacgatgctcgaatgaacctggccatcgccctgaccgcagctaggtatggagcagccacagcgaattacatggaagtagtgtccctgctcaagaaaaccgacccacaaactgggaaagtgagggtgtctggcgccagatgtaaggacgtgctcacggggcaagagttcgatgtacgggcgaagtgtgtaataaacgcgaccggaccctttaccgattccgttagaaaaatggatgataaggacgcagcggcaatttgtcagcccagtgcgggagtgcacatcgtgatgccggggtattactcgccagagagcatgggcttactcgatccagccacttccgacggtcgggtcatattctttcttccatggcaaaaaatgacaattgccggcaccacagatacaccaactgacgtcacccaccacccaataccgagcgaagaggatataaattttattcttaatgaagtgtag

SEQ ID NO: 24318 - DNA, 1263 bp, Artificial Sequence
  Description of Artificial Sequence: Synthetic coding sequence
atgagcggccggccccggaccaccagcttcgccgagagctgcaagcccgtgcagcagcctagcgctttcggaagcatgaaagtgagtcgcgacaaagacgggagtaaggtgaccactgttgtggctaccccgggccagggaccagaccggccccaggaagtctcctatactgacacaaaggttatagggaacggcagcttcggggtagtgtatcaggccaagttatgtgacagcggtgagctggtcgcaataaaaaaggtgctgcaagacaaaagattcaaaaatcgagagctgcagatcatgcggaaattggatcattgcaacatagttaggctccggtacttcttttattcttctggagagaaaaaggacgaggtttatttaaacctagtgctggattatgtcccagagactgtgtacagagtggcgcgacactactcccgggcaaaacagaccctgcctgtgatctacgtcaaactctacatgtatcagcttttcaggtcccttgcatatatccactcttttggcatatgtcacagggacataaagccccagaacctgctactggacccagacacagccgtgctgaagctgtgcgatttcggtagtgctaaacagctggtgagaggcgaacctaacgtcagctatatctgttcgagatattacagggcgcccgagctaatcttcggagccactgactataccagctcaattgatgtctggtcagccgggtgcgtcctggctgagttgctgctaggccagccaattttccccggtgattcaggagtcgaccagctggtggaaattattaaggttctcggcacacccacgcgagaacagatccgggagatgaatcccaactatacagagttcaagttcccccagattaaggcccacccttggacgaaggttttccgtccacgaacccctccagaggcaatagcgttgtgctccagacttcttgagtataccccaactgccaggttaactcctctcgaggcctgcgctcactctttcttcgatgaactgagggacccaaacgtgaaactgccaaacggaagagacacaccagcccttttcaacttcactacccaggagctctcaagtaacccaccacttgcaacaattctaatacctccccacgccaggatacaggccgctgccagcacccctactaatgccacagcagcctccgatgctaacactggagatcggggccaaacgaataacgctgcatctgcctccgccagcaattctacctag

SEQ ID NO: 24319 - DNA, 1302 bp, Artificial Sequence
  Description of Artificial Sequence: Synthetic coding sequence
atgagcggccggccccggaccaccagcttcgccgagagctgcaagcccgtgcaacagccgagtgcatttgggagcatgaaggtgagtagggataaagatggcagcaaggtgaccactgtggttgcaacgcccggtcaggggccggaccggccacaggaagtgagctatactgacacaaaggtaatcggcaacgggtcttttggcgtcgtgtatcaggccaaactttgtgattccggggaactggtggctattaagaaggtcctgcaagataagcgtttcaagaatagggagcttcagatcatgaggaaactggatcattgtaacatcgtgcgcctacgatattttttctactcaagcggggaaaagaaggacgaggtctacttaaatttagtgctcgattacgtacctgaaaccgtctaccgtgtggccaggcactactcgcgggctaagcagaccctgcccgttatctacgtcaaattatacatgtaccagctgttccgctctctggcatatatccactcattcggtatttgtcatcgagatattaaaccacagaatttgctccttgatccggacaccgcggttctgaagctgtgcgatttcggctccgctaagcagttggtcaggggcgaacccaatgtgagctacatttgctcccgttattacagggctccagaactcatctttggtgctacggattatacctcttctatcgacgtgtggtctgccggctgcgtgctggccgaactcctcctgggccagcctatcttccctggcgacagcggagttgatcaattggtggaaatcattaaggttctggggacaccaactcgcgagcaaataagagagatgaaccccaactatactgagttcaaattcccccagatcaaggcacacccatggacaaaagatagtagcggcacgggacacttcacctcaggcgttcgggtgttccgcccgagaacaccaccggaagctatcgcactttgcagcagactactggaatacacgcccactgcaagactgactcccctggaagcctgtgctcactcattttttgacgaactgagggaccctaatgtcaaactgccaaatggccgagatacgccagccctgttcaacttcacaactcaggagctcagctctaatccacccctggctactatcctaattccaccccacgcacgaattcaggccgctgcttctaccccaactaatgccaccgccgcaagcgacgccaatactggggacaggggccaaactaataatgccgcctccgcctcagcttctaattccacatag

SEQ ID NO: 24320 - DNA, 315 bp, Artificial Sequence
  Description of Artificial Sequence: Synthetic coding sequence
atgaaccccaactacaccgagttcaagttcccccagatcaaggcccatccgtggacaaaggtctttcgacctcgaacacctccagaggccatcgccctctgtagcaggctgctcgagtacacgcccaccgctagactgacacctcttgaagcctgcgcccactcattcttcgatgaactgagagatcccaatgtcaagctgcccaacggtcgcgacacacctgccctcttcaatttcacaactcaggatgccaataccggagacagaggccagactaacaacgctgcgtctgccagcgcatcaaatagcacttag

SEQ ID NO: 24321 - DNA, 837 bp, Artificial Sequence
  Description of Artificial Sequence: Synthetic coding sequence
atggaggagaacatggaggagggccagacccagaagggctgcttcgagtgctgtatcaaatgccttggaggaattccatacgcttcgctgattgccaccatcctgctgtacgctggcgtggcgctgttctgcggatgcgggcatgaagccctgagcggaaccgttaatatacttcagacgtacttcgagatggccaggaccgccggcgacaccttggacgtgtttactatgatcgacatattcaaatacgtcatctacggaatcgcggctgctttctttgtgtacgggattctcttaatggtggaagggttttttaccacgggcgctattaaggatctgtacggcgatttcaaaatcaccacttgcggacgctgtgtgagcgcatggttcatcatgctgacctacctgttcatgctcgcctggctcggcgtaactgcattcacttctttacccgtatatatgtacttcaacctgtggactatttgccgaaacacgactctggtcgagggcgcaaatttgtgcctcgatctaaggcagttcgggattgtaacgattggtgaggaaaagaagatttgcacagtttcagaaaactttttaaggatgtgcgagagcactgagctcaacatgacctttcatctcttcatcgttgcgttggcgggagctggagcggcagttatcgcgatggtacactatcttatggttctgtcagctaactgggcttacgtgaaggatgcctgtaggatgcagaagtacgaagacattaagagcaaggaagaacaggagctccatgatatacacagtacacgcagcaaggaacgtttaaacgcatatacctag

SEQ ID NO: 24322 - DNA, 837 bp, Artificial Sequence
  Description of Artificial Sequence: Synthetic coding sequence
atggaggagaacatggaggagggccagacccagaagggctgcttcgaatgttgtattaaatgtctcggcggcataccttacgccagcttgatcgctactattctgttgtacgccggcgtggcgctattctgcggatgcggccacgaagctctttccggaacagtgaatatcctacagacatatttcgaaatggcaagaactgctggagacactctggacgtcttcacaatgatcgatatttttaagtacgtcatatacggaatcgctgcggcttttttcgtgtacgggatattattgatggtggagggcttctttaccaccggtgccatcaaggatctctacggggacttcaagattaccacctgcggccggtgcgtctccgcctggttcatcatgctaacctacctttttatgctggcttggctaggtgtaaccgctttcacgtctctaccggtgtacatgtatttcaatttatggactatctgtcgtaatacgaccttggtagaaggggcaaatctctgcctggatttgcgtcaatttggtattgtgacaatcggcgaagagaagaagatctgcaccgtatcggagaacttcctccgcatgtgcgagagcacagaactgaatatgaccttccatctatttatagtggccctggcaggggccggcgcagccgtgatcgccatggttcactacctgatggtactatccgctaactgggcctatgtcaaggatgcttgtaggatgcagaaatatgaggacatcaagagtaaggaagagcaggagttgcatgacatccactcaactagatccaaggagcgcttaaacgcgtacacatag

SEQ ID NO: 24323 - DNA, 33 bp, Artificial Sequence; identical to SEQ ID NO: 10859
  Description of Artificial Sequence: Synthetic coding sequence

SEQ ID NO: 24324 - DNA, 804 bp, Artificial Sequence
  Description of Artificial Sequence: Synthetic coding sequence
atgggctgcttcgagtgctgcatcaagtgcctgggcggcatcccctacgcatcgctgattgcgaccatcttgctctacgccggggtggctctgttctgcggctgcgggcacgaggccctgtctggtacggtcaatatcctgcaaacctatttcgaaatggcgcgcacagccggcgatacattagatgtgttcaccatgattgatatctttaagtacgtgatctatggcatcgccgccgcttttttcgtttacggtattctgttaatggtcgagggatttttcaccaccggggcaataaaagacctgtatggtgattttaaaatcacaacgtgcggtaggtgcgtcagcgcttggttcataatgctgacatacctgttcatgcttgcctggctgggagtaacggccttcacgagcctgccagtatatatgtactttaacctgtggacaatctgccgcaatacgactcttgtggaaggggcaaacctatgcctcgacctccgccagttcgggatcgtcaccatcggcgaggaaaaaaaaatctgcaccgtgagcgagaatttcctgcgaatgtgtgaatctaccgaactgaatatgacctttcacctctttatcgtggccctggcaggcgccggcgctgctgtgatcgccatggtgcattacttgatggtgctctcagcaaattgggcgtacgtcaaggacgcatgtagaatgcagaagtatgaggatatcaaatccaaagaagagcaggaattgcacgacatccactccactagaagtaaagaaaggctgaacgcctacacttag

SEQ ID NO: 24325 - DNA, 390 bp, Artificial Sequence
  Description of Artificial Sequence: Synthetic coding sequence
atggaggagaacatggaggagggccagacccagaagggctgcttcgagtgctgcatcaagtgcctgggcggaattccctatgcctccttaattgccaccatccttttatatgccggagtagcgcttttttgcgggtgcggtcacgaggcgctgtccggtactgtgaatatcctgcagacttacttcgaaatggccaggacagcaggcgacactctggacgtctttaccatgattgatatctttaagtatgtcatttatggtattgcagcagccttttttgtctacggcattctgcttatggtggagggcttcttcacaactggggctattaaggatttgtatggcgattttaagatcactacttgtggtaggtgcgtgtctgcttggtag

SEQ ID NO: 24326 - DNA, 816 bp, Artificial Sequence
  Description of Artificial Sequence: Synthetic coding sequence
atgaccgacctggagggctgcttcgagtgctgcatcaagtgcctgggggggatcccctacgcctctctgattgccaccatccttctatatgcaggagtagcacttttttgcggctgtggacacgaagccctaagtggtaccgtgaacattctgcaaacctacttcgagatggcgcgaactgctggagataccttggacgtgttcactatgatagatattttcaagtatgtcatctatgggatcgctgccgcttttttcgtgtacggaatcctcttaatggttgaaggattttttaccacaggtgcaataaaggacttatatggagatttcaagatcaccacgtgcggcaggtgcgttagtgcctggttcatcatgctaacatatctgttcatgttggcctggctgggggttacggcatttaccagccttccggtgtacatgtatttcaatctgtggactatctgtaggaataccacactggtggaaggtgctaacctctgcttagatctgaggcagtttggaattgtcacaattggggaggaaaagaaaatttgcaccgtgagcgagaattttctgaggatgtgtgagtccactgaactcaacatgacatttcacctctttattgtggcgctggccggcgcaggggctgccgtgatcgccatggtacactatcttatggtgttgagtgctaattgggcctacgtcaaggatgcctgcagaatgcaaaaatatgaagacataaagtcaaaggaagagcaggagctccatgacatccactccacacgatctaaggagagactgaatgcttacacctag

SEQ ID NO: 24327 - DNA, 1206 bp, Artificial Sequence
  Description of Artificial Sequence: Synthetic coding sequence
atgatgggcctgggcaacggccggcggagcatgaagagcccccccctggtgcttgctgcacttgtcgcctgtataatcgtgttaggatttaactattggatagccagctccagaagcgtagatctgcagacgagaattatggagctcgaagggcgggtgcgacgggccgcagctgaaagaggcgccgttgagctgaagaagaatgagttccagggcgaactggagaaacagcgagaacagctcgacaagatccagtccagccacaacttccagcttgaaagcgtgaataagttataccaggacgagaaagcggtacttgtgaacaacatcacgaccggcgagcgactcattagggttctgcaggaccagctgaaaacactccagcggaattacggcagacttcagcaggacgtgctgcagtttcaaaaaaatcagactaatcttgaacggaaattttcctatgatctgtcccagtgcattaatcaaatgaaggaggtgaaagagcaatgtgaagagcggattgaagaggtgacgaagaagggcaacgaggcagttgcctctcgcgacctgagtgaaaacaacgaccagcggcagcagctacaggccctcagtgagcctcagcccaggctgcaagcggcaggactgccgcacactgaagttccccagggcaaggggaacgtgttagggaactccaaaagtcagacaccagctcccagctcagaggtagtgctcgacagcaaaagacaggtggaaaaagaggagaccaatgagatacaggtcgtcaacgaggagcctcaacgagatcggctgcctcaagagccaggaagggagcaggtcgtggaagacaggccagtgggaggtcgggggtttggcggtgctggggaacttggccagacgccccaggtgcaggccgcactgagcgtgtctcaggaaaacccagaaatggaggggcctgaacgtgatcaactggtcatcccagacgggcaggaggaggagcaggaggcagccggcgagggccgaaatcagcagaagcttagaggcgaagatgactacaacatggatgagaatgaggccgagagcgaaaccgacaagcaagcagccctggcaggaaacgataggaacattgatgtgttcaatgtggaggaccagaagcgtgacaccatcaacctcctggatcaacgagaaaagaggaaccatacactgtag

SEQ ID NO: 24328 - DNA, 1206 bp, Artificial Sequence
  Description of Artificial Sequence: Synthetic coding sequence
atgatgggcctgggcaacggccggcggagcatgaagagcccccccctcgtgctcgcagcactagtggcctgcataattgtactgggcttcaactactggattgcgtcctcaaggtccgtggacttacaaacccgcataatggagttggaaggacgagttagaagagctgccgctgaacgcggggcagttgagctgaaaaagaacgaattccagggggaacttgaaaagcagagggaacagttggacaaaattcagtccagccacaacttccaactggagagtgtcaataagctgtaccaggatgagaaggccgtactcgtaaataacatcacgaccggcgagcgcctgatacgggtactccaagaccagttgaaaacgctgcagagaaactatgggcgcctgcagcaagatgtgctgcaatttcagaagaaccagaccaacctggaacgaaagttttcttatgacctaagccagtgcatcaaccagatgaaagaagtgaaagagcaatgtgaagaacggatcgaggaggtgacgaagaagggcaatgaggcagttgcttcacgtgacctgagtgaaaataacgatcagcgccagcaactgcaggccctgtctgaaccccagcctcgactgcaggcagccgggctaccacataccgaggtaccgcagggaaaggggaacgttttgggcaactcaaagtcccaaacaccggccccatcttccgaagtggttctcgactccaagagacaagtcgagaaggaagagaccaacgagatccaagttgtaaatgaggaacctcagcgagaccggctgcctcaagagcccgggcgagaacaagtggtggaggacaggcccgtagggggcagaggctttggaggagctggggaactggggcaaacccctcaagttcaggctgcactcagcgtgtctcaagaaaaccccgaaatggagggccctgagcgagaccagctggtgatcccggacggacaggaggaagagcaggaggcagcaggcgagggacgcaatcagcagaaacttcggggagaagatgactataacatggacgagaacgaggccgagagtgagaccgataagcaggccgcattggccggcaacgataggaacatcgatgtgttcaatgtggaggatcagaagcgggacactatcaatctgctggaccaaagggaaaagcgaaaccatacgctgtag

SEQ ID NO: 24329 - DNA, 243 bp, Artificial Sequence
  Description of Artificial Sequence: Synthetic coding sequence
atgatgggcctgggcaacggccggcggagcatgaagagcccccccctagtactggccgctcttgtcgcgtgtataattgtgttgggcttcaattactggatcgcttcttcaagatcggtcgacctgcagacccggattatggaactcgagggccgggtccggcgggccgctgcggaacgaggagctgtggaactgaagaaaaatgagtttcagggtgagctcgagaaacagcgcgagcaatag

SEQ ID NO: 24330 - DNA, 366 bp, Artificial Sequence
  Description of Artificial Sequence: Synthetic coding sequence
atgatgggcctgggcaacggccggcggagcatgaagagcccccccctcgttctggcagcacttgtcgcgtgcattatcgtgctgggattcaactactggattgcatccagccgatccgtggatctacaaacccggattatggaattggaaggacgggtgagacgtgcggccgctgaaagaggagcagtcgagctcaagaaaaatgagttccaaggagaactggagaaacagagagaacagctggacaagatccagagcagccataactttcaactcgaatcagtgaataagttatatcaggacgagaaagccgtgttggtgaataatatcacaacaggcgaaagactgattcgcgtgttgcagtag

SEQ ID NO: 24331 - DNA, 279 bp, Artificial Sequence
  Description of Artificial Sequence: Synthetic coding sequence
atgaagcccatccagaagctgctggccggcctgatcctgctgacctggtgtgtggaagggtgttcgtcccagcactggagttatggccttagacctggtggtaaaagagacgccgagaacctgattgactcgttccaggagattgtcaaggaagtgggtcagttggccgagacgcaacgattcgaatgcacgactcaccagcctcggagccctttgagggacctgaagggagctttggagtcactgatagaggaagaaaccggacagaagaaaatttag

SEQ ID NO: 24332 - DNA, 279 bp, Artificial Sequence
  Description of Artificial Sequence: Synthetic coding sequence
atgaagcccatccagaagctgctggccggcctgatcctgctgacctggtgcgttgaaggatgctctagccaacactggtcgtacggactcagaccaggtgggaaacgtgatgccgagaacctgatcgattcattccaagaaatagtgaaggaagtgggccagttggctgagacgcagcgatttgagtgtaccactcatcagccccgctcacctcttcgggatctcaagggcgccctggaaagcctgattgaagaagaaacaggacaaaagaagatatag

SEQ ID NO: 24333 - DNA, 774 bp, Artificial Sequence
  Description of Artificial Sequence: Synthetic coding sequence
atgcccgccagcatgttcagcatcgacaacatcctggccgcccggcccaggtgcaaagattcagttctacccgtggctcatagcgccgctgccccagtcgtgttccccgcactgcacggtgatagcctatacggagctagtggcggcgcatcaagtgactacggcgctttctatccccgacctgtcgcccccggaggggctggcttgccggccgcggtatcaggttctcgactgggctacaacaattatttctacggccaactgcatgtgcaggctgcaccggtgggccctgcgtgctgtggagcagtgcccccattgggcgcccagcagtgttcgtgcgttccaacgccccccggttacgaggggccagggagtgtgctcgtttcgcccgtaccccatcagatgctgccatatatgaatgtgggaactctgagcagaaccgaacttcagctgctcaatcaactacattgtcggcggaagaggcgtcacagaactattttcacagacgaacagctggaagctctggagaaccttttccaggagaccaaatatcctgacgtgggaacacgggaacaactggctcgcaaagtacaccttcgcgaggagaaggtggaggtgtggttcaaaaaccgacgcgctaagtggaggagacaaaagaggagctctagcgaagaaagtgaaaacgctgagaagtggaataagacatcatcatcaaaagcgtcccctgagaagagggaagaagaaggaaaatcagatctagacagtgattcctag

SEQ ID NO: 24334 - DNA, 654 bp, Artificial Sequence
  Description of Artificial Sequence: Synthetic coding sequence
atggcctaccccggctacggcggcggcttcggcaacttcagcatccaggtgcctggaatgcagatgggccaacccgtgcctgagaccgggcctgctattctgttagatggttattccggacctgcctattcggatacatattcatctgccggagatagcgtctacacatatttcagcgccgttgcagggcaggatggcgaggtcgacgccgaagagctccagagatgtcttacgcagtctgggattaacgggacctattctcctttttctttagaaacttgcaggatcatgattgcaatgctcgatcgggatcatactggcaagatgggattcaacgctttcaaagaactctgggccgccctgaatgcttggaaggaaaacttcatgactgtcgaccaggatggaagtgggacagttgagcatcacgagcttcgtcaagccatcggtctcatggggtaccgcttatctccccaaacactgactactattgtgaagcggtatagtaaaaatgggagaatttttttcgacgactacgtagcatgttgcgtgaaactgagggcactgacagatttttttcggaaacgggaccatctgcagcagggctctgcgaatttcatatacgatgactttcttcagggtacaatggccatctag

SEQ ID NO: 24335 - DNA, 438 bp, Artificial Sequence
  Description of Artificial Sequence: Synthetic coding sequence
atggccacctgggccctgctgctgctggccgccatgctgctgggcaaccccggcctggtgttttcgaggctgtctccagaatattacgacctagctcgcgcccacctgagagacgaggaaaagagttgtccgtgtctggctcaagaaggcccccagggcgacctgttgaccaagacccaagagctgggtcgtgactacaggacgtgtctcacgattgtccagaaactgaagaagatggttgataaacccacgcaacgctctgtctccaacgccgctacccgcgtgtgccgaacgggtcgatctagatggcgtgacgtatgcaggaatttcatgcggcgctatcagtccagagtcacccagggcctggtggccggcgaaaccgcacaacaaatttgcgaggacctgcgactgtgcatcccatcaactggtccattatag

SEQ ID NO: 24336 - DNA, 393 bp, Artificial Sequence
  Description of Artificial Sequence: Synthetic coding sequence
atggagggcctggtgttcagccggctgagccccgagtactacgacctggcaagggcacatcttagggacgaggagaaatcctgtccctgtttggcccaggagggccctcaaggagacctcctgactaagacacaggagttgggacgggactacagaacttgcctaactattgtccaaaagctgaagaaaatggtggacaagcctacgcaaaggtctgtgagcaacgctgctaccagggtgtgtcgcaccgggaggtctaggtggcgggacgtctgccggaactttatgagaaggtaccagtcccgggtcactcagggcctggttgctggtgaaacagctcaacaaatctgcgaagaccttcgtctctgcattcccagtacaggccctctttag

SEQ ID NO: 24337 - DNA, 555 bp, Artificial Sequence
  Description of Artificial Sequence: Synthetic coding sequence
atgagccggaccgcctacaccgtgggcgccctgctgctgctgctggggacgctgctacctgctgccgaggggaaaaaaaagggaagccagggtgccataccccctcccgataaagcacaacacaacgatagcgagcagacccagtcaccccagcagcccggatcgcggaaccggggaagagggcagggcagagggactgctatgcctggagaggaggtccttgaatcatcacaggaagctttgcatgttacagagcgtaagtacctcaagagagattggtgcaaaacacagccactgaagcagacgatacacgaagagggctgtaatagtcgtaccattattaatcgattttgctacggacaatgtaattcattttatattccgaggcatatcagaaaagaggagggtagcttccagtcatgttccttctgcaagccaaaaaagttcactacgatgatggttacgcttaattgcccagaactccaacctcccactaaaaaaaagagagtgacgcgtgtgaaacagtgccgctgcatcagcattgacctagactag

SEQ ID NO: 24338 - DNA, 432 bp, Artificial Sequence
  Description of Artificial Sequence: Synthetic coding sequence
atgagccggaccgcctacaccgtgggcgccctgctgctgctgctggggaccctcctgccagccgctgaagggaagaagaaaggatctcagggcgctattcctccccctgataaggccctgcatgtcaccgagcgcaagtacctgaaaagggactggtgcaagacgcaaccactcaagcagaccattcatgaagagggctgtaacagtcggacgataataaaccgcttctgttatggacagtgcaacagcttctacattcctaggcacatcagaaaggaggaggggtcctttcagagctgctcattttgcaagcccaaaaagttcaccacaatgatggtgactttgaattgccctgaactgcagccccccaccaaaaagaagagagtaacacgagtaaagcagtgcaggtgtatcagcatcgacctagattag

SEQ ID NO: 24339 - DNA, 432 bp, Artificial Sequence
  Description of Artificial Sequence: Synthetic coding sequence
atgagccggaccgcctacaccgtgggcgccctgctgctgctgctgggcactctgctacccgcagccgaaggaaagaagaaggggtcccagggcgcaatcccacctcccgataaggccctgcatgtcaccgaaaggaagtacctcaaaagggattggtgcaaaacacagcctttaaagcagactattcacgaagaggggtgtaactccaggacaatcattaacaggttttgttacggccaatgcaactcattctatatccccaggcacatccgaaaggaagaagggtcattccaatcctgctctttttgcaagcccaagaagttcacgaccatgatggtcacgctcaactgccccgagctccagcctccaacaaagaaaaagcgcgtgacacgggtgaagcagtgtcgctgtattagcatcgacttggattag

SEQ ID NO: 24340 - DNA, 396 bp, Artificial Sequence
  Description of Artificial Sequence: Synthetic coding sequence
atgaccctggaggagttcagcgccggcgagcagaagaccgagagcgatcctgataatgtcgtgctctgcttattagccgcagatgaagacgatgatcgggacgtggcccttcagatacactttaccttgatccaggccttctgctgcgaaaacgacattaacatcctaagggtcagcaatcccggccgcttggctgagctgctgctccttgagacagacgccggacctgccgccagcgaaggggcagaacagccacctgaccttcactgcgtgctggtaaccaatcctcattctagccagtggaaagatccagctctaagtcagctgatatgcttctgtagggaatcacgctatatggatcagtgggtacctgtcattaacctccctgaaagatag

SEQ ID NO: 24341 - DNA, 498 bp, Artificial Sequence
  Description of Artificial Sequence: Synthetic coding sequence
atgaccctggaggagttcagcgccggcgagcagaagaccgagcggatggataaggttggggatgctctggaagaagtcctttccaaggccctgtcccagagaaccatcacagtgggtgtatatgaggcagcgaaactcttgaatgtggaccctgataacgtcgtgctttgccttttagctgcagatgaagacgacgaccgggacgtagctcttcaaatccattttacgcttatccaggcgttttgctgcgagaatgatattaatatactgcgagtgtctaacccaggacggctggcggagctgctgctgcttgagaccgacgcaggacccgccgcatccgagggtgcagaacagccaccagacctgcattgtgtactcgtgaccaatccccactcttcccagtggaaagatcctgccctctcccagttgatctgcttttgtcgcgaatcaagatacatggaccaatgggtcccagttataaatttgccagaacgatag

SEQ ID NO: 24342 - DNA, 3693 bp, Artificial Sequence
  Description of Artificial Sequence: Synthetic coding sequence
atgagcgccctgtgctggggccggggcgccgccggcctgaagcgggctctaaggccatgcggccgccctggcttgccgggaaaggaagggacagccgggggggtgtgtggacctcgccgcagcagcagcgctagccctcaggaacaggaccaagataggagaaaagattgggggcatgtagaactgctcgaagtccttcaggccagagtgagacaactccaggctgagagtgtcagcgaggtcgtggtgaatcgggtggatgtggcaaggttaccagaatgtgggtctggagatggctcactgcagccacccaggaaagtccagatgggtgccaaggatgctaccccagtgccatgtgggcggtgggctaagatcttagagaaggacaagcgtactcagcagatgcgcatgcagcgtcttaaggccaaactccagatgcctttccagtccggagagtttaaagctttaacaaggaggctgcaggttgaacctaggctgctgtcaaagcagatggctggctgcctggaggattgcacgcggcaggcacccgaatccccatgggaggaacagctggctcgcttgctgcaggaagcccccggcaaattgtccctggacgttgagcaggcacctagtggacagcactcacaggcccagctcagcggccagcaacaacgcctgctggccttttttaaatgttgtctgctgactgatcagctgccgttggctcaccatcttctcgtagtccatcacgggcagcgacagaagcgaaaactgctgacccttgatatgtacaatgcagtcatgttgggctgggcccggcagggggctttcaaggagctggtctacgtcctgttcatggtaaaggatgccgggcttacccctgatctactctcctacgccgctgccctgcagtgcatgggccgacaggatcaggacgccggcacaattgagagatgtcttgagcagatgtcacaggaaggactgaaactgcaggctctgtttactgcagtcctgctatccgaggaggacagagccacagtcctgaaagccgtgcataaggtcaagcccacattttctctgcccccacagctcccgccccctgtaaacacctccaaacttctccgagatgtctacgccaaggacgggagggtctcctaccctaagttgcatctccctctgaaaaccctccaatgtctcttcgagaaacagctgcacatggaattggctagcagagtgtgtgtcgtctctgtggagaagccaactctgccttccaaagaggtgaaacacgcgcggaagactctcaagacattgagggaccagtgggagaaggcactgtgcagggctttgagggaaacgaaaaatcgcttggagagagaggtgtacgagggacgcttttcgctgtaccccttcttatgtctactggatgaacgtgaggtcgtgcgaatgttgcttcaagtactgcaggccctccccgctcaaggagaatccttcactacactggccagagaactcagcgcccggacttttagccggcatgtggtgcagcgccagcgtgtgtccggacaggtgcaggctctacagaatcattatcggaagtatttgtgcctacttgcatccgatgcggaggtgcccgagccctgcctcccccgacagtactgggaggagttgggcgcaccagaagctctgagggagcagccatggcccctccccgtacaaatggagctgggcaaactgctagctgaaatgctcgtgcaggcaactcagatgccttgttccctggataagcctcacaggagctctcgactcgtgccggtgctgtaccacgtctactctttcaggaacgtccagcagatcggtattctgaaaccacaccccgcctacgttcagctgctcgagaaggctgccgaacctaccctgacttttgaagccgtagatgttccaatgctgtgcccccccctgccatggacctctccccacagcggcgcctttcttctgagcccgaccaagctgatgcgtacagtggagggggctactcagcaccaggagctgctggagacttgtccccccaccgcactccatggggcattagacgcactgactcagctagggaactgcgcctggcgtgtgaacggcagggtgctggatctggtgctacagttgtttcaggccaaaggttgcccacaattgggggtccccgcacctccaagcgaagcaccacagccacccgaagcgcacctcccgcatagtgcagctcccgctagaaaagctgagctccggcgcgaacttgctcattgtcagaaggttgcgagagagatgcattctctgcgtgcagaagctctctaccggctgtctctggcccagcacctcagggacagagtgttctggttgcctcataacatggactttaggggtaggacgtacccctgcccacctcactttaatcacctgggctccgatgtggccagggcccttctggagttcgctcaaggtaggccgctcggcccacacgggctcgattggttaaaaatacatctggtcaatttgactgggctgaagaagcgcgagcccttgcgcaaaagattggccttcgcagaggaggttatggacgatattttagactcagccgaccaacctctaacagggaggaagtggtggatgggggccgaggagccatggcagacgctcgcctgttgcatggaggtggccaacgcagttcgggctagcgatccggcagcatatgtttcccatctgcccgtgcatcaggacggctcttgcaacggacttcagcactatgccgcactggggagggactcagtcggtgcagccagtgtcaacctcgaaccttcagacgtaccacaggatgtctatagtggagtggcagcccaggtggaagtatttcggcggcaggacgcacagcgagggatgcgtgtggctcaagtgttagaggggtttatcacaagaaaagtcgtcaagcagaccgtgatgactgtggtttacggagtgacccgatacggcggcaggctacagatcgaaaagagactccgcgagctcagcgatttcccacaggaatttgtctgggaagccagccactatcttgttcgccaggtgtttaaatccttacaggagatgttttccggcaccagagccatccagcactggctcacggaaagcgccaggctgatttcccacatggggtcagtggtggaatgggtgactcctcttggcgtacccgtaatacaaccctaccgactagattctaaagtcaagcagattgggggaggtattcaaagcattacatacacccataacggagacattagccggaagcccaacacacgcaagcagaaaaacgggtttccccccaacttcatccacagcttagattcctcccatatgatgttgacggcgctgcactgttatcgcaaaggcctgacctttgtgtctgtacatgattgttactggactcatgccgcagacgtgagtgtgatgaaccaggtgtgccgtgagcaattcgtgcggctgcacagcgaacctatcctccaagacctgagtagattcctagtgaagaggttttgctctgaacctcagaagatccttgaggccagccagctcaaggagacactgcaggcggtaccaaagcccggtgcattcgacctcgagcaggtgaaaaggagcacttatttcttcagctag

SEQ ID NO: 24343 - DNA, 480 bp, Artificial Sequence
  Description of Artificial Sequence: Synthetic coding sequence
atgaccctggaggaggtgcggggccaggacaccgtgcccgagagcaccgcaaggatgcagggcgctggaaaagctctgcatgaactccttttgtcggctcaaaggcaaggatgcctcacggctggcgtctacgagagcgcaaaggtgctgaacgtggatcccgataacgtgaccttctgcgtgttggcggccggagaggaagacgagggcgacattgccctccaaatacatttcaccctgatccaggccttttgctgtgaaaatgatatcgatatagtaagagtgggagacgtgcagagactagccgctatagtgggtgcgggggaggaagcaggggccccaggcgaccttcactgcatcctgatctcaaatccaaacgaagatgcttggaaagacccagccttggagaagctgtccctgttttgtgaagagtcccgatccgtgaatgactgggtgcccagtattaccctgccagagtag

SEQ ID NO: 24344 - DNA, 426 bp, Artificial Sequence
  Description of Artificial Sequence: Synthetic coding sequence
atgcagggcgccggcaaggccctgcacgagctgctgctgagcgcccaaagacagggctgcttgacagctggggtgtacgaatccgcaaaagtgttaaacgtcgatccagacaatgtgacattttgtgttctggctgccggcgaagaagacgagggtgatatcgcgcttcagattcacttcacactgatccaagccttctgctgtgaaaacgatattgacatcgttcgagtcggggatgttcagagactggctgctattgtgggcgccggcgaagaagccggcgcccccggcgatctacattgtatcctcatttccaatcccaacgaagacgcatggaaggaccccgccctggagaaactgagcctcttttgcgaagagtcacggtctgtgaacgactgggttccttctattacactgccagagtag

SEQ ID NO: 24345 - DNA, 2085 bp, Artificial Sequence
  Description of Artificial Sequence: Synthetic coding sequence
atgcagcccgccatccaggtgtggttcggcgaggacctgcccctgtcaccaagatcacccctgactccccggcatggtccaggactagccaatgtctgtcagtacgatgaatggattgcggtaagacatgaagccactctgctaccaatgcaggaggacttgtccatttggctgagcggccttctgggaatcaaagtgaaagcagaaaagctcctagaagaattagataatggcgtgttgctttgccagttaattgatgtcctacagaacatggtcaagacctgcaatagcgaggagagtgggaattttccaatgcggaaagtgccttgtaagaaggatgctgctagtggttccttcttcgcgcgcgataatactgcgaacttcctccactggtgtagggacatcggagtcgatgaaacttatctgttcgagagcgaggggctggttctccacaaggaccccagacaggtctatctgtgcttgctggagataggcaggattgtctcaaggtatggcgtggaaccgcccgtgctcgtcaagctcgagaaggagatcgagcttgaggagacgctgctcaatacttccggaccagaggatagcatctccattccaaagtcctgctgtcgtcacgaagagctccatgaggctgtgaagcacatagctgaggaccccccgtgttcctgctcacatcggttctcaatagaatacctcagcgagggtagatacaggctcggcgacaagatcctttttataagaatgttgcatggcaagcacgtgatggtgagagtgggtggtggatgggatactctacagggatttctgttgaaatatgacccctgtaggatcctgcagttcgcgactctggagcaaaaaattctcgctttccagaaaggtgtcagcaacgaatcggtcccggattcacccgcacgaactccccagccaccggagatgaacccattatctgcagtgaatatgtttcaaaagcagaacagtaagccgtcagtaccagtgtccattcccaagagcaaggagaaacagggtagaccacccggcgcccttgtgcctgccagctccctgaaaggaggaaatttgggcagtatgtccgtccgatcaaaattacctaattcacctgcggcttcctcccaccccaagctgaagagtagcaaaggaatcaccaaaaagccgcaagcgccatcgaacaacgcatccagttcactggcctccctgaatcctgtagggaagaacacatcctcaccagcgctgcctaggactgccccatgtatttccgaatcgcctaggaaatgcatctcctcacccaataccccgaaagccaaggtgatccctgctcagaattctgccgacctccctgagtctactctactcccaaacaagtgcagcggtaaaactcagccaaagtacttgaagcataatcacatctccagcagggataacgcggtgtcgcatctggccgctcacagtaattcttcttccaagtgtcccaagctgcccaaggcgaatatccctgtcagaccaaaacctagctttcagtcctccgccaagatgaccaagacgtcaagtaagacaattgctaccggtcttggcacccagtctcagccatccgacggtgccccgcaagccaagcccgttcccgctcaaaagctcaaatcagctctgaatttaaaccaacccgtgtcagtgtctagtgtgagtcccgttaaagcaacgcagaaatcgaaggataagaacatcgtctcagccacaaaaaaacagccacagaataaatctgcatttcaaaagacaggtccttctagccttaaaagcccgggccggacaccactttccattgtaagtctgccccaaagttctaccaaaacacagaccgctcccaagagcgctcagacagtggccaagtcccagcacagcacgaaaggccctccacgaagcgggaaaactcctgcgtccattagaaaaccccccagcagcgtgaaggatgctgactcaggagacaagaagccaacagccaaaaaaaaagaagacgatgatcactacttcgtaatgacgggatccaaaaagcccaggaagtag

SEQ ID NO: 24346 - DNA, 2085 bp, Artificial Sequence
  Description of Artificial Sequence: Synthetic coding sequence
atgcagcccgccatccaggtgtggttcggcgaggacctgcccctgagtcctcgctctcccttgacccctaggcatggtccggggttagcaaatgtgtgccagtacgacgaatggatagccgttaggcacgaggctaccctcctgccaatgcaggaagatctctccatatggctcagtgggctgttgggcataaaggttaaggctgagaaacttcttgaggagttggacaacggagtgttactatgtcagctaatcgatgtactgcagaatatggtcaagacatgtaactcagaggaaagcgggaactttcctatgcgaaaggtgccctgtaaaaaagacgctgcttccgggtctttcttcgccagggataacacagccaattttcttcattggtgcagagatatcggggtggacgaaacctatctgttcgaaagcgagggtctggtgctacacaaggacccgcggcaggtctacctgtgcttgctggagattggacgtatcgtgtcacgctatggggtggaaccccctgtactggtgaagctggagaaggagattgaattagaagaaactctacttaatacctctgggcctgaagattctataagcattcctaaatcttgttgtcggcatgaagagctccacgaagccgtcaagcacatcgctgaggacccgccctgctcttgcagtcataggttttctatcgagtacctttcagaaggccgataccggctcggcgacaagatattgtttatacgtatgctgcatggcaaacatgtcatggtgagggtaggcggcggttgggacaccctgcagggattccttctgaagtatgatccttgtcgtatcttgcaatttgctaccctcgaacagaaaattttggccttccagaagggagtttcaaacgaaagcgtcccagactcacccgccagaacacctcaaccacccgagatgaacccgctctccgcagtcaacatgtttcagaaacagaacagtaaaccaagcgtccccgtttctattccaaaaagtaaggagaagcaggggcgccctcctggcgctctggtccctgctagctctctgaaggggggaaacttaggctctatgtctgtgagaagtaaattacccaattcgccagctgcctcaagccacccaaagcttaagtcctccaagggcatcacaaaaaaaccacaagccccctccaataacgcatcgagttctctagcctcccttaaccctgtcggtaaaaacacctcgagccctgccttgccaaggacggccccctgcatcagcgaatctccacgcaaatgcatttcctctccgaatacgcccaaagcgaaggttatccctgctcagaatagcgccgatcttcctgagagtacactgcttcccaataaatgcagcggtaaaacccagcccaagtatttgaaacacaatcacatttcatcaagagataacgcagtttcgcacctggcagcacacagcaatagcagctccaagtgccctaaactcccaaaggcaaacattccggtccggccgaaaccgagcttccagtcatcagccaaaatgaccaaaactagttcgaagaccattgccaccggtcttggcacacaaagccagccctccgatggcgccccccaggccaaacccgtccccgctcaaaagctcaaaagtgccttaaacctgaaccaacctgtctctgtgtcttctgttagccctgtgaaagccacacagaaatccaaagacaaaaacattgtgtccgctacaaaaaaacagccacagaacaagagcgccttccagaagacagggccatcctccttaaagtcacccggccgaacccccctctctatcgtgtcgttgcctcagtccagcaccaagactcaaaccgctcccaaatccgcccaaactgtggccaagagtcaacactctaccaaaggcccaccacgctcaggcaaaaccccagcctccatcagaaaaccacctagctccgtgaaggacgcagacagcggtgacaagaagcccacagcaaagaagaaggaggacgatgaccactactttgtcatgactggaagtaaaaagccaagaaaatag

SEQ ID NO: 24347 - DNA, 2085 bp, Artificial Sequence
  Description of Artificial Sequence: Synthetic coding sequence
atgcagcccgccatccaggtgtggttcggcgaggacctgcccctgagcccccgctcaccgttaacccccagacatggtcccggcctggctaacgtgtgccaatatgacgagtggatcgctgttaggcatgaggccacattgctgcctatgcaggaagacctttctatctggctatcgggacttttggggatcaaagtgaaggcagaaaagttactcgaagaactcgacaacggagttcttctttgtcagctgatagacgttctccagaatatggtgaagacgtgcaacagcgaggagagcggaaactttcctatgcgtaaggtaccctgcaagaaagatgctgccagtgggtctttcttcgcacgggataatacggctaacttcctgcattggtgcagggacattggcgtggacgagacgtatcttttcgagtccgaggggctcgtgctgcacaaagacccgcggcaggtttacctgtgccttctcgaaataggtcgcatcgtgtcacgttatggtgtcgagcccccagtcctcgtgaaactggagaaagagatcgagctggaggagacactcctgaacacgtcaggtcctgaggacagcatcagcatccccaagtcctgttgcaggcatgaagaacttcatgaagccgttaagcacatcgctgaggatcccccttgtagctgtagccaccgcttcagcatagagtatctgtctgaaggacgctatcggctcggggacaaaattttgttcatcaggatgctgcacgggaagcacgtgatggtgcgagtgggcggtggctgggacacattgcagggattccttctgaagtacgacccttgcaggattctccaatttgccactctcgaacagaagatcctggccttccagaagggggtgtctaacgaatccgtccccgatagcccagcccgtacaccacaacctcccgagatgaatcccctttccgcagttaacatgttccaaaaacagaactccaagccgagtgttcccgtgtccatcccaaaaagcaaggagaagcagggaagaccgcctggggccctcgtgccagcgtctagtcttaaggggggcaatcttggctcaatgtcggtgcgaagcaagctgcctaatagtcctgccgccagttctcatcccaagcttaagtcttctaagggaatcaccaaaaaacctcaggccccttcaaataatgcaagcagttcactggctagcctgaaccccgttgggaaaaacacgtcatcacccgccctccctcgcaccgctccttgcatttccgaatcaccccggaaatgcatctcctctccaaacacacctaaagcgaaggtcattccagctcagaactcagctgacctccccgaatctacactgttgcccaacaagtgctcaggtaagacccagcctaaatacttaaaacacaaccacatctcatctagggacaacgccgtgagccacctcgcagcccattcaaattcgtccagtaagtgtcccaagctacccaaagcaaacattcccgtgaggccaaagccgtcgttccagagcagcgctaagatgactaaaacgagctccaaaaccatagctacggggctgggcactcagagccagcctagcgatggggcccctcaagcgaagcctgtgccagctcaaaaactgaaatctgctctgaacctcaaccaacccgtgtccgttagctctgtgtcccctgtgaaggcgacccaaaagtccaaagataaaaatattgtctctgccacgaaaaagcagccccagaataagagtgcgtttcagaagacgggaccttcctctctgaaatctcccgggcgcacaccccttagcatcgtgagtctgcctcaatcaagcactaagacacagaccgcgcctaaaagtgcacaaacagtggccaagtctcaacatagcaccaaagggcccccccgcagtggtaaaacgcccgcttccataagaaagcctcctagctccgtcaaagacgctgatagcggggataaaaaacccacagctaaaaaaaaagaggacgatgatcattacttcgttatgactggctctaaaaagcctcgcaagtag

SEQ ID NO: 24348 - DNA, 150 bp, Artificial Sequence
  Description of Artificial Sequence: Synthetic coding sequence
atgcagcccgccatccaggtgtggttcggcgaggacctgcccctgagcccaagaagtccacttaccccacgtcatggcccagggctggccaacgtctgccaatatgatgagtggatcgcagtgcgacacgaggcgactctgctcccatag

SEQ ID NO: 24349 - DNA, 1611 bp, Artificial Sequence
  Description of Artificial Sequence: Synthetic coding sequence
atgaacgccagcctggagagcctgtacagcgcctgcagcatgcagtcagatactgtgcccctgctccagaatggccagcatgcacgcagccagccacgggcctccggtcctccccgatcaatccagccccaggttagccccagacagcgcgtgcagagaagccagcctgtgcacatcctggcagtacgtagactgcaggaggaagaccagcagttccgtacaagcagtctgccagctattccaaacccttttcctgagctttgtggccctggatcacctccagtgctgactcccgggagcctaccgccctcgcaagccgcagctaaacaagacgttaaagtctttagcgaggatggaacctcgaaggttgttgaaattctagctgatatgaccgcacgagacctgtgtcaactattggtgtataaatctcactgcgtggatgataacagctggaccctagtggagcaccacccccatctgggactcgagcggtgtctagaggaccacgaacttgtcgtccaggtggaatcgactatggcttctgaatccaagttcctgtttcggaagaactacgcaaagtatgagttctttaagaatccaatgaacttctttccggagcagatggtcacctggtgtcagcagagtaatgggagccagactcagttactgcagaattttctaaattccagttcatgccccgaaatccagggctttttgcatgtcaaggagctcggtaagaagtcatggaagaaactttacgtctgccttcgcaggtcaggcctgtattgctcaacaaaaggaacttccaaggagccacgtcatcttcagttgctggccgaccttgaggatagcaacatcttctccttgattgccggccgcaaacagtacaacgcaccaacagatcacgggttgtgcatcaaacctaacaaagtgaggaatgaaaccaaggaactccggcttctctgcgctgaggacgaacagacccgaacctgctggatgactgctttcagactgctgaaatatggaatgctgctataccaaaattacagaattccccagcagcggaaagcccttctgtctccattctccaccccggtgaggtctgtctcggagaacagtctggtagctatggacttctcaggccagactggcagagtgatcgagaacccagccgaggcccagtctgcagccctggaagagggtcatgcatggagaaagcgtagcactcgaatgaacattttgggtagccagtctcccttgcacccctccaccttgagcactgtcatacaccgcacgcagcattggttccatgggaggatttcacgcgaagaaagccacaggattattaagcagcaggggttggtggacggcctgttcctgctgcgagactctcagagtaaccctaaagcatttgtgctgacactgtgtcatcaccaaaagataaagaacttccagatcctcccctgcgaagatgatggccagactttcttctccctggatgatggaaataccaaattcagtgatctgatacagctggtagacttttatcagctaaacaaaggcgtcctgccttgcaagcttaaacaccattgcatcagagtggcactttag

SEQ ID NO: 24350 - DNA, 1647 bp, Artificial Sequence
  Description of Artificial Sequence: Synthetic coding sequence
atggccctggccggctgccccgacagcttcctgcaccacccctactaccaagataaagtggaacagacccccaggtcacagcaggatccagctggcccaggactccccgcgcagagcgatcgtttggcgaaccaccaggaagacgatgtcgaccttgaagccctggtaaacgatatgaacgcctctctggagagcctgtacagcgcttgttccatgcagtccgataccgttcctctgctgcagaatggtcagcatgcaaggtcccagcctcgggccagtggaccaccacgctctattcagccgcaggtcagcccccggcagcgagttcaacgcagccagcccgtgcatatattagcagtccggcgcctccaggaagaggatcagcagtttcgcacatcttctctgccagctataccaaacccctttccagagctctgtgggcccggctctccccctgttctgacacccggttcattgcccccgagtcaagccgcagccaagcaagacgttaaggtcttttctgaagacggaacttccaaagttgttgagattctggcggacatgacggcaagagacttgtgtcagctgctcgtgtacaaaagccactgtgttgacgataatagctggacgttggtggagcatcaccctcacctgggcctggaaagatgtttagaggatcacgaactggtggtgcaggtggaatcaactatggcttcagaatcaaaattcttgtttcggaagaattatgcaaaatacgagtttttcaagaacccaatgaatttcttccctgagcagatggtgacctggtgccagcagtccaatgggtcccagacgcagctccttcaggagcctcgtcatctgcagctgctggctgatttagaggattctaacatcttttctctaattgccgggaggaaacagtataatgctcccacggaccacgggttgtgcatcaagccaaacaaggtcagaaatgagacaaaggagcttcggctcctgtgcgccgaggacgaacagactaggacttgttggatgaccgccttccgcctgctgaaatatggaatgctgttataccagaactacaggattccacagcagagaaaggccctgctatcaccctttagcactcctgtgaggagtgtgtccgagaatagtttggtagcaatggacttttctggacaaacaggcagggttatcgagaacccagccgaggcccagtctgctgctttagaagagggccacgcatggagaaagcgcagtactaggatgaacattctgggtagtcagtctccactgcatccttccactctcagcaccgtgatccatcgcacccagcactggttccatggacgcatatccagagaggagtctcaccgcataattaaacaacagggattggtggacggtctgttcctcctgcgcgattctcagagtaatcccaaagcatttgttttaacgctgtgtcaccatcagaagataaaaaatttccaaattctgccatgcgaagatgacggccagactttcttctctttggatgatgggaatacaaaattcagcgacttgatccagctggtggacttctatcaactcaacaaaggcgtccttccatgtaaactcaaacatcactgtatcagagtggctttgtag

SEQ ID NO: 24351 - DNA, 381 bp, Artificial Sequence
  Description of Artificial Sequence: Synthetic coding sequence
atgaacatcctgggcagccagagccccctgcaccccagcaccctgtccacagtaatacataggactcagcattggtttcatggtcgtatttctcgcgaagaaagccatcgcataataaagcagcagggactagtggatgggctatttctactgagagactctcagagcaatcccaaggctttcgtgcttacactctgtcaccatcagaagattaaaaacttccagatcctgccatgtgaagacgacggtcagacctttttctccctcgacgacggtaatactaaattctcagatctcatacagctcgtcgacttttaccagctaaataagggagtgttaccttgcaaattgaaacaccactgcattcgagtcgctctgtag

SEQ ID NO: 24352 - DNA, 1611 bp, Artificial Sequence
  Description of Artificial Sequence: Synthetic coding sequence
atgaacgccagcctggagagcctgtacagcgcctgcagcatgcagagcgataccgttcctctgctgcaaaacggccagcatgcccggtcacagcctagagccagcggcccccctcggtccattcaaccacaagtgtctccacgacagcgagtccagaggagccaacctgtgcacatcctggcagtgcgacgactccaggaagaagaccagcagtttcggaccagctccctgcccgccatcccaaaccccttcccagagctgtgcggcccaggatcgcctcctgtcctcacccctggtagcctccctccctcgcaggccgccgccaagcaagatgtaaaggtgttctccgaagatggcaccagcaaagttgtggagattttggctgacatgaccgcccgcgacctgtgccagctgctggtgtataaatcacattgtgtggacgacaattcttggacattggtggaacaccacccgcatctcgggctggaaagatgtctcgaggatcatgagctggtcgtccaggttgaatccaccatggcctcagagagtaaattcctatttcggaaaaattatgcgaagtatgaattctttaagaacccaatgaatttctttcctgagcaaatggtcacctggtgtcagcagtcaaacggttcacaaacgcagcttttgcaaaattttctcaactcttcctcctgtccagaaatccagggattcttgcacgtgaaggaactagggaaaaagagttggaagaagctgtacgtctgcctacggcgttcaggactgtactgtagcacaaaggggacaagcaaagaacccagacatttgcagctcctagccgatcttgaagactctaacatattctccctgatcgctggccgtaagcagtacaatgcccctacggatcacggattgtgtatcaagcctaacaaggttagaaatgaaacaaaggaactacgattgttgtgcgctgaagacgagcagacccgcacatgctggatgacagcttttagattgctgaagtatggcatgctcctgtaccagaactatcgcattccccaacagaggaaggctcttctgagcccgttttctactccagtgcgatctgtcagtgaaaactcactggtggccatggatttctccggtcaaacaggcagggttatagaaaatcctgccgaagcacagagcgccgcgcttgaggaaggccacgcgtggcgaaaaagaagtactcgaatgaacatcctcgggtcacagagccccctgcacccttccaccctcagcactgtcatacatcgtactcaacactggttccacggaaggattagcagggaagaaagccatagaattatcaaacagcaggggctggttgacggtctctttcttctgagggattcccagtcaaatcccaaagcctttgtcttgacattatgccatcaccaaaagattaaaaacttccaaattctgccttgcgaggacgatgggcagaccttcttttctctggacgacggtaataccaagtttagtgatctcatacagctggtggatttctatcagttgaacaagggggtgctcccttgcaagttgaaacaccattgcatcagggtcgccttatag

SEQ ID NO: 24353 - DNA, 1785 bp, Artificial Sequence
  Description of Artificial Sequence: Synthetic coding sequence
atggccctggccggctgccccgacagcttcctgcaccacccctactatcaggacaaggtcgagcagaccccccgctcgcagcaggaccccgctgggcccgggctgcccgcccagtctgataggctcgccaaccaccaggaagatgacgtggacctggaggcgttagtgaacgatatgaatgcatctctggaaagcctgtattcagcatgcagtatgcagtcagatacggtgccactgctgcagaatgggcaacacgcgcgcagtcagccgcgagcttctgggcctccccgcagtatccagccccaggttagccccaggcagcgagttcaacggagccagcccgtccacatcctggccgtccggagactccaggaggaggatcagcagtttcgtaccagctctctgccagccatcccaaaccctttccccgagctgtgcgggcctggctcccctccagtactgactccaggcagtctgcctcccagtcaggcagccgccaagcaggatgtgaaggtgttctctgaagacggtaccagcaaagtcgtggagatcctcgcagacatgacagcgcgtgacctgtgtcagttgctggtctacaaaagccattgcgtggatgacaacagctggacattggttgagcaccaccctcatcttggactggaacgctgtcttgaagatcatgagcttgttgtccaggttgagagcaccatggcaagcgaatcgaagttcctgtttagaaaaaactatgcaaagtacgagttttttaaaaatccaatgaatttttttcctgagcagatggttacctggtgtcaacagagtaacgggtcccagactcagcttctccagaattttttgaactcatcctcttgccctgaaattcagggatttctgcatgtgaaagaattggggaagaagtcttggaagaagctatacgtatgcctccggcggagtggactgtattgttccactaaagggacaagtaaggagccaaggcatctgcagctcctggccgatctcgaagacagcaacatattcagtctgattgccggacgcaaacagtacaatgcccccacagaccacgggctgtgtatcaagccgaacaaggtgcggaatgagaccaaagagctcagactgttatgcgccgaagatgagcagacacgcacctgttggatgacagctttcaggctgttgaagtatggaatgttgctgtatcagaattataggatcccgcaacaacgtaaggccctccttagccccttctctacgcccgtgcgctccgtctcagagaactcgttggtcgctatggatttctctggtcagacgggccgcgtcattgagaatcctgccgaggctcagagcgctgccctcgaagagggtcatgcctggcgcaagcgaagcaccaggatgaacatcctcggatcacagtcacccctccatccatccacgctgagcacagtgattcatcggacccagcattggttccacgggagaatctccagggaggaaagccaccggatcattaagcagcagggtttggttgacggtctgttcttgctgcgcgattcacagtccaatcctaaggcgttcgtgttgaccctgtgtcaccaccagaagattaagaattttcagatcctcccctgtgaagacgatggtcaaaccttcttttccctagatgacggaaataccaagttcagtgatttaattcaattagtcgatttttatcaacttaataaaggcgtgttaccctgtaaattaaaacaccattgcattagggtagctttgtag

SEQ ID NO: 24354 - DNA, 1785 bp, Artificial Sequence
  Description of Artificial Sequence: Synthetic coding sequence
atggccctggccggctgccccgacagcttcctgcaccacccctactaccaggacaaggtagagcagactcccaggtcccaacaagaccctgccgggcccggcctaccagcccagagcgatcgactggcaaatcaccaggaagatgacgtggacctagaggcccttgtgaatgatatgaatgcctccctcgaaagcctgtactcagcctgttccatgcaatcagataccgtgccattgctgcagaatgggcagcacgcccggagccaacccagagctagtggacccccacggagcatccagccacaggtgtctccacgacagcgagttcagcggagccagccagtgcatattctcgcagttcggagacttcaggaagaagatcagcagtttcgcactagcagtttacccgcgatccctaacccttttcccgagctgtgcggccccggctccccgcctgtgctgaccccaggatcgctgccgccatctcaggccgctgccaagcaggacgtgaaggtgttttctgaagacgggacctcgaaagtcgtcgaaattttggcagatatgacagcgagagacctttgtcaattgctcgtctataaatcccactgtgtggacgacaacagctggacgctggtagagcatcatccccacttaggtctagagagatgcttggaggaccacgagctcgtagtgcaggtagaatccactatggcctcagagagcaagttcctgttccgcaagaactacgccaaatacgaattcttcaagaacccaatgaatttttttcctgaacaaatggtcacatggtgccagcagtctaatggctcgcagacacagctcctgcagaacttccttaatagctcctcatgccccgagatccagggattcttgcacgtcaaggagctagggaaaaagtcatggaaaaaactttacgtgtgtttgcggcggtctgggctctactgctccactaagggaacctctaaagaaccccggcacctgcagctgctggctgaccttgaggattcaaacatcttcagcctaatcgccgggagaaagcagtacaacgctccaacagatcacggcttgtgtataaaacctaataaggtgcggaacgagacaaaggaattacgactcctctgtgcagaggacgaacaaacgcgaacatgttggatgactgcctttcgcctgttgaagtatggaatgctactgtatcaaaattatagaatcccacaacagcgcaaggctctcttgtcccctttcagcacccctgttagatccgtcagcgagaattctctggtggctatggatttttcaggacagaccggcagggtgatcgaaaacccagccgaggcgcaatctgccgccttggaagaggggcatgcatggcgaaagcgatccacacggatgaacatcttggggagtcagtcaccgctccacccctcaacgctatccaccgtcatccatagaacacaacattggttccatggacggatcagccgggaggagagtcaccgtatcattaagcagcaaggactcgtggacggcctgttcctgctgcgagactcccaaagcaaccccaaggctttcgtactgaccttgtgtcaccaccagaagattaagaattttcagattctgccctgcgaggatgatggccagacattcttcagtcttgatgatgggaacactaagttttccgatctgattcagctcgtggacttttatcaactcaacaagggtgtactcccctgtaagctgaaacaccactgcatacgcgtggcgctttag

SEQ ID NO: 24355 - DNA, 1611 bp, Artificial Sequence
  Description of Artificial Sequence: Synthetic coding sequence
atgaacgccagcctggagagcctgtacagcgcctgcagcatgcagtctgatacggtcccactcttacagaacggccagcacgcccggagccagcctcgcgctagtggtcctccacgttccattcagccgcaggtcagtcccaggcagcgagttcagcggtcacagccagtgcatattctcgccgtccgccgactacaggaggaagatcagcagtttcggactagtagccttccagcgatcccgaatcctttccctgaactctgtgggcccggaagtcccccggtactcactccggggtccttacctccatcacaagccgccgccaagcaggacgttaaggtcttttccgaggacgggacttcaaaggtggtggagatcctggccgatatgaccgccagagatctatgccaactgcttgtgtacaagagccactgtgtggacgataacagttggacattggtggaacatcacccacacctggggctggagcggtgtctcgaagaccacgagctggtcgtgcaggttgaatcaaccatggctagcgaaagtaagttcttgttcaggaaaaactacgctaagtacgagttttttaaaaaccccatgaacttcttccccgaacagatggtgacctggtgccagcaaagcaacggcagccagactcagctgctgcagaattttttgaattcatcttcttgtcctgagatccaaggattcctgcacgtgaaggaactcgggaaaaagagttggaagaagttgtatgtgtgtctacggcgatcagggctatattgttccacgaaaggcacaagcaaggagcccaggcatctgcagcttctggccgacctcgaggatagcaacattttttctttgatagcagggagaaagcagtacaatgctcctacagatcacggtctgtgcattaagcccaataaggttcgcaacgaaaccaaggaacttagattgctctgcgcagaggatgagcaaacaaggacctgttggatgaccgcattcagattacttaagtacgggatgctgctgtaccagaattaccgcatccctcagcagagaaaggccctcctttctccttttagcactcccgtgcgttccgtgtcggaaaactcacttgtggccatggattttagtggccaaacaggacgggttatcgaaaatccagctgaggctcaatccgctgctctggaggaagggcacgcttggagaaaacgttccactagaatgaatattttggggtcccagtcccctctgcacccaagtacactgagtaccgtgatccatcggacacaacactggttccacggtcggatcagtcgcgaggaaagtcatcgaataataaaacagcagggacttgtggatggactattcctgctccgagactcacagagcaacccaaaggcattcgtgctgactctgtgtcaccatcagaaaataaaaaacttccaaatactgccttgtgaagacgacgggcaaacttttttcagtcttgatgacgggaacacaaaattttctgacctcatacagctcgtagacttctaccagctgaataagggagtactgccatgtaagcttaaacaccactgcataagggtagcgctgtag

SEQ ID NO: 24356 - DNA, 1611 bp, Artificial Sequence
  Description of Artificial Sequence: Synthetic coding sequence
atgaacgccagcctggagagcctgtacagcgcctgcagcatgcagtctgacaccgtccccctgcttcagaatgggcaacatgctcggtctcaaccgcgcgctagcgggccccctaggagcattcagcctcaggtttcgcctcgtcaacgggttcagagaagtcaaccagtccacatcctggccgttcgtcggttgcaagaggaagaccagcaatttaggacctcctcactccctgccattcccaaccccttccctgaactctgtggacctgggtctcctcccgtgctcacaccgggatccctgcctccctcacaggcggccgccaagcaggatgtgaaagtcttttccgaggatggcacttccaaagtagtggaaatattggcagatatgactgccagagatctctgtcagctgctagtctacaaaagtcattgcgtggacgacaacagctggacacttgtcgaacaccacccccaccttgggctggaacgatgccttgaggaccacgaacttgtggtgcaagtggagagcaccatggcatctgagtctaaatttctcttcagaaaaaactacgccaaatacgaattttttaaaaaccctatgaattttttccccgagcagatggtgacctggtgccagcagtccaatgggtcccagacgcagttgctgcagaattttcttaattcttcctcatgccctgaaattcaaggcttccttcacgtgaaggagctgggcaagaagtcttggaagaagctgtatgtgtgcctgcgcaggagtggactatactgttctacaaaggggacctcgaaggagccacggcatttacaactgctggctgaccttgaagatagcaatattttttcactgatcgcaggcagaaagcagtacaatgccccaaccgaccacggattgtgtattaaaccaaacaaagttcgaaacgaaaccaaggagcttaggttactgtgcgccgaggacgagcagaccaggacctgctggatgacggcttttcgcttgctgaaatatggaatgctgctgtaccagaactaccgtatcccccagcagcggaaggcacttctgtcacctttttctaccccggtcaggtcggtctctgagaactcactggttgctatggacttctctggtcaaaccggtcgagtgattgagaatccagccgaggcacagtcagccgccttggaggagggccacgcttggcgtaagcgctctactagaatgaacatcctcggctctcagtctccactgcaccctagcactttaagcacggttatccaccgaacacagcactggttccatggaaggatcagtagagaagaatcccaccgaattattaaacaacaagggttggtggatggtcttttccttttgcgcgatagccagtcaaaccctaaagccttcgtcctgacactctgtcatcaccagaaaataaagaacttccagatcctgccctgtgaggatgacggccaaactttttttagtctggacgacggtaataccaagttcagcgatctcattcagctggtggacttttaccagcttaataagggcgtgctcccctgcaagctgaaacatcattgcattagggttgcactgtag

SEQ ID NO: 24357 - DNA, 1767 bp, Artificial Sequence
  Description of Artificial Sequence: Synthetic coding sequence
atgcaggccgccggccccctgttccggagcaaggacaaggtggagcaaacgccacgcagtcagcaggacccagccggccctgggttacctgcacagagcgatcgcctggccaatcaccaggaggacgacgtggatctagaagcactggtgaatgacatgaacgcctccctcgagtccttgtatagcgcctgttccatgcagtcagacacggtgccactcctccagaacggacagcacgcccggagccagccaagagcttccgggcccccccgttctatccagccccaagtgtctccccgccaaagggtgcagcggtcacagccagtccatattctggcggtccgccgactgcaggaggaggaccagcagtttcgtacaagcagtctgccggcaatcccaaaccctttcccagagctgtgcggaccgggaagcccgcctgtgctgacccctggatccttgcctccctctcaggcagcagctaagcaagacgtcaaggtgttctcagaggatgggacaagcaaggtcgtggaaattttagcagacatgacggctcgtgatctctgccagctgctcgtgtataagtcacactgtgtggacgacaatagttggactcttgtggagcaccacccgcaccttggcctggaacgctgcttagaagaccatgagcttgttgtgcaggttgaatctaccatggccagcgagtcaaaattcttgtttcgcaaaaactacgctaaatacgagtttttcaagaatcccatgaatttcttccctgaacaaatggttacttggtgtcagcagtccaatgggagtcaaacccagctgctccaaaacttcctcaattccagctcctgtcctgagatccaaggctttctgcacgtaaaggagcttggaaagaagtcatggaaaaagctctacgtgtgtttacggcgatcaggactttattgcagcaccaagggcacttcaaaggaaccgcgccacttgcagctcctggctgacctggaagactctaacattttctctcttattgcagggcgcaagcagtataatgctcctacggatcacggtctttgtattaaaccaaacaaggtgcgcaatgaaacaaaagaactaaggttattgtgtgcagaggacgagcagacccggacctgttggatgaccgccttccgactactgaaatatggcatgctgctttatcagaattataggatcccgcaacagaggaaggccctgctgagcccattcagtacaccagtgaggtcggtaagtgagaactcactggtggccatggatttctctggccagaccgggagagtgattgagaaccccgctgaggcacagagtgctgctctcgaggagggacacgcatggcgcaagaggagcacacgcatgaacatcttaggctcccaatctcctctgcatccatcgaccctgtcgacagtgatacatcggacccagcactggttccatgggcgcataagtcgcgaagaaagtcatcgaatcataaaacagcaggggcttgtggacggacttttcctgctaagagactcccagtcgaatcccaaggctttcgtcctgactctctgccaccatcagaagatcaaaaattttcagatcctgccatgtgaggatgatggacagacttttttctccctggacgatggaaacactaagttttcggacctcatacagctggtggacttctaccaactcaataagggggttcttccatgtaaactaaagcatcactgcatccgggtagcactgtag

SEQ ID NO: 24358 - DNA, 1611 bp, Artificial Sequence
  Description of Artificial Sequence: Synthetic coding sequence
atgaacgccagcctggagagcctgtacagcgcctgcagcatgcagagtgataccgtccccctactgcagaacggtcaacatgccaggtctcaaccacgtgcctcggggccgcctcgcagcatccagccccaggtaagccctcggcagcgggttcaaagatctcaaccagtgcatattctggctgtgaggaggttacaggaagaagaccagcaatttcggacaagtagcctgcctgctattccaaacccttttcccgagctgtgtggaccgggctcaccccccgtcctcactccagggagcctccctccctctcaagccgcagcaaagcaagatgtgaaggtcttctccgaggacgggacttcaaaggttgtggaaatactggcagatatgacggctcgggatctgtgccagttgctagtgtacaagtcccattgcgtcgacgacaatagctggacactggtagagcatcacccacacttaggcctagagcgctgtctggaagatcacgagctagtcgtgcaggtggagagcaccatggcctccgagagcaaattcttgtttcgtaaaaactacgctaagtacgaattttttaagaatccaatgaatttcttcccagaacaaatggtcacgtggtgccagcaatcaaatgggtcccaaacgcagctgctacagaatttcctgaattcttccagttgcccagaaattcagggcttcctgcatgtcaaggagctaggtaagaaatcctggaagaaactatatgtgtgcctgaggcggagcggattgtactgtagtaccaaaggtacaagcaaggaaccccggcatttgcagctcctcgctgacctggaagattcaaacatttttagcctcatcgctggaagaaagcaatataacgcccccactgaccacggactgtgtataaaaccgaacaaagtgaggaacgagaccaaagagctccgtctgttgtgcgccgaggatgagcagactaggacctgctggatgacagccttccgattactcaaatatggcatgctgctgtatcagaattatcgtatccctcagcagcgaaaggcgctccttagcccctttagcacgccagtccgcagcgtgtctgaaaacagcctggtggccatggatttctcaggtcagaccgggcgggttattgagaatcctgccgaggcccagagtgctgccctcgaagaaggccacgcctggcgaaagcgatccactcgcatgaacatactcggatctcagtcgcctctgcacccctcaaccttatcaactgtcatccacagaacccagcattggtttcatgggcggatttctcgcgaagaaagccaccgaattataaaacaacagggtttagtggatggtctttttctgctcagagactcgcagtccaacccaaaggctttcgtgctgaccctgtgtcaccaccaaaaaattaagaattttcagattctgccttgtgaagatgacggccagacctttttctcccttgatgatggcaacacaaaatttagcgatctcatccagcttgtagatttttaccagcttaataagggagtgcttccctgcaaactgaaacatcactgcattcgagtggccttatag

SEQ ID NO: 24359 - DNA, 1611 bp, Artificial Sequence
  Description of Artificial Sequence: Synthetic coding sequence
atgaacgccagcctggagagcctgtacagcgcctgcagcatgcagagcgacactgtgcccctactccaaaatggccagcatgctaggagccagccgagggcttctggaccgcctcggagtatccagcctcaggtcagccctcggcagcgagtacagaggagccaaccagtacatatactggctgtgagacgattgcaggaggaagatcaacagttccgaaccagctctctgcccgcgattccaaatcctttccccgagctgtgtggccctggcagtcctcctgtcctgacaccgggaagcctgcccccttcacaggcggcggcaaagcaagatgtcaaagtattttctgaggatggaacctcaaaggtggtcgaaatcttagctgacatgaccgcaagagacctgtgtcagctactcgtgtataaaagccactgcgtggatgacaactcttggacactcgtggagcaccacccgcacctgggactcgagcgctgccttgaagaccatgagctcgtggtccaagtggaatctaccatggcctctgaatcaaagttcttgttccgtaaaaactatgcaaagtacgagttttttaaaaaccctatgaattttttccccgaacagatggtgacctggtgccagcagtctaatggctcccagacccagcttctgcagaatttccttaactcctcttcttgccccgaaattcaggggtttctacatgtgaaggagctaggaaagaaatcctggaaaaaactgtatgtgtgcctccggagatcaggactctactgctccaccaagggcacttcgaaagagcctcgccatttgcaattactcgccgaccttgaggattcgaatatattcagtttaattgccgggcgtaaacagtataacgcccctaccgaccacggtctgtgtatcaagcctaataaagttaggaacgagacaaaggagctgaggctgctgtgcgccgaggatgagcagactcggacgtgctggatgaccgcgtttcggctgctaaagtacgggatgctgctgtaccagaattataggattcctcaacaaaggaaagccctgctatcaccattcagcacccccgtgaggagcgtttcggaaaattcgttagtcgctatggacttcagcggccaaacgggccgcgtaatcgagaacccagctgaagcccaatccgctgctctggaggaggggcacgcttggcgaaaacggtctacgcgcatgaacatcctaggctcccagagccccctgcacccttccaccttaagtactgtgatccatcgaacgcagcactggttccacggccggatatccagagaggaatcgcatcggatcattaaacaacaggggctagtggacggactctttctgctgcgagattcacagtccaacccaaaagcgttcgtgttgacactgtgtcatcatcagaagatcaagaacttccagattcttccctgcgaagatgatggccagacctttttctcactggatgacggtaatacaaagttctcagacctgatccagctcgttgacttctaccaactgaacaaaggggtactgccatgtaaactgaaacatcattgtatccgggtggctctttag

SEQ ID NO: 24360 - DNA, 345 bp, Artificial Sequence
  Description of Artificial Sequence: Synthetic coding sequence
atgcaggccgccggccccctgttccggagcaaggacaaggtggagcaaacccctcgttctcaacaggatcccgcaggtcccggtttaccagcacaaagcgaccgcctggctaatcaccaggaagatgatgtggacctcgaggctttagtgaacgatatgaacgccagtctggaaagcctgtacagcgcgtgttccatgcaatctgacacggtgcccctccttcagaacgggcagcacgccagaagtcaacctcgcgcatcgggtcctcctcgctcaatccagccgcaggtgtccccccggcagcgggtacagagaagccaacccgtccatatattggccgtgtag

SEQ ID NO: 24361 - DNA, 1767 bp, Artificial Sequence
  Description of Artificial Sequence: Synthetic coding sequence
atgcaggccgccggccccctgttccggagcaaggacaaggtggagcaaacacccaggtctcagcaggatccggccggcccagggttgccagctcagagcgacaggctggccaaccatcaggaagacgacgtggatctggaagcgctagtgaacgatatgaacgcttccctggaaagtctctacagcgcttgctctatgcaatctgacactgtccctttgttgcagaacgggcaacacgcacgctctcagcctagggcaagcggccctccaaggagcattcagccgcaggtgagtcctcgacagagagtgcagagaagccagcccgtccatatactagctgtcagacggttacaggaagaggaccagcagttcagaacaagttccctgccagcgatacctaatcccttccctgagctgtgcggccccggatccccacctgtactgacccccggatccctgcccccgagccaagccgccgcaaagcaggacgtgaaagtctttagtgaagacgggacctctaaggtcgtagaaattctcgcagatatgaccgctcgcgatttgtgtcagttactggtctacaagtcccactgcgtcgacgacaatagctggaccctggtagaacaccatccgcacctggggctcgagcgttgcctggaagatcatgaattggtagtccaggtggagagcaccatggctagcgaatctaaatttttgttccgaaagaactacgctaaatatgagttctttaaaaaccccatgaatttcttccctgagcagatggtaacgtggtgtcagcaatccaatggcagtcaaactcagctgctgcagaatttcctgaatagcagctcgtgccccgagatccagggctttctccatgtaaaggaactaggaaagaaaagctggaaaaaactgtacgtttgccttagaaggtccggactttactgctctactaaaggaacttcgaaagaaccgagacatctgcagctcctggcagatcttgaggattctaatatctttagtctcatcgcaggccgcaagcagtacaacgcgcccacagaccatggactgtgtatcaagcctaacaaggtgagaaacgaaaccaaggaactgcgcctgctctgtgccgaagacgagcagacccggacctgctggatgacagccttccgactcctgaaatatggcatgctgttgtaccagaactacagaattccgcagcagaggaaagccttgctcagccccttctcaactcccgtgaggtctgtttcggaaaattcccttgtagccatggatttctcaggtcagactggcagggtgatcgagaaccctgctgaggcacagtccgctgctctcgaggagggccacgcttggagaaagcggtctacccggatgaatattctcggatctcagtcaccgctgcacccatccacgctgagtaccgtgatccatagaacccaacattggtttcatggcaggattagccgagaggaatctcaccggattatcaaacaacaggggctggtggacggtttgtttctcctccgtgattcccagagcaatcctaaagcctttgtcctcactctgtgccaccaccagaaaatcaagaacttccagatcctcccctgcgaggatgacggccaaacatttttctctttagacgacggtaataccaagttctcagaccttatccagcttgtggatttttaccagctaaacaaaggggtgctgccatgcaagctcaagcatcattgcatcagggtggcactgtag

SEQ ID NO: 24362 - DNA, 531 bp, Artificial Sequence
  Description of Artificial Sequence: Synthetic coding sequence
atggaggccatcgccaagtacgacttcaaggccaccgccgacgacgagctgagctttaagagaggcgacatcctcaaggtcttaaatgaagaatgtgatcagaattggtacaaagcagagttaaacggcaaagatggctttattcccaagaactacattgagatgaaacctcacccgttcggcaacgatgtgcagcacttcaaagtgctgagggacggagctggaaagtactttctttgggtggtgaagtttaattctctgaatgaactggttgattaccacagatcaaccagtgtctcccgaaatcagcagatctttcttagagacatcgaacaggtgcctcagcaacccacatacgtacaggctctgttcgatttcgacccgcaagaggacggggaacttggctttcgaaggggcgactttatccatgtgatggacaattctgaccccaactggtggaagggcgcctgccatggacagacaggcatgttccccaggaattacgtcacgcctgtgaaccgtaacgtttag

SEQ ID NO: 24363 - DNA, 654 bp, Artificial Sequence
  Description of Artificial Sequence: Synthetic coding sequence
atggaggccatcgccaagtacgacttcaaggccaccgccgacgacgagctgtcgtttaagaggggtgatattctgaaggtgcttaatgaagaatgtgaccagaactggtataaagctgaattgaacggcaaggatggtttcatccccaaaaattatattgagatgaaaccccacccttggttcttcgggaaaattccacgggcaaaggctgaggagatgctgtccaagcagcgacacgatggcgctttcttaatccgcgagtctgaatccgcacccggcgacttctctctgtccgtgaaattcggcaatgacgtgcagcatttcaaagtattgagggacggagccggaaaatatttcctgtgggtggtgaagtttaactcactgaacgagctcgtggactaccaccgcagcaccagtgtgtctaggaaccaacagatctttctcagggacattgaacaggtccctcaacagcccacatacgtccaggcattatttgactttgaccctcaagaagacggggagttgggcttcaggaggggggacttcattcacgtgatggacaatagtgacccaaattggtggaaaggagcttgtcacggacagaccggtatgttccccagaaattacgtgacaccagtgaacagaaatgtctag

SEQ ID NO: 24364 - DNA, 654 bp, Artificial Sequence
  Description of Artificial Sequence: Synthetic coding sequence
atggaggccatcgccaagtacgacttcaaggccaccgccgacgacgaattgtcattcaaacggggcgacatactgaaggtactcaatgaggaatgtgaccagaattggtacaaggcagaactgaacgggaaggatggatttatcccaaagaactacatcgaaatgaaacctcacccctggttctttggaaagatcccacgggcgaaggctgaggagatgctttccaagcaacgccacgatggcgccttcctaatccgagagtccgaatcagcccccggagactttagcctgagcgtaaaattcggaaacgacgtccagcacttcaaagttctgcgtgacggggccggcaaatactttctgtgggtggttaaatttaatagtctcaatgagctggtcgattatcaccgaagtacaagtgtctcaagaaatcagcagatcttcctcagagatatagagcaggtgccacagcaacctacatacgtccaagcactgttcgacttcgaccctcaggaggacggtgagctgggctttcgacgcggagatttcattcatgttatggacaattcagatccaaattggtggaagggagcatgtcacggtcagaccgggatgtttccccgaaattacgtcacccccgtgaaccgaaacgtgtag

SEQ ID NO: 24365 - DNA, 654 bp, Artificial Sequence
  Description of Artificial Sequence: Synthetic coding sequence
atggaggccatcgccaagtacgacttcaaggccaccgccgacgacgagttaagctttaaaagaggcgatatcctcaaagtcttaaacgaagagtgcgatcaaaattggtacaaagcggaactgaatggaaaggacggcttcatcccaaaaaactacattgagatgaagccgcacccatggttcttcggcaagattccccgggcaaaagcggaggaaatgttgagtaaacaaaggcacgacggtgcctttctaatcagggagtccgagtccgcacctggcgactttagtctcagtgtcaagttcggcaacgatgtgcagcacttcaaagtgcttcgagatggggccgggaaatactttctctgggtggttaaatttaacagcctgaatgaactggtggactaccacaggtccacatctgtgtcgcggaaccagcagatttttctgagagacattgaacaggttcctcaacagcccacctatgtccaggccctgttcgactttgatccacaggaggacggcgagttaggattcagaaggggggacttcatacatgttatggataacagcgacccaaactggtggaagggcgcttgtcatggccagactggaatgttcccccggaattatgtcactcccgtaaataggaatgtttag

SEQ ID NO: 24366 - DNA, 222 bp, Artificial Sequence
  Description of Artificial Sequence: Synthetic coding sequence
atgcccgccctgcacatcgaggacctgcccgagaaggagaagctgaagatggaagtcgaacagctgcggaaggaggtgaaattacaacgtcagcaggtgagcaagtgctctgaggaaattaagaattacatagaagaaagatccggggaggaccccttagttaaggggattccagaggacaagaatccttttaaggagaaggggagttgcgtgatctcttag

SEQ ID NO: 24367 - DNA, 432 bp, Artificial Sequence
  Description of Artificial Sequence: Synthetic coding sequence
atgagcggccggggcaagaccggcggcaaggcccgggccaaggccaaatcaagaagcagccgggccggactgcagttccctgtggggcgggtgcacagattgcttaggaagggccactatgcagagagggtgggcgcaggagccccggtttacctcgccgcagttcttgagtatttgaccgccgagattttagagctggcaggtaatgccgctcgggataataaaaaaacccgaatcattccaaggcatctccagctagccatccggaatgacgaagaactgaataaactgctgggaggcgtcacaatcgctcaggggggagttcttcctaatatccaggctgtgctcctgcccaagaagacatctgctacagttggcccaaaggccccgagcggaggcaaaaaggctacccaggcttcccaagagtattag

SEQ ID NO: 24368 - DNA, 432 bp, Artificial Sequence
  Description of Artificial Sequence: Synthetic coding sequence
atgagcggccggggcaagaccggcggcaaggcccgggccaaggccaagtcgcgaagcagccgggccggcctgcagtttccggtcggacgagttcacagactcttacggaaaggacattatgctgagagggtgggggccggagcacctgtgtatcttgctgctgtcctcgagtatctcacagctgagatcctggaacttgccggaaatgccgcccgtgataataagaaaacccgaatcataccacgccatttacagcttgctatcagaaatgatgaggaattgaacaagctcctcggaggcgtgaccatcgcgcagggcggagtcttaccaaatatccaagccgtgctgttgccgaaaaagacttcggccactgtagggccgaaagccccttccggcggtaagaaagcaacacaagctagccaggaatactag

SEQ ID NO: 24369 - DNA, 276 bp, Artificial Sequence
  Description of Artificial Sequence: Synthetic coding sequence
atgtgcccctgccccctgcaccggggccggggcccccccgccgtgtgcgcctgctctgcggggaggcttggtctgcgtagtagtgcagctcaactaaccgccgcgcgcctcaaggccctcggagatgagctccaccagagaactatgtggaggaggcgtgctaggtcaaggagagccccagcccctggtgcactgcctacgtattggccttggctatgcgcagctgcccaggtcgcggccctggcagcatggctcctcggacggcgtaacttatag

SEQ ID NO: 24370 - DNA, 618 bp, Artificial Sequence
  Description of Artificial Sequence: Synthetic coding sequence
atgaccgagcggcgggtgcccttcagcctgctgcggggccccagctgggatcccttccgggactggtatcctcacagccggctctttgaccaggcattcggcctgccccgacttccggaggagtggtcccagtggctgggcggctcctcttggcccggctacgtccgccccctccctccagccgctatcgagtcccctgccgtggctgcccccgcttactccagagccctgtctaggcagcttagcagtggtgtcagtgagattcggcatacagcagatcggtggagagtatcgctcgatgtgaaccattttgcgccagacgaactcaccgtgaagacaaaggatggcgttgtggagataacggggaaacatgaggaacgacaggatgaacacggatatatttcgcgctgtttcaccaggaaatacactctgcctccgggggttgaccccacccaagtgtcttcaagtctgtcccctgagggaacgctgactgtggaggctcctatgccaaaactggcaactcaaagtaatgaaatcaccatccctgtgactttcgagtcaagggcccagctcggcggacccgaggctgctaagtcagatgagaccgcagccaagtag

SEQ ID NO: 24371 - DNA, 513 bp, Artificial Sequence
  Description of Artificial Sequence: Synthetic coding sequence
atgaccgagcggcgggtgcccttcagcctgctgcggggccccagctggcccggctacgttaggcctcttcctccagcagcaatcgaatctcctgctgtggccgccccggcttactctcgagctctctcgcgacagttgtcctcaggtgtctcggaaatccggcacacagccgatcgctggagagtctcactggatgtgaaccatttcgcgccagatgaactgaccgtgaaaacaaaggatggagtagtggagatcactggcaaacacgaagagcggcaagacgagcacggctatatttctagatgctttaccagaaaatataccctgcctcccggagtcgaccctacacaggtatccagttcgctctctcccgagggtacgttaacggttgaagctccaatgccaaaactcgctacccagagcaatgagatcacaattccagtgacctttgaatcacgggcccagcttggcggcccagaagcggctaagagtgacgagaccgccgctaagtag

SEQ ID NO: 24372 - DNA, 1926 bp, Artificial Sequence
  Description of Artificial Sequence: Synthetic coding sequence
atggccaccgccaagggcatcgccatcggcatcgacctgggcaccacatactcctgcgtcggggtgtttcagcacggcaaggtggagattattgcaaacgatcagggcaacaggaccacaccgagctacgtggccttcaccgatactgaaaggctgattggagatgcagccaagaatcaggtggctatgaacccacagaataccgtgtttgacgctaaaaggctgattggccgcaagtttaacgacccagtggtgcaggcagatatgaagttgtggccctttcaagtcatcaatgaggggggcaaacccaaggtgctcgttagttacaagggcgaaaacaaggccttttaccctgaagagatctccagtatggtactcaccaagctgaaagaaacagctgaagccttcctcgggcatccagtaacaaacgccgttatcacagtgcccgcctattttaatgacagccagagacaagccactaaggatgcgggggtaatcgcaggcctgaacgtactgagaattattaacgaaccaacagccgctgctattgcatacggcctggataaggggggccaaggcgaaaggcacgtcctgatcttcgacctggggggagggacatttgatgtgtccatacttaccatcgatgatggaatatttgaggtgaaggcaacggccggagacacccacctaggaggcgaggactttgacaaccgcctggtgagccacttcgtggaggagttcaaacgaaagcacaaaaaggacatctctcagaacaagcgcgcagtccggcggctgaggaccgcctgtgagcgcgcaaagaggacattgagcagctccacccaggccaatctggagattgatagtctgtatgagggaatagatttttatacctctatcaccagagcgcgattcgaggaactgtgcgctgatctatttaggggtactttggaacccgtcgagaaggccctgagggacgccaaaatggataaagcaaagatccacgatatagtgctggtgggaggtagtacgcgcatccctaaggttcagagactgctgcaagattatttcaatggtcgagatcttaacaagtccatcaatcctgacgaggcagtggcctatggagctgctgtgcaggctgcaatcctgatgggggataagtctgaaaaggttcaggatctgcttcttctggatgttgcgccacttagtctcgggcttgaaacagctggaggggttatgaccgctctgatcaaacgcaatagcacgatccctacaaaacagacgcagatctttactacttacagcgacaatcaacctggcgtgctcattcaagtttacgagggcgagcgcgcgatgactaaagacaacaacctgctgggccgtttcgacctgactgggatcccaccagcccctagaggcgtgccacagatcgaggttacatttgatattgacgcaaacggcattctcaacgtcacagccatggataaatctactggtaaagtaaacaagataacaataacaaacgacaaagggcgtctctctaaagaggaaattgagaggatggtactcgatgctgaaaagtacaaagctgaagacgaggtccagcgcgagaaaatcgcagccaaaaacgccctggaatcttacgcattcaacatgaagtcagtcgtgtcagacgagggactgaaggggaagatatccgagtccgacaagaataagattttggataaatgcaatgagttgcttagctggctcgaggttaatcagctcgcagagaaagatgaattcgatcacaaaagaaaagaactgaagcagatgtgcaacccaatcatcacaaagctttaccagggagggtgcaccgggccagcctgcgggacagggtatgtcccaggtcgccccgccaccggaccgaccatcgaggaggtcgactag

SEQ ID NO: 24373 - DNA, 1599 bp, Artificial Sequence
  Description of Artificial Sequence: Synthetic coding sequence
atggccaccgccaagggcatcgccatcggcatcgacctgggcaccacatattcgtgcgtgggggtgtttcaacatgggaaggtcgaaatcattgctaatgatcaggggaaccgcaccactcctagctacgttgcattcacagacacagagcggcttatcggagacgcagccaaaaatcaggtcgcgatgaatccccagaacaccgtgtttgacgccaaacgattgattgggcgtaaattcaatgaccccgttgttcaggctgacatgaagctgtggccgtttcaggtgatcaatgagggaggcaagccgaaggttctagtgtcatataagggggagaacaaagcattttatcccgaagaaatctcatctatggtgttaacaaaattgaaagaaactgcagaggcatttttgggacatcctgtgactaatgcagtaattaccgttcctgcctactttaatgactctcagcgccaggctactaaggacgccggggtcattgcagggttgaacgtgctgagaatcatcaacgagccaaccgcagcagccattgcatacggcttggataagggaggtcagggagagcgccacgtcctgatttttgaccttggagggggaacatttgatgtttccatactcacaatcgacgacggcatctttgaagtcaaggctacagctggcgatacccacctcggaggagaagattttgataacagactcgtgtcacacttcgtcgaggaatttaaacggaagcacaagaaggacatctcacagaataaaagagccgtgagacgcctgcgcaccgcatgcgagcgagctaagcgcactctgagttccagcacacaggccaatctggagattgacagcctgtatgagggaatcgacttttatactagcatcacgcgggctcggtttgaagagctctgtgcagacctgttccggggcaccctcgaaccagtggaaaaggcccttagggacgccaaaatggataaggcaaagatacacgatatagtcctggtaggcggatccacccggatcccaaaggtgcagaggcttcttcaggactacttcaacggacgcgatctgaataagtccattaatcctgacgaggctgtagcttacggagccgcagttcaggccgcaatcttgatgggtgacaaaagcgaaaaagtgcaggacctcttgctgctggacgtggctcctctctctctcggcctggaaacggccggcggcgttatgaccgcactcatcaagaggaatagcaccattcccacaaagcagacccagatcttcaccacatactctgacaaccaacccggggtgttgatccaagtgtatgagggagagcgtgcaatgactaaggacaataatcttctggggagattcgatttaacagggatcccccccgccccaagaggagtaccccagatcgaggtgacattcgacatcgatgctaacggcatcctgaacgtgactgcgatggataaatctactggcaaggtaaacaagatcactattactaatgataagggaaggctgtccaaggaagagatcgagcgcatggtgttagatgccgaaaagtataaggccgaggacgtatag

SEQ ID NO: 24374 - DNA, 1926 bp, Artificial Sequence
  Description of Artificial Sequence: Synthetic coding sequence
atggccaccgccaagggcatcgccatcggcatcgacctgggcaccacctacagttgcgtgggagtcttccagcacggcaaggtcgaaatcattgctaatgaccagggcaacaggaccacccccagctacgtggcattcactgacactgaacggctgatcggtgatgctgctaaaaatcaggtagccatgaatcctcagaatacggtattcgacgcaaaaaggctgatcggacgtaagtttaacgaccccgtggtacaagccgatatgaaattatggcctttccaggtgataaatgaaggggggaagccgaaggtgctggtctcctacaagggcgaaaacaaggctttctaccctgaggaaatctctagtatggtactaacaaagctgaaagagaccgctgaagctttcttgggtcatccagtgactaacgctgtgatcacagttccagcgtactttaacgatagccagcgacaagcgaccaaggacgcgggcgtaatcgctggcttgaatgtgcttagaataataaatgagccaaccgctgctgcaattgcatatgggctcgataagggaggacagggggaaaggcatgtattgattttcgacctcggcggggggacatttgacgtgtcaatactgacaattgatgatggtatatttgaggtgaaagccaccgccggcgatacccatctaggaggcgaagactttgataatcgcctggtaagtcactttgtcgaggaattcaagagaaagcataagaaagacatttcccagaacaagagggctgttcgccgcctaaggaccgcctgtgaaagagccaagcgcacacttagctcgtcaactcaagcaaacctggagatagacagcctctacgagggcatcgatttttataccagtattactcgcgcacgttttgaggaactgtgcgccgacctgtttagaggcaccctggagccagtggagaaggctcttcgggacgcaaagatggataaggcaaagattcatgatattgtgctggttggcggatctacccggattcccaaggtccagaggttactccaggactacttcaacggaagggacttgaacaagtctatcaatccagatgaagctgtggcctatggcgcagcagttcaggcggcaattctgatgggagacaagagcgagaaagtccaagacctcctgctactggacgtcgcacccttgtcgctgggccttgagactgccggaggcgtgatgacagcactgattaagaggaatagtaccattccaaccaagcagacccagatcttcacaacttacagcgataaccagccgggggttctaatccaggtgtacgaaggggaacgcgctatgacgaaggataacaatctcctgggccgattcgatttaactggcattccgcctgccccccggggtgtgccgcagattgaggtgacatttgacattgacgccaatggaatcctaaatgtgacagccatggataagagcacaggcaaagttaacaaaattactattacgaatgataagggaaggcttagcaaggaagaaattgaacggatggtgctggacgcagagaagtataaagctgaagatgaggtccaaagagagaaaattgctgcaaagaatgcactggagtcatacgctttcaacatgaagagtgtcgtgagtgatgagggcctcaaggggaagattagtgaatccgacaaaaacaagatattggataagtgtaatgaactgctcagctggcttgaagtcaatcagttagcagagaaagacgaatttgaccacaagagaaaggagctcaagcagatgtgcaatcctatcattacgaaactttaccaaggcggctgcacaggcccagcctgtggcactggatatgtaccgggaagaccggcaaccggaccaaccatcgaggaggtggattag

SEQ ID NO: 24375 - DNA, 699 bp, Artificial Sequence
  Description of Artificial Sequence: Synthetic coding sequence
gccaagggcatcgccatcggcatcgacctgggcaccacctacagctgtgtgggggtgtttcaacatgggaaggtggaaataattgccaatgaccaaggaaataggactacgccatcctatgtggctttcaccgataccgagcgcctcatcggagatgccggtgtaatcgccgggttgaacgtcctgagaatcataaatgaacccactgccgccgcaatagcttacgggctggacaagggcggacagggcgagaggcacgttctgatctttgatcttgggggagggacctttgacgtttccattctgaccatagatgatggtatcttcgaagtcaaggccacagctggtgacactcaccttggcggcgaagatttcgacaatcgcctggtatcgcatttcgtggaagaatttaaaaggaagcataagaaggacatcagtcagaacaagcgagcagtgcggaggctgcgtaccgcatgcgagcgtgcgaagaggacgttgagctccagcacccaagccaacttagaaattgacagtctgtacgaggggatcgatttctacacctcaataacgcgcgccaggttcgaggaactctgtgctgatctctttcgcggcaccctggagccagtggaaaagggggctcctcccgcctcaccgcgctgtagcggatgtttcaggaccacttcaatggatgtcatttag

SEQ ID NO: 24376 - DNA, 1074 bp, Artificial Sequence
  Description of Artificial Sequence: Synthetic coding sequence
atgaaggagaacaaggagaacagcagccccagcgtgaccagcgccaatctggaccacaccaaaccatgttggtactgggacaagaaggatcttgctcacaccccttctcagctcgaaggactcgaccctgcaacagaggcaaggtaccgacgagaaggtgcccgctttattttcgatgtgggtactaggctgggattgcattacgacaccctggcaacagggataatctacttccaccggttttacatgttccacagctttaaacagtttcccagatatgttaccggagcctgctgcctgtttttggcaggcaaggttgaagaaaccccaaagaaatgcaaggacatcatcaagaccgctcgctcccttcttaatgacgtacagttcggtcagtttggagatgatccgaaggaagaagtgatggtcctcgagcgaatcttactacagacgataaagttcgaccttcaggtggaacatccctaccagtttctcttgaaatacgcgaaacagctgaagggggataagaacaagatccagaaactggtgcaaatggcttggacctttgtgaatgaccgaacgtcactgtgtacaacgttgagtctgcagtgggaacccgaaatcattgctgttgcggtgatgtacctagccgggagactgtgtaaattcgagattcaggaatggacttccaagccaatgtatcggagatggtgggagcagtttgttcaagacgttccagtagatgttctcgaggacatatgccaccagattttagatctgtattctcaggggaaacagcagatgccccaccataccccccaccagttacagcagcctcctagcctacaacctaccccacaggtgcctcaggtgcagcagtcccaaccaagccagtcatcagaaccaagtcagccccaacaaaaggatcctcccctcattctactgcagggctgggcttgcagacagcccgctactcacctgctccccagcccactcgaggattcactgctgtgtccacgtccctttcctcacccagcatgtctgcagctggggggatggggagggcagcctggatag

SEQ ID NO: 24377 - DNA, 2565 bp, Artificial Sequence
  Description of Artificial Sequence: Synthetic coding sequence
atgcccccctgcagcggcggcgacggcagcaccccccccggccccagcctgcgagatcgtgactgtcctgcccagagtgccgagtatcctagggataggttagatcctcgtccaggttctcccagcgaagcgtccagccctccattcttgcgttccagggcacccgtgaattggtaccaagagaaagcacaggtgtttctgtggcacttgatggtttctgggagtaccaccctcctctgtctttggaaacagcctttccatgtgagtgcctttcctgtgacggcttcacttgctttcagacagtcccagggcgcaggacaacacttatacaaggacctgcaacctttcattctgcttaggctgctcatgccagaggagacccagacccaggaccagcctatggaagaggaagaagttgaaacatttgccttccaggctgaaatcgcgcagctgatgtcccttattatcaataccttctactccaataaagaaatcttcctgcgcgagctgattagtaacagttctgacgccctggacaagattcggtacgagtctctgacagatcctagcaaactggatagtggaaaggagttacatattaatctgatccccaacaagcaggatcgaactctcaccattgttgataccgggatcgggatgactaaagccgatctaatcaacaatctgggcaccatcgctaagagcgggactaaggcattcatggaagccctgcaggccggggcagacatcagcatgattgggcagtttggtgtgggcttctacagcgcgtacctggttgccgaaaaggtcacagtgattacaaagcacaacgatgacgagcagtatgcgtgggaatcctcagccggtggatcgttcaccgtgcgcacggatacaggcgagcccatgggccgcggaacaaaggtgattctccatctgaaagaggaccagacggagtacctggaggagagacgcatcaaagaaatagtgaagaagcacagccagtttattggataccctatcactcttttcgtggaaaaagagagggataaagaggtatctgatgatgaggcagaagagaaggaagataaagaagaagaaaaggagaaggaggaaaaagagtctgaggataagcccgagattgaagacgtcgggagcgacgaggaggaggagaagaaggacggggataagaaaaagaaaaagaaaatcaaggagaaatacattgaccaggaggagctgaataaaacaaaacctatttggacgcggaatcctgatgacatcaccaacgaggaatacggcgaattttataagtcacttaccaacgactgggaagaccatctagcagtgaagcacttctctgtcgaaggccagctggaattccgggctctgttatttgtcccacggcgggcaccctttgacctgttcgaaaatcgcaaaaaaaagaataacataaagctatatgtgcggagggtgttcatcatggataactgtgaagaactgatcccagagtatctgaactttatcagaggggtggtggacagcgaggatctccctctgaatataagcagagaaatgttgcagcaaagtaagatattgaaagtgatccggaaaaatctggtgaaaaagtgtctagagttgtttacagaacttgcagaggacaaagaaaactacaagaagttctacgaacaattctccaaaaacattaaactcggtattcacgaagatagtcagaaccgcaagaaactcagcgaactcctcagatactacacgagtgcatctggtgatgagatggtgtcactaaaggattactgcacgcggatgaaggagaatcagaaacatatctattacatcaccggagaaactaaagatcaggtagccaattccgcttttgtggagcggttgaggaagcatggcctggaggttatttatatgattgagcccatagacgaatactgcgttcagcagctgaaggagttcgagggaaagacattggtttccgtgacgaaggaagggcttgagctccccgaggacgaagaggagaagaagaaacaagaagagaagaagacgaagttcgaaaatctctgcaagattatgaaggacattctggaaaaaaaggtggagaaagtggtagtttccaaccgactcgtcaccagtccctgctgtattgtgaccagtacgtatgggtggaccgccaatatggagcggatcatgaaggcacaggccctgcgtgacaatagcacaatgggctacatggctgcgaagaagcacctggagataaatcccgaccatagtataatcgagactctcagacagaaggccgaggccgacaaaaacgacaaatcggtgaaagacctcgtgatcctgctttacgaaaccgctctgttgtcctctggattcagtctcgaagacccccaaacccatgcaaacaggatctaccgaatgatcaagctcggcctggggatcgacgaggatgatcccaccgccgacgataccagcgctgcggtgactgaggagatgcctcccctggagggagatgatgacacgtctagaatggaggaggtcgactag

SEQ ID NO: 24378 - DNA, 1242 bp, Artificial Sequence
  Description of Artificial Sequence: Synthetic coding sequence
atgggccggggcaccaaggtgatcctgcacctgaaggaggaccagacggaatacttagaggagcgcagaataaaagagatcgtcaagaaacactctcagttcatcggctacccaatcacgttgtttgtggagaaagaaagagacaaggaggtctctgacgacgaggccgaagagaaggaagacaaggaggaagagaaggaaaaggaggaaaaagagtccgaagacaagcctgaaattgaagacgttggttcagacgaggaagaggaaaagaaggacggcgacaagaaaaaaaagaaaaaaataaaggagaaatatattgaccaagaggaactgaacaaaacaaagcccatctggaccagaaatcccgatgacataactaatgaagaatatggcgagttttataagtccctaacaaacgattgggaggatcacttagcagtgaagcactttagtgtggagggacagctcgagttcagggctctgctgttcgtcccgagacgggctccatttgatctgtttgaaaatcgcaagaagaagaataacataaagctgtatgttcggagagtgttcatcatggacaattgcgaggaactgattcccgagtacctgaattttatccgcggagttgtggatagcgaagacctccctctgaatatttctagagagatgctgcagcagtctaagatcttgaaggtcatacgcaagaacctcgttaaaaagtgtcttgagctgtttaccgaactggccgaggataaagagaattataagaagttttacgagcaattcagtaagaatatcaaactgggtatccacgaagactctcaaaataggaagaaactatccgagctgctgcgatactatacgtctgcgtcgggtgacgagatggttagcctgaaggattattgcactaggatgaaagaaaaccaaaaacacatttactacatcacaggagagaccaaggatcaggtggcaaattctgcatttgtggaacggttgaggaaacacggccttgaggtgatttacatgattgaacccattgacgagtactgcgtacaacagctgaaggagtttgagggaaaaacgttggtctcagtaaccaaagaaggactcgaattaccggaagatgaggaggagaaaaaaaagcaggaggagaagaagaccaagttcgaaaatctgtgcaagatcatgaaagacattctggaaaaaaaagtggaaaaggtatgcgagtactctatttcgtag

SEQ ID NO: 24379 - DNA, 2412 bp, Artificial Sequence
  Description of Artificial Sequence: Synthetic coding sequence
atgcgggccctgtgggtgctgggcctgtgctgcgtgctgctgaccttcggatccgtacgcgcggatgacgaggtggatgttgatggtacagttgaggaagatctcgggaagtcacgcgagggttctagaacggatgacgaagtggtgcagcgggaggaggaggctattcaattggatggactcaatgcctcacagatcagggagctgcgagagaaatctgaaaagtttgcctttcaggcggaagtgaatcgcatgatgaaattgatcatcaactccctatataaaaataaggagatcttcctgagggaattgatttctaacgcatccgatgctctggataagatacgattgattagtctgacggacgagaatgcactgagcggcaacgaagagttgaccgtaaagataaagtgcgataaggaaaaaaacctgctgcatgtaaccgacaccggcgtcgggatgaccagagaggaactagtgaaaaacctgggcactattgcaaagtctggaacttccgagtttctgaataaaatgaccgaggctcaggaagacgggcagtctacttcagagctgatcgggcagtttggtgtcgggttctatagtgcttttctggtagcagataaggtgatcgtgaccagtaagcacaataacgatactcagcacatttgggagagcgatagcaacgagttttccgtaattgctgacccccgagggaatacactgggtagaggcactaccataacactggtcttgaaggaagaagcctccgactacctcgaactggacacaatcaagaatttggtcaaaaaatattctcagtttatcaatttcccaatctacgtatggagttctaaaaccgagacggtcgaggagcccatggaggaggaggaagcagctaaagaagagaaggaggagagcgatgatgaagccgcggtagaggaggaagaggaggaaaaaaagccgaagactaagaaggtggaaaagaccgtgtgggattgggaacttatgaacgacattaaacccatatggcagcgaccctcaaaagaggtggaggaggacgagtataaagccttctataagagcttttcgaaagaaagcgatgaccccatggcttacattcactttaccgcagaaggagaggtgacgttcaaatcaatactatttgtcccaaccagtgccccccgtggactgtttgatgagtacggctcgaaaaaatctgattatataaaactctacgtcagaagggtatttatcaccgatgattttcacgacatgatgcctaaatacctgaactttgtgaagggcgttgtcgatagcgacgacctgccgttgaatgttagccgcgaaacccttcagcagcataaactcctgaaagtcattagaaagaaattagtacgtaagaccctagacatgataaagaagattgccgatgataaatacaacgacacattctggaaagaattcggcactaacatcaaacttggtgtcatagaagatcatagcaatcgaactagactggcgaagctcctccgcttccagtcatcacaccacccaacagacataacaagcctggaccagtacgtagagaggatgaaagagaagcaggacaagatttacttcatggctggctctagccggaaagaagcggagtctagtccttttgtcgagcgactgttaaagaagggttatgaagtgatatacctcactgaaccagtggacgaatattgcatccaggcactccctgagtttgacggtaaacgatttcagaatgtcgcaaaagagggcgttaaatttgacgagagtgaaaagaccaaggaaagtagggaagcggtcgaaaaggagttcgaacccctattgaactggatgaaggataaagccctgaaagataagatagaaaaggctgtcgtttctcagagacttactgagagcccatgtgccttagtagccagccagtatggctggtcgggcaatatggaaaggattatgaaggcacaggcgtatcaaacgggcaaagacatatctacaaactactacgcctcacagaaaaagactttcgaaattaaccctcgacatccattgattcgtgatatgctgagaagaatcaaggaggatgaggacgacaagaccgtactggacttggccgtggtactgtttgagaccgcaactttgcggagcgggtacctccttcccgacactaaggcatatggggatcgcatagagcgtatgctccgcctttcgctgaacatcgaccctgatgccaaggttgaagaggagcccgaagaggagcccgaagagaccgcagaggacactaccgaagacactgaacaggacgaggacgaagagatggatgtgggcaccgacgaggaagaggagaccgcgaaagaatccacagccgaaaaagatgaactttag

SEQ ID NO: 24380 - DNA, 1662 bp, Artificial Sequence
  Description of Artificial Sequence: Synthetic coding sequence
atgcgggccctgtgggtgctgggcctgtgctgcgtgctgctgacctttggttctgtgagggcagatgatgaagtcgacgtcgatggaacagttgaagaggacttgggcaaaagtagggaggggtctagaacggacgacgaggcagcaaaagaagagaaagaagagtctgacgacgaggccgcggtcgaggaggaagaagaagaaaaaaaacctaaaacgaagaaggttgaaaaaacagtctgggactgggagctgatgaatgacataaaaccaatttggcagcgaccttcaaaggaggtggaagaggatgaatacaaggccttctataagtccttcagcaaggaatccgacgatcccatggcgtatatccacttcacggctgagggagaagtcacattcaagtcaattctttttgtgccgacttccgctccaagagggctgtttgacgaatatggatccaaaaagtcagattatataaagctgtacgtaagacgggtgttcatcacagacgatttccatgatatgatgcccaaatacctaaattttgtgaaaggtgttgtggacagtgatgacttacccctgaacgtgtctcgtgaaactctgcagcagcataagctactgaaagtcatccgaaagaaactggttcggaagacactggacatgatcaagaagatcgctgatgataaatacaatgatacattctggaaggagtttggaacgaatattaaactgggagtgatcgaggatcacagcaaccggacaaggctggctaaattgctacgcttccagtcaagccatcacccaaccgatattacctcactggaccaatatgtcgagagaatgaaggaaaagcaggacaagatttatttcatggccggctcatcaagaaaggaggcggagagctcacctttcgtggagagactgctcaaaaaaggctacgaggtgatctatctgactgagcccgtggatgaatactgcatacaggctttacctgagtttgatgggaagaggttccagaatgtggcaaaggaaggtgtcaagtttgatgagtctgagaagaccaaagaaagcagagaagcagtggagaaagagttcgagccgcttttgaactggatgaaggacaaggccctgaaagacaagatcgagaaagctgtggtctctcagcgcttaacggagagcccctgcgccttagtggcgtctcagtacggatggagcggcaacatggaaaggatcatgaaagcacaggcatatcaaacaggaaaggatatctcaacaaattactatgcgagccaaaagaaaacatttgaaattaatcccagacaccccctgattcgcgatatgcttcgtcgaatcaaagaagacgaagatgacaaaaccgtgctcgatcttgccgtcgtactctttgagaccgccacactacgtagcgggtaccttctgcctgacactaaggcatacggcgacaggattgagcggatgttgcggctgagcctgaacatcgatccagatgccaaggtggaggaggagccagaagaggaacctgaagaaactgccgaagataccaccgaagacacagaacaggacgaggatgaagagatggacgttggcacggatgaggaggaggagacggccaaagagagtacagccgagaaggacgaattgtag

SEQ ID NO: 24381 - DNA, 948 bp, Artificial Sequence
  Description of Artificial Sequence: Synthetic coding sequence
atgcgggccctgtgggtgctgggcctgtgctgcgtgctgctgaccttcggctccgtgagggcagatgacgaggtcgatgttgacggcaccgtcgaagaggacctgggaaagagccgggaagggtctcgcactgacgatgaggttgtccagcgagaggaggaagctattcaactagatggcctgaatgcctcacagatcagagagctgagagaaaaaagtgagaagtttgcctttcaagcggaggtaaataggatgatgaagttgattatcaattctctgtataaaaataaagagatttttttaagagagctcattagcaatgctagcgacgccttagacaaaatccgcctaatctcacttaccgacgaaaacgccctttctggcaacgaggaactcacagtgaagattaagtgcgacaaagaaaaaaatctcttgcatgtgacagatactggcgtcggcatgactcgggaagaactggtcaagaacctgggaactatagccaagtctggtaccagtgaattcttgaataaaatgacagaggcacaggaagacgggcagtcgacaagcgaactcattgggcagtttggggtcggcttctattcagcctttctggtcgcagataaagtcatcgttacttctaagcataacaacgatacccagcacatttgggagtctgattccaatgagttcagcgtgatcgccgacccacgcggcaataccctgggccgcggcaccacaatcaccctggtactgaaggaagaagccagcgattaccttgagttggataccattaaaaatctggttaagaaatattcccagtttattaatttccctatttatgtgtggagctccaaaactgagaccgttgaggaacccatggaggaggaggaggccgccaaagaggagaaggaggagtccgatgacgaagcagcagcccggcgtagatag

SEQ ID NO: 24382 - DNA, 483 bp, Artificial Sequence
  Description of Artificial Sequence: Synthetic coding sequence
atgagcgaggtgcggcccctgagccgggacatcctgatggagaccctcttatacgaacagttactcgagccacctaccatggaggttctgggaatgacggacagtgaagaggatttggaccctatggaagattttgatagcctggaatgtatggagggctctgatgccctggctctccgtctggcgtgcataggagatgaaatggatgtgtcgctccgagcaccccggcttgcccagttaagcgaggttgccatgcacagtctcgggctggccttcatctatgatcagacggaggacattcgggatgttctgcggtcatttatggatggttttactactctgaaggaaaatattatgagattctggagaagtccgaatccaggatcctgggtgtcttgtgagcaggtgctgctagccctcctgctcctgcttgccctgttattgccactgttgtccggtggactgcaccttttgctgaagtag

SEQ ID NO: 24383 - DNA, 564 bp, Artificial Sequence
  Description of Artificial Sequence: Synthetic coding sequence
atggagcggccccagcccgacagcatgccccaggacctgagcgaggctctgaaggaggcgactaaggaagtgcatactcaggccgaaaacgccgagtttatgcgaaattttcagaagggtcaagtgactagagatggctttaagctggtgatggccagcctgtaccacatctacgtcgcactcgaggaggagattgaacggaataaagagtcacccgtgttcgcccccgtttacttcccagaggagctccatagaaaagcggccctcgaacaggatctcgcattctggtacggtccccggtggcaagaagttatcccttataccccagccatgcagcgctatgtgaaaaggctgcatgaagtaggccgtactgaacccgagctgcttgtagcccacgcctacacccggtatctaggtgacttgtctggaggtcaggtgttgaagaaaatagcccagaaagccctggatcttccttcatctggcgaaggactcgcatttttcacattcccgaatatagcctctgccacaaagtttaaacagctataccggtcacggatgaactag

SEQ ID NO: 24384 - DNA, 1581 bp, Artificial Sequence
  Description of Artificial Sequence: Synthetic coding sequence
ctgggcggccggagcagctgcgaggaccccggctgcccccgggacgaggagcgggctcctaggatgggatgcatgaagtcaaaattccttcaggttggaggaaacactttttcaaaaactgaaacgtcagcgtcaccccactgccccgtgtatgtgccagaccctacatcaaccattaagcctgggcccaatagtcataattctaatacccctgggatccgggaagccgggtccgaggatattatagtagtcgccctgtacgactacgaggccatccaccacgaggacctcagctttcagaagggagaccaaatggtggtgctggaggagagtggtgaatggtggaaagcccggtccctagctactagaaaggaaggctatattcccagcaattacgttgcccgtgtcgattcactcgagaccgaagagtggttctttaaaggaatctcacgaaaagatgcagagcggcagctgctggcgccagggaacatgttaggcagctttatgatacgcgattcggagaccaccaagggcagttatagcctgagtgtgcgtgactacgaccccagacagggcgacaccgtaaaacattataagatccgcactctggacaacggaggattctacatctcaccccgcagcaccttctcgaccctgcaggaattagtggatcattacaagaagggaaatgacggtctttgtcagaagttgagcgtcccatgtatgagctcaaaaccacagaaaccttgggaaaaagacgcctgggagattcctcgcgagagcctgaagctggagaaaaagctgggtgcaggtcaatttggcgaagtttggatggcaacttacaacaagcacacaaaagtcgctgtcaagacaatgaaaccagggtctatgagcgtggaagcgttcctggcagaggccaacgttatgaagacgctccagcacgataagctggttaagctgcatgccgtggtgactaaggagcctatttatatcattacagaattcatggctaagggctccctgctggactttttgaagtcagatgagggaagtaagcagccattaccgaaactgatcgactttagcgcccagatcgcagaggggatggcattcatcgaacagagaaattacatccaccgagacctcagagcagctaacattctggtatcagccagtctcgtatgcaagatagctgatttcggattggctcgggtgatagaagataatgagtataccgcccgggagggcgctaagttcccgataaaatggactgcacccgaagcgatcaatttcgggtccttcaccataaagtctgatgtctggtcttttgggatcctgctgatggaaatagttacttacggtagaataccttatccagggatgtccaacccagaagtgattagggcattagagcgcggatatagaatgccccgccctgaaaattgtcccgaagagctgtataacatcatgatgcgatgctggaaaaatagacccgaagagcgaccaacttttgagtacatccaatccgtgctggatgatttctataccgccactgagagccaataccagcagcagccctag

SEQ ID NO: 24385 - DNA, 1578 bp, Artificial Sequence
  Description of Artificial Sequence: Synthetic coding sequence
ctgggcggccggagcagctgcgaggaccccggctgcccccgggacgaggagcgtgcccctcgtatgggatgtatgaaatctaagtttcttcaggtcggggggaatactttcagtaaaacagagacaagtgccagccctcactgtcctgtgtatgtgcctgacccaacaagtaccatcaagccgggaccgaatagtcataattccaatacccccggcatccgcgagggctccgaagacatcatagtcgtggccctgtacgactatgaggccattcaccacgaagatctcagtttccagaagggcgaccagatggtagttctggaggagagcggcgagtggtggaaagcaaggtccctggcaacacggaaggagggctatattcccagtaattacgtggcccgggttgattccctggagacagaagagtggttctttaagggaatctctagaaaggatgccgaaaggcagcttctagcgcccggaaacatgcttggttctttcatgatcagagattctgaaaccaccaaggggtcttactctttgtccgtccgagactacgatcccaggcaaggagacacagtgaaacactacaaaatccgtactctagacaatggcggattttacatttcccccagatctactttctcaactctgcaggagctggtggatcattacaagaaaggcaacgacggcctgtgtcagaaactctccgttccttgcatgtccagcaaacctcaaaagccatgggaaaaggatgcctgggagattccgcgtgagtccctgaagcttgagaagaaactgggcgccgggcagtttggggaagtctggatggcaacatacaacaaacatactaaagtcgccgtgaaaaccatgaaacctggctctatgtctgtcgaggctttcctggcagaggccaatgtaatgaagaccctccagcatgataagttagttaaattgcacgctgtagttaccaaggagccgatctatattatcaccgaattcatggcaaaagggagtcttttggacttcctgaagtccgatgagggttcaaaacaaccattacccaagttgattgacttcagtgctcagattgcggaaggtatggcctttatcgaacagagaaactatatccaccgggacctgcgggctgcaaatattctggtgtccgcctcgctagtctgcaaaatagcagactttggcctggcccgcgtaattgaagacaatgaatacacggccagggaaggcgctaagttccccatcaaatggacagcccccgaagccattaattttggttcattcaccattaaatcagatgtctggagcttcgggattcttctgatggaaatcgttacatacggcagaataccgtaccccggaatgtccaacccggaggtgatccgcgcattagagcggggttaccgtatgcctcgccccgagaattgtccagaggaactttacaatatcatgatgcgctgctggaagaaccgcccagaagaaaggcccacattcgaatacattcagtctgtgctggatgacttttacaccgccactgaatcacagtatcagcagcagccgtag

SEQ ID NO: 24386 - DNA, 1515 bp, Artificial Sequence
  Description of Artificial Sequence: Synthetic coding sequence
atgggctgcatgaagagcaagttcctgcaggtgggcggcaacaccttttccaagactgagacttccgcaagcccgcactgtcctgtttacgtgccagatcccacaagcactattaagcccggaccaaatagtcacaactcaaatactccagggatcagagaaggctccgaagatatcatcgtggtggccctctacgactatgaagcgatccaccatgaagatctgagttttcagaagggcgatcagatggttgtgctggaggagtctggagagtggtggaaggcaaggtccctggccactaggaaagagggatatataccaagtaattatgtcgcccgtgttgactctctcgaaacagaggagtggttcttcaaaggcatcagcagaaaggacgcagagagacaattactggctccagggaatatgctcggtagcttcatgatccgggactcagaaacgactaaggggagttactctttgagcgtgagggactatgatccgcggcagggcgacaccgtcaagcattacaagatccgcaccctcgacaacggggggttctatattagcccaaggagcactttctctactttgcaggagttagtcgatcattacaagaagggcaatgacggtctctgtcagaagctgtccgtgccttgcatgtctagtaaaccgcagaaaccttgggagaaagacgcatgggagatccccagggagtccttgaaactcgagaagaagctgggagctggccagttcggtgaggtgtggatggccacatataacaagcatactaaagttgctgtgaaaacaatgaagcctggatctatgtcggttgaagcattcctggccgaggccaatgtgatgaaaaccctgcagcacgacaagcttgtgaagttgcacgcagtagtcactaaagaaccaatttacattataacagagtttatggcgaaagggtctcttttagactttctgaagagcgatgaaggaagtaaacagcctctcccaaaacttatcgacttttcggcacaaattgctgaaggaatggcgttcattgaacagcggaattacatccaccgcgatctgcgtgctgctaatattctcgtttccgccagtcttgtgtgcaaaatagctgactttgggctggcacgagtaatcgaagacaacgagtatacagcaagagagggcgctaaatttcccatcaaatggacggctcccgaggccatcaacttcgggagctttacaatcaagagcgatgtgtggagcttcggaatcctgcttatggagattgtgacatacggaagaatcccgtatcctggtatgagcaatcccgaagtaatccgtgctctggagagaggatacaggatgccccgaccggagaactgtccagaagagctttacaacataatgatgcggtgctggaaaaataggcctgaggaacgccctaccttcgagtacatccaatcagtgctcgatgatttctacaccgctacggaatcccaatatcagcagcagccctag

SEQ ID NO: 24387 - DNA, 1518 bp, Artificial Sequence
  Description of Artificial Sequence: Synthetic coding sequence
atgggctgcatgaagagcaagttcctgcaggtgggcggcaacaccttctccaaaaccgaaaccagtgctagcccacattgccctgtctatgtgccggatcccacctctactatcaagccagggcccaattcacacaacagcaacacacccggcatccgggaagcaggcagtgaagatatcatcgtggtggccctctatgactatgaggcgatacaccatgaggacctttcctttcagaagggcgaccagatggtggtgctcgaggaaagcggggaatggtggaaggcacgttccctcgcaacacggaaggagggatacattccttccaattatgtggcaagggtggactctctggaaacagaagagtggtttttcaagggcattagtagaaaagatgcagaacggcagttgctcgctcccggcaacatgttaggtagcttcatgatcagggattccgagacaaccaaagggtcttattcattgagcgttcgagactacgatccccgtcagggagacacggtgaaacactataagataaggacgctggacaacggtggcttttacatctcgccgcggtctaccttttcgaccctgcaggaattggtcgaccactataagaagggtaacgacgggctgtgtcagaagctgtctgttccttgcatgtcctcgaagccgcagaaaccctgggaaaaagacgcatgggagatccctcgcgagtccttaaagttagagaaaaaattaggagccggccagttcggtgaggtatggatggctacatacaataaacacactaaggttgcagtcaagactatgaaaccaggctctatgagtgtcgaggcatttttagcggaagccaacgtgatgaagaccttacagcacgataagcttgtcaaattgcacgcagtagtcacaaaggaacccatctacattatcacagaattcatggccaagggtagtttgctggactttttgaagtcagacgagggcagtaagcagccccttccaaagctgatcgatttctcggcccaaattgcagagggtatggcgtttattgaacagcgtaactacattcatagggatttacgggcggccaacatcctggtgagcgcctctctcgtatgcaagatcgccgacttcgggctcgcccgcgtgattgaagataacgagtatacagcccgggagggtgccaagttccctatcaaatggacggcgcccgaagccatcaatttcggcagcttcaccattaagagcgatgtctggagcttcggtatcttgctgatggaaattgtgacatatggcaggatcccctatccgggcatgagcaacccagaagtgattcgcgccctggagcgcgggtatcgaatgccgcgcccagaaaactgtcctgaagagctttacaacatcatgatgagatgctggaaaaaccgaccagaggagaggcccaccttcgagtacatacagtcagtcctggacgatttttacacagccaccgagagtcagtaccagcagcagccctag

SEQ ID NO: 24388 - DNA, 1521 bp, Artificial Sequence
  Description of Artificial Sequence: Synthetic coding sequence
atgatgggctgcatgaagagcaagttcctgcaggtgggcggcaacaccttttcgaagactgaaacctcggcctctccacactgtcccgtgtacgtacctgacccaacaagcaccattaagccaggacccaactctcacaattccaatacccccggaatcagggaggcaggctctgaagatatcattgttgtagcactttatgattatgaagccatccaccatgaagatctgtcttttcagaagggtgaccaaatggtggtcctagaagagtctggcgagtggtggaaggctaggtctctggccactaggaaggagggctacatcccctcaaactacgtggcccgggttgactctttagagacagaggaatggttttttaagggcatctcgagaaaagacgccgagcgtcagttacttgcacccggaaacatgctgggatcgttcatgattagggacagtgagaccaccaagggttcttactctctctctgttcgcgactatgacccgaggcagggggacacagtcaaacactacaagatcaggaccttggacaacggggggttctatatctcaccaaggtcgacttttagcaccctccaggagttagtggatcactataagaagggcaatgacgggttatgccagaagctgagcgtcccctgtatgtctagtaagccccagaagccctgggagaaagacgcttgggagataccccgtgagtccctcaaactagaaaagaagctgggcgcgggccagtttggagaggtttggatggcaacttacaacaagcatactaaagtggccgtgaaaacgatgaagcctggatctatgtccgtggaagcttttctggcggaggccaatgttatgaaaactctgcagcatgacaagctcgtaaaactgcacgccgtggtgaccaaagagccgatctatatcatcaccgagttcatggccaaaggctccctactcgacttcctaaaatctgatgagggctcgaaacagccattacccaagcttattgacttttccgcccaaattgccgaaggtatggccttcattgaacagagaaattacatccacagagatcttagagctgcaaatattctcgtgagcgcatcattggtgtgcaagattgctgatttcggcctggcaagggtgatcgaagataatgagtatactgcccgtgaaggggccaaattcccaatcaagtggaccgcaccagaagccattaatttcggttcatttacaatcaaaagcgacgtttggagctttgggatcttgctgatggagatcgtcacttacggacgtatcccttatcctggcatgagcaaccccgaggtgatccgagctctggagagagggtatcgtatgcccaggccagaaaactgtcctgaggagctctacaatattatgatgaggtgttggaagaaccgacccgaggaacggcccacttttgaatatattcagagcgttctggatgatttctatacagcaacagaaagtcagtaccagcagcagccctag

SEQ ID NO: 24389 - DNA, 1518 bp, Artificial Sequence
  Description of Artificial Sequence: Synthetic coding sequence
atgggctgcatgaagagcaagttcctgcaggtgggcggcaacaccttctcaaaaacggaaacgagcgctagtccccactgccctgtatacgtgccggaccccactagcaccattaagccaggccccaactcccacaattccaacacacctgggatccgggaagctggaagtgaggacatcatcgtcgtggccctgtatgattatgaagccatacaccacgaagacctgtcattccagaagggtgaccagatggtggtcctagaagagtccggagagtggtggaaggcacgttctctggccaccagaaaggaaggatacatccctagcaactatgttgccagagtggactccttagaaactgaggagtggttcttcaaaggcatcagtcggaaagacgcagaaaggcaacttctggccccaggcaatatgctgggcagtttcatgatccgggacagcgaaacaaccaagggctcatatagcttaagcgtgagggattacgacccaaggcagggagacaccgtgaagcattataagattaggacactggacaatggcgggttttacatctcaccacgttctacgttctcaacactgcaggaactcgtagatcactacaagaagggcaacgatggcctgtgccagaaactcagtgtgccgtgtatgagctcaaaaccacagaagccctgggaaaaagatgcctgggaaatcccccgggagagtctcaagctcgaaaagaaactgggcgccggtcagttcggtgaagtgtggatggcaacatacaataagcacacaaaggttgcagttaaaaccatgaaacccggaagtatgagtgtggaggcgttcttggccgaggctaatgtcatgaagaccctgcagcatgacaaattggtcaagttgcatgccgtagtcaccaaagagccaatctatatcattacagaattcatggcgaaagggtctctgctcgactttctgaaatctgatgagggtagcaagcagccacttcccaagttaatcgacttctctgcccagattgctgaaggaatggccttcatagagcagcggaactatattcatcgcgatttgcgcgccgccaatattctggtgagtgccagtctcgtctgcaaaattgctgatttcggattggctcgcgtgatcgaggataacgagtatactgccagggagggggccaagtttcctatcaagtggactgcccctgaggctatcaacttcggcagtttcactatcaagtccgatgtgtggtcatttggaatattgcttatggaaattgtaacatacggccgaataccgtacccaggcatgagcaaccctgaagtcattagggctctggaaagaggctataggatgccacgccctgaaaattgtcctgaggaactgtacaatataatgatgagatgctggaaaaaccgaccagaggaacgcccaaccttcgagtacattcagagcgtgctcgatgatttttacaccgccaccgaaagtcagtaccaacagcagccctag

SEQ ID NO: 24390 - DNA, 1632 bp, Artificial Sequence
  Description of Artificial Sequence: Synthetic coding sequence
atgctgctgcggagcaagcccgccctgcccccccccctgatgctgctgttgctagggcctctcgggccgttatctccaggggctcttcctcgcccggctcaggcccaagatgtcgtcgacctggatttctttacccaagagccattgcacctggtgagcccctcctttctgtccgtgacaatcgacgcaaacctggccacggatccgcgattcctcattcttctggggagccctaaacttcgcacgctggcgagagggctgagtcccgcctatctcaggttcggaggtaccaaaactgattttctgatatttgacccgaagaaagagtcaacattcgaggagcggtcctactggcagtctcaggttaaccaggacatttgcaagtatgggagtatccctcctgacgttgaagagaagttaaggctggaatggccataccaggaacagttgttgttaagggagcactatcagaagaagtttaagaactctacatattcgcgaagctctgtggacgtgctatatactttcgcaaattgttctggcctggatcttatcttcgggctgaacgccttgctccgcacagcagatctccaatggaatagctccaacgcgcaattgctcctcgattactgtagcagcaaaggatataacatttcttgggagctgggcaatgaacctaattcctttctcaagaaggcagatatattcatcaatggttcacagctcggcgaggacttcatccaactccataagttactgagaaagtccacgttcaagaatgcaaagctgtacggaccggatgtgggacagccacggcggaagaccgccaaaatgctcaaaagctttcttaaggccggcggggaagtaatagacagcgtaacttggcaccattattatctcaacgggcgcactgccacaaaagaagacttcctgaatcctgacgtcctagacatttttataagctcagtgcaaaaggtatttcaggtggtagaatccacgcggccagggaaaaaggtctggctcggcgagacatcctcggcctatggcggcggggcaccactgttgtctgacacatttgccgcaggcttcatgtggctggacaagctggggctctccgctaggatgggcatagaggttgttatgcgccaagtgttcttcggagcaggaaactaccacctggtcgatgaaaatttcgaccccctgcctgactattggctaagtttgctgtttaagaagctggtgggcactaaagtgctgatggcgtccgtgcaaggctctaagcgccggaagctgcgggtttatctgcactgcacaaataccgataacccgagatacaaagaaggggacctcactctctatgcaataaatctgcataacgtgaccaagtatctgaggttaccttaccctttcagcaacaaacaagtggacaagtacctcctgcgaccgctaggtccacatggcttgctgtctaaatccgtgcagctgaatggactgacactgaagatggtggatgaccagacactgccaccactgatggagaaaccgctccgccctggtagtagcctgggcctccctgctttctcctacagttttttcgtcatacgcaacgccaaagtagccgcttgcatttag

SEQ ID NO: 24391 - DNA, 1632 bp, Artificial Sequence
  Description of Artificial Sequence: Synthetic coding sequence
atgctgctgcggagcaagcccgccctgcccccccccctgatgctgttgcttttgggcccgctgggtcctttatcccctggagctctccctcgaccagcccaagctcaggatgttgtggacttagatttcttcacgcaggagcccctgcatttggtgagccccagcttcctgtctgtgactatcgatgcaaatttagctactgacccacgctttctgatactgctcggcagtccaaagttacggactctggcaagaggtctctcgccagcatatctgcggttcggcggcacaaaaacagatttcctcatattcgacccgaagaaagagtccacctttgaggagcgaagctattggcagagccaggtgaatcaggacatctgcaaatatgggagcatccccccggatgtggaggaaaagctccgtttggagtggccataccaggaacagctcttactgcgggagcactaccaaaagaagttcaaaaattccacttactctagatcatctgtcgatgtgttatacaccttcgcaaattgctccgggctggacctgatttttggcttaaatgcactccttcggaccgctgatctgcaatggaattcgtcgaacgcccagctcctgctcgactactgctcttctaagggttataatatcagctgggaactgggtaacgagcccaatagttttctgaagaaagctgacatcttcattaatggcagtcagctgggcgaggattttatccagcttcacaagctcctacgcaaaagtaccttcaaaaatgctaaattgtatggaccagatgtggggcagccacgtcggaaaacggccaaaatgttgaagtcatttctcaaggcaggtggagaagtgattgactcagtaacctggcaccactactatctgaatggtcgtacggccacgaaagaggatttcttgaatcctgacgttctcgacattttcatctcatcagtgcaaaaagtcttccaggtcgtggagagcacaagacctggcaagaaggtttggctcggcgaaacttcatcagcatatggtggcggggctccactactaagcgataccttcgccgccggttttatgtggcttgacaagctgggactttccgccagaatgggcatagaggttgttatgcggcaggtctttttcggagcagggaactaccacttggtggacgagaactttgatcctctacccgactattggctgagcctattatttaagaagttggtgggaactaaggtgctaatggcctcagtgcaaggctccaagagacgtaagctccgcgtgtacctccattgcaccaacacagacaatccgcgctataaagagggagacttgactctctatgctatcaatctgcacaatgtgaccaagtatttacgtttgccatatcccttttctaataagcaggtggacaagtaccttttgagaccactggggccacacgggctgctgtccaagagcgttcagctgaatgggttaactttaaaaatggttgatgaccagactctgccacctctcatggaaaagccattgagacctgggagtagtctcggattgcctgcctttagctattcgttttttgtcattagaaacgccaaggtagctgcttgtatatag

SEQ ID NO: 24392 - DNA, 294 bp, Artificial Sequence
  Description of Artificial Sequence: Synthetic coding sequence
atgctgctgctgctgggccccctgggccccctgagccccggcgccctaccacggccagcccaggcacaggatgtggtggacctggatttcttcacacaggaacccctgcacctggtgagcccatctttcctgtcagtcacccgtccaggcaaaaaggtctggctaggtgagacatcctccgcatacggtggaggcgcccccctgttgagcgacacctttgctgcagggtttatgtggctggacaaacttggattatcagccagaatgggtattgaggtcgtcatgcggcaatag

SEQ ID NO: 24393 - DNA, 1410 bp, Artificial Sequence
  Description of Artificial Sequence: Synthetic coding sequence
atgctgctgcggagcaagcccgccctgcccccccccctgatgctgctgcttcttggaccactaggccctctgagccctggagccctgcctaggcccgcccaagctcaggacgttgtggatcttgacttctttactcaagaacctctacatctggtgtccccgagtttccttagtgtgacaattgacgccaatcttgctacagacccgaggttccttatcctgctgggctctcccaaacttcggactctggctcggggactgagcccagcttacttgaggttcggcggaaccaagaccgattttctgatctttgaccccaaaaaggagtctactttcgaagagcgcagctattggcagtctcaggtgaaccaggatatctgtaaatacgggtctattccacccgacgtggaagaaaaactgcgactggaatggccctaccaagagcagttgctcctgagagagcactaccagaagaagtttaagaattccacatactcccgcagctctgtggacgttctctatacattcgcaaactgtagtgggcttgatctgatatttggtctgaatgccctgctgcgcaccgctgatctgcaatggaacagctccaacgcccagcttttgctcgactactgttccagcaagggttacaacatctcatgggagctgggtaacgagccaaactccttccttaaaaaagccgatatttttattaacggcagccaactgggtgaagactttatccaactgcacaagcttctgagaaaatctacctttaagaacgcaaagctgtatggccccgacgtcggtcagcccagacgaaaaacagcaaaaatgttgaagtctttcctcaaagcaggcggcgaggtgattgatagtgtcacttggcatcactattacctgaacggccgcacggccaccaaggaggactttctaaatccagatgtgctcgatatcttcatctcttcagtgcaaaaagtgttccaggattactggctgtctctcctattcaaaaagttggtggggaccaaagttctcatggcaagtgtccaaggctcaaaacgccggaaactgagagtgtacctccactgtacaaacacggacaatcctcgctataaagagggcgacctgacgctctacgccataaacctacacaatgttacaaaatatctgcggctgccataccccttctccaacaagcaggtggataaatatctcttaaggcctttgggccctcacggtctgctgtctaagtccgtgcagcttaacgggctcactctcaagatggtggacgatcaaaccctgccaccacttatggagaaacccctgaggcctggaagttccttgggacttccggcattctcgtatagtttctttgtgatccgcaacgcaaaagtggccgcctgcatatag

SEQ ID NO: 24394 - DNA, 1458 bp, Artificial Sequence
  Description of Artificial Sequence: Synthetic coding sequence
atgctgctgcggagcaagcccgccctgcccccccccctgatgctgctgctgctgggtcccctaggccctctcagtcctggagctttaccgcggcccgctcaagcgcaggacgtagtcgaccttgatttcttcacacaagagccccttcacctggtgtctccctctttcctgagcgtcacgattgacgctaacctagcaaccgatcctcgctttctgattttactgggatcaccaaaactgaggacacttgcacggggtctaagcccagcgtatcttagattcggaggtacaaagaccgacttcctcatctttgatcctaagaaggaaagtacctttgaggaaagatcctattggcagtcccaagtcaatcaggacatatgcaagtatggctccatccctcctgatgtagaagagaaacttcgcttagaatggccttaccaagaacagctgctcctgagagagcattatcagaaaaagtttaagaacagcacatactccaagcctaatagcttcttaaaaaaggctgacattttcatcaacggctcacagctcggtgaagactttatacagttacacaaactcttacgcaagtctaccttcaaaaacgctaagctgtatgggcctgatgtgggtcagcccagaagaaaaactgcaaaaatgttgaagtcctttctgaaggctggcggagaggttattgatagtgtcacctggcatcattactacttaaatgggcggacagccacgaaggaagatttcctgaatcctgacgtgcttgacatctttatcagttctgtccagaaagtcttccaagtcgtggaatcaactcggcctggcaagaaggtgtggctcggggaaacctcatctgcatacgggggaggcgcacctctcttgagtgacacctttgccgctggttttatgtggttagataaattgggtctgtctgcgcggatgggcatcgaggtcgtgatgcggcaagtgttcttcggcgctggcaactatcacctagttgatgaaaactttgaccccctgcccgactattggctgtccctgttgttcaaaaaactggtgggaaccaaagtgctcatggcgagtgtccaagggagcaagagacgtaaactgagagtctacctccattgcaccaacaccgataacccgagatacaaagagggggacctcaccctctatgcaatcaacctccataatgtgacaaagtacctgaggttgccatatccgttttctaataagcaggtcgataagtacctcctgcggcccctcggtccgcatggcttactgagcaaatctgtgcagctgaacgggttaactctgaaaatggtggatgatcagaccctgcctccccttatggaaaagcctctcaggccggggagcagcctggggctgcctgccttctcgtactctttcttcgtgatcagaaacgccaaggtcgctgcttgcatttag

SEQ ID NO: 24395 - DNA, 1062 bp, Artificial Sequence
  Description of Artificial Sequence: Synthetic coding sequence
atggagaagaccctggagaccgtgcccctggagcggaagaagcgggagaaggagcagttcaggaagctgttcattggcgggctatcatttgagaccacggaggagtctctccgaaactattatgaacaatggggcaagctgacagactgtgttgtcatgagggaccccgcctctaagaggtcgcggggctttggctttgtcacctttagctccatggctgaggttgatgctgcaatggccgcccggccacattcaattgacggccgagtggtcgaacctaaaagggcggttgcgagggaggaaagtggtaagcccggcgctcatgttaccgtgaaaaagcttttcgtgggcggaataaaggaggatacagaggagcaccacttacgggactattttgaagagtacggcaaaatcgacactattgaaattattactgacagacaatccggcaagaagagaggttttggatttgtgacttttgacgatcatgaccccgtggataagattgtgcttcaaaagtatcatacgatcaatggccataatgccgaggtacggaaagccttgagccggcaagaaatgcaagaagtccagtcaagccgtagtgggcgggggggaaacttcggattcggcgactcccggggcggtggcggtaacttcggccctgggcctggtagtaacttcaggggcggcagcgatggctacgggagcgggcgcgggttcggcgatgggtacaacggctacgggggcgggccgggaggaggcaattttggtggttcgcctggctatggggggggacgcgggggatacggaggaggagggccagggtacggcaatcagggggggggatacggtggcggctatgacaactacggcggcggcaattacggttcaggcaactacaacgacttcggcaactacaaccaacagcctagtaactacggacctatgaaaagtgggaattttggaggaagcaggaacatgggcggcccttatggaggtggaaactatggtccaggaggaagcggcggctccggagggtatggcggaagatctcggtactag

SEQ ID NO: 24396 - DNA, 1026 bp, Artificial Sequence
  Description of Artificial Sequence: Synthetic coding sequence
atggagcgggagaaggagcagttccggaagctgttcatcggcggcctttccttcgaaacgaccgaggagagcttgcgtaattactacgaacagtggggcaaattgactgactgcgtggtgatgcgcgaccctgctagtaagaggtccagggggtttggctttgttacgttttcaagcatggcggaagttgacgcggccatggccgcccgcccacactcaattgacgggagggtcgttgagcccaaacgagcagttgctagggaggagtcgggcaagccaggggctcacgtaactgtgaagaaactgttcgtgggcgggatcaaagaagataccgaggaacatcacctgcgggattatttcgaagaatacggcaagattgacaccattgaaattattactgaccggcagagcggcaagaaaagaggctttggattcgtaactttcgatgaccacgatcccgtggacaaaatcgtgctgcaaaagtaccatacaattaacgggcacaatgctgaggtgagaaaagcccttagcaggcaggaaatgcaggaagtgcagtcctcccggagcgggcggggtggcaacttcgggttcggggattccaggggaggcggaggcaatttcgggcctggcccagggagcaacttcagagggggctccgacggttacggctctggtcgcgggttcggtgatggctacaacgggtatgggggaggacctggaggtgggaactttggcggatcaccaggttacggcggtggcaggggcggatatggaggaggtggccctggctacggtaatcagggcgggggttacggcggcgggtacgacaactatgggggcggcaactacggaagcggtaactacaatgatttcggcaattacaatcaacagcccagtaactacggtcccatgaagtccgggaacttcggcggctctcggaacatgggggggccttatggtggcgggaactatgggccagggggctctggtgggtccggcggctacggaggacggagccgctattag

SEQ ID NO: 24397 - DNA, 1062 bp, Artificial Sequence
  Description of Artificial Sequence: Synthetic coding sequence
atggagaagaccctggagaccgtgcccctggagcggaagaagcgggaaaaggagcagttccgaaaactgtttattggcggactgtcattcgaaactaccgaggagagtttacgcaactattatgaacagtgggggaagctgaccgattgcgtggtgatgagagaccccgcctctaagcgatctcgcggtttcggcttcgtcaccttctcctctatggctgaagtggacgcagctatggctgcccgcccacacagcatagacggccgggtggtagagcctaagcgcgcagtcgcacgggaggaaagtggcaaacccggcgctcatgttactgtgaagaagctgttcgtaggaggcataaaagaggacaccgaagagcaccacttaagggactatttcgaagaatacggcaaaatcgatactatagaaattatcaccgaccggcagagtggcaagaagagaggctttggtttcgtcacgttcgacgatcacgatcctgtcgataaaatcgtattacagaagtaccacacaatcaacggacataacgccgaagtgcgaaaggccctgagtcgtcaggagatgcaggaagtccaaagtagcaggtctggacggggagggaatttcggttttggggactcccggggaggaggaggcaattttggaccaggtcccggtagtaacttcagagggggcagtgacgggtatggcagtggacggggatttggcgatggatacaacgggtacggtggcggacctggcggcgggaacttcggaggatcccccggatatggcgggggccgggggggctatgggggcgggggccccggctatggtaaccaggggggtggatatgggggcggttacgataattacggcggcggtaattacgggtcaggtaactacaacgactttgggaattacaaccaacagccatctaactatggacccatgaaaagcgggaattttggcggctctcgcaatatgggtggaccttacggcgggggtaattacgggccgggcggcagtggcggatccggcggttatggcgggcgctctcggtactag

SEQ ID NO: 24398 - DNA, 750 bp, Artificial Sequence
  Description of Artificial Sequence: Synthetic coding sequence
atggagcgggagaaggagcagttccggaagctgttcatcggcggcttatcatttgaaactaccgaggaatcacttcggaactattatgaacagtgggggaagttgactgactgtgttgtgatgagggaccctgcatctaagcggagtcggggttttggcttcgtgaccttctcttctatggcagaggtggatgcagcaatggccgctcgcccccatagcatcgatggtagagtagtggagcctaagcgggcagtggccagggaggaatcaggcaagccaggtgcacacgtcaccgtaaaaaagctgtttgtcggtggaatcaaagaggacaccgaggagcaccatctgcgcgactactttgaggaatacgggaagattgacactatcgaaataattacagatagacagtcaggaaagaagagaggcttcggctttgtcacatttgatgatcatgatccggtggacaagattgttctccaaaagtaccacacaattaatggccacaacgcggaggtgcgaaaagccctttctcgacaggagatgcaggaagatcttgaggtcgctattttggaagtggcccccgtcatggaggaggaggaagaggatatggtggtggaggacttagatatggctacccgagtgggcgccaccgaggtggtgatgactacaatggaggaggagatcatggaggtcgagatcactatgatcctggagatcatcacctcaaacttgctcactactgtgcagtag

SEQ ID NO: 24399 - DNA, 846 bp, Artificial Sequence
  Description of Artificial Sequence: Synthetic coding sequence
atgagcgaggagcagttcggcggcgacggcgccgccggcaacggcggaggccgacgcgcgggcgagcaggagggcgcgatggtggccgcaacccagggcgcggctgcacgggaagcagagccaggacctggtgccgagcccagactggaggcccccaagggggccgagtcagaaggagcaaaaattgatgcaagtaaaaacgaggaggacgagggcaaaatgttcatcggaggccttagctgggataccacaaagaaggaccttaaggattactttagcaagttcggagaagtagttgattgcactctgaaactggacccaataacaggaaggtctcggggatttggatttgtactgttcaaggagtctgaatcagtggacaaagtcatggaccagaaggaacacaagctgaacggaaaagtcatcgatcctaaacgtgcaaaggccatgaaaaccaaggaacctgtgaaaaaaattttcgtaggcggcctcagcccagacaccccagaagagaagattcgtgagtacttcggcggttttggtgaagtggagagcatagagctgcctatggacaataaaaccaacaagcgcaggggtttctgtttcattactttcaaggaggaggagccagtcaaaaaaattatggagaaaaaatatcataatgtgggcttgtcgaagtgtgagattaaggtcgctatgagcaaggaacagtaccagcagcagcaacagtggggatccaggggaggattcgcagggagggccagaggtcggggtggcgaccagcagtccgggtatggcaaggtgtctagacggggggggcaccagaattcctacaagccctattag

SEQ ID NO: 24400 - DNA, 1068 bp, Artificial Sequence
  Description of Artificial Sequence: Synthetic coding sequence
atgagcgaggagcagttcggcggcgacggcgccgccgccgccgccaccgcagcggtgggcggcagcgccggggaacaagagggcgccatggtggccgccacccagggggcagcagcggcagcaggcagcggggccggcactggaggcggaacggcttcgggcggcactgaaggcgggagtgcagagtctgaaggtgcaaagatcgacgctagcaagaacgaggaggacgaggggcacagtaactcttcacccagacattcagaggccgctaccgcccagcgagaagaatggaaaatgttcatcggggggttgtcatgggacactaccaaaaaagaccttaaagactactttagcaagtttggtgaggtcgtggactgtacgctgaagctggacccaatcacgggacgctccaggggtttcggcttcgtgttgttcaaggaatctgagagcgtggacaaagtaatggaccagaaggagcacaagctgaacggtaaagtgattgatcccaaacgggcgaaagccatgaaaaccaaggagccagttaagaaaatttttgtcggtggcctctcccccgacacgcccgaggagaagatccgcgagtattttggcgggtttggtgaggtggagtccattgaactcccgatggacaataagacaaacaaaaggcgcggcttttgttttatcacattcaaagaggaggagcccgtcaaaaagattatggagaagaagtatcataacgtgggcctctccaagtgcgaaatcaaggttgctatgtctaaggagcagtatcagcagcaacagcagtggggctccagggggggatttgcaggacgtgcgagggggagggggggcggaccctcccaaaactggaatcagggttacagtaattattggaaccagggttacggtaattacgggtataatagtcaagggtacggcggttacgggggctacgactatactggttataataactactacggctacggggactattctaaccagcagtctggttacggcaaggttagtagacggggtggccaccaaaatagctacaaaccttattag

SEQ ID NO: 24401 - DNA, 1011 bp, Artificial Sequence
  Description of Artificial Sequence: Synthetic coding sequence
atgagcgaggagcagttcggcggcgacggcgccgccgccgccgccaccgcagctgtcggaggtagtgcaggagagcaggagggcgctatggtcgctgccactcagggggctgctgcggccgctggatccggagcgggtaccggcggcgggactgcctctggagggacagagggtggctcggctgagtctgagggcgctaaaattgatgcctcaaagaatgaagaagacgagggcaagatgtttataggcggcctgtcgtgggatactacaaagaaagatctgaaagattatttcagcaagttcggcgaggtggtcgactgtaccttgaagctggaccctatcaccggaaggagtcgcggatttggcttcgtacttttcaaagagtctgaatccgtagataaggtgatggaccagaaagagcataagctgaacggaaaggttattgatccaaagcgcgccaaagctatgaaaaccaaggaaccggtaaagaaaatcttcgtggggggattgtctcctgacacacctgaagagaaaatcagagagtactttggcggtttcggggaggtggagtccatcgagttacccatggataacaaaaccaataagagaagagggttctgcttcatcacttttaaagaagaagaacccgtaaagaagattatggagaagaaataccacaatgttggcttgtccaaatgcgagatcaaggtggccatgtcaaaggaacagtaccagcaacagcagcagtggggcagtaggggcggctttgctggcagagctcggggcagaggtgggggaccttcccagaattggaaccaggggtattctaactattggaaccagggttacggaaactacggctataactctcaggggtatggagggtacggtggatacgactacaccggttacaataattattacgggtatggcgactatagcaaccaacagagcgggtacggcaaggtgtctagaagaggtggacatcagaattcctacaagccctactag

SEQ ID NO: 24402 - DNA, 921 bp, Artificial Sequence
  Description of Artificial Sequence: Synthetic coding sequence
atgagcgaggagcagttcggcggcgacggcgccgccgccgccgccactgccgctgtggggggctcagccggagagcaggaaggcgcgatggtggccgcgacccagggggccgcagcagcagctggttcaggagccggtaccggaggagggactgccagcgggggtaccgaaggcggctctgctgaaagtgagggagctaagatcgacgccagcaagaatgaagaggacgaaggccactctaacagtagtccaagacactctgaagccgcaaccgcccagagagaggagtggaagatgttcatcggaggtttatcatgggatacgacaaagaaagatctgaaagactattttagtaagtttggcgaagtggtggattgcacactgaaattagatcctataacgggccggagccgcggattcggcttcgtactgtttaaggaaagcgagtcagtggataaagtcatggaccagaaagagcacaagctgaacggcaaggtaattgatcctaaacgggcaaaagctatgaaaactaaggagccagtgaaaaaaatctttgtggggggcctgtcccctgacacacctgaagaaaagattagagagtacttcgggggctttggcgaggtggaatcaattgaacttccaatggacaataaaactaacaaacggagaggcttttgtttcatcaccttcaaggaagaagagccagtcaagaagattatggaaaagaagtatcacaatgtgggcctgtcaaaatgtgagattaaagttgcaatgagcaaagagcagtaccaacagcaacagcagtggggttcaagaggcggtttcgccggccgtgcacgagggcgaggtggagatcagcaatcagggtatggaaaggtttcccgacgcgggggccaccagaattcatataaaccttactag

SEQ ID NO: 24403 - DNA, 468 bp, Artificial Sequence
  Description of Artificial Sequence: Synthetic coding sequence
atgagcgaggagcagttcggcggcgacggcgccgccgccgccgccaccgcagccgtcgggggttctgcaggtgagcaggaaggagccatggtcgctgctacccagggcgccgctgccgcggctggatctggggccggaacgggtggtggcaccgcatctggaggaaccgaaggagggtcagctgaatcagaaggcgccaagatagatgcctccaaaaacgaagaagatgagggtaagatgttcatcggcggactgtcttgggataccacgaaaaaagaccttaaggattatttttctaaatttggcgaggtggtggattgtactctcaagctcgatccaattaccggcaggtcccgcgggtttggatttgtcctgtttaaagagtctgaatccgttgataaggtcatggaccaaaaggagcacaagcttaatggaaaggtcattgaccccaaacgggccaaggcctag

SEQ ID NO: 24404 - DNA, 666 bp, Artificial Sequence
  Description of Artificial Sequence: Synthetic coding sequence
atgagcgaggagcagttcggcggcgacggcgccgccgccgccgccactgccgccgtgggcgggtctgccggggaacaggagggtgcgatggtggccgccactcagggcgctgccgccgctgccggttcaggtgccggaaccggtggcggaactgcctcaggcggtacagagggcgggagcgccgagagcgaaggagcaaaaattgacgcttcaaaaaatgaggaggacgaggggcacagcaatagctctccgcgccattccgaggccgctacagcacagcgtgaggaatggaaaatgttcattggcggcctgagttgggataccaccaagaaagacctaaaagattatttctctaagttcggagaggtggtggactgcacccttaagctagaccccatcaccggtaggtcccggggattcggttttgtgctctttaaggaatccgagtcggtcgataaggttatggatcaaaaggaacataaactcaacggtaaagtcatcgatcctaaaagagcaaaggcaatgaagactaaagaacctgttaagaaaatcttcgtgggtggtctgtcacccgatactccagaggagaagatcagagagtatttcggaggattcggcgaggttgagagcatagagcttcccatggacaacaaaactaataaatag

SEQ ID NO: 24405 - DNA, 633 bp, Artificial Sequence
  Description of Artificial Sequence: Synthetic coding sequence
tgaaagatgttcatcggcggcctgagctgggacaccaccaagaaggaccttaaagattattttagtaagtttggcgaagtggtcgactgcaccctaaagctcgatcccattacagggaggtctcgtgggttcggattcgtgctctttaaggagagtgagtcagtcgataaagttatggaccagaaagaacataaactcaacgggaaggtgatcgaccctaagcgggcaaaggctatgaagacgaaggagccagtgaagaaaatctttgtagggggcttatcaccagacacacccgaagagaaaatcagagaatacttcggcgggttcggagaagttgaatcaatcgaacttcctatggataataagaccaacaagaggcgagggttctgttttattacgttcaaagaggaagagcctgtgaagaagatcatggagaaaaagtatcataatgtcggactttccaagtgcgagattaaggtcgccatgtccaaggagcagtaccagcaacaacagcagtggggcagcagaggggggtttgcagggcgtgcccgcggccgcgggggggaccaacagtctggctacgggaaggtgtccaggcgcggaggccatcagaactcttataagccctattag

SEQ ID NO: 24406 - DNA, 606 bp, Artificial Sequence
  Description of Artificial Sequence: Synthetic coding sequence
atggaccagaaggagcacaagctgaacggcaaggtgatcgaccccaagagagcaaaggccatgaagaccaaggaaccggtgaaaaagatattcgtcggcggactgagccctgacaccccggaagagaagataagggagtactttggagggtttggcgaggtggagagtatcgagctgccgatggataacaagaccaataagcgacgcgggttttgttttatcacattcaaagaggaggaacccgtgaagaaaataatggaaaagaaatatcacaacgtgggtctgagtaaatgcgaaataaaagtagctatgtcgaaagagcagtaccagcagcagcagcaatggggctcccgcggcggctttgccgggcgggctcggggcagaggggggggccctagtcaaaattggaaccagggctacagtaactactggaatcagggatacggcaattacggatacaattctcaaggatacgggggttacggcggctatgattacactgggtacaacaattactatggctacggtgattattccaaccaacagtcaggatacgggaaggtgagcaggaggggtgggcaccagaacagttataagccctattag

SEQ ID NO: 24407 - DNA, 912 bp, Artificial Sequence
  Description of Artificial Sequence: Synthetic coding sequence
atgagcgaggagcagttcggcggcgacggcgccgccgccgccgccactgcagcggccagcggtggcactgaaggagggtccgccgagagcgaaggtgccaaaatcgacgcatctaaaaatgaggaggatgagggcaaaatgttcatcggcgggttaagttgggacacaaccaaaaaagacttgaaagactatttctctaagttcggagaagtggtagactgcactttgaaactggaccccataacaggaaggagtcggggattcggctttgttctgttcaaggaatccgagtcagtggacaaggtcatggatcagaaagagcacaagctaaacgggaaggtcattgatcctaaacgcgccaaagccatgaagactaaggaacccgtcaaaaaaattttcgtagggggccttagccccgacacgcctgaggagaagattcgcgagtatttcggcggctttggcgaagtggaaagcatcgagcttcccatggacaataaaactaataagcgcagaggcttttgcttcatcactttcaaggaggaagagccagtgaagaaaataatggaaaagaagtaccacaacgtaggccttagtaagtgcgagattaaggtggcaatgtccaaagagcagtaccaacagcaacagcagtggggctcccggggcggctttgcgggaagggccaggggaaggggcggtggtcctagtcagaactggaaccagggatactctaactattggaatcagggctatggaaactatgggtacaatagccagggctacggcggctatggcggatacgactacaccggctacaacaattattatggctatggagactattctaaccaacagtcaggatatggtaaggtgtcacgaaggggcggccaccagaacagctataaaccatactag

SEQ ID NO: 24408 - DNA, 1974 bp, Artificial Sequence
  Description of Artificial Sequence: Synthetic coding sequence
atgccccggtacaccgtgcacgtgcggggcgagtggctggccgtgccttgccaggatgcacagttgaccgtcggttggttggggagagaagctgtgcggaggtatattaaaaacaagcccgacaatggcggctttactagcgtcgatgacgcccacttccttgtaaggagatgtaaagggctgggcctgcttgacaacgaagataggctggaggtggcattagaaaacaatgaattcgtggaggttgtcatcgaaggagacgccatgagcccagattttattcccagtcaacccgaaggggtgtatctttatagcaaatatcgtgagccggagaaatatattgagctggatggagaccgactgacaacagaggatctggtgaatttgggcaaaggcaggtataaaattaaactgacgccaactgcagagaagagggtgcagaaatccagggaagtaatagatagcattatcaaggaaaagacagtggtgtacggaatcaccaccggatttggcaagtttgcccgcaccgtgattcctatcaacaagctacaagagctacaggtgaatctcgtcaggagccactcgtccggagtgggaaagcccctcagccccgaacggtgtcgaatgttactcgcacttaggatcaatgtgctggccaaaggttacagcggaatcagcctggaaactctgaaacaggtgattgaaatgtttaatgcgtcatgcctcccatatgtgcctgaaaagggtaccgtaggagcgagtggagatttagctccactcagtcaccttgccctgggcctggtgggagagggaaaaatgtggagccccaaatcaggatgggctgatgctaagtacgtacttgaggcgcacggtctgaagccggtgatcctgaagccaaaggagggtttggccctgatcaacgggactcagatgatcacctcactcggatgcgaagcggttgaacgggcctctgcaatagcaagacaggcagacattgttgcggccctgacccttgaggtgctgaagggaaccactaaagcttttgatacggacatacatgccctaaggccacaccgcgggcaaattgaagtagccttcaggttcaggagtttgctcgatagcgatcatcatccatccgagatcgcagaaagccacaggttctgtgaccgtgtacaggatgcctacacactgcgctgctgcccccaggtgcacggggtcgtgaacgacaccatcgccttcgtcaagaacatcattactaccgaactgaattccgccacggacaaccccatggtgttcgctaatagaggcgagactgtgtctggcggaaacttccatggtgaataccctgcaaaggccctggattacctggccataggcatccacgagctggctgcaatctcagaaagaaggatcgaacggctgtgcaacccctctttgtctgagcttccggctttcctggtggcagagggtggactcaacagcggctttatgatcgctcattgcacagctgcagccctcgtaagtgagaacaaggcactttgtcaccccagttctgtcgactccctatcaactagtgcagcaaccgaagatcacgtctccatgggcggctgggccgccaggaaagccctgagagtgatcgagcacgtggagcaagtgctggccattgagcttctcgctgcatgtcagggcattgagtttctgaggccactcaaaacaacaactcctttggaaaaagtgtacgacctggtacgttccgtcgtacggccgtggatcaaagaccgctttatggccccagacattgaggcagcgcacaggcttctgctcgaacagaaagtctgggaagtggcagccccctacatcgagaagtatcgtatggaacacatccccgagtcacgtccactttcccctaccgcgttcagtctgcagttcctgcataagaagtccactaagatccccgaatcagaagacctttag

SEQ ID NO: 24409 - DNA, 1776 bp, Artificial Sequence
  Description of Artificial Sequence: Synthetic coding sequence
atgccccggtacaccgtgcacgtgcggggcgagtggctggccgtgccttgtcaggatgctcagctgaccgtgggatggctgggccgcgaggctgtgagaaggtatataaagaacaaaccagataacggggggttcacatcagtcgacgatgcacacttcctggtgcgccgctgtaagggcttgggactcctcgataacgaggatcgcctggaggtggccctcgagaacaacgaatttgttgaagtcgtgatcgagggagacgctatgagcccagatttcataccctcacagccagagggggtgtatctgtattcaaagtaccgggaacctgagaaatacatcgagcttgacggcgaccgtctcaccactgaggatttggtaaacctagggaaaggacggtacaaaattaaactgacccctacggccgagaaacgagttcagaaatcaagagaagttatcgactcaatcatcaaggaaaaaacagttgtctacggcatcactacaggcttcgggaagttcgctcgaactgtgattcctattaacaagctgcaggaactgcaggtgaaccttgttcggtcccactcatcaggcgtaggcaagcctctctccccagagaggtgcagaatgctccttgcactgcggattaatgtgctcgctaaaggatattcaggcatcagcttagagacactcaaacaggtgatcgaaatgtttaatgcctcatgccttccctacgtcccggagaagggaactgtaggagcctccggcgatctcgctcccctgtcacatttagccctggggctagtcggtgaggggaagatgtggagtcccaaatccggatgggctgacgcaaagtatgtgctcgaggcccacggccttaagcccgtcatcctcaagccaaaggagggcttagcccttatcaacggaacacagatgataacaagtttaggctgcgaggcagtggagcgtgcaagtgccatagccagacaggccgatattgttgccgccctgaccctcgaggttctgaagggcacgaccaaggcatttgacacagacattcatgccctgcggcctcaccgcggccagatagaggtcgcgttcagatttcgtagtctcctggactccgatcaccatccaagcgagatagccgagagtcatcggttctgcgatcgcgtgcaggacgcctacactctgagatgttgcccccaagtccatggagtcgtgaatgatactatcgcctttgtgaagaatataatcaccactgaactcaatagcgcaactgataatcccatggtgtttgccaacagaggcgaaactgttagcggtggcaactttcatggcgaataccctgcaaaggccttagattacctggcaatcgggattcatgaactggcagctatatcagaacggagaattgagagactgtgtaacccatccttgagcgagctgcccgcgttcctggtggccgaaggagggctcaactccggtttcatgatcgcccattgcactgcggcagctttggtgtccgaaaacaaggccctgtgtcatccatctagcgtggacagtctatccacgagcgcagctaccgaagaccatgtctctatgggtggttgggcagccagaaaagcacttcgagtgatcgagcacgttgagcaggtgctcgctatcgagctgcttgctgcctgccaggggatagaatttctcaggcctctcaaaaccacaactccactggaaaaggtctacgatttagtgcggtctgtcgtgcgctttggtaagtag

SEQ ID NO: 24410 - DNA, 1350 bp, Artificial Sequence
  Description of Artificial Sequence: Synthetic coding sequence
atgctgctggccctgcggatcaacgtgctggccaagggctacagcggcatctctctcgagaccctgaaacaggtaatcgagatgtttaacgcttcttgcctcccctacgtacctgaaaagggcaccgtgggcgcctcaggagatctcgccccgcttagccatcttgcactggggctggtaggggaaggaaagatgtggtctcccaagtcaggctgggcagatgccaagtatgtcttggaggcccatggactcaaaccagttattcttaagcccaaggaaggtcttgccctgataaacggaacccaaatgatcacgagcctgggatgcgaagccgtggaaagagcatccgccatcgctcgccaggcggacattgtggccgcactcaccctcgaagtcctcaagggaacaaccaaagcctttgacactgacatccatgccctccgaccacatagaggccagatagaggtggccttcaggttcagaagcctcctcgactccgaccaccacccgagcgaaatcgccgaaagtcatcgcttctgtgatagagtgcaggacgcttacacactccgctgctgcccacaggttcatggggtcgtgaatgacacaatcgcattcgtgaagaatatcatcaccacagaactgaacagcgcaacggataatccaatggtctttgcaaacagaggggagaccgtgtctggggggaactttcacggcgaatatcccgccaaagcccttgattacctcgccattggaattcatgagcttgccgccatcagcgagagacgcatcgagcgattgtgcaatcccagtcttagtgagcttccagccttccttgtcgccgagggaggccttaattctggcttcatgatcgctcattgtactgccgccgcactggtatcagaaaataaggcgctgtgccaccctagtagcgtagactccctttctacaagtgccgctactgaggaccatgttagtatgggaggatgggctgcccgcaaggcacttagggtaatcgagcatgtggagcaggttttagcgatagaactacttgcagcctgtcaggggatagaatttctgaggcccctgaagacaactacacccttagaaaaggtttacgacttggtgagatcagttgttagaccatggattaaagaccgatttatggcgccggacattgaagccgcccaccggctcttattggaacaaaaagtgtgggaagttgccgccccttatattgagaagtatcgcatggagcacattccagagtcgagacctctgagtcccacagccttctcactccagtttcttcacaagaagtctacaaaaatccccgagagcgaggacctgtag

SEQ ID NO: 24411 - DNA, 1260 bp, Artificial Sequence
  Description of Artificial Sequence: Synthetic coding sequence
atggccggcttcggcgccatggagaagttcctggtggagtacaagtccgccgtggaaaagaaactggctgagtataagtgcaatacgaacactgcaatcgaattaaaacttgtgagattccccgaggacctggaaaacgacatccgcacattcttcccggaatatacccaccaactgttcggcgatgatgagactgctttcgggtataaagggctcaagatattgctgtactacatcgcaggtagcctgagcaccatgttccgggtggagtacgccagcaaagtggatgaaaatttcgattgtgtggaagcagatgacgtggaggggaagattcggcagatcatacctccaggattctgtaccaacacgaatgactttctgtccctgttggaaaaagaggtggattttaagccctttgggaccctgcttcacacctattctgttctctcccccaccggcggagagaattttacgttccaaatctacaaggcggacatgacatgccgaggctttagggagtaccatgagaggcttcagaccttcttgatgtggtttattgagactgcgtcattcattgacgtggacgacgaaagatggcattactttctggtctttgaaaaatataataaggatggtgccaccctatttgcaactgtgggctacatgacagtatacaactactacgtttatcccgacaaaacccggcctcgtgtctctcaaatgctgatcttgaccccctttcagggtcagggccacggagcacagctattagagaccgtgcatagatattacaccgaatttcccactgtgttggacatcaccgcagaagaccctagcaaatcctacgtcaaactgcgggacttcgtgctggtgaagctatgccaagatcttccctgtttctcacgtgaaaagttaatgcaggggtttaacgaggacatggcaatcgaagcccaacaaaagtttaagatcaataaacaacacgcgcggagagtatacgagatcctgagactgctagttaccgatatgtcggacgccgaacagtacagatcatacagactggacatcaagcgacggctcatttctccatacaagaagaaacagagagatcttgctaaaatgcgtaagtgtctgcgacccgaggaattgacgaaccagatgaaccagatcgaaattagcatgcagcacgagcaactcgaggagtccttccaggaactggtcgaagactacaggcgagtgatagaacgcttagcgcaggagtag

SEQ ID NO: 24412 - DNA, 1005 bp, Artificial Sequence
  Description of Artificial Sequence: Synthetic coding sequence
atgttccgggtggagtacgccagcaaggtggacgagaacttcgactgcgtggaggcagacgacgtggaaggcaagataagacagattattcctcccgggttttgtactaacaccaacgattttctcagtctcctggagaaagaggtcgatttcaagcccttcggaactctgttgcacacttacagtgtgctgtcacctacagggggcgaaaatttcactttccagatttacaaagcagacatgacatgccggggtttccgtgagtaccacgaacgattgcaaacgttccttatgtggtttatagagactgccagcttcattgatgtggatgacgaacgttggcattactttctggtgtttgagaaatacaacaaggatggagctacacttttcgcaacagtcgggtacatgacggtatacaattactacgtgtatcctgacaaaacgcggccgcgggtgtcccagatgttaattcttaccccctttcaaggccagggacacggcgcccaacttctggagaccgtgcaccgttattacacagagtttcctacggtcctagacattactgcagaagacccttctaagtcttacgtgaaactgcgtgatttcgtgctagtcaaactctgtcaggacctgccctgcttttcccgagagaaactaatgcaaggattcaatgaggacatggccattgaagctcagcagaaatttaagattaacaaacagcacgcacgccgggtgtacgaaatcctcagactgctagttacagacatgtcagacgctgagcagtataggtcatataggctagacatcaagagacgcctgatttccccctataaaaaaaagcagcgcgacctggcaaaaatgagaaagtgccttaggcccgaagagctgactaaccaaatgaaccagatcgagatttcgatgcagcatgagcagctcgaagagtccttccaagagttggtggaagattataggagagttatagagcgcctggcgcaggagtag

SEQ ID NO: 24413 - DNA, 870 bp, Artificial Sequence
  Description of Artificial Sequence: Synthetic coding sequence
atgaccgtgagcttccacaagtacggcgagtacttccccggcaccggagatcttcgggacataggtgcgggcaaagggaaatactacgccgttaattatcccctgcgcgacggaatcgacgacgagtcttacgaggccatctttaagccagtaatgtcaaaagttatggagatgtttcagccctccgccgtagttcttcagtgcgggtctgatagtctatccggggatcgtctcggatgtttcaatctgacaattaagggacacgctaagtgtgtcgaattcgtaaagtccttcaatctgccaatgctaatgctgggtggcggtggttataccatcagaaacgtcgcaagatgctggacatacgagacagccgtggcgctagacacagagattccgaatgaattaccatacaacgactactttgagtactttggtccggattttaaactacatatatctccctcaaacatgacaaatcagaatactaatgagtacctcgagaaaattaagcagaggcttttcgaaaacctgcgtatgctgccacatgctcccggcgtgcagatgcaagcaattccggaggatgccatccctgaggaatccggcgacgaggacgaggacgatcccgataaaagaatctcaatctgctccagtgacaaacgcatcgcctgcgaggaagagttttctgatagtgaagaagaaggagagggcggcaggaagaattccagcaatttcaaaaaggccaaacgggtcaaaaccgaagacgagaaagaaaaagacccagaggagaaaaaagaagtgaccgaagaagaaaagactaaggaagagaaaccagaggcaaaaggggtaaaagaggaagtgaagttggcctag

SEQ ID NO: 24414 - DNA, 1449 bp, Artificial Sequence
  Description of Artificial Sequence: Synthetic coding sequence
atggcccagacccagggcacccggcggaaggtgtgctactactacgatggtgatgttggcaattattattatggccaggggcaccctatgaaaccccaccgtatccgtatgacccacaacctactgctgaattacggactctatcggaaaatggaaatctaccgccctcacaaggcgaatgctgaagagatgaccaaatatcacagtgacgactatataaagttcttaagatccattcgaccagataacatgtctgagtactctaagcagatgcagaggtttaatgtgggcgaggattgtccagtgttcgatggactctttgaattctgtcagttgtctactgggggtagcgtggcctctgccgtgaagctgaacaagcaacagacagacatcgctgtgaattgggctgggggattacatcatgcaaagaaatcagaggccagtggtttttgctacgtgaacgatatagtgctcgctatactagagttactgaaataccatcaaagggtgttatatatcgacatcgatatccaccatggggatggggtggaggaagctttctatactaccgacagggtaatgacagtgagcttccataagtacggcgagtattttcccggtaccggggatctgagagacataggcgccggaaagggcaagtattatgcagtgaactatcctctccgggatggcattgacgacgagagttacgaagctatcttcaagcctgtcatgagcaaagtgatggagatgtttcagccttctgcagtggtactgcaatgtggaagtgactcattgtccggagaccggctgggttgttttaatctgactatcaagggccacgcgaaatgcgtggaatttgtgaagtctttcaacctgcctatgttaatgttgggcggtggcgggtacacaataaggaatgtggccagatgctggacatacgagaccgccgtggccttagacaccgaaatccccaacgagcttccctataacgactactttgagtactttggtccagactttaaattgcacatttccccttccaacatgacaaaccagaatactaatgagtatctagagaagatcaagcagcggctgtttgagaacctgaggatgctcccacatgctcccggcgttcagatgcaggctatcccggaggacgccatccctgaggagagcggagatgaggacgaggatgaccctgataagagaatctctatttgttctagcgataagcgcatagcctgcgaggaagagttcagcgatagtgaggaagaaggtgagggagggcgtaagaattcctcaaatttcaagaaagccaagagagtcaagactgaggacgagaaggaaaaggaccccgaagaaaagaaggaggtgaccgaggaagaaaaaacaaaggaggagaaaccagaagctaaaggggtgaaggaggaagttaaattggcctag

SEQ ID NO: 24415 - DNA, 636 bp, Artificial Sequence
  Description of Artificial Sequence: Synthetic coding sequence
atggcccagacccagggcacccggcggaaggtgtgctactactacgacggggatgtaggcaactactattacgggcaaggccatccaatgaaacctcaccgcatcagaatgacccacaacctccttttaaactatggcctctaccgcaaaatggagatctacaggccccataaagctaacgctgaggagatgactaagtaccatagtgacgactatataaaattcctgcgctccatcaggcctgacaatatgagtgaatacagcaagcagatgcagcgctctagcgccgtgaaactaaataaacagcagaccgacatcgctgttaactgggctggcggcctccaccatgcgaaaaagtccgaagcttccgggttctgctatgtgaatgacattgtgctcgccattcttgagctactcaaataccaccagcgggttctttacattgatattgatatccaccatggcgatggtgtcgaggaggcattttacaccaccgaccgggtaatgactgtctcttttcacaagtatggggaatacttcccaggaactggcgacctgagagatataggtgcaggcaaaggaaagtactatgctgtgaattacccactacgagatggaatcgatgacgagagctag

SEQ ID NO: 24416 - DNA, 1044 bp, Artificial Sequence
  Description of Artificial Sequence: Synthetic coding sequence
atgctgcacaccacccagctgtaccagcacgtgcccgagacccggtggcccatcgtatactctcctcgatacaacattacatttatgggattggaaaagttgcatccttttgatgcagggaaatggggcaaggttataaattttctgaaagaggagaagctgctgtccgattcaatgttggtcgaggcccgggaggcctctgaagaagatctgctggtggtccatacacgcagatatctgaacgaactcaaatggagctttgcagtagccaccattaccgagattcccccagtgatcttccttcccaattttctggttcagcgaaaggttctgaggccgctaaggactcagacgggtggaacaatcatggcaggtaaactggccgttgagcgtggatgggccattaacgtggggggcgggttccatcactgcagcagcgatcgagggggtggcttttgtgcctacgctgacattacgttggctatcaagttcttatttgagagggttgagggtatatcacgggccacgatcatcgatctggacgcgcatcagggtaacgggcacgaacgcgacttcatggatgacaaaagagtgtacattatggatgtctataatcgacatatctatccaggcgatagatttgctaaacaggcgatacggcgcaaagtggaattggagtggggcacagaagacgatgagtacctggacaaagtggaaaggaatattaagaaatctctacaggagcacctgccggatgtcgtagtttataatgccgggaccgatatccttgaaggggacagactaggcggcctgtctatctcacccgcaggcatcgtgaagagggacgagctggtctttaggatggtcagaggccgaagagttccgattctgatggtaacctcaggcgggtatcagaagcggaccgcgaggatcatagcagactccatcctcaatctattcggtctgggcctcataggccctgagtcccccagcgtgtccgcacagaactcagacacaccgctcctaccacccgcagttccatag

SEQ ID NO: 24417 - DNA, 711 bp, Artificial Sequence
  Description of Artificial Sequence: Synthetic coding sequence
atgggcctggagaagctgcaccccttcgacgccggcaagtggggcaaagttatcaatttcctcaaggaagagaagctactgagtgattctatgcttgttgaagctcgggaggctagtgaagaggatctgctcgtggtgcacacccgcagatacctaaacgagctgaagtggagctttgcggtggctacaattactgagattccaccggtgatcttcctccctaactttttggtgcaaaggaaagtacttcggccgctgaggacacaaacaggaggcaccatcatgggtgtcgccagtactacagcgcctgctaccgtcgctggcgctagtgtccccatgcggacctctagatctccttcttccttctgcctgtccgtgtggagagcctcccctggtctcccatctctgattctgatgcccatccgggctatgggaatgtccgaaaccagctggacaacctccgtttgtacttcctggatgtccactacggcaacgagcacccaaggcaccgctctgccctccaggcccagtgggggacgttggtcctggtcgggcgctcagaggatgatgtccacctggattaggtggcgtgggacgtcgcggaatccaagccgctcaacctgtccgacttggtggtacactatgcaggcccctacctcatcacggggcacggcattagggggctgtccaagcgcacagcgggccagttag

SEQ ID NO: 24418 - DNA, 960 bp, Artificial Sequence
  Description of Artificial Sequence: Synthetic coding sequence
atgggcctggagaagctgcaccccttcgacgccggcaagtggggcaaggtcattaacttcttgaaagaggagaaactcctttctgactctatgttggtcgaggcaagggaagcctcggaggaagatcttcttgtggtccatacgcgcaggtatctgaacgagctgaaatggtctttcgccgtggcgacaatcactgagatacctccagtcatcttcctccctaattttcttgttcagcgcaaagtgctcaggcccctgcggactcaaactgggggcactatcatggccgggaaactcgccgtggaacggggctgggccatcaacgttggcggaggctttcaccactgctccagtgatcgcggcggcggcttctgcgcctatgccgacattacactggccattaaattcttgttcgaaagggtagaagggatttcgagagctacgattattgacctcgacgcccatcaggggaacggccacgaacgcgacttcatggatgacaagagagtgtacatcatggatgtttataaccgacatatctatcctggagatcgcttcgcaaagcaggcaattaggcgcaaagtcgagctggagtggggcaccgaggatgacgagtacctagacaaggtggagcggaacataaaaaaatccctccaggaacacctgcccgatgttgtagtctataatgccggaactgacattctggaaggggatagactgggaggactgagcatcagccccgccgggatcgtaaagcgcgacgaactggtgttccgcatggtgcgtgggaggagagtacccatcctcatggtcacatcaggcggctaccagaagcgcacagctcgcattatcgccgactctatactaaatctgttcgggttgggcttaatcgggcccgaaagtccgagtgtgtccgcgcagaactccgatacccctttattgcctcctgccgtgccgtag

SEQ ID NO: 24419 - DNA, 468 bp, Artificial Sequence
  Description of Artificial Sequence: Synthetic coding sequence
atggacgacaagcgggtgtacatcatggacgtgtacaaccggcacatttacccaggggacagattcgcaaagcaggcgatcaggagaaaagtggaactcgaatggggtacagaagatgacgaatatctggacaaagtggagcggaatattaagaagtctctccaagaacatctgccagacgttgtcgtgtacaatgcagggaccgacattctagaaggggaccggctcggagggctgtctatcagcccggccggcatcgtgaaacgagacgagctcgtattcagaatggtgcgcgggcggagggtccctatcctgatggtgacttccggaggatatcagaagcgaacagcaaggattatcgccgattccattctaaatctcttcgggctcggattgatcggtccggagtcaccctccgtctcagcccagaactccgacacacctctgctcccccccgctgtgccctag

SEQ ID NO: 24420 - DNA, 891 bp, Artificial Sequence
  Description of Artificial Sequence: Synthetic coding sequence
atgggcctggagaagctgcaccccttcgacgccggcaagtggggcaaagtgatcaattttctgaaagaggaaaagctcctgtcggactcaatgctggtggaggccagggaggcgtctgaggaagatttgctcgttgtgcacaccaggaggtacctgaacgagcttaaacggaaggtactgagacctctcagaacacagactgggggaacgattatggccggcaagttagccgtggaacggggctgggcaatcaacgttgggggcggcttccaccattgctcctctgaccggggcggtggattctgtgcctacgcagatattactctcgctattaagtttttattcgagcgcgttgagggcatcagtcgcgctacaataatcgacttagatgcccatcagggtaatggtcacgagagagacttcatggatgataaaagggtctatatcatggacgtctataatagacatatttatcctggcgatcgcttcgccaaacaggcaatcaggcgaaaggtagaattagaatggggcaccgaagacgatgaatacctggacaaagtggagcgcaatattaaaaagtctctccaagaacatctccccgatgtagtagtctacaacgctggaactgacatactcgagggcgaccgtctaggtggattgagcatctcacctgccggaatcgtgaagagagatgagctcgtttttaggatggtgcggggccggcgggtgcccattctgatggttacctctggcgggtaccagaagcggacggccagaataatcgccgactccatattaaacctattcgggcttggactgatcggtcctgaatctccttccgtgtcagcccaaaactccgacactccgctgctccctccagcggtgccctag

SEQ ID NO: 24421 - DNA, 1377 bp, Artificial Sequence
  Description of Artificial Sequence: Synthetic coding sequence
atgaagccccaccggatccggatgacccacaacctgctgctgaactacggactctataggaaaatggaaatctatagaccacacaaagccaccgctgaagaaatgacaaagtatcatagcgacgaatatataaagttcctgcggagtataagacccgataacatgtccgagtattctaagcaaatgcagaggttcaacgttggtgaagattgccctgtgttcgatggactgttcgagttttgccagttgagcacggggggaagtgtggctggtgctgtgaagcttaaccggcagcagacagatatggcagtgaattgggcaggcggtctgcatcatgcaaagaagagtgaggcaagtggcttttgttatgtgaacgacatagtcctcgctatcctcgagttacttaaataccatcagagagtcctgtatatcgatatcgatatacaccacggggatggagtggaggaagctttttacacaactgaccgcgtgatgacagtgagcttccataaatatggagagtactttccagggaccggcgatctaagggatattggtgcaggcaaggggaagtattatgctgtcaatttcccaatgcgcgatggcatcgatgatgaaagttacggccagatctttaaaccaattatctccaaagtaatggaaatgtaccagccaagcgcggtggtactacaatgtggcgctgatagcctatctggcgacaggctgggatgcttcaatcttacggtgaagggacatgccaagtgcgtggaggtggtcaagactttcaacctgccgctgctgatgctgggtgggggcggctacactatccgcaacgtggcacggtgttggacatacgaaaccgcagtggcattagactgtgagatcccgaatgagcttccatataacgactacttcgaatacttcggtccagattttaagctgcacattagcccatcaaatatgaccaaccaaaatacacctgaatacatggaaaagattaagcagcggttattcgagaatctccgcatgttgcctcacgctcccggggtgcagatgcaggcaattccagaagatgcagtgcacgaagattcaggcgacgaagatggagaggatcctgataaacgcatctcaatccgcgcatccgacaaacgtattgcctgcgatgaagaattcagtgactctgaggatgagggagaaggcggccgccgaaacgtggccgaccataaaaagggggccaaaaaagccaggattgaagaggataagaaggagacagaagataaaaagacagatgtgaaggaggaagataagtccaaagataatagcggcgagaagaccgacaccaagggcactaagtccgaacagttgagtaacccatag

SEQ ID NO: 24422 - DNA, 1749 bp, Artificial Sequence
  Description of Artificial Sequence: Synthetic coding sequence
atgcggagccccccctgcggcctgctgcggtggttcggcggccccctgctggcctcttggtgtcggtgccatctgcgcttcagggcatttggcactagtgctggctggtatcgcgcattccctgcacctcctccactgctgcctcctgcctgccccagtccccgcgactaccgccctcacgttagcctgagtccatttctgtcgcggccctccaggggcggaagctcctcctcgagcagcagcaggcgccggagccctgtggcagccgtggccggcgagccgatggcctattcgcaggggggaggcaagaagaaggtttgttactactacgatggagacattgggaactattattatggccaaggacatcccatgaaacctcaccgcattcgcatgacccataatcttctgcttaattacggcctgtataggaagatggaaatttaccgaccgcacaaggctaccgctgaagaaatgacaaagtaccatagcgacgaatatatcaagttcttaaggtccataaggcccgataacatgtcagaatattctaaacagatgcagcgctttaacgtgggggaggactgtcccgtgttcgatgggcttttcgaattctgccagctttctaccggagggagcgtcgcaggggcagttaagcttaatagacaacaaaccgatatggctgttaattgggctggtggcctccaccacgccaagaaatccgaggctagtggattctgttacgttaacgatatagtgctcgccatcctggaactgctgaagtatcaccagcgcgtgctctacattgatatcgacatccaccatggagacggggtcgaggaggccttctacacaacggaccgcgtcatgacagtgagttttcacaaatatggagagtactttccagggacaggggatctgcgggatatcggtgctggaaaggggaagtattacgcagtcaactttccaatgagggacggcatcgatgacgagtcctatgggcaaatcttcaaacctatcatttccaaggtgatggagatgtaccagcccagcgctgttgtgctgcaatgcggggccgacagtttatccggagatcgcctcggctgttttaatctgacagttaagggccatgccaaatgtgtcgaagtggtgaaaacctttaatctccccctattaatgctgggaggggggggatacactataagaaacgtggctaggtgttggacgtatgagaccgccgtagctctggattgtgagatccctaacgagctgccatacaatgactatttcgaatacttcggaccagactttaaacttcatatttccccgtcgaatatgacaaatcagaacacccctgagtatatggagaagatcaagcagaggcttttcgagaacctgcgtatgctgccccatgcccctggcgtacagatgcaggctattccggaagatgccgttcatgaagattcgggtgatgaagacggggaggacccagataaacggataagtatcagagctagcgataagcgcattgcctgcgacgaggagttttcagatagcgaggacgagggtgaagggggacggcggaacgtcgccgaccataaaaagggcgctaagaaggctagaatcgaagaggataagaaagaaacagaagacaaaaagaccgacgtcaaggaagaagacaagtcaaaagacaattcgggagaaaaaaccgatacaaaggggacaaagtcagaacagctgagtaacccgtag

SEQ ID NO: 24423 - DNA, 1467 bp, Artificial Sequence
  Description of Artificial Sequence: Synthetic coding sequence
atggcctacagccagggcggcggcaagaagaaggtgtgctactactacgatggtgatataggtaattattattatggtcaggggcatcctatgaagccccatcggatcaggatgacccataatcttctcctgaactatggactgtaccgcaagatggaaatctatcgacctcacaaagctaccgccgaggaaatgaccaagtatcactccgacgagtacatcaaattccttaggtccatccgtcccgacaatatgtcagaatattcgaaacagatgcagcgtttcaatgtgggcgaggactgtcctgtgtttgacggcctcttcgagttttgccagctgtccacaggaggaagcgtggctggggcggtaaagctgaatcgccaacagaccgacatggcggttaattgggccggcggcctgcaccacgccaagaagtcagaggcatctgggttttgctacgtaaacgacattgtgctggctatcctagagctgctgaagtatcatcagcgagtcctctacatcgatatcgatatccatcacggagacggcgtggaggaagctttttataccacagaccgggtgatgactgtgagttttcataagtatggagagtacttcccaggcactggcgacctacgagacatcggcgccggtaaaggtaagtactacgctgtcaactttcctatgagagacgggatcgatgacgagtcttacggccagatttttaaacccatcattagtaaggtcatggaaatgtatcagcccagtgcagtggtcttacagtgcggtgccgacagcttatcgggcgatcggctaggttgtttcaatctaaccgttaaagggcacgcaaagtgtgtggaagtggtaaagacatttaatctaccgctgctcatgctgggtggcggcggttacaccattaggaatgttgcgaggtgttggacctatgagactgcagtcgccctggactgcgagatccccaacgagctcccatacaacgactactttgagtatttcgggcccgactttaaactacacatcagccctagtaacatgaccaatcagaacaccccggaatatatggaaaagatcaagcagagactgtttgagaacctgaggatgttgccgcatgcaccaggcgtccagatgcaggccattcctgaagatgctgttcacgaggactccggggatgaagacggcgaggatcccgacaaacggataagcattagagcatcagacaaacggatcgcctgtgacgaggaattcagcgatagcgaagatgagggggaggggggaaggcgtaatgtggcagatcacaaaaagggcgccaagaaagccaggatcgaggaggataagaaagagactgaggataaaaaaaccgatgtcaaagaagaggataaaagtaaggacaatagtggcgaaaaaaccgatactaagggcacaaagtctgagcagctcagcaatccctag

SEQ ID NO: 24424 - DNA, 1377 bp, Artificial Sequence
  Description of Artificial Sequence: Synthetic coding sequence
atgaagccccaccggatccggatgacccacaacctgctgctgaactatgggctctaccgaaagatggagatttatcgtccccacaaggccacggcagaggagatgactaagtaccactcggatgagtacatcaagtttttgagaagcatccgaccagataacatgtcagagtattctaagcaaatgcagcgcttcaatgtaggagaggattgccctgtgtttgacggattgtttgagttctgtcagctctctactggggggtccgtagcaggagcagtcaaactgaacaggcagcagacagacatggcagtcaattgggccggcggcttgcaccatgccaaaaagtcagaggcttctggattctgctacgtgaatgatatcgtgctagccatcttggagctgctcaagtatcatcagcgcgtgctttacatagacatcgatatccatcacggagatggtgtggaagaagcattttacaccaccgatagagtgatgaccgtatcctttcacaagtatggcgagtactttccagggacaggagatttgcgagacattggagctgggaaaggtaagtattatgccgtgaatttccctatgcgggacggtattgatgacgagtcatatggtcagatctttaagccgatcatctccaaggttatggagatgtaccagccgagcgccgtggtgctgcagtgtggggcagatagcttgtctggagaccgcctcggctgtttcaatctgacggttaaagggcacgctaagtgtgtggaagtggtcaaaacgtttaatctgcccctacttatgctcggcgggggaggttacacgatccgaaatgtggccagatgctggacctatgaaacggccgttgctctggattgtgagataccgaacgaactgccctataacgactactttgaatatttcggacctgatttcaaactgcatattagcccaagcaatatgacaaaccagaatacacctgaatatatggagaagattaagcaaaggcttttcgagaacctgcgcatgttgccacacgcccctggggtacagatgcaagcgataccggaggacgccgtgcacgaggactcaggcgatgaggacggggaagacccggacaaaagaataagcatccgagcgtctgataaacgtatagcttgtgatgaggagttttctgacagcgaagatgaaggagaaggcggacgccggaatgtcgcagaccataagaagggggccaaaaaggccagaatcgaggaagacaagaaggaaacagaggataagaaaacagatgtcaaagaggaagataaatccaaggacaatagcggggaaaaaaccgacaccaaagggacaaaaagcgagcaattgtcaaacccctag

SEQ ID NO: 24425 - DNA, 1287 bp, Artificial Sequence
  Description of Artificial Sequence: Synthetic coding sequence
atggccaagaccgtggcctacttctacgaccccgacgtgggcaacttccattacggcgctggtcatcctatgaaaccccatcgtctggccctgactcacagtctcgtgctccactacggtttgtataaaaagatgattgtattcaaaccgtaccaggcttcccagcacgacatgtgccgattccattccgaggattatattgatttccttcaaagggttagcccaaccaacatgcagggttttacgaaatcactgaatgcattcaacgtgggagatgactgtcccgtttttcccggcctcttcgaattttgcagccggtataccggagcatccctgcagggagcaactcagctgaacaataagatttgtgatattgcgattaactgggctggcggtttacatcatgcaaaaaaattcgaggcttccggtttttgttacgttaatgacatcgtgattgggatccttgaactgcttaaatatcacccacgggtactgtacattgatatcgacatacatcatggggacggcgtacaggaagccttttacctgaccgaccgcgtgatgaccgtgtccttccacaagtacggcaactatttttttccaggcaccggcgatatgtacgaggtcggagccgaatctggtaggtactactgtcttaatgtgcccctgcgggacggaattgatgaccaatcatataaacatctgttccaacccgtgatcaaccaggtagttgatttctatcagcccacctgcattgtgctccagtgcggcgcggacagcctgggatgtgacagattaggttgctttaacctttccatccgtggccacggagagtgtgtggaatacgttaagagcttcaacatcccactgctggtgctgggcggggggggttacactgtgagaaacgtggcacgatgctggacctatgaaacctctcttctcgtcgaagaagccatatcagaggagctgccctactcagagtactttgagtactttgctcccgattttacactccatcccgatgtctccacccgcattgaaaaccagaattcacggcagtacctcgaccagataagacagacaatttttgagaacctgaagatgttgaaccacgccccaagtgtgcaaatccatgatgtgccagctgacttgttaacttacgataggacagatgaagcagacgcagaagagcgaggtcctgaggagaactactccagacccgaggcccccaacgagttctatgatggcgaccatgacaatgacaaggagagcgacgtggagatttag

SEQ ID NO: 24426 - DNA, 3255 bp, Artificial Sequence
  Description of Artificial Sequence: Synthetic coding sequence
atgagcagccagagccaccccgacggcctgagcggccgggaccagcctgtggaacttctcaaccctgcccgcgttaatcatatgcctagcaccgtggatgtcgcgacagccctccctctccaagtggctccatccgcagttcccatggatttgcgtctggatcatcaattttccctgccagtggctgagcctgccttgcgggaacagcagctgcaacaggagctcctggctctaaagcagaaacagcagattcagaggcagatactgatcgcagagtttcagagacagcacgaacaactgagccgtcagcacgaggctcagcttcatgaacatattaagcaacagcaggagatgttggccatgaaacaccagcaagaactgctggaacatcagcggaagctggagagacaccggcaggaacaggaactggaaaagcagcacagagaacagaagctgcagcaactgaaaaacaaggagaaaggaaaggagtcggccgtcgcttcgactgaggtgaagatgaaactgcaggagttcgtcctcaacaagaagaaagcgctcgcccaccgcaatctcaatcattgtatctcctctgatccgcggtattggtacgggaaaacccaacattcctctctggaccaatcctcaccgccacagtcgggagtctcgactagttacaaccaccctgtcttgggaatgtatgacgctaaggacgattttcccctgcggaaaacagccagcgaacctaacctgaagctgcgatcgcgcctgaaacaaaaggttgctgaaagacggagctctcccctactgcggagaaaggatggacccgtggtgacagcactgaaaaagcgtcctctggacgtgaccgattctgcctgctcctctgctcccgggagcggtcccagctctcccaacaattcatcggggtcggtatctgccgaaaatggtattgccccagcagtgccatctatccctgccgaaacctccctggcacacagactcgtcgcaagggagggttcagccgcccccctgcccctgtacacttctccaagcctgcctaacattacccttgggctgcctgcaaccgggccatccgccgggacagctggacagcaggacgcagagcgcctgacactgccggctctccagcagcgcctgagcctgtttcccggcacacatctgaccccctatttatccaccagccccctggagagggatgggggcgctgcccattccccactactgcagcatatggttttgctcgagcagcccccggcacaggctccactggtcacagggctgggcgctctgccactacacgcacagagccttgtcggagcagaccgggtgtccccctcgatccacaaactgcgacagcatcgccccctgggccgtacccagtcagcccctctgccacagaatgcacaagcattgcagcatctggttatacagcaacaacatcaacagtttttggagaagcataagcagcagtttcagcaacagcaactgcagatgaacaaaattataccaaaacccagcgagcccgccagacagccagagtcccaccccgaagaaaccgaggaagagctcagagaacaccaagctttactggatgaaccctaccttgaccgattgcccggccagaaagaggcgcacgctcaagccggggtccaggtcaagcaggagccaattgaaagcgacgaagaagaagccgagccccccagggaagtggaaccaggtcaacgacagccatcggagcaggaactcctgtttcgccaacaggccctcctcctcgagcagcagaggatacatcagctgcgtaattaccaggcaagcatggaagccgccggtatcccagtctcattcggaggtcaccgacccctcagccgcgcccagagcagccctgccagtgcgacattccctgtctccgtgcaggagcctcccacgaaaccccggtttaccacgggactggtgtatgacactcttatgctcaaacaccagtgcacttgcggaagttcttcctcccatcctgaacatgccgggcgcatccagagcatctggtcaaggctgcaggaaactggactccgagggaagtgcgagtgtataaggggcagaaaggcgacactggaggaactacaaactgtgcatagtgaagcacatacactgctgtacggcacgaacccccttaatcgccagaagctcgacagcaagaaattgctgggatcccttgcttctgttttcgtgcggctgccctgtggaggcgtgggcgtagactccgacactatttggaatgaagtgcacagcgctggtgccgccagactcgcggtagggtgtgtcgttgagctggtgtttaaagtggctaccggcgaactgaagaacgggttcgcagtggtgagaccccccggtcatcacgccgaggaaagcacgccaatgggattttgctactttaattctgtggcggtggctgccaagctcctccagcagcgactgtctgtgagcaagattttaatcgtggactgggatgtccaccatgggaacgggacccagcaggccttttattccgatccctcagtactctacatgagcttacacaggtacgatgacgggaatttcttcccaggatcaggcgcaccagacgaggtgggcacgggccctggcgttggcttcaacgttaacatggccttcacgggtggactggaccctcctatgggggatgctgagtacctcgccgcttttagaaccgtggtgatgccaattgcatcggaattcgctccggacgtggtccttgtgagctcaggctttgacgctgtggaagggcacccaactcctttgggcgggtacaacttgagtgcccggtgttttgggtacctgaccaaacagctgatgggtctggccggcggccggatcgttttggcactagagggggggcacgatctgaccgcgatctgcgatgcctccgaggcctgcgtatctgccctgctaggtaacgagctggatcctctcccagagaaggtgctgcagcagcgacccaatgctaacgccgtgcgcagcatggaaaaggtcatggagatccactcaaaatattggaggtgcctgcagcggacaacctcaactgctggtcgttcgttgattgaggcccagacctgtgaaaacgaagaggctgaaacagtaacggcaatggcaagcctgtccgtgggtgttaaacccgctgaaaaacggcccgacgaagagcctatggaagaagagcctcccctgtag

SEQ ID NO: 24427 - DNA, 1941 bp, Artificial Sequence
  Description of Artificial Sequence: Synthetic coding sequence
atgctggccatgaagcaccagcaggagctgctggagcaccagcggaagctcgagaggcaccgacaagagcaagagcttgagaagcagcatcgggagcagaaattacaacaactgaagaacaaagagaaggggaaggaatccgctgtggcttctaccgaagtcaagatgaagctgcaggagtttgtgcttaacaagaagaaggcactggcacacagaaacctaaatcattgcatatctagcgatcccagatattggtacggtaaaacgcagcattcttccttagaccagagtagccccccccagagtggggtgtccacatcatataatcaccctgtgctgggaatgtacgacgccaaagatgattttcctctgagaaaaactgctagcgagcccaatctaaaattgagatcacgcctaaaacaaaaggtggccgagagacgcagcagtcccctgctgagacggaaggacggccccgtcgtgactgcgcttaagaaaagaccactcgatgtgacagacagcgcatgtagttctgcccccgggagcggcccctcttcacccaataactccagtggtagtgtctcggcggagaatggaatcgctcctgccgtgccctctattcccgctgagaccagtctggcacacaggcttgtggctagggaaggttctgcggccccattgccgttgtacacctcgccatccctccccaacatcacactcggacttccagcaactggcccttcagctggtactgctggtcaacaggatgcagaaagactcaccctgccggcacttcagcagaggctttctctgttccctggcacccaccttacaccttacttgtcaactagtccactggagcgcgatggcggtgctgcccactccccccttctgcagcatatggtgctcctggagcagccacctgcgcaagcccccctcgttaccggactcggcgcgctgcccctgcatgcacagagtcttgtcggggcggaccgggtgtcaccttcaattcacaagcttaggcagcacaggcctctgggccgcacccagtcagctcctctcccccagaacgctcaggccttacaacacctggttatccagcagcagcaccagcagttcctggaaaagcacaaacaacagttccagcagcagcagctgcaaatgaacaagattatacccaagccttcagaaccagcgaggcaaccggaaagccatcccgaagaaacagaggaggagctgcgggaacaccaggccctcctagatgagccatatctggaccggctgccagggcagaaggaggcacacgctcaggcaggggtgcaagtgaagcaggagccgattgagagcgacgaggaggaagcagagcccccccgcgaagttgagccgggccaaagacaaccatctgagcaggaactcctgttccgccaacaggccctgctgctcgaacaacaacgtatccatcagctgagaaactaccaggcgagcatggaagccgcaggaatccccgtctcttttgggggacatcgcccacttagtagggctcagagctccccagcttcagccacattccccgtcagtgtgcaggagcctcctaccaagcctcgcttcactactgggctcgtctacgacaccctgatgcttaagcatcagtgcacctgtggatcttcatctagccatcctgaacatgctggaaggatccagtctatctggagcaggctgcaggagaccggactgaggggcaagtgtgagtgcatcagaggacgtaaagccactttagaagagttgcaaacagtgcattctgaggctcatactctcctatacggaacaaatccactgaatcggcagaaacttgacagcaagaaactgctggggagcctcgcaagcgtgttcgtgcggctgccatgcggcggagtaggcgtctctgttccgctgatgtgcaagtag

SEQ ID NO: 24428 - DNA, 2919 bp, Artificial Sequence
  Description of Artificial Sequence: Synthetic coding sequence
atgctggccatgaagcaccagcaggagctgctggagcaccagcggaagctcgagcggcaccggcaagaacaagagctggagaaacagcaccgggagcagaagttacagcagctgaagaataaggagaagggcaaagaaagtgccgtggccagcacagaggtcaaaatgaagttgcaagaatttgtccttaataaaaagaaggctctagcgcaccggaacctaaatcactgcatttcctcagatccccgctactggtacggcaaaacccagcactccagcctggatcagagcagtccaccacagagcggggtctcaaccagctacaaccatccggtcctcggcatgtatgacgccaaagatgactttccacttcgcaagaccgcctctgaacccaatctgaagttaagaagccgcttgaagcagaaggttgcagagagacgttcatctccgttgctgaggcgtaaggatggtcctgtagtgacagccttgaaaaagagaccccttgacgttacggactccgcttgtagttctgctcccgggtccgggccatcttcccctaacaatagctcaggctcagtctccgccgaaaatgggattgcaccagcagtccctagcatcccggcagaaacatctctggcacacaggctggttgcgcgtgaggggtccgccgccccacttcctttatacacctcaccgagtctcccaaacattaccctggggctgccagctactggacctagcgccggtactgccgggcagcaggatgcagagcgacttacccttcctgccctacagcagcgtctgtccctgtttcctggtactcatctgactccttaccttagtactagcccacttgaacgcgatggaggcgctgctcacagtccgttgctacagcacatggtcttactggagcaacctcctgcacaggctcctctggtgaccgattggtatcttagcggcctgggcgcactgcctctccatgcgcagtctctggtgggcgccgatagggtgagcccctcaatccacaaactgaggcagcacagacccctggggagaacacagagtgcccctcttcctcagaacgcacaggccctccagcatctcgttattcaacagcaacaccagcaattcttggaaaaacataagcagcagtttcagcagcagcagctgcaaatgaataagattatccctaagccatcagaaccagctcggcaacccgaatcccacccggaggagaccgaagaggagctgagagaacaccaggctcttcttgatgagccatacttggaccggctgcccggacaaaaagaggctcacgcccaggccggtgtgcaggtgaaacaagagccaattgagagcgatgaggaggaagccgaacccccgcgggaggtcgaacctggacagcggcaacctagtgaacaagagcttttatttagacaacaggcattactgctcgagcagcagcgtatccatcaactgcgtaactaccaggcgtctatggaggccgccgggatccccgtcagctttggcggccatcgcccgctcagcagggcacagagctcgccggcttccgccacgttccccgtgtctgtgcaagagccaccgaccaagccaaggtttacaaccgggctcgtatatgatacactaatgctgaagcatcaatgcacatgcggaagctcctcctcacaccccgaacacgctgggaggattcaaagtatttggtcccggcttcaggagactggactcagaggtaagtgtgagtgtataaggggacgtaaagccacgctggaagagctgcagactgtgcacagcgaggcacacacccttctttacgggactaatccgttgaacagacaaaagctagacagcaagaaactgctaggaagtctggcctccgtgttcgtgcgactcccgtgcgggggggtgggcgtggattccgatacaatatggaacgaagtgcattctgcaggggccgcaagacttgctgtaggatgtgtcgttgaactggtgttcaaagtggctactggagaacttaagaacggcttcgcagtggtcaggcctccggggcatcacgccgaggagtcaactcctatgggtttctgctattttaacagtgtcgcagttgccgcgaaactgttacagcagagactctcagtttcaaaaatcctgatagtcgactgggatgtacaccacgggaacggaacccagcaggcgttttactcagaccctagtgttctgtacatgagcctgcacaggtacgacgatgggaatttctttcctggttcgggcgccccagatgaagtaggcaccggacccggagtcggtttcaatgttaacatggctttcacaggcggactggatccacctatgggggacgccgaatacctggctgcttttcggactgtggttatgcccatcgcctctgagttcgctccagacgtggtactggtaagctcgggattcgacgctgtagaaggccaccctacaccactcggggggtataacctgtctgctcgttgctttggctatcttacgaagcagctcatgggactcgctggcggccgtatagttctggcgctcgaaggaggccacgatctgacagccatctgcgatgcgtccgaagcctgtgtgtctgccctactgggcaacgaactggaccctctgcctgagaaggtgctgcaacagagacccaacgccaacgctgtaagaagtatggagaaagtgatggagatacactctaagtactggaggtgcctgcagcggactacctctaccgcaggacgttctcttatcgaagcgcagacatgcgagaatgaggaggctgagaccgtcaccgcaatggcaagcctttccgtaggagtgaagcctgccgagaaacgtcccgatgaggagcccatggaggaggagcctcctttgtag

SEQ ID NO: 24429 - DNA, 2214 bp, Artificial Sequence
  Description of Artificial Sequence: Synthetic coding sequence
atggacgtggccaccgccctgcccctgcaggtggcccccagcgccgtcccaatggacctgcggcttgatcaccagttttctctccccgtagcggagcccgcccttcgggagcagcagctccagcaggaactgctagctttgaagcagaaacagcagatccagcggcaaatcctcatcgccgagttccagcgccagcatgagcaactttccagacaacacgaagcccagttgcacgagcacatcaaacagcagcaagaaatgttggccatgaagcaccagcaggagctactggaacatcagagaaagttggaaaggcatcggcaggaacaggagctagaaaaacaacatcgcgagcagaaactgcaacagctcaaaaacaaggagaagggtaaggaatccgcagtggcctctacggaggtcaagatgaagttacaggagttcgtgttaaacaagaaaaaggcactggcccaccgcaacctaaaccattgtatcagttcagatccacgctactggtacggtaagacacagcatagcagtctggatcagtcctcacccccacaatcaggtgtttccacttcctacaaccaccccgtgctgggtatgtatgatgctaaagacgatttccctctcagaaagaccgccagtgagccaaatttgaagctcaggagtcggctgaagcagaaagtggcggaaagacgctcctcccccttgctccgccggaaggacgggcctgtggtgactgcactgaaaaaaaggcccctcgatgttaccgattcagcctgctcctctgcaccaggtagcggcccctcatcacccaataacagctcagggagcgtctctgctgagaacggcattgctcctgccgtgccctccatccctgccgagacatctttggcccacaggcttgtcgcccgggagggctccgctgctcctctccccctttacaccagtccttcccttcccaacatcacgctgggactgcctgccaccggtccctcagcaggcaccgcaggccagcaggacgctgagagactcaccctgcctgccttacaacagagactgtctttgtttccaggtactcacctcaccccctacctgagcactagccccctagagagagacgggggtgcagcccactcccctctgctgcagcacatggtgctgctcgaacaaccccccgcccaggcacctcttgtcactgattggtatctgtctggtcttggagcactacccctgcacgcccaatctcttgtcggagcagacagagtttcccctagcattcacaagttacgccagcaccgaccgctcggcagaactcagtctgcgcctctgccccagaatgcgcaagcattgcagcatctagtcatccagcagcagcaccaacagttcctggaaaagcacaagcaacagttccagcaacagcagttacagatgaacaagatcattcctaaaccctctgagccagcccgccaacccgagtctcatcccgaggaaaccgaagaagagttacgggagcaccaagccctgctggacgaaccttacctcgatcggctgcccggtcaaaaggaagcccacgcccaagcaggggtacaggtcaagcaggaacctatcgagtccgacgaggaggaggctgaaccccctcgcgaggtggaacctgggcagcgccagccatctgagcaggagctactctttagacagcaggctcttctacttgagcaacagagaatccatcagctgcgtaactaccaagctagcatggaagcggccgggattcctgtctcgttcggcggacataggcctctgtccagggcccagagctcccctgccagtgctacgttcccagtgtccgtgcaggaaccaccaactaaaccacggtttactaccggcctcgtgtatgacacactcatgctgaaacaccagtgtacttgtggctcctcttccagccatccagagcatgctggtaggatacagagtatctggagcaggctgcaggaaactggtcttcgcggtaaatgtgagtgcattcggggacgcaaggccactctggaagagctgcagacagtccacagtgaagcgcatacactcttgtacggtaccaatcctctcaatcgccagaaacttgactccaaaaaacttcttgggagtctcgctagcgtgttcgttcgcctcccctgcgggggcgtcggggtttcggtacccctgatgtgcaagtag

SEQ ID NO: 24430 - DNA, 2007 bp, Artificial Sequence
  Description of Artificial Sequence: Synthetic coding sequence
atggtgctgctggagcagccccccgcccaggcccccctggtgaccggactaggcgccctcccactgcatgcccaatctctggttggcgctgacagggtttccccatctatccataagttaagacagcaccggcccctcggccggacccagtctgccccactgcctcaaaacgcccaagccctgcagcacttggtgatccagcagcagcaccagcagtttttggaaaagcataagcaacagtttcagcagcagcagctacagatgaacaaaatcattcccaagcctagtgagcctgctcgacagcctgagtctcatccggaggaaacagaagaggaactgcgtgagcatcaggcgctgttagacgagccatatcttgataggctgcccggccagaaagaagcccacgcacaagccggtgttcaggtaaagcaggagcctattgaatcagacgaagaagaggccgaacctcctagggaggtggagccgggtcagagacagccgagtgaacaagaactcctttttaggcagcaagccctccttctagaacaacagagaattcatcaactccggaattaccaggcgtcaatggaggctgctggcattccagtgtcatttggaggccacaggccgctctcccgggcacagtcaagccccgcctcagcaacctttccagtgagcgtgcaggagccaccaactaaacctaggttcacgaccggcctcgtgtacgacacgcttatgctgaaacaccagtgtacatgtgggtctagttcctcccaccctgagcacgccgggcgcatccagagcatctggagccgtctgcaagaaactggcctgcggggaaaatgtgaatgtatccgcgggcggaaggctactcttgaagaactgcagaccgtacattcggaggcccacaccctgttatatggcaccaaccctctgaatcggcaaaaactggattcgaagaagctcctaggctctctggcatccgtgtttgtgaggctcccatgcggcggggtaggcgtggattccgacaccatatggaacgaggtccactctgccggggctgctcggctggcagtggggtgtgtggtggaactagttttcaaagtggccactggagagttaaagaacggcttcgcagtggtccggcctcccggtcaccatgccgaggagagcactccaatggggttttgctattttaactctgttgcggtggctgctaagttattgcaacagaggctgtccgtatccaagatcttaattgtggactgggatgtgcaccatggcaatggcacccagcaggctttttactccgaccctagcgtcttgtatatgtcattacataggtacgatgacggaaactttttcccaggctccggggccccagacgaagtgggcactgggcctggcgtgggtttcaatgtcaacatggcattcaccggaggactggatccccctatgggtgatgctgaatacttagcagccttccggacagtagttatgccgattgcaagtgagtttgctcccgacgtggtgctcgtgtcaagtggatttgacgctgtggagggacaccccacacctttaggaggatataacctctccgcgcggtgtttcggctatctgacaaaacagctcatgggactcgccggcggacgaattgttctcgccctcgaaggtggtcacgatctgacggctatctgtgatgcgagcgaggcctgcgtttctgctttgctcggcaacgagctggacccattgccagaaaaggtgctacagcagcgaccaaacgcgaacgctgttaggagcatggagaaggtgatggaaatccacagtaaatactggcgctgcctgcaaagaactacatcaaccgccggacgaagcctcattgaggctcaaacatgtgaaaacgaagaagcagagacagtgactgcaatggcttcactcagtgtgggggtcaaaccagcggagaaaagaccagacgaagagcccatggaggaggagccacctctgtag

SEQ ID NO: 24431 - DNA, 90 bp, Artificial Sequence
  Description of Artificial Sequence: Synthetic coding sequence
atgagcagccagagccaccccgacggcctgagcggccgggaccagccagttgaactcttgaaccccgcgcgggtgaaccacatgccatag

SEQ ID NO: 24432 - DNA, 3648 bp, Artificial Sequence
  Description of Artificial Sequence: Synthetic coding sequence
atgaccagcaccggccaggacagcaccaccacccggcagcggcggtcaaggcagaatcctcagtcccctccgcaggactcttcagtgaccagtaagaggaatattaagaaaggcgccgtgccccgcagtataccaaatctcgcagaagtaaaaaagaaaggtaaaatgaaaaagttgggtcaggcaatggaggaggacctgatcgtaggtttgcagggaatggatttgaacttagaggctgaggcgcttgctggaaccggtctcgtgttggacgagcagctcaacgaattccactgcctgtgggatgactccttccccgaaggacccgagagactccatgctataaaggaacagctgatccaagagggcttactggatcgctgcgttagcttccaggctcggtttgccgaaaaagaagaactgatgctggtccattcattggagtacattgatctgatggaaaccactcagtatatgaacgaaggggagctccgggtcctcgccgatacctatgattctgtgtatcttcaccccaactcctattcttgtgcttgcttggccagcggatccgtgctgagactggtggacgccgtactgggggctgaaatcagaaacggcatggccattattcgtccccctggccaccatgcccagcactccttaatggatggatattgcatgttcaatcacgtcgcagtcgcagccaggtatgcccagcagaagcatcggatccggcgcgttctaattgtggattgggacgtgcaccatggccaaggaacacagttcactttcgaccaggacccctccgtcctgtatttttccattcacaggtacgagcagggacggttctggccacatctgaaagccagcaattggtccactacagggttcggtcagggacagggctacaccattaatgtgccatggaaccaggtagggatgcgggatgcagattatattgctgcattcctccatgtgctgctgcccgtagccctcgaattccagcctcagttagtcctcgtggccgcgggcttcgacgcattgcagggtgaccccaaaggcgagatggcggctaccccggcaggctttgcacagcttacccatctgctgatgggcttagctggcggcaagcttatcctgtccctggaaggtggctacaaccttagggcgctcgctgagggagtttcagccagcttgcatactctgcttggtgacccgtgccctatgctggaaagcccaggggctccatgcagatctgcgcaggcctcagttagttgtgccctggaagctttggagcccttttgggaggtgttagtcaggagcactgaaacagtggagcgggacaatatggaagaagataatgtggaggagtccgaagaggagggaccatgggaacctccagtgctgccaatattgacctggccggtcctccagtcgagaacaggtttagtttacgaccagaacatgatgaatcactgcaatctgtgggattctcatcaccccgaggttccgcaaagaattctgaggatcatgtgccgcctcgaggagctggggctcgcggggaggtgcctaacgttaacaccccgtccagccacagaagcggagctcctgacctgtcacagcgcggaatatgtgggtcatctccgggccaccgaaaagatgaagactagagagcttcatcgtgaaagcagtaactttgattctatctacatttgtccttccacctttgcctgcgctcagcttgccacgggggccgcctgcagactggtggaagccgtgctgtctggtgaagtgctgaacggggctgcagtcgtgcggccacctggccaccacgcagagcaagatgcagcatgtggtttctgttttttcaacagcgttgcagttgctgccagacacgctcagactatcagtggtcacgcgcttcgtattctgatcgtggattgggacgtgcaccacggtaacggcacccagcatatgttcgaagacgatccctcggtgttgtacgtgtccctgcatcggtatgaccatggtactttttttccaatgggcgatgagggtgcttccagtcaaatcggaagagccgctgggactggctttacggttaatgtggcctggaacggccccaggatgggggacgcagattatctcgcggcatggcatcggctggtcctccccatagcatatgagtttaaccccgagcttgtcctggtgtcggccggttttgacgctgcaaggggtgaccctctcggggggtgccaggtctccccagaaggctacgcccacctgacccatctcctgatgggattagcgagtgggcggattatcttgatcttggagggaggttacaacctgacctcaatttcagaatccatggcagcctgcacacgatctctgctgggagatcctcccccgctgcttacactgccaagaccaccactttccggtgcattagctagcataacggaaacgatccaggtgcatcggaggtattggagaagcctccgagtcatgaaggttgaagaccgggaaggtcctagtagttccaagctggtgacaaagaaggcaccccagcctgccaagcctaggctggccgagcgcatgaccactcgggagaagaaggttctggaagctggtatgggaaaggtgacctcagcaagcttcggcgaagaatcaacccctgggcagacaaatagcgagacagctgtggtagcacttacccaagatcagccatcagaagctgctactggcggtgctacactggctcaaaccatcagcgaagccgccattggcggtgctatgctggggcagacaacaagtgaggaagccgtcggtggtgccacccctgatcagactacatccgaagaaactgtaggaggtgctattctggaccagaccacatcagaggacgcggtgggcggcgccactctcggtcagaccacatccgaagaggctgtgggaggagccaccttggctcaaaccacatcagaagcagctatggagggcgccacactggatcagactactagtgaagaagctccaggcggcaccgagctgatccaaactccactggcctcatccactgaccatcagacgcccccgactagcccagtacagggcaccaccccccagattagcccgtcaacactgatcggttcgctccggacattagagttggggtctgaaagtcagggagcatcggaatcacaggcccccggggaggaaaacctcctgggagaagccgcgggcgggcaggacatggcggactccatgttgatgcagggcagccgtggactgacagatcaggccatattctacgctgtgacccctctgccctggtgcccccacctggtggcagtgtgccctattcctgctgcaggtctcgacgtaacacagccgtgcggagactgtggcacgattcaagagaattgggtgtgcctgagctgttatcaggtctactgtgggcggtacattaatggtcatatgttgcaacatcatggcaacagcggtcacccccttgtgctcagttatatagacctgtctgcatggtgttactactgtcaagcttatgtccatcatcaagccctcttggatgtcaagaatattgcccaccagaataagtttggcgaggacatgccgcacccccattag

SEQ ID NO: 24433 - DNA, 633 bp, Artificial Sequence
  Description of Artificial Sequence: Synthetic coding sequence
atgaccagcaccggccaggacagcaccaccacccggcagcggcggtctaggcagaacccgcagagccccccacaggactcctccgtgacctctaagagaaatatcaagaagggtgcagtccccagatccatccctaacctagcagaggtcaagaaaaaaggtaagatgaaaaagctggggcaggctatggaagaggatttgatcgttggccttcaggggatggaccttaatttggaggccgaggctcttgctgggacaggtctggtcctcgatgaacagctgaatgagttccactgcctctgggatgactctttccctgagggacccgagcgactccacgccatcaaggaacagttaatccaggagggcctgctggatcgatgtgtttcattccaggcccgctttgctgagaaggaagagctaatgctggttcactctctggaatatatcgacctgatggaaaccacccagtacatgaacgaaggtgaactgcgggtgctcgctgacacatatgacagcgtatatctacacccaaactcttacagctgtgcctgtctggcgtcaggatccgtgctgcgtctggtagacgccgtgcttggggcagagatccgaaatggcatggccatcatatag

SEQ ID NO: 24434 - DNA, 3648 bp, Artificial Sequence
  Description of Artificial Sequence: Synthetic coding sequence
atgaccagcaccggccaggacagcaccaccacccggcagcggcggtctcgtcagaacccccagtctcccccacaggacagtagcgtcaccagtaaacgaaacattaagaaaggagccgtgcctcgctccattcctaacctcgctgaagtgaagaagaagggaaagatgaaaaagttggggcaggcaatggaggaggatctcattgtcggtctgcagggcatggacctgaacctcgaagccgaagccctcgccgggacggggctcgtgctggacgaacaacttaacgagttccactgtctgtgggacgactctttcccagagggaccggaaagactccacgccattaaggaacaactcatccaagaaggcctgttagaccgatgcgtgtcattccaggcccgttttgctgagaaggaggaattgatgctggtgcactcactggagtacattgatctcatggagacaacccagtatatgaatgaaggcgagctgcgggtgctggccgacacgtatgacagcgtctacttgcatccaaattcctactcgtgcgcctgcctggcgtcaggttcggtgctgaggctcgtagacgccgtgctgggcgccgaaatacggaacggaatggctatcataaggccacccggacaccacgcacagcacagcctgatggacggatactgtatgttcaatcatgtcgccgtcgccgctcgctacgctcagcaaaagcacaggatacggagggtcctgatcgtggattgggatgtgcaccacgggcaagggacacagttcacattcgatcaggacccctcagtgctctacttctctattcaccggtacgaacagggccggttttggccccacttaaaagcctccaattggagcacgacaggcttcggccagggtcaggggtacactatcaatgtgccctggaatcaggtaggaatgcgcgatgcagattatatagcagcatttttacatgttctcctacccgtcgccctggaatttcaaccacagctggttcttgtcgcggccgggtttgatgcccttcagggtgatcctaagggcgaaatggcggccaccccagccggctttgctcagttgacccatctattgatgggtcttgctggcggcaagctgattctaagtctcgagggaggttacaacctgcgggccctggccgagggtgtgtctgccagcctgcacacactgctcggcgacccatgccccatgctggaatcaccaggcgcaccctgcaggagcgctcaagcctcggtaagctgcgctctcgaggccttggaaccattttgggaggttctggtaagaagcaccgaaactgtggagcgcgacaacatggaggaagacaatgtggaagagagcgaagaagagggcccatgggaaccacctgtattgcctatcctgacttggcctgtgttacagtccagaactggcttagtgtacgatcagaacatgatgaaccactgtaatctttgggacagccaccaccctgaagtgcctcaaagaatactgcgcatcatgtgtagactggaggagctgggcctcgcagggcggtgcttgacgcttacccctcgacctgctaccgaagcagagctcttaacatgccacagcgctgaatatgttggccatttaagagcaacagaaaagatgaagacgagggagctgcaccgagaatcgtctaacttcgacagtatctacatctgtccatccacattcgcttgcgcccagctggctacaggagcggcctgcagacttgttgaggctgtgctgtctggagaggtgttaaatggtgctgccgtggttaggccaccaggccaccacgctgagcaggatgcagcctgcgggttttgtttcttcaacagcgtggccgttgccgctagacacgctcaaacaattagcggccacgcactgaggatcttaatcgtggactgggacgtacaccatggcaatggtacccaacacatgtttgaggacgacccatccgtgctctatgtctcccttcacagatatgatcatggcacgtttttccctatgggcgacgagggagccagcagccagattggcagggctgccggcactggcttcacagtcaatgtcgcatggaacggtcctcgtatgggcgatgccgattacctcgccgcatggcatcggctcgtgttacccatcgcttacgagtttaaccccgagttggtgctggtgtcagccggattcgatgctgccaggggggatccgctcggaggctgccaggtatctccggaaggttatgcccatctgactcacctgttgatgggactggcttctggtcgcataatactcatactggagggcggctacaatcttacatcaatttccgagagtatggctgcatgcacgaggtcactgttgggcgatcccccccccctgttgacattaccaaggccccccctgtctggggccctggccagcatcacagagacaattcaggtgcaccgacggtactggcgcagcctccgcgtgatgaaggtggaggacagagagggcccgagctcctcaaagttggtgaccaaaaaggctccccagccagccaaacccaggcttgcggaacggatgactacaagagagaaaaaggtgctagaagctggcatgggaaaggtcacgagtgctagtttcggtgaagaatccaccccaggccagactaacagcgagaccgctgtggtggccctcactcaggatcaaccatctgaggccgctacgggaggggccacactcgcccaaacaatctccgaagccgccatcggaggtgctatgcttggtcagaccacgagcgaggaggcagtcggtggggctactccagatcagaccaccagtgaggagacagtgggaggtgctatcctcgaccagacaacctcagaggacgctgttgggggggcgacactcgggcagaccacttccgaggaggcagtagggggcgcaaccctcgcacagaccaccagcgaggcggcaatggagggggctacactggaccagaccaccagcgaggaagcccccggtggcacagagctgattcagactccactggccagctcaaccgatcaccaaacaccgcctacttcaccagtgcaaggcactacccctcagatctccccgtcaacgctgattggctctctgcgcaccctcgaacttgggagcgaatctcaaggtgccagcgaatcccaggccccgggtgaagaaaatttgctgggcgaagccgccggggggcaggacatggccgacagcatgctcatgcaaggcagtaggggtctgacggaccaggctattttctatgccgttactccactgccctggtgccctcatctggtggcagtgtgtccaattccagcggccggtctcgacgttacccagccttgtggggactgtggaaccatccaagagaactgggtttgtctgtcttgctatcaggtgtattgtggaaggtacatcaatgggcatatgctacagcaccacggtaatagcgggcaccccctggtgctgagctatatcgacctgtccgcttggtgctactattgccaagcctacgtgcaccaccaggccctgctggacgtcaagaatattgcccaccaaaataagttcggagaagatatgcctcaccctcactag

SEQ ID NO: 24435 - DNA, 633 bp, Artificial Sequence
  Description of Artificial Sequence: Synthetic coding sequence
atgaccagcaccggccaggacagcaccaccacccggcagcggcggtccagacagaatccccagtctcccccccaggacagcagtgtgacttccaaacgcaatatcaaaaagggcgcagtgccacgatccatcccaaacctggccgaagtgaagaaaaaaggcaagatgaaaaagctcggccaagctatggaggaggacttgatcgtcggactgcaggggatggatctcaatctcgaagctgaggctttggctgggacaggactggtgctcgacgagcagctcaacgagtttcactgcctttgggacgattcatttcccgaaggccccgaacggctgcatgctataaaagaacagcttatccaggaaggattgctcgataggtgtgtgagcttccaggcacgctttgccgagaaagaagagctcatgcttgtccactccttagaatatatcgacctgatggagacaacacagtacatgaacgaaggcgagctccgtgtcctggccgacacctacgattcggtgtacttgcacccaaacagctatagctgtgcttgcttggcctccggatccgtgctccgcctggtcgacgcagtgctaggagcagaaatccggaatggaatggctatcatttag

SEQ ID NO: 24436 - DNA, 891 bp, Artificial Sequence
  Description of Artificial Sequence: Synthetic coding sequence
atgaagaagctgggccaggccatggaggaggacctgatcgtgggcttacaaggcatggacctcaacctggaagcagaggctctagcaggaacaggactagttctggacgaacagctcaacgaatttcactgtctgtgggatgattcttttcccgaaggtcccgagagactccacgcgatcaaggaacaactaattcaggaaggactcttggatcgctgtgtttccttccaggcacgcttcgcagagaaggaagagctgatgttagtccacagcctggagtacattgatttgatggagaccacacaatacatgaacgagggagaactgagggtgctggctgacacgtacgattccgtctacctgcacccgaatagctactcttgtgcctgtctggctagcggctctgtgctgcgactggtcgatgcagttctgggggcagaaataaggaacggcatggccatcatccggcctcctgggcaccacgcccaacattctctgatggatggctattgcatgttcaaccatgtggccgtagccgcccgctacgcccagcagaagcaccgaatccgacgcgtactgattgtagactgggacgtgcaccacggacagggcacccagtttaccttcgaccaggacccgtccgttctgtatttcagcattcacagatatgagcagggccggttctggccccaccttaaggccagcaattggtccaccactgggtttggtcagggccaaggatatacgatcaatgtcccttggaatcaggtggggatgcgtgacgcagattacatcgcggcctttttgcatgtcctgttgcccgtcgctctcgaagttctcggcatttggggagttctcggcggaggagtggcattaaaggtgcggctctag

SEQ ID NO: 24437 - DNA, 429 bp, Artificial Sequence
  Description of Artificial Sequence: Synthetic coding sequence
atgaccagcaccggccaggacagcaccaccacccggcagcggcggagtcggcagaaccctcagtcccccccccaagactcaagtgttacaagcaagcggaatatcaaaaagggcgctgtgcctcgctctattccgaacctggcagaagtgaaaaagaagggaaagatgaagaaactgggacaagcgatggaagaggacttgatcgtgggcttgcagggaatggacctaaatctcgaggccgaggccttagccggaaccgggttggtcttagatgagcagttgaacgagtttcactgcctgtgggacgactccttcccggagggccccgagcgactccacgcaataaaagagcagctgatacaggaaggcctgctcgatagatgcgtcagctttcaggcacgatttgccgaaaaggaggagctcatgtag

SEQ ID NO: 24438 - DNA, 810 bp, Artificial Sequence
  Description of Artificial Sequence: Synthetic coding sequence
atgaccagcaccggccaggacagcaccaccacccggcagcggcggtcacggcagaaccctcagtccccgccacaggacagctctgtgacaagcaagaggaatattaaaaagggcgccgttccccgatccatacctaatctcgccgaagtgaaaaaaaaaggcaagatgaaaaagctaggccaggcaatggaagaagatctaattgtggggctgcagggcatggatctcaacctcgaggccgaagccctggccggcacaggactggttctggatgagcagctgaacgagtttcactgcctctgggacgatagctttcccgagggccctgaaagactgcacgccataaaggagcagctcatccaggagggcctgcttgaccgctgcgttagcttccaggctaggtttgcggaaaaggaggagctgatgcttgtacactccttagagtatatcgacttgatggagactacacagtacatgaacgagggcgagttgcgggtgctggccgatacttatgacagtgtgtacctgcatccgaatagctactcttgtgcttgcttggcctctggtagtgtattacggttagtcgatgcagtgctgggcgccgaaatacggaatggtatggctatcataaggccaccaggccatcacgctcaacattctctcatggacggatactgtatgtttaaccacgtggccgttgccgcaaggtatgcgcagcagaagcatcgtatcaggagagtgctaatagtcgattgggacgtgcatcatggacagggtacacaattcacttttgaccaggatccaaggtag

SEQ ID NO: 24439 - DNA, 2454 bp, Artificial Sequence
  Description of Artificial Sequence: Synthetic coding sequence
atgaccagcaccggccaggacagcaccaccacccggcagcggcggagtcgtcaaaacccacagtcgcccccacaggactcaagcgttacaagtaagaggaatatcaaaaagggagcagtaccccgctccatccccaaccttgccgaggtcaagaagaaaggtaaaatgaaaaagctcggccaggccatggaggaggatctgatagtggggctccagggcatggacctgaatctggaggccgaagccctcgccggtacagggctggttctggacgagcaacttaatgaatttcattgtctatgggatgacagttttcccgagggccctgagcggctccacgccatcaaagaacaactgattcaggaggggctgcttgatcgctgtgtgtcctttcaagccagattcgcagaaaaagaggagttgatgctggtccactctctggagtacattgacctgatggaaactacgcaatacatgaatgagggcgaactccgcgtactcgctgatacttacgactctgtatatttacaccccaacagttactcctgtgcttgcttggccagcggctccgtgttgagactggttgacgccgtccttggagccgaaattagaaatggaatggcaattatccggccccccggacatcatgctcagcactcactgatggacggatactgcatgttcaatcacgtggccgtcgccgccagatacgcccagcaaaaacacaggataagacgggtacttattgtggactgggacgtgcaccacggccagggtactcagtttacattcgatcaggacccgtccgtgctctatttttctattcaccggtacgagcagggccgcttctggcctcacctaaaggcctcgaactggtctacgacagggttcggccagggccaaggctatactattaacgtcccttggaatcaggtgggcatgcgcgatgcggactacatagctgccttcctccacgttttgctgccagttgcgctggagttccagccccagcttgtcctggtcgctgcggggtttgacgccctccagggggatcctaaaggcgagatggcagcaactccagcaggcttcgctcagctcacccatctgctcatgggactggctgggggaaaactaatcttgtccttggagggcggctataatctccgggctcttgccgagggggtatctgctagcctgcatacccttctcggggatccctgtccaatgctcgagtcaccgggggcaccctgtcgcagcgctcaagcaagtgtttcgtgcgctctggaagcacttgaacccttttgggaagtactcgtacgcagtaccgagaccgttgaaagggacaacatggaggaggacaacgtagaggagtctgaagaggagggtccgtgggaaccacccgtgttgcccatcctcacatggcctgtgctgcagtccagaacaggccttgtgtatgaccagaatatgatgaatcattgcaatctgtgggattcacaccacccagaagtgccgcagcgtatcctccggattatgtgcaggctcgaggaacttggcttagccggacgctgcctcactttaacaccgcgcccagccactgaagcggagcttctcacctgtcatagcgccgaatacgtgggtcacctgcgagcgaccgaaaagatgaagacacgcgagctgcatcgagaatcttccaattttgattccatctacatctgtcctagtacgttcgcttgtgcccagctcgccactggagctgcatgccggctggtggaggcagtactttcaggggaggttttgaacggagcagcagtcgtacgcccgccgggtcaccacgcagaacaggatgccgcctgcggcttttgcttctttaattctgtggctgtggctgcccggcatgcacaaacaatttccggccacgcccttagaatcttgatagtggattgggatgtgcaccatggcaacggtacgcaacacatgttcgaggatgatccaagcgtactctatgttagtttgcaccgctatgaccatgggacgttttttcccatgggggatgaaggcgcgtcttcacagataggtcgcgcggccggcactggcttcactgtaaacgtggcctggaacggacctcgcatgggcgacgcagattacctcgccgcatggcatcgactcgtattgcccatcgcatatgagtttaatccagagttggtcttggtttcagccgggtttgacgccgcccgtggggacccactcggtggctgtcaggtgagtcccgagggatatgcacacctgacgctgccaatcgcgtgcctgcgggggacaacaaccccagcccagaaagaacgcggggcagctcagtggccacaggaaggagctgacattatgaggattaccctggccggaggggaactcaccggacggcatggcaaagtggcctacgtgatcaagtacaaattgtag

SEQ ID NO: 24440 - DNA, 156 bp, Artificial Sequence
  Description of Artificial Sequence: Synthetic coding sequence
atgaccagcaccggccaggacagcaccaccacccggcagcggcggtcgagacagaacccacaaagcccaccacaagatagctccgtcactagtaaacggaatattaagaaaggggcagttcctcggtcaattcctaaccttgcagaggttaagtag

SEQ ID NO: 24441 - DNA, 516 bp, Artificial Sequence
  Description of Artificial Sequence: Synthetic coding sequence
atgaccagcaccggccaggacagcaccaccacccggcagcggcggagtcgacagaatcctcaatcgccaccacaggactctagcgtaacatcaaagcggaatatcaaaaagggggcggtaccccgctcaatacctaatctcgcggaagtgaaaaagaaggggaagatgaagaaactcggccaggccatggaagaagatctaattgtgggcctgcaggggatggatctgaatcttgaagccgaggcgttggccggcacaggtttagtgcttgatgagcagttgaacgagttccactgtctgtgggatgactccttccccgagggcccggagaggctccacgccatcaaggagcaattgatccaggaaggattgttggataggtgcgtgtccttccaagccagattcgccgaaaaagaagaactcatgctcgtccactcgctggagtacatcgatcttatggagactacccagtatatgaatgaaggtgagctgcgggttctcgctgacacctactag

SEQ ID NO: 24442 - DNA, 486 bp, Artificial Sequence
  Description of Artificial Sequence: Synthetic coding sequence
atgaccagcaccggccaggacagcaccaccacccggcagcggcggtctcgccagaaccctcagtcaccaccccaagatagcagcgtgaccagcaagcgcaacattaagaaaggagccgtgcctaggtccatccccaaccttgctgaggtaaagaagaagggaaagatgaagaagctggggcaggccatggaggaagatctaattgtggggctccaagggatggacctgaacttggaggccgaagcactggcaggcaccgggctcgttctggatgaacagctcaatgagttccattgtttgtgggatgattctttcccagagggtccagaacgtcttcacgctattaaagagcagcttatacaggaaggcctgctagacagatgcgtgtcttttcaggcaaggtttgcagaaaaagaagagctgatgctagtgcactcgttagaatacatagacctcatggagactacgcagtacatgaacgagtag

SEQ ID NO: 24443 - DNA, 504 bp, Artificial Sequence
  Description of Artificial Sequence: Synthetic coding sequence
atgaccagcaccggccaggacagcaccaccacccggcagcggcggagccgacagaatccccaatcccctccgcaagattctagtgtgacgtctaagcggaatatcaagaagggagctgttccacgctcaataccgaacctggccgaggttaaaaagaaggggaagatgaagaagttgggccaagccatggaggaggaccttatcgtaggccttcagggcatggacctcaatcttgaagcagaagcccttgctgggacaggtctggtactggacgagcagctgaacgagttccactgtctttgggatgactcatttcccgaaggcccagagcgcctgcatgcaatcaaagaacagctgatacaggagggcttgctggaccgctgtgtcagcttccaggcgaggtttgcagagaaagaggagctgatgctggttcattctttggaatacatcgatcttatggagaccactcagtatatgaatgagggcgagttgcgggtactatag

SEQ ID NO: 24444 - DNA, 3690 bp, Artificial Sequence
  Description of Artificial Sequence: Synthetic coding sequence
atgagcggcgccaaccggggccggggccaggccagcagcaccatgaccagcaccggccaggacagcaccactacacggcagcgcaggtctaggcagaatcctcagagtccccctcaggacagctccgtgacgtccaaacgaaatatcaaaaagggagctgtcccgagatccatcccaaacctcgctgaggttaaaaagaaggggaagatgaaaaaactgggccaagccatggaggaagacctcattgtcgggttgcagggcatggacctgaatttagaggccgaagctcttgctggcacaggtcttgtcctggacgaacagcttaacgaattccactgcctgtgggatgacagtttccccgaggggccagagaggctgcatgccatcaaggagcagttgattcaggagggcctgcttgatcggtgcgtgtcgttccaggctagattcgccgagaaggaggagcttatgctagttcattccctggaatacatcgacctgatggagaccacccagtacatgaatgaaggagaactccgggtcttggcagacacttacgattctgtgtatctgcaccccaactcctactcgtgcgcttgtctggccagcggcagcgtactgagactggtggacgcagtcctcggggctgagatccgcaacggtatggcgatcatccgccctcccgggcatcacgctcagcatagcctcatggacgggtattgtatgtttaatcacgtcgcagttgcggctcgttatgcacagcagaaacaccgcatccgtagagtgctgattgtcgactgggacgttcatcatggccagggaacccagttcacctttgatcaggacccaagcgtgctgtacttttcaattcatcgctacgaacaagggcggttttggccacatctcaaagcctcaaattggagcactacaggctttgggcaaggccaagggtacaccatcaacgtcccctggaatcaggtcggaatgcgcgacgcggattatatcgcagctttcctgcacgtgctcttaccagtggctcttgagtttcagccacagctggtgctggtggcggctggatttgacgcacttcagggcgaccccaagggtgagatggctgctactcctgctggctttgcacagctcacccatcttctgatgggcctggccgggggcaaactgattctgtctttagagggaggctataatttacgcgccctggctgaaggcgtgtccgcaagcctgcacacattactgggagacccatgccctatgctagagtcaccgggagcaccctgtaggtctgctcaggcctcggtttcttgtgcgctggaagctctcgagcccttctgggaagttctagtgcggtcaaccgagaccgtggaaagagataacatggaagaagacaacgtcgaggaatctgaggaggagggaccttgggagcctcctgttctgcccatactcacttggcctgtactccagtcacggaccggactggtgtacgatcaaaatatgatgaaccattgcaacctttgggatagtcaccacccagaagtaccccagcggatcttgcggataatgtgccggctggaagagctcggactggccggcagatgtctaacgctcacaccaaggcccgccacagaggcagagctcctgacgtgccattccgccgaatacgtcgggcacctccgcgccacagaaaaaatgaagaccagggagctgcaccgggagagctccaacttcgatagcatttacatctgtccttctacgttcgcatgtgcgcaattagctaccggggccgcttgtaggcttgtcgaggccgtactgtctggtgaggtacttaacggcgctgcggttgttcggccccccggccatcacgccgaacaggatgccgcttgtggtttctgcttctttaattctgtggccgtggctgctaggcatgcgcagaccatttccggccacgccctgcgtatactgatcgttgactgggacgttcatcacgggaacgggacccaacacatgttcgaggacgatcccagcgtcctttacgttagtctgcacaggtacgaccacggcacttttttccccatgggggacgagggtgcatctagccagatcggccgcgccgccggcacaggctttaccgttaacgtcgcatggaacgggcccagaatgggcgacgccgactatctagccgcttggcatagactggtgctccccattgcctatgagttcaatcccgagttagtgttagtgtcagccggttttgatgctgcccgcggcgatccccttgggggctgtcaggtgagcccggagggatacgcccacctgacccatctgctgatggggctagcctcgggacgcatcatacttatcctcgagggcggctacaacctgacgagcatctccgagtccatggccgcatgtacaagatctctgctgggtgaccccccccctctgctcactcttcctcgaccacctctcagtggagcactggcaagtattactgaaactatccaggttcacagacgctactggcgcagccttcgggtaatgaaagtggaggaccgggaaggcccttcgagttctaagctggtgaccaaaaaggctccacaaccagctaagccacgattggccgagcggatgacaacacgagagaagaaggtgctggaggccggcatgggcaaggtaacctcggctagcttcggcgaggagagcactccgggccagactaatagtgaaacagccgtcgttgcactgacgcaagaccaaccaagcgaagcagccaccggtggggccacccttgcccagaccattagcgaggcggcgataggcggcgctatgctcggccagacgacatccgaggaggccgttggaggcgccacccccgaccagactacatcggaagagacagtgggcggagccattcttgatcagaccacatccgaggatgccgtgggaggggctactctggggcagactacatcagaagaagcagtgggcggtgccaccctggcacaaaccacatccgaggctgccatggaaggcgccacactggaccagactacctctgaagaggccccaggggggacagaacttatccaaactcccctggcaagttccaccgatcatcagacacccccaaccagcccagtgcagggtaccaccccccaaatttcaccatccaccctgattggctccttgagaactctggagcttggatccgagtcccaaggcgcctccgaatcccaggcacctggcgaggagaaccttctgggcgaagctgccggagggcaagacatggcagatagcatgctgatgcagggctcaagaggactgacggatcaagcaatcttttatgccgtaacccctctgccctggtgcccccacttagtcgctgtgtgccctatcccggctgctggtctggatgtgacacaaccctgcggcgactgtggaacaattcaggagaattgggtgtgtttgtcatgctaccaggtatactgtgggcggtatataaacgggcacatgctacagcaccacggaaactcaggacatccacttgtcttaagttatatcgatctgagtgcttggtgctactattgccaggcgtatgtgcaccaccaggcgctgttagatgttaaaaatattgcccatcagaacaagttcggtgaggacatgccacatccacattag

SEQ ID NO: 24445 - DNA, 2976 bp, Artificial Sequence
  Description of Artificial Sequence: Synthetic coding sequence
atgcacagccccggcgccgacggcacccaggtgagccccggcgcccactactgttctcccactggggccggatgtccacgaccgtgcgctgacactcccggaccccagcctcaaccaatggatctccgagtcggccagagaccacccgtggaacctcctccggaacccaccctcctcgctctgcaaagaccccagcgccttcatcaccacctttttctcgcaggcttgcaacagcagcggagtgtggaacctatgcgcctatctatggatactcccatgccagaactgcaagtgggcccacaggagcaagagcttagacagctgcttcataaggacaagtccaaaagatccgcggtggcgagctcagttgtaaagcagaagctggcagaagtcatcttgaaaaagcaacaggcagcccttgagagaaccgtgcaccccaacagccccggtatcccttatcgtaccctggaaccgctggagactgagggtgctacccgctcaatgctctcttcttttctgccaccggtgccctcactgccctccgatccccccgagcactttccccttcgcaagaccgtctccgaacctaacctcaaactgcggtataaacctaaaaagagcctggaacgccgaaagaacccattgctgcgcaaagagagcgccccaccctcattacggcgtcggcccgccgaaacactgggagattcgtccccttcgagctcctcaacacccgcctccggatgctccagtcctaacgattctgaacacggtcctaatccaatcctcggctcagaggccctgttggggcagaggcttcgcctccaagagacctcagtggcccccttcgccttaccgaccgtgagcctgcttcccgctattacactgggtttgccagcgcctgccagggccgacagcgacagaagaacccaccctaccctgggcccaaggggccctatcctcggatccccccatactcccctgttcctgcctcatggcctggaacccgaagccggtggtaccttgccctctcggctgcaaccaattctgttacttgacccaagtgggtctcatgcccccctgctgacagtacccggcctcggtcctctgcccttccattttgcacaaagccttatgaccaccgagagactgtcagggtcaggccttcactggccgctgtccagaacgcgttccgaacccctcccccccagcgccaccgcaccccctcctcccggccccatgcagccccggcttgaacaactcaaaactcacgtgcaagttatcaagcgttccgcgaagcccagtgagaagcctcggctgcgccagattccctccgctgaggacctcgaaaccgacggtggcggccccggtcaggtggtggacgacggcttggaacaccgcgagttggggcatggccagccggaggcacggggaccagcacctctccagcaacacccgcaggtgctgttatgggagcaacaacgactcgccggtagacttccacggggctctaccggggacacggttctgctaccgcttgcccagggtggccatcgtccgctgtcgcgtgcccagtcgtcccccgcggcaccagcaagcctgagcgccccagagccagccagtcaggccagagtgttaagctcaagcgagaccccagctaggaccttgccgttcactaccggccttatttatgattctgtaatgctgaagcaccagtgctcttgcggcgataactcccgccaccccgaacacgctggtagaattcaatccatttggagccggctgcaggagcggggtctgagatcgcaatgtgaatgcttgaggggaagaaaggcaagtctggaggagctgcagtccgtacatagtgaacgacatgtactgctctacgggacaaatccactatcccgcctgaaactggataatgggaagctggctggcctcctggctcagcgtatgttcgtgatgttgccctgcggaggggttggagtagatacggacacgatttggaacgagctccactcatcgaatgctgcccgctgggctgctgggagcgtgactgacctggccttcaaggtggcatctagggagctgaagaacggcttcgcagttgtgcgcccccctgggcaccatgcagatcatagcacagctatgggattttgcttcttcaatagcgtggcgatagcctgtaggcagctgcagcagcagtccaaggcaagtaagatcctgatagttgactgggatgtccaccacgggaatggtacacagcagacattctaccaggatcccagcgtgctttatattagtttgcatcgtcacgacgacggcaattttttccctggctctggagccgttgatgaggtgggggcgggaagtggagagggtttcaatgttaatgtggcgtgggcaggggggctcgacccaccgatgggcgatccagaatacttagcagcgttccggatcgtggtgatgcctattgcacgcgaattttccccggatctggtgttggtcagcgcggggttcgacgccgctgaaggacaccctgcccccttgggaggctaccacgtgtctgccaagtgttttgggtatatgacacagcaactgatgaatttggccggaggcgcagtcgtcctggctctcgaaggcggtcatgacctcacggccatctgtgatgccagcgaagcgtgcgtcgccgccctgctcggcaaccgggtcgacccactcagcgaagaaggctggaagcagaaacccaatcttaatgcaattcgcagtctggaagcggttattagagtccatagcaaatactggggttgtatgcaaaggcttgccagttgccctgatagctgggtgccccgggtgcccggtgcagacaaagaagaagtcgaagccgttaccgccctcgcgtccctttctgtaggaatactggctgaagatagaccatcggagcagctggtcgaggaagaggaaccgatgaatctttag

SEQ ID NO: 24446 - DNA, 2865 bp, Artificial Sequence
  Description of Artificial Sequence: Synthetic coding sequence
atgcacagccccggcgccgacggcacccaggtgagccccggcgcccactactgtagccctactggtgctgggtgcccacggccttgcgcagacacccctggacctcagccgcaaccaatggatttgcgggttggacagcggccgcccgtggagcccccgcccgagcctacccttctggcactccagcgcccacaacgcctgcatcaccacctctttctcgccggtctccagcagcagagatctgtggagcccatgagactaagcatggacacccctatgcccgaactccaggtaggcccgcaggaacaagaattgcgtcagctgctgcacaaagataagtccaagcgctctgccgtggccagttcggtggtcaagcagaaactggccgaagtgatactcaagaagcaacaggccgctcttgaacgcaccgtccacccaaacagccccggaattccttaccgcaccctggagccgctcgaaaccgagggagcaaccagaagcatgcttagcagtttcttgccacctgtccctagcctgccatctgacccccctgaacattttccgttacggaagactgtcagtgaacccaatctgaaattgcggtacaagcccaagaaatccctggaaagacgtaagaatcctctgcttcgcaaagaaagtgctcctccgtctttgaggcgcaggcccgctgaaacgctgggtgactcgagcccctcttcatcatctacacctgcaagcgggtgcagctcccctaacgattcagagcacggacccaatccaattcttggctccgaagccgactcggatcgccgcactcatccaacactgggccctaggggcccaattctcggatcgcctcataccccactgtttctcccccacggtctggaaccagaggcaggggggacactgccatcccgcctgcagccaatcctgcttctggatccctcaggatcacacgctcccttgctgaccgtgcctggcctcgggcctctgcccttccatttcgctcagagtctgatgaccacggaacgactgtccggatcgggcctccattggcccttgagtcgcaccaggtcagagccattgccacctagcgccaccgctccacctccacccgggcccatgcagcctaggctcgaacagctcaagacccatgtgcaggtgattaagagaagcgctaaaccatctgaaaagcctcgactccggcagatcccatctgccgaagatttggagacagatgggggagggcccggtcaagtcgtagacgatgggctcgagcatcgcgagctcggtcacggtcaacccgaggctagagggcccgcgcccctgcagcagcatccacaggtgctgctgtgggaacagcagcggttggctggtaggttgcccaggggtagtaccggagacacggttttgctacccctggcacagggaggtcaccgccccctgtcccgggcgcagtcttctccagccgcccccgcgagcctgtccgccccagaaccggcgagccaagctcgtgtcctgagctccagcgaaacacccgcacgcactctgcccttcaccaccggcctgatttacgacagtgtaatgttgaaacaccagtgtagctgcggagataacagccgacatccggagcatgctgggaggattcaaagtatatggtcacgcttgcaggaacgtggcctcagaagtcagtgcgagtgcctcagagggcgtaaggcctcactggaggagttgcagagcgtccattcagaaagacacgtgctgctatatggcaccaatcccctgagtcggctgaaactggacaacggcaaactggccggccttctggctcaaagaatgtttgtaatgctaccatgcggtggagttggagtcgacacagatacgatatggaacgagttgcactcctccaatgcagctaggtgggcagctggaagcgtgaccgatctggccttcaaggtagcgagccgggagctcaaaaatggtttcgccgtcgttcgcccccccggacaccacgctgaccatagcactgccatggggttttgcttttttaattcagtggctatcgcgtgtagacagctgcagcagcaatcaaaggcctctaagatcctaattgtggattgggacgtgcaccacggtaatgggactcaacagacattctatcaggacccctcagtattgtatatcagcctccaccggcacgacgacgggaattttttccccgggtctggcgctgttgacgaggttggagcaggcagcggagagggctttaacgtgaatgtggcctgggcaggcggcttagacccccctatgggtgatccggagtatctggctgctttcagaatcgtcgtcatgcccatcgcgagagagttctcgcctgatttggtactggtgtcagctgggttcgatgctgcggagggtcaccccgctccactgggaggataccatgtaagcgccaaatgctttggctatatgactcagcagcttatgaacctggcgggcggcgccgtggtccttgccctggagggcggccatgatcttacagcaatctgcgatgccagcgaggcttgcgtagccgcattattaggaaaccgagtggaccctttatccgaggaaggctggaagcagaagcctaatctgaacgccatccggtcgttggaggctgtcatcagggtgcactccaaatattggggctgcatgcagcggctggcctcatgtccggatagttgggtcccgagggttccgggagccgacaaagaggaagtggaggccgtcacagcacttgcctcccttagtgtggggatactcgctgaagatagaccatctgagcaacttgtggaggaagaagagccaatgaatttgtag

SEQ ID NO: 24447 - DNA, 3045 bp, Artificial Sequence
  Description of Artificial Sequence: Synthetic coding sequence
atgagcgacctgcggaagcgggagctgggcgccctgttcaccagcagaggtaccgggggcgtggaatgggatgggacgcaagtgagtcctggggcgcattactgttctcccaccggagccggttgtccccggccgtgtgccgacacacccggccctcagccccaacccatggacttgcgcgtcggccagcgccccccagtggaacccccgcccgaaccaactttgctagccctccagcgcccccaacgcctccaccaccacctgttcctcgcgggtctccagcagcagcgcagtgttgaaccaatgagactgtctatggatacacccatgcctgaactccaagtggggccccaggagcaggagttgcgccaactactacataaagacaagagtaaaaggtcagctgtggcctcctctgtggtgaaacaaaagctggccgaagtaattctcaaaaagcagcaggccgccttagagaggaccgtgcatcccaactctccaggcattccgtaccgcacactcgaacccctcgagactgagggtgcaacacgatccatgttgagttctttcttgcctcccgttcctagtctcccgtccgaccccccagagcactttccattgagaaagaccgttagtgaacccaacctgaaactccgatacaagcccaagaagtctcttgaacggcgcaaaaatcccttgcttcgcaaggagtcggcaccaccttccctcagacggaggcctgctgagacactgggcgacagcagtccatctagttcatcaaccccggcatcagggtgctcctctcctaatgactccgagcacggccccaatccgatcttggggtccgaagcactgctggggcagcgcctgaggttacaggagacctcagtggctcccttcgcactaccaacggtaagcctcctccccgcgatcacactggggctgcctgccccagcccgggccgattccgaccggcggacccaccccaccctaggtccaagaggacccatcctgggttcacctcatactcctctttttcttccccatggattggagcccgaagccggcggaaccctaccatcccgtttacagcctatcctgttactggaccctagcgggtcacatgcccctctcctgacagttcccggcttgggtcccctcccctttcacttcgcccaaagcctgatgacaaccgagcgcctctccggaagcggcctccattggccgctgagccggacaagatctgagcccctgccaccatctgcaaccgcccccccacctcccggcccaatgcagccgagactggagcagctgaagacacatgtgcaggttatcaagcgctccgctaaaccttcggagaaaccaagacttcgtcaaattccaagtgctgaggatttggagacagacggggggggtcccggacaggttgttgatgacggcttggagcaccgagagttgggacatggccagcctgaagcgaggggccccgctcccctgcagcagcatcctcaggtgcttttgtgggagcagcaaagactagcaggccgcctgcccagagggtccacaggtgacaccgtccttcttcccctcgcccagggcgggcatcgaccactctcccgggcccagtcgagtcctgcagcgcccgcgtctctgagcgcacctgagcccgcaagtcaggctcgagtgctttcctcctccgaaactccagcccgcaccctgccctttaccacaggcctaatctacgatagcgtaatgctgaaacatcagtgcagctgtggggacaatagcaggcaccctgaacacgctggcagaatacagtctatctggtccaggctgcaggagaggggactgcggtcccagtgcgagtgccttcggggtcggaaagccagtctggaagagctgcagagcgtccattcggagcgccacgttcttctatatggtacgaatcccctgtctagactgaaactcgacaacgggaagctcgccgggcttttggcccaacgaatgttcgtgatgctaccatgcggaggagtaggggttgataccgacaccatctggaacgagctccattcaagcaatgccgcaaggtgggccgctggaagtgtgacagacctggcattcaaggtggcctccagagagctcaaaaatggttttgccgttgtccgacctccgggtcatcatgcagaccactccaccgcaatgggtttttgctttttcaactccgtcgctattgcctgtcggcaacttcagcaacagtctaaggcctcgaaaatactaattgttgactgggatgtgcatcacggcaacggtactcagcagactttttaccaggatcctagtgttctttatataagcctgcatcgtcacgacgacggtaacttcttcccagggagtggcgcagtggatgaggtgggggcaggatcgggagagggtttcaacgtaaacgtggcttgggcagggggactggaccctccaatgggcgatccagagtatctggccgcgttccgtattgtggtcatgcctattgccagggagttctcccctgacctggttttggtgtctgctgggtttgatgcggctgaagggcatcctgcaccactgggcgggtaccatgtgtccgctaaatgttttggctacatgactcaacagttgatgaacctggctgggggcgcagtggtcctggcactggaagggggtcacgacttaaccgcaatttgtgacgcaagtgaggcttgcgtggcggccctgttgggaaatcgggttgatcccctgtctgaagagggatggaaacagaaacctaatcttaacgcaatcaggtcactcgaggccgttatccgtgtgcacatgggtgcactgacactctctcagattcccgggcacggatcctcccagcaacaggccggaggcgcctttagctggcctggacatccttgtcgagctgcggtggtgatggtgaataccggcgccgcctgtagcgcatggcccccagttcagaccccaggctgtcttgagtgtcaggggctgacaaagaaaaaatggaggcagtag

SEQ ID NO: 24448 - DNA, 402 bp, Artificial Sequence
  Description of Artificial Sequence: Synthetic coding sequence
atgcacagccccggcgccggctgcccccggccctgcgccgacaccccaggcccccaaccacagccaatggacctaagggtgggccagcgacccccagtggaacccccccctgagcctacgctcctggcgctgcagagaccccagcgtttgcaccatcatttattcctggctggcctgcagcagcagagatcagtcgaaccgatgcgcctctccatggatacccccatgcctgaactgcaggttggtccccaagagcaggaacttaggcagctcctgcataaagacaagagcaaaagaagcgctgtggcgtcatcagtggtgaaacagaaactagccgaggttatactgaaaaagcagcaagctgccctggagcggactgtccatccgaattctcctgggtag

SEQ ID NO: 24449 - DNA, 2859 bp, Artificial Sequence
  Description of Artificial Sequence: Synthetic coding sequence
atggacctgcgggtgggccagcggccccccgtggagcccccccccgagcctacacttctagcccttcaaaggccacagagactgcaccatcacctgttcctggctgggctgcagcagcaacggtccgtcgagccgatgagactgagcatggacacccccatgccggagctgcaagttggcccccaggaacaggaactacgccagttactgcataaagacaaaagcaagcgctcagccgtagcctcctcagtagtcaagcaaaaactcgccgaagtgattctaaaaaaacagcaagccgcacttgaaagaaccgtgcaccctaactctcccggcatcccttacagaacccttgagccactcgagactgagggtgccactaggtctatgttgtcatccttcctccccccagtccccagtctgccttccgaccctcctgaacacttccccttgaggaagaccgtctccgaaccaaatctgaaactgagatacaagcccaagaaaagcctagagcgacgaaagaaccctttgttgaggaaagaatccgcacctccctccctccggcgcagaccggcagagaccctgggtgatagctcacccagttcaagcagcacccccgcctcagggtgctctagcccaaatgacagcgaacacggcccaaatccaattttaggatctgaggccctgttgggccagcgactgaggcttcaggaaacctctgtagcgccatttgcactgcctacagtttctctcctcccagctataacactgggccttccggcaccggcccgggccgattcagatagacgaacccatccgacactgggcccaaggggacccatcctcggctccccacatacaccactgttccttccccatgggttagagcctgaggccggaggtacccttccctctcgattacagccaattttgcttcttgacccatccggatcgcacgccccactactaaccgtccctggtctcggccccctcccatttcatttcgctcagtcattgatgacaactgagagactgtcagggtcaggcctccattggccactgtctcgaactagatccgaacctctaccgccctccgctactgccccgcctccaccgggccccatgcaaccccgcttggaacagttaaaaacacatgtgcaagttatcaaaagatcggccaagccgagtgaaaagcccaggctgcggcagattccctctgctgaggacctggaaactgatggaggcggtcccgggcaggtggtggatgatggacttgaacaccgcgagcttggtcacggccagccagaggctcgcggcccagccccactgcagcagcacccccaggtgctcctgtgggagcaacagaggctggcaggccgcctgccccgtggaagcaccggagacaccgttttgttacccctggcccaaggaggccacagacctctgtcaagagcacaatcctctcctgccgcacctgcgagtctatcagccccagagcccgccagccaggcacgcgtcctgtccagctccgagactccagctcgcactctgccttttaccacaggacttatttacgactccgtcatgctgaaacaccagtgctcgtgcggggacaattctcggcatccagagcacgctggcaggattcagagcatttggtcacgactgcaagaaagaggcctgcgcagccagtgtgagtgtctcaggggccgcaaggctagcttggaagagctgcaaagtgtgcattccgaacgccatgtcctgctttacggcacaaatcctctgtctaggcttaaactggataatggtaagctcgctggactacttgcgcagaggatgtttgttatgctcccatgcgggggcgtcggtgtcgatacagacactatctggaacgaactgcactctagtaatgcagcccgatgggccgccggctccgtcactgatttggcgtttaaggttgctagccgtgagctcaagaacggatttgctgtagtccggccgcctggtcaccatgccgatcatagcacagccatgggattttgttttttcaactcggtcgccatcgcctgtcgccagctgcagcaacagagcaaagcctctaaaattttaattgtggattgggatgtacaccacggaaacgggacccaacagactttctaccaggacccaagcgttctttatataagtctacaccgccacgatgatggcaactttttccccggcagcggagccgtggacgaggttggggctggatctggggaggggttcaacgtgaatgtggcttgggccggaggtctggatccaccgatgggagacccagagtatctggcagctttcaggatagtggtaatgcccatcgccagggagttctccccggatctcgtgctagtgtctgcaggattcgacgcggcagagggacatcccgcccccctcggaggctatcacgtgtcggccaaatgcttcggctacatgactcaacagctgatgaacttagccggtggcgccgtggtcctggcactggagggcggacatgatttaactgccatctgcgacgctagcgaggcttgcgttgccgccctcttggggaatagggttgatcccctgtcagaggaggggtggaaacagaagccaaatttgaatgcgatcagaagtttagaggctgtgataagagtgcacagcaagtattggggttgtatgcaaaggctggcgagctgccccgatagctgggtaccgcgcgttccaggcgccgataaggaggaggtcgaagcagtgacagccttggcttccctgagcgtggggatcctagcagaggaccgacctagtgaacagctcgtggaggaagaggagcctatgaatttgtag

SEQ ID NO: 24450 - DNA, 2925 bp, Artificial Sequence
  Description of Artificial Sequence: Synthetic coding sequence
atgcacagccccggcgccggctgcccccggccctgcgccgacacccctggtcctcagccacagcccatggacctgcgagttgggcagcgcccacccgtcgaacctccacctgagcctacactgcttgccttgcagcgcccccaaagactgcaccaccacctgttcctcgccggtctgcagcagcaacgctcagtagagcctatgcggttaagcatggacacacctatgcccgagttacaggtggggccacaggagcaggaactgcgccagctactgcacaaagacaaatctaagaggagcgccgtcgcatccagcgtggtgaaacagaaattggccgaggtgatattgaaaaaacaacaagccgccttagagcgtaccgtgcacccaaactctccaggcattccttacaggacattggaaccactcgagaccgagggagcaacaaggagtatgctgtcgtcttttctgcccccagtgccatccctgccaagcgacccgccagaacacttcccacttagaaagactgtgagtgagcccaacttaaaactgaggtacaaacctaaaaagtctctcgaacgaaggaaaaaccctctgctccgaaaagaaagtgctcctcctagtctgcgccggagaccagcagagacactcggtgattctagtcccagctcttcatcaacccccgcctctgggtgctcctcccccaatgacagtgagcatggaccgaatcctatcctcgggagtgaagctttgctgggccagcgcttgcggttgcaagagacgtccgttgccccattcgcacttcccacagttagtttgcttccagcgatcactctgggcctgccagcgcccgctcgagcggatagcgaccggcgaacccacccaaccctgggaccacggggccccattctcgggagtcctcatacgcccttgttcctcccccacggcctggagcctgaggctggaggaacccttcctagtcgcctacagcccattttattgctagacccgtccggaagccatgccccgctgctgactgttcctgggttaggccctctccctttccatttcgcccagtccctgatgaccaccgaacgcctgagtggctctggtcttcactggcccttgtctcgcaccagatcggaaccattgcctcccagcgccacagcaccccctcccccagggcccatgcagcccaggctcgaacagctgaagacacacgtacaggtgattaagcggagcgccaagccaagtgaaaagcctagactaaggcagatccccagtgctgaagatctggaaactgatggcggtggccctggacaggtggtggacgacggcctggaacaccgggagctgggacacggacaacctgaggctcgaggacctgctccactgcagcagcacccccaggtgctcttgtgggaacagcagcgattagctggccgactcccacgcggcagtacaggggacacagtgttattgccactggcacagggaggccatagacctctttctagggctcagtcctctcctgccgcccccgcaagcctttccgcacctgagcccgccagccaggcaagggtgctcagcagctcagagacccccgcccgaacgctccccttcaccacgggcctgatctacgattctgttatgctgaaacaccagtgcagctgtggagacaattcaagacatccggagcacgcgggcaggattcagagtatctggagtcgtctgcaggaacgggggctgcgttctcagtgtgagtgcctccgcggccggaaagctagtcttgaagaattgcagtccgtgcacagcgagcggcatgtgctgctctatgggaccaacccactttcacgcctgaagcttgacaacggaaaactggcaggtctgttggctcagagaatgttcgtaatgctcccatgcgggggcgtcggtgtggataccgacacaatctggaatgagctgcattcgagtaatgctgccaggtgggcagcaggctctgtcacggatctggcttttaaagtcgcgtcacgtgaattaaaaaacggcttcgctgtggtccgacctccggggcaccatgccgaccactctaccgccatgggattttgtttctttaattctgtcgccatcgcgtgtcgtcagctgcagcagcagtctaaagccagcaagattctgatagtcgactgggatgtgcaccacggcaatggcacgcaacagacattctatcaggatccctccgtcctgtatatcagtctccatcgccacgatgatgggaacttcttccccggtagcggggcagtagatgaggtgggcgccggttcaggagagggctttaacgtgaatgtcgcttgggccgggggcctggatccgcccatgggcgatccagaatacttggctgcttttcgaatcgtggtcatgcccatcgcaagagagtttagccctgacctcgtcctggtctcagccgggtttgacgcggcagaaggccaccctgcaccccttgggggataccacgtgagcgccaaatgttttggatatatgacacagcagctcatgaatctggccggaggagccgttgtgttagccctagaaggaggccatgatctcactgcgatttgcgacgcctccgaagcatgtgttgcggccctcctgggaaatagggttgaccccctttccgaggaggggtggaagcaaaaaccaaatctcaacgccattaggtctctggaagctgttataagagttcatagtaaatactgggggtgcatgcagcgcctcgcatcatgccccgattcctgggttccccgggtccctggcgccgataaagaggaggtggaggcggtcaccgcactggcttctctctcagtcggcatcctcgcagaagatagaccaagtgaacagctcgttgaagaggaggaacctatgaacctttag

SEQ ID NO: 24451 - DNA, 819 bp, Artificial Sequence
  Description of Artificial Sequence: Synthetic coding sequence
atggaggagcccgaggagcccgccgacagcggccagagcctggtgcctgtgtacatatactcccctgagtatgtctccatgtgtgactccctggccaagatcccaaaacgggcttctatggtgcactcactgattgaagcctacgccctccataagcagatgaggattgtgaagccaaaggtggctagtatggaagaaatggcgacgttccacactgatgcctacctgcaacacctccagaaggtgagtcaggagggagacgatgatcatcctgactccattgaatatggcctggggtacgactgcccagccactgagggcatctttgattacgctgcagccatcgggggagctacaatcactgctgcccagtgtttgatagacggaatgtgcaaggtagcaatcaactggagcggtggatggcatcatgcaaagaaagatgaggccagtggcttttgctatctcaacgatgcggtgctaggcatcctgcgcctgcgtcgcaaattcgagagaattctctatgttgacctcgatctccaccatggtgatggggtggaggatgcatttagtttcacatcaaaggtaatgactgtctccctgcataagttcagtcctggcttcttccctgggaaatcggacgtgtctgatgtcggattagggaagggaaggtattactcagtaaacgttccaatccaggacggtattcaggacgaaaagtactatcaaatctgtgaaagcgtcagaacttcatgcccaaagtcaagacctgtcgaggctgccgcagccgcctgtctgcctcacttacattctttggtctag

SEQ ID NO: 24452 - DNA, 1134 bp, Artificial Sequence
  Description of Artificial Sequence: Synthetic coding sequence
atggaggagcccgaggagcccgccgacagcggccagagcctggtgccagtgtatatctattctcctgaatacgtgagtatgtgtgatagtctagccaagattcctaaacgtgcgtctatggtccattccttaatcgaggcatatgctttacataaacaaatgcggatcgttaaacccaaggtggcgagtatggaggagatggctacttttcatactgacgcttacttgcagcacctgcagaaggtctcacaggagggcgatgatgatcatccagactctatcgagtacggactgggttacgactgcccggctactgaaggcatatttgactacgccgctgcaattggcggcgccaccattaccgcggcccaatgtctcatagatggtatgtgtaaggtggctataaattggagcggtggctggcatcatgccaaaaaagacgaggccagcggattctgctacctgaatgacgctgtactgggcatcctgagattgcggagaaagttcgagcgtatcctctacgttgatctggatctgcaccacggcgacggcgttgaagatgcattctcattcaccagtaaagtgatgaccgtcagtctgcataaattttcacctgggtttttcccgggcacaggggacgtatccgacgtgggcctgggaaagggacggtactacagtgtcaacgttcctattcaggacggcatccaagatgaaaagtattatcagatctgtgaaagcgtgctcaaggaagtgtatcaagctttcaatcctaaagctgtcgtcctgcaacttggagccgatactatcgcgggggatcccatgtgctccttcaacatgactccagttggcatcggaaaatgtctgaagtacatcctgcagtggcaactagctacattgattctgggtggaggtgggtacaatctggctaacactgcgcggtgctggacctacttaacaggagtgatactgggtaaaaccctgtcaagcgagatccctgatcatgagttttttacagcttatggtcccgattatgtattggaaattacaccgagctgtagacctgatagaaatgaaccccatcggatacagcaaatcctcaactatataaagggcaatctgaaacacgtggtctag

SEQ ID NO: 24453 - DNA, 861 bp, Artificial Sequence
  Description of Artificial Sequence: Synthetic coding sequence
atggaggagcccgaggagcccgccgacagcggccagagcctggtgcccgtatatatttactctcctgagtacgtgtctatgtgcgacagcctggccaagatccctaagcgcgcatccatggtccacagcctaatcgaagcctatgcactccataagcaaatgcgagatgaagcctctggcttctgttacctgaacgacgccgtgctaggaatcttgcgcctccgtaggaagtttgaacgcatcctgtatgtagacctggacctgcaccacggcgacggcgtagaagatgcctttagcttcaccagcaaggtgatgacagtgtctttacataaatttagcccgggcttttttccaggaaccggagacgtgtccgacgtggggctcggaaagggcagatactactctgtgaacgtccccattcaggacgggatccaagatgagaagtactaccaaatatgcgaaagcgtgctgaaggaagtgtatcaggctttcaatcctaaggccgtggtccttcagttgggggctgataccattgccggagacccaatgtgcagctttaacatgactcccgtggggatcggtaaatgtctgaaatacattctgcagtggcagctggctaccctgatcctcggcggcggagggtacaatctggctaatacagctcgttgctggacatatctgaccggcgtgattttagggaaaacccttagctctgagattcccgaccatgagtttttcaccgcttacgggcccgactatgtgctcgagattacaccgagctgccgtccggatcgtaatgaaccccaccggatccaacaaatactgaactatatcaaaggcaaccttaaacacgtggtgtag

SEQ ID NO: 24454 - DNA, 549 bp, Artificial Sequence
  Description of Artificial Sequence: Synthetic coding sequence
atgaccgtgagcctgcacaagttcagccccggcttcttccccggcaccggcgatgtgtcagacgtgggccttggcaagggacggtattattcagtgaacgttcccattcaagacgggatccaagatgagaaatattatcagatttgtgaatcggtcctgaaagaggtgtatcaggcgttcaatccaaaagccgttgtactgcagctaggcgccgacaccatagcgggcgatcctatgtgtagctttaacatgactccggttggcatagggaagtgcctaaaatatatacttcagtggcaactggctacactcattctgggcggcggcggatacaacctggctaataccgcaagatgctggacctatcttactggggtgattctcggaaagacattaagctcagaaatcccagaccatgagttctttactgcttacggacctgattacgtgttggaaattacccccagctgccgccccgatagaaacgagccgcaccgcatccaacaaattctgaactacatcaagggtaaccttaaacacgtcgtgtag

SEQ ID NO: 24455 - DNA, 441 bp, Artificial Sequence
  Description of Artificial Sequence: Synthetic coding sequence
atggaggagcccgaggagcccgccgacagcggccagagcctggtgcccgtctacatttacagcccagagtacgtgagtatgtgcgactccttagctaagatcccaaaaagggcttccatggtccatagcctcatcgaggcttatgctctgcataaacagatgcgtattgtgaagcccaaggtggcttctatggaagagatggcgacgttccacacagatgcatacctgcagcatcttcagaaagtgagccaagagggcgacgacgaccacccagactcaatagaatacgggcttggatacgactgtccagcaacagagggtatctttgattatgcggctgctatcggaggggctaccatcaccgccgcacagtgcctgattgacggtatgtgcaaggtggcaattaactggtcggggggatggcatcacgcaaaaaaatag

SEQ ID NO: 24456 - DNA, 477 bp, Artificial Sequence
  Description of Artificial Sequence: Synthetic coding sequence
atggaggagcccgaggagcccgccgacagcggccagagcctggtgcctgtctatatctactcccctgagtacgtgagcatgtgcgactcactggccaaaatcccaaagagggcctctatggtgcattctctgatcgaggcctatgctctccacaaacagatgcgaatcgtgaagccaaaggtagcatcgatggaagagatggctacctttcatacagatgcctacctccaacacctgcagaaggtgagccaggaaggtgacgatgaccatcctgattcaatcgaatacggcttgggttacgattgtccagctacagaagggattttcgattatgctgcagcaatcgggggtgccacaatcactgcagcccagtgtctgatcgacggcatgtgcaaggttgctataaattggtccggaggctggcatcatgccaagaaagaaacatgcgtgtacgtggctctctacaaagctttttag

SEQ ID NO: 24457 - DNA, 420 bp, Artificial Sequence
  Description of Artificial Sequence: Synthetic coding sequence
atggaggagcccgaggagcccgccgacagcggccagagcctggtgcctgtgtacatttatagccccgagtatgtctccatgtgtgacagcctcgccaagatacccaaaagagcctcaatggtgcactcactaatcgaagcctacgccttacacaagcagatgagggacgaagcgtccggtttctgctacctgaatgacgccgtgttgggcattctgcgtctgcgcaggaagtttgagcggattctgtacgtggacttggatttacaccatggcgacggcactggagatgtgtcagacgtgggactcgggaagggcagatactacagcgtgaacgtccctatccaggatgggattcaggatgagaagtattaccaaatttgcgaacgttacgagcctccagcccccaatcctgggctgtag

SEQ ID NO: 24458 - DNA, 771 bp, Artificial Sequence
  Description of Artificial Sequence: Synthetic coding sequence
atggaggagcccgaggagcccgccgacagcggccagagcctggtgcccgtttatatctatagccctgagtacgtgtctatgtgcgactctctcgcaaaaattccaaaacgcgctagtatggtgcacagtctgattgaagcctacgccctgcacaaacagatgcgaatagttaaacccaaagtggcatctatggaggagatggcaaccttccacacagatgcctacctgcaacacctccagaaggtgtcacaggaaggagacgatgatcaccctgactccattgagtacggcctcggatacgactgccccgccacggaggggatattcgattatgccgccgccatcgggggcgccactatcaccgccgctcagtgcctgatcgacgggatgtgcaaggttgccatcaattggtctggtgggtggcatcatgccaagaaagacgaggccagtggattctgttacctgaatgatgcagtgctggggatcctcaggctgagaaggaagttcgagcggatcctctatgtcgacttggacttacaccacggcgacggagtcgaagacgctttcagctttacttcaaaggtcatgactgttagcctgcataaattctcccctgggttcttccctggcaccggcgacgtaagtgatgtcggattgggcaagggacggtattattccgttaacgtgcctatacaggacgggattcaggacgaaaaatattaccagatctgcgaacgttacgagccgccagcccccaacccaggattgtag

SEQ ID NO: 24459 - DNA, 831 bp, Artificial Sequence
  Description of Artificial Sequence: Synthetic coding sequence
atggccggccccgccgccctgagcgccgccgccgccgccgccctggccgccgctttgttgctgctgcggcgggaggaccccggacccggcgccggtcccagtatggccgaaaccgaggcgctgtcaaaactgagggaagattttaggatgcagaacaagtccgtgtttatcttgggcgccagcggagaaacaggcagggtcctcctgaaggagatcttagagcagggccttttctccaaagttacactgatcggtaggaggaagctgacttttgatgaagaggcatataagaacgtaaatcaagaagtcgttgatttcgagaagctcgatgactacgcatctgctttccagggacacgacgtcggcttttgctgtctggggaccactcgagggaaggcaggtgcagaagggtttgttagggtggatcgcgactatgtgctgaaatccgctgagttggccaaggccggcggttgtaagcactttaacctgctgtctagcaagggcgccgataaaagttccaatttcctgtacctccaggtgaaaggagaggttgaagccaaagttgaagagctgaaatttgaccgttactccgtgttccgcccaggcgtgcttctttgtgacagacaggaatccaggccaggagagtggctagtgcgaaaattctttgggtccctccccgattcctgggcatccggccatagtgtcccagtggtgacggttgttagagctatgttaaataatgtggtgaggcctcgtgacaagcagatggagcttctcgaaaacaaggccatccacgatctgggaaaggcacacggatctctcaagccttag

SEQ ID NO: 24460 - DNA, 729 bp, Artificial Sequence
  Description of Artificial Sequence: Synthetic coding sequence
atggccgagaccgaggccctgagcaagctgcgggaggacttccggatgcagaacaaatccgtgttcatccttggggccagtggtgaaacagggagagtgttgctgaaagagatccttgagcaggggctgttctcaaaagtcacattaattggtagaaggaaactaacgtttgatgaggaagcctacaagaatgtgaaccaagaagtagttgatttcgaaaagcttgacgactacgcatccgcttttcaggggcacgatgtcggattttgctgcctaggcacaacccggggcaaggcaggcgctgaaggatttgtgcgcgtagaccgggactatgtcctcaaatctgccgagctcgctaaggccggtggatgtaagcactttaatctactatcaagcaaaggagcagataagagttctaacttcctttatctccaggtcaagggagaagtcgaagccaaagtggaggagctgaaatttgatcgctattccgtgtttaggcccggagtgcttttatgtgaccggcaggagtcccgccccggtgaatggctagtcagaaagttttttggatccctcccggattcttgggcctcaggccacagtgttccggtggtcacagttgtccgcgcgatgctcaacaacgtggtccgccccagggacaagcagatggaacttctcgagaataaggccattcacgacctcggcaaggcccatgggagcttgaagccttag

SEQ ID NO: 24461 - DNA, 729 bp, Artificial Sequence
  Description of Artificial Sequence: Synthetic coding sequence
atggccgagaccgaggccctgagcaagctgcgggaggacttccggatgcagaacaagtccgtattcatccttggtgcctctggcgagaccggcagggtcctcctcaaggagatcttagagcagggattgttctcaaaggtcacccttatcggacggagaaagctgaccttcgatgaagaggcatataagaacgtcaaccaggaggtcgtcgactttgagaaactggacgactacgcctctgcatttcaaggccacgacgtcggattttgttgcctcggaactactaggggcaaagcgggagcagagggcttcgtcagggtggaccgagactacgttcttaagagcgcggagctggcgaaagcaggcggctgcaagcacttcaatctgctttccagcaagggggccgacaaaagtagcaacttcctctacctgcaggtgaaaggcgaagtcgaggcaaaggtggaagagctgaagttcgataggtacagcgtgttccggcctggtgtactactgtgcgataggcaggagtcccgtccaggagagtggctggttcggaaattcttcgggtctctccctgactcttgggcttctggccactctgtccctgtagtcaccgtggttagggccatgctcaataacgtagttaggccacgggataaacagatggagctgcttgagaacaaagccattcacgatttgggtaaggctcatggctccctaaagccttag

SEQ ID NO: 24462 - DNA, 729 bp, Artificial Sequence
  Description of Artificial Sequence: Synthetic coding sequence
atggccgagaccgaggccctgagcaagctgcgggaggacttccggatgcagaacaaatctgttttcattctgggggcctctggggaaaccgggcgagtacttcttaaggagattctggagcaggggctcttttcaaaagtgaccttgatcgggagacgtaagctgacattcgacgaagaagcgtataagaacgttaatcaggaggtggttgatttcgaaaaattggatgactacgccagcgcctttcagggccacgatgttgggttctgctgtctgggaacaacgcggggcaaagctggcgctgagggatttgttcgcgtcgatcgggattacgtgctcaaatccgccgaactcgccaaggcaggaggctgcaagcatttcaatcttctgagctcaaaaggagccgataaaagtagtaactttctttatctacaggtaaaaggggaagtagaagctaaagtcgaagagcttaaatttgaccgttatagtgtgtttaggcctggcgtgctgctctgtgacagacaggaaagtcggccaggggagtggctagtgcggaagttttttggatcacttcctgacagttgggcctctggccacagcgttccggtggtgacagtggtgagggccatgctgaataatgttgtgcgcccgagagacaaacagatggagctgctggaaaataaagctatccatgacctgggtaaggcccacggcagcttaaagccatag

SEQ ID NO: 24463 - DNA, 402 bp, Artificial Sequence
  Description of Artificial Sequence: Synthetic coding sequence
atggccgagaccgaggccctgagcaagctgcgggaggacttccggatgcagaacaagtccgtgtttatcctcggcgcttcaggcgagaccggacgggtcctactcaaggagatcctggagcaaggccttttcagcaaggttaccttgattgggcgccgcaagttgacctttgacgaagaagcctacaagaacgtaaatcaggaagtcgtggacttcgaaaaactggacgactacgcttccgcctttcagggccacgacgtcgggttctgctgcctaggtaccactcggggtaaggcaggtgcggtgagaaaggcctatgccttattccccttctgttggccggtgatttccagaattctgtttctgctgacgttattcctttgtgcatgctgtaacgcctag

SEQ ID NO: 24464 - DNA, 402 bp, Artificial Sequence
  Description of Artificial Sequence: Synthetic coding sequence
atggccgagaccgaggccctgagcaagctgcgggaggacttccggatgcagaacaagtccgtttttattttaggagcgtcaggtgagactggacgcgttttgcttaaggagatcctggagcagggactcttttctaaggtgactttaatcggacgacgaaaactgacctttgatgaagaggcgtacaagaatgttaatcaggaagttgtagatttcgagaagctcgatgactacgcgagcgctttccagggccacgacgttggattctgttgcctagggacaacccgcggcaaagctggcgcagttcgcaaagcctacgccctcttccccttctgctggccagtgatttctcggatcctctttctgttaacattatttctatgtgcctgctgtaatgcgtag

SEQ ID NO: 24465 - DNA, 402 bp, Artificial Sequence
  Description of Artificial Sequence: Synthetic coding sequence
atggccgagaccgaggccctgagcaagctgcgggaggacttccggatgcagaacaagtcagtctttattttaggtgcttcaggcgagactggtagagtgctcctcaaggagatcctggaacaagggctgttctcaaaagtaactctgataggaagacggaaactgacattcgatgaagaggcatacaagaacgtcaaccaggaggtggttgatttcgagaagctggacgactatgcaagcgcgttccagggccacgacgtgggattttgctgcttgggaactacacggggcaaagcaggggccgtgcggaaggcatacgccctattccccttctgctggccagtaatatcccggatcttattcctgcttactttgttcctttgcgcctgttgtaacgcttag

SEQ ID NO: 24466 - DNA, 1080 bp, Artificial Sequence
  Description of Artificial Sequence: Synthetic coding sequence
atggccgagcacggcgcccacttcaccgccgccagcgtggccgacgatcagccctcaatttttgaggtggtggcgcaggattcattgatgactgctgtacggcctgccctgcagcatgtcgtgaaagtgttggcagagtctaatcccacacactatggcttcttatggcgatggtttgatgagattttcaccctacttgacctgctcttgcagcaacattatctgagccggacctctgctagcttctctgagaatttttatggactgaaacggatcgttatgggggacacacataaatcacagcgtctcgcttccgcaggtctccctaaacaacagctttggaagtctatcatgttcctcgtattgcttccatacctaaaagtgaagctggaaaagctggtctcctcgcttcgggaggaggacgaatactcaatccaccctccctctagtcggtggaagaggttctatcgcgcatttttggcagcctaccccttcgtaaatatggcctgggaggggtggttcttggtccaacagctgcggtatatcctgggaaaggcccagcatcactcccccctactgcgcctggcgggcgtgcagttaggccggctaacggttcaggacatacaagccctggagcataaaccagccaaggcgtctatgatgcagcagcctgcccggtctgtaagtgaaaaaattaacagcgccctgaagaaagccgtcgggggggtggctctatctctgagcaccggcctgagcgtcggtgtgttcttccttcaatttctcgactggtggtacagtagcgagaaccaggagactatcaaatcgttgacagcgctgcctacccccccccctccagtgcacctagactacaattccgacagccctcttttgcccaaaatgaagactgtttgccccctttgtcgtaaaactagggttaacgataccgtgctcgctacttcgggatatgtgttctgctatagatgcgtcttccactacgtgcgctcccatcaggcctgtccaatcacaggctatcccaccgaagtccaacatctgataaaactgtatagccccgagaattag

SEQ ID NO: 24467 - DNA, 1374 bp, Artificial Sequence
  Description of Artificial Sequence: Synthetic coding sequence
atggtgagcaagctgaccagcctgcagcaggagctgctgagcgccctactctcctctggcgtgaccaaggaagtgctagtccaggcactcgaagagttactcccctctccaaactttggggtcaagctggagacccttccgctgagtcctggtagcggagcagaaccagatacaaaacctgtttttcatactctcaccaatgggcacgctaaggggaggttgtccggagacgaaggcagcgaggatggcgacgactatgatacgccacctatcctgaaggagctgcaggccctgaacacagaagaggccgctgaacaaagagcagaagttgataggatgctgagcgaggatccatggagagcagccaagatgattaaaggctatatgcaacagcataacatccctcagagggaagtggtcgacgtgactggcctcaaccaaagtcacttgtcgcagcacttaaacaaaggtacccctatgaaaacacagaaacgggcagccctgtacacttggtacgtccgcaagcagagggagatccttcgccagttctcacagcagagccacggcccaggccagtccgatgacgcatgttcagaacctacaaacaagaagatgcgccggaataggtttaaatggggcccagcctcccaacagattctctaccaagcatatgacagacagaagaatcccagcaaggaagagcgcgaggccctcgtcgaagagtgcaatcgtgccgagtgtttgcagaggggtgtttcgccttcaaaggcccatgggctggggtctaatcttgttacagaagtcagggtttacaattggtttgcaaataggagaaaggaggaggcttttcgccaaaaactggccatggacgcctatagctcgaatcagacacattcccttaaccccctgctatctcacggcagccctcatcaccagccaagttcaagccctcctaacaagctgagtggggtcagatatagccaacaggggaacaatgagatcactagtagcagtactatatcacaccacggaaactctgcgatggtgaccagccagtcggtactgcagcaagtgtctccagcctcacttgacccagggcacaatctcctttctcctgatggcaagatgatctccgtgagcggaggtggcttgccacctgtgagcaccctaaccaatattcactcactgagccatcataatcctcagcaatcccagaatctgatcatgactcccttgagcggggtgatggctatcgcccagatgtccagtacctccttagtgatgcctactcatcacctgctccgcgctcagcaacagggaccttgttttccacatcaccaccccctgggctcttgtcatggaaaggctcagtag

SEQ ID NO: 24468 - DNA, 1338 bp, Artificial Sequence
  Description of Artificial Sequence: Synthetic coding sequence
atgctgagcgaggacccctggcgggccgccaagatgatcaagggctacatgcagcagcataacattccccagcgggaagtggtagacgttacagggcttaaccagtcccatctctctcagcacttgaacaaaggaacccccatgaaaacgcaaaaacgggctgcgctgtacacatggtacgtgcggaaacaaagagaaatcctgcgacaatttaatcagacggtgcagagttccggaaacatgaccgataaatcttcccaggatcagcttttgtttttattccctgagttttcacagcagtcacacggccctggacagtccgatgatgcctgtagcgaaccgacaaacaaaaagatgcgtagaaacaggtttaaatggggtcctgcgtcgcagcagatcctctaccaggcgtacgatcgacagaagaatccgagtaaggaagagagagaggctcttgtggaagagtgcaatagggccgagtgtctccagagaggtgtatccccttcgaaggctcatggtctcggatccaacctagtcacagaagtgcgggtgtacaactggtttgccaaccggcggaaggaagaagccttccggcagaaactagccatggacgcctattccagtaatcagacccattcgctaaaccccctcttaagccacggcagccctcatcaccagccttccagcagtccacctaataagctctcaggtgtcagatattcgcaacaaggcaacaacgagatcacttctagttctacgatctctcatcacggaaattctgccatggtgacctcacagagcgtgctccaacaagtgagccccgcatccctggacccgggtcataatctcctgagccctgatgggaagatgatcagtgtgtccggtgggggcttacctccagtgagcacccttactaacatccacagtctgtcacatcacaaccctcagcaatctcaaaatctgattatgacacctctcagcggagtgatggccattgcgcagtccctgaatacgtcacaggcccagagcgtgccagtgatcaattctgtcgcggggtccctggcagctctacagcccgtccagtttagccagcagctgcactcaccgcaccagcagcccttgatgcagcagtcacctggaagtcatatggcccagcaaccgtttatggctgctgtcacacaacttcaaaactcacatatgtacgcacacaagcaggagcctccccagtatagtcatacaagcagattcccttcggctatggtcgtaactgacactagtagtatctcaactctcaccaacatgagctcgtctaagcagtgtcctttgcaggcctggtag

SEQ ID NO: 24469 - DNA, 1278 bp, Artificial Sequence
  Description of Artificial Sequence: Synthetic coding sequence
atggtgagcaagctgaccagcctgcagcaggagctgctgagcgccttgctctcatcaggggtgaccaaagaggtcctcgtgcaggcccttgaggaactcctcccaagccctaatttcggggttaaactggaaaccctacctcttagccccggttccggagctgagcccgacactaagcccgtgttccacacactgactaacggccatgccaaggggagattatccggggacgaagggtcggaagacggggacgactacgatactcctcctatcctgaaggagcttcaggctctgaatactgaggaagcagccgagcagagggcagaggtggatcgaatgctgagtgaagacccttggagggccgctaagatgataaaagggtatatgcaacagcataacatccctcagcgggaagtcgtcgacgtaaccggcttaaaccagtcccatctgagtcagcatttgaataaaggtacacctatgaagactcagaagcgcgccgccctgtacacgtggtacgtgaggaagcagagagagatcttacgccagttcaatcaaaccgtccaatcgagcgggaacatgacagacaagtccagccaggaccaactcctgttcttgtttccagagttcagccagcagtcgcatgggcctggccagtccgacgacgcctgctcggaacctacgaataagaagatgcgtcgcaatcggtttaagtgggggcccgcctcacagcagattctgtatcaggcctatgatagacagaaaaatccttcgaaggaagaaagggaggctctggtagaggaatgtaacagggctgagtgcttacagcgcggtgtgagcccgtcaaaagcacacggcctcggatcaaacctggtgacagaggtcagggtctacaactggttcgccaacagacggaaggaagaggcctttagacagaagctggctatggatgcctactcatccaatcagacccattcccttaaccccctcctcagccacggcagcccgcatcaccagccaagctcctcacctcccaacaaactgtcaggcgtccggtatagccagcagggtaataacgaaattacttcatccagtacgatctcccaccacgggaacagtgcaatggtgacttcacaatccgtcctgcagcaggtctcacccgcttctcttgacccagggcataatttgctatcgcccgatggaaagatggacttgagcctgcgaaggcggtttgcaccttcccagcacttagacgagtaccctcaacctctgcccccctag

SEQ ID NO: 24470 - DNA, 1596 bp, Artificial Sequence
  Description of Artificial Sequence: Synthetic coding sequence
atggtgagcaagctgaccagcctgcagcaggagctgctgagcgccttgctctcttccggggtgacaaaggaggtgttggttcaagctctggaggaactactgccatcccccaacttcggggtgaaactcgagaccctgcccttatctcctggatctggggccgagcccgataccaaaccggtcttccacactctgacaaatgggcatgcaaaggggagactgtcaggagatgagggatcagaagacggagatgattatgacacccccccaatcctgaaggagctgcaggccctgaacaccgaagaggctgccgaacaacgggccgaagtcgaccgcatgctgtcagaggacccgtggcgggctgccaaaatgatcaagggctatatgcagcaacacaatatacctcaacgagaggtagtcgacgtgaccggtttgaatcagagccatctcagccagcacctgaataaaggaacccctatgaaaacacagaagcgagccgcactatatacctggtatgtgcggaaacaaagagagatactgcgccagttttcacagcagagccacggccctggacaatctgatgacgcctgcagcgagcctacgaacaagaaaatgagaaggaaccgtttcaaatgggggccggctagccagcagatcttataccaagcgtacgaccggcagaagaatccaagcaaggaggagagggaagctcttgtggaagaatgcaaccgcgcagagtgccttcaacggggagtctcgccttcaaaggcccacggactgggatccaacctcgtcactgaggtgcgggtttataattggtttgcgaatcgacgcaaagaagaagcattccggcaaaaactggctatggatgcatactcaagtaatcagacccactcccttaatccactgttgagtcacggatcgccacaccaccagccgtccagcagcccaccaaacaagctgtccggcgtgcgctactcccagcagggtaacaacgaaatcacatcttccagcactatctctcaccatggaaactctgctatggtgactagccaaagcgtgctacagcaagtgtcaccagcttcactggacccgggtcataacctgttgagccctgacgggaagatgatatccgtttcaggcggcggtctgccaccagtgagcaccctgaccaacatccactcactatcccatcacaatccacagcagtcacagaatctgataatgacaccactgtcgggagtcatggcgatcgctcagagcctgaatacctcacaggcccaatcggtgccggtgatcaactcagtggctggttccctggccgccttgcagccagtgcagttttctcaacagctgcactcgccccatcagcagcctctgatgcagcaaagccctggatcacacatggcgcaacaacctttcatggcagcggtcacccagctgcagaacagccatatgtacgcccataagcaggaacctccccagtactctcatacttcccgcttcccttccgccatggttgtcacggatacatcatctatctcaacccttaccaatatgagcagcagtaagcagtgcccccttcaggcatggtag

SEQ ID NO: 24471 - DNA, 843 bp, Artificial Sequence
  Description of Artificial Sequence: Synthetic coding sequence
atgaagttccgggccaagatcgtggacggcgcctgcctgaaccacttcactagaatcagcaatatgattgccaagctggccaagacatgtactcttagaatcagccctgataagcttaactttattctgtgtgataaacttgccaatggcggggtaagtatgtggtgcgaattggagcaggaaaacttctttaatgagttccagatggagggtgtgtcagccgaaaataacgagatctatctggaactgacatccgaaaacttatctagagctctgaagacagcacaaaatgccagagccctgaagataaaactgacgaacaaacactttccttgcctgacagtcagcgtcgaactcctttccatgtctagttccagccgaatagtgacgcacgacataccaatcaaggtgatcccacggaaactatggaaggatctacaagagcccgtagtgccagaccccgatgtctctatttatctaccggttctcaagacgatgaagagcgtggttgagaaaatgaaaaacatctccaatcacttagtgattgaagccaatttggacggtgagctaaatctgaaaattgaaaccgagcttgtgtgtgtgactactcattttaaggatttaggtaacccacctctagcgagcgagtccacacacgaagatagaaacgtagagcatatggctgaagtacacatagatatcaggaagttgctccaattccttgcaggccaacaggtgaatcctaccaaggctctgtgcaacattgtcaacaataaaatggtccatttcgacctcctacacgaggacgtatctttacagtattttattcctgcgttgagctag

SEQ ID NO: 24472 - DNA, 780 bp, Artificial Sequence
  Description of Artificial Sequence: Synthetic coding sequence
atgatcgccaagctggccaagacctgcaccctgcggatcagccccgataaactcaatttcatcctttgtgataaactagccaatgggggtgtgtccatgtggtgcgaattggagcaagaaaatttctttaacgagtttcagatggagggcgtgtccgccgaaaacaacgaaatttatctggaactgacctctgagaatttaagccgagcgctgaagacagctcagaatgcaagggctctgaagatcaagctcacaaacaaacatttcccatgcttgactgttagcgtcgagctgcttagtatgagctcctctagtaggatcgtaacacatgatatcccaatcaaggtaattcctcgcaaattatggaaggacctgcaggagccagttgtgcctgatcccgacgtgtccatttatctacctgtgctaaaaaccatgaagtcagtggtagagaagatgaagaatatttcgaaccacctggtgattgaagcaaacctcgacggcgagctcaacttgaagatcgaaactgagttggtatgtgtgaccacgcactttaaggatctcggtaatcctccattagcctcagagtctacacacgaagaccggaatgtagagcacatggccgaggtgcacattgacattcgcaaactcctgcagtttttagctgggcagcaggtgaaccctaccaaggctctatgcaacattgttaataacaagatggtgcacttcgacttactccacgaagacgttagcttacagtacttcattcccgcactaagctag

SEQ ID NO: 24473 - DNA, 843 bp, Artificial Sequence
  Description of Artificial Sequence: Synthetic coding sequence
atgaagttccgggccaagatcgtggacggcgcctgcctgaaccactttactaggatctctaatatgatcgccaagcttgcaaagacctgtaccctaagaatcagcccagacaagctcaattttattctgtgcgataagctagctaacgggggggtcagtatgtggtgtgaacttgagcaggagaactttttcaatgaatttcagatggagggagtgtctgctgaaaacaacgagatctacttggagctgacgtcagaaaacctgtccagggccctgaaaactgcacagaacgcgcgcgctttgaaaatcaagttaacaaataaacactttccctgtctgacagtatcagtggaacttcttagtatgagctcaagttctcggatcgtaactcacgatattccgatcaaggtgattccccggaagctgtggaaggatctacaggagcccgtcgtccccgacccagatgtttctatctacctgccagtcttgaaaacaatgaaatcagttgttgagaagatgaaaaacattagtaaccacttagttatcgaggcaaacctggacggcgaattaaatctgaagatcgagacagaactggtgtgtgttactactcactttaaggacctcgggaatccaccactggcctctgagtccacacacgaggaccgaaatgtagagcatatggctgaggttcatatcgacattcgcaaactcctgcagttcctggctggacagcaggtaaatcctaccaaggccctctgcaatatcgttaataataagatggtgcacttcgacctcctgcatgaggatgtaagcctgcagtatttcattcctgcactgagctag

SEQ ID NO: 24474 - DNA, 780 bp, Artificial Sequence
  Description of Artificial Sequence: Synthetic coding sequence
atgatcgccaagctggccaagacctgcaccctgcggatcagccccgacaaactcaactttatcctgtgcgacaagctcgctaatggcggggtgtcaatgtggtgtgaactggaacaggagaactttttcaacgaattccagatggagggcgtttcggccgagaataatgagatttatctggagctaacttccgagaacctgtctagagcacttaagactgcgcagaacgcccgtgctcttaagattaaactgacaaacaagcacttcccatgtctgacagtctctgtggaactcttgagtatgtccagctcctcgcgcatcgtgacccacgacatcccaattaaagtaatacctcggaagctgtggaaagatttgcaggaaccagtagtcccggaccctgacgtgtccatttatctccccgtgctgaagaccatgaaaagcgtggtggaaaagatgaagaatatatcaaaccatctcgtaattgaagccaatctggatggagaattaaacctcaagatcgaaacggaactcgtgtgcgtgaccacccactttaaagaccttggtaatcccccactggcctccgagtcgacccacgaagataggaatgtggaacacatggcagaagtccacatcgacatccgcaagctgcttcaattcctggccggtcaacaagtaaatcccacaaaggctttgtgtaatattgtaaataataaaatggtgcacttcgacttactccatgaggatgtgtctctgcagtactttatcccagctctgagctag

SEQ ID NO: 24475 - DNA, 2130 bp, Artificial Sequence
  Description of Artificial Sequence: Synthetic coding sequence
atgagcttccccaaggcccccctgaagcggttcaacgaccccagcgggtgtgccccttcccccggagcttacgacgtgaagactttggaagtcctgaagggcccagtgtcctttcagaagagtcagcggtttaagcagcaaaaggagtctaagcagaacctcaatgtagataaggataccacccttccagcttccgcaagaaaggtgaaaagtagcgaatccaaaatccgcgtgctgctgcaggagagaggtgcccaagaccgaaggatacaggatttggaaaccgagttggaaaagatggaggcaaggcttaacgccgccctcagggaaaaaacgtcactctctgccaacaatgcaacattggaaaagcagctgatcgagcttacccgcactaatgagctgctgaaatcaaagttcagcgagaatggcaaccagaaaaatctgaggatcctctcacttgagctgatgaagctgcgaaacaagagggagactaaaatgcgtggcatgatggccaagcaggagggcatggagatgaagttgcaagttacccagcgctccctagaggaaagccaaggtaagatcgcacaactggagggaaaattagtctccattgaaaaggaaaagattgatgagaagtcagagacggaaaagctgctagagtatatcgaggaaatcagctgtgcctctgatcaggtcgagaaatacaagctcgacatcgcacaactggaggaaaacctcaaagagaagaacgatgaaattctctctttgaaacagtccctggaggagaacattgtgatcttgagtaagcaagtcgaagatctgaatgtgaaatgccagctgctggagaaggagaaagaagaccatgtcaatagaaaccgggaacataacgaaaatctgaatgcagagatgcaaaacctgaagcaaaaatttattttagagcagcaggaacgggaaaaactccagcagaaggagcttcagatcgacagtcttctgcaacaggaaaaagagcttagttccagtctgcaccagaagctttgtagtttccaagaggagatggttaaggaaaagaatctcttcgaagaggaactcaagcaaactctggacgaactggataagctgcaacagaaggaggagcaagctgagagactcgtgaagcagctggaagaggaggctaagtctcgggctgaagagcttaaactgctggaggaaaagcttaaggggaaggaggctgaattggagaagtcttcagccgcacatacacaagcaactctgcttctccaggaaaagtacgactcaatggttcagtcactggaggatgtcaccgcacaattcgaatcttacaaggcgctgacagccagtgagattgaagatcttaagctggagaacagtagcttgcaagagaaggctgctaaggccggcaagaatgccgaggacgttcagcaccagatcttggccacagagtccagcaatcaggagtatgtaagaatgttgctggacctgcagacgaaatccgcccttaaggaaacagagattaaggagatcacggtgtccttcttgcagaagatcacggacttacagaaccaattaaagcaacaagaggaggattttaggaaacaactggaagatgaggaaggtcgaaaggccgagaaagaaaacaccacagccgagctgacggaggagattaacaaatggcgtttgctttatgaggagctttacaacaagaccaaaccttttcaactgcaacttgacgccttcgaggtagaaaagcaggctctcctaaacgaacacggggcagcccaggagcagttaaacaaaatacgcgattcctatgccaaactcctgggtcatcagaacctcaaacagaagattaaacacgtggtaaaattaaaggacgagaacagccaacttaagtctgaggtgtccaagctgcggtgtcagctggccaagaagaagcaatccgaaactaagttacaggaggagcttaataaggtgctcggaatcaaacacttcgatcctagcaaggccttccaccatgagtccaaagaaaacttcgcgcttaaaacacctcttaaggagggcaacaccaactgctaccgagcgccaatggaatgccaggagtcctggaaatag

SEQ ID NO: 24476 - DNA, 2175 bp, Artificial Sequence
  Description of Artificial Sequence: Synthetic coding sequence
atgagcttccccaaggcccccctgaagcggttcaacgaccccagcggttgtgccccaagtcctggtgcatatgatgtgaaaacccttgaggtgcttaaagggcccgtctcctttcagaagagccagagattcaagcagcagaaagaatcaaaacagaatcttaacgtggataaagacaccaccttacctgctagtgcgcggaaggtcaagagctccgaaagcaaagaaagccagaagaatgataaagacctcaagatcctggagaaagagatcagagtgcttttgcaggagcggggggcccaggatcgccggatacaggatcttgagaccgaactcgagaagatggaagctaggctgaatgccgccttaagggaaaagacatccctctcagcgaacaacgccacactggaaaagcagctcattgaactgacaagaaccaatgagttactgaagtctaagttcagtgagaacgggaaccagaaaaacttgcggatcctgtccctggagctcatgaagttgaggaacaagagggagacaaaaatgcgagggatgatggcaaaacaggagggaatggagatgaagttgcaggtgacccagcgcagtctcgaggaaagtcaaggcaaaatcgcccagttagaggggaaacttgtgtctatagaaaaagaaaagattgacgaaaagtccgagactgagaagctgctcgagtacattgaggaaatatcctgcgctagtgatcaggtagaaaaatataagctggacatcgcccagctggaggagaatttgaaggaaaagaatgatgagatactgagtctgaaacagagtttagaagaaaatatcgtcattctgtcaaaacaggtcgaggaccttaatgtgaaatgccaactgctggaaaaggagaaagaggaccatgtgaaccgcaaccgcgagcacaatgagaatctcaatgctgagatgcaaaatctgaagcaaaaattcatcctagagcagcaggagagggagaagctccagcaaaaggaacttcagattgactccttgctgcagcaggaaaaggaactcagctcatccctacatcagaagctctgcagttttcaggaagaaatggtaaaggaaaagaacctctttgaagaagagctgaaacagacacttgatgagcttgataaactacagcagaaggaggagcaagcagagcgcctggtaaagcaactggaggaagaagcgaaatcccgtgcggaagaacttaagctgctggaagagaagctaaagggaaaggaagctgagctggagaaatcaagcgccgctcacacacaggccacgttgctactgcaggagaagtatgatagcatggtccaatccttagaggacgtgaccgcccagttcgagagctataaggctttgaccgcctctgagatcgaagatctgaaactggagaattcgagccttcaggagaaggcagccaaagcaggcaagaatgctgaagatgttcaacaccagattcttgctactgaatcctctaaccaggaatatgtgagaatgctcctggatctgcagactaagtcagccctcaaggaaacagaaattaaagagataactgtttccttcctccagaaaatcaccgacctgcagaatcagcttaagcagcaagaagaggactttcgcaaacagcttgaagacgaggagggacgcaaggcggaaaaggagaacacaacagccgaattgacggaggagataaacaaatggcgtttgttgtacgaggagttgtacaataagacgaaaccattccagctgcagctggatgcgttcgaggtcgagaagcaggccctgttaaatgaacatggagcggctcaggaacagctgaacaagattagagattcatacgctaaactgctggggcatcagaatctcaagcagaagataaaacatgtcgtcaagttgaaggacgaaaactcgcagctgaaatccgaagtgagcaagctgaggtgtcagctggccaagaaaaaacagtctgaaaccaaattacaggaggagctaaacaaggtgctcggaattaagcacttcgaccctagtaaggcttttcaccatgaaagcaaagaaaacttcgcactgaaaacaccacttaaggaaggtaacaccaattgctatcgagcccccatggagtgccaggagtcatggaagtag

SEQ ID NO: 24477 - DNA, 2178 bp, Artificial Sequence
  Description of Artificial Sequence: Synthetic coding sequence
atgagcttccccaaggcccccctgaagcggttcaacgaccccagcggctgcgcaccatctccaggggcctatgacgtgaaaacactggaggtcctcaagggccctgtgtcgtttcaaaaatcccagagattcaaacagcagaaggaatccaagcagaaccttaacgtggataaagacacaaccttaccagcgagcgcccgtaaggtcaagagcagtgagagcaagaaggagagccaaaaaaacgataaggacttgaaaatcctggaaaaggaaatccgggtcctgctccaggagcgcggcgctcaagaccgaagaattcaggacctggagacggaactggaaaaaatggaggctcgcctgaatgccgccctgagggagaaaacttccctttccgccaacaacgccacactcgagaaacagctcatcgagctgaccaggacgaatgagctgctgaaaagtaaatttagcgagaacgggaaccagaagaatcttcgcatactctctctcgagcttatgaaactccgcaataaaagggaaacaaaaatgaggggcatgatggctaaacaggagggcatggagatgaagctgcaggtgacacagcgctccctcgaagagtcacagggtaagatcgcacagcttgaaggcaagttggtgtctattgagaaggagaagatcgacgaaaaatcggagactgaaaagttgctcgagtacattgaagagatatcttgcgcttctgaccaggtggaaaagtacaagcttgacatcgcgcaacttgaggagaatttgaaggagaagaatgacgaaatcctcagtttaaagcagtccctcgaagagaatatcgtaatcttgagcaagcaggtagaagacctgaatgtcaaatgccaacttctggagaaagagaaggaggaccatgtgaacaggaaccgcgaacacaacgaaaacctgaacgcggagatgcagaatctgaagcaaaagttcatcctggagcagcaggagagggaaaaactgcagcaaaaggaactacagatcgacagcctgctgcagcaggagaaggaactctcctcctccttgcatcagaagctgtgtagcttccaagaggagatggtgaaggagaagaacctttttgaggaggagctgaaacaaacgctggacgaactggataaactgcagcaaaaagaggagcaggccgagcgcctggttaagcaactggaggaggaggcaaaatcgcgggctgaggagctgaagctgctagaggaaaaactgaagggtaaagaggcagaattagaaaagagcagcgccgcccatacacaggctactcttctcctgcaagagaagtacgattccatggtacagtcactggaggatgtgacagcacagttcgagagctacaaagccttaaccgcatctgagatcgaagatctcaaactggagaattccagcttgcaggagaaagcagccaaagctggaaaaaatgcagaggacgtacagcaccaaattttagccacggaatcatctaaccaggaatatgtgagaatgctgctggacctgcagactaaatccgccttgaaagagactgagatcaaggaaatcacagtgagcttcctgcagaagatcaccgaccttcagaatcagctcaagcaacaggaagaagacttcaggaagcagctcgaggatgaggaaggacgcaaagcagagaaagagaacacaactgctgagctgaccgaagaaatcaataagtggcgattattatatgaggagctgtataacaagacaaaaccctttcagctccagctcgacgccttcgaggtggaaaagcaggccctgctgaatgagcacggcgccgcgcaggagcagcttaacaagatccgggattcatatgccaaactgctcggccatcagaacctcaaacagaagattaagcatgtggtcaaactgaaggatgagaattcacagctaaagagcgaggtgagcaaactgcggtgccagctggcaaagaagaaacaatctgagacaaagctacaggaggaattgaataaggttcttggcatcaagcacttcgatccgagcaaggcttttcaccacgagtctaaggaaaacttcgccctgaaaacgcccttgaaggaagggaatactaattgctatcgggctcctatggaatgtcaggaaagttggaagtag

SEQ ID NO: 24478 - DNA, 2106 bp, Artificial Sequence
  Description of Artificial Sequence: Synthetic coding sequence
atgagcttccccaaggcccccctgaagcggttcaacgaccccagcgggtgtgctcctagtcccggcgcctatgacgtgaaaacgttagaggttttaaagggacccgtatccttccagaagtcccagcgattcaagcagcaaaaagaatctaagcagaatctcaatgtggataaggataccaccctgcctgcaagcgcccgcaaggttaagagcagtgaatccaaaaaggaaagccagaaaaatgacaaggacctcaagatactcgaaaaggagatacgcgtgctgctccaggaacgtggagcacaggacaggaggatccaggatctggaaacagaactggagaaacagcttattgagctgactaggacgaatgaactgctgaagagcaaattttccgagaacgggaatcaaaagaatctgaggatcttaagcctggaactgatgaaactcagaaataaacgggaaactaagatgcgagggatgatggctaagcaggagggtatggagatgaaactccaggtgacccagcgatcgttggaagagagtcaaggcaagattgcacagctggaaggtaaactggtctctattgagaaagagaagatcgatgaaaaatctgagacagagaagctgttagagtatatcgaagaaatctcttgtgcctctgaccaagtggagaagtacaagttggacattgctcagctggaggagaatctcaaagaaaagaatgatgagatactgtccctgaagcagagtttagaggagaatatagtgatactgagcaaacaagttgaggatcttaatgtcaaatgccagctgcttgaaaaggaaaaggaggaccatgtgaatcgaaaccgggaacacaatgaaaacctcaacgccgagatgcaaaacttgaagcagaagtttatcctcgagcaacaggagcgagagaagctgcaacagaaagaactccagattgattcactgctgcagcaggagaaagagctcagctcctctctccaccagaagctgtgctcctttcaggaggagatggtgaaggagaagaatctcttcgaagaggagctgaagcagaccttggatgagctagacaagctccaacagaaagaggagcaggcagagcgcctcgtgaagcaactagaagaggaagccaaaagcagggctgaagagctgaagctacttgaggaaaagttgaaaggaaaagaggcagagctggagaagtcttccgccgcacatacgcaggccaccctgctccttcaggagaagtacgattctatggtccagtccctggaagatgttaccgcacaattcgaaagctacaaagccctgactgcttccgaaattgaagatctgaagctggagaactcttctttgcaggagaaagctgcaaaagctggcaaaaacgcagaagacgtgcagcaccagatccttgccacagagtcctccaatcaagagtatgtgaggatgctgttggacctccagactaaaagcgcactgaaagagacggaaatcaaggaaatcacagtgtcctttctgcagaaaataaccgacctccagaatcaattaaagcaacaggaggaagacttcagaaaacagttggaagatgaagaaggcaggaaggcggagaaggagaacacaactgcggaactaaccgaggaaataaataagtggcgcctcctctacgaagaactgtataataagaccaaaccttttcagcttcagctagacgcatttgaagtggagaaacaggctctgctcaacgaacacggtgccgcccaggagcagttaaataagattagggattcctatgcaaagctgcttggccatcagaacctcaagcagaaaatcaaacatgtggttaaactgaaagatgaaaacagccagctgaaaagcgaagttagcaagttaaggtgccagctggccaaaaaaaagcagtccgaaactaagctccaggaagaactgaataaagtccttgggatcaaacactttgacccatcaaaagcatttcatcacgagtcaaaggaaaatttcgcactgaaaaccccactaaaagaaggcaatactaattgttatagagctcctatggagtgtcaggaaagttggaaatag

SEQ ID NO: 24479 - DNA, 1917 bp, Artificial Sequence
  Description of Artificial Sequence: Synthetic coding sequence
atgaccctgctgatccgggtgctgctgcaggagcggggcgcccaggacagaaggattcaggacctggagactgagctggagaaaatggaagccagactcaacgccgccctcagggagaagacctctctgagcgctaataacgctacgctagagaagcaattgatcgagttgacccgtacgaacgagctcctgaaatccaagttcagtgaaaatggcaaccagaagaatcttcggatattgtcccttgagcttatgaagcttcggaataagcgggagaccaaaatgcgcggcatgatggccaagcaggaggggatggaaatgaaactacaggtgacccagcggtcactcgaagagtcacagggcaagattgctcagctcgaaggcaagctcgtatcgatcgaaaaggaaaaaatcgacgaaaagtcggaaacagaaaaactcctcgagtacatcgaggagattagttgtgcatccgaccaagtagaaaagtataagctcgatatcgcccagctggaggaaaatctgaaagaaaagaacgacgagattctctccctgaagcagagcttagaagagaatatcgtgatcctgagtaaacaagtcgaagacttgaacgtcaaatgccaactattggagaaggagaaagaggatcacgttaacagaaatcgagagcataacgagaacctgaatgccgaaatgcaaaatctcaaacagaagttcatcttggaacagcaggagagagagaagctccaacagaaggagcttcaaatcgacagtctactgcaacaggaaaaggagctgagttcgagccttcaccagaaactgtgctcctttcaagaggagatggttaaggaaaaaaacctctttgaggaagagttgaaacagactctcgacgagctagacaaactccagcagaaagaggaacaggcagagcgcctggtgaagcagctcgaagaggaggccaaaagcagagctgaggagcttaagctgcttgaagagaagttaaagggaaaagaggccgagcttgaaaaaagctccgccgcacatacgcaggccaccctgttactgcaggaaaaatacgactccatggttcaatcacttgaggatgtgaccgcccagtttgagtcttacaaagccctgaccgcaagcgaaatcgaagatctaaagcttgagaacagttcactgcaagagaaggctgccaaggcgggcaagaatgccgaagacgtgcagcaccaaatattggccacggagtcttctaaccaagaatacgtgaggatgttgctcgatttgcagaccaagtcagcattgaaggagactgagattaaggagattaccgtgtcgttcctgcagaaaattaccgacctgcagaatcagttgaagcagcaggaggaggacttcagaaagcagctcgaagatgaggaaggaagaaaagctgagaaagaaaacacaaccgcagagttgaccgaggagattaataagtggcggctgctgtatgaagagctatataacaagactaaacctttccagctgcagctggacgcctttgaggtcgagaagcaggctctcctcaatgaacacggcgcggctcaggagcagcttaacaaaatccgcgactcctacgccaagctgctggggcatcaaaacctcaagcagaagatcaagcacgtcgtcaagctcaaggatgaaaatagccagctgaagtccgaggtgagcaagctcagatgccagctcgctaaaaaaaagcaaagcgaaacaaaattgcaggaggagctaaacaaggtactcggcattaagcacttcgacccttctaaggcgttccaccacgagtctaaagagaactttgctctgaagactcccctgaaggaaggcaacacgaattgttaccgcgcgccaatggaatgccaggagtcttggaagtag

SEQ ID NO: 24480 - DNA, 996 bp, Artificial Sequence
  Description of Artificial Sequence: Synthetic coding sequence
atgagcttccccaaggcccccctgaagcggttcaacgaccccagcggatgtgcacctagtcctggagcctatgacgtgaaaacactcgaagtcctgaagggcccggtgagttttcagaagagtcagcggttcaagcaacagaaagaatctaagcagaacttaaacgtcgataaagacacaacactgccagcttcagccagaaaagtgaaatcatctgaatcaaagattagagtactgttacaggagaggggggcccaggatcggcgaatacaagatctggaaaccgagctagagaaaatggaagccaggctaaacgccgctctgcgagagaagacatcgctgtccgccaacaatgccacacttgagaaacaactgattgagctcacccggacaaacgagctgttgaagagcaagttctcagaaaacgggaaccagaaaaacctccggatcctcagtctagaactcatgaagctccgcaataaaagggaaacaaagatgagggggatgatggccaagcaggaaggtatggaaatgaaacttcaggttacacagcggtccctagaagagtctcagggcaaaatcgctcagctcgaaggcaagctggtgtccattgagaaggagaagattgacgagaagtcagagaccgagaagctgctggagtacattgaggagatctcgtgcgcaagtgaccaggttgaaaagtataagctcgacatagcacagctggaagagaacctgaaggagaaaaatgatgagatcctgagcctgaagcagagcttggaggaaaacattgtgattctgtcaaagcaggttgaggatctcaacgttaaatgtcagttattggaaaaggaaaaggaagatcatgttaaccgtaatagagaacataatgagaatttaaatgcagagatgcagaacttgaaacagaaatttatcctcgaacagcaggagagagaaaaactgcagcagaaaaaaaagcaaatgaggagaaaaaagtag

SEQ ID NO: 24481 - DNA, 537 bp, Artificial Sequence
  Description of Artificial Sequence: Synthetic coding sequence
atgcacgtgaacggcaaggtggccctggtgaccggcgccgcccagggaataggcagagcctttgctgaagccttgctgctgaagggagcaaaggttgcgctagtggactggaatctggaggctggagtgcaatgcaaagccgctttggacgaacagtttgaacctcagaagaccctcttcattcaatgcgacgtggctgatcaacaacagctgcgggacacctttaggaaggtcgttgaccactttggacgactggacattctggtcaacaacgcaggggtcaacaacgagaaaaattgggagaaaacccttcagataaatctcgtgtccgttatctccggcacgtacctaggtctagactatatgtccaagcaaaatggcggagaaggcggcatcatcataaatatgtcctctttggcaggcctgatgcccgtggcacaacagcctgtttactgtgcttctaaacacggcatcgtgggtttcacgcgtagcgctgctccgacaattgattgccaatggattgataacacgcactag

SEQ ID NO: 24482 - DNA, 801 bp, Artificial Sequence
  Description of Artificial Sequence: Synthetic coding sequence
atgcacgtgaacggcaaggtggccctggtgaccggcgccgcccagggaattggtcgggcgtttgcagaggcactgttgctgaaaggtgccaaggtggctcttgtggactggaacctggaggccggcgttcagtgcaaggcagccctagatgagcagtttgaaccccagaagacattatttattcagtgcgacgtcgccgaccagcagcagctgcgggatactttccgcaaggtggtagaccactttggcagactggacattttagtcaataacgccggagtaaataacgaaaagaactgggaaaagaccctccagataaacctcgtaagcgttatttccggcacatacttgggcctcgattatatgagtaagcagaacggcggtgaggggggcatcatcataaatatgtcatctttagctggacttatgcctgtggcacagcagccagtgtactgcgcctctaagcacggcatcgtaggtttcaccaggagcgctgcactggctgcaaatctgatgaacagcggggttcgcctgaatgctatctgtcctggctttgtaaatacagctattttagagagtatagagaaggaagagaatatgggccaatacatcgaatataaagatcatatcaaagacatgataaaatactacgggatcctggatccacccctgatcgcgaacggcctaatcactctcatcgaagatgacgctctgaacggggccattatgaagataactacctcaaaagggattcactttcaggactatgatactacaccttttcaggctaaaacccaatag

SEQ ID NO: 24483 - DNA, 438 bp, Artificial Sequence
  Description of Artificial Sequence: Synthetic coding sequence
atgagcaagcagaacggcggcgagggcggcatcatcatcaacatgtcaagcctcgcggggcttatgcctgtggctcaacaacccgtctattgcgcgtccaagcatggaatcgtcggattcacccgatctgcagcgctcgccgccaacctcatgaactctggcgtgaggttgaacgccatctgcccgggatttgtaaacaccgcgatcctggaatcgattgagaaagaagaaaacatgggccagtacatcgaatacaaggatcatattaaggacatgatcaagtattacggaatactagatccacctttaatagcgaatggcctgattaccctgattgaagatgatgccctcaatggggccatcatgaaaatcactacttctaagggcattcactttcaagattacgataccacaccgtttcaggctaagacgcagtag

SEQ ID NO: 24484 - DNA, 438 bp, Artificial Sequence
  Description of Artificial Sequence: Synthetic coding sequence
atgagcaagcagaacggcggcgagggcggcatcatcatcaacatgtcttctttggcaggtttaatgccggtggctcagcagccagtctattgtgccagcaagcatggcattgtgggctttacacggagtgcagcactcgctgccaacctcatgaattccggagttcggctgaatgccatatgtccaggattcgtgaacaccgctatcctggaatccattgagaaggaggagaatatgggacagtacatcgagtacaaggatcacatcaaggacatgattaagtattatgggatcctggatccaccgttgatcgcgaacggcctgattacacttatcgaggacgatgctcttaatggagctatcatgaagattacaacaagcaaggggattcacttccaagactatgacacgacaccgtttcaggccaagacccagtag

SEQ ID NO: 24485 - DNA, 432 bp, Artificial Sequence
  Description of Artificial Sequence: Synthetic coding sequence
atgcacgtgaacggcaaggtggccctggtgaccggcgccgcccaggggatcggaagggcttttgcagaggctctgctgcttaaaggcgccaaggtcgctctggtggattggaacctggaggccggcgtgcaatgcaaagctgccctcgatgaacagtttgaaccccagaagacattgttcattcagtgtgatgtggccgaccaacagcagctccgagacacctttcgcaaggtggtggaccacttcgggcgtcttgacattctcgtgaataacgccggggttaataatgagaagaactgggagaaaacactccagatcaatctggtgagcgtcatctccggaacctacctgggcctggactatatgtccaaacagaacggtggggaaggaggcataatcatcaacatgagctcacttgcggcgcatcactag

SEQ ID NO: 24486 - DNA, 2202 bp, Artificial Sequence
  Description of Artificial Sequence: Synthetic coding sequence
atgaccttccccgaggccgacatcctgctgaagagcggcgagtgcgccggccaaacaatgctggacactatggaggcgcctggtcattctcgccagctacttctgcagttgaataatcagcggactaagggatttttatgcgatgtcatcatcgtcgtccaaaacgccctgtttagagctcacaagaatgtgctggcggccagctcagcatacttaaagagcctagtcgtgcacgacaatctgcttaatttggatcatgacatggtgtctcccgcagtattcaggttagtactggactttatctacacaggtcgcctcgctgacggggcagaagcagcggccgctgcagcagtggcaccaggtgccgagccaagtttaggggcggtattggcagcggcatcgtacctgcagatccctgacctggtcgctttatgcaagaagagattaaaaagacacggcaaatattgccacctgaggggtgggggcggtggtgggggcgggtacgctccatacgggaggccaggacgcggactccgtgccgccacccctgtcattcaggcctgctacccctctcccgtgggcccaccgcccccacccgctgccgaaccaccctccggcccagaggccgctgtcaatacgcattgtgcagaactgtacgcctccggcccaggccccgccgcggctctctgtgcatcagagagacggtgcagcccattatgcggactggatctgagcaaaaagtcacctcctggcagcgcagccccagagcggccactcgcagaacgcgagttgccccccaggcctgactccccaccatctgcgggccctgcggcttacaaagagccgcccctcgctctcccaagcctaccaccgctgcccttccagaaattagaagaagcggctcctccctctgacccctttcgcggaggatctgggtcccctggacctgagcccccgggcaggccagatggaccatcacttctatacaggtggatgaaacacgagcccgggttggggagttacggcgacgagctgggacgagagaggggttctccatcggaacgatgtgaagaacgcggaggcgatgccgctgtcagcccaggcggacccccactgggtctggcccccccacctcggtacccgggtagcctcgacgggcctggcgctggcggcgacggggacgactacaaatcgtcctctgaagaaaccggctccagcgaggatccctccccacctggcggtcatctggagggctatccttgtccacacctcgcgtatggcgaacccgagagcttcggagacaatctctacgtgtgcataccgtgcggcaaaggattcccctcaagcgagcagttgaatgctcacgtggaagctcacgtagaggaagaggaggcgctgtacggacgcgcggaagctgcagaggtggccgctggagccgccggcttaggaccacccttcgggggtggcggcgataaggtggccggggccccgggtgggctcggcgaacttctgcgcccatacagatgtgcctcctgtgataagtcatacaaagatccagcaacactcaggcagcacgagaagacgcactggctgacccggccatatccatgcactatctgtggcaaaaagtttactcagcgcggtaccatgacccgacatatgcggagccacctgggactcaaaccttttgcgtgcgacgcctgtgggatgcgttttactagacagtatcgactcaccgaacacatgcggatccatagcggcgagaaaccttacgaatgtcaggtgtgtggtggcaaatttgcacagcaaaggaatctgatatcacatatgaagatgcacgcggttggaggcgccgctggggccgcaggagccctcgcaggactggggggcctgcccggcgtccccggacctgatggaaaaggtaaactggatttcccggaaggcgtttttgcagtggcccggctgaccgccgagcagcttagcctgaaacagcaagataaggctgccgcggctgagctgcttgcccagaccacacatttcctccacgaccccaaggtcgccctggagagtctgtaccctctggcaaaatttactgccgaattaggcctgtcaccggataaggccgccgaggttctaagccaaggagcccacctcgcggccggccccgacggaagaactatagatcgctttagtccgacatag

SEQ ID NO: 24487 - DNA, 2145 bp, Artificial Sequence
  Description of Artificial Sequence: Synthetic coding sequence
atgctggacaccatggaggcccccggccacagccggcagctgctgctccagctgaataaccagcggactaaagggtttctctgtgatgttatcatcgtggtgcagaatgccctgttccgagcccataagaacgtgctggctgcgagctccgcgtacctaaagagcctggttgtgcacgataaccttctcaacttagaccacgacatggtgtctcctgctgtgttcaggctggtccttgattttatatatacagggaggctagccgacggcgcggaagcagccgctgcagcggccgtggcccctggtgccgagccatctctcggcgccgttttagccgcagccagctacttacagattcctgacctagtcgctctctgtaaaaaaagattaaaacgacacggcaagtattgccatttgcgaggtgggggcggcggcggggggggctacgctccttatggaagacctgggagggggctgagggctgcgacccccgtgatccaagcttgctacccatctcctgtgggtccaccccccccaccagctgccgaacctcctagcggtcccgaagctgccgtaaacacccactgtgcagaattgtacgctagcggacccggcccagcggccgccctgtgcgcatcagaacggaggtgctcacccctgtgtggcctcgacctgagcaagaaaagccctcccggcagcgccgcaccagagcgccctctcgcagagagagaactgccgccccggcccgatagcccgcctagtgccgggccagccgcatataaggaaccacctctcgctctgccctccctgcctccgctgccgtttcagaaattggaagaagctgctcccccttcagacccttttagaggcgggtcaggctcccccggtccggagcctccaggccggccagacgggccctccttattgtaccgctggatgaagcatgagcctggcctggggtcgtacggcgacgagcttgggagggagcgaggtagcccttccgaacgctgcgaagagagaggcggcgatgccgcggtttctcccggcggcccacccctcgggctggccccccccccccgttaccctggtagtctggacggacccggcgcaggaggcgacggtgatgattacaagtccagcagcgaagaaactggcagttccgaggaccctagccctcctggtgggcatttagaaggatatccctgcccccatctggcctacggggaacccgagtccttcggcgacaatctttatgtttgtataccttgcggaaaaggcttcccctcaagtgaacaactcaacgctcatgtagaagcgcatgtggaagaggaagaagccctgtacggccgtgcagaagcagccgaggtggccgctggggccgcaggcctgggacctccattcgggggggggggcgataaggtcgccggcgccccaggaggattgggagagctattaaggccttacagatgcgcgagctgtgataaatcttacaaggaccctgccacgctgaggcagcacgagaaaactcactggctgacacgtccctacccctgtactatctgcggaaaaaaatttactcaacgcggcaccatgacccggcacatgcggtcccacctggggctcaagccttttgcttgtgacgcatgcggcatgcgattcacccgacagtacagactaaccgagcacatgcgaattcacagtggagagaagccttatgaatgccaggtctgtggcggcaagtttgcacaacagcgcaatctgatatctcatatgaaaatgcacgccgtgggaggcgcagctggagccgcgggggccttagccggcctgggaggcctgcccggtgttcccggtcccgacggaaagggaaagctcgacttccccgagggcgtgttcgctgtcgctagactgaccgctgaacagttgtctctcaagcaacaggataaagctgcggccgctgaattgttggcccagaccacacactttctgcacgaccccaaagtggcccttgagagtctttatcctctcgcgaagtttacggcagaactcgggttaagcccagataaggccgcagaggtcttatcgcagggcgcgcacctcgcagccggtcctgatgggagaaccattgacaggtttagcccaacttag

SEQ ID NO: 24488 - DNA, 2208 bp, Artificial Sequence
  Description of Artificial Sequence: Synthetic coding sequence
atggagggcgccggcggcgccaacgacaagaagaagatcagcagcgagaggcggaaagagaaatctagagatgccgctaggagccgtaggtctaaagagtccgaggtgttttacgaactggcccaccagctcccccttccacataacgtgtcctcccatcttgacaaggcttctgtcatgagactgaccataagctatctccgtgtccgcaagctgctggatgcaggtgatttagacattgaagatgatatgaaagcccagatgaactgcttttacttaaaagccctcgatggtttcgtgatggtgctgactgatgacggcgacatgatttacatcagcgacaacgtgaacaagtacatgggcctgacccagttcgagttgaccggtcattccgtttttgatttcacacacccctgcgatcacgaggagatgcgcgagatgcttacccatcgaaatggactggtgaagaagggtaaggagcagaacacacagcgcagcttcttcctgcgcatgaagtgcacattgacctccagggggagaaccatgaatattaagtctgccacttggaaggtcctccactgcacaggacatattcacgtctacgacactaactctaaccagccacagtgcggctataagaagccaccgatgacctgcctggtcttaatctgcgagccaataccccatccaagcaatatagaaatccccctagacagcaagactttcctatcccgtcactccctagatatgaagttctcgtactgtgatgagagaatcaccgagctgatgggctatgaacctgaggagctactaggtagatccatttacgagtattaccatgcccttgactctgatcaccttaccaagactcatcatgacatgtttaccaaggggcaggtgaccacaggccagtacagaatgctggccaagaggggaggttacgtgtgggttgagacacaggcaactgtcatttacaacaccaaaaactctcagccccagtgcattgtgtgtgttaattatgtagtcagcgggataatacagcatgatctcatctttagcctgcaacagacggagtgtgtgttgaaacctgtagaatccagcgatatgaaaatgacacagttattcaccaaggtggaaagcgaagatacctccagcctgttcgacaaactcaaaaaggagcctgatgccctgactcttttggcacccgcagctggcgataccattatctccctcgattttggctccaatgacacagagactgatgaccagcagctggaggaggttcctctgtataacgacgtcatgctgccatcacctaatgaaaaacttcagaatatcaacctcgccatgagtcctctgcctaccgcagaaacaccaaaacccctgcgcagttcagccgaccctgcactgaatcaggaggttgctctgaagctggagcctaatccggaatccctggagctgagcttcacgatgcctcaaatccaggatcagacccctagtcccagcgacgggagcaccaggcagagttcgccagaacccaattccccttccgaatactgcttctacgtggattctgacatggtgaacgaattcaaattagagctggttgagaagctgttcgccgaggatacggaggccaagaatccttttagcacccaggataccgatctcgacctggagatgctggcaccctacatacctatggacgatgacttccaactccgctccttcgaccaactctctccgctggaatcgtcctctgccagtcctgagagtgctagcccgcaatccacagtcaccgtgtttcagcagacccagatacaggaacctactgccaacgcgacaaccaccaccgctaccaccgacgagttaaagacggtcaccaaagatcgcatggaagacattaagattctgatcgcaagtccctcccccacacacattcacaaggagacaacttctgcgacgtccagtccttatcgcgatactcagtctaggacagcttcacccaacagggccggtaaaggggtaatagagcagactgaaaaatcacatcctagaagcccgaatgtgctgtccgttgccctgagtcagagaacaacggtgcccgaggaagaactgaatcctaaaatcctagcactccagaacgcacagcgcaagcgcaagatggaacacgatggctctctcttccaggctgtcggcatcatttag

SEQ ID NO: 24489 - DNA, 2481 bp, Artificial Sequence
  Description of Artificial Sequence: Synthetic coding sequence
atggagggcgccggcggcgccaacgacaagaagaagatcagcagcgagaggaggaaagaaaagtcaagagatgcagccaggtccagacgtagcaaggagtcggaggtgttctatgaattggctcaccagttacccttaccacataacgtgagttcccatctagataaagctagcgtgatgcggctgacaatctcctatctgagggtgaggaaactccttgacgcgggggaccttgacatcgaggacgacatgaaagctcagatgaactgcttctacctcaaagctctggacggttttgttatggtcctgaccgacgatggtgacatgatctacattagcgataacgtgaacaagtacatgggcctgactcagttcgaactgacgggccacagcgtgtttgatttcacgcacccttgtgatcacgaggagatgcgggagatgctcacccatagaaatggactcgtcaaaaagggaaaggagcagaatactcagaggagcttctttttacggatgaaatgcaccctgaccagccgcgggaggactatgaatataaagagcgccacatggaaggttctgcactgcactggtcacattcatgtgtatgacactaattctaaccagccccagtgcggttataagaagccccccatgacatgtctggtgctgatttgtgaacctattccccatccatctaatatcgaaattcccttggactccaaaacctttctcagtcgtcacagcctcgatatgaaattcagttattgcgatgaaaggatcactgagcttatgggatatgagccagaggagctgctcggtcgcagtatctacgaatactatcacgccttagactccgatcatctcactaagacccaccatgatatgtttaccaaaggccaagtcactacaggacagtatcgcatgcttgctaaaagaggcggctacgtctgggtggaaacacaggctacggtgatctacaatacaaagaactcccagccccagtgcatcgtgtgtgtgaactatgtggttagtggcattatacagcacgacctgatcttttccttgcagcagaccgaatgcgtgttaaagcctgtcgagtcatctgacatgaaaatgactcagttgtttacaaaggtggaatccgaggacacaagcagcctgttcgacaaactgaagaaagagccagatgcattgaccctcctggccccagcggctggagacacgattatttccttggacttcggcagtaacgatactgaaacagacgatcagcaactagaggaagtgccattatacaacgatgtcatgctgccttcaccaaacgaaaagctacaaaatatcaacctggccatgtctccactccctaccgccgagaccccgaagccgctgcgttccagtgccgaccctgcacttaaccaagaggttgcactcaagctagagcccaatccagagagccttgaactaagcttcactatgccacagattcaggaccagaccccatctcccagcgatggtagcaccagacagagttctcccgagcctaactctccttccgagtactgcttttatgtggactccgacatggttaacgaatttaagctggaactggtggaaaaactttttgccgaggacactgaagcgaagaacccattttcaactcaggataccgatctggacttggagatgctggccccttacatccccatggacgatgatttccagctgagatcctttgaccagctttctcccctggaatccagtagcgcttcccccgaatctgcttccccccagtcgacggtgactgtgtttcagcagactcagatccaggaaccaactgccaatgctactactaccactgccacaacagacgaattgaagaccgtcaccaaagatagaatggaggacatcaagatcttgatcgcgagtccaagtcctacccacatccacaaggaaactacctctgctacgtcatccccctaccgagatacccagagcaggaccgcttcccctaacagagctggcaaaggagtaattgaacagacagaaaagtctcaccccagatctcccaatgtactgagcgtggctctcagccagcgcacaacagtgccagaagaagagctgaatcctaagattcttgccctccagaatgcccagagaaagcgtaagatggaacatgacggctcactctttcaggctgtcggcattggcacactgctccagcaaccggatgatcatgcagctacaaccagtctgtcctggaagagggtgaagggatgtaaatcctctgagcaaaatggaatggagcagaagaccattatcctaattccctccgacttggcatgtcggctcctcggtcagtctatggatgaaagcggactgccccaattgacatcttacgattgtgaagttaatgcaccaattcaggggtcacgcaacctcctgcagggggaggagctcctgagagcactcgaccaggtgaattag

SEQ ID NO: 24490 - DNA, 2304 bp, Artificial Sequence
  Description of Artificial Sequence: Synthetic coding sequence
atgcggctgaccatcagctacctgcgggtgcggaagctgctggacgcaggtgacctggatatcgaggatgacatgaaggctcagatgaactgcttctatctcaaggccctggacgggtttgtaatggtgctgacagacgatggtgacatgatctacattagcgataatgtcaacaagtatatgggtcttacacaattcgagttaactggtcattccgtgtttgatttcacccacccttgcgatcatgaggagatgcgcgaaatgcttacccatagaaatggactggttaaaaaagggaaggagcagaatacccaaaggagcttctttttaaggatgaagtgtactttgacctcccgggggcggaccatgaacattaagtctgcgacctggaaagtgttgcattgcacggggcacattcacgtgtacgacacaaattcaaaccagccccaatgcggatacaaaaaacctccaatgacatgcctggttctaatatgcgagcccattcctcatccgagcaatatcgagataccactcgactcaaaaaccttcctgtctaggcactccctagacatgaagttctcctactgcgacgagagaataactgaacttatgggctacgagcctgaggagcttctgggcagatcgatttacgaatactaccatgcactggacagtgaccacctcacaaaaacacaccatgatatgttcacaaagggtcaggtgacgaccggtcaatacagaatgttggcaaaacggggcggctacgtttgggtggagactcaggcgacagtgatctataatactaagaattctcagcctcagtgtatcgtctgcgtgaactacgtggttagcggaattatccagcacgatctgatcttcagcctgcagcaaactgagtgcgtgctgaagcccgtggaaagcagcgacatgaagatgacccaactgtttaccaaagtggagtcagaggacaccagcagcctgttcgataaactgaagaaagagccagacgccctcactctgcttgcaccagctgccggcgacacaattatttctttggattttggttctaatgatacggagacggatgaccagcagctcgaagaagttcccctgtacaatgacgttatgttgccaagccccaacgagaagctgcagaatatcaatcttgctatgagccctctaccaacagcggagacccctaaacccctgcgttcgtccgccgaccccgccttaaatcaggaggtggcattgaagctggagcccaacccagagtcactcgaactgtccttcaccatgccacagatacaagaccagacgccgtcgccaagtgacgggtccactcgacagtctagccctgaacccaactccccatccgagtactgtttttacgttgattccgacatggtcaacgaatttaagttggagctcgtggaaaaactgttcgcagaagacaccgaagctaaaaacccctttagcacacaggacacagacctggatctggaaatgcttgcgccctacatccccatggacgatgacttccagctgcgatcatttgaccagttgtccccgttggaatcctcctcagcgtccccagaaagtgccagccctcagtctaccgtaacagtcttccagcagacgcagattcaagaaccgacagctaacgctacaaccacaactgccacaaccgatgagcttaaaactgtcacaaaggatcggatggaagatatcaagatcctaatcgcgagcccctctccaacacatattcataaggagacgacctctgcgacatctagtccctaccgggatactcaatcccggacagcgtcccctaacagagcagggaagggcgtgatcgagcagacagaaaaatctcacccccgatctcccaacgtgctgtctgtggccctatcccagcggacaactgtccccgaagaagagttgaatcccaagatactcgccttacaaaacgcacagagaaaacgcaagatggagcatgacggctccctgtttcaagctgttgggatcggcacactgctgcagcaaccagatgaccatgcagctactacttctctgtcctggaaaagagtgaaggggtgtaagagcagtgaacagaacggcatggagcagaagactatcatcttaatccccagtgatttagcatgcaggttgcttgggcagtcaatggatgagtccggtctgccccagctcaccagttacgattgtgaggtgaacgcacctatccagggcagccggaatctcctacagggtgaagagctgctccgagccctcgatcaggtcaactag

SEQ ID NO: 24491 - DNA, 2484 bp, Artificial Sequence
  Description of Artificial Sequence: Synthetic coding sequence
atggagggcgccggcggcgccaacgacaagaagaaccggatcagcagtgaacggagaaaagaaaagtctagggacgctgcgagaagtcgtcgctccaaggaatccgaggtgttttatgaattagcccaccaactgccattacctcataatgttagctctcacctcgataaagctagtgtgatgcggctgaccatcagctaccttcgggtgcgaaagctactcgacgcaggagacttggatattgaggatgatatgaaggctcagatgaactgcttctacctgaaagcactggatgggttcgtgatggtgcttaccgatgatggagatatgatctatatctctgacaacgtaaacaaatacatgggactgactcagtttgaactcaccgggcattccgtcttcgatttcacgcacccctgcgaccacgaagaaatgcgcgagatgctcactcaccgcaatgggctggtaaagaagggaaaggaacagaatacgcagcgatcgttcttcttacggatgaaatgcactctgacatccaggggccgtactatgaatatcaaaagcgcaacctggaaggtcctacattgcaccgggcatatccatgtgtacgatacgaacagtaatcagcctcagtgcggctacaagaaaccacccatgacctgcctggtcctgatctgtgagccaatccctcatccctcgaacattgaaattccactggattcaaagacctttctgtcaaggcacagtctggacatgaagttctcctattgtgacgaacggattacagagcttatgggctacgaaccagaggagctgctcggacggtctatctacgaatattatcatgcactggacagtgatcacctcaccaagacacaccacgacatgtttacaaaaggccaggtgacaaccggacagtaccggatgctagctaaacgcgggggctatgtctgggtggaaactcaagcgaccgtgatctacaacacaaagaatagtcagcctcagtgcatcgtatgcgtgaactacgttgtgagcggtattattcagcacgatctcatattctccctgcagcaaaccgagtgcgtcctcaaacccgttgaaagctccgatatgaaaatgacacagctcttcaccaaagttgagagcgaggacacatcgtcactgtttgacaagctgaaaaaagaaccagatgccctaacgcttctggcacccgccgcgggggacaccataatctccctggacttcggatctaatgacactgaaactgatgatcagcagctggaagaggtccccctgtacaacgacgttatgcttccctcaccaaatgagaagcttcaaaatatcaacctggccatgtcacctctgccaactgcagaaacacctaagcccctcagaagctcggcagaccccgccctcaaccaagaggtggccttgaaactagagccaaacccagaatcgctggaactctcttttactatgccacagatacaggaccagactccatcgccttccgacgggtccacacggcagagttcacccgagccaaacagcccctccgagtattgcttttatgtcgattccgacatggtcaatgaatttaaattggagttggtggaaaaattgttcgccgaggatacagaggccaagaaccctttttctacgcaggatacagaccttgacctggaaatgctggccccatacatccccatggacgacgattttcagctaaggtctttcgaccaattaagtcccctcgaatcctctagtgcaagcccggaatccgctagcccccagtccactgtcaccgtattccagcagactcagattcaggagcctaccgctaacgcaactacaaccacagcaacaactgacgagctaaagactgtcaccaaggaccgtatggaagatatcaagatactaattgctagtcccagccccactcatatccacaaggaaactaccagtgccactagctcaccttaccgggacacgcagagtagaaccgcgtctcccaatcgggccgggaagggtgtgatcgaacagacagagaaaagccatccacggtcacccaatgttctcagtgtcgccttatcccagaggactaccgtccccgaagaagagctgaaccccaagattctggcgctgcagaatgcccagcggaaacgtaagatggagcacgacggatcactgtttcaggctgtaggcatcggcaccctgcttcaacagcccgacgatcacgcggccacaaccagtctctcctggaagagagttaaggggtgcaaaagttccgagcagaatgggatggaacagaagactattattttgatccccagtgacctggcatgtcgacttcttgggcagagcatggatgagtcaggtctcccccagctcaccagctacgattgcgaggtcaacgcccctatccagggcagcagaaatctgctccaaggggaagagctcctcagggcactggatcaggttaattag

SEQ ID NO: 24492 - DNA, 2553 bp, Artificial Sequence
  Description of Artificial Sequence: Synthetic coding sequence
atgagcagccagtgccggagcctggagaacaagttcgtgttcctgaaggaagggctaggaaacagcaagcccgaggaactcgaggaaatcaggatcgagaacggacggatttcttccgagcgtagaaaagaaaaaagcagagacgcggccagatctaggcggtccaaggagtccgaggtgttttacgagttggcacaccagctgccactgcctcacaatgtatccagccacctggataaagcgagcgtgatgcgcctgacaatcagttatctgagggtacgcaaactgcttgacgccggcgacctcgatatagaagacgatatgaaggcacagatgaactgcttttacctcaaggcgctcgatgggtttgtgatggtcctgaccgatgatggggacatgatctatatctccgacaacgtcaataagtacatggggttgacccaatttgagctgaccggccactctgttttcgactttacacacccatgcgaccacgaagagatgagggaaatgctgacgcaccggaatgggctggtaaaaaagggtaaggagcagaacacgcagcgatctttctttttgcgtatgaagtgcacactcacctctcggggcagaaccatgaacatcaagtcggccacttggaaagtcctgcattgcacagggcatatacacgtgtacgacacaaatagcaaccagccccagtgtgggtacaagaaacctccaatgacctgtttggtgctgatatgcgagcccataccccatccttccaacattgagattcccctagactccaaaaccttcttaagccgacatagtctggacatgaagttctcttactgcgatgaacggattactgagttgatgggctacgagccagaggaacttttgggcagaagcatttacgaatactatcacgccctggattcagaccacttaacaaaaacgcaccacgacatgtttaccaaggggcaggtgaccacaggccagtatagaatgctggctaagagagggggctacgtgtgggtcgagacacaggccaccgttatctacaatacgaaaaatagccagcctcagtgtatagtttgcgttaactatgtagtttcagggatcattcagcacgacttgatcttttccctgcagcagaccgagtgtgtgttaaaacctgtagaatcgagcgacatgaagatgacacaattatttaccaaggtggaatcggaagatactagttcactttttgataaattgaaaaaagagccagacgcactcaccctgctggctcctgctgccggcgacaccataatctctttggacttcggtagcaacgacacagagacagatgatcagcagctcgaagaggttccactgtacaatgatgtgatgctgccatcaccgaacgagaaattacagaacattaaccttgccatgagcccgctgcccaccgcagaaacccctaaacctcttaggtctagtgccgatccggccctgaaccaggaagttgcgcttaagttggagcccaacccagagagtttagaactgagttttaccatgccgcagatacaagaccagacccccagcccatctgatggctcaacacggcagagctcacccgaacccaatagcccttctgagtactgcttctatgttgattcagatatggtcaatgagtttaaactcgagctagtcgagaagctcttcgctgaggatacagaagcaaagaatcccttctcaactcaagacactgacctggacctggagatgttggctccgtacatccccatggacgatgatttccagctgcgaagtttcgatcagctgtccccacttgagtccagcagtgcctctcctgagagcgctagcccacagagtaccgtcactgtgtttcagcagacacagattcaggaacctaccgccaatgctaccaccaccactgcaacaacagacgaactgaaaacagttactaaggataggatggaggatatcaaaatccttattgctagtccgtctcctacacatatccacaaggagaccactagtgcaactagcagtccttatagagatacacagagtaggactgcatccccaaatagagcagggaagggcgtgattgagcagacagagaaatcccaccctaggagtcccaacgttctatcagtggctctcagtcaacgtaccaccgtcccggaggaagagctcaacccaaagattctggctctacagaatgcacaaaggaagcgaaagatggaacatgatgggagcctgttccaggctgttggaatcggaactctgctccaacaaccagacgaccatgctgccactaccagtctctcctggaaaagggtcaagggatgcaagagctccgagcaaaacgggatggagcagaaaaccatcattctgattccgagtgatctggcatgcagacttctgggtcaaagcatggacgaaagcggtctaccacagctaaccagctacgattgcgaagtcaatgcccccatacaggggagtcgcaatctgctacagggtgaggagcttctgcgagcccttgatcaagtgaattag

SEQ ID NO: 24493 - DNA, 1734 bp, Artificial Sequence
  Description of Artificial Sequence: Synthetic coding sequence
atgaagttcagctactgcgacgagcggatcaccgagctgatgggctacgagccagaggaactcctcggaagatccatctacgagtactaccatgcattggattccgatcacctgacgaaaacccaccacgatatgttcaccaaggggcaggtcaccacagggcaatacagaatgctggccaagcggggcggttacgtttgggtggagacacaggccaccgtcatttacaacaccaaaaactcgcagcctcagtgtattgtttgtgtgaactatgtagtgtctgggatcattcagcacgacctgatcttctctctgcaacagacagagtgcgttctgaagccagtggagtccagtgacatgaagatgactcagctttttacaaaggtggagagtgaagataccagctccttgttcgacaagttgaaaaaagaaccagatgcccttacgctgctggcccccgccgctggagacacaatcatctcactcgactttggcagcaatgacaccgagacagacgatcagcagctggaggaagtgccactctacaacgatgtcatgctccccagtcccaacgagaagctccagaacatcaatctggccatgtcacccctccctacagcggagaccccgaaacccctgagatctagtgctgatccagccctgaatcaggaagtggccctgaagctcgaacccaatcccgagtcgcttgaactgtcctttacaatgccacaaattcaggaccaaactccaagcccaagcgatggctccacacgacagtcttcgcccgagccgaacagcccaagtgaatattgtttctacgtggattctgacatggtgaacgagttcaagctcgaactggtcgaaaaactttttgctgaagatacagaggctaaaaaccccttctctacacaagataccgatctcgacctcgaaatgctggccccttatatacccatggacgatgatttccagctgcgctcctttgatcagctgtcgcccctagaatcatccagcgcttctccagagtccgcttccccacagtctaccgtgaccgtgtttcagcaaacacaaattcaggaaccaacggccaacgctaccaccactaccgccacaaccgatgaactcaagacagtcaccaaggaccgaatggaggatatcaagattctgattgcgagcccatcccctactcatatccacaaagaaactaccagtgccacatcttccccataccgagacacccagagcaggactgcttctcccaaccgggcagggaagggggtgatcgaacagacagagaaatctcatcctcggtcacccaacgtgttaagcgtggcactgtcacagcgaactaccgttccggaagaagagctaaaccctaagatccttgcactacagaatgctcaaagaaaaaggaagatggagcatgacggtagcctattccaggccgtgggaatcggaactctgttacagcagccagatgatcacgccgctaccacctcgttgtcctggaagagggtgaaggggtgtaaaagttccgaacagaatggcatggaacaaaaaacgattattctgattccaagcgatctggcgtgtagactgttaggccagtccatggacgagtccggccttccgcagctgacatcatacgattgcgaggttaacgccccgatccagggatcccgtaacctgttgcagggtgaggaactgctgagggcactcgatcaggtcaactag

SEQ ID NO: 24494 - DNA, 2304 bp, Artificial Sequence
  Description of Artificial Sequence: Synthetic coding sequence
atgcggctgaccatcagctacctgcgggtgcggaagctgctggacgcaggagatctggatatagaagacgacatgaaggctcagatgaactgtttctacctaaaggcactggacgggttcgtgatggtgctaactgacgacggagacatgatatacatctcagacaacgtaaacaagtacatgggtctgacgcagttcgagctaaccggccatagcgtgttcgacttcactcacccctgcgaccacgaggagatgagggagatgctgactcacaggaacggccttgtgaaaaaaggcaaagaacagaacacccagcgctctttctttctgagaatgaagtgtaccctgacctcaaggggtcgaaccatgaatataaagagtgctacctggaaagttttgcattgcaccggacatatccatgtgtatgataccaacagtaaccaaccacaatgcgggtataaaaaaccccccatgacatgtctggtgctgatttgtgaacctataccccatccaagcaatattgaaattcccttggattctaaaacatttctctctaggcattcccttgatatgaagttctcctactgcgatgagcgaatcacggaactgatggggtacgaacctgaggaactgctgggaagatccatctatgagtactatcacgctcttgattccgatcacttaaccaagacccatcacgacatgttcaccaagggacaggtgaccaccggccaatacaggatgttggctaaaaggggaggatatgtctgggtcgagactcaagccaccgttatatataacacaaaaaacagccagccccagtgtattgtgtgcgtgaattatgtggtgagtggtattattcagcatgacctgatcttttccctgcaacagaccgaatgcgtactgaagccagtcgagtcttctgatatgaagatgacgcagctattcaccaaggtcgagagtgaagatacaagcagcctgttcgataagctgaaaaaagagcccgacgcgctgacactcctcgcacccgcggcgggggatacaatcatctcattggatttcgggtctaacgacaccgaaacagacgaccagcagctcgaagaggtacccctgtataatgacgtgatgctgccttccccaaatgaaaagctgcagaatatcaacttggccatgagccctttacccaccgcagagacacccaagccgctgcgctcctctgcagacccagccctgaaccaggaggttgccttgaagctcgagcctaaccctgagagtctcgagttatcgtttaccatgccacagattcaggaccagaccccatccccctcagatgggtccactcgccagtcctctcctgagccaaatagcccctccgagtattgcttctacgttgactctgacatggtaaacgagttcaaactggagcttgttgaaaaacttttcgcagaggataccgaggccaagaaccccttttctacacaggacacagacctggacttggagatgctagcaccttatatcccaatggacgatgattttcagttgagatcattcgatcagttatcccccttggaaagtagctcggcgtccccagagtctgcaagcccacaaagcaccgttactgtgtttcaacaaacgcagatccaagaaccgactgccaatgcaaccaccacaacggctaccactgacgaactgaaaaccgtaaccaaggatcgtatggaggatattaaaatcctgatagccagcccaagcccgacccacatccataaggagacgacatccgccacttctagtccatatagagatactcagtctagaacggccagtcccaaccgcgcaggcaaaggtgttattgagcagacagaaaagtcccacccccgcagcccgaacgtgttatccgtggccctgtcacagcgtaccactgtgccagaagaagagttgaaccctaagatcctggcactccagaacgcacaaaggaaacgcaaaatggaacatgatggatcattattccaggccgtggggatagggactttgttgcaacagccagatgatcacgccgcaacaacatctcttagttggaagagggtaaaagggtgcaagtcatccgagcaaaatgggatggagcagaagactatcattctgataccaagcgacctcgcatgcaggttgctgggacagtccatggatgaaagcggcttgccccagctaacgagctacgactgtgaggtgaacgcccccattcaggggtctaggaatcttttacagggagaagaactcctgagggctttggaccaggtgaactag

SEQ ID NO: 24495 - DNA, 1296 bp, Artificial Sequence
  Description of Artificial Sequence: Synthetic coding sequence
atggaggacatccagaccaacgccgagctgaagagcacccaggagcagtcggtcccagccgagagcgccgccgtgctcaatgattattctctcaccaaaagccacgagatggagaacgtcgattccggggaagggcctgcaaacgaggatgaggacataggcgatgattctatgaaggttaaggacgaatactccgagagggacgagaacgttctcaagagtgaacccatgggaaacgccgaggagcctgaaattccatactcttactcacgcgagtacaacgagtatgaaaacattaaattggagaggcacgtggtctccttcgacagttcacgccctacttccggaaagatgaactgtgacgtatgtggcctttcctgtattagcttcaacgttctgatggttcacaagcggagccatacaggcgagcgaccattccagtgcaatcagtgcggagccagcttcacacagaaaggcaacctactcaggcacatcaagctgcacactggcgagaagccgtttaaatgtcatctgtgtaactatgcctgtcaaaggcgagacgctttaacagggcatcttcgcacacacagcggtgaaaaacgacactgttttgatgtcaattacaactcttcttacatgtacgaaaaggaatccgagctcatccagactcggatgatggaccaggccataaacaatgcaattagctatcttggggctgaagctcttcggccgctggtacagactccccctgcccctacaagcgagatggtccctgtgatttcgtccatgtaccccatagcacttacccgggcagagatgagtaacggagcccctcaggaactagagaagaagtcaatacacctgcctgagaagtccgtgcccagcgaaagaggtctgtctcccaataactcagggcatgattctaccgacaccgattctaatcacgaggagcgtcagaatcacatttaccagcagaaccacatggtgctgtccagagcccgcaatgggatgcccctactcaaagaggtgccccggagttatgaactcctgaagcctcctcccatttgccccagggacagtgtcaaagtaattaataaggagggtgaggtcatggacgtgtaccgatgcgatcattgccgtgtgctcttcctggattacgtgatgttcacgatacacatgggctgccacgggtttcgagatcccttcgaatgtaacatgtgcggctatcgctcccatgataggtacgaattctcctctcatatcgcaaggggagagcatagggcactgttgaagtag

SEQ ID NO: 24496 - DNA, 1245 bp, Artificial Sequence
  Description of Artificial Sequence: Synthetic coding sequence
atggaggacatccagaccaacgccgagctgaagagcacccaggagcagtcagtgcctgcggaatctgctgccgtgctgaatgactattcactgactaagtcacatgaaatggagaatgtggacagtggggaagggcccgctaatgaagatgaggacatcggcgatgattcaatgaaggtcaaagatgagtacagtgagcgggacgagaacgtcctcaagtcggagccgatgggaaatgcggaggagcccgaaatcccctattcctacagcagggaatacaatgaatatgagaacataaaacttgagaggcacgttgtctctttcgattcatcacgccccaccagcgggaagatgaattgcgatgtatgtggcctgagctgcatcagctttaatgtgctgatggtgcataaacgctcacatacggccagtgccgaggcacgccacattaaggcggagatgggctctgagcgagccttggtgcttgacagacttgcctctaatgtcgccaaaagaaagagttcaatgcctcaaaagttcattggtgagaagcgtcattgtttcgacgttaactacaatagctcgtacatgtatgagaaagaatcagaactaattcagactcgaatgatggatcaagctattaacaacgcgatctcgtatctgggggccgaggcacttaggccgctggtgcaaaccccccccgcccctacctcagagatggtgcctgtgatcagcagtatgtatccaatcgcattgaccagggccgaaatgtcaaatggggccccccaagaactggaaaagaagtcaattcatctcccggagaaaagcgtgccgagtgaacgcggattatctccaaacaactccggccacgattccacagacacagactctaaccacgaagaacggcaaaatcacatttaccagcaaaaccatatggtgctctcaagagccaggaatggcatgcccctgttgaaagaggtccctcggagttatgagttgctcaagcctcctccgatttgcccaagagattccgtaaaagttatcaacaaggagggggaggtcatggacgtctaccggtgtgatcactgccgtgttcttttcctggattatgttatgtttacgattcacatgggatgccatggttttagggaccccttcgaatgcaatatgtgcgggtacaggagccatgacagatacgagttcagttctcacattgctaggggtgagcatcgggccttgctcaaatag

SEQ ID NO: 24497 - DNA, 1413 bp, Artificial Sequence
  Description of Artificial Sequence: Synthetic coding sequence
atggaggacatccagaccaacgccgagctgaagagcacccaggagcagtctgtcccagcggagtcagcggccgtgctcaatgactacagtttgaccaaatcacatgaaatggaaaatgtggattccggagagggacccgcaaacgaagacgaggatatcggcgatgattctatgaaggttaaggacgagtatagcgagagagacgaaaacgtgctgaaatcagagcccatgggaaacgctgaagagcccgagataccatattcatacagtagagagtataacgagtatgagaacattaagctggagaggcatgtggtttctttcgattcttcccggcctacttctggtaaaatgaattgcgatgtctgtggcctgtcttgcatatcatttaacgttctgatggtgcataaacgctcacataccggtgagaggcctttccagtgcaaccagtgcggggcatctttcactcagaagggtaatctcctgcgccacatcaagttacacactggcgagaagccgttcaaatgtcacctatgcaattacgcctgccagcgccgagacgctcttaccgggcaccttcgtacacactcagtagaaaagccctacaagtgtgaattttgtgggaggagttataaacaaagatcaagcctggaggaacataaagagaggtgcagaactttcctccagtcaaccgatccgggggatacgggagagaagcgtcattgctttgacgttaactacaactcgagctatatgtacgaaaaagaaagcgagctgatccagacaagaatgatggatcaggccattaataacgccatctcttatttgggcgcggaagcactccgcccacttgtgcagaccccgcctgccccaacctctgagatggtgcccgttataagtagtatgtatcccattgcactgacgcgagctgagatgtcaaacggcgccccacaggaactggaaaagaaatcaatccatctcccagagaaaagcgtaccatccgagagaggcctctccccaaataactccgggcatgattcaacagacacagatagcaaccatgaagaacggcaaaaccacatataccagcagaatcacatggtgctgtcacgggctcgtaatggaatgccactactcaaagaggtgcccaggtcttacgagttgctcaagcccccaccaatatgccctcgcgatagcgtgaaggtgatcaataaggaaggagaggtgatggacgtctataggtgtgatcattgcagagtcctcttcctcgactatgtgatgtttactatacacatgggatgccacggctttagagacccatttgaatgcaatatgtgtggctacaggtcgcacgaccgatacgagttcagctcgcacatcgcacgcggagagcaccgtgctctgctgaagtag

SEQ ID NO: 24498 - DNA, 1413 bp, Artificial Sequence
  Description of Artificial Sequence: Synthetic coding sequence
atggaggacatccagaccaacgccgagctgaagagcacccaggagcagagcgtgccagcagagtctgcagctgtcctcaacgactactcattgaccaaatcacacgaaatggaaaatgttgacagcggcgaggggccagcaaatgaggacgaggatatcggagacgattcaatgaaagtcaaggatgagtatagtgagagagacgaaaacgttttaaagtctgaacccatgggaaatgccgaggagccagaaattccatacagttatagtcgagagtataacgagtacgaaaacataaagttggaacgtcacgtggtttcatttgacagcagccggccaacctccggaaaaatgaattgcgacgtctgtggtctatcatgtattagctttaatgtgttgatggtccacaagagatcccatacaggggaacggccatttcagtgtaaccaatgcggcgcttcttttacacaaaaaggcaacttgctgaggcatatcaaacttcacacaggtgaaaaaccattcaaatgtcatttgtgtaattacgcttgccagcgccgcgatgccctgacagggcatctgcggactcattccgcctcagccgaagcgcgccatataaaggccgagatggggagcgagcgcgcactggtccttgacaggctcgccagcaatgtggcgaaacgaaaatcttctatgccccagaaattcattggagaaaagcgccattgttttgatgtgaattacaactcttcatacatgtatgagaaagagtcggaactgatccagacaagaatgatggatcaggcgatcaataatgccatttcctatctaggggcagaggcccttaggccgttggtgcaaacaccccccgcgccaacgtcagagatggttcccgtgatttcttctatgtatccaatagccttgaccagagctgagatgtccaacggtgccccgcaggagttagagaaaaagtctatacatcttcccgaaaaaagtgttccgtcagagcgcggactatcccccaacaatagtgggcatgacagcactgacacagattccaatcacgaggaaagacagaaccacatttatcagcaaaaccacatggttttgtcacgcgccaggaacggtatgcccctgctgaaggaagtgcccagaagttatgaacttcttaaaccgcctcctatatgtcccagagactcggttaaagtgattaacaaggaaggtgaggttatggatgtctaccgttgcgaccactgtcgcgtgttgtttctagattacgttatgttcacgatccacatgggatgccatgggtttcgagaccctttcgagtgtaacatgtgcggctatagatcccacgatcgttacgagtttagctctcatatcgctcgcggagagcaccgcgctctgctgaagtag

SEQ ID NO: 24499 - DNA, 1101 bp, Artificial Sequence
  Description of Artificial Sequence: Synthetic coding sequence
atggaggacatccagaccaacgccgagctgaagagcacccaggagcagagcgtcccagcggaaagcgccgcagtccttaacgactattcgctcacaaagtctcacgaaatggagaatgtggacagtggagagggacccgctaatgaggacgaggacataggggttgagaagccctacaagtgcgaattttgtggccgctcgtacaaacaaaggtccagtttggaggagcacaaggagcgatgccgtaccttcctccaaagcacagaccccggggacacagctagtgccgaggccagacatataaaggccgagatggggtcagagcgcgcactagttctggaccgcttggcctcaaacgttgccaagcggaagagttcaatgccgcagaaatttattggagagaagaggcattgttttgacgtaaattacaactcttcctacatgtacgaaaaagaatccgaactgatccagaccagaatgatggaccaggccataaacaatgctatcagctaccttggtgctgaagcgttaaggcctcttgtacaaactccgccagcaccaacatctgaaatggtccctgttatcagctccatgtaccctattgctctcacaagggccgaaatgtcaaatggcgcccctcaagagctggaaaaaaagagcattcacctacccgagaaatcagtacccagcgagaggggcctctctcccaacaactcaggacacgatagtaccgacactgattcgaatcacgaggagcgccagaaccatatttatcagcagaaccatatggtcctttctcgcgcccggaatggaatgccactactcaaggaggtgccacggtcttacgaattactgaaacctcctcccatttgccctcgagactcggtaaaagttataaataaggaaggagaggtgatggatgtgtaccgatgtgaccactgccgagtgttgtttctggattatgtaatgttcacaatccacatgggctgccatgggttccgtgatccattcgagtgcaatatgtgcggttatcggtcccacgaccgttatgaattttctagccatattgccaggggggaacatagggccctgttaaagtag

SEQ ID NO: 24500 - DNA, 1128 bp, Artificial Sequence
  Description of Artificial Sequence: Synthetic coding sequence
atggaggacatccagaccaacgccgagctgaagagcacccaggagcagtccgttcccgcagaatccgcggcagttctaaatgactactcactgactaagtctcatgaaatggagaatgtggactcaggggaggggccagctaatgaggatgaagatatcggagatgactccatgaaagtcaaggatgaatattctgagcgagacgaaaatgtgttgaaatcagagccaatgggtaatgccgaagaaccggagattccgtatagctattcgcgcgagtacaatgagtacgagaatattaagcttgagagacatgtcgtctctttcgattctagccgtccaactagtggcaaaatgaattgtgacgtgtgcgggcttagttgtatttcattcaatgtgctgatggtgcacaaaaggagccataccggtgagaagcgccattgcttcgatgtgaactacaacagctcttacatgtacgaaaaagagagcgagttaatccaaacacgaatgatggaccaagccattaacaacgctatcagctacctgggcgcggaggctctaaggcctctcgtccagacaccccccgcccctaccagcgaaatggtgccagtgatctcatctatgtatcccatcgccctcactagggccgagatgtcgaacggggctccccaagagctagagaaaaagagcatacacctccccgaaaagtccgtaccaagcgagaggggtctgagccccaacaactctggccacgattctaccgatacagactccaatcatgaagagagacagaatcacatttatcagcagaatcatatggtgctgagccgagcacggaacggaatgccgctgctcaaggaagtcccgcggtcctacgagcttctcaagcccccgccaatttgcccccgggactccgttaaggtaattaacaaagagggcgaagtgatggacgtgtaccgttgcgaccactgccgggtgctgtttcttgactatgtgatgtttaccatccatatgggttgccacggattccgggacccgtttgagtgcaatatgtgcgggtataggtctcacgacaggtatgaattttccagtcacattgcacgtggcgagcatagagcacttttgaaatag

SEQ ID NO: 24501 - DNA, 867 bp, Artificial Sequence
  Description of Artificial Sequence: Synthetic coding sequence
atggaggacatccagaccaacgccgagctgaagagcacccaggagcagagtgtgcccgccgagtctgcagctgtcctaaatgattattcgctcacaaaaagccacgagatggaaaacgttgatagcggcgagggcccggcaaacgaggacgaagacatcgggggagagaagcgacattgcttcgatgtaaattataacagctcatacatgtacgagaaagagtccgagctgatccagactagaatgatggaccaggcaattaataacgctatcagctacctgggagcagaggctttacgacccctggtccaaacaccacctgccccgacttcagaaatggtgcccgtgattagctccatgtatccgatcgccctgacgcgtgccgaaatgtcaaatggagctcctcaagagcttgagaagaagagtattcatttaccagaaaagagcgtgcctagtgagagagggctgtcacctaataatagcggacatgacagcacagacactgactcaaaccacgaggagcggcagaatcacatctaccagcaaaatcacatggttctgtcacgtgctaggaacggtatgcctctcctgaaagaagtcccccgttcctacgaattgttaaaaccacctcctatctgtccgcgggatagtgtgaaagtgatcaacaaagagggcgaagttatggacgtgtataggtgcgaccattgccgtgtgctgtttctcgactacgtgatgttcacaatacacatgggttgccatggatttagggatcctttcgagtgtaatatgtgtggttatagatcccacgacagatacgagtttagctcccacatcgctcgaggcgagcatcgagccctgttgaagtag

SEQ ID NO: 24502 - DNA, 1269 bp, Artificial Sequence
  Description of Artificial Sequence: Synthetic coding sequence
atggaggacatccagaccaacgccgagctgaagagcacccaggagcagtctgtccccgccgaatcagctgcagttctcaatgactacagtcttacgaagagccacgaaatggagaatgtcgattccggagagggacctgctaatgaggatgaggatatagggggagaacgacccttccagtgcaatcaatgtggggccagttttacacagaagggcaacctgctgcgacacattaaactgcacaccggcgaaaaaccttttaaatgccatctgtgcaactacgcttgccagcggcgagacgccttgactggacatttgcgtactcactctgtcgaaaagccttataagtgtgaattttgtggcagatcctataagcagcgaagcagtttagaagagcacaaggagcgatgcaggaccttcctccagtccacagatccaggtgacaccgcatctgcagaagccagacacataaaagcagagatgggatcggagcgcgctttggtcctggatcggctggcttctaacgtcgctaaacgcaaatctagcatgccacagaagtttatcggcgaaaaaaggcactgttttgacgtcaactacaactcttcatacatgtacgaaaaagagagcgaactgatacagacaaggatgatggaccaggcgatcaataatgccatctcctatctgggagctgaggcgctgcgcccactcgtccagactccgccggcccccaccagtgaaatggtcccagtaatctcttccatgtatccgatagccttgacaagggctgagatgtctaatggcgctccacaggagctggagaaaaaaagcattcatttgccagagaaaagtgtgcccagcgagcgtggtctgagcccaaataactcaggacatgatagcaccgatactgattccaaccatgaggaacggcaaaatcacatttaccagcagaatcacatggtcctgagcagagctcgcaacggcatgccactgctcaaggaagtcccccgatcgtatgaactcctgaaacccccccctatttgcccccgggactcagtgaaggtgattaacaaggagggcgaggtcatggacgtttacaggtgcgatcattgccgagtgctgttcttggactacgtaatgttcaccatccatatgggctgtcacggatttagagacccatttgagtgtaacatgtgcgggtatagatcccacgatcggtatgaattcagctctcacatcgcacgaggcgagcaccgagccctgttgaaatag

SEQ ID NO: 24503 - DNA, 984 bp, Artificial Sequence
  Description of Artificial Sequence: Synthetic coding sequence
atggaggacatccagaccaacgccgagctgaagagcacccaggagcagagtgttcccgcagagtccgccgctgtgctaaatgactactcactcaccaagtcccacgagatggagaatgtcgactccggcgagggacctgccaacgaggacgaggacataggcgcatctgccgaggccaggcacattaaagcagagatgggtagcgagcgggcgctcgtgttagatagactggcaagcaatgtggccaaacgcaaatccagcatgccgcagaaatttataggggaaaaacgccactgttttgacgtcaattataactccagctacatgtacgaaaaagaatccgagttaattcagacgagaatgatggaccaagctattaacaacgctatcagctatctgggggccgaagctctacgacccctggtccagactcctccggcccctacatccgaaatggttcccgtgatctcctcaatgtaccccattgccttgacccgagcagagatgagtaatggcgctcctcaggaactggaaaaaaagagcattcatcttcctgaaaagtccgtgccatctgaaaggggactgtctccgaacaacagcggtcatgactctacagacactgactctaatcatgaggaacgccaaaaccatatataccagcagaaccatatggtgttgagtagggctcgcaatggaatgcccttactcaaagaggtgcctcgcagctatgagctcctgaaacccccgcccatctgtccaagagattctgtgaaagtaattaataaggagggagaggtaatggacgtgtacagatgcgatcattgtcgggtactttttctggactatgtcatgtttacaattcatatgggttgccacggattcagggaccccttcgagtgtaacatgtgcggatatagaagccatgaccgatatgaattttcctctcatatcgcgaggggagagcaccgagcacttctgaaatag

SEQ ID NO: 24504 - DNA, 1392 bp, Artificial Sequence
  Description of Artificial Sequence: Synthetic coding sequence
tgacaggagcagagcgtgcccgccgacgacagcatgaaggtgaaggacgagtacagcgaacgagacgagaatgtgctgaaatctgagcctatggggaatgccgaggaacccgagatcccttatagttacagcagggaatacaacgaatacgaaaatatcaaactggaacggcatgtggtctctttcgattcctcccgaccgacatccgggaagatgaactgtgatgtctgtgggttgtcctgtatttctttcaatgtgctaatggtgcataagcggagccacactggggaacgcccattccagtgtaatcagtgcggtgcatccttcacccagaagggtaacctcttgcgccacattaagttacatacaggggagaagccctttaaatgtcacctctgtaactatgcttgccagcgtagggatgctttgactggacacctcagaacacattccgttgagaagccttacaagtgcgagttctgcgggcgctcctacaaacagagaagttctttagaggaacacaaagagagatgccggacattcttgcagtcgacggaccctggtgacactgcgagcgccgaagcccgtcatataaaggcagaaatgggaagtgagcgcgccctggtgttagacaggttagctagcaatgtggcgaagaggaagagttctatgccccagaagttcatcggtgagaagcgccactgcttcgacgtcaattacaactcgagctatatgtacgaaaaggagtctgagctgatccaaaccaggatgatggatcaggctatcaataatgccatcagttacctgggcgctgaggcattacgaccactcgtgcaaacgcccccagcacctaccagtgagatggttcccgtcatatccagcatgtaccctatcgctttaactagagctgaaatgtcaaacggtgccccccaggagctggaaaaaaaatcaatacaccttccggagaaatctgtgccaagcgaaagaggcttgtctccaaacaactccgggcatgactctactgacaccgactcgaatcatgaagagagacaaaatcatatttaccaacagaatcatatggttttatccagggcaagaaatgggatgccactgctgaaggaagtgccaaggtcgtatgaactgcttaaaccacctcctatttgccccagagattctgttaaggttataaacaaggagggagaggtgatggatgtgtataggtgcgatcactgcagagttctattccttgattacgtgatgtttacaattcatatgggctgtcacgggtttcgggatcccttcgaatgcaacatgtgcggttatcgcagtcatgacagatatgagttctccagccacatcgcaagaggcgagcacagggccctgcttaaatag

SEQ ID NO: 24505 - DNA, 1275 bp, Artificial Sequence
  Description of Artificial Sequence: Synthetic coding sequence
tgacaggagcagagcgtgcccgccgacgacagcatgaaggtgaaggacgagtattctgaaagggacgagaacgtgctgaagagtgagcctatggggaatgcagaagaacctgagatcccttactcatactccagggagtacaatgaatacgaaaacatcaagttggaacgccacgtcgttagttttgattcaagcaggcctacttcaggaaagatgaattgtgacgtttgcgggctcagctgtatatcattcaacgtgcttatggtacacaagagatcccacactggtgaaaggccattccagtgcaaccaatgtggggctagcttcacccagaaggggaacctcctacgccacatcaaactgcacaccggtgaaaaacctttcaaatgtcacctgtgcaattacgcatgtcagcgccgagatgccctcaccggtcacttaagaacacacagtgcctctgctgaagcgagacatatcaaagccgagatggggtctgaaagagcactcgttctagaccgactggctagcaacgtggcgaagcggaaatccagtatgccacagaagttcattggagaaaagcggcattgttttgatgtcaattataatagctcatacatgtacgagaaggaatcggagttgatccagacgcgcatgatggatcaagctatcaacaacgccatcagctacctgggtgccgaagcactccggcccctggtacagaccccccctgccccaaccagcgaaatggtaccagtaatctccagcatgtatccaatagcgttaactagagccgaaatgtcaaacggtgcaccacaggagcttgagaaaaaaagcattcacctgcccgaaaagtccgtcccatctgagcgaggcttatctcccaacaactcgggacacgactccaccgatacggacagcaaccacgaagagaggcagaatcacatttatcaacagaatcatatggtgttaagtagggcccgaaatggaatgcctctcctgaaggaggtcccccgcagctacgaactactgaagccccccccaatttgtccccgcgactccgtgaaggtgatcaataaagagggcgaagtgatggatgtgtaccggtgtgaccactgccgcgtgcttttcttggattatgttatgttcactatccacatgggatgtcatgggttccgagatcctttcgagtgtaacatgtgcggttaccgttcccacgacagatatgagtttagctctcatattgctagaggcgagcacagggctctgcttaagtag

SEQ ID NO: 24506 - DNA, 1362 bp, Artificial Sequence
  Description of Artificial Sequence: Synthetic coding sequence
atggaggacatccagaccaacgccgagctgaagagcacccaggagcagtcagtccccgctgagtctgccgcggttctgaacgattacagtctgactaagtcccacgagatggagaatgtggactccggcgaggggccagccaacgaggacgaagatatcggggatgacagcatgaaagtaaaagatgagtactctgagcgagacgagaacgtgctgaagtcagagccaatgggcaacgccgaggaaccagagatcccctactcctatagccgggaatataatgagtacgaaaacatcaaattggagaggcacgtggtatcattcgactccagccgaccaaccagcggcaagatgaactgtgacgtctgtggcctttcttgcatctccttcaacgtgttaatggttcacaagagatcccatactgtggaaaaaccgtataaatgtgagttctgcgggcgttcatacaagcagcgctcctccctggaggagcataaggaacgctgccgcacattcctacagagtacagatcccggcgataccgcgtctgctgaggccagacacatcaaggctgagatgggaagcgagcgggccctcgtgcttgaccgcctggccagcaacgtggcaaaaaggaagagctccatgccccagaaattcattggcgagaagaggcactgctttgacgttaactacaattcatcatacatgtacgagaaagagagtgaactcatccaaacccgtatgatggaccaagccatcaataatgccatatcttatctgggagctgaagcattgcggcctcttgtccagactcctccagctcctaccagcgagatggttccagtgatctcgtccatgtatcccattgcactgacacgcgccgaaatgtccaacggcgcacctcaggaactagaaaagaagtccatacacttacctgagaagtctgtgcccagcgagcggggcctctcaccaaacaatagcggacatgattccaccgatactgattcaaatcatgaggagagacaaaaccatatttatcaacaaaatcacatggtgctgtcccgggcccgcaacgggatgccactgctcaaagaggtaccacggtcttacgagctcctgaaacccccgcctatctgtcctcgggactcagtgaaggtgatcaataaagaaggcgaggtgatggatgtctacaggtgcgaccactgcagagtacttttcctcgactacgtgatgttcacaatacatatgggatgccacggattcagagaccctttcgaatgtaacatgtgtggttaccggtctcacgatcggtatgagttttcctcgcatattgccaggggtgagcaccgcgccctcctgaaatag

SEQ ID NO: 24507 - DNA, 1530 bp, Artificial Sequence
  Description of Artificial Sequence: Synthetic coding sequence
atggaggacatccagaccaacgccgagctgaagagcacccaggagcagtctgttcccgctgaaagcgcagccgtgctgaacgattattctctcaccaaatctcacgagatggagaacgttgattctggtgagggccctgctaatgaggatgaggacattggggatgactctatgaaggtcaaagacgagtacagcgagcgcgatgagaatgtgctgaagagcgaacccatgggtaacgccgaggaacctgagatcccatatagctacagcagggagtataatgaatatgagaatatcaagctggagcgccacgttgtctcgtttgacagtagcaggccaactagtggaaaaatgaactgcgacgtgtgcggactgagttgtatctccttcaacgtcctgatggtgcacaaacgtagtcacaccggcgagaggcccttccagtgcaaccagtgcggagcgagtttcacccagaagggcaatctgctccgccatatcaaactgcacaccggtgaaaagccattcaagtgtcacctctgcaattatgcctgccagcgacgcgatgctttgactggccaccttcggacgcacagtgtggagaaaccctataagtgcgaattctgcgggagatcatataaacaaagatcgtcactcgaggaacataaagaacgctgcaggaccttcctacaatcaaccgatcccggagacactgcctcggccgaggccaggcacatcaaagcggagatgggaagcgaacgagctttagttctggataggctggcatcgaacgtcgccaaacgcaagagtagcatgcctcagaagtttatcggggaaaagcgccattgcttcgatgtcaattacaacagtagttacatgtatgaaaaggaatcagagctcattcaaactcgtatgatggatcaagcgatcaataatgccatctcctatctgggggctgaagcccttagacctctggtgcaaactccccctgctcccacgtccgagatggtcccggtcatttcctcaatgtatccaatcgcactgactagggccgagatgtcgaacggcgctccacaggagctggaaaaaaagtccatccacttgccagagaagtctgtcccctctgagaggggtctatcaccaaacaacagtggccacgatagtaccgacacggactccaatcacgaggaacggcagaaccatatttaccagcagaaccacatggtgttaagtcgggcccgtaatggcatgcctctgctcaaagaggtgcctcgatcatatgaacttctcaagccacccccgatttgccccagagacagcgtaaaggttatcaataaagaaggagaagtgatggacgtttatcggtgtgatcattgcagagtgcttttcctcgattatgtgatgttcaccattcacatgggttgccacggctttagagaccctttcgagtgcaacatgtgcggttatagaagccacgatcgttacgagttttcctcccacatagctcgaggagagcacagagcgttattaaagtag

SEQ ID NO: 24508 - DNA, 1428 bp, Artificial Sequence
  Description of Artificial Sequence: Synthetic coding sequence
atggaggacatccagaccaacgccgagctgaagagcacccaggagcaatctgtccccgctgacgatagtatgaaggttaaagatgaatacagtgagcgagacgagaatgtcctcaagagcgaacccatgggaaatgctgaggaacccgagattccgtactcttacagtagagaatataacgaatatgaaaatattaagcttgagcgtcacgttgtgtcattcgatagctcccgaccaaccagtggcaagatgaattgcgacgtctgcggattatcatgtatctcgtttaacgtcctgatggtgcacaagagatcccatacaggagagagaccattccagtgcaatcagtgtggtgctagttttacacaaaagggaaatcttctgaggcacatcaagctgcataccggcgaaaagccctttaagtgccatctctgtaactatgcatgccaacgccgagacgccctcaccggccatctgcggactcacagcgtcgaaaagccatacaagtgcgagttttgcggcaggtcatataaacagcgaagttctttagaggaacacaaggagcgatgccgaaccttcctgcagagtactgacccaggtgacactgcaagcgctgaggccagacacattaaggctgagatgggaagcgaaagagctttagtgttggacagactggccagtaacgtggctaagcgcaagagttcgatgccccaaaagtttattggcgagaaacgacactgttttgacgtgaattacaactcatcctatatgtatgaaaaagaaagcgagctgatacagacccgcatgatggatcaggcgatcaacaacgctatttcatatctgggagcggaggctctgcgaccacttgtacagaccccccccgcccccacgagcgaaatggtgcccgttattagtagtatgtatccaatcgccttaacccgggcagaaatgtctaatggcgccccccaggagctggagaagaaatccatccatctcccagaaaagtcagtgccatccgagcgcgggctgtcaccgaataattcgggtcacgacagtaccgatacagacagtaaccatgaggagagacagaaccacatttaccaacagaatcacatggtgttgtcaagagcccgcaatggaatgcctttgctcaaggaagtcccgcggtcatacgagttgctcaagccaccacccatctgccctcgcgacagtgtgaaggtgattaataaggaaggggaggtcatggatgtctataggtgtgaccactgccgggtcctctttctggactacgtgatgtttaccatccatatgggctgccacggcttcagggatcccttcgagtgtaatatgtgtgggtacagatcccatgatagatacgaattctcttcgcacatcgccaggggggagcatcgagccctgcttaagtag

SEQ ID NO: 24509 - DNA, 450 bp, Artificial Sequence
  Description of Artificial Sequence: Synthetic coding sequence
atgaaggtggccagcggcagcaccgccaccgccgccgccggccccagctgtgccctgaaagcaggcaaaacagcaagcggcgccggtgaggtggtccgctgcctgagtgagcaaagtgtggctatctcccggtgcgctgggggtgccggagcacgcttgccagccctgcttgacgaacagcaggtgaacgttttactatatgatatgaacggatgttactcgcgactgaaagaactggtgccaactcttccccagaacaggaaagtttctaaagtagaaatcctacagcatgtgatcgattacattcgcgatcttcaactggagcttaacagcgaatcagaagtcgggaccccaggtggacgggggctgcctgtgcgcgctcccctcagcactcttaacggagagatatccgctttgactgcagaggtgaggagtagaagcgaccactag

SEQ ID NO: 24510 - DNA, 468 bp, Artificial Sequence
  Description of Artificial Sequence: Synthetic coding sequence
atgaaggtggccagcggcagcaccgccaccgccgccgccggccccagctgtgccctgaaagccggtaagaccgcctctggtgccggcgaagttgtccggtgcctttcagagcaaagtgttgcaatctcaagatgcgctggtggggcaggcgcccgcctgcctgcccttttagacgaacaacaggttaatgttctcctctacgacatgaacggttgctactcacggctcaaagagctggttccaactctgcctcaaaaccgcaaagtctccaaggttgagatccttcagcacgtcattgactatattagagacctgcaacttgaactcaattccgaatctgaggttgggacacccggcggtcggggtttaccagtcagggctccactgagtacactcaacggcgagatctctgcccttactgccgaagccgcatgcgtgccagccgatgatcggattctatgccggtag

SEQ ID NO: 24511 - DNA, 738 bp, Artificial Sequence
  Description of Artificial Sequence: Synthetic coding sequence
atggccgccggcatgtacctggagcactacctggacagcatcgagaatttgcctttcgaactgcagcgtaactttcagcttatgagggacttggaccagaggaccgaggacctgaaagccgagattgataagctggccaccgaatatatgtcctcagcacgtagtttatcttctgaggagaagctcgctttgcttaagcagatacaggaagcctacgggaagtgtaaagagtttggcgatgacaaagtacagttagctatgcagacatatgaaatggtcgataagcacatacgccgactggacactgatttagccaggttcgaggccgatcttaaagagaaacagattgaaagctccgactacgacagttcatcctccaaagggcggactcaaaaagagaaaaaggccgctcgggctaggagcaaagggaagaactcagatgaggaagccccgaaaaccgcacagaaaaagctgaagctggttcgtaccagcccagaatacggaatgccgtcagtaacctttggaagcgtgcatccctctgatgtactcgacatgccagttgaccctaatgagccaacttactgcctgtgccaccaagtgtcctacggggaaatgattggttgtgacaaccctgactgctcaattgaatggttccacttcgcctgtgtcggacttacaaccaaacccagggggaagtggttctgcccacgctgcagccaagagcgtaaaaagaaatag

SEQ ID NO: 24512 - DNA, 840 bp, Artificial Sequence
  Description of Artificial Sequence: Synthetic coding sequence
atgctgagccccgccaacggcgagcagctgcacctggtgaactacgtggaagattacctcgattcaatcgaaagcctgcctttcgacctccaacgcaacgtctcactgatgagggaaattgacgccaaatatcaggaaatccttaaagaactggacgaatgctacgagcgatttagccgcgagaccgatggagctcagaaacgccggatgctgcactgtgtccaaagggccctgattcgcagtcaagagttgggggacgagaagattcagattgttagccagatggtggagctggttgagaatagaaccaggcaggtcgattctcacgtcgaactgtttgaagcgcagcaggagctcggcgatactgcgggaaactctggtaaggctggcgctgatcggccgaagggtgaagccgcggcacaggctgataaacccaactcgaagcggtcccgcaggcagaggaacaatgaaaatagggagaacgcgtcgagcaaccacgaccacgacgacggggccagcggaacccctaaagaaaaaaaggccaagacctcaaaaaagaagaaacgctcaaaagcaaaggccgagagggaggctagccctgccgacctgcctattgatcctaacgagcctacttactgtctttgtaaccaagtgagctatggcgagatgattggctgtgacaatgatgaatgccccatagagtggttccattttagctgcgtggggttaaaccataagccgaaagggaagtggtattgtcccaaatgtcgtggagagaacgagaaaaccatggacaaggcgctagagaaaagcaaaaaggaaagagcctacaaccggtag

SEQ ID NO: 24513 - DNA, 708 bp, Artificial Sequence
  Description of Artificial Sequence: Synthetic coding sequence
atggagatcctgaaggagctggacgagtgctacgagcggttcagccgtgaaactgatggagcacaaaaaaggcgtatgctgcattgcgtccagcgggcacttatccgatcccaggaactgggcgatgaaaagatccagattgtgtctcaaatggttgagttagtggaaaacaggacacgccaagtggacagccatgtggaattgtttgaagcgcagcaggagctgggggacaccgcaggcaattcaggcaaggctggagctgacaggcccaaaggggaggcagccgctcaggccgataaacccaatagcaaaaggagcagaaggcagaggaataatgagaatcgtgagaacgcctcctcaaaccacgatcacgatgacggagcctctggtactccaaaggagaagaaggccaagacatccaaaaaaaaaaaacggtcaaaggcaaaggccgaacgagaggccagccccgctgatctgcccatcgatccaaatgaaccaacctattgtctgtgtaatcaagtgtcttacggagagatgatcgggtgcgacaatgatgagtgtccgatcgagtggttccatttctcctgcgtggggctcaaccacaaacctaaaggcaagtggtattgtcccaaatgcaggggagagaatgagaagaccatggataaggcgctcgaaaagtcaaaaaaggaaagggcctacaataggtag

SEQ ID NO: 24514 - DNA, 1269 bp, Artificial Sequence
  Description of Artificial Sequence: Synthetic coding sequence
atgagcttcgtggagtgcccctaccacagccccgccgagcggctggttgccgaagccgacgagggggggcctagcgctataacaggtatgggcctatgcttccggtgtctgctgttttctttcagcgggcgttccggagttgaaggcgggcgtgtcgatctgaatgtttttgggagtctgggcctgcagccgtggatcgggagttccaggtgttggggtgggccatgtagcagtgccttacggtgcggctggttttcatcgtggcctcccccttcaaagtctgcgatccccatcggaggcggctccaggggcgccggaagggtatctaggtggccacccccccattggctagaagcttggcgtgttagccccctgcccctgtccccactgtcccccgcgaccttcggcaggggctttatcgctgtggcggtaatccccggtctatgggcgcgagggagaggttgttcctcagaccggctgcctaggcctgctgggccagcacggaggcaatttcaggcagcctctcttttgactcgcggctggggcagggcatggccttggaaacagatactgaaggaactagacgagtgctacgagaggttctcacgtgagacagatggggctcagaagcggagaatgctacactgtgtgcagcgcgctctgattaggagccaagagttgggggacgaaaagattcaaatcgtgtctcaaatggtggagctggtggagaacaggacgcgccaggtggattctcacgtggaactgtttgaggcccagcaagagttgggagataccgccggtaactctggtaaggccggcgctgatcgaccaaagggtgaagccgctgcccaggcggacaagcctaacagcaagcgttcacgcagacagcgcaataatgagaatcgcgagaatgcttccagcaaccacgatcacgatgacggggctagcgggacgccgaaagaaaaaaaagctaagacctcgaaaaagaagaagcgatctaaagccaaggccgagagggaggctagtccagctgatctgccaatagatcccaatgaaccaacatactgcctgtgtaaccaggtgagctacggagagatgatcgggtgtgacaatgacgagtgtcccattgagtggttccacttttcctgcgtaggcctgaatcacaagccaaagggaaaatggtactgtcccaaatgcaggggtgaaaatgaaaaaactatggataaagcattagagaaatctaagaaagagcgggcgtacaaccggtag

SEQ ID NO: 24515 - DNA, 633 bp, Artificial Sequence
  Description of Artificial Sequence: Synthetic coding sequence
atgctgcactgcgtgcagcgggccctgatccggagccaggagctgggtgatgagaagatccagatagtctcccagatggtcgagcttgtggagaaccgcacccgccaggtagactcccatgtcgagctgttcgaggcccagcaggagcttggggacaccgccgggaattctggcaaagcaggagcagatagaccaaaaggggaggccgctgcgcaggccgacaaacctaacagcaagagaagtaggcgtcagcgtaacaacgagaaccgagagaatgcttcctcaaaccacgatcacgatgatggtgcctctggcacccctaaagagaaaaaggccaaaactagcaagaaaaaaaagagaagtaaggccaaagcagagcgcgaagcttctcccgcagatctgccgattgatcccaacgaaccaacttactgcctgtgtaatcaggtgtcttacggagagatgattggttgtgataatgatgaatgcccaattgagtggtttcacttcagttgcgtaggtctgaatcataagccaaaggggaaatggtactgccccaaatgtaggggagaaaatgagaaaacgatggataaagctctcgagaagagcaagaaagagcgggcttacaaccgctag

SEQ ID NO: 24516 - DNA, 747 bp, Artificial Sequence
  Description of Artificial Sequence: Synthetic coding sequence
atggccgccggcatgtacctggagcactacctggacagcatcgagaatctcccattcgaactgcagcgtaattttcaattaatgcgagacctggatcagaggacagaagaccttaaggccgagattgataagctagctaccgaatatatgagctcagcccggtcgctgagctccgaagagaagttagccctcctcaaacagatccaagaggcatatggcaagtgcaaagagtttggcgatgataaggtccagctcgctatgcagacgtacgaaatggtggacaaacacataaggagattggacacagatctggcaaggtttgaagcagatctgaaggagaaacagatcgaaagctccgattatgattcttcttcttcaaagggaaagaagtcgcgtacccagaaagagaaaaaagcagccagagctcgtagcaagggcaagaacagtgacgaggaggcccctaagaccgctcagaaaaagttgaaacttgtccgcacttccccggaatatggcatgccctccgtgaccttcgggtctgtgcatcccagcgacgtgctggatatgccagtcgatcccaatgaaccaacctattgtctttgccaccaagtttcttatggagaaatgataggctgtgataatcctgattgttctatagaatggtttcatttcgcttgcgtgggtctcactacaaagccacgtggcaaatggttctgtccaaggtgctcccaagaaaggaagaagaaatag

SEQ ID NO: 24517 - DNA, 750 bp, Artificial Sequence
  Description of Artificial Sequence: Synthetic coding sequence
atggccgccggcatgtacctggagcactacctggacagcatcgagaacctcccctttgagctgcaacgtaacttccaactcatgagagatttggatcagcggactgaagacctgaaagccgaaatcgataaacttgcgacagagtatatgtctagtgcccgatccttgtctagcgaggaaaaactggcccttctgaaacagatccaggaggcatatggtaaatgtaaagagttcggagatgataaggtgcaactggctatgcaaacatacgaaatggttgacaagcatatacggagactggacaccgacctggcgaggttcgaggccgacttaaaagaaaagcaaatagagagttccgattatgactcatcctcgtcaaaaggtaagaaaaaagggcgcacgcagaaggaaaagaaagccgccagggcccgttcaaagggaaaaaattccgatgaggaagctcctaagaccgcccagaagaaattaaagctcgtccgcacatcaccagagtatggtatgccaagcgtaacgtttggcagcgtacacccgagcgacgtgctcgatatgccagttgatccaaatgagcccacttattgcttatgccatcaagtttcctatggcgagatgattggttgcgataacccagattgctcaattgaatggtttcactttgcatgtgtgggactcacgacaaagccacgcggtaagtggttctgtccccggtgcagccaggaacgtaagaagaaatag

SEQ ID NO: 24518 - DNA, 741 bp, Artificial Sequence
  Description of Artificial Sequence: Synthetic coding sequence
atggccgccggcatgtacctggagcactacctggacagcatcgagaacttacccttcgagctccagcggaattttcaactcatgagagatctggaccagcgtactgaagatctgaaagccgagatagacaagctggctaccgaatacatgagcagcgctagaagcctttccagcgaggagaagctagccctcttgaagcagatacaggaggcttacggcaagtgtaaggagttcggagatgataaggtgcagctggctatgcagacgtatgagatggttgacaagcatattcggcggctcgacacagacctggccagattcgaggccgacctgaaggaaaaacaaattgagagcagtgactatgactccagctcctccaaagaaggtagaactcaaaaggaaaagaaggctgcacgggcgcgaagcaagggcaagaacagcgatgaagaggcacctaaaactgcacagaagaagctcaagttagtgcggacatcccccgaatatgggatgccctcagtcacatttgggtcagtgcatcccagcgacgtgctggacatgccagtagatcccaatgaaccaacttactgcctgtgccatcaagtgtcttacggagaaatgatcggatgcgacaaccccgattgtagcatcgagtggttccattttgcctgcgtcggactgacaacgaagcccagaggcaaatggttctgtccacgttgcagtcaagagcgcaaaaaaaagtag

SEQ ID NO: 24519 - DNA, 540 bp, Artificial Sequence
  Description of Artificial Sequence: Synthetic coding sequence
atggccgccggcatgtacctggagcactacctggacagcatcgagaacctgcctttcgagctgcagcgtaatttccagcttatgagagaccttgatcaaagaaccgaggacttgaaagcagagatcgacaagttagcgacagaatacatgtcctctgccagatccctgtctagcgaggaaaagctggccctcttaaaacagattcaagaagcctacggcaagtgtaaagagtttggcgacgacaaggtgcagcttgctatgcaaacatatgaaatggtggacaagcacatccgtcgcctcgatactgatttagcacgatttgaggccgatctcaaggagaagcagattgagtcgtccgactacgatagtagcagttctaaaggtaagaaaaagggccgtacccagaaagagaagaaagccgctagggccagatcgaagggcaagaatagcgacgaggaggcacccaagactgcccaaaagaaactgaaactggtccgaactgtcccactatctggatctattcttcccgtgtggggctag

SEQ ID NO: 24520 - DNA, 678 bp, Artificial Sequence
  Description of Artificial Sequence: Synthetic coding sequence
atggccgccggcatgtacctggagcactacctggacaacctgaaggcggagatcgacaaacttgccactgaatatatgtcaagcgctcgcagtctgtcttccgaggaaaaactcgctctgctgaagcagatccaggaggcgtacggaaaatgcaaagaatttggagacgataaagtccaacttgccatgcagacgtatgagatggtcgacaaacacattcgccgtcttgatacggatctggccagatttgaagccgaccttaaagaaaaacagattgaatccagcgattatgacagctcctcctctaaaggaaagaaaaagggccgaacacagaaggaaaagaaagctgcccgggcaaggtcaaaaggtaagaactctgatgaagaagcccccaagaccgctcagaagaaactgaagctcgtgcgaaccagcccggagtacggtatgccttctgtgacttttggcagcgtgcacccttccgacgtgctggatatgcccgttgatcccaatgagcccacatattgcctttgccatcaggtatcctacggcgagatgattgggtgtgacaaccccgactgctctatcgaatggttccacttcgcttgcgttggactgacgactaagccaagggggaaatggttttgtcctagatgttcccaggaaaggaaaaaaaaatag

SEQ ID NO: 24521 - DNA, 3729 bp, Artificial Sequence
  Description of Artificial Sequence: Synthetic coding sequence
atggccagcccccccgagagcgacggcttcagcgacgtgcggaaggtcggctatctcagaaagcccaagtccatgcataaacgctttttcgtgctgagggctgcatccgaggcaggaggaccagcccgcctggagtattatgagaacgaaaagaaatggcgacacaagtcatccgctccaaagcgttctatacccctggaaagctgttttaacattaacaaaagggccgatagtaaaaacaaacacttagtagccctgtacacccgcgacgagcacttcgcgattgctgcagatagcgaagccgagcaggactcttggtaccaagctttactgcagctccataacagggctaaaggtcaccatgatggcgccgcagccctgggtgcgggggggggagggggctcctgcagtggtagctctgggctcggcgaggcgggagaggacctgtcctacggagacgtgccaccagggcctgcattcaaggaggtgtggcaggtaatcttgaaacccaaagggctgggtcagaccaagaacttgatcggaatttacagactgtgtttgacctccaagacaatatcattcgtgaagctgaacagcgaagccgccgcggtcgtcctgcagctcatgaatatccgacgctgtggtcactctgagaactttttctttattgaagtgggccggagcgccgtaacaggtcctggtgaattttggatgcaagtggacgactcagtcgtggcccaaaacatgcatgagaccatactggaggcgatgcgcgcgatgtctgatgaattcaggccaagatccaaaagtcagtctagctcaaattgcagtaatccaatcagtgttcccttgcggagacatcacttgaacaaccctccccccagtcaggtggggctgacccgtagatctcgtacggaaagtataaccgccacgagccccgcatcaatggtgggaggaaaacctgggagcttccgcgttcgggcttccagcgacggcgaggggacgatgagtcggcccgccagtgtagacggctctcccgtttcaccgagtactaatagaacccacgcacatcgacaccgggggagtgcccgcctgcatccacctctgaatcacagtagatccatcccaatgcctgcatctagatgctccccatctgcaacatctcctgtcagcctcagctcgtccagtacaagtggccatggcagtacatcagactgcttgttcccgcgacgatcttctgcgagcgtaagtggctctccttcagatggggggttcatctcctctgatgaatacggatcatccccatgtgattttcgtagcagttttaggtccgtcactcctgattccctgggtcatactcctccagcgcgtggcgaagaagaactgtctaactatatttgtatgggaggaaaggggccaagcactcttaccgctcctaatgggcactatattcttagtcggggcggtaatggccatcgctgtactcccggcaccggtctgggcacctccccggcgctcgccggagatgaggctgcctccgctgcagatctggataaccgcttccgcaagcggactcattctgcaggaacttccccaaccatcacccaccagaagaccccttcgcagtcttcagtcgcctcaattgaagaatacactgagatgatgcctgcctaccctcctggaggtggctctggcgggagactccctggacatagacacagcgcattcgtcccaacccggagttacccagaggagggcttagagatgcaccctctggaacgccggggcgggcaccacagaccagattcctctaccctgcacactgacgatggatacatgcctatgtcccctggagtcgcgccagtgccttcaggtaggaaaggctctggggactacatgcccatgtcaccaaagagtgttagcgcccctcagcagattataaatcctatcagacgccaccctcaacgggtggaccctaatggctatatgatgatgtctccatctggaggctgcagccctgacataggaggaggaccgtcctcgtcaagctcaagtagtaatgccgtgcccagtggaaccagctacgggaagctgtggactaatggtgtgggcggacaccattcccatgtgctgcctcacccaaagcctcctgtggaatccagcggggggaagcttttaccctgtaccggagattatatgaacatgagcccagtgggcgactccaatactagctctcccagcgactgttattatgggcctgaggatccacagcataagcctgttttgagctattactcattaccccggtcatttaagcacacacagcgccctggggagcccgaggagggagcacgccaccagcatttgagactgtccactagctccgggcggctgctttacgctgccactgctgatgattccagcagtagcacctcaagcgacagcttaggaggtggatattgcggggcaagacttgagcctagcttaccgcacccccatcaccaggtgctccagcctcatcttcctcgcaaagtggataccgccgcacagaccaactctaggctggcaaggccaacaagactaagtctgggtgaccccaaagcgtcaaccctacccagagcccgggaacaacaacagcagcagcaacccctgctccacccacccgagccaaagagtcccggcgaatatgtaaatatcgaatttgggagcgatcagtccggctacctctcgggaccagtcgctttccactcaagcccaagcgtcaggtgcccttctcagttgcagcccgcgccacgcgaggaggagaccggtacagaagagtacatgaaaatggacttaggacccggcaggcgggccgcttggcaggaatcaactggcgttgagatggggcgtcttggtcccgcccctcccggggcggcaagcatttgccgtccaactagagctgtgccatcgagcagaggggattatatgaccatgcaaatgtcttgcccgaggcaatcctatgtggacacctcgcccgcagcgccagtttcctacgctgacatgcgcactggaatcgcagccgaagaagtctctctccctagggcgaccatggccgccgcgtcatctagctctgccgcctccgcgtcccccactgggcctcagggcgctgcagaactcgccgcccactctagcctcttaggagggccccagggacccggtggaatgagcgccttcaccagggtgaacctcagcccaaaccgcaatcagtctgcgaaggtcatccgcgcagaccctcagggatgtcgccgcagacactcttcagagactttcagctcgactccttccgccaccagggtaggaaataccgtgcccttcggggcaggggcggctgtgggaggtgggggagggtcatcatccagtagcgaggacgtgaaaagacactcaagcgcatctttcgaaaatgtatggctgcggccaggtgaattaggcggcgcgcccaaagagcctgcaaagctctgtggcgcggctggcgggctggagaacgggctcaattacatcgacctggaccttgtgaaggactttaagcagtgtcctcaggagtgtactcccgagccccagccaccgcctccgccgccacctcatcagcctttgggttctggggaaagttcctcgacacgccggagctccgaggatttaagcgcttacgcctccataagcttccagaagcaacccgaggatcgacagtag

SEQ ID NO: 24522 - DNA, 588 bp, Artificial Sequence
  Description of Artificial Sequence: Synthetic coding sequence
atgggcaagatcagcagcctgcccacccagctgttcaagtgctgcttctgcgacttcctgaaggtcaagatgcacacaatgtcgagtagccatctgttctatctcgcactctgtctcttaacctttacctctagcgccactgccggtcccgagactttatgcggagctgaactggtggacgcgttgcagttcgtttgtggagatcgggggttttattttaataagccaactggatacgggagcagcagcagaagagctccgcagaccggtatcgttgacgagtgctgtttcaggtcatgtgacctacgacgcctcgagatgtactgcgcgcctcttaaaccagcaaaatcagctcgaagtgtccgagcccagagacacactgacatgccaaaaacccagaaataccagccgccctccaccaataaaaacacgaagtcccagaggaggaagggctggcccaaaacacacccaggcggtgagcagaaggagggcacagaagcatcactgcagatcaggggaaagaaaaaggagcagcgtcgcgagataggctccaggaatgccgaatgtcgcggaaagaaaggcaagtag

SEQ ID NO: 24523 - DNA, 462 bp, Artificial Sequence
  Description of Artificial Sequence: Synthetic coding sequence
atgggcaagatcagcagcctgcccacccagctgttcaagtgctgcttctgcgacttcttgaaagtgaagatgcacaccatgtcctctagtcatctattttatctcgcgctctgtctactgactttcacatcgtctgccactgccggtcccgagacattatgtggtgcagagctcgttgacgccttgcagttcgtgtgtggcgatcgtgggttctatttcaataaacccacgggctatggaagtagctccaggagagctccacagactggtattgtggacgagtgttgcttccgaagctgcgacctacgaaggttggagatgtactgtgcccccctgaagcccgctaagagtgcccggagtgtgcgtgctcagaggcatacagacatgcccaaaacacagaaggaagtgcacctaaagaacgcaagccggggctccgccgggaataaaaactatcgcatgtag

SEQ ID NO: 24524 - DNA, 477 bp, Artificial Sequence
  Description of Artificial Sequence: Synthetic coding sequence
atgggcaagatcagcagcctgcccacccagctgttcaagtgctgcttctgcgattttctgaaggtcaagatgcacactatgagctcatcacatctcttctacttggcgctgtgtctgttgactttcaccagtagcgcgaccgccgggcccgagacactgtgcggggcagagctagtggacgcactccaattcgtgtgcggtgaccgcgggttttactttaataagccgactggttatgggtctagctcgaggagagccccgcagactggcatcgtagatgagtgttgttttcgctcctgtgatctcagacggttagaaatgtattgcgctccactgaagccggctaagtctgcccgctccgtgcgcgctcagcggcacacagatatgcctaagacccaaaaatatcagccaccttcaaccaataagaacacaaagagtcagcgcaggaagggctcaacattcgaggagagaaagtag

SEQ ID NO: 24525 - DNA, 420 bp, Artificial Sequence
  Description of Artificial Sequence: Synthetic coding sequence
ctgaaggtgaagatgcacaccatgagcagcagccacctgttctacctcgcactttgcctgctgacattcaccagctccgccaccgccggtccagaaactctctgcggcgctgaactggtggatgctcttcaattcgtgtgcggcgatcgcggattttacttcaataaacctaccgggtatggcagcagttcgagacgggcacctcagacaggaattgtagacgagtgctgtttccggagttgcgatctacggaggctggaaatgtactgcgctcccctcaagccagcgaagagcgcaagatccgtacgcgcccagagacataccgatatgcccaaaacgcaaaagtaccaacccccgtccacgaacaagaacacaaagagtcagaggcgcaaagggtccacattcgaagaacggaaatag

SEQ ID NO: 24526 - DNA, 414 bp, Artificial Sequence
  Description of Artificial Sequence: Synthetic coding sequence
atgatcacccccaccgtgaagatgcacaccatgagcagcagccacctcttttacttagccttatgtttgctcactttcacatcctccgccaccgcaggacccgaaaccttatgtggcgcagaactcgtggacgctctgcagtttgtgtgcggggacagaggcttctacttcaacaagccaaccggatacggctctagttcccgcagagcacctcagacaggcatcgtcgatgaatgctgctttaggagttgcgatctccggcgactggagatgtattgcgcccctctcaagcctgcaaaatctgcaaggtcagtgagggctcagagacacaccgatatgccaaagactcaaaaggaagtgcaccttaagaacgctagccgcggcagtgcaggcaacaagaactatcgaatgtag

SEQ ID NO: 24527 - DNA, 477 bp, Artificial Sequence
  Description of Artificial Sequence: Synthetic coding sequence
atgggcaagatcagcagcctgcccacccagctgttcaagtgctgcttctgcgacttcttgaaagttaagatgcacaccatgtcgagcagtcacctgttctacctggccctgtgcttattgacctttacttcaagtgcgactgcgggaccggagacactctgtggggcagagctcgtcgatgccctgcaattcgtatgcggcgatagagggttttacttcaataaaccaacaggatatggatcgagcagcagaagagccccgcagacaggcattgtagatgaatgctgtttccggtcctgcgatttgaggagactggaaatgtactgtgctcctctgaaacctgccaaatcagcccgtagtgtgagggctcagagacacactgacatgcctaagacccagaaatatcagcccccttccaccaataaaaatacgaaaagccagaggcggaaggggagtacctttgaggaaaggaagtag

SEQ ID NO: 24528 - DNA, 4104 bp, Artificial Sequence
  Description of Artificial Sequence: Synthetic coding sequence
atgaagagcggcagcggcggcggcagccccaccagcctgtggggcctgctttttctgtctgcagcgctcagtctctggccgacctcgggggagatctgtggcccaggaatcgatattaggaacgactaccaacagctgaagcgcctcgagaactgcacagttatcgaaggctatctgcacattttgttaatatccaaggccgaggattataggagttatagatttcctaaactcaccgtgattacggagtatctgcttctgttccgagtcgcaggtttagagtcactgggtgatctcttccctaatctgaccgtgatccgaggttggaaacttttttataattacgcactggttatcttcgaaatgacaaatctgaaggatatcgggttgtacaatttaagaaacattacgcggggtgctatcagaattgagaaaaacgcagatctgtgttacttatcaactgttgattggagtctcatcctggacgccgtgtcgaacaactatattgtaggcaacaagcctccaaaggaatgcggggatttatgccccggcactatggaggaaaaaccgatgtgtgagaagacaaccattaataatgagtataattataggtgctggacaacaaatcggtgtcagaagatgtgtccatcaacgtgcggcaaaagagcatgcaccgagaacaacgagtgctgccatcccgaatgtttggggtcctgtagcgcccctgacaatgacacagcctgtgtcgcctgtcgccactactactacgcaggggtctgtgtgcctgcatgcccccccaatacgtatagatttgaaggatggcggtgcgtggatagggacttctgcgcaaacatactgagcgccgagagcagcgattccgaaggattcgttatccacgacggagaatgtatgcaggagtgtccatctggtttcattaggaacggctctcagtccatgtactgtatcccatgcgaggggccttgccccaaggtctgtgaagaagagaaaaagactaagactattgacagcgtaacctcagcacagatgctgcaggggtgcacaatatttaaggggaatctcttgatcaacatccgccgtggaaataacatcgcttcagagctggagaactttatgggtttgatagaagtggttactggctacgttaagataagacattcacacgcgcttgtgagtctatcattcctgaagaatctccggctgattctcggcgaagagcagctggagggcaactacagcttttacgtactcgacaaccagaatttacaacagttatgggactgggaccatcgaaatttaacaataaaagcaggcaaaatgtactttgcattcaatcctaagctgtgcgtttcggagatttatcggatggaggaagtcaccggcactaagggtcggcagagcaagggcgacattaatacaagaaataatggcgaacgagcctcgtgtgagtccgatgtgttgcatttcacctccactaccaccagcaaaaatcgtattatcattacgtggcaccggtacagaccaccggattaccgggacttaatcagttttaccgtgtattacaaggaagcccctttcaagaatgtaaccgagtatgatggccaagatgcttgtgggagtaattcttggaatatggtagatgtggacctgcccccaaacaaggatgttgagcccggtatccttctgcacggtctcaaaccttggacccagtacgcagtttacgtcaaggccgttactctcacaatggtggagaatgaccacatccggggtgcaaagtccgagattttgtatatcagaacgaatgcatctgtccctagtattccactcgacgtgctgtccgcgagcaactccagtagtcagctgattgtgaaatggaaccccccttcactcccgaacggaaacttgagttactatatcgttcggtggcagaggcagccacaggatggctatctctatcgccacaattattgctccaaagacaaaatccccatacgcaaatacgccgacggcacgattgatattgaggaggtgactgagaaccccaaaaccgaggtctgcggcggggaaaaaggcccatgttgcgcatgtccaaaaaccgaggcagagaagcaggccgaaaaggaggaggcggaatatagaaaagttttcgagaacttccttcataactccatttttgtgcccagacccgagagaaagagaagggacgtaatgcaagtggccaacaccacaatgagctcacgtagccgaaacaccacagcagctgacacttataacattaccgaccccgaggagcttgagaccgaatatcctttcttcgagtcccgagtcgacaacaaagagagaaccgtcatcagtaacctgaggcccttcactttgtacagaatcgacattcactcttgtaaccacgaggctgaaaagctcggctgttccgccagcaatttcgtttttgcccgaaccatgccagccgagggagctgatgatatacctggtcctgtaacatgggagcccagacccgagaatagcatcttcctcaaatggcccgaacccgaaaatcccaatggcctgatactcatgtacgagattaagtacggaagccaagttgaggatcagcgagagtgtgtttcacgccaagagtacaggaaatatggaggggccaagctgaacaggctcaaccctggtaactatactgccagaattcaagcaaccagtcttagtggcaacggctcttggaccgaccccgtctttttctatgttcaggcaaagaccggatacgaaaacttcatacatctgattatcgccttgccggtggccgttctgctcatagtgggcggcctggtaatcatgctctacgtcttccaccggaaacgcaataattcccgcctgggcaatggtgttttatacgcctctgtgaatccagaatacttcagcgctgctgacgtttacgtgcccgatgagtgggaggtcgctcgggagaagataacaatgtcaagagaactggggcagggaagctttggaatggtctacgaaggtgttgctaaaggggtggtgaaggacgaacctgagacgagagtggcaatcaaaacagtcaatgaagcagccagcatgcgagagagaattgagtttctgaacgaggcctccgtaatgaaggagtttaattgccatcacgtcgtccgactgctgggcgttgtgtcacaggggcagcctacactggttataatggagctgatgactaggggggatctgaagagctacctcagaagcttaaggcccgagatggaaaacaaccctgtgctcgcccccccaagcttgtccaaaatgatacaaatggcaggagagatcgcagacggaatggcctacctaaacgcaaataagtttgtgcaccgggatctggccgcacgaaattgtatggtagctgaagatttcacagtcaagatcggcgactttgggatgactcgggatatctacgaaactgattattacaggaagggggggaaaggtctactgccggtgcgatggatgagccctgaaagcctaaaggacggcgtgttcacaacgtacagcgatgtgtggtcgttcggagtggtgctgtgggagatagccacactagctgagcagccatatcagggactgagcaacgaacaagttcttcggttcgtgatggagggggggttacttgataagccggataattgcccagatatgctgtttgagttaatgcgcatgtgttggcagtacaaccctaagatgagaccgtctttcctagaaattatcagctcaattaaggaggagatggaacctgggtttcgtgaagtgagcttttattattctgaagagaacaaactgccagagcccgaagaacttgacttggagccagaaaacatggagtcagtgcccctagacccctccgcaagctcttcctccttacctttaccggataggcactccgggcataaagcggaaaacggaccaggacccggggtccttgttctgcgggcttcgtttgatgaacgacagccatacgcccatatgaatggaggcagaaagaacgagagagcgctgcctttgcctcagtcctctacatgctag

SEQ ID NO: 24529 - DNA, 543 bp, Artificial Sequence
  Description of Artificial Sequence: Synthetic coding sequence
atgggcatccccatgggcaagagcatgctggtgctgctgaccttccttgcgttcgcctcttgttgcattgccgcataccggccatctgagacactgtgcggcggtgagctggtggatactcttcagttcgtgtgcggggaccggggcttttatttctcaagaccagcctctagagtctcacggagatctaggggcatcgtggaggaatgttgctttagaagttgcgacctggcgcttctagagacgtattgcgctacccccgcaaagagtgagagggacgtgagtacacctccaaccgtgctgcctgataacttcccaaggtaccccgtggggaaattttttcagtacgacacatggaagcagtctacgcagcgccttcgccggggactgcctgcactgctgcgcgcgaggcgggggcatgtcctcgccaaggagttggaagcatttcgcgaggctaaacggcatcgtcccctaatcgcactgcccacgcaagacccagctcacggtggcgctcctcccgaaatggccagtaaccggaagtag

SEQ ID NO: 24530 - DNA, 543 bp, Artificial Sequence
  Description of Artificial Sequence: Synthetic coding sequence
atgggcatccccatgggcaagagcatgctggtgctgctgaccttcctcgccttcgcaagctgttgcattgcggcttacagacctagtgagaccctctgtggcggagagctcgtcgatactctgcagtttgtgtgtggcgaccgtggcttctacttcagtaggcctgcctctagggtaagccgcaggagtagggggatcgtcgaggaatgctgtttcagaagttgtgatctggcacttctggaaacttactgcgctactcccgccaaatcagaaagggacgtttccacacctccaactgtcttgcccgacaatttccctcggtacccggtaggcaagtttttccaatacgacacttggaagcaatccacccagcggctacgaagggggctgccagcactacttcgcgcgcggaggggccacgtgctggctaaagagttggaggctttccgagaggccaaaagacaccggccactcatcgctctgcccacgcaagatcctgcacatggaggtgccccccccgagatggccagtaaccgcaaatag

SEQ ID NO: 24531 - DNA, 552 bp, Artificial Sequence
  Description of Artificial Sequence: Synthetic coding sequence
atgggcatccccatgggcaagagcatgctggtgctgctgaccttcctggcgtttgcttcatgctgtattgcagcttaccgcccttcggagactctctgcggaggcgagttggtggataccctgcagttcgtgtgcggggacagagggttctactttaggctgccaggccgtccagcctcccgggtgtctcggaggtccagagggatcgtagaggaatgctgtttccggtcatgcgacttagctctcctagaaacttactgtgccaccccggcaaagtccgagcgggacgtgagcactcctccaacagtcttaccagacaattttccacggtacccagtgggtaagtttttccagtatgacacgtggaagcagagcacacaacgtcttcggagaggtctgccggctttattgagggctagacgcggacacgtgctcgccaaggagctcgaggcattcagagaggcaaagcgacaccgaccgctgatcgcactacctactcaggaccctgcacacgggggcgccccccccgaaatggcgtcaaacagaaagtag

SEQ ID NO: 24532 - DNA, 552 bp, Artificial Sequence
  Description of Artificial Sequence: Synthetic coding sequence
atgggcatccccatgggcaagagcatgctggtgctgctgaccttccttgccttcgcctcctgctgtatcgcggcctatagacccagtgaaacactttgtggcggagagttggtggatacactccagtttgtctgtggcgatcgcggattttacttccgactgccaggtagaccggcctcaagagtgagcaggcgctcacgaggaatcgtggaagagtgttgcttcagaagctgtgatctggccctgctcgaaacctactgcgccactccggctaaaagcgagagagatgtgtctacacccccaaccgtgctgcctgacaattttccacgatatccagtgggaaaattttttcagtacgatacatggaagcagtcaacccaaaggctgaggcggggtcttccagcactattacgagcgcggaggggacatgtcctggctaaagagctggaagccttcagggaggctaagagacacaggccattgattgcattacctacccaggaccccgctcacggcggcgctcctccagaaatggctagcaacaggaagtag

SEQ ID NO: 24533 - DNA, 543 bp, Artificial Sequence
  Description of Artificial Sequence: Synthetic coding sequence
atgggcatccccatgggcaagagcatgctggtgctgctgaccttccttgccttcgctagctgctgcattgcagcttaccgcccttcggaaacgttgtgtgggggcgagctcgtcgacacactgcagtttgtttgtggagacagagggttttacttcagcaggccagcatcaagagtctccaggcgcagccgtggaatcgtggaggagtgttgctttcgctcttgcgaccttgcacttttggaaacctactgcgcaacgccagcgaagagcgaaagggatgtttcaacgcccccaacagttcttccagataatttcccgagatacccagtagggaaattctttcaatatgacacctggaaacagagcacccaaaggctgagacgtggactccctgcacttctgagggcccgcagaggccacgttctcgccaaagagcttgaagccttccgggaagccaagaggcatagacccttgatagccctgcccacacaggaccccgcgcatgggggcgccccaccggaaatggcctcaaaccgcaagtag

SEQ ID NO: 24534 - DNA, 552 bp, Artificial Sequence
  Description of Artificial Sequence: Synthetic coding sequence
atgggcatccccatgggcaagagcatgctggtgctgctgaccttcttggcatttgctagctgttgcatagcagcctatcgtcccagcgagaccctctgtggtggagagttggttgacacacttcagtttgtgtgcggcgatcggggcttctatttccgccttcccggcaggcccgcctcccgggtttctcgcaggtctcgcgggatcgttgaagagtgttgtttccgctcgtgcgatttggccctcttggagacttactgcgcaacacccgcaaaatctgagcgagatgtttcaaccccccctacggtgctaccagacaactttcctcgctatccagtcggcaagttctttcagtacgacacttggaagcagtccactcagcggctgcggcgggggttacccgcattactaagagcgagacgaggtcacgtgctggcaaaagaactcgaggcattccgagaggctaagcgccaccggccactgatcgcccttcctactcaggacccggctcacgggggtgccccacccgagatggcttcaaatcggaagtag

SEQ ID NO: 24535 - DNA, 543 bp, Artificial Sequence
  Description of Artificial Sequence: Synthetic coding sequence
atgggcatccccatgggcaagagcatgctggtgctgctgaccttcctcgctttcgcttcctgctgcatcgctgcttaccggccatccgagacgctctgcggtggcgaattagtggacacccttcagtttgtatgcggcgaccgtgggttctacttctctaggcctgccagcagggtctccaggaggtcccgaggaattgttgaagaatgctgtttccgcagttgcgacctggctcttctcgagacatactgtgctacacccgcaaaaagtgaacgggacgttagcacacctcctaccgtcttgcctgacaattttcccagatacccagtgggtaagttctttcagtatgatacttggaaacaaagtacacagaggctgagacggggactccccgccctgctgagagcccgcagaggccacgtattggcgaaggagttagaggccttccgcgaagcaaagcgtcacaggcccctgatcgctctgccaacacaagatccggcccacggcggcgcaccccctgagatggctagtaataggaaatag

SEQ ID NO: 24536 - DNA, 552 bp, Artificial Sequence
  Description of Artificial Sequence: Synthetic coding sequence
atgggcatccccatgggcaagagcatgctggtgctgctgaccttcctggcctttgcgagctgttgcatcgccgcatacagaccgagcgaaaccttgtgcgggggggagctcgtcgataccctgcagttcgtgtgtggagatagaggcttctactttagactccccggccgcccagcttctagggtgtctagaaggtcccggggtattgttgaagagtgctgcttccggtcatgtgaccttgcactgttggagacgtactgcgccaccccagcaaaaagcgagagggacgtgtctacgcctcccactgtactcccagacaatttcccacgttatcctgttggcaagttcttccagtatgatacctggaaacaatctacacagagactccgcagagggcttccagccctgttgagggctcgccgggggcatgtgctggcgaaggagttagaagccttcagagaggccaaacggcaccgccctcttatcgccctgccaacccaagatcccgcacatggcggtgcgcccccggaaatggcctctaataggaaatag

SEQ ID NO: 24537 - DNA, 543 bp, Artificial Sequence
  Description of Artificial Sequence: Synthetic coding sequence
atgggcatccccatgggcaagagcatgctggtgctgctgaccttcctggcctttgcgagctgctgcatagctgcctatagaccatctgagacgctctgtggtggcgagttagtcgacacattgcagttcgtgtgcggtgaccgtgggttctactttagtcgtcctgcgtcccgggtgtcgcgtcgatctagaggtattgtggaagaatgttgcttcaggtcctgcgatcttgcactgttggaaacgtattgtgcaacacctgctaagtctgagcgtgatgtatcaactccccctaccgtgctgcctgacaactttccaagataccccgtaggaaagttcttccagtacgatacctggaaacagtcaacacaacggctacggcgcggcctgcctgctctgttacgagctaggaggggccacgtccttgcgaaggagttggaagcgttcagggaggctaaacgacacaggcccctcattgcactccccacacaagaccctgcccacgggggagcacctcctgaaatggcctctaatcgtaaatag

SEQ ID NO: 24538 - DNA, 543 bp, Artificial Sequence
  Description of Artificial Sequence: Synthetic coding sequence
atgggcatccccatgggcaagagcatgctggtgctgctgaccttcttggcgttcgctagttgttgtatcgccgcatatagacctagcgagacactgtgcggaggcgagttggtcgacaccctccagtttgtctgcggagaccgcggcttctatttctcacggcctgcctcccgggtatccaggcggagtcgaggtattgtggaggaatgctgttttcgaagttgcgatcttgctttgctcgaaacttactgcgccacacccgccaagagcgaaagggacgtgtctaccccgccaaccgtacttcctgataacttcccgcggtatccagtcgggaagttcttccagtatgacacctggaaacagtccacgcagaggctgaggcgcggcctgcctgcactgttacgcgccagaaggggccatgtcttagccaaagagctagaagcatttagggaggctaagcggcaccgaccactgattgcattaccgacccaagaccctgcacatggtggggctccccctgaaatggcatctaaccggaagtag

SEQ ID NO: 24539 - DNA, 711 bp, Artificial Sequence
  Description of Artificial Sequence: Synthetic coding sequence
atggtgagccccgacccccagatcatcgtggtggcccccgagaccgagctggcttcaatgcaggtgcagcggaccgaggacggcgtgaccattattcagattttttgggtaggtagaaaaggagagcttctcagaaggacaccagtctcttccgcgatgcagacacctatgggaatccctatgggcaaatccatgctggttctattgacatttctggcctttgcaagctgctgcatcgctgcctatagaccaagcgagactctttgtgggggagaacttgtcgacactctacagttcgtgtgtggagacagaggcttttacttctctcgtcccgcttcccgagtatcccgcagatctcgagggattgtcgaggagtgctgtttcaggtcctgcgacttggcgctcttggagacttattgtgctacacctgccaagagcgagcgtgacgtgagcactccccccactgtactccccgacaactttccccggtaccctgtgggaaagtttttccagtatgatacctggaagcagtcgacccagcgtctcaggcgggggcttcccgccttactgcgcgctagaaggggccacgtgcttgctaaagagctggaagccttccgggaggctaagcgtcaccgaccactcatagcattgcctacccaggatcctgcccacggcggcgccccccctgaaatggccagtaaccggaagtag

SEQ ID NO: 24540 - DNA, 876 bp, Artificial Sequence
  Description of Artificial Sequence: Synthetic coding sequence
atgcagcgggcccggcccaccctgtgggccgccgccctgaccctgctggttctgctaaggggtccacccgtggcgcgtgctggcgcttcgtccgctggtttgggcccggttgtgcgctgtgaaccatgcgacgcacgggctctggctcaatgcgctccacctcctgcagtgtgcgcggagctcgtgagggagccaggctgtgggtgctgtctgacctgtgctttgagtgagggtcaaccctgcggcatctacaccgaaaggtgcggttccgggctacggtgccagccctcaccagacgaggctcgaccgctgcaggccttgctagatggacgcgggctatgcgtcaatgccagtgccgtgtcacgactgcgggcgtacctgctgcctgctccacccgctccgggtaacgccagcgagagcgaggaagataggtccgccggctcagttgaatctccgtccgtgtcttctacacatagggtgagtgacccaaagttccatccattgcacagcaagattatcataattaagaaggggcatgcgaaggactctcaaaggtacaaggttgattacgagagccagagcacagatacccaaaatttttccagcgagtctaaacgcgagacagagtatggcccctgtcggagggagatggaggacaccctcaatcacctgaagtttctgaatgtgcttagccccaggggcgtgcatattcctaattgtgacaagaaaggcttctacaaaaaaaaacagtgcaggcctagcaagggacgaaaaagaggcttctgttggtgcgtagacaagtatggccagccgttaccaggctacacaacaaaaggcaaggaggacgttcattgttattcaatgcaaagcaaatag

SEQ ID NO: 24541 - DNA, 894 bp, Artificial Sequence
  Description of Artificial Sequence: Synthetic coding sequence
atgcagcgggcccggcccaccctgtgggccgccgccctgaccctgctggttctcctgagaggcccacctgttgcccgggccggcgcctcaagcgccggcctgggacctgtggtgaggtgtgagccctgtgacgcccgggctctcgcgcaatgcgcccccccccctgccgtgtgcgcggagttggtgcgggaacctggatgcggctgttgcctgacttgtgctcttagcgagggccagccctgcggaatttacacagaaaggtgtgggtccggactgcggtgccagcctagcccagacgaagcgcggccccttcaagctctccttgacggcagggggctgtgtgtgaacgccagcgctgtcagtcggctcagagcttatttgcttcccgcccctcctgctcctggggagcccccggcacccggaaacgcgtcggagagtgaagaggacaggtccgcgggatcggtcgaaagtccctcggtctcctctacgcaccgcgtcagcgatcccaagtttcacccgctgcactccaaaatcatcattatcaagaaagggcacgctaaggattctcagaggtataaagtggattacgagagccaatcaaccgatactcaaaacttttcctctgaaagcaagagggagaccgagtacgggccttgccgcagggaaatggaggatacactcaatcacctgaagttcctcaatgttctgagcccgaggggagtgcacatcccgaactgcgataaaaaagggttttataagaagaaacagtgcaggccaagcaaggggcgaaagagggggttttgttggtgtgtggacaagtatggacagccattacctggttacaccaccaagggaaaggaggatgtacactgttatagcatgcaatcgaaatag

SEQ ID NO: 24542 - DNA, 585 bp, Artificial Sequence
  Description of Artificial Sequence: Synthetic coding sequence
atgcagcgggcccggcccctgcaggccctgctggacggccggggcttatgcgtgaacgctagtgccgtgtcccggctgcgggcctacctgttacccgcaccacctgcgcctggcaacgctagcgaatcagaagaggaccggagtgcaggaagcgttgagtctccgtctgtgagctctacgcaccgtgttagcgaccctaagtttcacccactgcacagtaagatcataatcatcaaaaaagggcacgcaaaagatagccagcgctacaaagtggattacgaatcacagagcaccgatacacagaatttcagttccgaatccaaaagagaaaccgagtatggcccctgtcggagggaaatggaggatactttgaaccatcttaagttccttaacgtgttgagtccgcgcggagtccacatccctaactgcgacaaaaagggtttctacaaaaaaaagcagtgtcgcccaagcaaagggcgtaagcggggtttctgctggtgcgtggataaatatgggcagccactaccgggctacacaactaaaggaaaagaggatgtgcattgctattcaatgcagtctaagtag

SEQ ID NO: 24543 - DNA, 462 bp, Artificial Sequence
  Description of Artificial Sequence: Synthetic coding sequence
tgaagcgaggaggaccggagcgccggcagcgtggagagccccagcgtttcctcgacccatagggtctctgaccccaagttccaccccttgcattctaagatcattatcataaagaaaggccacgcgaaagacagccagagatacaaagttgattacgagtctcagagcactgatactcaaaatttcagcagcgaaagtaaaagggaaacagaatacggaccttgccggcgcgaaatggaagataccctgaatcaccttaagttcttgaacgttctctcccctagaggcgtacacattcccaactgcgataaaaagggattttacaaaaaaaaacaatgtcgaccatccaaggggcggaaaagggggttctgctggtgcgtggacaaatacgggcagcccttacccggctacacaaccaaagggaaggaagacgtccactgctattctatgcagtcaaaatag

SEQ ID NO: 24544 - DNA, 432 bp, Artificial Sequence
  Description of Artificial Sequence: Synthetic coding sequence
tgagagagccccagcgtgagcagcacccaccgggtgagcgaccccaagtttcatccactacatagtaagattatcatcatcaagaaaggccatgccaaggactcccagaggtataaagtcgattacgaatcccaatccactgacactcagaacttttcaagcgaatccaagagagagactgaatatggtccatgtcggagagagatggaagacaccctcaaccatttaaaattcctcaacgtgctatcccccagaggagtgcatattccaaactgtgacaaaaaaggcttttacaagaagaagcagtgccgtccgtctaagggaaggaaacgggggttctgctggtgtgtcgacaagtacgggcagcccctccctgggtatacaacaaaggggaaggaagacgtccattgttactccatgcagtcaaagtag

SEQ ID NO: 24545 - DNA, 792 bp, Artificial Sequence
  Description of Artificial Sequence: Synthetic coding sequence
atgcagcgggcccggcccaccctgtgggccgcctgcgagccctgcgatgcccgggccctcgcacagtgcgccccccctccagctgtctgcgccgaactggtccgggaacccggatgtgggtgttgtctgacatgtgccctgtcggaaggacagccatgtggtatctatacggaaagatgcggcagtggcctcagatgccagcctagccccgacgaggcacgaccactgcaagcactcttggacgggcgcgggctgtgtgtaaatgcctcagctgtctctcgtttacgggcctaccttttaccagctcctcccgcacctggcaacgcctctgagtcagaagaagaccggtcagcaggatcagtggagagcccatccgtttcatctacacaccgagtgagcgaccctaaattccaccctctgcactccaagatcatcatcattaaaaaggggcatgccaaggactcccaaagatacaaggtggactacgaatcacagagcacagatacacagaactttagcagcgagtcgaaacgtgaaacagagtatggtccttgccggagggagatggaagacacccttaaccatttaaaattcctcaatgttttgtccccccgcggtgtgcatatcccaaattgcgataaaaaaggtttttacaaaaagaagcagtgcagaccctcaaaaggacgaaaaaggggcttttgctggtgtgtggacaaatatggccagcccctgccaggctatacaaccaaaggtaaggaggacgtccactgctatagcatgcagagcaaatag

SEQ ID NO: 24546 - DNA, 834 bp, Artificial Sequence
  Description of Artificial Sequence: Synthetic coding sequence
atgcgggccctgcggctgggcgccgaggaccagcccctgcccgcctggatcccccagctgagagctgtgtactgccggcctataccggccaggccggcgtgccaagccgcctgccctggttgccggcgtcatgccgcaggagccacccatgccctaggacgctgcgccgatagcgcaggagcagcccctagagccgctggtggggctggctggagggaactgggcgggctgggttcaaggggcgcattgagggctgtgagacatcttcatcgtgcactactggacggtagggggttgtgcgttaacgcctctgccgtgagccggcttagagcctatttgcttcccgctccacccgctcccgggaacgcttcggaaagcgaggaagatcggagcgcaggcagcgtggagagtccttccgtgtcaagcacacatcgggtttctgatcccaagttccaccccctccacagtaagataattatcatcaaaaagggccacgccaaggacagtcaacggtataaagttgattacgaatctcagagtacagacacacagaattttagctcggagtctaaaagggaaacagaatatggcccctgccgacgagagatggaagatactttgaaccatctgaagtttctgaatgtcctttcaccacgcggcgtgcatatccccaattgtgataagaaaggcttttacaagaagaaacaatgtcggccatccaaaggacgtaagagaggattctgttggtgcgtagacaagtacgggcaacccctgccaggttacacaacgaagggcaaagaggacgtccactgttattctatgcagtcgaagtag

SEQ ID NO: 24547 - DNA, 570 bp, Artificial Sequence
  Description of Artificial Sequence: Synthetic coding sequence
atgcagcgggcccggcccaccctgtgggccgccgccctgaccctgctagatggccggggactgtgcgcttatcttctccccgccccccccgcaccgggcaatgccagcgagtccgaggaagatcggtctgcaggatccgttgaaagcccctcagtatcttccacgcatcgggtttctgatcccaaattccaccctcttcactctaagatcattattatcaaaaaagggcatgctaaggacagccagagatacaaggtggattacgaaagtcaatccactgacacgcagaatttctcatccgagagcaagagggaaacagaatatggtccttgccgacgcgagatggaggataccctcaatcatctgaagtttctaaacgtccttagccctcgtggagtgcacattcccaattgcgacaagaagggattttataagaaaaagcagtgtcgcccttcaaaagggcgtaagcgtgggttctgttggtgtgtggataagtatggccagcctctgccgggctacaccacaaaaggtaaggaagacgttcattgttattctatgcagtcaaagtag

SEQ ID NO: 24548 - DNA, 807 bp, Artificial Sequence
  Description of Artificial Sequence: Synthetic coding sequence
atgcagcgggcccggcccaccctgtgggccgccgccctgaccctgttggtgcttcttagaggtccccctgtcgcccgagccggtgcatcatccgctggcctggggccggtggtgcggcgcgaacctggttgcggctgctgtttgacatgtgcactgagtgaggggcagccctgcggcatttacactgagcgttgtggcagcgggttgcgatgccaaccgtcacccgacgaggcccggcctctccaggccctgctggacgggcggggactctgcgtgaatgcctcagcggtttccagactgagagcatatctcctgcccgccccacccgcaccgggcaacgcgagtgagagcgaggaggatagatcggccggcagtgtagagagcccttccgtatcgtctacccacagagtgagcgaccccaagttccatccgctgcactccaaaattattattattaagaaaggtcatgcaaaggactcacaaagatacaaagtcgactatgagtcccaatctacagacacccagaacttcagcagcgagtctaagcgagagactgagtacggtccttgcaggcgagaaatggaagacactctgaatcacctaaagttcctcaatgttcttagtccacgcggcgtgcacattcctaactgtgataagaagggcttttataagaagaaacaatgcaggccgagcaaggggagaaagagagggttctgttggtgtgtcgataagtatgggcagccactaccaggctatacgacaaaagggaaggaagacgtacattgctactctatgcagtcaaagtag

SEQ ID NO: 24549 - DNA, 978 bp, Artificial Sequence
  Description of Artificial Sequence: Synthetic coding sequence
atgctgccccgggtgggctgccccgccctgcccctgcccccccccccccttctgcctctgctgctcctgttactgggggcatctggcgggggagggggggctcgggcggaagtgctgttccgctgtcccccatgtacacccgagagactcgctgcatgtgggcctccccccgtcgccccgcctgcagctgttgccgccgtggccggcggagctaggatgccctgcgctgagctagtgcgagagcccggttgtggttgttgctcagtatgtgcccgcctagagggtgaggcctgcggagtctacactccacgctgcggccaagggttgaggtgttatccccacccagggtctgaactgccgcttcaggctctggtcatgggtgaaggaacctgtgagaagagaagagacgcagagtacggcgcttctcccgagcaggtggctgacaatggggacgaccacagcgaaggaggtctggtggagaaccacgtggactctacaatgaacatgctcggtggtgggggtagcgctggacggaaaccactgaaatccggcatgaaagagctggccgtgtttcgagagaaagttactgagcaacataggcagatggggaagggcgggaagcatcatcttggcttggaagaacctaaaaagctgaggccaccaccagctcgtacaccatgccagcaggagctggaccaggtgttggaacgtattagcaccatgagactcccagacgagaggggcccactggagcacttatactcactacacattccaaactgcgataaacacggcctgtacaatctgaagcagtgcaaaatgagtctgaacggccagcgcggggagtgctggtgtgtgaatcctaataccggaaaactcatccaaggggcacccaccatccggggagatcctgagtgccatctgttttacaatgaacagcaggaggcccgcggcgtccatacacagagaatgcagtag

SEQ ID NO: 24550 - DNA, 3099 bp, Artificial Sequence
  Description of Artificial Sequence: Synthetic coding sequence
atggcctgggaggcccggcgggagcccggcccccggcgggccgccgtccgagaaacagtgatgctgctgctgtgccttggggtgcctaccggccggccctataacgtggacacagaatccgcgttgctgtatcagggtcctcacaataccctgttcggatactcagtggtccttcattctcatggcgccaatcggtggctgctggttggcgctcctaccgcaaactggctggcaaacgcatccgtgatcaatcctggagcaatttacaggtgtcgcatcggcaaaaacccaggacagacctgcgagcagctgcagcttggaagccccaatggagagccgtgtgggaagacctgtctggaggaaagggacaaccagtggctcggtgtgacgctttctcgccaacctggagaaaacggctcaatcgttacttgcggccaccgctggaaaaacatcttctacattaagaacgagaacaagcttcccaccggcggttgctacggggtgccaccagatctcagaaccgaactaagtaagcgtattgccccttgttatcaagactatgtcaaaaaatttggggaaaactttgcaagttgtcaggcgggtattagctctttctataccaaggatttgatcgtcatgggcgcaccaggctcttcatactggactggatcgctcttcgtctacaatataaccacgaataaatacaaagcattcctcgataaacaaaaccaggtcaaattcggatcctaccttggctactccgtgggggccgggcacttccgctcccagcatactactgaggtggtaggtggagccccgcagcacgagcagattggtaaagcgtatatcttctctattgatgagaaagaactgaatatcctgcacgagatgaagggtaagaaactggggtcctatttcggagcaagtgtctgcgccgtagatctaaatgctgacggattctccgacctgctagtcggggcaccaatgcagtccaccatcagggaggaagggcgagttttcgtgtatatcaacagcggctccggagccgtcatgaatgctatggagacaaacctggtgggaagcgataaatatgccgctcgctttggcgagtcaatagtcaacctgggcgacatagataacgatggctttgaggacgtcgcaatcggggcgcctcaggaggatgatctgcaaggagccatttacatatataatggaagggccgacggaatctcatctaccttttcgcagcggatcgagggcttacagatctccaagagcctcagcatgtttggtcagtccatcagcgggcagatagacgctgataacaatgggtacgtggatgtggcagtgggcgctttcagaagtgatagtgcagtcctccttaggacaaggcctgtagtcatcgtagacgcatccctttcacacccagagtccgtgaataggacgaaatttgactgcgtggaaaatggttggccaagtgtttgcattgatctgacattgtgctttagctacaagggtaaagaagtgccgggctacatcgttctgttctataacatgtcgttggacgtaaaccggaaggcagagtcaccacctcgattctacttcagctcaaatggcacgagcgatgtgattacaggctccattcaggtctccagtagagaggccaactgtcgcactcaccaggcattcatgcggaaggatgtgcgggacattctgactccaatccaaatcgaggctgcataccatctgggcccacacgttatttcaaaaaggagcactgaggagttcccaccattgcagcccattctccagcaaaagaaggagaaggacataatgaaaaaaaccataaatttcgccaggttttgcgcacacgagaactgcagtgccgatctgcaggtgagcgctaaaatcgggttcctgaagccccatgaaaacaagacttatctcgcggtgggatctatgaagacccttatgttaaacgtttccctcttcaacgctggtgacgatgcgtacgagaccaccctgcatgtgaagcttcccgtaggactctacttcattaaaatactcgagctcgaggagaaacagattaactgcgaggtcacagacaattccggggtcgtgcagcttgattgtagtatcggatatatttacgtagaccatctctctcgaatagacatttcttttctcttggacgtgtcaagtctttcccgggcagaagaagatttatcaattactgtgcatgcaacgtgcgagaacgaagaggaaatggataacttgaagcactctcgcgtaactgttgctatacccttgaagtatgaggtcaagcttactgtacatgggtttgtcaaccccacctccttcgtgtacggatcaaatgatgaaaacgaacccgaaacatgcatggtggagaagatgaacctgactttccatgtgattaatacggggaattctatggctccgaacgtgtccgtggaaattatggtgcccaacagcttcagcccacaaacagacaagttgtttaatatcttggacgtccagaccaccaccggcgagtgtcactttgaaaattaccagcgtgtatgcgccctggaacagcagaaatctgccatgcagacccttaagggcatcgtccggtttttgtccaagacagataagaggctgctgtattgtattaaagcagatcctcactgcctcaatttcctgtgcaattttggcaaaatggagagtggtaaggaagccagtgtccatatccaattggaaggacgcccaagtatactggaaatggacgagacaagcgcactgaaatttgagattcgcgcgactggcttcccagaaccaaatccccgggttattgaactcaataaggatgaaaatgtggctcacgtgctgctggaggggctccaccaccaacggccaaagcgttatttcaccatcgtcatcatatcctcttcactcttgctaggtctgatcgtgctgttacttattagctacgtgatgtggaaggcaggcttttttaaacggcagtacaagagtatactgcaggaggagaataggcgcgattcctggtcgtacatcaattccaagtccaacgatgattag

SEQ ID NO: 24551 - DNA, 1854 bp, Artificial Sequence
  Description of Artificial Sequence: Synthetic coding sequence
atggcctgggaggcccggcgggagcccggcccccggcgggccgccgtgcgggagactgttatgctgctgttgtgcctcggggtccccactggacgcccctacaacgtggacaccgagtccgccctgctgtaccaagggccgcacaatactcttttcggctatagcgttgtcctacattctcatggggcaaatagatggttactggtaggcgctcccacagctaactggctggccaatgcgagcgttattaacccaggggccatctaccgatgtagaattggcaagaaccctgggcagacatgcgagcagctgcagctggggtcaccaaatggcgagccctgcgggaagacttgcctggaggagcgcgataatcagtggcttggcgtgactttgagtcggcagcccggggaaaacggaagcatcgtcacctgcggacatcggtggaaaaacatcttttatattaaaaatgaaaacaagctccccacaggcggctgctatggggtgcctccagacctacgtaccgagctttcaaaaaggatcgcaccctgttaccaggactacgtcaagaaattcggagagaactttgctagctgtcaggcaggtatcagcagtttctacacaaaggacctcattgtgatgggtgctcctggaagctcctactggaccggtagtctgtttgtatataacatcactacaaataagtataaggcattcttggacaaacagaatcaagtcaagtttggcagctacttaggatatagcgtgggcgccggacactttcgatcacagcacacgaccgaagttgtgggtggcgctcctcagcacgagcaaattgggaaggcctatattttcagcatcgatgaaaaggagctcaacatcctccacgaaatgaaggggaagaaactggggagctatttcggcgccagcgtatgtgctgtggatcttaacgccgatggtttttcggacctgctggtgggcgcccccatgcagagtacaatccgggaagagggaagggtgtttgtgtatattaacagcggttctggcgccgtgatgaacgccatggagacgaaccttgtggggagtgacaagtatgctgcccggtttggggagagtatcgtgaatctgggtgatattgacaacgatggcttcgaagatgtcgctattggcgccccccaggaagatgatttgcagggggccatctacatctataatgggcgtgcagacggtatcagtagcacgttctcccagagaattgaaggactgcagatatcaaagtccctctccatgttcgggcaatccatcagcggacaaatcgatgcagacaacaatggctatgtcgacgtcgcagtgggggcctttcggtcagactcagccgtcctgctccgaacccgcccggtggtgatcgtggacgccagtctgagccaccccgaatcggttaatcgtacaaagtttgattgtgtggagaacgggtggccgagcgtgtgtatagacttaaccctatgcttctcctacaagggtaaggaagtgcctggttacatcgtgttgttctataacatgtcactagatgtcaaccgcaaagctgagtcccccccaagattctattttagcagcaacggcacctcagatgttatcaccggcagcatccaggtgagctccagggaagccaactgtcggacccaccaggccttcatgcgcaaagacgtgagggacattctgacacccatccagattgaagctgcctatcatcttggcccccatgtgatctcaaaacgcagcaccgaagagtttcctcccctgcagccaattctgcaacagaagaaggaaaaggatattatgaagaaaaccaaaaagtag

SEQ ID NO: 24552 - DNA, 3150 bp, Artificial Sequence
  Description of Artificial Sequence: Synthetic coding sequence
atgggcagccggacccccgagagccccctgcacgccgtgcagctgcggtggggacctcgccgtcgtccacctctactaccgctgctccttctgctgcttccacccccaccaagggtaggtggctttaatctggacgccgaagcacccgctgtcttaagtggacccccggggtcctttttcggattctccgtggagttctatcgacccgggactgacggggtgtccgttctggttggggccccgaaggcaaatactagtcagccaggggtactgcaggggggggctgtttacttgtgcccatggggtgcatcacctactcaatgtacacctatcgagtttgacagcaaagggagtcggctacttgaatcatccctatcctcctccgagggggaggagcctgtggaatacaagtcactgcaatggttcggagctacagtaagagctcatggctcttcaatcctcgcatgtgcccccctgtatagttggaggacagagaaagaaccgcttagtgaccccgtaggcacttgctacttgagcactgacaacttcacccgtattctcgaatacgcaccatgccgatccgatttctcttgggcggccggtcagggttactgccagggaggattttccgcagagttcacaaagaccgggagggtagtgctgggcggtcccggttcttatttctggcagggtcagatcctttctgccacccaagagcaaattgcagagtcatactaccctgaatacttgattaatttggtgcagggacagctgcaaacgcgccaggcctcaagcatttatgacgactcctacttggggtattctgtcgctgttggggagttttctggagacgatacggaagattttgtggcaggtgtgcctaagggcaatcttacttacggctacgtgaccatcctcaacggttccgacatcagatccctttacaatttcagcggcgaacagatggcatcgtacttcggctacgccgtggctgctacagacgtcaacggagacgggttagacgatctccttgtaggagccccacttctgatggaccggaccccagacggcaggccccaggaggttggccgcgtttatgtttacctacagcacccagccggtatcgagcctactccaactctcaccctgactggccacgacgagttcgggcgatttggatctagtctgaccccactcggagacttggaccaagatggctacaacgacgtggctattggtgccccattcggtggagagactcagcagggagtggtcttcgtgttccctgggggacctggcggcctgggaagtaaaccctcacaggttcttcagcccctgtgggctgcgtcacacaccccggatttttttggtagtgccctcagaggtggccgtgacctggacggaaatggctatcctgatttgattgtaggctctttcggagtggacaaggccgtcgtctacaggggcaggcctattgtgtccgcttctgccagtctcacaatcttccctgccatgttcaaccccgaagagcggtcatgtagcctcgaaggaaacccagtcgcctgtatcaatctttctttttgcctcaatgcttcagggaaacacgtcgctgattcaatcggtttcacggtggaactgcagctcgattggcagaaacagaaaggtggagttaggcgggcactattccttgcaagcagacaggcaacgctgactcagactctgttaatccagaacggcgctcgcgaagactgtcgtgagatgaaaatctacctgaggaacgagtctgaattcagggacaagctgagtccgatccacatcgccctgaacttcagtttagatccccaagcacccgttgattcccacggcttgcggccggcacttcattaccagtccaaaagcagaattgaagataaagctcaaatcttgcttgattgtggagaagataatatctgcgtacccgatctgcagctggaagtgttcggcgagcaaaatcacgtgtatctgggagataaaaatgctctgaatctgacgttccatgcacagaatgtgggcgaaggcggtgcatacgaggccgaactgcgggttaccgcaccaccggaggcagagtacagcggcctggtgcgccaccccggcaatttcagtagcctgtcttgcgattatttcgctgttaaccagagtagactgctggtttgcgacttgggcaacccgatgaaagctggcgcgtctctgtggggaggcctgcggtttacagttccacatctgagagacaccaaaaagaccatccagttcgattttcagattctctcaaaaaacctgaacaatagtcaatccgacgtagtttcttttcgtctcagcgtagaagctcaagctcaggtcacactgaacggggtttcaaaacctgaagccgtgttgtttccagtgtccgattggcaccccagagaccagccccaaaaagaagaagacctgggcccagcagtacaccacgtttatgagttgatcaatcaggggccctccagtatttcgcagggagtgctggagctgtcatgtccccaggccttagaaggacagcaactgctctatgtgacacgagtgactgggctgaactgcacaaccaaccacccaattaaccctaaaggtctggaactggatcccgaaggctcattgcaccaccagcagaagcgcgaggctccgagtcgatccagcgcttctagcggcccacaaattttgaagtgccccgaagccgaatgtttcaggctgcggtgtgagctgggccccctgcaccaacaggagtcccagtcacttcaactccattttcgcgtatgggcaaaaacattcctccaacgggaacaccagcccttcagtcttcaatgcgaggccgtatacaaggccctgaaaatgccctaccggatccttccccgtcagctgccccagaaggagcgtcaggtggctacagcagtgcagtggactaaagctgaaggatcgtacggggtgcccttatggatcatcattctggctattctgtttggattattactcctaggattgctaatctatatcctgtataaattggggttcttcaagcgtagcctcccttacgggaccgccatggagaaggctcagttgaagccccctgccactagcgatgcatag

SEQ ID NO: 24553 - DNA, 3393 bp, Artificial Sequence
  Description of Artificial Sequence: Synthetic coding sequence
atggccgccgccggccagctgtgcctgctgtacctgagcgccggcctgctctctcgtctcggcgccgcattcaatttggacacaagagaagataatgtgatcagaaagtacggcgaccccggcagcctgttcggcttcagcttggccatgcattggcagctgcagcccgaagataagcgcttactcctggtgggggcccctcgtgcggaggccctacctctgcaacgggcaaatcgcacaggcggcctttactcctgcgacatcacagcaagggggccttgcacccggatcgaattcgacaatgacgcagatccaacatctgaatccaaagaagaccagtggatgggcgttaccgtgcagtcccaagggcccggagggaaggttgtgacctgtgctcaccgttacgagaaaagacaacatgtgaacacgaaacaggaatcacgtgacatattcggccgatgttacgtgctcagtcagaaccttaggattgaggacgatatggatggaggggattggagtttttgtgacgggcggctaagaggacacgaaaagttcggttcatgtcagcagggcgttgcagctactttcaccaaggacttccattatatcgtgtttggcgccccaggcacctacaattggaagggcatcgttagggtggagcagaagaacaacaccttcttcgatatgaatatcttcgaagacgggccatacgaagttggcggggagacggagcatgatgaaagtctggtcccggtgcccgctaacagctatctgggactactctttctgaccagcgtctcgtatacagaccccgatcagtttgtgtataagactaggccaccacgcgagcaaccagataccttccctgatgtaatgatgaatagttacctgggattctcacttgattctgggaaagggattgtttctaaggatgaaatcacctttgtgtctggtgcccctcgggccaatcactcgggagccgttgtacttctgaagcgtgacatgaagtccgcccatcttctgccagaacatattttcgacggggaaggcctcgcatctagtttcggctatgacgtcgcagtagtagacctgaataaggacggatggcaggacatcgttattggcgcgccacagtactttgacagggacggcgaggtaggcggcgccgtgtatgtttatatgaatcagcagggtaggtggaataatgtcaagcccattcgactgaacgggactaaagacagtatgttcggtatcgcagtcaagaacattggggatattaatcaggatggctatccagacatcgccgtgggggccccttatgacgacttaggaaaggtcttcatctaccatggctccgcgaacggcattaacacaaaaccaacccaggtcctaaaaggtatttctccttacttcgggtattcaatcgccgggaatatggacctggatagaaatagctatccagacgtggccgtcgggagtctgtcagactctgtcaccattttccggtccagaccagtgatcaacatccagaaaactatcactgttactcccaaccggatcgacttgcggcagaagaccgcttgtggagccccttctggcatctgcctgcaagtgaaatcatgttttgaatatacagccaacccagccgggtataatcctagtataagcattgtggggacacttgaggccgagaaagaacgaagaaaaagcgggctgagtagccgggttcagtttcggaatcaaggatcggaacccaagtatacacaagagcttactctaaaacggcagaagcaaaaagtttgtatggaggagacactctggctacaggacaacattcgggacaagctgaggcccattcccatcacagcctccgtggagatacaagagccatcatccagacggcgcgtaaacagcctcccagaggtgctgcctatactgaatagcgatgaacctaaaaccgcccacattgatgtgcacttcctcaaggagggttgtggggatgacaacgtgtgtaattctaaccttaaactggagtacaagttctgcacccgtgaagggaaccaggacaaattttcttaccttccgattcagaagggcgttccggaattggttcttaaggatcagaaggacattgcacttgaaatcaccgtgacgaattccccttccaatccccgaaatcccaccaaagacggcgacgacgcccatgaggctaagctcatcgcaacctttcctgacaccttgacatactctgcctaccgcgaattgcgtgcattcccagagaagcagctatcttgtgtagccaaccagaacggatcacaagctgactgcgaattggggaatccttttaaacggaattccaatgtgactttttacctcgtgctgagtaccacggaagtgacattcgataccccggatctcgatattaacttgaagttggagaccacatccaatcaggacaacttggcgcccatcacagctaaggcgaaagtggtcatagagctcttactgtctgtgagcggggtggctaagccctcccaggtgtattttggcggcaccgtggtcggggagcaagccatgaaatctgaggatgaggtggggtcacttatcgagtacgagttcagggtgattaacctaggaaaaccgctaacgaacctgggcacagctactctgaacatccaatggccaaaggaaatttcaaatggcaagtggctactgtacctggtgaaggtcgaaagtaaaggactggagaaggtaacttgtgagccccagaaagagatcaattctttaaatctgaccgaatctcataattcgcgcaagaagcgggaaatcacagagaaacaaattgacgataaccggaagtttagcctgtttgcagaacgcaagtaccagacactcaattgctctgtgaatgttaactgtgtcaatatccggtgccctctgagaggactcgactccaaagcctcgctgatcctcaggtcacggttgtggaatagcaccttcctggaggagtattccaagttaaactacctagacattctcatgcgggcattcattgacgtcacagctgcggctgaaaatatccgcttacccaatgctggaacacaggttagagtgaccgtgttcccatcgaagaccgttgctcagtattcaggggtgccctggtggatcatcctggtcgcaattttggccggtatcctaatgctcgccttgttagtgttcatcttatggaaatgcggcttcttcaagcgctcaagatatgacgattccgtgcctcggtaccacgccgttcgcataagaaaggaagaaagggagattaaagacgagaagtatatcgacaatctcgagaaaaagcagtggattaccaagtggaatgagaatgaaagttacagctag

SEQ ID NO: 24554 - DNA, 3222 bp, Artificial Sequence
  Description of Artificial Sequence: Synthetic coding sequence
atggccgccgccggccagctgtgcctgctgtacctgagcgccggcttgctctctaggcttggagccgccttcaatctggatacacgagaggataacgttattagaaaatatggagatccaggtagcctgttcggattcagcctcgcgatgcattggcagcttcaaccggaggacaaaaggctactgctggtgggggctccccgtgcggaggccctcccgttacagcgggcgaacagaacagggggcctgtacagttgtgacattactgcaaggggtccctgcacccggatcgaattcgataatgatgccgacccgacgtctgagtctaaggaagatcagtggatgggggtgaccgtacaatcccagggccctggtgggaaagtcgttacctgcgcacaccgatatgagaaaaggcagcacgtgaatacgaagcaagagtcccgggatatattcgggcgctgttacgtactgtctcagaaccttcgcatcgaggacgacatggacgggggcgattggtccttttgtgatgggagattgagagggcacgaaaagttcggctcctgtcagcagggggtcgccgcgacattcactaaggactttcattatatcgtgtttggcgccccaggcacctacaactggaagggaattgtgagggtcgagcagaaaaataatacattcttcgatatgaatatatttgaagacggcccctatgaggttggaggcgagacggaacacgacgagagcctggtgccggtgcctgccaattcctacctaggtttctcactggacagtggcaagggcatcgtatccaaggatgagatcacattcgtttcgggcgccccaagggcaaatcattctggagcggttgtgttgctgaaacgtgacatgaaatcagctcatctgctgcctgaacacatcttcgacggcgaggggctcgcctctagcttcgggtacgatgtcgctgtggtagatctgaataaagatggctggcaggatattgtgatcggcgcccctcagtactttgatagggacggagaagtaggcggggccgtgtatgtgtatatgaaccagcagggccgctggaataatgtgaagcctattcggctgaacggcactaaagactctatgttcggtatcgcggtgaaaaacataggtgatatcaatcaagatggctaccctgacattgcagtgggtgcgccttacgacgacctcggtaaggtgtttatctaccatggctctgcaaacggtataaacacgaagcctacacaggtactaaaaggcatatctccttactttgggtactccatagctgggaatatggacttagatcggaactcgtaccccgatgtagcggtgggcagcctctctgatagtgtgaccatctttcgaagccgtccagtaatcaacatccagaagaccattaccgtgacacctaacagaatagatctgagacagaagaccgcatgtggggccccgagtggcatttgcctgcaggtgaagtcttgctttgagtacactgctaaccccgctggctataatccttcaattagcatcgttggcactttagaggcggagaaagaacgtagaaagagtggcctaagcagtagggttcaatttagaaaccaagggtccgaaccgaaatacacacaagaactgactttgaagcgacagaagcagaaagtttgcatggaggagactctctggctccaggacaacattagagacaagcttcgccctatcccgataactgctagcgtggagatccaggagccaagctcccgccggagagtgaactctctgcccgaggtattacctatcctgaactcggatgaacccaaaactgcccacatcgacgtgcacttcctgaaagaagggtgcggtgacgacaacgtgtgtaacagtaatctgaaactggagtacaagttctgtactcgagaaggaaaccaagataagtttagctacctgccaatccagaagggtgtgccagagcttgtgctgaaggaccagaaagacattgccctggagatcaccgttactaacagtccgtcaaacccgcgcaatcccactaaggatggcgacgacgcccatgaagcaaagctcatcgccactttccctgatacgctcacgtatagtgcatacagggaactccgagctttccccgaaaaacagctgtcctgcgtggctaatcagaacggaagtcaggccgattgtgagctgggtaatccttttaagaggaactctaacgtgaccttctatctagtgctgtcaacgacagaagtcacatttgacacaccagatttggatatcaacctgaaactagagactacttccaaccaggataatctggctcccattacagcgaaggctaaggtggttattgagttgttgctatcggtgagcggagttgcaaaacccagtcaggtttacttcggcggcactgtggtgggggagcaggccatgaaaagcgaggatgaggtcggaagcttaatcgagtacgagttccgggttatcaatctcggcaaacctttaacgaacctaggtaccgcaacgctgaacatccagtggcccaaggagataagcaatggcaagtggttgctgtatctagtgaaagtcgagagcaaggggttagaaaaagtcacttgtgaacctcagaaagaaatcaattcacttaacctaaccgagagtcataattctaggaagaagagggagatcaccgagaagcagatcgacgataataggaagttctctttgtttgcagagcgcaagtaccaaactctaaattgctccgtcaacgtaaactgcgttaacattcgctgtccgctgaggggactcgattccaaagcatctctgatcctgagaagcaggttgtggaatagcacctttctggaagaatacagcaagctgaactatcttgacattctgatgcgcgcttttattgacgtaaccgccgcagctgagaacatacggctcccaaacgctggaactcaagtgcgcgttactgtgttcccttccaaaactgtggcacagtattctggggtcccatggtggatcatactggttgccattttggcaggaatcttgatgctcgccctgctggtgtttattctttggaaatgtgggttctttaaaaggaataagaaggatcactatgacgctacgtaccataaggcagagattcatgcccagcccagtgataaggagaggttgacctctgacgcctag

SEQ ID NO: 24555 - DNA, 3207 bp, Artificial Sequence
  Description of Artificial Sequence: Synthetic coding sequence
atggccgccgccggccagctgtgcctgctgtacctgagcgccggcctcctttctaggctcggcgccgctttcaatcttgataccagggaggacaacgtgatcagaaagtatggtgaccctggaagtcttttcggattcagcctcgccatgcactggcagctgcagccggaggataagcggctcctgctggtgggggcccccagggcagaggctcttccactgcaaagagctaataggaccggaggtctgtacagttgtgatatcaccgctcgggggccctgtacacgtattgaattcgacaatgacgctgaccctaccagtgagtcaaaagaagatcaatggatgggagtcactgtacaatcccaaggaccaggggggaaggttgtgacatgtgcccaccggtatgaaaagcgacagcacgtgaacacaaaacaagaatcaagagacatctttgggcgctgctatgtgctatcacagaacttgcgcatcgaagacgatatggatggcggcgactggagcttttgtgacggccggttacgcgggcacgagaagtttggctcatgtcaacaaggcgttgcagccaccttcacaaaagactttcactacattgttttcggcgcacctggaacatataattggaagggactgctgtttctgacctctgtttcatacacggatcctgaccagtttgtgtacaaaactcggcccccaagggaacagcccgatacgtttcctgatgtcatgatgaattcctatctggggttctctcttgattctggaaagggcatcgtgagcaaggatgaaattaccttcgtttcgggtgcaccaagggcaaatcactccggcgccgtggttcttctgaaacgagatatgaagagcgcgcacttattgcctgagcacattttcgatggagaggggttggcttccagtttcggatatgacgtggccgtcgtggatctgaacaaggacgggtggcaggatatagtgatcggtgctccacagtatttcgacagagacggtgaagtcgggggcgcggtttacgtttatatgaatcagcaagggaggtggaacaatgtcaagccaattaggttaaacggcacaaaggactcaatgttcggtatcgccgtgaagaatattggtgacatcaaccaagacggatacccagacatcgccgtgggtgccccttatgatgatctgggcaaggtatttatctatcacggatccgctaacggaattaataccaaacccactcaggtcctgaagggaatcagcccctacttcggatatagtattgcaggtaacatggatctggatagaaactcttaccctgatgtcgccgtcggttcgctgtctgactctgtcacgatattccggagccgccccgtgatcaacatccagaagaccatcacagtgacacctaacagaatagaccttagacagaagaccgcttgtggcgctccgagtggcatctgcctgcaggttaaatcttgcttcgagtacacggccaatcccgccgggtacaatccatcgatcagtatcgtggggacattggaggcagagaaggagaggaggaagagcggactgtctagccgggtacagttcaggaatcaaggaagcgagcccaaatacacacaagaactaacacttaaacggcagaagcagaaggtttgcatggaggagaccctttggcttcaggacaatatacgtgacaaactccggcccattccaatcacagcttccgtagagatccaggagccttcatctcgacggagggtgaattccctgcctgaggtgcttccgattctcaattcagatgagcctaaaacggctcacattgatgtgcactttttaaaagaagggtgtggggacgacaacgtatgtaatagcaacctcaagctggaatataagttctgtactcgggaaggaaaccaggacaaatttagctatcttcctattcagaaaggggtgccagagcttgtgctgaaggaccagaaagacatagccctggagatcaccgtgacaaatagtccgtctaatcctcgtaacccgacaaaggacggagacgatgcgcacgaggcgaaactgatcgctacctttccagataccctgacttactctgcctaccgcgaactgagagcgttccccgaaaagcagttgtcctgcgtcgcaaaccagaatggatcccaggcagactgtgagttgggaaacccctttaaaagaaatagcaacgtgacgttctacctggtgctgtccactacagaagttacatttgatactccggatcttgacattaacctgaaactggaaacaacaagcaaccaggacaatttagctccaattaccgcaaaagcgaaagtcgttatcgagctactcctatcagtgtctggagtagccaagccaagccaggtctactttggcggcactgtagtgggcgagcaagctatgaagagcgaagacgaagtcgggtcacttattgaatacgaatttcgtgttatcaatctgggaaaacccctcaccaacctgggaacggcaaccctcaacatccagtggcctaaggagatttcaaatggcaagtggctgctctacctggtgaaggttgaaagcaagggtctggagaaggtaacctgcgagccgcagaaagaaattaatagcctcaatttgactgagagccataacagccggaagaaaagagagattacggagaagcagatagacgataatagaaagttctcgctttttgccgagaggaagtatcagacactgaattgctcagtgaacgtaaactgcgtgaatattcggtgcccccttcgcggacttgatagtaaggcaagcttgatcctgagatcccgcttatggaacagtacatttttggaggagtactctaaactgaactatctggacatcctcatgcgcgctttcatcgacgtgaccgctgcagcagagaatataaggctcccaaatgccgggacccaagttcgcgtcacagtttttccgtccaaaactgtcgctcagtatagcggcgtgccttggtggattatcctcgttgctatcctggcgggcattctgatgctggcactcctcgtcttcatcctgtggaagtgtggcttcttcaagcgcaacaaaaaggaccactatgacgctacttatcataaggctgagatccacgcacaaccatcagacaaggaaaggctgacatccgatgcctag

SEQ ID NO: 24556 - DNA, 3339 bp, Artificial Sequence
  Description of Artificial Sequence: Synthetic coding sequence
atggccgccgccggccagctgtgcctgctgtacctgagcgccggcctccttagccgtctcggtgccgcttttaatctcgatacacgggaggacaatgtgatcagaaaatatggagatcccggaagcctgtttgggttctctctggcaatgcattggcagttgcaaccagaggacaagcgtttgttactagtaggggcaccgagagcagaagccttgcctctgcagcgagctaacagaaccggaggtctgtacagttgcgacattaccgcccgcgggccctgtaccaggatcgagttcgataatgacgcagatcctacaagtgagtccaaggaggaccaatggatgggggtcacagttcagtctcagggccccggtggaaaagttgtaacctgcgcacaccgctacgaaaaaagacaacatgtgaacacaaaacaggagtctagagacatctttgggcgctgttatgtgctgagtcaaaacttgcggattgaggatgacatggacggaggcgattggtccttttgcgatgggagattacgcggtcacgagaaattcggctcctgtcagcaaggtgtggccgcaacttttacaaaagatttccattacatagtctttggcgcaccaggtacctacaactggaagggaatcgtacgggtggagcagaagaacaatacatttttcgacatgaacattttcgaagacggaccttatgaagtcgggggagagacggagcacgatgaaagcctggtacccgtacccgctaattcatatctaggattactcttcttaacaagtgtctcttatactgacccagatcaatttgtgtacaagactagacctcccagagagcagcccgacacctttccagacgttatgatgaacagctaccttggtttctcactggactctggcaaaggcattgtcagcaaggatgagataacctttgtgtccggcgccccaagggcgaatcactctggcgccgtcgtcctgctgaagcgtgatatgaaatccgcgcatttgcttccagaacatatattcgacggtgagggattggccagctcttttggttatgacgtcgcagtagtcgacctcaataaggatggctggcaggacattgtgattggcgccccacaatactttgatcgcgatggcgaggtgggcggcgccgtttacgtttacatgaaccagcagggacggtggaacaatgtcaagccaatcaggctgaatgggaccaaggacagcatgttcggcatcgccgtgaagaacattggcgacattaaccaggatggatatccggacattgctgttggcgcaccttacgacgacctgggaaaggttttcatatatcatggctcggcaaacggaataaacacaaagcccacacaggttttgaaggggatcagcccatactttggctacagtattgccggtaacatggacctggaccggaactcctacccagacgtagccgtgggcagcctgtcagatagtgtaaccatcttccgcagccggcctgtcataaatatccagaaaacaattacggtgacaccaaaccggattgatctccgacaaaagacagcctgtggcgcgcccagcgggatatgcttgcaagttaaatcttgcttcgaatataccgccaaccctgctggttacaatcctagtatatctatcgttggtactttggaggccgaaaaggagaggcgaaaatccggccttagctcaagagtccagtttcgcaaccagggctctgaacctaagtatacgcaggaattgactctgaaacggcagaagcagaaggtctgcatggaggaaaccctgtggctccaggataacattagggataagcttcgccctataccaatcacagcatccgtggaaatccaggaacctagctcgagacgtcgggtgaactccctgcccgaggtgctcccgattctcaatagcgacgaacccaaaaccgctcatatcgacgtgcattttttaaaagaaggttgtggggatgacaacgtctgtaactccaacctcaagctggagtacaagttctgcacacgagaagggaatcaggataagtttagctaccttcctattcaaaaaggagtgcccgagttagtcttgaaagatcagaaagacatcgcactcgaaataaccgtgacaaactctccatcaaacccacgcaaccctactaaggatggcgacgacgcccacgaggctaagctcattgctaccttcccagatacccttacctactcagcctatagggagctgagagcttttcccgaaaagcagctctcttgcgtggcaaatcagaacgggtcacaggcagattgcgagctcggcaacccgttcaaacggaatagcaatgtcacgttctacctcgtgctgtcaacgaccgaagttactttcgatactcccgatcttgatattaacctcaagctggaaaccacctctaaccaggacaatctggctcctatcaccgccaaagccaaggtagtcattgagctactgttgtcagtgtccggggtggcgaagccctcccaggtgtacttcggaggcaccgtggtgggcgagcaagccatgaaaagtgaagacgaggtcgggtccttgattgagtacgaattccgcgtcattaaccttggtaaaccgctaaccaatctgggcaccgcaacactaaatatccagtggcccaaggaaatttccaatggaaagtggctgctatacctcgtgaaagtggaatctaagggccttgagaaggtgacttgcgaacctcagaaggagattaattctctgaacctgaccgaaagccacaactctcggaaaaagcgcgagattaccgagaaacagatcgacgataatcgcaagtttagcctcttcgcagaacggaagtaccagactctgaactgtagcgtcaacgtcaactgtgtgaatatcagatgtcctctgcgagggttagacagcaaagcgtcactcatccttcgcagccgtctctggaactcgaccttcctcgaggaatattctaagttgaattatctggacattttaatgcgggcatttatcgatgtaaccgccgcagcggagaatattaggctgcccaatgccgggacgcaggtaagagtgacagtattcccttccaaaaccgtggcgcagtactccggagtcccatggtggatcattctggtagctatcctggcgggaattcttatgctggctctgttagttttcattctgtggaagtgcggcttcttcaagcgcaataagaaggaccattacgatgccacttatcacaaggccgagatacacgcccagcccagcgacaaggagagacttacaagcgatgcctag

SEQ ID NO: 24557 - DNA, 3276 bp, Artificial Sequence
  Description of Artificial Sequence: Synthetic coding sequence
atggccgccgccggccagctgtgcctgctgtacctgagcgccggcctgctgtctcggctcggcgctgcttttaacctggacactcgggaggacaacgtgatcaggaagtatggcgaccctgggtcactcttcgggttttcgcttgccatgcactggcaactccagccagaagacaagagattgctgttagttggcgcccctagagcagaggccctgcctctgcaacgtgcgaaccgtaccggcggactgtactcatgtgatataacagctcgtggcccctgcaccagaatcgagtttgataatgacgccgatccaactagtgaaagcaaggaggaccaatggatgggtgtgacagtccagtcccagggcccaggagggaaggttgtaacctgcgctcacagatacgagaaacgccagcatgtaaacactaagcaagaatccagggatatatttgggcggtgctatgttctatcacaaaacctaaggatcgaggatgacatggacggaggcgactggtctttctgtgacggccggctgcgtggccacgaaaaattcggatcctgccagcagggagtggccgccaccttcacaaaagactttcattacattgtgtttggggcccccggaacatacaactggaaggggattgtccgtgtggagcagaaaaataatacttttttcgatatgaatatcttcgaggacggtccatatgaagtgggaggggagacagagcacgacgagtctcttgtgccagtgcctgccaattcgtacttggggttctcattagatagcggtaaggggatcgtgagtaaggacgaaataactttcgtgagcggggctccaagggccaatcactccggcgccgtggtattgctcaaaagagacatgaaatccgctcacttacttccggagcatatcttcgacggggaaggcctggcctccagttttgggtacgacgtcgcagtcgtagatctgaacaaggacgggtggcaggacattgtgattggggcaccacagtactttgatagagatggtgaggttgggggcgcggtttacgtgtatatgaatcagcaaggccggtggaataacgtcaagccaatccggctgaacgggacaaaggacagcatgtttgggatagccgtcaagaatatcggagacatcaatcaggacgggtacccggatattgccgtcggggcaccttacgacgacctgggaaaagtgttcatttaccatggaagtgcaaacggaatcaataccaaacccacgcaggttcttaaagggatttctccgtatttcggatattcaatcgccggcaacatggatctcgaccggaattcctatcccgatgtagctgtgggaagcctttcagatagcgtaaccatatttagaagtcggcctgtcattaatatacagaaaaccatcactgtgaccccaaaccgaatcgacctcaggcaaaaaacagcttgcggagctccatcagggatttgtcttcaagtcaaatcctgtttcgagtatactgcgaatcctgcggggtataacccttcaatcagtatcgtgggaaccctcgaggccgagaaagaacgacgcaaatccggtctgtcctcacgcgtacagttccggaaccaaggatccgaacctaaatacactcaggagctcaccctcaagcgacagaagcagaaagtttgtatggaagagacgctctggctgcaagacaacatcagagataaactaagaccgattccgatcacagctagcgtggagatccaggaaccttcctcacggagacgtgtgaatagcctgcccgaagtgttgcctatactcaattctgacgaaccaaaaacagcccatatcgatgttcatttcctgaaggaagggtgcggtgatgacaacgtgtgcaattctaatctgaagcttgagtacaagttctgcacccgcgaagggaaccaagacaagttctcttatttgccaattcaaaagggagtccccgaattggtgctgaaggatcagaaagatattgccctagagataacggtgaccaactcgcccagcaatcctcgcaaccctacaaaggacggggatgatgcccacgaggccaagctgatcgccacattcccagacaccctaacatattccgcttatagagaacttcgggcattccctgagaagcaattgagctgcgtcgccaaccagaatggcagccaggctgactgtgaattggggaacccattcaagcgcaactctaatgtaaccttctatctcgtcctgagcacaactgaggtgacatttgacaccccagatctggacattaatttgaagcttgagacaacatcgaaccaggataacttagcccccattacagccaaagctaaagtcgtgatagagttattactgtcagtaagtggcgttgcaaaaccctcacaagtgtactttggaggaacagtggtgggcgaacaggctatgaaatccgaagatgaagtgggttcactcatcgaatacgaatttcgggtaataaatctcggcaaacctctgacaaatctcgggacggcaactctgaatatccaatggcctaaagagatctcgaatggtaagtggctactttatctggttaaagtggagtcgaagggccttgagaaagttacctgcgaaccacagaaagagattaactcacttaatctcaccgaatctcataatagtcgtaagaagcgcgaaattacagagaaacaaattgacgataataggaagttttcactctttgccgaaagaaagtatcagacacttaattgcagtgtcaacgtgaattgcgttaatattaggtgcccactccgtggattggactcaaaggctagtttaatcttgaggtcccgcctgtggaactcaactttcctcgaagagtacagtaaacttaattaccttgatattctaatgagagctttcatcgacgtgacggccgcggccgaaaatatacgcttgcctaacgccggaacacaggttcgggtcaccgtctttcccagtaagaccgtggcccaatactcgggcgttccatggtggataatcctggtggccattctggccggaatacttatgctcgcgttactagtatttatattgtggaaatgcggcttcttcaaacggtctcgttatgatgatagtgtcccccggtaccatgctgtcaggatacgcaaggaggagcgggaaatcaaggacgagaagtacattgacaatttagaaaagaagcagtggatcacgaagtggaatgagaacgaaagctattcgtag

SEQ ID NO: 24558 - DNA, 2865 bp, Artificial Sequence
  Description of Artificial Sequence: Synthetic coding sequence
atgggcgtgaccgtgcagagccagggccccggcggcaaggtggtgacgtgtgcacatcgatacgaaaagcggcagcacgtgaatacaaagcaggagagccgcgatatcttcgggaggtgttacgtgttgtcgcaaaatcttagaattgaagatgatatggatggcggcgactggtctttttgcgacgggcgcttgagaggtcacgaaaaattcggctcctgccagcaaggggtagcggcaacctttacaaaggatttccactatatcgttttcggcgcccctggcacctataactggaagggattattgttcctcacatctgtgagttacaccgaccccgaccagtttgtttataagacacggccacccagagagcagccagatacatttccagatgtgatgatgaactcttacctgggtttttcattagactccggcaaggggattgtgagcaaggacgagatcacattcgtcagcggcgcccctagagcgaatcattctggcgccgtcgtgctcctgaagcgggatatgaagtctgcacatctgctgcccgaacacatattcgatggcgaaggcttggcctcttcttttggctacgacgtggccgtcgtggacttgaacaaagatgggtggcaagatatcgtaatcggggctccccagtacttcgatcgggacggggaagttgggggtgccgtttacgtttatatgaatcagcaagggcggtggaataacgtcaaacccattagacttaacggcaccaaggacagcatgttcggtattgcagttaaaaacattggcgacataaaccaggatggatacccagatatcgctgtgggagccccctatgatgatcttggtaaggtttttatctaccacgggtccgccaacggcatcaatacaaagcccacccaagttcttaaaggaatcagcccatactttgggtacagcatagccggcaacatggatctcgaccgcaatagttatcctgatgttgccgtggggtcactgtccgattctgtgactatctttaggagcagaccggtgatcaatatccagaaaaccattaccgtgacgccgaacagaattgatctacgccagaagacagcttgtggggctccctcgggcatctgtctgcaggtcaaaagctgtttcgagtatacggctaaccccgctggctacaacccttctatttccatcgtgggcaccttagaagccgagaaagaacggaggaaatccggtttgtctagtcgtgtccagtttcgaaaccaggggtccgaacccaaatatactcaagagctaactcttaaacggcaaaaacaaaaagtctgcatggaggagaccctgtggctccaagataatatacgagacaagctgagaccaatccctattaccgcgtccgtggagatccaggagccctcctcacggagacgcgttaacagtttgccagaggtgctcccaatcctgaactcagacgaacccaagactgcacacatagacgtccattttctcaaggaaggatgtggcgacgataacgtgtgcaattccaacctaaagctggagtacaaattttgtacaagagaagggaatcaggataaattttcatatcttcccattcagaagggcgttccagagctggtgttgaaagaccaaaaagatatcgcactggaaattacggttaccaattctccatctaacccccggaatcctactaaggacggggatgacgcgcatgaggctaagctgattgctaccttccccgacaccctgacctattccgcctatcgggagctccgggccttccctgagaagcagttgagttgtgttgcgaaccagaatggttcccaggctgactgcgagcttggaaacccgttcaagaggaactctaatgtgacattctacctcgtgctcagtaccaccgaggtcactttcgacacgcccgaccttgacattaacctgaaactggagaccacctcaaatcaggacaatctggcacctatcacggccaaagccaaagtggtaatcgagctccttctgtcagtgtccggtgtggcaaagccgtcacaggtttactttggtggcaccgtcgtgggggaacaggccatgaagtcggaagacgaggttgggtccttgatagaatatgagttccgcgtaatcaacttagggaagcctttaaccaatcttggcaccgccacactgaacattcagtggcctaaggagatcagcaacggcaaatggctcctttatctggtaaaggtcgagtccaaaggattagaaaaggtgacttgtgagcctcaaaaggaaatcaactccctgaatctgacggagagtcataacagccggaagaaacgagaaattactgaaaaacagatcgacgacaaccgtaagttcagcctgttcgctgagcggaagtaccaaaccctgaattgttccgtgaatgttaactgcgtcaacatcagatgtccattacggggtctagattcaaaggcatcactcatcttacggtcaagactctggaactctaccttcctggaggagtatagcaagctgaactacttagacatattgatgcgggccttcatcgacgtgacagcagccgctgagaacattcggctgcccaacgctggaactcaggtgcgcgtgactgtgtttccttcaaagaccgtcgcccaatattctggcgtgccttggtggatcatcctggtggccatattggcaggaattttgatgctggcgctattggtgttcattttgtggaagtgcggctttttcaagcggaacaaaaaagaccattacgatgctacctatcataaagcagagatacacgcacaacctagcgataaggagcggctgacatctgacgcatag

SEQ ID NO: 24559 - DNA, 3393 bp, Artificial Sequence
  Description of Artificial Sequence: Synthetic coding sequence
atggccgccgccggccagctgtgcctgctgtacctgagcgccggcctgctgagcagattgggtgccgcctttaatctagacacgagggaagacaatgtcattagaaagtacggcgaccctggctctttatttggtttcagccttgcaatgcattggcagcttcagccggaggataaaagacttcttctggtcggcgccccgcgggccgaggcacttcctctgcagcgcgcaaaccggaccggcggtctttatagctgtgacatcacggcaagaggcccttgtacaaggattgagtttgacaacgacgccgatccgacttccgaatctaaagaggaccagtggatgggtgttaccgtgcagagccaagggcccggcggcaaggtcgtgacgtgcgcacaccggtatgagaaacggcagcacgtcaacacaaagcaggaatccagagacattttcggtagatgctacgtgctgagccaaaatctcaggatcgaagacgacatggatgggggggattggagtttctgtgatggacgactgcgggggcacgagaagttcggttcatgtcaacagggggttgccgctactttcacaaaggattttcactatattgtgtttggagctccgggtacctacaattggaagggcattgtcagagtggagcagaaaaacaacacattttttgacatgaatatttttgaggacggcccgtatgaggtggggggagagaccgaacacgacgagagtctggttcctgttcccgctaacagctatttaggtctgctgttcctgacaagcgtgagctacaccgacccagatcaattcgtgtacaagactcggccgccacgggaacagcccgacactttccccgacgtgatgatgaactcttatctgggtttctcccttgattcaggaaagggcatcgtatctaaggacgaaatcacattcgtcagcggggcaccccgggccaatcactctggagccgtggtgttgctaaagagggacatgaagagcgcccatctccttcccgaacacattttcgatggtgaaggcttagcctcttcatttggatacgatgtagccgtcgtcgatcttaacaaggatggctggcaggacatcgtgatcggagcacctcagtacttcgacagggatggggaagtgggaggagccgtctacgtatacatgaatcagcaaggtagatggaataacgtaaagcctattaggctgaacgggacgaaggactcaatgttcggcatagctgtgaagaacataggtgacatcaaccaagatggctacccagacatagccgttggagctccctatgatgacctgggcaaggtctttatctaccacgggtctgctaacgggatcaatacaaagcctactcaggtactgaaggggatttctccttacttcgggtattcaatcgccggcaacatggatctggatcggaattcctacccagacgtggctgtggggagcctttctgatagtgtaacgatttttagatctcgccccgtgattaacatacagaagactattacggtgacaccaaacagaattgatttgcggcagaagacggcttgcggcgccccctcaggaatttgcctgcaggtgaaatcgtgcttcgaatataccgcaaatccggcaggctacaatccgtctatcagtattgtcgggactcttgaggcggagaaagagaggcggaaaagtgggcttagcagcagggttcagttcaggaatcaaggctctgagcctaagtatacccaggagctgacgctgaagaggcaaaaacaaaaggtttgtatggaggagacgctctggctccaggataatatcagggacaaacttcgccccatccctattaccgccagcgtggagatccaagaaccctcatccagacggcgtgtgaactccctccccgaagtcctgccaatcctcaattccgacgagccaaagactgctcacattgacgtccattttctgaaggagggttgtggcgacgacaacgtttgtaacagcaatctgaagcttgaatacaaattctgcacaagagagggcaatcaagacaagttttcttacctgcctatccagaaaggtgtccccgaactagttctgaaggaccagaaggatattgcactggagatcaccgttaccaactccccgtcaaacccccggaaccctacgaaggacggggacgacgctcacgaagccaaactgattgctaccttccctgacactctgacatactctgcgtacagagagctgcgtgccttccccgagaagcagctgtcatgtgtcgctaaccagaatggctcacaagccgattgtgagttggggaaccccttcaagcgaaactcaaatgtcactttctacttagtcttgtctacaacggaagtgacgttcgacacgcctgatctagacattaacctgaaacttgagactacatccaatcaggataatcttgccccaatcaccgccaaagcaaaggttgtgattgaattgttactgagtgttagtggggtcgccaaaccctcccaggtgtacttcggcggcacagttgtaggtgagcaagccatgaaaagtgaggatgaggtggggtccctgattgagtatgaatttcgagttataaatttaggaaagcctctcaccaatctgggaaccgcaaccctgaacattcaatggcctaaagagatctcaaacgggaagtggctgttgtatctggtgaaggtcgaaagtaagggcttggaaaaggttacctgcgaaccccaaaaagaaattaacagcctgaatctaaccgaatcacacaatagccgaaagaaacgggagattaccgaaaagcaaatcgacgacaacagaaaattttccctctttgccgagcgaaaataccagacgttgaactgcagtgtgaacgtgaattgtgtcaatattaggtgcccactgagaggcctggactccaaggccagcttaattcttcgatcgagattatggaactcgacattcctcgaagagtacagcaagctcaattacctagacatcctgatgagagcttttatagatgttacagctgcagccgagaacattcggttacctaacgctgggacccaggtgcgcgttacagttttcccttccaaaacagtggcccagtacagtggtgtaccttggtggattatccttgtagcgattttggccggaatactgatgctggccttgttagtattcatcctgtggaaatgcggattcttcaagaggagcagatatgacgacagcgtgcctaggtatcacgcggtgaggattcgtaaggaagagagagagattaaagatgagaagtatatagataatctcgagaagaagcagtggatcacaaaatggaatgagaacgagagttatagctag

SEQ ID NO: 24560 - DNA, 3261 bp, Artificial Sequence
  Description of Artificial Sequence: Synthetic coding sequence
atggccgccgccggccagctgtgcctgctgtacctgagcgccggcttgctgagccgtttaggcgccgcctttaacctggatacaagggaggataatgtgatccgcaagtatggggaccctggtagcctgtttggtttcagtctcgccatgcactggcagcttcagcccgaagacaagagactcctgctcgtaggggcccctagggctgaagcactgcctctccagcgggccaacagaacaggtggcctatactcctgcgacattaccgccaggggcccctgcacccggatagagttcgataatgatgcagaccccacatcagagagcaaagaggatcaatggatgggagtcacggtacagagccagggcccaggtggcaaagtggtaacttgcgcacaccgatacgaaaaacgtcagcacgtcaacaccaagcaggagtctagagacatatttggaaggtgttatgtgctaagccaaaatttgagaatcgaagatgatatggatggtggtgactggtcattttgcgacggccggctcagggggcacgaaaagttcggaagctgtcagcagggtgttgcagcaactttcactaaagacttccactacattgtattcggcgccccgggaacgtacaactggaaaggcctcctctttctgacatctgtgtcctataccgatcctgatcaatttgtgtacaaaacccgcccaccccgcgagcaaccagatacctttcctgacgtcatgatgaactcctacttagggtttagcctcgattctggtaagggtatcgttagtaaagacgagatcacattcgtgtcaggggcccctagggcaaatcacagcggggctgtggtcctgctgaagagggacatgaaatccgcccacttgctgccagagcatatttttgacggggaaggcttggcgtcttctttcggctacgatgtcgcagttgtggacctgaataaagatggctggcaagatatcgttatcggcgccccacaatacttcgatcgggacggggaagtgggcggggcggtctacgtctacatgaatcagcagggacgctggaacaatgtcaagcctatccggcttaatggaacgaaggactccatgttcggcatcgccgtcaaaaacataggcgatatcaaccaagacggatacccagatatcgctgtgggtgctccttacgatgacttagggaaggtctttatttatcatgggtccgctaacggcattaacacaaaacccactcaggtactcaaaggcatctccccctatttcgggtatagcatagccggaaacatggatctggacaggaattcatacccagatgttgctgtcggcagcctcagcgactctgttacaattttcagatcccgccccgtgattaatatccagaagacgataaccgtcacgccaaaccggatcgatttacgacagaaaaccgcgtgtggggcaccttcaggaatatgtttgcaggttaaatcctgttttgagtatactgccaacccagccggctacaatcctagtatttccatagtgggcaccctcgaggcagagaaggagcgaaggaaaagcggcctgagctctagggtgcaatttaggaaccaagggtccgaacccaagtacactcaagagctgactctcaagagacagaaacaaaaagtgtgcatggaagaaaccctgtggctacaggataatattagagataagttaagacccattcccattactgcaagtgtcgagatccaggaaccgagttctagaaggcgcgtaaattcgctgccggaagtcctccctatcctaaacagcgatgaacccaagacagcccacatcgatgtgcattttctaaaggagggatgtggcgacgataatgtgtgtaacagcaacctcaaactcgagtacaagttttgcacccgtgaggggaaccaggataaattcagctatctccctatccagaagggcgtgccagaactcgtattaaaggaccagaaggatatagcgcttgaaatcaccgttaccaattccccatctaatcctcggaaccccaccaaggatggggacgacgctcacgaggccaagttgattgccaccttccctgacacactgacctatagcgcgtacagagaactgcgcgcattccctgagaaacaactgagttgtgtagctaaccagaacgggtcccaggcggattgtgagttggggaacccctttaagaggaatagcaatgtcaccttctacctcgtcctctccacaacggaggtaacatttgacactccggatctcgacatcaacttgaagctggagacaacatcaaatcaggacaacctcgcaccaattaccgccaaggctaaggtggttatagagctgttgttgtccgtgtccggagtggccaagccctcccaggtgtatttcggaggcactgtggtgggtgagcaggccatgaagtcggaagacgaagtggggtcgctgatagaatatgagtttcgcgtaattaacctcggcaagccactaacaaatctagggacagccactctgaatattcagtggccgaaggagataagcaacggcaaatggctattatatctcgtgaaagtcgaatctaaaggactggaaaaggtcacctgcgaaccccaaaaggagatcaattcactaaatcttacggagagccacaattccaggaagaagcgcgagataactgaaaaacagattgacgataacagaaaattctcccttttcgctgaacgaaagtaccagacccttaattgctctgtcaatgtgaactgtgtgaacattcgctgccctctgcggggtctggactccaaggctagcctgatccttcgatccaggctgtggaattcaacttttttggaggagtactcaaagctgaactatctggacatcctgatgcgggcctttattgacgtgaccgccgccgccgagaacattagattgcctaatgcaggtactcaggttagagtgactgtattcccctctaaaaccgtggctcagtatagcggtgtgccctggtggatcattctggtggctatcctcgcgggaattctgatgcttgccctgttagtgttcatcctgtggaaatgtggattcttcaaacgtagcaggtatgacgattctgtaccccggtatcacgcggtgcgaattcgcaaggaggaaagagaaatcaaagatgagaagtacatcgacaacctggagaagaaacagtggattactaagtggaatgagaacgagtcctactcctag

SEQ ID NO: 24561 - DNA, 3414 bp, Artificial Sequence
  Description of Artificial Sequence: Synthetic coding sequence
atggccggcgcccggagccgggacccctggggcgccagcggcatctgctacctgttcggcagccttctcgtggaattactgttttcaagggcggtggctttcaacctggacgtgatgggggcactgagaaaagagggggaacctggcagcttatttgggtttagtgtagctctgcatcggcagctccagccacggccccagagttggctattggtcggtgccccacaggctctggccctccccgggcaacaggccaaccgcactggaggcctgttcgcatgtcctttgagcctagaggaaactgactgctatcgagtcgacatagatcaaggcgcagacatgcagaaagagtccaaggagaaccagtggctaggtgtaagtgtacggagtcagggccctggcgggaagatcgtcacctgcgcacatcgctacgaggcccggcagcgggtggatcagattctggaaacacgggacatgatagggagatgttttgtactcagtcaggaccttgccatccgggatgaattggatgggggcgaatggaaattctgtgaaggccggccgcagggacacgagcagtttgggttctgccagcagggaactgccgcagccttttctccggatagccactacctattgtttggggcgcccggtacctataactggaaaggtctcctgtttgtaacaaatattgactcctctgatccagatcagcttgtctacaaaaccctggaccctgccgacagactgcccggcccagccggggatctcgcactgaactcgtatcttgggttcagcattgatagcggcaagggcttagttcgggcggaggaattgtcattcgtcgctggcgctcccagggcgaatcacaaaggagccgtggtgatcttgcgcaaggactcagctagccgcctcgtccccgaagtcatgctaagcggcgagcgactgacatctgggttcggctactccttggctgtggccgaccttaacagcgacggttggccagacttgatcgttggcgccccttatttctttgaaagacaggaagaattaggaggcgcagtgtatgtgtacctgaaccagggaggccactgggctggtattagccctctgcgcctgtgtggcagtcccgacagcatgttcggcatctccctggccgtgctaggagacttaaaccaggacgggttcccggacattgctgtgggagccccattcgacggcgatgggaaggtgttcatctaccatggctcttccctgggggtggttgctaaaccatctcaagttttggagggggaggccgtgggcatcaaatcattcggctacagcttgagcggttctttggacatggacggaaatcagtatcctgatctgcttgttggcagcctagcggataccgccgttctgtttcgggccaggcctatactccacgtgtcccacgaagtgtccattgctccccgatccattgaccttgagcagccaaattgtgccggcggccactcagtttgtgttgacctacgcgtctgcttctcatacattgcggtgcccagtagttactctccaaccgtagctctggattatgtgttggacgccgatacagatagaagactgagaggccaggtgcccagagtcacctttctcagccgaaatctcgaagagccgaagcatcaagcctcaggaaccgtgtggttgaagcaccaacacgaccgtgtttgcggagatgcaatgtttcagctgcaggaaaacgtcaaagataaactgcgggctatcgtggtcactctgtcttactctctgcagacaccacggctgcggaggcaagcacccgggcagggtctcccccccgtggcgccaattttgaatgcccaccaaccaagtacccagagagccgaaatccatttcctcaagcagggatgtggggaagataagatctgtcaatccaatttacaactggtacgggcccggttttgtacacgagtttcggatactgagttccagcccctgcccatggatgtggatggcaccacggctctatttgccctgtccgggcagcccgtgatagggctggaactaatggtcacaaacctgccttcagaccctgcccagccgcaagcagacggcgacgacgcccacgaggcccagttactggtgatgctgcctgacagcctgcactatagtggggtaagggcacttgacccagccgaaaaaccactttgcctctctaatgagaatgcctcgcatgtggagtgcgagctggggaacccaatgaagagaggagcacaggtgaccttctacctgatcctttcaacttctggcatttcaattgaaaccacagagctggaggtggagctactcctagctacgatctctgagcaggagcttcatcccgtatcagcccgagcaagggtgtttatcgagctgcctctttcaatcgcaggaatggcgattccccagcagttgtttttcagtggggtcgtgagaggggagagggccatgcagtctgagcgcgatgtgggcagcaaggtgaaatatgaagtaaccgtgtctaaccaggggcaatccttgcgaaccctgggttccgccttcctcaatataatgtggccccatgagatcgccaatggtaagtggttactgtaccctatgcaggtggaattggaaggtggccaggggcctggacagaaaggcctctgctctcctcgccctaacatcctgcatctcgacgtcgatagtagagataggcgtcgtagggaattggagcccccagagcagcaggagcctggcgaacgtcaagagccctcgatgtcctggtggcctgtctcctctgctgagaagaagaagaacatcacgctggactgcgctcggggtactgcaaattgcgtcgtcttcagctgccctctctatagcttcgatcgagcagcggtccttcacgtatgggggcgcctttggaatagcaccttcctcgaagaatactctgcagtgaaatcactcgaggtgatcgtacgcgccaatataaccgtgaagagttctattaagaatctgatgctccgggacgctagcactgtaatccccgttatggtgtacctggaccctatggccgttgtggctgaaggcgttccatggtgggtgatcctgctggcagtactggcgggtctgctggtcttagctctgctcgtcctgttactttggaagatggggtttttcaagagagcaaagcacccggaggctactgtgccgcagtatcacgcagtcaagattccacgggaggatcggcagcagtttaaggaagaaaaaaccggtaccatcttacggaacaactggggaagcccacgaagggagggacctgacgcccaccctatcctcgccgccgatggtcacccagagctgggtcctgatggccatcccgggccgggcaccgcctag

SEQ ID NO: 24562 - DNA, 3489 bp, Artificial Sequence
  Description of Artificial Sequence: Synthetic coding sequence
atggccggcgcccggagccgggacccctggggcgccagcggcatctgttacctgttcggcagccttctggtggaactgctattctccagggccgtcgcctttaatctggacgttatgggggccttacggaaagaaggagagccaggatccctgttcggcttctctgtggcattgcacaggcagcttcagccaagaccacagagctggctacttgtgggcgcgccgcaggctctagctcttcccggacagcaggccaaccggaccggtggcttgttcgcttgcccgctctctttggaggaaactgattgctatcgcgtggacattgatcagggagccgacatgcaaaaggaatctaaggagaaccagtggctcggcgtgagcgtccgctctcagggccccgggggaaagatcgtaacatgtgcacacagatacgaggcaagacaaagagtcgaccaaatactggagactagagacatgattgggagatgcttcgtgctgtcacaggacttagcaatcagagatgaactggatggaggggagtggaaattttgcgaagggcggccccaggggcatgagcagttcggattttgtcagcagggcaccgcggccgccttctcacccgattctcactacttattattcggtgcacctggcacatataactggaagggcactgctcgtgtcgaactatgcgctcagggcagtgcagacctggcacaccttgacgatggtccatacgaggcaggcggggaaaaagaacaggaccccaggcttatccctgtcccggcaaactcttactttggccttctgtttgtgactaacatcgactccagtgatccggaccagctcgtgtataaaaccctggatcccgccgataggttacctggtcccgctggtgatttggcactgaacagttacctgggcttttccattgactcgggaaaaggccttgtaagggctgaagaattgtcattcgtggccggggcacctcgtgccaatcacaagggggctgtcgttattttgaggaaagacagcgcctccagactggtccccgaggtgatgctgtccggtgagcggttaaccagcgggttcggctattctttggcagtcgccgacctgaacagcgatgggtggcctgatctcatagtcggggctccctatttcttcgagagacaggaggaactgggcggggccgtttatgtttatctcaaccaggggggccactgggccggaatcagcccattgaggctctgcggatcccctgactccatgttcggcatatcactggcagttcttggtgaccttaatcaggacgggttcccggacatcgcagtcggtgcaccgtttgatggggatggcaaggtcttcatctaccacggttcttctctgggggtggttgccaagcctagccaggtgctggaaggggaagcagtgggcatcaagtcctttgggtactcactgagcgggtctcttgacatggatggcaatcagtaccccgacctgttggtagggtcactggcggatactgcagtcctttttagagcccggccgattctgcacgttagccatgaagtgagcatcgctcctcggtcaatagacctggaacaacccaactgtgccggaggccacagtgtctgtgtggacttgagagtctgctttagctacatcgctgtgccatcatcatattcacccactgtggcgctggactatgttctggacgcagataccgataggcgtctgcgcggacaggtgccgagggtgactttcctgagcagaaacttggaggagcctaaacaccaagcttccggcactgtatggctgaaacaccaacacgatcgggtttgtggggacgctatgtttcagctacaggaaaacgtaaaggacaagctgagagcaattgtggtgacactctcctacagtctgcagacgcctcgtctgcgccgacaagccccaggtcagggtctccctcccgttgccccgatccttaacgcacatcagccctccactcagcgggcagaaatccattttctgaaacaggggtgtggagaggataaaatttgccagtccaacctgcagctcgtgcgtgcacggttttgcacacgagtgtcagatacagagtttcagccattgcctatggatgtggacggtacgactgcactgttcgccctgagcggtcagcctgtgatcgggctagagttgatggttacgaacctgccatcggaccccgcccagccccaggctgacggcgacgacgcacatgaagcccaactgttggtcatgctgcctgactctttgcactactcaggcgtccgggctctcgacccggcagagaaacctttgtgtctgagcaatgagaacgcgtcacacgtcgagtgcgaactgggtaaccccatgaagaggggagcacaagtcactttttatcttatcctcagcacatctggtatcagcattgagactactgagctggaagtggagctgcttctggcaactatcagcgaacaagaattgcaccccgtgagtgccagagcacgtgtgttcattgaactgcccctgagcatcgcaggcatggcaattcctcagcagctttttttttcaggagtagtcaggggcgagcgggctatgcagtccgagcgcgacgtagggagcaaagtgaaatatgaagtgaccgtgagtaaccagggccaatctcttcgcacccttgggagcgcctttctcaacatcatgtggcctcacgaaatagcaaacgggaaatggctattgtatcccatgcaggtagagctagaggggggccagggcccaggtcagaaaggtctttgttctccccggcccaatattctgcatcttgatgtggatagcagggataggcgtcggcgcgaactggaaccccccgagcaacaggaacccggagaacgacaggaaccttccatgagttggtggccggtaagttccgcagagaagaagaagaacatcactctggactgcgcccgaggcaccgccaattgcgtagtattctcctgcccgctgtactcattcgaccgggcggccgtattgcatgtgtggggcagactttggaactctacctttctggaagagtacagcgctgtaaaatccctagaggtgattgtacgcgccaacattaccgtcaagtcctccatcaagaatctgatgttgagggatgccagcacagtgatccctgtcatggtgtacctggacccaatggcagtcgtggccgagggcgtcccttggtgggtgatccttttggccgtgctcgccggcctgttggtcttggcacttttagtgctgctcctgtggaagtgtggcttcttccataggagctcacaatccagctcatttcccactaattaccaccgggcctgtctggcggtgcagccgtcggctatggaagtgggcggtcccggcacggtaggttgggattcgtccaacggcagatccaccccccggcctccatgtccctcaactatgcgatag

SEQ ID NO: 24563 - DNA, 2976 bp, Artificial Sequence
  Description of Artificial Sequence: Synthetic coding sequence
atggccggcgcccggagccgggacccctggggcgccagcggcatctgctacctctttggcagtcttctggtcgaactgctgttctccagggccgtcgcattcaacttggacgtaatgggggcattacgtaaggaaggtgaacctggttccctattcggcttcagtgtggcactgcacagacagttgcagccccggccccagtcctggctcctggtgggggctccccaggccctcgccttgcccggacagcaagcgaatcggaccgggggtctatttgcttgcccgctgagtttagaggagacagattgttaccgcgtggatattgatcagggagctgacatgcagaaggagtcaaaagagaatcaatggctgggagtcagtgtgagaagtcaaggccccggcggtaagattgtgacttgcgcccatagatacgaggccaggcagagagtggaccagatcttagagactagggacatgattgggcgatgtttcgtcctgagtcaggatcttgctatcagggacgagctcgatggaggagaatggaaattctgcgaaggtaggccccaaggccatgagcagttcggcttttgtcaacagggcaccgctgccgcttttagtccagattctcattaccttctctttggcgctccagggacttataactggaagggtactgcaagagtcgagctgtgtgctcagggaagcgctgacttggcccacctcgacgatggtccgtatgaggctggtggcgagaaagagcaggacccgcgattgatcccagtgccggctaattcctatttcggactcttgttcgttacaaacattgattctagtgatccagaccagctggtgtataaaacgttggaccccgcagacaggctgccagggccagcaggagatctcgcgctgaactcttacttaggatttagcatcgattccggcaagggactggtccgggctgaagaactgtctttcgtcgccggggccccgcgggccaaccataaaggagcggtggtaatcctgcggaaggattcggcatcgcgcctggtgcctgaagtgatgctgtccggggaacggttgacgtccggatttggatactccctggcggtggctgacctcaactcagatggatggcctgacttaattgtgggagcaccctactttttcgagagacaagaagagctgggcggtgcagtttacgtgtacttaaaccagggcggacactgggcgggcatttctcccctgaggctgtgcggaagtcccgattcaatgtttgggatttcgctcgctgtactcggtgatctgaatcaggatggatttcccgatatcgctgtaggcgccccttttgacggggatggcaaggttttcatctaccatggcagctcccttggggtcgtcgccaaacccagccaagtgttagagggagaggccgtagggattaagtcctttggatattcccttagtggttccctggatatggatgggaaccagtatcccgacctcctggtgggcagcctagccgacaccgccgtgctgtttagggccagacctatcttacatgtgtcccatgaagtctctatcgcgccccgatctatcgatctagagcagcccaattgtgcgggagggcattctgtgtgtgtagatttgagggtctgcttcagctacatcgcggtgccttcatcttacagcccgaccgttgcactcgactacgtactggatgccgatacagaccggaggctgcgcgggcaggtccctagagtgactttcttgagccgcaatctggaagaacctaagcatcaagccctggatcctgctgagaagcccctgtgcctctccaatgaaaatgctagccacgtcgagtgtgaactcgggaaccctatgaagaggggcgcccaggtcacattttacctgatcttatccacctcgggtatttccatcgaaaccacagaactggaagtggagttgttactcgctaccatcagcgaacaggagcttcaccctgtgtcggccagggctagggtctttatcgagctacctctgagcattgctgggatggccataccgcaacagctatttttttccggagtggtgcgaggagagcgggcaatgcagtctgagcgcgacgtaggatcgaaggtaaagtacgaggtgacggtttccaaccagggacagtccctcaggacactgggttctgcttttcttaacatcatgtggccccacgaaattgccaatgggaagtggcttctttaccctatgcaggtggagctggaaggcgggcaaggcccagggcagaagggtctgtgttcccctagaccaaacattcttcacttagacgtcgatagtcgggaccgccggagaagggagctggagccgcccgagcagcaggaaccaggcgagcgacaggagccaagtatgtcttggtggcctgtgtcttcagctgaaaagaagaaaaatattacactcgactgtgcacggggcaccgcaaactgtgtggtcttctcgtgccctctctacagctttgatagagctgccgtgctccatgtgtggggcagactgtggaatagcaccttccttgaggaatattctgccgtcaagtcactggaggtgatcgttagagccaacatcaccgtgaagagtagtatcaaaaacctcatgctaagagatgcctctaccgttataccagtcatggtgtatctggaccctatggcagtagtagcagaaggtgtgccttggtgggtaattcttcttgctgttctggctggactgctggtgctggctttactggtgctgctgctgtggaagtgtggattctttcatcggagttcacagagctcctcattccccacaaactaccaccgcgcgtgtttagccgtccagccctcggccatggaggtaggcgggcccggtacggtcgggtgggattctagtaatggtagaagcaccccacggcccccctgtccttccaccatgcggtag

SEQ ID NO: 24564 - DNA, 3357 bp, Artificial Sequence
  Description of Artificial Sequence: Synthetic coding sequence
atggccggcgcccggagccgggacccctggggcgccagcggcatctgctacctgttcggctctctcttggtcgagcttttattttcacgagctgtggcgtttaacctggatgttatgggtgctttgagaaaagagggcgagcctggttcactattcggattttcggtggcgctccacaggcaactccagccccggccccaatcttggctgcttgttggcgcaccccaggctttggcccttcccggccagcaggcgaataggacaggtggcctgtttgcctgccccctgtcacttgaagagactgactgttacagggtggacatcgatcaaggcgctgacatgcagaaggagtctaaagagaaccagtggctgggggtgagtgtccggagccagggaccgggtggcaaaatcgtcacctgtgcccacaggtatgaagctcgacagcgcgttgatcagatactggaaacaagggacatgattggtagatgttttgtgctctctcaggatctggcaataagggacgagctggacggcggagagtggaagttttgcgagggaagaccacaaggccatgaacagtttggtttttgccagcagggtacggccgccgcgttcagccctgactctcattacctgctgtttggcgcccctggcacttataattggaaggggctgctgtttgtgacaaatattgacagctctgatccggatcagctggtgtataaaaccttagaccccgctgaccgcctgccggggcctgccggggacctggccttaaactcctatctcggatttagcatcgacagtggcaaaggactggtgagagcagaggagctgtcctttgtcgccggcgcgcctagagccaaccataagggggcggtcgtgatcctcagaaaggactcagcctcccggttagtgccagaagtgatgctgagcggtgagaggcttacatccggatttggctatagcctggccgtcgccgatttgaatagcgacggttggcccgacctgatagtgggagcaccatacttcttcgagcgccaggaggagctgggcggtgcagtctatgtttacttgaaccagggtgggcactgggccggtatctctcccctccggctgtgcggctctcctgactccatgttcgggatctccctggcagtcttgggtgacctgaatcaagatggcttcccagatatcgctgtgggagctccgttcgatggagatgggaaagtatttatttatcatggctccagccttggcgtagtggccaaaccatcccaggtcttagaaggcgaggctgtaggcattaagtcgttcggatacagcctgagcggtagcctagacatggacgggaatcaatacccagatttattggtcggctctttagcagacactgcggtgctgttccgagctcgccctatcctgcacgtgagccacgaagtctcaatcgctccccggagcatcgatctagagcagcccaattgcgctggagggcattccgtctgtgtggacctgcgggtgtgtttctcctatatcgcagtgccatccagctattcccccacagtggccctagactatgtgctcgatgctgacacagatagacggctcaggggacaggtgcctagggtcaccttcctgtcccggaatcttgaagagcctaagcatcaagcctccggaaccgtgtggcttaaacaccagcatgatagagtttgcggggacgctatgtttcagttgcaggaaaatgtaaaggataaactgagagctatcgtggtgactctaagctatagtctgcagactcccagactgaggagacaagctccaggccaggggctgcctcccgtggctcctatcctcaacgcacatcagccatccactcagcgggctgaaattcactttctcaagcaagggtgcggggaagacaagatctgtcagagcaacctgcagctggtacgggctcgtttttgtaccagagtctcagatactgaattccagccattgccaatggacgtcgatggaacgactgcactttttgccctgtcagggcaacccgtaatcggcctggaactgatggtgaccaacctcccaagcgaccctgctcaaccccaggctgacggtgacgatgcgcatgaggcccagctgctggtgatgctgccagattccctgcattactctggggtaagggctctggacccagcggaaaaacccctctgcctttccaatgagaatgcgtcacacgtggagtgcgaactgggtaaccctatgaaacgcggcgcacaagtgactttttatctgattctgtccaccagcggtatctccatcgagacaacagaattggaagtggaactcctcttagctaccatttcagaacaagaacttcatcccgtctctgcacgtgcgcgcgttttcatcgaattacccctttcgatcgcaggcatggccatccctcaacaactgtttttctccggagtggtgcggggggagcgggcaatgcagagtgaacgtgacgtgggaagcaaagtgaagtatgaagtcacagtgtcaaatcagggccagtcgctcaggacattggggagcgccttccttaacatcatgtggcctcatgagattgcgaatggcaagtggcttctctaccctatgcaagtagagctcgagggggggcaggggccgggccagaaaggtctgtgctctccacgacccaacatcttacaccttgatgttgattcgcgggatagacgtcgccgggaactcgaaccaccagagcagcaggagcctggcgagcgccaggaaccctcgatgtcttggtggcctgtctctagcgcggagaagaaaaaaaacatcactttagactgtgcaagaggcacggccaactgcgtggtcttctcttgcccactgtacagcttcgacagagctgcagttctccacgtttggggaaggctttggaatagcactttcctggaagagtatagcgcagttaagtctctagaagtgatagtacgggccaatatcactgtcaagtcgagtataaagaacctgatgttgagggatgcgtctacagtcattcctgtaatggtgtatttagatcctatggctgtagtggccgaaggtgtaccctggtgggtgatcctgctcgctgtcttagcgggactgctagtgctggctctgctggtgctgctcctttggaagtgcgggttttttcaccgctcctcacaaagttcctcctttccaactaactatcacagagcttgtctggccgtgcagccatccgcaatggaagtcggcggccctggcactgtggggtgggactctagcaatggccggagtacccctaggcctccttgtccctctacaatgcggtag

SEQ ID NO: 24565 - DNA, 3369 bp, Artificial Sequence
  Description of Artificial Sequence: Synthetic coding sequence
atggccggcgcccggagccgggacccctggggcgccagcggcatctgctacttatttggctccctgctggtggagttgttgttctcaagggctgtggctttcaacctcgacgtcatgggcgccctgaggaaggagggcgaacctggatcgctgttcggatttagcgttgccctgcatcggcaattgcaaccccgcccccagtcttggctgctcgtgggagctcctcaagccctcgcgctgcctgggcaacaggcaaatcgtacagggggactgttcgcgtgccctttgtcccttgaagaaaccgattgctacagagtcgatatagatcagggtgcggatatgcagaaggagtctaaagagaaccaatggctgggggtatcagttagaagtcagggcccaggtggaaaaatcgtgacatgtgcacataggtacgaagctaggcagcgggtggatcagatactggagacgagggatatgattggacggtgctttgtcctctcccaggatctggcaatacgagacgagctcgatggaggtgaatggaagttctgtgaaggacgccctcagggccacgagcaattcggcttctgccagcagggaactgctgcggctttcagcccggactcccactatctgctgttcggcgcacccggcacatacaactggaaaggcacagctcgtgtcgaactgtgcgcccagggctcagctgacctcgcacatttggatgacggaccatacgaagcgggaggggagaaggagcaggatcccaggttgatcccggtccccgcgaattcttattttggcttctccattgattcaggtaaaggactggtccgcgctgaggagctctccttcgtggccggcgcgccacgcgctaatcacaagggcgccgttgtcattctgaggaaagacagcgcatctaggttagtgcccgaggtgatgttgtccggagagagattaacttcaggattcggatattccctggctgtggctgacctgaatagcgacggctggccagatctgatagtgggggcaccctacttcttcgagagacaagaggaattggggggggcagtctatgtctacctgaaccagggcggccattgggccggaatctctccattacgcctgtgcgggtctcctgatagcatgtttggaatttcactagccgtgctcggggacttgaaccaagacgggtttccagacatcgccgtgggggcccctttcgatggggacggaaaggtgtttatttaccacggctcttctctgggcgttgtcgccaaaccgtcacaggtcctggagggggaagctgttggcatcaagtcttttggatacagcttaagtggatccctggatatggatgggaaccagtaccccgatttgcttgtcggaagccttgccgatactgcagtgctgttccgcgccagacctattcttcacgtgtcccatgaggtgagcatcgcgccaagaagcattgatctggagcagccaaactgcgccggcggccattcagtgtgtgttgatctcagggtatgctttagctacatcgccgtgcctagctcatattcccctactgtggcgttggattatgtgctggatgccgatacagaccgtcggttacgcggccaggtgccacgcgtcactttcttgtctaggaacctcgaggagcccaagcaccaggcaagtgggaccgtctggcttaaacatcagcatgaccgtgtgtgtggagatgccatgttccaactgcaggagaacgtgaaagacaaactccgcgccattgttgtgacattgagctattccctgcagacacctcgcctgaggcgacaggcacctggacaggggctcccccctgttgcccccatccttaacgcacaccagccttccacgcagcgagccgagatacactttctaaagcagggttgcggagaagataagatctgccagtctaacctacaattggtcagagcccggttctgtacccgtgtgtccgacactgagtttcagcctcttccaatggacgtagacggcacaactgccctgttcgcattgagtggccagcccgtgatcgggcttgagctgatggtgaccaatcttccttcggatcctgcccagccgcaggctgacggggatgacgcgcatgaagctcagctgctggtgatgctccccgacagcctgcactatagtggggtaagggccttagaccccgctgaaaagccgctttgcctgtccaatgagaacgcctctcacgttgaatgcgagttggggaatcctatgaagagaggagcccaggtgaccttctacctgattctaagcacgtcgggaatttccatcgagacaaccgagttggaagtagagctgttgttggctacaatctccgagcaggagctgcacccggtctctgcccgcgctagggtcttcattgaactgcccttgagtatcgcaggaatggctatccctcagcaactattcttctcaggggtggtacgaggggaacgcgctatgcagtctgaacgggacgttggtagcaaagtcaagtacgaagtgaccgtctcaaaccagggtcagtcgctgagaaccctgggaagtgctttcttaaatatcatgtggccccacgaaatcgccaacgggaagtggttactgtaccctatgcaggtggagctggaaggcggtcaagggccaggccagaaagggctctgcagtccgcgccctaatattcttcatctggacgtcgattcacgcgacagaagacgaagggaactggaacctcccgagcaacaggaacccggagaaagacaggaaccctcaatgtcctggtggcccgtctccagtgccgagaagaagaagaacataaccctagactgcgctcgtgggacagctaactgcgtggttttctcctgtcctctatatagcttcgatagggctgccgtactgcacgtttggggaagattgtggaatagcactttcctcgaagagtactctgccgtgaaatccttagaggtgatagtccgagccaacattacagtcaagtcatctatcaaaaacctgatgctgcgggatgcctccaccgtaattcccgtcatggtctacctagatcctatggctgtagtggccgaaggggtgccatggtgggttatcctgctcgcggtgctcgcaggtctgctcgtgctggccttgttagtgttgttactgtggaaatgcggcttcttccaccgctccagccaatcctcttcattccccacaaattaccaccgcgcttgcctggcagttcagccaagcgcaatggaggtgggaggacccggaacagtgggatgggacagctctaatgggcgttccactcccagacctccatgcccctcaacaatgcgatag

SEQ ID NO: 24566 - DNA, 3135 bp, Artificial Sequence
  Description of Artificial Sequence: Synthetic coding sequence
atggcccccttcgccacccccatggtgcaggccctgaccaccacccggatacagcgtcaggctgaaggttttcagtgctggagagaatgcgggacgcgcaggagcccttttgaaggaaaggaaacgtgcgcacacagatatgaagcccgccagagggttgaccagatcctggaaacccgtgatatgattggccggtgctttgtgttgagccaagacctggccatccgcgacgaactagacggaggagaatggaaattttgcgaaggcagaccccaggggcacgaacaattcggattctgccagcagggaacagccgccgcgttttcccccgactctcactatctgctctttggcgctcctggtacctacaattggaagggcaccgcgagggtggagctttgtgcccaggggagtgcagacttagcccacctggatgacgggccatacgaagccggaggagaaaaagaacaggacccacgcctgatcccagtgccggccaacagttactttggatttagtattgactccggtaagggcttggttagagcggaagaacttagcttcgttgctggggcgccccgggcaaaccacaagggggcagtcgtcatattgagaaaagacagtgcctctcggcttgttcctgaggtcatgctaagcggtgaacggcttactagtggcttcgggtatagcttggcggtagctgatctgaattctgacggatggcctgatctgatagtgggcgccccctactttttcgaaagacaagaggagctgggcggggccgtgtacgtctacctgaatcaggggggtcactgggctggaatctcaccattaaggctgtgcggatcccccgatagtatgttcggcataagcctcgcagtcctgggggacttaaaccaagacggctttccagacattgcagtcggagccccctttgacggagatggtaaggtgttcatctaccacgggtcatccttaggagtggtggcaaaaccttcacaagtcctcgaaggcgaggccgtgggtattaaatcctttggctattctctttcgggtagtctggatatggacgggaatcagtatccagacctgctggtagggagcctggccgacaccgctgtgttgtttagagcacggcctatccttcatgtgtcgcacgaggtgagtattgcacctcgttctatcgatctcgaacagccaaactgtgccgggggccatagcgtgtgcgtggatttacgcgtttgcttttcctacatcgcagttccatcgtcatattcgcctaccgttgccttggactatgtgctggatgccgataccgaccggaggcttaggggccaggttccccgcgtaacattcctctccaggaacctagaagagcctaaacaccaggcaagcggaaccgtgtggctgaagcaccagcacgatagagtctgtggggatgctatgttccagctgcaagaaaacgttaaagacaagctgcgagctattgtggtgacgttgagttactcactgcagactcctcggttacggcgccaggcccccggtcaaggcttgccacctgtggcccccatcctgaacgcccaccaaccttctacacagcgggctgaaatacatttcctcaagcagggttgcggggaagacaagatctgccaatcgaatcttcagttagtcagagccagattctgtacgcgcgtatctgacaccgagtttcagccgcttcctatggatgtggacgggacaacggcactgtttgctctcagcggacagccggtgatcggcctggagctcatggtgaccaacctgccttcagatcccgcccagcctcaggcggatggggatgacgctcacgaagctcaactgctggtaatgctgcctgactctcttcattattccggagtcagagccttggaccccgcagagaagccactctgtttgtccaatgagaacgcaagccacgtggaatgcgagctgggcaacccaatgaagagaggcgcgcaggttaccttttacctcatattatctactagtggaatttctattgagacaactgagcttgaggtggaactattgctcgccaccatttccgagcaggagttacatcccgtctctgcgagagctcgagtgttcatcgaacttcccctttcaatcgccggtatggccataccacagcagctgtttttttccggtgtcgtcagaggggaaagggccatgcagtccgaacgcgacgtggggtctaaggtgaaatacgaggtcacagtgagtaatcagggccaatcactcagaacactaggcagtgccttcctgaacattatgtggcctcatgaaatagccaatggtaaatggctgctgtatcctatgcaggtcgagctggaagggggccagggtccagggcaaaaaggactttgctctcctagaccgaacattttacatcttgatgtcgacagccgggatagaaggcggagggaattggagccccctgaacagcaggaacccggcgagcggcaggagccctccatgtcctggtggcctgtgagttcagctgagaaaaagaaaaatatcactctggactgcgcgcgggggacagctaattgtgtcgtgttcagctgccccctgtattcctttgatagagctgccgttctgcatgtgtggggaaggctgtggaactcaacattcctggaggaatatagcgctgtaaaatcactggaggttattgtgcgtgctaatatcactgttaagtcatccattaaaaatctcatgcttcgagatgccagtactgtaatacctgtgatggtataccttgatcccatggctgttgtagccgagggcgtcccatggtgggtgatcctgctcgcagtgctagccggcctactggtactggcgctgttggtgctgttgttgtggaagatgggattctttaaacgggcaaagcacccagaagccacagtgccccaataccatgccgtaaagattccccgcgaagacagacagcagtttaaagaggagaaaaccggcactatcctgcggaacaactggggatctcccagacgcgaggggccggatgctcatcccatccttgctgccgacggccaccccgaactgggtcccgacggacaccccggccctgggactgcatag

SEQ ID NO: 24567 - DNA, 3426 bp, Artificial Sequence
  Description of Artificial Sequence: Synthetic coding sequence
atggccggcgcccggagccgggacccctggggcgccagcggcatctgttatctgttcggttctctgctcgttgaactgctttttagccgagcggtagcgttcaacctggatgtgatgggggccctgaggaaagagggagaacctggcagtcttttcgggttttcggtggccctgcaccgtcagctgcagcctagacctcaaagttggcttctggtaggggccccccaagcactcgctctccctgggcagcaagcaaatcggactggcggcttattcgcttgccccctgtcccttgaggaaaccgactgttaccgggtcgacattgatcagggagccgatatgcaaaaggaatccaaggagaaccagtggctgggggtttccgtgaggtctcaaggacctggcggaaaaatagttacctgtgcacacagatatgaggctagacagcgcgtggatcagattctggagacccgcgacatgattggcagatgcttcgtgctgagccaggatctggcaattagagacgaactggacggcggagaatggaaattctgcgagggcaggccacaggggcacgaacaatttggtttctgccagcagggtaccgctgcagcgttctctcctgatagtcactacctcctgtttggtgcccccggcacttacaactggaaagggaccgcgagagtagagttgtgtgctcagggttcagccgacctggctcatctcgacgatgggccatacgaggctgggggggagaaggagcaggacccacggctcataccagtccccgctaattcatatttcgggttctcaatagactcaggaaaggggctggtgagggccgaagagttgtctttcgtggcaggcgctccgagagccaatcacaagggtgcagtggtcattctgagaaaagacagcgcatccaggctggtacccgaggtgatgctgagtggcgagaggttgacttccggctttggctacagcctggctgtggcggatctcaactcagacggatggccagatctgattgtcggcgctccctactttttcgagagacaggaagagctgggaggcgccgtttatgtgtatctgaaccagggcgggcactgggcggggatctccccactccggctctgcggttcgcccgactccatgttcggcatttcactggccgtgctgggagacttaaaccaggacggcttccctgatatcgccgtcggcgcgccgtttgatggagacggaaaagtgtttatttaccatggcagtagcctgggggtggtcgcaaagccctcccaggtgcttgagggcgaggccgtcggtatcaagtcctttggatattcccttagcggatcgcttgacatggacggtaatcagtaccccgacttacttgtgggcagtctggccgacaccgccgtactctttcgggcccgcccgatactgcatgtcagtcacgaagtttccatcgcacccagatctatagatctggaacagccaaactgtgccggcggccattcagtctgcgttgatctgcgagtctgtttctcctatatcgctgttccctcttcctactcacccaccgtggcactagattacgtactcgacgccgatactgatcgtcggctgcgcggacaggtgcctcgagttaccttcctttcccgcaacctcgaagagccaaaacaccaggcctctgggacagtgtggttgaagcaccaacacgacagagtatgtggtgatgccatgtttcagttgcaggagaacgtgaaagacaaactgagagctattgttgtcaccttgagttacagcttacagacaccccggcttcgaagacaggcccctgggcaagggctgcctcccgtggcacccattttgaatgcacatcagccttcaactcagcgagctgaaattcattttcttaagcaaggctgcggcgaagataagatttgccagagcaatttacagctcgtgagagccaggttttgcaccagggtgagtgacactgagtttcagcctctgccaatggacgtggacggtactaccgcgttgtttgccctgagcgggcagcccgtcatcggcctggaactgatggtgaccaaccttccctcagatcccgctcagccccaggccgacggcgacgatgcccatgaagcccagctattggtgatgttgccagattctttacattactccggcgtgcgagcgctggatcccgctgaaaagccactttgtctaagcaacgagaatgcttcccatgttgagtgtgaattgggcaacccaatgaagaggggcgcacaggtaacattttatctgattctctccactagcgggattagcattgaaacaactgaactggaagtcgaactacttctggctactattagcgaacaagagctgcacccagtgtcagctcgcgcccgggtgtttatagaactaccccttagtatcgccggaatggcaatccctcagcaactattctttagtggcgtggtgcgaggcgaacgggccatgcagtccgagcgggacgtgggttcaaaagtgaaatatgaagttaccgtcagcaatcagggccaatcgctccggacactaggatcagccttcctgaacatcatgtggcctcacgagatcgccaacggcaaatggctgctttatcctatgcaggtggaactagaaggtgggcagggcccgggacaaaagggcctgtgtagccctcgtccaaatatactccatcttgatgtggattctagagaccgccggcgtcgggaactcgaaccccccgagcagcaggaaccgggagagcggcaggaaccatccatgtcttggtggcccgtttctagcgctgaaaaaaagaagaacatcaccctcgactgcgccagggggactgccaactgcgtcgtgttctcctgtccactctactcgtttgaccgggccgccgtgttacatgtgtggggacggctgtggaattctactttcctggaagagtacagcgctgttaaaagtctggaggtgattgtccgcgccaatattacggttaagtcaagcatcaagaatctgatgctgcgggacgcaagcacggttattcccgtgatggtctacctcgatcctatggcggtggtggcggagggggtgccctggtgggtgatcctgttggccgttcttgccggcctacttgtgctggcacttttagttctcttgctttggaagatgggttttttcaagagagcaaagcacccagaagcgactgtcccccagtatcacgcggtgaaaatcccacgggaggacagacaacagtttaaggaggagaaaactggaaccatactgcggaacaactggggctccccccgtcgtgaaggacctgatgcccaccccatcttggctgcagatggacatcctgaactaggacctgacgggcatcctgggcccggtactgcctag

SEQ ID NO: 24568 - DNA, 3546 bp, Artificial Sequence
  Description of Artificial Sequence: Synthetic coding sequence
atggccggcgcccggagccgggacccctggggcgccagcggcatctgctatctgttcggcagtcttctggtcgagttgctgtttagccgtgcggtagcctttaacctggacgttatgggcgccttgaggaaggaaggcgagccaggcagcctattcggcttcagcgtcgctctccatcgtcagctgcagcctagacctcagagttggttactggtgggggccccccaggccctggccctgcctggacaacaggctaacagaaccggggggctttttgcctgcccacttagtctggaggaaaccgattgttacagagtggatatcgaccagggggcggatatgcagaaggagagcaaggaaaatcagtggctgggtgtcagtgttaggagccaggggcccggggggaagatcgttacctgtgcacatcgctacgaagctagacagcgggttgaccagattctggagacgcgtgacatgattggtagatgcttcgttctgagtcaagacctggccattcgggacgaattggacggcggtgagtggaagttttgcgaaggacgcccacaaggccatgagcagttcgggttctgtcagcagggaactgctgccgctttttcaccagatagccattatctcttattcggggcccccggcacttacaactggaagggcacggcacgcgttgagttgtgcgctcaaggttccgctgatctggcccatctggatgatggcccctacgaggccggcggagagaaggaacaggacccccggttgatcccagtgcccgcgaactcatattttggactgttgtttgtcactaacattgatagctctgatccggaccaactggtatataagactctggacccggcagaccggctccccggtccagcaggcgatctggcactgaatagctacctgggattcagtatcgattctggaaaaggtctcgtgcgagccgaggaattgagtttcgtcgccggcgctcctcgcgctaaccacaaaggggcagtcgtgatacttcggaaggacagcgccagtcgtctcgtacctgaggtcatgttgtccggcgaacgactgacaagcgggtttggttatagcttggctgtcgccgacctaaactcagatggttggcctgatctgattgttggagctccatattttttcgaaagacaggaagagttaggcggagcagtctatgtgtatttaaatcagggtggacactgggcaggcatttcccctctgcgcctatgtggcagtccggattctatgttcggcatttcccttgccgtcttaggcgacctgaatcaggacggatttccagacatagccgttggagctcccttcgatggggatggaaaagtcttcatctatcatggatctagcctgggagtcgtggcgaagccatcccaagtattagagggggaagctgtcggcataaagagcttcggctacagtctgtccggctccctggacatggacggaaatcagtaccctgatctgctggtagggagccttgccgacaccgcagtcttgttccgagcacggccaatcttgcacgtatcacacgaggtctctattgccccacgatccatcgatttggagcagcccaactgcgctggggggcattctgtgtgcgtggacttgcgggtttgcttcagttacattgccgtgcccagtagctacagccccactgtggctttggactacgtcctagacgccgacacggacagaaggctgcgaggtcaagtaccaagggtgaccttccttagccgcaacctggaagagcccaagcaccaggcctctggaaccgtgtggctgaaacaccagcatgatcgggtgtgtggtgatgcaatgttccagctccaggaaaatgtgaaggacaaattacgggctatcgtagtcaccctttcctactctctgcagacgccacggttgcggcgacaggccccagggcaagggctgccgcctgtggcgcctatccttaacgctcatcagccctctacacagcgcgccgaaattcacttcctaaagcaaggatgcggggaagataaaatttgccagagcaacctgcagctggtccgggcccgtttttgcacgagagtgagtgacacagaattccagcccctgcctatggatgtggatgggacgacagccctgttcgccttgagtggacagccggtgataggactggaactgatggtaaccaatctacccagcgaccccgcgcagccacaagcagacggggacgatgcccacgaagcccagttgttagtgatgttgcccgacagtctgcactattcaggcgtgcgcgcactggacccagctgaaaagcccttgtgcctgtcaaacgagaacgccagtcatgtggagtgcgaactgggtaatcctatgaagcgcggtgcacaggtcacgttctatctgatcctgtctacaagtggcatttccattgaaacgaccgagctcgaggtggagttattactcgccactatcagtgaacaagaactgcaccctgtctccgctcgcgcccgcgtcttcatagaactgcctctttccattgcgggcatggcaatcccacaacagcttttcttcagcggcgtcgtccgcggggagagggcaatgcagtctgagcgggacgtgggatcaaaggtcaaatacgaagtgacggtttcaaaccagggccagagcctgcgtacactagggtccgctttcctgaatattatgtggccacacgagattgctaatggaaaatggctcctgtaccccatgcaggtcgaactggagggcggacaagggcctggacagaaaggcctctgttcacctcggcccaatatactgcacctggacgtggatagtcgtgatagacgccgtagagagctagagccacccgagcagcaggaacccggagagcgtcaggaaccatccatgtcctggtggcctgtgtcttccgctgagaagaaaaagaatatcacattggattgtgccagaggaacagctaattgcgtggtgtttagctgcccactatattcttttgaccgagccgccgtgttgcatgtgtggggccgactgtggaattccacattcctagaggagtatagcgcagtgaaatctctggaggtgatcgtgagagcaaatatcacagtgaaatcgtccatcaagaacctgatgctgagagatgcttccacggttatacctgtgatggtgtatctggatccaatggcggtcgttgctgaaggagtgccttggtgggtgatcctcctagcagttttagctggcttgttagttttagccttacttgtactgttactgtggaaaatgggcttctttaaaagggccaaacaccccgaagccaccgtgcctcagtaccatgctgtcaagattccaagagaggatagacagcagttcaaggaggagaaaactggaaccattctgcgcaataactggggttccccaaggcgggagggacccgacgcccaccccatcctggcagccgacggccaccctgagctgggaccagatggccatccggggcctggcaccgcgtag

SEQ ID NO: 24569 - DNA, 3147 bp, Artificial Sequence
  Description of Artificial Sequence: Synthetic coding sequence
atggccttccccccccggcggcggctgcggctgggcccccggggcctgcccctgctcctctctggcctattgctgcctctgtgccgcgcttttaacttggacgtggattctcctgcggagtactcaggccccgagggttcctacttcggtttcgccgtggatttctttgttccatctgccagcagcaggatgttcttactggtcggagcgccaaaggctaataccacccagccaggtattgtagagggcgggcaggtgctcaagtgtgattggtccagtacgcggcgttgccagccaattgagttcgacgctaccgggaaccgggattatgccaaggacgaccccctggaattcaaaagccaccaatggttcggggcttcagtgagaagcaagcaggacaaaattctggcttgcgccccgctctaccactggagaaccgagatgaaacaagagcgggagccggtggggacctgctttctgcaggatggaaccaagactgtggaatacgccccttgcaggtctcaggatattgacgccgatggtcagggcttctgccagggcgggtttagtatcgactttacgaaggccgatcgagtacttctgggcggccctggaagcttctactggcagggccagttaatatccgaccaggttgctgagatcgtgtccaagtatgatccaaacgtctattcaatcaaatacaacaaccagctagcaacccggacagcccaggctatctttgatgattcttacctcggctactccgttgctgttggcgactttaatggggacgggatcgacgacttcgtatcgggagtcccacgggccgcccgcactttgggtatggtgtacatatacgacggcaagaacatgagctcgctttacaacttcacaggagaacagatggctgcatactttggctttagtgtggctgccacagatattaatggcgacgactacgccgacgtttttataggagctccactcttcatggacagaggaagcgacggcaagctacaggaagtcggacaggtctctgtgagccttcagcgcgcgtccggcgacttccaaacaacaaagcttaacggtttcgaggtcttcgccaggttcggttctgcgattgctcccctgggagacttagatcaggacggctttaatgatatcgcaattgccgccccatatggaggagaggacaagaagggaattgtgtacatttttaatggccggagtacgggattgaacgccgttccaagccagattttggaaggtcagtgggccgcacgtagcatgccaccttcttttggatactccatgaagggcgccacagacatcgacaaaaacggttacccagatctcatcgtcggcgcctttggggttgacagagctatcctgtaccgagccagacccgtgattacggtcaacgccggtctggaagtttacccatcaatcctaaaccaagacaataaaacatgctctctcccgggaaccgccctgaaggtgtcctgcttcaacgtgagattttgtctgaaagccgatgggaagggagtcctcccaaggaagctaaattttcaggtggaactgctcctagacaagcttaagcaaaagggggccatccggcgcgcactctttctgtacagccgcagcccctctcatagcaagaatatgactatcagcaggggggggctaatgcagtgcgaggaactgattgcctatctgagggacgaatcagaattccgcgacaagcttacccctatcactatcttcatggaataccgactggattataggactgcggccgacaccacggggctgcagcctatcctgaaccaatttaccccagccaacatcagtagacaggctcatatcctgctagattgtggtgaggacaatgtctgtaagcctaagctggaggtgtccgtggactcggaccagaaaaaaatctacatcggcgacgataatcctctaacactgatcgtcaaagcccagaatcagggcgagggagcatatgaagctgaactaattgtgtccatccctcttcaggccgatttcattggggtcgtgcgaaataacgaggcgctagcgcggctttcctgcgccttcaaaacagaaaatcaaactcggcaagttgtctgcgacttgggaaacccaatgaaggcaggcactcagctgcttgccgggcttcggtttagtgttcaccagcagtccgagatggatacgagtgtgaaatttgacctgcagattcagtcctcaaatctatttgataaggtcagtcctgtggtctcccacaaggtggacctcgccgtcctggctgccgtggaaattcgcggagtctctagcccagaccatgtgttcctccctatccctaattgggaacacaaagaaaatcccgagaccgaggaggatgtgggccctgtggtacagcacatttatgaactgcgaaataacgggccatcctctttctccaaagctatgttgcaccttcagtggccttacaaatataataataatactcttctctatatactccactatgacatcgatgggccaatgaattgtacgtctgacatggagatcaatcctctccggattaaaatctccagcctccagactacagaaaaaaatgacaccgttgccgggcagggtgaaagagaccacctcattactaagcgcgacttagcactgagcgagggtgatatacacacactgggttgcggggttgctcaatgtttgaaaatcgtgtgccaggtgggacgcttagacagaggaaagtcggcaattctatatgtgaagtccctactgtggactgagacattcatgaataaagaaaaccagaaccactcgtacagtcttaaatcatctgccagcttcaacgtcatcgagttcccatacaaaaatcttcctattgaggatataactaactctactctggttacaaccaatgtgacctggggcatccaacccgctcccatgcccgtccctgtttgggtgattattctggccgttctggccgggctcttgctcctggctgtgctggtgtttgtgatgtataggatgggattcttcaagagggtccgcccgccccaggaagaacaggagcgcgaacaactccagccccacgagaacggggaaggtaactcagagacatag

SEQ ID NO: 24570 - DNA, 3039 bp, Artificial Sequence
  Description of Artificial Sequence: Synthetic coding sequence
atggccttccccccccggcggcggctgcggctgggcccccggggccttcctttgttactctctggacttttgctacctctctgtagagcctttaatctggatgttgactcacccgctgagtactcgggccctgaaggatcatacttcgggtttgctgtcgatttcttcgtcccaagcgcctccagtcgaatgttcttattggttggggctcctaaagctaataccacacaaccaggaatcgtggaaggcgggcaggtgcttaagtgtgactggagcagtaccaggaggtgccagcctattgagttcgacgctaccgggaaccgcgactacgccaaggatgaccccctggagttcaaaagccaccaatggttcggcgcgtcagtgcgctctaagcaggataaaatcctggcttgtgctccgttatatcactggagaactgagatgaaacaggagagagaacccgttggcacctgcttcttgcaggacgggaccaaaacggttgaatacgcaccatgccgatcacgccaactgatctccgaccaggtagccgagattgtgagtaagtatgaccctaacgtatattctatcaagtacaataaccagttggcaactcgcaccgctcaagccattttcgacgactcatatctcggatatagtgtggctgtgggagattttaacggtgacggaatagatgactttgtgtcaggggtgccacgggccgccagaaccctggggatggtgtacatctatgacggtaagaacatgtcctctctgtacaattttacaggggagcagatggcagcatacttcggttttagcgtggccgccacagatataaatggggatgattacgctgatgtgtttattggtgcaccgttattcatggataggggcagcgatggcaagctgcaggaagtgggtcaggtcagcgttagcctgcaaagagccagtggagatttccagaccacaaaactgaacgggtttgaggtgtttgctcgttttggtagcgccatagcaccattgggggacctggaccaggatggctttaatgacatcgccattgccgccccctatggtggcgaggacaaaaagggcattgtgtacatttttaacggtcggtccaccgggctgaacgctgtgccctcccagatcctagagggacaatgggctgccaggtccatgcccccctcttttggttatagcatgaaaggggctacagatattgacaaaaacggctaccccgacctgatcgtcggtgctttcggggttgaccgcgcaattttgtaccgggcaagacccgtcataaccgttaatgccggcctcgaggtatatccctcgattctcaaccaggataacaaaacctgtagcctcccaggcacagccttaaaagtgtcgtgcttcaacgtgagattttgtctaaaggccgatggcaaaggcgtacttcctagaaaacttaactttcaggtggaattattgctcgacaagctaaagcaaaaaggcgccattaggcgcgcgctcttcctgtatagcagatctccttcccactctaagaatatgactatctctcgtggaggactcatgcaatgcgaggaactcatcgcctatcttagggatgaatcagagtttcgcgacaagttgaccccgataaccatctttatggagtaccggcttgactataggacagccgcagataccacgggtctgcaacccatcctcaatcagttcacgccggctaacatatcaagacaagctcatattcttcttgattgtggcgaggacaacgtgtgcaaaccgaaactagaggtctccgtcgatagcgaccagaagaagatatacataggtgatgataacccccttaccctgattgtgaaggctcaaaaccagggagagggggcttacgaagctgagctcatcgtgtccatcccactgcaagctgacttcatcggagtagtccgaaacaatgaagccttggctcggctgtcgtgtgcattcaaaactgagaatcagactagacaggttgtttgcgatttggggaaccctatgaaagcgggaacccagctgttggctgggttgcgatttagcgtgcaccagcagtccgagatggatacatctgttaaattcgatctgcagattcaatcctccaatttgttcgacaaggtttcgcctgtggtgtctcacaaggtggacctggccgtgctggctgccgtagagatccgcggcgtttcttcccccgatcacgtgttcttgccaatacccaactgggagcacaaagagaacccagaaacagaggaggatgtaggtcccgtggtccagcacatatacgaactgagaaataatgggccttcctctttcagtaaagcaatgctgcatctccagtggccttataaatacaacaataatacgctgctgtatattctccattatgacatcgacggacccatgaattgtacttctgacatggagatcaaccctttgaggattaagattagctcgcttcagaccaccgaaaaaaatgataccgtcgccggacagggcgaaagagatcaccttatcactaaacgggacctggccttgagcgagggggacatccataccctgggttgtggcgtggctcagtgcctgaagattgtgtgtcaagtggggagactcgacagaggtaaaagtgctatcctgtatgtgaagagcctactgtggacggagacctttatgaataaagagaaccagaaccacagctattcactcaagtcaagtgcaagcttcaacgtcatcgaatttccatataaaaatcttcctatcgaggatatcacaaacagcacactggtcacaaccaacgttacttgggggatccagcctgcgcctatgccagtgcccgtgtgggtgatcatactggcggtactggctggtctcctgctcctcgccgtgctggtgtttgtcatgtatagaatgggatttttcaaacgagtcagacctccccaagaagaacaggagcgcgagcaactgcagccacacgagaatggggaaggcaattcagagacctag

SEQ ID NO: 24571 - DNA, 3009 bp, Artificial Sequence
  Description of Artificial Sequence: Synthetic coding sequence
atgctgctgggcaccctgctgctgatcctgtacatcctgatgctgtgcaggatgtttctgttagttggtgctccaaaagccaataccacccagccaggaattgttgagggcgggcaggtgctcaaatgtgattggtctagtacgcgcagatgtcaaccaattgagttcgatgccaccggaaatagggactacgcaaaggatgacccactggaatttaagagtcaccaatggttcggggccagcgtccggtcaaaacaggacaaaattctggcttgtgctcccctataccactggcggactgagatgaaacaggagagggaaccagtgggcacatgcttcctccaggatggaaccaagactgtggaatatgccccttgtcggagccaggacatcgacgcggacggacaaggcttctgccaggggggttttagcatcgacttcaccaaagccgaccgggttttgctcggcggtcccgggagcttctactggcaaggccaattaatttctgaccaggtagctgagattgtgagcaagtacgaccctaatgtctatagtatcaagtacaacaatcagctggcgacaagaacagcacaggccattttcgacgattcttatctgggctactcagtggccgttggagatttcaacggcgacgggattgacgatttcgtgtccggagtcccaagggcagcaagaactttgggcatggtatacatttacgacggaaagaacatgtcctctttgtataactttacaggtgagcaaatggctgcgtattttggatttagtgtagcagcaaccgacatcaatggagatgactatgcagacgtttttattggggcccccttatttatggatcgcggtagcgatggaaaacttcaggaggtcggccaagtctccgtctcactccagcgcgcgagcggggacttccagacaacgaagctgaatgggtttgaagtattcgcaagattcggatcagccatagcgccgttaggagacctcgatcaagatgggtttaacgacatcgctatcgccgctccatatggcggagaagataagaaagggattgtctatattttcaatgggaggtcaactggcttaaatgccgtgcctagtcagattcttgagggccagtgggcagcaaggagcatgcctccttcatttggctacagcatgaaaggcgcaacagacatcgataaaaacggctatcccgatctaatagtcggtgcatttggagtggatcgcgcaattctatatcgtgcaagacccgttattaccgtcaatgccggcctggaagtatatccatctattctaaatcaggacaataagacttgcagcttgcctggtaccgctcttaaagtgtcttgcttcaatgtgcgcttttgtctcaaagctgatggtaagggggtcctaccacggaagctcaacttccaggttgaattgttgctcgataagctgaaacagaagggcgctattcggcgagcgctgttcctctactcccgcagccccagccactcaaaaaatatgacaataagtcgcggtgggttaatgcagtgtgaggagttaattgcctaccttagagatgagtccgagtttagagataaactaacacctattacgatctttatggaatatagactggattatcgcacggccgccgatacaactggcctgcagccgatcctcaaccaattcacccctgccaacatcagcagacaggcccacatcctgctggattgtggtgaggataacgtctgcaagccgaaactcgaggtatctgtcgactctgatcagaaaaaaatttatatcggggatgacaacccactgactctgatcgttaaggcgcagaaccagggcgagggcgcctacgaggctgagctaatcgtaagtatacccctgcaggcggatttcattggagtagtgaggaacaatgaggcactggccagattatcttgcgctttcaagacagagaatcagacgaggcaggtcgtgtgtgaccttggaaaccctatgaaggcaggtacccaactgctcgcgggactgagattttcagtacatcagcagagcgaaatggatacctcagtgaagttcgatcttcaaatccaatcctcaaacttgtttgacaaagtttcccctgtggtgtcccataaggtggacttggcggtgctggccgccgtggaaatccggggcgtttcttcccccgaccacgtctttctgcctatccctaactgggagcataaagaaaaccccgaaaccgaggaggacgtcgggcctgtggtgcagcatatctacgaattacgcaacaacggcccatcgtcgttcagtaaggctatgctacacctccagtggccatacaaatacaacaacaatacactgctgtacatcctgcattatgacatcgacgggcccatgaactgtacctccgacatggagattaacccgctgcgtatcaaaatctcctctctgcaaaccacagagaagaatgacactgtggccgggcagggtgaaagggatcatctgatcactaagcgtgacctggccttgagtgaaggcgacatccataccctgggatgtggcgtcgcccagtgccttaagatcgtatgtcaggtgggtcggctcgaccgtggaaaaagtgcgatactgtacgtaaaaagcctcctgtggacagaaactttcatgaataaagagaaccagaaccattcctactccttgaaaagctcagcctctttcaatgtgatcgagttcccctacaagaacctcccgattgaggatattactaattcaactctggtgacgacaaatgtgacatggggcatacagccagccccaatgcccgtccctgtctgggtgatcattctggctgtgctggctgggcttctgctgttggcggtacttgtgtttgtcatgtataggatgggattctttaaaagagtacggcccccccaggaggaacaggagagggaacagttacagcctcatgagaacggtgagggcaatagtgagacttag

SEQ ID NO: 24572 - DNA, 1449 bp, Artificial Sequence
  Description of Artificial Sequence: Synthetic coding sequence
atggccttccccccccggcggcggctgcggctgggcccccggggcctgccccttctcctgagcggcctcctgcttccactgtgtagagcttttaatttggacgtcgactctccggctgagtattcaggaccagaaggttcttacttcgggttcgcagtcgacttttttgtaccctcagctagttctaggatgtttcttctcgtcggcgcgccaaaggccaatacgacgcaacctggcatcgtggagggtggccaggtgctgaaatgcgattggagttccacacgacgatgccaacctattgaattcgacgcaactggtaaccgagattacgccaaggacgatcctttggagttcaagtcacaccagtggttcggagcctctgtgagaagtaaacaagataaaatcctcgcatgcgcgccgttatatcattggcggacagagatgaagcaagaaagagagcccgtcgggacttgcttccttcaggatgggaccaaaactgtcgagtacgccccttgccggtctcaggacatagatgctgacgggcaaggcttctgtcaaggtggctttagcatcgatttcaccaaggccgaccgcgtgctgctgggaggaccaggttcattctattggcagggacagttgatttcggaccaggtggctgagatcgtgagtaaatacgacccgaatgtgtattctattaaatacaataatcaactggccactagaaccgcccaggcaatcttcgatgattcgtacctaggttacagtgttgctgtgggcgacttcaatggagacggaatagacgactttgttagtggagtgccccgcgccgcccgcactttaggtatggtctacatttacgatggtaagaacatgagttccttgtataacttcacaggggaacaaatggcggcctattttggcttctctgtggcagctaccgatatcaatggtgacgactatgccgacgttttcattggggccccacttttcatggataggggctccgatggaaagcttcaggaagtgggtcaagtgtcggtatctctgcagagggcttccggggatttccaaaccacgaagcttaacggattcgaggtgtttgcccgttttggctccgctatcgcaccattgggggatttagaccaggacggattcaacgatatcgccatagccgcaccctacggcggtgaagataaaaagggcattgtttatatctttaacggccgctcaaccggattaaatgccgtgccttctcagatcctggagggacagtgggccgccagatctatgcctccttcgtttggctatagcatgaagggtgctaccgacatcgataagaacggctatcctgaccttattgtcggagcttttggagtggatcgagcaatactgtacagagcgcgacctgtgattccaatcttcgttcagttacatcacgtggtccactag

SEQ ID NO: 24573 - DNA, 2397 bp, Artificial Sequence
  Description of Artificial Sequence: Synthetic coding sequence
atgaacctgcagcccatcttctggatcggcctgatcagcagcgtgtgttgtgtgttcgcacagaccgacgaaaatagatgtctgaaagcgaacgccaagtcatgtggagaatgtatacaagctggcccaaattgtggttggtgtaccaacagtactttcctgcaggaaggaatgccgactagcgcgcggtgcgatgatcttgaggctctcaaaaagaaggggtgtcctccagatgatatagagaatcctcgtggctctaaggatattaaaaagaataagaatgtcaccaaccgctccaaagggactgctgaaaaactgaaacctgaggatattacacagatccagcctcagcagttagttttgcggctcagatcgggggagcctcaaacttttacactgaagttcaagagggccgaagattaccccatcgacctctactatctaatggatctgtcctattctatgaaggacgaccttgaaaatgtgaagtccctcggtactgaccttatgaacgaaatgcgccgaatcacaagtgacttccgcatcgggttcggttcttttgtggagaaaacagtgatgccttacatctctaccacaccggccaagctccgcaacccatgcacatccgagcagaattgtaccagtccgttttcctacaagaatgttctgtcattgaccaataaaggcgaggtatttaacgagctggtgggcaaacagcgcatttctggcaacctcgactcccccgagggcggcttcgatgccatcatgcaggtggcggtgtgcggaagcctaatcggatggagaaacgtgaccaggcttttggtgttctccaccgacgccgggtttcatttcgcgggggatggaaaattgggaggaattgtgttacccaacgatgggcagtgccacttggagaataacatgtacaccatgagtcactactatgactacccttctattgcgcatctggtccagaaactgagcgagaataacatccagacaatctttgccgtaaccgaggagtttcagcctgtgtacaaggaacttaaaaatttgatacccaagtcagccgttgggactttgtcggctaacagctccaatgttatacagttgatcatcgatgcctataattctctgagctctgaggtgattctagaaaatgggaaactcagcgagggcgtgaccattagttacaaaagttattgcaaaaatggagtaaacggaactggcgagaatggtagaaagtgcagcaatatctctatcggcgatgaagtgcagttcgagatcagcattactagtaacaaatgtcccaaaaaagattctgattccttcaagattcgccccctgggcttcaccgaggaggtggaggttatccttcagtatatctgtgagtgcgagtgtcagagcgaaggaatacccgagagtcctaaatgccatgagggcaatggaacatttgagtgtggcgcatgccggtgcaatgaggggcgcgtcgggcgacattgtgagtgtagcacagatgaagttaattctgaggacatggatgcgtactgtaggaaagaaaattcttccgagatctgttcaaataatggcgagtgtgtttgtgggcagtgcgtgtgtagaaagagagataacacaaatgaaatctacagcggtaagttttgcgagtgtgataatttcaactgcgatcgctccaacggccttatctgcggcggaaatggggtatgtaaatgccgggtctgcgaatgcaacccaaactatactggtagcgcctgtgattgcagtctcgacacctccacctgcgaggcttcaaatggccaaatatgtaatggccgagggatttgcgagtgtggggtctgcaaatgtaccgaccctaaatttcaagggcagacctgtgagatgtgccaaacctgtttaggagtgtgtgccgaacacaaagagtgcgttcagtgccgcgcctttaacaagggtgagaagaaggatacgtgcacccaggaatgcagctatttcaacatcaccaaagtcgaatcgcgcgataagctgccccaaccagtgcaacccgatcccgttagccactgtaaggaaaaagatgtggatgactgttggttctacttcacatattccgtgaacggaaataatgaagttatggtgcacgtggtagaaaatcctgaatgtccaacgggacccgatatcattccgattgtcgctggagtggttgccggcatagtactcattggcctggccctgttgttgatctggaagctgttgatgattattcatgacagacgggagtttgcgaaattcgagaaagaaaaaatgaacgcaaagtgggatactggagagaatccaatttataaatcagcggtgacgactgtcgtcaatccaaaatacgaagggaagtag

SEQ ID NO: 24574 - DNA, 2478 bp, Artificial Sequence
  Description of Artificial Sequence: Synthetic coding sequence
atgaacctgcagcccatcttctggatcggcctgatcagcagcgtgtgttgcgtatttgcacagacggacgagaatcgctgcctgaaagctaacgccaagtcctgcggggagtgtatacaggcaggcccgaactgcggatggtgtaccaattcgaccttcttacaggaaggcatgccaactagcgcccgctgcgacgatctcgaggctctgaagaagaaaggctgtccacccgatgacattgaaaacccaagggggagcaaggatataaaaaagaacaaaaatgtcacaaaccgatccaagggtaccgctgaaaaactcaagcccgaagatattacacagatccagcctcagcagttggtccttcgcttgagatcgggagagccgcagactttcacccttaaattcaaaagagctgaggattatcctattgacctgtattacctgatggatctgtcttatagcatgaaggacgatctggagaatgtcaagagtcttgggaccgaccttatgaatgagatgcggagaattacgagtgattttcgtatcgggttcggatcgtttgtggagaaaacagtgatgccttacatctccacaacccctgcaaaattgagaaacccatgtacctcggaacagaactgcactagccctttcagttacaagaacgtgctgagtctgactaataaaggcgaagtcttcaatgagctggttggtaagcagcgtatctcaggcaaccttgattcccccgagggaggctttgacgcaatcatgcaggtcgcagtctgtggctccctgatcgggtggagaaatgtgactcgcttgttggtattctccacagatgcgggattccatttcgctggcgacggaaagctcgggggtatcgtcctgcccaacgacgggcagtgccatctggagaacaacatgtatacaatgtcgcactactatgactacccttccattgctcatctggtgcaaaaacttagcgagaacaatatccagacaatattcgctgttaccgaagagtttcagcctgtatacaaggagttgaagaatctgatacccaagtccgcagtgggaacgttaagtgctaattccagcaacgttattcaactgataattgatgcatacaacagtttgagttctgaggttatactggaaaacgggaaactaagcgagggggtgacaatttcatacaaatcatattgcaagaatggtgttaatgggacaggcgaaaatggccggaaatgctccaatatttctattggggatgaggtccaattcgaaatctccatcaccagcaataagtgtccaaagaaagacagcgattcttttaagatccgccctttgggatttaccgaggaggtcgaggttatcctccagtacatttgtgagtgcgagtgtcaatcggaaggcatccctgagagcccgaagtgtcacgaggggaatggtacctttgagtgcggggcgtgccgatgcaacgaaggcagggttggtcgacattgcgaatgttctacagacgaggtgaattctgaggatatggatgcctattgcaggaaggagaacagtagcgaaatctgtagtaataacggcgaatgtgtgtgcggtcagtgcgtgtgtcgcaagcgcgacaatactaatgagatctattctggcaagttttgcgaatgtgacaacttcaattgtgacaggtcaaacggcctgatttgtggggggaacggagtctgtaagtgtagggtgtgcgagtgcaatcccaattatacaggctcagcctgcgactgctccctggatacctctacgtgcgaagcttccaatgggcagatctgcaacgggcggggtatttgcgagtgcggtgtctgcaaatgtactgatcctaagtttcagggccagacctgcgagatgtgtcagacctgtctgggagtgtgcgcagaacataaggagtgtgtccaatgcagggctttcaataagggggaaaaaaaagatacctgtacccaggagtgttcctattttaacatcactaaggtggagagtagggacaaacttccacagcctgtgcagcccgatccagtatcccattgtaaggagaaagacgtggatgattgctggttctatttcacctactctgtaaacgggaataacgaagttatggtgcacgtagtggagaaccccgagtgtccaactggccctgacataattccaattgtagctggggttgtggctggaatcgtattaatcgggttggcccttttgctaatctggaagctgttaatgattatccacgaccggagggagtttgcgaaattcgagaaggaaaaaatgaacgccaagtgggacacttcattatcagtggcgcagccaggggtccagtggtgtgacatcagctccttgcagccactcacttcccgattccaacaattctcttgcctgtctctgccgtccacttgggattatagagtgaagatactctttattagggtgccctag

SEQ ID NO: 24575 - DNA, 2397 bp, Artificial Sequence
  Description of Artificial Sequence: Synthetic coding sequence
atgaacctgcagcccatcttctggatcggcctgatcagcagcgtgtgctgtgtgttcgcacagaccgacgaaaatcggtgtctcaaggccaacgcaaaaagctgcggtgagtgtatccaggcaggcccaaactgcgggtggtgtactaactccacctttttgcaggaggggatgccgacatctgctaggtgtgatgatcttgaagctctgaaaaaaaagggctgccccccggacgacatcgagaatccaaggggctctaaagacatcaagaagaataaaaacgtcaccaacagatcgaagggaacggccgagaagcttaaacctgaggatatcactcagatccaacctcagcagctcgttctccggctcaggtccggggagccccagacattcaccctcaaatttaagcgggccgaagactatcctattgacttatactatctgatggacctgagctacagtatgaaagatgatctggagaatgtcaaatctctggggaccgatcttatgaacgagatgcgaagaataacaagtgacttccgcatcggtttcggaagcttcgttgaaaagaccgtgatgccctatatcagtaccacacccgccaaactccggaacccttgcacatccgagcagaattgcacatcccctttttcttacaagaacgtgctctccctcactaacaaaggagaagtctttaacgagctagtggggaaacagaggatcagtggcaacttagattctcctgaggggggcttcgacgcaatcatgcaggtggcagtttgcggctcactcatagggtggcggaatgtcactcggttgctggtcttctctacggatgccggctttcattttgcgggcgatggaaagcttggcggtattgtgctgcctaatgacggtcagtgtcatctcgagaataatatgtacaccatgtcccactactatgattatccctcaattgcacatctggttcagaagcttagcgaaaataacatacagaccattttcgctgtaactgaggaatttcagcccgtctataaggagctgaagaacctgattcctaagtcagctgtggggacactgtccgccaacagctccaacgttatccagcttattattgacgcctacaatagtttatcaagcgaggtgattttagagaacggaaaactgtccgagggagtcaccatctcatacaagagctattgcaagaatggtgtcaatgggactggcgaaaatggacgaaaatgttctaacatttccattggggacgaagtgcaattcgagatcagcatcacctccaacaagtgcccaaagaaagactctgatagtttcaaaatccgccctcttggcttcactgaagaggtcgaggtcatattacagtatatctgcgagtgtgaatgtcagagtgaagggatccctgagagcccaaaatgtcatgaaggaaacggaactttcgagtgcggagcctgccggtgtaacgaaggccgggtcgggcgccactgcgagtgtagcactgatgaggtgaacagcgaagacatggatgcttactgtaggaaagagaactctagtgaaatctgctctaacaatggtgagtgcgtctgcggacagtgtgtatgtaggaagcgagacaacactaatgaaatttatagtggcaaattttgcgaatgtgacaatttcaattgcgatcgttctaatgggttgatctgtgggggtaatggcgtgtgcaagtgccgggtgtgcgaatgtaaccctaactatactggctcagcctgcgattgtagcctggatacttccacctgcgaggcctctaatggacagatttgcaatggccgcggaatctgtgaatgtggggtgtgcaagtgtactgacccgaaatttcagggccagacctgtgaaatgtgtcaaacttgtcttggagtgtgcgcggaacataaagagtgtgtccagtgcagggcttttaataaaggagagaaaaaagacacgtgcacccaagagtgttcttatttcaacataacaaaggtggagtctcgcgacaaacttccccaacccgtgcagccggacccagtttctcactgtaaggagaaagacgtagatgactgttggttttatttcacgtactcagtgaatggtaataatgaagtcatggtccacgtggtggagaatccagagtgtcccaccgggcctgatatcattcctatcgtggctggcgtggtcgctggtatcgtgttgatcggacttgctctgttactcatttggaaactgctcatgattatccacgacagaagagagttcgcaaagttcgagaaagagaaaatgaatgcaaaatgggatactggtgagaaccccatttataagagcgcagttacaaccgtggttaacccgaagtatgaggggaaatag

SEQ ID NO: 24576 - DNA, 150 bp, Artificial Sequence
  Description of Artificial Sequence: Synthetic coding sequence
atgaacctgcagcccatcttctggatcggcctgatcagcagcgtgtgttgtgtgttcgctcagacagacgagaaccgatgtctgaaggccaatgcgaaatcctgcggtgagtgcattcaggctggccctaactgtgggtggtgtacatag

SEQ ID NO: 24577 - DNA, 270 bp, Artificial Sequence
  Description of Artificial Sequence: Synthetic coding sequence
atgaacctgcagcccatcttctggatcggcctgatcagcagcgtgtgctgcgtgtttgcgcagactgatgaaaatcgatgccttaaagccaatgctaagtcctgcggagagtgcatacaggccggccccaactgcggatggtgcaccaactccacttttctccaggagggtatgcccaccagcgccaggtgcgacgatttagaggcactaaaaaaaaagggctgtccacctgatgatatagagaaccctagaggaagtaaggacatttag

SEQ ID NO: 24578 - DNA, 2406 bp, Artificial Sequence
  Description of Artificial Sequence: Synthetic coding sequence
atgaacctgcagcccatcttctggatcggcctgatcagcagcgtgtgttgtgtcttcgctcaaacagacgagaatcgttgtcttaaggccaacgccaaaagctgcggtgagtgcattcaggcagggccgaactgcgggtggtgtaccaacagcactttcctccaggaagggatgccaacctcagctaggtgtgacgacttggaggctttaaagaagaaggggtgcccaccagacgacatagagaacccaagaggtagtaaggacatcaagaagaacaagaacgttacaaaccggtctaagggtactgccgaaaaactgaagccagaggatattactcagattcaaccgcaacaactggtcctaagactgaggtcaggagagcctcaaaccttcaccctgaagtttaagcgcgcagaagactatcctattgatctgtactatctgatggacctatcctattcaatgaaggacgacttagaaaacgtcaaatccttaggcacagacctaatgaacgagatgcgaaggatcacatctgactttagaatcggctttggctcctttgtggaaaaaaccgtaatgccttatatttccactacccctgctaaactccgtaatccctgtacctctgaacaaaactgcactagtcctttcagctacaagaatgtcctgtctctaaccaacaagggggaagtctttaatgagctcgtcgggaagcagcggatatctggcaacctggactcacctgagggaggattcgatgcgattatgcaggtggccgtgtgcgggtcactcatcggttggcgaaatgtaaccagactgttagtgttttcgactgacgcgggcttccacttcgctggagatggaaagctcggcgggattgtgctcccaaatgatggccaatgccacctagagaacaatatgtatacgatgagtcattactacgattatccttcaatcgctcatctcgttcagaagttgtcagagaataatattcagacaatctttgcagtgaccgaagagtttcagcctgtgtacaaggagctcaagaatctgatccccaaatccgcggtgggcacgttgtctgctaactcttccaatgtgatacagctgatcatcgatgcctacaacagcctgtcatccgaggtaattttggagaatggaaagctaagcgagggggtcaccatttcatataagagctactgtaagaacggagtaaacggaaccggagagaacgggagaaaatgctccaatattagcatcggagacgaggtgcagttcgaaatctcaattacgagcaataaatgtcccaagaaagattctgattccttcaagatccgacctttagggtttaccgaggaggttgaagtgattctccagtacatctgcgagtgcgagtgtcagtcagagggaatcccagagtctccaaagtgccatgaggggaacgggacatttgaatgcggcgcttgccggtgcaatgaaggaagggtcggacgccactgtgaatgctcaacagacgaggttaatagtgaagacatggatgcttactgccggaaagagaatagcagcgagatctgttccaacaacggagagtgcgtttgcggccagtgtgtttgtcgcaagcgggataacaccaacgaaatctattccggtaaattctgtgaatgtgacaatttcaattgtgaccggtccaatggcctgatttgcggaggcaatggcgtctgtaagtgccgtgtgtgcgagtgtaatcctaattataccggcagcgcatgcgactgtagcctggacacttctacctgcgaagcatctaatggccaaatatgtaacggacgaggcatctgcgaatgtggagtgtgtaagtgcacagatcccaagttccagggccaaacctgcgagatgtgccagacctgcttaggcgtctgtgccgagcacaaggagtgtgtgcaatgtagggctttcaacaagggagagaagaaagatacctgcacacaagaatgttcttatttcaatatcacaaaggtggagtcaagggacaagcttccacagccggtacaacctgaccccgtgtcacactgcaaagagaaggacgtcgatgactgctggttctatttcacttattctgtcaacggtaacaatgaagttatggtacacgtagtcgaaaaccctgagtgcccaaccgggcctgatattataccaatcgttgcaggtgtcgtggcagggatagtactaatcggactcgctttactgctgatttggaagctcctcatgatcattcacgataggagagagtttgccaaattcgagaaggagaagatgaatgccaaatgggatactcaggaaaacccaatatataaatcacctatcaacaattttaagaaccccaactatgggcggaaggcagggctgtag

SEQ ID NO: 24579 - DNA, 411 bp, Artificial Sequence
  Description of Artificial Sequence: Synthetic coding sequence
atgaacctgcagcccatcttctggatcggcctgatcagcagcgtgtgctgtgtgttcgctcagactgacgagaacagatgtctgaaggccaacgccaagtcttgcggcgagtgtattcaggccggtcctaactgtgggtggtgcacgaacagcacctttcttcaagaaggaatgcctacaagcgcccgctgcgatgatctcgaagccttgaagaaaaagggatgtccacccgacgatatcgaaaacccaagagggtctaaggatatcaaaaagaacaaaaacgtgacgaacaggagcaaaggtacagcagaaaagcttaagcccgaagacatcacccagattcaaccccagcagctggtcctacggctacgttctggtgaaccacagactttcaccctgaaattcaagtag

SEQ ID NO: 24580 - DNA, 378 bp, Artificial Sequence
  Description of Artificial Sequence: Synthetic coding sequence
atgaacctgcagcccatcttctggatcggcctgatcagcagcgtgtgttgcgtgtttgcccagaccgacgaaaatcggtgtctgaaagccaatgcaaaatcatgtggcgaatgcatccaggccggccctaattgtgggtggtgcacgaattctacctttctacaagaagggatgcctacctcagctagatgtgacgacctggaagccctaaaaaaaaagggctgcccccctgacgatatagaaaatcctaggggttctaaggatatcaagaaaaacaagaatgtgactaacagatccaaaggaactgccgaaaaactgaagcccgaggatattactcagattcaacctcagcagctggttctccgcctgaggtcttag

SEQ ID NO: 24581 - DNA, 492 bp, Artificial Sequence
  Description of Artificial Sequence: Synthetic coding sequence
atgaacctgcagcccatcttctggatcggcctgatcagcagcgtgtgttgcgtgttcgcacaaactgatgagaatcggtgtctaaaagcaaacgccaaatcctgtggggagtgcatacaagcagggcccaattgtggttggtgcacaaatagcacattcctgcaagaggggatgcctacctcagcccgctgtgacgacctggaagcgctgaaaaagaagggttgccctccggatgacatcgaaaatccaagggggagcaaagatataaaaaaaaacaaaaatgtgaccaatcgcagtaaggggacggctgagaagctgaagcctgaagatatcacgcagattcagccgcaacaattagttctgcgattgcggtctggtgagcctcagaccttcactcttaagttcaaaagagctgaggattatccgattgacctctattatctgatggacctttcatactctatgaaggatgatctcgagaatgtgaaatag

SEQ ID NO: 24582 - DNA, 459 bp, Artificial Sequence
  Description of Artificial Sequence: Synthetic coding sequence
atgaacctgcagcccatcttctggatcggcctgatcagcagcgtgtgttgcgtctttgctcagacggacgaaaaccgatgcctaaaggcgaatgccaagagctgtggcgagtgcatccaggctggacccaactgcgggtggtgcactaacagtgtaagcaaaacctttctgcaagaggggatgcccacatctgctcggtgtgacgatctggaggctttaaagaaaaagggctgtccccctgatgacattgagaaccctagaggctccaaagacataaagaagaacaagaacgttaccaacagaagtaagggcaccgctgaaaaactgaagccagaggacattactcagatccagccgcagcagctcgtcctgcgactcaggagcggagaaccccagacattcacgcttaaattcaaaagagccgaagactacccaatcgatttgtactatctgatgtag

SEQ ID NO: 24583 - DNA, 315 bp, Artificial Sequence
  Description of Artificial Sequence: Synthetic coding sequence
atgaacctgcagcccatcttctggatcggcctgatcagcagcgtgtgttgcgtattcgcacaaactgacgagaaccgctgcctcaaggcaaatgccaagagttgcggtgaatgtattcaagccggccctaattgcggctggtgcacaaacagtacttttcttcaagagggaatgcccacgagtgcacgctgcgacgatctggaagctctcaagaagaaaggatgcccgcccgacgacatcgagaatcctcggggctccaaggatatcaagaagaataagaacgttactaatcgtagcaagggaacagccgagtag

SEQ ID NO: 24584 - DNA, 432 bp, Artificial Sequence
  Description of Artificial Sequence: Synthetic coding sequence
atgaacctgcagcccatcttctggatcggcctgatcagcagcgtgtgctgtgtgttcgcgcagaccgacgagaaccgatgccttaaggccaatgcaaaatcctgcggggagtgcatccaagcaggacctaactgtggatggtgtaccaactctaccttccttcaagaggggatgcccactagtgcccggtgtgacgatctggaggcactcaagaagaaagggtgcccccccgatgatattgagaatcctcgcggttcaaaagacataaagaagaacaagaatgtgactaatagatccaaaggcacggccgaaaagctgaaaccggaagatatcacccagatccagcctcaacaacttgtcctgagactgagatcgggcgaaccgcagacgttcaccctgaagtttaagagggcagaggattacccaatctag

SEQ ID NO: 24585 - DNA, 2310 bp, Artificial Sequence
  Description of Artificial Sequence: Synthetic coding sequence
atgctgggcctgcggccccccctgctggccctggtgggcctgctgtccctgggctgcgtgctgagtcaggaatgcacaaagtttaaggtttctagttgtagggagtgtatcgaaagcggcccgggctgtacctggtgccagaagttaaatttcaccgggccaggcgatccagactcaatccgctgcgacactcgtccccaattactaatgcgcggatgtgcagccgacgacatcatggacccaacgagcctggcagagacacaggaagatcataatggtggtcaaaaacagctgtccccccagaaggtcacactttatcttcgtcccgggcaggctgccgccttcaacgttactttccgaagggccaaaggctaccccatcgatctgtattatttgatggacctgtcgtacagcatgcttgatgacctacggaacgttaaaaagctcggcggggacctgctcagagccctgaacgagatcacagagtctggcaggatcggcttcggctcatttgttgacaagacggtcctccccttcgtgaatacccatccagataaacttcgcaatccgtgccctaacaaggaaaaggaatgtcagcccccattcgctttccgccacgtcctgaagctgacaaacaatagcaatcagttccaaacagaagtgggcaaacagctaatttctggtaacctggacgcccctgaaggtggcctggacgcaatgatgcaggtcgcggcctgtcctgaagagattggttggcgtaatgtcacacggctacttgtctttgcaactgacgatggctttcactttgctggagatggcaagctgggcgcaatattgaccccaaatgatgggcgctgtcatttagaagacaatctgtacaaacggtccaacgaattcgactatccaagtgtggggcaactcgcccacaagctcgccgaaaacaatatacagcccattttcgctgtcacgtccagaatggtgaagacatacgaaaaactgactgaaattattcccaagtccgccgtcggcgagctttcagaagattcttctaatgtggtgcaactcatcaaaaatgcctacaataaattgagctcccgggtattcctcgaccacaatgccttgcctgatactctcaaagtgacgtacgactccttttgttccaacggagtcacacatcgtaatcagcctaggggcgactgtgacggcgtgcagattaatgtacctattacgtttcaggtgaaagtcaccgctaccgagtgcatccaagaacagagtttcgtcatccgcgccttaggatttactgacatagtgaccgtccaggtccttccccagtgtgagtgccggtgtcgcgaccagtcaagagatagatcactgtgtcacggcaagggctttctggagtgtggaatctgccgctgcgatactggatacatcggtaagaactgtgaatgccagacccaggggcggtcaagccaagagttagaggggtcatgcagaaaggacaacaactccattatctgcagcggcctgggcgactgcgtttgcggccagtgtctttgtcatacatctgacgtgccaggcaaattaatatatgggcagtattgtgagtgtgacactatcaactgtgagcggtataacggacaggtttgtgggggtccaggccgcgggttatgcttctgtggcaagtgcagatgtcacccaggtttcgaaggctctgcctgtcagtgtgagagaaccaccgagggatgtctcaatccccgacgtgtggagtgctcaggcaggggacggtgccgctgtaatgtttgtgaatgccattcaggataccagttacctctgtgccaggagtgtccgggttgcccttccccctgtgggaagtacatcagctgcgccgagtgcctaaagttcgaaaaaggaccattcggaaagaactgttctgcagcgtgtcccggactgcagctgagcaataatccagtcaaaggtagaacatgcaaagagcgcgacagcgagggttgctgggtagcatatactcttgagcaacaggacggaatggacagatatttgatctatgtggatgaaagtagagagtgtgtagcaggacctaacatcgcagcgatcgtcggaggcacagtggctggtattgtcttgatcggcatcctattacttgtcatctggaaagctttgattcacctgtccgatctacgggagtataggcgcttcgagaaagaaaaactcaagagccaatggaacaacgataaccccctgtttaaatccgcgactaccaccgtgatgaatccgaagttcgccgaaagttag

SEQ ID NO: 24586 - DNA, 969 bp, Artificial Sequence
  Description of Artificial Sequence: Synthetic coding sequence
ggccggctgggcaaggacctggccaccggcgtgctgagccaggagtgcactaaattcaaagtgtctagctgtagagagtgcatcgagtctggtccggggtgtacatggtgtcagaaactgaatttcactgggcccggggacccagattctatacgctgcgataccaggcctcagcttctcatgcggggatgtgccgctgacgatataatggatcccacaagccttgcggagacgcaggaagaccataatggcggtcagaagcaactgtctccacagaaagtaactctgtaccttcgaccaggtcaggctgctgcgttcaacgtaacgttcagaagagccaagggctacccaatagatttgtactacctaatggacctgtcgtacagcatgttagatgatctgcggaacgtgaagaaattaggtggtgacttactccgggctctaaacgagataactgagtccggcaggattggctttggtagttttgttgataagactgtgctaccatttgtcaatacccaccccgataaattaagaaatccctgccccaataaagagaaggaatgccagcccccatttgcctttcgccacgtgcttaaactgacaaacaactctaaccaatttcaaaccgaggtcggcaagcagctgatcagtggaaatctggacgcaccggaaggcgggcttgacgcaatgatgcaggtggctgcatgtcccgaggagataggttggaggaatgtaactaggctgttggtcttcgctaccgatgatggattccacttcgccggagatggcaagctaggagccattcttaccccaaatgatgggcgatgtcatctggaggataacctttataagcggtccaacgagtttgattatcccagtgtgggccagttagcccacaagctggctgagaataacatccaaccaatctttgccgtaaccagtcgaatggtgaagacatatgagtag

SEQ ID NO: 24587 - DNA, 2310 bp, Artificial Sequence
  Description of Artificial Sequence: Synthetic coding sequence
atgctgggcctgcggccccccctgctggccctggtgggcctgctgtcactagggtgcgtgctttcccaagagtgtaccaagttcaaagtgagtagctgtcgggagtgcatcgaatctggtccaggatgtacctggtgccagaagctcaatttcaccggcccgggagaccccgactccatccgctgcgacacccggccccagctgttgatgcggggttgcgcagcagacgacattatggacccgacttccctggctgagactcaggaggatcacaatggcggccaaaagcagctgagcccacagaaggtcaccctgtacctgaggcccgggcaggctgccgcgtttaatgtgacgttcagaagagctaagggctaccctatcgacctctattaccttatggacctgagctactctatgttggacgatctgaggaacgttaaaaagctgggaggggatttgctgagggctctgaacgagataaccgagtctgggcgcatcggctttggaagctttgttgacaagaccgtactaccctttgtgaatacacatccggataagctgcggaacccttgccccaacaaggagaaggaatgtcaacctccattcgcattccggcacgtcctgaaattgacgaataactccaaccagtttcagacggaggtgggcaaacaacttatctccggaaatctggatgcgccagaaggtggccttgacgccatgatgcaggtggctgcctgccctgaggaaatcggatggagaaacgttactagactcctggtatttgccacagacgacgggtttcattttgccggcgacggcaaattgggggcaattctgacgccaaatgatggccggtgtcatctggaagacaatctgtacaaacggtcaaacgagtttgattatccaagcgttggccagttggcccacaagctggccgaaaacaacatccagccaattttcgccgtgacttcacgcatggtgaagacgtatgaaaagctgaccgaaatcatccctaagagtgccgttggcgaactgtccgaagacagttcgaatgttgtacagctcatcaaaaatgcctacaataaactgtccagtagagtgttcctcgaccataacgccttaccggacacgcttaaggtcacttacgacagtttttgcagcaatggggtcacccacaggaatcagccgcggggagactgcgacggcgtccagatcaacgtccccatcacatttcaggtgaaagtgacagccaccgaatgtattcaggagcagtcatttgtaattagggccttggggttcaccgatatagtgactgtgcaagtgttacctcagtgtgaatgcagatgtagggatcagtcccgggacaggtcgctgtgtcacggcaaaggatttttggaatgtgggatctgtcgctgcgacaccggctatatcggcaaaaattgtgagtgtcaaactcagggtcgctcttcccaagagcttgaaggatcatgccgcaaagacaataatagcatcatctgtagcggtttgggtgactgcgtctgcggccagtgtctgtgtcatacttcagacgtgccgggtaagttgatttatgggcaatactgcgagtgcgatacaattaactgtgaacgatacaacggccaagtatgcggaggacccggacgggggttgtgtttttgcgggaagtgtcggtgccaccctggattcgaagggtccgcctgccaatgtgagcgcacgacagagggctgcctcaacccccgcagagtggaatgtagcggccggggcagatgccggtgtaatgtgtgtgaatgccacagtggctaccagctccctctgtgtcaagagtgccctggctgcccttcgccatgcggaaaatatatttcctgtgcagagtgtctgaaattcgagaagggaccatttggtaagaactgtagcgctgcctgccccggactgcagttgagcaataaccctgtgaagggacggacatgtaaggagagagattcagaagggtgttgggttgcctacaccctggagcagcaggatgggatggaccgctacctgatatatgtggatgagtctagagagtgcgtcgctggccccaacatagccgcaatcgtgggggggaccgtggctggcatagtgttaattggaattctgctgctcgtcatttggaaagctctgatacacttgagtgatttaagagagtataggcggtttgaaaaagagaaactcaagtcccagtggaataatgacaatcccctcttcaaatcagccacgactaccgtgatgaacccaaagttcgccgagagctag

SEQ ID NO: 24588 - DNA, 2310 bp, Artificial Sequence
  Description of Artificial Sequence: Synthetic coding sequence
atgctgggcctgcggccccccctgctggccctggtgggcctgctgtccctcgggtgcgtgctcagtcaagagtgcacaaaatttaaggtaagttcttgtcgagagtgcatcgagtcagggcccggctgcacatggtgccagaaattaaatttcactggcccaggtgacccggacagtatccgatgtgacacccgtccccaattattgatgcgaggatgtgctgctgacgacattatggatcctacttctttagctgagacccaggaggatcataacggcgggcagaaacagctgagcccccaaaaggtgacgctatatctgagaccagggcaggccgctgcgttcaatgtgacttttagaagagcgaagggatatcctattgacctgtactaccttatggacttatcctactccatgctggacgacctgaggaacgtgaaaaagttggggggcgacttgctcagggcgctgaatgagatcactgagagcggacgaatcggttttggctccttcgtggataagactgtgctgccgtttgttaatacccatccagacaagctgcggaacccatgtcccaataaggaaaaagaatgtcagcctcctttcgccttcaggcacgtactgaagctgaccaacaattctaatcagtttcaaaccgaagtaggaaaacagcttatttcagggaacctggacgcccctgagggtggattggacgctatgatgcaggtggcagcatgtcctgaggaaatcggctggcggaacgtgacccgccttctggtatttgcaacggatgatgggtttcacttcgcaggcgatgggaaattgggcgccattttaacacctaatgacggccgctgtcacctggaggacaatctatacaaacggagcaacgagttcgattacccttcagtcggccagttggcacacaaactggctgagaacaatattcagccaatcttcgctgtgacatctagaatggtcaaaacctatgagaaattgaccgaaatcattcctaagagtgccgtgggagaattgtcagaagactcaagcaatgtggttcaattaatcaaaaatgcttataacaaactctcttcaagagtttttcttgatcataatgcactgccagacaccttgaaagtgacatatgattctttctgttccaatggagtgactcatcgcaaccagccccgtggtgattgtgatggagtgcaaataaatgtaccaataacctttcaggttaaggtcacagcaacggagtgtattcaagagcagagctttgtcatccgagcactgggttttacagatatcgtgaccgtccaggtgctgcctcagtgcgagtgcagatgtagggaccagagtcgcgatcgcagcctctgtcacgggaagggctttctggaatgtggcatctgtcggtgcgacacaggctacataggcaagaactgtgagtgccagactcaaggtcggtccagccaagaattggaaggctcttgtcggaaggacaacaactctattatttgcagcgggctgggcgactgcgtttgtgggcagtgcctttgccacacatccgacgtgccgggtaaacttatttatgggcagtattgcgagtgcgacaccatcaattgcgaaaggtacaacggtcaagtttgcggagggcctggtagagggctttgtttctgcggcaagtgccggtgtcacccagggtttgaaggatctgcgtgtcagtgtgagagaacaaccgaagggtgcctgaatccacgccgggtcgagtgcagcggtagggggagatgccggtgtaacgtgtgcgaatgccattcaggctaccagcttcccctctgccaggagtgccccggctgtccttctccttgtggcaaatacatcagctgtgccgaatgcctaaagttcgagaagggcccgtttggaaagaattgcagcgccgcctgtcctggccttcagctgtccaacaaccctgtcaaaggccgtacatgcaaagagcgcgactcagaagggtgctgggtcgcctacactcttgaacaacaggatggcatggaccgctacctgatctacgtagacgaatcccgggagtgtgtcgcaggccccaatattgcagcaatcgttggcgggacagtggcaggcatcgtgctgattgggatcctcctgttggtaatttggaaggcgctgattcatttatctgacctgagggagtaccgccggttcgagaaggagaaattaaaaagccagtggaacaacgataaccctcttttcaaaagcgcaacaacaacagtgatgaaccctaaattcgcggagtcgtag

SEQ ID NO: 24589 - DNA, 2310 bp, Artificial Sequence
  Description of Artificial Sequence: Synthetic coding sequence
atgctgggcctgcggccccccctgctggccctggtgggcctgctgtcacttggctgcgtcctgagccaggaatgtaccaaattcaaagtgagttcttgtagggagtgcatagaatcaggacctggctgcacctggtgccaaaagctaaatttcaccggccccggcgacccagactcaatacgttgtgacacccgtccacagcttcttatgcggggatgcgcagctgacgacattatggaccctacatctctggctgagacacaagaggatcacaatggagggcagaagcagctgtctcctcagaaagtgacgctgtacctaagacctggacaagcggccgctttcaacgtgactttccgccgggctaagggttatccaatcgacttgtattatctaatggatttgtcttactccatgctcgatgatcttcggaacgtgaaaaagttagggggggatctgcttcgggctctgaatgagattacagaaagcgggcgtatcggcttcggcagcttcgtcgataaaacagtcctgccttttgtcaacacccatcccgacaagctccggaacccttgccctaacaaggagaaggagtgccagccaccatttgctttccggcacgtgctgaagctcacaaacaactcaaaccaattccagactgaagttggcaagcagctcatcagtggcaacctcgatgcacctgaaggcggcttggacgccatgatgcaggtggctgcatgtccagaggaaattggctggaggaacgtgaccaggctgctagttttcgctacggacgatggatttcactttgccggggacggtaagttgggggccattctcactcctaacgacgggcgctgtcatctggaggacaacctatataaacgctcaaatgaattcgattacccaagcgtcggacagttggctcataagctggctgagaacaacatacaaccaattttcgcagtcacaagtcgcatggtgaagacctacgagaaactaacagaaatcatcccaaagagtgccgtgggcgagttgagcgaagactccagcaacgtggtccagctcattaagaatgcatacaacaaactgagttcaagagttttcctcgaccacaatgccctcccagataccctgaaagtaacatacgacagtttttgcagcaatggcgtgacccaccggaatcagccccgcggagactgtgacggtgtccagatcaacgtgcccataacctttcaggtcaaggtaacagcaacagagtgtatccaggagcaatctttcgtgattcgcgccctgggtttcactgatattgttacagtccaggtgctgccacagtgcgaatgcaggtgccgcgaccaatcacgagaccgttccttgtgtcacggcaagggcttcctggagtgcggaatttgtcgatgtgacactggatatataggcaagaactgtgagtgtcaaacacagggccgctctagtcaggaactcgagggctcttgtcgaaaggataacaactccataatctgcagcggactgggagactgcgtctgtggacagtgtctatgtcacactagcgatgttccagggaagctgatttacgggcagtattgtgaatgcgataccatcaactgtgagcggtataacggacaggtctgcggggggccaggacgaggattgtgcttttgcgggaagtgccgttgtcacccaggatttgagggctctgcttgtcaatgtgagagaaccacggagggctgcctaaaccctcgaagggttgaatgctctgggagaggcaggtgtcggtgcaatgtatgcgagtgtcactcaggttaccagttgcccctttgtcaggaatgcccaggctgtcctagcccttgcggaaagtacatatcctgcgccgaatgtctgaagtttgaaaaggggccatttgggaaaaattgctcagccgcgtgcccagggctgcagctgtctaataatcctgtcaaggggcgcacatgcaaggagagggactcggagggatgttgggttgcatataccctggaacagcaggacggcatggacagatatttgatttacgtcgatgagagtagagaatgcgtggctggccccaatatagctgctatcgttggcggcacagtcgctggcattgtattaataggtatattgctccttgtgatttggaaagcccttatccacttatcagatctgcgggagtatcgccgcttcgaaaaggaaaagctgaagtcacaatggaataatgacaaccctctgttcaaatcggccactacaactgtaatgaatcccaagttcgctgagagttag

SEQ ID NO: 24590 - DNA, 2310 bp, Artificial Sequence
  Description of Artificial Sequence: Synthetic coding sequence
atgctgggcctgcggccccccctgctggccctggtgggcctgctgtctctcggatgcgtgctctctcaagagtgcactaaattcaaagtctcgtcttgtagggagtgcattgaaagcggtcccgggtgtacctggtgccagaagctaaactttactgggcccggcgaccctgatagtattcggtgtgatacacgtccacaacttctgatgcgcggctgcgccgccgatgatatcatggatccgacttctctcgccgagactcaggaggatcacaacggcggacagaaacaactgagtcctcagaaggtcactctttatctgcgccccggccaagcggcagcatttaacgtcacatttcggagggcaaaagggtatcccattgacctgtactatttgatggatctttcgtatagtatgcttgatgacctcaggaatgtcaagaaactgggcggagacctgcttcgagctctgaacgagatcaccgagtccgggagaattggtttcgggagctttgttgataagaccgttcttcctttcgtgaatactcacccagataagctgagaaacccttgccccaacaaggagaaggagtgtcaaccccctttcgcatttcgacatgttctgaagttgactaataatagtaaccaattccaaaccgaagtaggcaagcagctaatttcaggcaatctcgatgctcccgagggaggcctggatgccatgatgcaggtggctgcctgtcccgaggaaatcggatggaggaatgtcactagacttctcgtttttgccacagatgatggatttcattttgcgggcgacggcaagcttggagctatcctgaccccgaacgatggccgatgccatctggaggataacctctataaacggtccaacgagtttgattacccttctgtcggccagcttgcacataaattagctgaaaataacatacaacccatctttgccgtgacatctagaatggtgaaaacctacgaaaagctcaccgaaatcattccaaagagcgcagtgggggaactatctgaggattcctcaaacgttgtgcaactgattaaaaatgcatacaacaagctttcaagccgcgtttttctggaccacaacgcccttccagacactctcaaggtcacttacgattcgttctgttccaacggagtgacccaccggaaccaaccacgaggcgactgcgatggcgtacagatcaatgtgcctattacctttcaagtgaaggtcacagcgaccgagtgtatacaagagcaaagtttcgtgatccgcgcccttggctttacggacattgtgacagtccaggttctacctcagtgcgaatgtcggtgtcgtgaccagagtagagacaggtctctctgtcatggtaaagggtttcttgagtgtgggatttgtcgctgtgacacaggttacatcggaaagaattgtgaatgtcaaactcagggaagatcttctcaagagctcgagggaagttgccgcaaggacaataattcaataatatgcagtggtcttggagactgtgtatgcggccaatgtttgtgccatacgtcggatgtacccggcaagctgatttacggccagtactgcgaatgtgacaccatcaattgtgaacggtataacggtcaagtgtgcggaggccctggtcgcggcctgtgtttctgtgggaagtgtagatgccaccctggctttgaggggtcagcttgccagtgcgaacgcactacagagggctgtctcaacccacgtagagtggaatgctcaggccgtggccggtgtaggtgcaatgtgtgcgaatgccacagcggataccagttacccctgtgccaggagtgtcctggctgtccgtcaccatgtggcaagtacatcagttgcgcggagtgcctgaagtttgagaagggccctttcggtaagaactgcagcgccgcttgtcctgggcttcaactgagtaacaatcctgtgaagggccggacctgtaaagaacgggacagtgaaggttgttgggtggcatacactctcgagcaacaagatggaatggacagatacttgatctacgtggatgagagcagagaatgcgtcgcaggacccaatattgcggctattgttggtggcactgtcgccggaatcgtactgatcgggattctcctgcttgtgatttggaaagcactgatccacctctcagacctgagggaataccggcgatttgagaaggagaagctgaaaagccagtggaataatgacaatcccttgttcaagtctgccaccaccaccgtgatgaatcctaaattcgccgagtcctag

SEQ ID NO: 24591 - DNA, 363 bp, Artificial Sequence
  Description of Artificial Sequence: Synthetic coding sequence
atgctgggcctgcggccccccctgctggccctggtgggcctgctgagcttgggttgtgttctgtctcaggagtgtacaaagttcaaagtatcttcttgcagagaatgcatcgagtcagggcccggctgcacctggtgtcagaaattaaattttaccggaccaggtgacccagacagcatcaggtgcgacacccggccccagctcctgatgcgtggttgtgcagctgacgacataatggatcccacctcattggcagaaactcaggaggaccacaatggagggcagaaacagctttcccctcaaaaagtgacactctatttacggccaggacaagccgcagcctttaatgttacattcagatag

SEQ ID NO: 24592 - DNA, 213 bp, Artificial Sequence
  Description of Artificial Sequence: Synthetic coding sequence
atgctgggcctgcggccccccctgctggccctggtgggcctgctgtcattaggctgcgtgttgagtcaggagtgcaccaaatttaaggtctcctcatgcagggagtgtattgaatctggcccgggttgtacctggtgccagaagcttaatttcaccggacctggagatcccgatagcatccggtgtgacacaaggccacaattgcttatgtag

SEQ ID NO: 24593 - DNA, 150 bp, Artificial Sequence
  Description of Artificial Sequence: Synthetic coding sequence
atgctgggcctgcggccccccctgctggccctggtgggcctgctgagtctagggtgcgtgctgtcccaagagtgcaccaagttcaaggtaagtagctgccgcgaatgtatagagtctggcccaggatgtacatggtgtcagaagctgtag

SEQ ID NO: 24594 - DNA, 483 bp, Artificial Sequence
  Description of Artificial Sequence: Synthetic coding sequence
atgctgggcctgcggccccccctgctggccctggtgggcctgctgtcattgggctgcgttctgtctcaggaatgtacgaagtttaaggtgagcagctgccgcgaatgcatagaatcagggcccggctgtacatggtgtcaaaagctcaacttcacagggcccggagatcccgactcaatcaggtgtgacacacgtccccagctgctgatgcggggatgcgccgccgacgacatcatggatcccacctcccttgccgagacccaggaagatcataacgggggccaaaagcagctctctcctcagaaggtcactctttatctcagacccgggcaagcagcagcatttaatgttactttcaggagggcaaaaggataccctatagacctgtactatctgatggacctgtcttactcgatgctagacgacctccggaacgtgaagaagctggggggagatttgttgcgagccctaaatgaaatctag

SEQ ID NO: 24595 - DNA, 501 bp, Artificial Sequence
  Description of Artificial Sequence: Synthetic coding sequence
atgctgggcctgcggccccccctgctggccctggtgggcctgctgtcacttggttgtgtactctctcaagagtgcaccaaattcaaggtctcttcgtgtcgagaatgcatcgagtctgggcccgggtgcacctggtgccagaaattaaacttcaccggccccggtgatcctgacagcatccgttgcgatacacgaccccagctcctgatgcgcggttgtgccgctgacgatattatggacccaacctctctcgcagagactcaagaggatcacaatgggggccagaagcagctgagccctcagaaggtgaccctgtatctgcgtcccggtcaggcggccgccttcaacgtgacttttcggcgggctaagggttatccaattgatttgtactacctgatggacctttcctactccatgctggatgaccttcgaaatgttaagaagctcggaggtgacctactacgagccctgaacgagataactgagtctggacgcatttag

SEQ ID NO: 24596 - DNA, 1137 bp, Artificial Sequence
  Description of Artificial Sequence: Synthetic coding sequence
atgctgggcctgcggccccccctgctggccctggtgggcctgctgtcactgggctgcgtgttatcccaggaatgtacaaaatttaaagtgagctcatgtcgcgaatgtatcgaatccggaccaggatgcacttggtgtcaaaagctcaacttcaccggcccaggggaccccgactctatccgttgcgatactcgtcctcagttactcatgcggggatgcgcggccgacgatattatggatccaaccagcctcgccgaaacgcaggaggatcacaacggcggccagaaacagctttcaccacagaaagtcacactatacctcagacccgggtttggcagcttcgtggacaaaactgtgctgccctttgtaaatacacatccggataagcttagaaacccctgcccgaacaaggagaaagagtgtcaaccaccctttgctttcagacacgtcctgaagctgaccaataactcaaaccagtttcaaaccgaggtgggaaaacagttgatttcgggcaacctggacgcccctgagggtggattagacgccatgatgcaggtggcagcctgccctgaggagattgggtggaggaacgtgactcggcttctcgtgtttgctacagatgatggattccactttgccggcgacggtaaattaggagccatattgaccccaaacgacggacgttgccatctggaggacaatctgtacaagagaagcaatgagttcgactatcctagcgtgggacagttagcccacaagctggccgagaataacatccagccaattttcgctgtgacctctaggatggttaagacctatgaaaaactaacggagatcatacccaaatccgcggtgggcgagctctccgaggatagttcgaacgtcgtgcagctgattaagaatgcctacaacaagctaagtagccgagttttcctggaccacaacgccttacctgacaccctaaaagtaacctacgattccttctgttccaacggcgttacacaccggaatcagcctcgtggagactgcgatggcgtccagataaacgtgcccatcacttttcaggtaaaagtcactgcaacagagtgtatccaggagcaatcgttcgtgataggaaggtgggcctcccgaacttag

SEQ ID NO: 24597 - DNA, 2367 bp, Artificial Sequence
  Description of Artificial Sequence: Synthetic coding sequence
atgcgggcccggccccggccccggcccctgtgggccaccgtgctggccctcggcgcattggctggcgtgggcgtgggcggcccaaatatttgtaccacacgcggggttagttcatgccagcagtgtctcgcggttagtcctatgtgcgcttggtgcagcgacgaagctttgccattgggatcccctcggtgcgacctgaaggagaacttattgaaggataattgcgcccccgagtccattgaattccccgtgtctgaggcgagagtccttgaagatcggcctctctccgataagggctccggggattcctcccaagtcacgcaggtttcgcctcagcgcatcgctctcaggctaagacctgacgacagtaaaaacttcagtattcaggtgagacaggtggaggattaccctgttgacatctattacctcatggatctgagctattccatgaaggacgatctttggagcatccagaatctcggcaccaaactggcaacccagatgcgtaagctcactagtaatctgaggattgggtttggcgcattcgtggacaaaccggtgtcaccatacatgtacataagcccccctgaagccctggaaaatccgtgttacgacatgaagacaacctgtctgcctatgttcggttataagcacgtcctgaccctgactgatcaagttacaaggtttaatgaggaagtcaaaaaacaaagcgtttcaaggaaccgtgacgccccagagggtggctttgatgctattatgcaggctaccgtctgtgacgagaagatcgggtggagaaacgatgcgtctcacttgctggttttcactaccgacgcaaagactcacattgcgctggacggtcggctggccgggatcgtgcagcccaacgatggtcagtgccatgtcggttcagataaccactactctgcatcaaccacaatggactatccttccctgggattaatgaccgagaaactgtctcagaaaaatattaatctgattttcgcagtgactgagaatgttgttaacctataccagaattattctgagctgataccaggtacgacggttggtgttctgagcatggattcaagcaacgtcttgcagctaatcgtggatgcttatggtaagattaggtctaaggtggaacttgaggttagagacctaccagaagagctgtcactgtcatttaacgcgacctgcctgaacaatgaggtcattccaggtctcaaatcttgtatggggctgaaaattggagacaccgtgagtttcagcatcgaggccaaagtgcgggggtgcccgcaggagaaggaaaagtcttttaccatcaaacctgtcgggttcaaagattcacttatcgtccaagtgacttttgactgcgattgtgcgtgccaagcccaggccgagccaaatagtcatcgctgtaataacggcaacggcacgtttgagtgcggcgtctgcagatgcggtcctggatggctggggagccagtgcgaatgttcagaggaggactaccgaccgtcacagcaggacgaatgctctccgcgtgaaggacagcctgtgtgtagccagagaggagagtgtttatgtgggcaatgcgtctgccacagctctgacttcggaaagataaccgggaaatattgtgagtgcgatgatttctcgtgcgtgcgatacaaaggcgaaatgtgttcagggcatgggcagtgctcctgcggtgactgcctctgcgattcagattggactggctactattgcaattgtaccaccaggacagatacttgtatgtcaagcaacggtttgttgtgcagcgggagagggaagtgcgaatgcggctcttgcgtgtgtatccagcctggcagttacggcgacacttgcgagaagtgtcctacatgtccagacgcatgcactttcaaaaaggagtgcgtggagtgtaagaaatttgataggggggctctacatgatgaaaacacatgcaatcggtattgccgggatgaaatagagagcgtgaaggaattgaaagatacgggtaaagatgcagtgaactgcacttataagaacgaggacgactgcgttgttcggttccagtattacgaagatagtagcggaaaatccattttatacgtggtggaggagcccgaatgtcctaaagggccggacatacttgtcgttttactgtccgttatgggggctattttgcttatcgggctggctgcgctgctcatttggaaactactcataactattcatgatagaaaagaattcgccaaattcgaggaagaaagagcacgagctaaatgggatactgccaataacccattgtacaaggaggctacttcaacgtttaccaacattacttatagggggacttag

SEQ ID NO: 24598 - DNA, 2256 bp, Artificial Sequence
  Description of Artificial Sequence: Synthetic coding sequence
atgtgcgcctggtgcagcgacgaggccctgcccctgggcagccccagatgcgacctgaaagaaaatttactcaaggacaactgtgccccagagagtatcgagtttcctgtctcggaagcccgagtcctggaggacagacctctgagtgataagggcagcggtgacagttctcaagttacccaggtgagccctcaacggatcgcgcttagacttcgtcccgacgattctaagaactttagcattcaggtacggcaggtcgaggattatccagtcgacatatactatctgatggaccttagttattctatgaaggacgacctctggtctatacaaaacttaggtacgaagctggccacacagatgcggaagctgacatcaaacctgaggatcggcttcggggcatttgtggacaagcctgtttccccctatatgtacattagccctcccgaggctctagagaatccctgttacgacatgaagactacatgcctgccgatgtttggttacaaacacgtgctgactctgactgaccaggtcactcgctttaatgaagaggtgaagaagcagagcgtgagccgtaatcgagatgctccagaagggggtttcgacgctatcatgcaagccacagtttgtgatgagaagattggatggaggaatgacgcaagtcatctgctcgtatttaccacagacgctaagacccatatcgctctggacggacgcctagccgggatcgtgcagcccaatgacggtcaatgccacgtcggatcagacaaccactactctgcctccaccacgatggattatccatctctgggactcatgaccgagaagctgtcacaaaagaatattaacttgatcttcgcggtgacagaaaatgtcgtaaatctctatcagaattattctgagctcatcccaggcactactgtcggcgttctttcgatggatagcagcaacgtactgcagcttatcgtcgatgcttacgggaagatccggagcaaagtcgaactggaagttcgtgatctccccgaggaattgagcctcagtttcaacgctacctgcctgaataacgaggttattccaggcctcaagtcctgtatggggctgaaaattggagacacagtgtcattttctattgaggcaaaggtgcgaggatgtccacaagagaaggaaaaatcatttactatcaaacctgtgggattcaaggattcactgatcgtgcaagtgactttcgactgtgactgcgcctgtcaagctcaggcggaacctaatagccaccggtgcaataatggtaacgggacatttgaatgcggtgtctgtcgctgcgggccggggtggttagggtcccagtgcgagtgctctgaagaggactatagaccttctcagcaggacgaatgctctcctagagaaggccagccggtgtgcagtcagcggggtgagtgtctctgcggacagtgcgtctgtcacagttcggacttcggcaaaattacggggaagtactgcgagtgtgacgatttttcctgtgtacgatacaagggcgagatgtgcagcgggcatgggcagtgcagctgtggagattgtctttgcgattctgattggactggatattattgtaactgtaccacaaggacagatacctgtatgtcaagcaatggtctgctctgctctggcagagggaaatgcgagtgtgggtcttgcgtgtgcatccagcccggatcttacggcgacacctgtgagaaatgtcctacatgtcccgacgcttgcactttcaaaaaggaatgtgtcgagtgtaagaagttcgaccgtggtgctctacatgacgagaacacttgcaacaggtactgccgggatgagatcgaatccgtcaaggaactgaaggacacaggaaaggatgcagttaattgtacctacaaaaatgaggatgattgtgtggtgcggttccaatattatgaggactcttcgggtaagtctattttgtacgttgtagaagagccagagtgcccgaagggccccgacatcctcgtggtcctgctgagtgtgatgggcgccatcctcctcattggtttagccgcactactgatctggaaacttcttataacgatccatgacaggaaggaattcgcaaaattcgaggaagagagggccagggccaagtgggacacagagatcttgctgtactattgctcattcatcctggtgcaccagtctctggagtctctgaggaccgagttcaccagcaaacagaaggatggaaattag

SEQ ID NO: 24599 - DNA, 2367 bp, Artificial Sequence
  Description of Artificial Sequence: Synthetic coding sequence
atgcgggcccggccccggccccggcccctgtgggccaccgtgctggccttgggggcacttgctggcgtgggtgtgggagggccgaacatttgtacaacaagaggagtgtcatcctgtcagcagtgtctcgcagtgagtcccatgtgcgcgtggtgttccgacgaggccctcccactgggaagccccagatgtgacctgaaagagaaccttttaaaagataattgcgctccggagtccatcgagttccccgtctccgaagcaagggtcctagaagaccggccgctgagcgacaaaggttcaggagactcttcccaggtaactcaagtctcaccacaaagaattgctttaagactaagacccgatgattccaaaaacttttcgatccaggttagacaagtcgaagattaccctgtagacatctattacctaatggacttaagctatagtatgaaagacgacctctggtctatacagaacctgggaaccaaactcgctacccagatgcgaaaactcacgtctaatctgagaatcgggttcggtgccttcgtagataagccggtttccccatacatgtacattagccccccagaagctctggaaaacccttgctatgatatgaaaaccacttgtcttcccatgttcggttacaaacacgtcctaacactcacagaccaggtaaccaggtttaatgaggaagtgaagaaacagtccgtttcgcgcaacagggacgcgcccgagggaggttttgatgctattatgcaagcaaccgtgtgcgatgaaaaaatcggatggcgcaatgatgcttctcacctgcttgtcttcacaacggacgctaaaacccatatcgcgttggacggcaggttggcaggcattgttcagcctaacgacggacaatgccatgtgggttcagataaccactattctgcctcgactaccatggactaccctagccttgggttaatgacggagaagctctctcagaaaaatataaatctgatcttcgcagtcaccgagaatgtggttaatctctatcagaactattccgaacttatacctggcacgacggttggagtcctgagcatggactctagcaatgttctgcagctgattgtcgatgcctacgggaagattcgaagtaaagtcgaattagaggtccgcgatctgcctgaggaactgagcttaagctttaacgctacttgtcttaacaacgaagtgattccggggttgaagtcctgtatggggctcaaaatcggcgacaccgtgtcattttccattgaagcgaaagtaagaggctgtccacaggaaaaagagaagtcttttaccataaagcctgttggctttaaagactccctgatcgtccaggtaacttttgattgcgactgcgcatgtcaggcacaggccgagcctaattctcaccggtgtaataacggaaatggcaccttcgaatgtggtgtttgccgttgtggcccagggtggctaggctcacagtgtgagtgttccgaggaggattaccggcctagccaacaggacgagtgctctccaagggaggggcagcccgtgtgttcgcagcgcggagagtgtctgtgcggacagtgtgtctgccatagtagtgattttggtaaaatcaccgggaagtattgcgaatgtgacgacttttcttgtgtgcggtacaaaggtgaaatgtgttccggtcatgggcagtgttcctgcggggactgtctgtgcgacagcgactggaccggatattactgcaattgtacaaccaggacggatacctgcatgtcctcaaacggcctgctgtgttcgggacggggtaagtgtgagtgtgggtcctgtgtttgcatccagcctggaagctacggggacacttgtgaaaagtgccccacatgtcctgacgcctgcacttttaagaaagaatgtgtcgagtgtaaaaagtttgataggggagctctgcatgacgaaaatacgtgtaatcggtactgtcgcgacgaaatcgagtcagttaaagagctgaaggatactggaaaagacgccgtgaactgcacgtacaagaacgaggatgactgtgtggtacgttttcaatattatgaggatagttcaggtaagagcatcctgtatgttgtggaggagcctgagtgcccaaaggggccagatattctagtcgtcttactctcggtcatgggcgccattcttctaatcgggctggcggccctgctcatttggaaactcctcataaccatacacgaccgtaaggagtttgctaaattcgaggaagaacgggctcgagctaaatgggataccgccaacaatccgctgtacaaagaggcaacaagtacatttaccaatatcacctacagggggacttag

SEQ ID NO: 24600 - DNA, 1359 bp, Artificial Sequence
  Description of Artificial Sequence: Synthetic coding sequence
atggacgacatcttcacccagtgccgggagggcaacgccgtggccgtgaggctgtggctggacaatacggaaaatgacctgaatcagggcgacgaccatgggttttcgcctctgcattgggcctgcagggagggaagatccgccgtcgtagaaatgttaattatgaggggcgcaagaataaacgtgatgaatcgcggagatgatactccactgcacctcgcagcttcacacggtcacagggacattgtgcagaaacttctccaatacaaggcagatatcaacgcagtgaacgaacatggaaacgtcccactacactatgcctgcttctggggtcaagatcaggtggctgaggacttagtggcaaacggggctctagtgagcatctgcaacaagtacggagagatgcctgtggataaggccaaggctccgctgcgcgagctcctcagggaacgagcagagaagatgggtcagaacttgaaccgaatcccctataaggatacattttggaaaggaacaactcgaacccgacctaggaatgggaccttgaataagcactcaggaatcgatttcaaacagctgaacttcttaaccaaattaaatgaaaatcattcgggggagctttggaagggacggtggcagggcaacgacatagtggtgaaggtgttgaaagttcgggattggtccaccaggaagtcccgggactttaacgaagagtgccccagactccgaattttcagtcacccaaacgtgctgcccgtcctgggggcctgccagagcccacccgcccctcaccccaccctaataacccattggatgccctatggctccttgtacaacgttctgcacgaagggaccaatttcgtggttgatcaaagccaggccgtaaaatttgcactggatatggccagaggtatggcatttctccacactcttgagccactaatacctcgccatgcgcttaacagtagatcagtgatgattgacgaggatatgaccgcacggatttccatggctgacgtgaaattctcattccagtgccccggacggatgtatgcccctgcatgggtcgcccctgaggcgctgcagaagaaaccagaagataccaacaggcgttcggccgatatgtggagcttcgcggtcctgctttgggagctcgtcacgagagaggtcccgtttgcagacttatccaatatggaaataggcatgaaggtggcactggagggtttaagacctactatcccgcctggcatcagtcctcatgtatgcaagctgatgaagatctgcatgaacgaagacccagcaaaacgtcccaagtttgatatgattgtgcccatcctggagaagatgcaagataaatag

SEQ ID NO: 24601 - DNA, 1359 bp, Artificial Sequence
  Description of Artificial Sequence: Synthetic coding sequence
atggacgacatcttcacccagtgccgggagggcaacgccgtggccgtgcgcctttggctcgacaacaccgaaaatgacctcaaccagggcgatgatcatggattcagcccgttacactgggcatgtagggagggccgtagtgctgttgttgagatgctcatcatgcggggcgcaaggatcaatgtgatgaacagaggtgacgatacgcctcttcaccttgccgcttcccatgggcatcgagatatcgtgcagaaactgctccaatacaaggcagacatcaacgcagtgaacgaacatggcaatgtgcctctgcattacgcgtgtttctgggggcaggatcaggtcgctgaggacctggtggcaaatggggccctagtctcgatttgcaataagtacggcgaaatgcctgtcgataaggctaaggctccactgcgggagctgctccgtgaacgtgccgaaaagatgggccagaaccttaacagaattccatacaaagacactttctggaaagggacaacccggaccagaccacggaacgggaccttgaacaaacattcggggatcgactttaaacagcttaattttttgacaaaactcaacgaaaaccattcaggtgagctctggaagggtagatggcagggtaatgatatcgtcgtcaaagtgctgaaggtccgcgactggtctaccagaaaaagtcgggattttaatgaagagtgcccaaggttacgcatattctctcatcctaacgtgttacccgtcctgggggcctgtcagtccccacccgccccccatccaacccttatcacccactggatgccttatggatctctgtacaacgtgctgcacgagggcaccaattttgtggtcgatcaaagccaggcagtgaagtttgccctggacatggccagaggcatggccttccttcataccctggagccactcatcccgcgtcacgccctgaattcgcggtccgtgatgattgacgaggatatgaccgctaggatctctatggctgacgtcaagttttcctttcaatgccctggaaggatgtacgcaccggcctgggtagcacctgaagctctccagaaaaagcctgaagatactaacaggcgctccgctgatatgtggtcttttgctgttctgctctgggaactggtcacgcgtgaagtgccattcgcggatctgagcaacatggagattggcatgaaggtggccctagaagggcttagacccacaatcccaccaggcatctccccccatgtctgtaaactaatgaaaatctgtatgaacgaggacccagctaaacggcccaagttcgatatgattgtcccaattctggaaaaaatgcaggacaagtag

SEQ ID NO: 24602 - DNA, 1359 bp, Artificial Sequence
  Description of Artificial Sequence: Synthetic coding sequence
atggacgacatcttcacccagtgccgggagggcaacgccgtggccgtcagactctggctggataacacggagaatgatttaaaccaaggagatgaccatgggttcagtcctctgcactgggcatgtagagaaggacggtcagccgtagtggagatgctgataatgcggggggcacggatcaacgtaatgaatagaggagacgacacccccctgcatttggccgcctctcacggacaccgagatattgtccagaagcttctgcagtacaaggccgatatcaatgccgtgaatgagcacggcaatgtcccgctgcattatgcttgcttctggggtcaggaccaggtggccgaagatctagtagcaaacggggccttggtatctatctgtaacaagtatggagagatgcccgtggacaaggcaaaagcacccctcagggaactactgcgggaacgcgctgagaaaatggggcagaatcttaatcgcattccctataaagacaccttctggaaaggtacaacccgcacacgccctcgcaatggcactttgaataagcactcgggcattgattttaaacagctgaacttcctaaccaagctgaacgaaaatcacagcggtgagctgtggaagggtcgttggcagggcaacgacatcgtggtgaaggtgctaaaggtgagagattggtctactcgaaagagccgcgattttaacgaagagtgtccacgattgagaattttcagccatccaaatgtcctccctgtacttggcgcttgtcagtcccccccagccccgcatccgactctgatcacacattggatgccttacggttcactgtacaatgttctgcatgaaggtacaaattttgtggtcgaccagtctcaggcagtgaaattcgccctggacatggccagaggaatggcgttcctgcacacccttgaacctctgattcctagacacgccctgaacagcagatccgtcatgatcgacgaagacatgacagcccgcatttcaatggccgacgtaaagttttcttttcagtgcccaggccgaatgtatgcacccgcctgggtggctcccgaggccctgcagaagaaacctgaggatacgaatcgcagatctgccgatatgtggagctttgccgttctcctgtgggagttagtaaccagagaggtgccatttgctgacctctcaaacatggagatcggcatgaaagtggctctggagggtttgaggcccaccataccgcccggaatttctccccacgtctgtaagctgatgaagatttgcatgaatgaggaccccgccaagagaccaaagtttgatatgattgtccccattctggagaagatgcaggacaagtag

SEQ ID NO: 24603 - DNA, 957 bp, Artificial Sequence
  Description of Artificial Sequence: Synthetic coding sequence
atgcccgtggacaaggccaaggcccccctgcgggagctgctgcgggagagagccgagaagatgggtcagaacctgaacagaattccatataaggacaccttctggaagggaacaactagaacgcgccctcggaatggtactctgaataaacactcaggcatcgattttaagcagttgaatttcctgactaagcttaacgaaaaccacagcggagagttatggaagggaaggtggcagggaaatgacattgtcgttaaagtgctcaaagtccgagactggtcaaccagaaagagtagagacttcaatgaagagtgccctcgcctccggatcttcagccaccccaatgtgctccccgtgttaggggcctgccagtccccgcccgctccccatcctacactgattacccactggatgccttacgggtctctgtataacgtcctgcacgagggaactaatttcgtggtcgaccagtcacaggctgtcaagtttgcattggatatggcgcggggcatggcatttctccacacactggagccactaatccctcgccacgcactcaactcgcggagcgtcatgatagacgaggacatgactgcaagaattagtatggccgacgtcaagttttcctttcagtgcccaggcagaatgtacgcaccggcctgggtggccccggaggccctgcagaaaaagcccgaagatactaatcgccgatcagccgacatgtggagcttcgcagttttactttgggaactcgtgactcgcgaagtgccgttcgcggacctgagtaatatggagattggaatgaaggtcgctctggagggcctgcggccaaccattccgcccggcatttcaccgcacgtatgcaagctcatgaagatatgtatgaatgaagaccctgctaagagacctaaatttgatatgatagtgccaattcttgaaaaaatgcaggacaaatag

SEQ ID NO: 24604 - DNA, 978 bp, Artificial Sequence
  Description of Artificial Sequence: Synthetic coding sequence
atgcccatcacccggatgcggatgcggccctggctggagatgcagattaattccaatcaaatcccaggtctgatttggattaacaaagaggaaatgattttccaaatcccatggaaacatgcagcaaagcacggttgggacatcaataaagacgcgtgtctatttcgaagttgggccatacacaccggacggtataaagctggcgaaaaggagccagaccccaaaacttggaaagccaacttcaggtgtgctatgaactcacttcccgacattgaggaggtaaaggatcaaagccggaacaaagggtcatcagccgtgagagtctaccggatgctacctcctctcaccaaaaatcaacgtaaggagcgaaagtctaagtccagccgagacgccaagagcaaggccaaacgcaaaagttgtggagattcctccccagacacatttagtgacggtttaagttccagcaccttgcctgatgaccactcaagttataccgtcccaggctatatgcaggatctcgaagtggagcaggccctcacccccgcactcagcccctgtgctgtttcttccacactgcccgattggcacatcccagtagaggttgtgccggattccacctcagatctgtacaatttccaggttagtcccatgccctccacctcagaagcgacgactgatgaagacgaggagggcaagttacctgaagatataatgaagttactcgaacagtcagagtggcagccaacgaacgtagatgggaaaggatacctgctgaacgagcccggggttcagcccacttctgtgtatggagatttttcctgtaaggaggaaccggagattgatagccctggaggcgatattggcctgtccctccagagggtatttacagacctgaagaacatggatgccacctggctggatagtctgctgaccccagtacggctgccatccatccaggcaataccttgcgctccgtag

SEQ ID NO: 24605 - DNA, 978 bp, Artificial Sequence
  Description of Artificial Sequence: Synthetic coding sequence
atgcccatcacccggatgcggatgcggccctggctggagatgcagatcaacagtaaccagattcccggtctcatctggatcaataaagaagagatgatattccagatcccttggaaacacgctgcaaaacacggctgggacatcaataaggacgcatgtctctttagatcctgggccatccacacgggccgttacaaggccggagaaaaggagccagaccccaagacttggaaggctaatttccgctgtgcaatgaactctctgccagatatcgaggaagtaaaggaccagagcagaaataagggcagctccgctgtgagggtgtacagaatgctgccgccattgaccaaaaaccagcgtaaagaacgaaagtcaaagagttcacgggatgccaagagtaaggctaaacgcaagtcttgtggtgacagttccccggacacattctcggacggactaagcagttcaacactccccgacgaccacagtagttacacggttcctggctatatgcaggatctggaagttgagcaggcgctcaccccagccctgagtccgtgcgctgtgagcagtactctccccgactggcatatacccgtcgaggtggtgcccgattccacatccgacctgtacaacttccaagtatctccgatgccaagtacttctgaagcaactacggacgaggatgaagaaggaaagttgccggaagatattatgaagctgctggagcagagcgagtggcagcctactaatgtggacgggaagggctacctcttgaacgaacctggagtgcaaccaacctccgtgtatggtgatttttcttgtaaggaagagccagaaattgactctcccggaggcgacatcggcctttctctgcagagagtcttcaccgatctgaagaatatggatgccacttggctggacagcctgctcaccccagtgagacttcctagcatccaggccataccctgcgccccttag

SEQ ID NO: 24606 - DNA, 579 bp, Artificial Sequence
  Description of Artificial Sequence: Synthetic coding sequence
atgcccatcacccggatgcggatgcggccctggctggagatgcagataaactctaaccagatacccggactgatatggattaataaagaggagatgatcttccagataccttggaagcatgcagccaagcatggatgggatataaataaggatgcgtgccttttcagatcgtgggctatacataccggtagatacaaagcgggcgaaaaggagcctgacccgaagacttggaaagccaattttcggtgcgccatgaattctctgcccgatattgaagaggtgaaagatcagagtcggaataagggctcttccgctgtcagggtctataggatgcttccaccactaaccaaaaatcaacggaaggagagaaagtccaagtcctcacgcgacgctaaaagcaaggccaaacgcaagagctgtggcgactctagtccagacacattttcagatgggttaagttccagtacactgcccgacgaccatagcagctacacagtccccggatacatgcaggatctcgaagtcgagcaggcattgacacctgcactgagcccgtgtgctgtgagctcaactctctag

SEQ ID NO: 24607 - DNA, 1356 bp, Artificial Sequence
  Description of Artificial Sequence: Synthetic coding sequence
atgaacctggagggcggcggccggggcggcgagttcggcatgagcgcagtctcttgcgggaacggaaagctccggcagtggctgattgatcagatcgactctggcaagtatcctggactggtgtgggagaatgaggagaagagcatttttcgaatcccatggaaacacgccgggaagcaagactacaacagagaggaagacgccgctctttttaaagcgtgggccctcttcaagggcaagtttcgagaggggatcgataagccggacccacccacctggaagacccgtctgagatgcgctctaaacaagtccaacgattttgaagagctggtggagcgatctcagctggacattagcgatccctacaaggtgtatcgaatagtgcctgagggggccaaaaagggcgccaagcagctgacattagaggacccacaaatgtcaatgagccacccttatacaatgacaacaccctacccctccttgcctgcccagcaagtccacaactatatgatgcccccactggataggagttggcgggattacgtgccagatcaaccacacccagaaatcccataccagtgccctatgacctttggcccacgaggccaccactggcaaggacctgcttgtgagaatgggtgccaagtgacaggaaccttttacgcttgcgcgccaccggagagccaggcccccggggtgccgaccgagcctagcatccgctcagccgaggcgctcgccttctcagattgcaggttacacatttgcctgtattatagagagatcctcgtgaaggagctgacaaccagctccccagagggatgtcgaatttcacacggacacacgtatgatgcttcaaacctggaccaggtgttattcccctatccagaggataacggccaaaggaaaaatatcgagaagctgctatcacacctggaaaggggagttgttctgtggatggccccagacgggctgtacgcaaaacggctctgtcagagtagaatctactgggatggaccattagctctgtgcaatgatcgccctaataaactggagcgcgatcagacatgtaaactgtttgatacacagcagtttctgtcagaactccaggcttttgcccaccatggccggtccctgccacgatttcaagtgaccttgtgcttcggggaggagtttcccgatccccagagacaacggaaactgatcacagcgcacgttgagcctctgttggccaggcagctttattactttgctcaacagaatagtggccattttcttagaggttacgatcttcccgaacatatctccaatcctgaggactaccaccgaagcattcggcacagctcaattcaggagtag

SEQ ID NO: 24608 - DNA, 1443 bp, Artificial Sequence
  Description of Artificial Sequence: Synthetic coding sequence
ctgggccccaccgccgccctgagcagcgagagccgggcccgggccgctcaggctggcggaggcccaagggcgcgagccaggacacgggggatgaaccttgagggcggggggcgtgggggtgagttcgggatgtcagctgtgagctgcggtaacggcaaactcagacagtggctcattgaccagatcgactctggcaagtaccccgggctggtatgggaaaatgaagagaagtctatcttcagaatcccctggaagcacgccgggaagcaggactataatcgtgaagaggatgctgccctttttaaagcttgggcgctgttcaagggcaagttccgcgagggaatagataaaccagacccgcccacctggaaaactagactccgatgtgcactcaacaagtcaaacgattttgaggaactcgtggaacggtcccagttagatatcagcgatccctataaagtctaccggatcgtaccagaaggagcgaagaagggcgcaaaacagctgacactggaggatccgcagatgtccatgtcacacccttatactatgaccactccctaccctagtcttcctgcccaggttcacaactatatgatgccaccactggataggagttggcgagattacgttccagatcagccccaccccgaaatcccctatcagtgcccaatgacattcggtccacgtggtcatcactggcagggacctgcctgcgagaacggctgtcaggtgactggtaccttctacgcatgcgctcctcccgaatcccaggcccctggcgtgccaacagagccctccatccgatcagctgaggcgctggcttttagcgactgccgcctccacatttgcctgtactatagggaaatcttggttaaggagttgacgacttcctcccccgagggatgtagaattagccatggccacacttatgatgcatcaaacctggatcaggtgctattcccctacccagaagataacgggcaaaggaaaaacatcgaaaagcttctctcacacctcgagaggggcgtggtgctgtggatggcgcctgacgggctttacgccaaacgactgtgccaatcacgcatctactgggatggaccattagccctgtgcaatgatcggccaaacaagctggaacgcgaccagacatgtaagctgttcgacacccagcagtttctgtccgaattgcaggcctttgcacaccacggtcgcagtctccccagattccaagtcaccctctgttttggcgaagaattcccagatccccaacgtcaaagaaaactcatcaccgctcacgttgagccgctgctcgctagacagctatactacttcgctcagcagaacagtggccacttcctgcggggctatgaccttcccgaacacatttccaatcctgaggactaccacaggtctattaggcacagcagcattcaggaatag

SEQ ID NO: 24609 - DNA, 1497 bp, Artificial Sequence
  Description of Artificial Sequence: Synthetic coding sequence
atgaaccagagcatccccgtggcccccacccccccccggcgggtgcgcctgaagccctggcttgtggcacaagtcaatagctgccagtaccctggactccaatgggtgaatggtgaaaagaagctgttttgcatcccgtggaggcatgctactcggcacggccctagccaagatggagataatactatcttcaaggcctgggccaaggagactgggaaatacacagagggggtcgacgaggctgatccagccaagtggaaggctaacttgaggtgtgcgttgaataaaagcagggactttcgcctgatctatgacgggccacgggatatgcctccccagccctataagatctacgaggtgtgtagcaacggcccagctcccacagattcccagcccccagaagactatagctttggtgcaggagaggaggaggaagaagaggaggaattgcagagaatgctgccctcattgtccctaaccgaggacgttaagtggccaccaacgctccagccgcccacgttgcgtcctccaacactgcaacccccaaccctgcagcctccagtagtgctgggaccgcccgctccagatccctcaccactggcccctccccctggaaatcctgctggctttagggagctgctgtccgaggtgctggagccgggtcctctcccagcgagtctgcccccggccggtgagcaactgctacctgacctgctgatcagccctcatatgctccctcttacagatctggagattaagtttcagtacagagggagaccccccagggcactcaccatttcgaacccccacgggtgcaggcttttttacagtcagcttgaggcgacacaggagcaagttgaactgttcggacccatttctctcgagcaagttaggtttccaagtccagaagatatccccagtgacaagcagcgtttttataccaaccagttactggacgtcctggaccgcgggctgatcttgcagctgcaggggcaggatctgtacgcaattagactatgccagtgcaaggtattctggagtggcccctgtgcgtctgcacatgactcttgcccaaatcctatacaacgggaagtgaaaactaaactgtttagccttgagcattttcttaatgaactcatattgtttcagaaaggacagaccaacaccccacccccgttcgaaatcttcttctgctttggggaggagtggcctgaccgtaaaccccgcgagaagaagcttattactgttcaggtggttccagtggccgcccgcctactcctggagatgttcagcggagagctgtcttggagcgctgacagcattaggcttcagataagcaatcccgatctaaaagaccggatggtcgagcagtttaaggagctacatcacatttggcagtcccaacagagactgcagccggttgcccaagctcctccaggggcgggccttggtgtcgggcaagggccctggccgatgcatcccgccgggatgcagtag

SEQ ID NO: 24610 - DNA, 1545 bp, Artificial Sequence
  Description of Artificial Sequence: Synthetic coding sequence
atgaaccagagcatccccgtggcccccacccccccccggcgggtgagactcaaaccatggctggttgcccaggtaaacagctgccaataccctgggctgcagtgggtgaatggggaaaaaaaactgttctgcattccatggcgtcatgcaacccgccacggacctagccaggacggggataatacaatttttaaggcctgggcgaaggagacggggaaatatactgagggggtagatgaagctgatcctgccaagtggaaggcaaatttgagatgcgccttaaataagtcacgcgacttcaggcttatttacgacgggccacgcgatatgccacctcagccttataaaatatacgaggtgtgttctaacggacccgccccgaccgacagccagccccccgaagactattccttcggggctggcgaggaagaggaagaggaagaggaactccagagaatgcttccgtcactcagtctgaccgatgcagtccaatccggcccccacatgacaccttactctctgctgaaagaggacgtgaagtggccaccaacacttcagcctcccaccctgagacctcctacattgcaaccccctaccctacagcctcccgtcgtgctgggccctcctgcacccgaccccagtcctctggcacctccccccggcaacccggccggatttcgagagttgctctctgaggtgctggagccaggccctctgccagcgtctttacctcccgccggcgagcagctcctccctgatttactcatctcaccacatatgcttccgctaacggatcttgaaatcaaattccaatatcgcgggaggcctccccgggcattgacgatatccaacccacacggctgccgccttttctatagtcagctcgaagccacccaggaacaggtcgaactgtttggtccaattagtctggagcaggtaagattcccctcccctgaagatatcccgtctgataaacagcgcttttacacgaatcagctgctagacgtcctggacagaggactcatcttgcagctccagggtcaagacctctatgccatccgactttgccagtgcaaggtgttttggagcggtccatgcgcatcagcacacgacagctgtccaaacccaatccagagggaggttaaaaccaaactcttctcactggaacactttcttaacgaacttatcctgtttcagaaaggtcagacaaacacccctccgccttttgagattttcttctgtttcggtgaggagtggcctgatagaaagccacgcgagaagaagcttatcaccgttcaggtagtcccagttgcagcgcgacttctgctggagatgttcagtggggagctgtcctggtcagcggactcaatccggcttcaaatctctaatccggacctgaaggatcgaatggttgagcagttcaaagagttgcaccacatctggcagtcccagcaacgactgcagcctgttgctcaagccccccctggcgctgggcttggggttgggcagggcccctggcccatgcaccctgccggaatgcagtag

SEQ ID NO: 24611 - DNA, 1497 bp, Artificial Sequence
  Description of Artificial Sequence: Synthetic coding sequence
atgaaccagagcatccccgtggcccccacccccccccggcgggtgcggctcaaaccttggcttgtagctcaggtgaacagctgtcagtatcctggtttgcagtgggtgaatggggagaagaagttattttgtatcccctggaggcacgcaactagacatggcccttcacaggacggtgataacaccatatttaaagcatgggcgaaagagactggcaagtatactgaaggggtggacgaggccgatcccgccaagtggaaagcaaacctgagatgcgctctgaataaatctcgtgatttcagattaatctatgacggtccccgcgacatgcccccccagccatacaaaatttatgaagtatgttctaatgggcctgctcctacggatagccagccaccagaggattactcctttggagccggggaggaagaggaagaggaagaagagctccaaaggatgctcccatccctgtctcttaccgaggacgtaaagtggccacctacattacagccccctaccctgcgaccaccgacactgcagcctcccacgctacagccaccagttgtattaggccctccagccccagatcctagtcctctagctcccccccctggaaaccccgccggtttccgggagttattaagtgaggtgctcgagcccgggcccctccctgcttctcttcctccagcgggtgaacaattgctgcctgacctgctgattagcccacacatgctcccgcttacagatctagaaattaagtttcagtaccgtggccgtcctccccgggcactgaccatatcaaacccacacgggtgccggttgttctatagccagctcgaagccacgcaggagcaggttgagctctttgggcccatttctctcgagcaggtgcggttcccctcccccgaagacatcccgagtgacaaacagaggttttacaccaatcaattgctagatgtgctggatagaggtctcattctacaactgcagggacaggacctgtacgccatacgcctgtgccaatgcaaagtattctggagtggtccatgtgctagcgcgcatgactcatgtccaaacccaatccagcgcgaggttaaaactaaactctttagcctagagcacttcctgaatgaacttatattgtttcagaaagggcagactaatacaccacccccctttgagatatttttctgctttggggaagagtggccagaccgaaaacctcgggaaaagaagctcataactgttcaagttgtgcccgtggcagcacgcctgctgctggagatgttttcaggggagctgagttggtctgctgacagcattcgcctacagatttcgaatccagacctgaaggatcgaatggtggagcaattcaaggagctgcaccacatctggcaatcacaacagagattacaaccagtagcacaggcccccccgggcgctgggttgggcgtaggtcaaggaccatggccaatgcaccctgcgggcatgcaatag

SEQ ID NO: 24612 - DNA, 1467 bp, Artificial Sequence
  Description of Artificial Sequence: Synthetic coding sequence
atgaaccagagcatccccgtggcccccacccccccccggcgggtgagactgaaaccatggctcgttgcgcaggtgaacagctgccagtatcctggtctccagtgggtgaatggggaaaagaaactgttctgcatcccttggcggcacgcgactaggcatggcccaagccaggacggcgacaatacaatctttaaagcctgggctaaagaaaccggcaagtataccgagggcgttgatgaagccgacccggccaagtggaaagcaaatcttcggtgcgccctgaacaaatccagggactttcgactgatctatgacggcccgcgtgacatgccaccccagccatataagatctatgaggtttgcagtaatggacccgcccccactgattctcagccgccggaagattactcatttggtgccggcgaggaagaggaagaggaggaagagctgcagcgaatgttgccttccctttctcttactgaggacgttaagtggcccccgactctgcagccacctacccttcagcctcccgtggtgctcggcccaccagccccggacccaagcccactagcccctcccccaggtaacccagccgggtttcgcgaattactctcagaggtgctcgagccaggacccttgccagcctctctgcctcctgccggagagcaactgctcccggacctgctgataagtccccacatgcttccgctcacagacttagaaatcaaattccaatacaggggccggccaccccgtgcgctaaccatctcgaacccacacggatgccgtctgttttactcccagttagaggccacccaggagcaggtcgagcttttcgggcctatatcgctggagcaggtaagatttccctctcctgaagacattccatccgataagcagcgcttttacaccaaccagctcctcgacgtgcttgatagaggactgattctgcagcttcaaggccaggatttgtacgcgattaggctgtgccagtgcaaggtcttttggtccggaccctgtgcctcggctcatgatagttgccccaaccccattcagcgagaggtcaaaacgaagctattcagccttgagcactttctgaacgagttgatcttatttcagaagggccaaaccaatactccgccaccgttcgagatctttttctgcttcggcgaggaatggcctgataggaagccgcgagaaaaaaaactcattactgtccaggttgtgccggtggctgctagactgctgttggagatgttcagcggcgagctttcatggagcgcagactccattaggcttcagatcagcaacccggatttgaaggacagaatggtggagcagttcaaggagctgcatcatatttggcagagccagcagcgcctacagccagtggcacaggcccctcctggagcggggctgggcgtagggcagggtccatggcccatgcatcctgcaggcatgcaatag

SEQ ID NO: 24613 - DNA, 684 bp, Artificial Sequence
  Description of Artificial Sequence: Synthetic coding sequence
atgaaccagagcatccccgtggcccccacccccccccggcgggtgcggctcaaaccttggttggtggcccaggtaaacagctgtcagtaccccggattacaatgggtgaatggcgaaaagaaactgttttgcatcccctggagacacgccaccaggcacggcccctctcaggacggcgacaatacaattttcaaggcctgggcaaaagagaccggaaaatatacggaaggagtcgatgaagcggacccagctaaatggaaggccaacctccggtgcgccctcaataaatccagagattttcgtctgatatatgacgggccacgggacatgccaccccagccatacaagatatatgaagtctgtagcaacgggccagcccccactgattcacagcccccggaggactattcatttggtgcaggcgaggaggaagaagaagaagaggaacgcatgagttcagggcgccctctctgttcccgacctctgtgcggccgcctgctctgcagcagaccactgtgtagtcggccctggtgctgggtccctttgctgcaaacaccggccccatggctgctgccgctcgccaccctcctggcttccggcagtttcagcctgaggtcatggtctctgggcccttgcctccctgcatgcccactacaggccaattcatcatgccagacctgttag

SEQ ID NO: 24614 - DNA, 474 bp, Artificial Sequence
  Description of Artificial Sequence: Synthetic coding sequence
atgaaccagagcatccccgtggcccccacccccccccggcgggtgcggttgaagccgtggctcgtggctcaggtgaactcttgtcagtatcctggtctccagtgggtgaacggcgaaaaaaaactcttttgtattccttggaggcatgccactaggcacggcccctcacaggacggggacaatacgattttcaaggcttgggccaaggagacggggaaatatactgagggggtggatgaggctgaccccgccaaatggaaggcaaacctaagatgtgctctaaataagtcccgagactttcgtcttatttatgacgggcctcgtgacatgccaccacagccttataagatctatgaggtttgctctaatgggcctgcacccacagacagccaaccaccggaagattactcatttggcgcaggagaggaagaggaggaggaggaggagatgcagtgcagtttagcacccacttag

SEQ ID NO: 24615 - DNA, 321 bp, Artificial Sequence
  Description of Artificial Sequence: Synthetic coding sequence
atgaaccagagcatccccgtggcccccacccccccccggcgggtgaggctgaaaccatggttggtggcccaagtaaactcctgtcagtatcctggcctgcagtgggtcaacggagagaagaagttattctgcataccatggcgtcacgccacacggcacggaccctcacaggatggcgacaacacgatattcaaggcttgggcaaaggaaacgggcaaatatacagagggcgtggatgaagcggacccggccaagtggaaagccaacctgcggtgcgcactcaacaaatcccgtgattttcgactcatttacgacggttag

SEQ ID NO: 24616 - DNA, 180 bp, Artificial Sequence
  Description of Artificial Sequence: Synthetic coding sequence
atgaaccagagcatccccgtggcccccacccccccccggcgggtgcggctgaagccctggctcgttgcccaagttaacagctgtcagtacccagggttgcagtgggtgaacggggagaaaaagctgttttgcatcccatggagacatgcgacaaggcacggaccaagtcaggatggctag

SEQ ID NO: 24617 - DNA, 1497 bp, Artificial Sequence
  Description of Artificial Sequence: Synthetic coding sequence
atgaaccagagcatccccgtggcccccacccccccccggcgggtgagattaaagccctggctggtcgcccaggtcaacagttgtcagtaccctggcctccaatgggtgaacggggaaaagaagctgttttgtatcccttggcgtcatgctactagacatgggcccagccaggacggagacaacacaatttttaaggcatgggctaaagaaaccgggaagtatacggaaggggtggatgaggccgatcctgctaagtggaaagccaacttacgttgcgcattgaataaaagcagagacttcagacttatctatgacgggcccagagacatgcctcctcagccctataagatttatgaagtctgctctaacggccccgcccctacggattcccagccccccgaagactattcgtttggagctggcgaggaggaggaagaagaagaggagctgcaaagaatgctgccatctctcagcctgactgaagacgttaagtggccacccaccctgcaaccgccaacactgcgaccaccaaccctgcaacccccgacgctgcagccccccgtagtgcttggaccacccgctcccgatccaagccctctggccccgccacctggaaaccctgctggatttcgcgagttgttgtccgaagtactcgagccaggccctctgccagcaagtctacccccagccggtgagcagcttttgccagacctcttaatttccccacacatgctgccattaactgatcttgagataaagttccaataccgcggcaggccaccgcgtgcacttaccatttctaacccacacgggtgcaggctgttctatagtcaactggaagctacccaggaacaagtggaattattcggtcccattagccttgagcaagtccggtttcccagtccggaggatatcccgtctgacaagcaaaggttttataccaaccagctgttagacgtattggatcggggattgatcttgcagctccagggtcaggacctctacgctatcaggctttgccagtgcaaagtcttctggagcggcccatgcgcaagcgctcacgattcttgccctaaccctattcaacgggaggtgaaaactaagctgttctccctggagcatttccttaacgagctgattctgttccagaaaggacaaaccaatacccccccccctttcgagattttcttttgctttggggaggagtggcctgacaggaagccccgcgaaaaaaaactgatcactgtacaggttgttccggtggcggcccgtcttctgctggagatgtttagcggcgaactgagttggtctgccgattccatccgcttgcagattagcaaccccgacctcaaagatcgaatggtcgagcagttcaaggagctacaccatatctggcagtctcagcagaggcttcagcccgtggctcaagctcccccgggtgcaggccttggcgtggggcagggcccatggccaatgcatccagccggaatgcagtag

SEQ ID NO: 24618 - DNA, 426 bp, Artificial Sequence
  Description of Artificial Sequence: Synthetic coding sequence
atgaaccagagcatccccgtggcccccacccccccccggcgggtgcggctcaagccttggctagtcgctcaggtcaactcgtgccaataccccggcctccagtgggtgaacggagaaaagaagctgttttgcataccctggagacacgctactaggcatgggcccagtcaggatggagacaacacgatctttaaagcttgggccaaagaaaccggcaagtacaccgagggagtggatgaggcggatcctgcgaagtggaaggctaatctcagatgcgccctgaacaaatcccgcgatttccgcctcatttatgacggtcccagagatatgccccctcagccgtacaagatctacgaggtgtgtagtaacggcccggctcctacagacagtcaaccaccggaggactactcatttggagccggctag

SEQ ID NO: 24619 - DNA, 459 bp, Artificial Sequence
  Description of Artificial Sequence: Synthetic coding sequence
atgaaccagagcatccccgtggcccccacccccccccggcgggtgcggctaaagccttggcttgtcgctcaggtgaactcctgtcaataccccgggttgcagtgggtgaacggtgagaaaaagctgttctgtattccttggcgccatgcaacccgccacggcccttcacaagatggggataacacgatttttaaagcgtgggctaaggagacagggaagtatacagagggggtggacgaagctgatccagctaaatggaaggctaacctgagatgtgcccttaacaaatcacgcgattttaggttgatttatgacggtccaagagacatgcccccgcagccatataaaatctacgaggtgtgttctaacggtcccgcaccaacagactctcagccacccgaagattattcctttggtgcgggtgaggaggaggaggaagaggaagaagtcagcgtgtag

SEQ ID NO: 24620 - DNA, 1239 bp, Artificial Sequence
  Description of Artificial Sequence: Synthetic coding sequence
atgaaccagagcatccccgtggcccccacccccccccggcgggtgcgactgaagccttggctggtggcgcaggttaattcctgtcaatacccgggcctgcaatgggtcaatggggaaaaaaaactgttctgcatcccctggaggcacgctacacgccacggaccctctcaggatggcgacaatacaattttcaaagcttgggctaaagagacaggaaagtacactgaaggggtcgacgaggcggatcccgcgaagtggaaggcaaacctgcgctgcgcgcttaataagagccgtgacttcagacttatttatgatgggccgagagacatgcctccccagccatataagatctacgaggtctgttctaacggacccgcccccaccgattcgcagcctcctgaggattacagctttggcgcaggcgaggaggaagaggaggaggaggaactccagcggatgctgcctagtctctcactgacagtgacagacctagagattaagttccagtacaggggacgcccacctcgggcgctcactatttctaacccacatgggtgcagattgttttactcgcagttagaggctacgcaagagcaagtggagctctttggacctatctcgttggagcaagtcagattcccatcccctgaggatattccgagcgacaaacaacgcttctatacaaaccagttactcgatgtgctggaccgcggtctaatcttgcaactgcaaggccaggatctgtacgccatacggctctgtcaatgcaaagtcttctggtcaggcccttgcgcttctgcacatgattcttgcccaaaccctatccagagggaagtgaagacgaaactgttctctttagaacatttcctaaacgagctgatcttattccagaagggccagaccaatactccaccacctttcgaaatctttttctgtttcggtgaggagtggccggatcgcaaaccacgcgaaaaaaagctgattaccgttcaagtggtgccggttgccgcccgccttctacttgaaatgtttagcggcgagctgagctggtctgccgattcgattcggctccaaatctcaaatccagatctgaaagatcggatggtcgagcagtttaaagagctgcaccacatatggcaatcacagcagcgactgcaacctgtagctcaagcaccccccggggcaggcctgggagttggtcagggcccttggcctatgcaccctgctgggatgcaatag

SEQ ID NO: 24621 - DNA, 570 bp, Artificial Sequence
  Description of Artificial Sequence: Synthetic coding sequence
atggccagccccttcgccctgctgatggtgctggtggtgctgagctgcaagtcctcctgcagcttgggctgtgatctgcctgaaacacactccctggacaataggcggacgctgatgctccttgcacagatgagccgaatctctccctcctcctgccttatggacagacacgactttgggtttccccaggaagaatttgacggtaatcagtttcaaaaggcccccgccatttcagtgcttcatgagctgattcagcagatcttcaatctcttcaccaccaaagacagctctgctgcatgggatgaagacctgctcgacaaattctgcaccgaactctatcagcagttaaacgatttggaggcatgtgtgatgcaggaagagcgggtgggtgagaccccgctgatgaacgcagatagcatactggcagtgaagaaatactttcggaggataactctgtatttaactgaaaagaaatattcgccttgtgcttgggaggtggttagggccgagatcatgcggtctctcagcctgagtaccaatctgcaggagcgtttgcggagaaaggagtag

SEQ ID NO: 24622 - DNA, 516 bp, Artificial Sequence
  Description of Artificial Sequence: Synthetic coding sequence
atgctggtgaacttcatcctgcggtgcggcctgctgctggtgaccctatcattggctattgcaaaacataaacagagttctttcacaaagtcttgttatccccgcgggacactttcccaggctgtcgacgctctctacattaaagccgcctggctcaaggctacaattccggaggatcgaatcaaaaacattcggcttctcaagaagaaaacgaaaaagcagttcatgaagaactgccagttccaggagcagctgctgagcttcttcatggaggacgtgttcggtcagctgcagttgcaagggtgcaaaaagatcagatttgtagaggacttccacagcctgaggcagaaattgtctcactgtataagttgcgcatcctctgctcgcgagatgaagagtatcaccaggatgaaacgtattttttatcggatcggcaacaaaggaatatataaggctatttccgagctcgatatcctcctctcctggatcaaaaaactcctggagtcatctcaatag

SEQ ID NO: 24623 - DNA, 543 bp, Artificial Sequence
  Description of Artificial Sequence: Synthetic coding sequence
atggccctggccgacctgtacgaggagggcggcggcggcggcggcgagggcgaagataacgcagactcaaaggagacaatctgcagaccgtctggccgcaaatcctccaaaatgcaggcttttcgcatttgggacgtgaatcaaaaaacattttatttgaggaacaatcaattagtggcagggtaccttcaggggcccaacgtgaacctcgaggaaaagatcgatgtcgtgccaatcgagccacatgccttgttcctgggaattcatggcgggaagatgtgtctctcctgcgttaagagcggggacgagacccggctacagctggaggccgtgaacataaccgatctgagcgagaataggaagcaggataagagattcgcattcataaggagtgactcaggacctaccaccagctttgagtccgcggcatgtcctggttggtttctgtgcacagctatggaggcggatcagcctgtgtccctgacaaacatgccggacgaaggtgtgatggtgactaagttctacttccaggaggatgagtag

SEQ ID NO: 24624 - DNA, 480 bp, Artificial Sequence
  Description of Artificial Sequence: Synthetic coding sequence
atggccctggagaccatctgccggcccagcggccggaagagcagcaagatgcaagcattccgcatttgggacgttaatcagaagacattctatctgcgcaataaccagctcgtggctggatatctgcagggacctaatgtgaatcttgaggaaaagattgatgtggttccgatagaaccgcatgctctgttccttgggattcatggcggcaagatgtgtctgtcctgcgtcaagagcggcgacgaaacccgattacagctggaggctgtgaacatcacagacctctcagaaaatcggaagcaggataaacggtttgcctttatccggtcagactcaggacccacaacctcgtttgagtctgcggcgtgccctggctggttcttatgtacagccatggaagcagaccagccagtgtccttaaccaacatgccagacgaaggtgtgatggtgactaaattctactttcaggaggacgaatag

SEQ ID NO: 24625 - DNA, 534 bp, Artificial Sequence
  Description of Artificial Sequence: Synthetic coding sequence
atggagatctgccggggcctgcggagccacctgatcaccctgctgctgtttctgttccattctgagaccatatgccgacctagcgggcggaagtcgtcgaaaatgcaggctttcaggatctgggatgtaaatcagaaaaccttttacctgagaaataatcagctggttgcaggctatctgcagggaccaaatgtgaacctggaagagaaaattgatgtggtgcctatcgaaccacacgcactgttcctgggaatccatggagggaagatgtgtttgtcatgcgtgaaaagcggagatgagacccgactacagctggaggcagttaacataaccgacctgtccgagaatagaaagcaggataaaaggtttgccttcattcggagtgactcagggcctactactagtttcgaatcagcagcatgccccggttggttcctgtgtacggctatggaggccgaccaacccgtatccttgacaaatatgccagacgagggcgtcatggtcacgaagttctatttccaggaggacgagtag

SEQ ID NO: 24626 - DNA, 432 bp, Artificial Sequence
  Description of Artificial Sequence: Synthetic coding sequence
atgcaggccttccggatctgggacgtgaaccagaagaccttctacctacgcaacaaccaattggttgcggggtaccttcaaggtccaaatgtaaatctggaggagaagattgatgtggtgccgatcgagccgcatgccctcttcctgggaatccacggcggcaaaatgtgtctgtcgtgcgtaaaaagtggcgacgaaacccggttacagctggaggctgtcaacatcactgacctgtctgaaaataggaagcaagataagcggtttgcttttatccggtccgatagtgggcctacaacaagtttcgagagcgctgcctgccctggctggttcctttgtacagccatggaagctgaccagccagtttcattgacaaatatgcctgatgagggagtaatggtcaccaaattctattttcaggaggacgagtag

SEQ ID NO: 24627 - DNA, 1470 bp, Artificial Sequence
  Description of Artificial Sequence: Synthetic coding sequence
atggagcccggcctggagcacgccctgcggcggacccccagctggagctcattgggcggttcagagcaccaagaaatgtcattcctggagcaagaaaactcttcgtcctggcccagcccagccgtgaccagttcgtcggagcggatcagggggaaacgaagggccaaggctctgcggtggactcgccagaaaagcgtcgaggaaggcgagccaccagggcagggcgaggggccacggagccggccagcagcagagagcaccggcttagaagcaactttcccaaagaccacccccctggctcaagcagaccccgccggcgtcgggacaccgcctacgggatgggactgtctacccagtgattgtaccgctagcgccgctggatcatcaacagacgacgtggagctagcgacagaatttccagccaccgaagcctgggaatgtgagttagaaggacttcttgaggagcgacctgccctgtgtctcagcccccaggcgccctttcctaagctgggttgggacgatgaactgcgtaaaccaggagcacagatttatatgaggtttatgcaagagcacacttgttatgacgccatggccacaagtagcaaactagttatcttcgacaccatgctagagatcaaaaaagcgttcttcgccctagtcgcaaacggggtgagggccgcaccactctgggatagcaaaaagcagtctttcgttggtatgcttaccattacagattttatcctcgttctgcaccggtattacaggtccccactggtccagatttacgagattgagcagcataagattgaaacatggcgcgaaatctacctgcaaggatgctttaaaccgctggtcagtatcagcccgaatgacagcctgtttgaagccgtctatacccttatcaaaaaccgcatacatagactgccagtgctggatcctgtgtctggcaacgtgttgcatattctgacccacaagaggctgctgaagtttctccacatctttggcagcctgctccctagaccaagcttcctctacagaacaattcaggatctcggtatcgggaccttcagggacctcgccgtcgtccttgagactgcacctattctgacggccctggacatcttcgtggatcgtcgtgtgtccgctctgccggtcgtcaacgagtgtggccaggtcgttggcctgtacagcagatttgacgttattcacctggccgcacaacaaacctataatcacctcgatatgtccgtgggcgaggcactgcggcaacggactttgtgcttggagggggtgctgagttgtcagccgcacgaatccctcggggaagtgattgatcgcattgctcgcgaacaagtacataggctggttctggtggacgagactcaacacctcctcggcgtagtatcactttccgacatactccaggcactggtgttatctcctgcgggtatcgacgccctcggggcttag

SEQ ID NO: 24628 - DNA, 1710 bp, Artificial Sequence
  Description of Artificial Sequence: Synthetic coding sequence
atgaaggtgctgctgcggctgatctgcttcatcgccctgctgatctcctctcttgaagccgataagtgcaaggaaagagaagagaaaataatactagtgagctccgcgaacgaaattgatgttcggccctgccccctgaatcccaacgaacacaaaggcactatcacctggtataaggacgatagcaaaacgcccgtatcaaccgagcaagcaagccggatccatcagcataaggagaagctatggttcgtccccgctaaggtggaagacagcgggcactactactgtgtcgtgcggaattcctcttattgccttaggatcaagatctctgctaaattcgtcgagaacgagccaaatctgtgttataacgcccaagccatttttaaacagaagctgcctgtagcgggcgatggtggtctggtgtgtccatacatggaattcttcaagaatgaaaataacgaattacccaagttgcagtggtacaaggattgtaaaccattgctgctagataatattcactttagcggagtgaaggataggttaatagttatgaacgtcgcggagaagcatcgtgggaactatacatgtcatgcctcctacacttacctcggcaagcaatacccgatcactcgtgtgatcgagttcattactctggaggaaaataaaccaacccgccccgtgatcgttagcccagctaacgaaacgatggaggtggacttgggaagtcagatccagcttatatgtaacgtgacgggccagctcagcgatatcgcctactggaagtggaacggcagcgtgattgacgaagatgacccagtcttaggagaagattattattcagttgagaatcctgctaataagaggaggtctaccttgattacagttctgaatatatccgaaattgagtcaaggttctataagcacccttttacctgctttgcaaagaacacgcacggcatagacgccgcatatatccagctgatctaccccgtcacaaattttcagaaacatatgataggaatctgtgtgacattaactgtcattattgtgtgcagtgtttttatctataaaatcttcaagattgatatcgtgctctggtacagggactcttgttacgacttcctccctataaaggccagtgatggcaagacttacgatgcttatattctgtatcccaagaccgtgggggaaggttctacctcagattgcgacatattcgttttcaaagtcttgcctgaggtgttggagaaacagtgcggttataaattatttatttacggacgggatgactatgtaggggaggacatcgtcgaagtgatcaacgagaatgttaagaagtctcgccgactcattataatcttggtgcgggagaccagcggcttcagctggctcggcggcagttccgaggaacagatcgccatgtacaatgccctggtccaggatggcatcaaggttgtattgttggagcttgagaagattcaggactacgagaagatgccggagagcattaagttcattaagcaaaagcatggagccattagatggtcgggggacttcactcaaggcccgcagtccgctaaaacccgcttctggaagaacgtgagatatcacatgccagtccagcgcagatctccatctagcaagcatcagttgctgagccccgccaccaaggaaaaactccaaagggaggcccacgtgccgctcgggtag

SEQ ID NO: 24629 - DNA, 549 bp, Artificial Sequence
  Description of Artificial Sequence: Synthetic coding sequence
atgaaggtgctgctgcggctgatctgcttcatcgccctgctgatcagctcactggaggcggataagtgtaaggagagggaggagaagatcatactggtcagctctgccaatgagatagatgtgagaccttgtcctcttaacccaaatgagcacaaaggaaccattacctggtacaaagatgatagcaagacccccgttagcaccgagcaagcatcacggattcatcagcacaaagaaaaactgtggttcgttcctgcaaaggtagaggatagcggtcattactactgtgtggtgaggaactcatcttattgcctacgaattaagatcagcgccaagtttgtggaaaatgagcccaacctgtgttacaatgcgcaggcgatatttaagcagaaattacctgtcgcaggcgacggcggcctggtctgtccatacatggagttctttaagaatgagaataatgaactgcccaagcttcagtggtataaggattgcaagcccctgctgcttgacaatattcatttcagcggagtcaaagatcgactgatttag

SEQ ID NO: 24630 - DNA, 345 bp, Artificial Sequence
  Description of Artificial Sequence: Synthetic coding sequence
atgaaggtgctgctgcggctgatctgcttcatcgccctgctgatcagctcactggaggcggataagtgcaaggaaagggaggagaaaattattctcgtgtcaagcgccaatgaaattgatgtccgtccatgtcctcttaatccgaacgaacacaagggcactatcacatggtataaggacgatagcaagacgcctgtcagcactgaacaggcaagcaggatccaccagcacaaagagaagctgtggtttgtccctgcaaaggtggaggactcaggccactactattgtgtggtccgtaactcgtcatattgcctgcgcataaaaatttccgcaaaatttgtctag

SEQ ID NO: 24631 - DNA, 321 bp, Artificial Sequence
  Description of Artificial Sequence: Synthetic coding sequence
atgaaggtgctgctgcggctgatctgcttcatcgccctgctgatcagcagcctggaagcggataaatgcaaggagagagaagagaagatcatccttgtgtccagcgcaaacgagattgacgtgcgtccttgtccactgaaccccaacgagcacaagggtacgatcacctggtataaagatgactccaagactcctgtcagcacagagcaggcctcaaggatccatcagcataaggagaaactctggtttgtacctgccaaggtggaggattccggtcactattattgcgtggtgagaaactcaagctattgcctaaggtag

SEQ ID NO: 24632 - DNA, 243 bp, Artificial Sequence
  Description of Artificial Sequence: Synthetic coding sequence
atgaaggtgctgctgcggctgatctgcttcatcgccctgctgatctcctctttggaggctgataaatgcaaggagagagaagagaaaatcatcctagtgtcctcagctaatgagatagatgtcagaccctgtcctctcaatccgaatgaacacaagggcaccataacatggtataaggacgattcaaaaacacctgtaagtaccgaacaggcctcccgtattcaccagcataaagagaaatag

SEQ ID NO: 24633 - DNA, 810 bp, Artificial Sequence
  Description of Artificial Sequence: Synthetic coding sequence
atggccgaggtgcccgagctggccagcgagatgatggcctactactccgggaacgaggatgatctattttttgaagcagacggtcctaaacagatgaagtgttcattccaagacctggatctgtgtccgctggacggtgggatccagctcaggatatctgatcaccattattccaagggttttcgtcaggccgcttctgtggtggtggcaatggataaactgcgcaagatgctggtgccctgtccccagacgttccaggaaaatgacttaagcaccttcttcccttttatttttgaagaggagccaatctttttcgatacgtgggacaatgaggcttatgttcacgatgccccggtgaggagcttgaattgcacactgcgtgactcccagcagaaaagcttggtgatgagcgggccatatgagctcaaggctctgcacctgcagggccaggatatggaacagcaagttgtcttctcaatgtcattcgtgcaaggcgaggaaagtaacgataagatccctgttgcgctgggacttaaagaaaagaatctgtatctgagttgcgtgttgaaggatgacaaacctaccttacagctggagagcgtggatcccaagaattaccccaaaaaaaagatggagaagcgattcgtgtttaacaaaattgagatcaacaacaagctggagtttgaatctgcacagttccctaactggtacatttcaactagtcaggctgaaaatatgcctgtctttctcggaggaaccaaagggggccaagacataaccgactttaccatgcagttcgtgagttcctag

SEQ ID NO: 24634 - DNA, 336 bp, Artificial Sequence
  Description of Artificial Sequence: Synthetic coding sequence
atggccgaggtgcccgagctggccagcgagatgatggcctactactctggaaatgaggacgacttgttcttcgaagctgatgggccaaaacagatgaagtgctcctttcaggacctagacctatgcccccttgacggcggaattcagcttagaatttccgaccatcattactcaaaagggttccgccaggctgcctccgtggtggtggccatggataagttaagaaaaatgcttgtgccctgtccacagacctttcaggagaatgatcttagcacattttttcctttcatatttgaggaggaacccattttcttcgatacctgggataacgagtag

SEQ ID NO: 24635 - DNA, 432 bp, Artificial Sequence
  Description of Artificial Sequence: Synthetic coding sequence
atggccgaggtgcccgagctggccagcgagatgatggcctactacagcggcaacgaggacgatttgttctttgaggccgacggaccaaaacagatgaagtgttcctttcaagacttagatttgtgccctctggatggcggaatccagctgcggatttcagaccaccactactcgaaggggtttagacaagcggccagcgtcgtggtggcaatggacaaattacgaaagatgctggttccatgccctcagacatttcaggagaacgatctgagcaccttcttcccattcatttttgaagaggagccaatattcttcgacacctgggacaatgaggcctacgttcacgacgctcctgtacgttccctcaactgtaccctgcgcgactcacagcaaaagtcccttgtaatgtctggaccttacgagttaaagtag

SEQ ID NO: 24636 - DNA, 378 bp, Artificial Sequence
  Description of Artificial Sequence: Synthetic coding sequence
atggccgaggtgcccgagctggccagcgagatgatggcctactacagtggaaacgaggatgatctgtttttcgaagccgacggtcccaaacaaatgaagtgctccttccaggacctcgacctctgtcctctagacgggggaattcagttgcggataagcgaccatcactactctaaaggtttcaggcaagccgcgtctgtggtggttgcgatggacaagttgagaaagatgttggtgccgtgcccgcaaaccttccaggagaatgacctaagcacgttctttccttttatctttgaggaggaacctatcttctttgacacctgggataatgaggcatatgtccacgatgctcctgtcaggtcgctgaactgtacatag

SEQ ID NO: 24637 - DNA, 762 bp, Artificial Sequence
  Description of Artificial Sequence: Synthetic coding sequence
atgtggccccccggcagcgccagccagcccccccccagccccgccgcggctacaggccttcacccagctgccagacccgtgagccttcagtgccgcctgagtatgtgcccagccaggtcactcttgttagttgcaactttggtgctgttagaccatctgagtctggcacgcaacctgccagtggctactcccgatcccggcatgtttccctgcctgcatcacagccaaaatctgcttcgtgctgttagcaacatgctgcagaaggcacgccagaccttggaattctacccatgcacttcagaggagatcgatcacgaggacatcacaaaagataagactagtactgtcgaggcttgtctgcccttggaactcaccaagaacgagtcctgcctgaatagccgtgagactagcttcattactaatggttcctgtctggccagccgcaaaacatccttcatgatggcactttgcctctcaagtatctacgaggacctgaaaatgtatcaggttgagtttaagacgatgaacgccaaattattgatggaccccaagagacagattttcttagatcagaatatgttggcggtgatcgacgaactgatgcaagcgctgaacttcaactccgaaaccgtgccacaaaagtctagcctagaggaacccgatttctacaagactaaaatcaagttgtgcatcctgttacatgctttccgaattagagccgtgactatcgatagggtcatgtcttacctgaacgctagttag

SEQ ID NO: 24638 - DNA, 720 bp, Artificial Sequence
  Description of Artificial Sequence: Synthetic coding sequence
atgtggccccccggcagcgccagccagcccccccccagccccgccgcagccactggtctgcatcccgccgctcggccggtgagcctgcagtgtcggctctctatgtgtcctgcaagaagtctattgttggtcgcaaccctggtcttactggatcacctttcccttgctcgtaacctaccagtggccacccccgacccgggaatgttcccctgcctccaccactctcaaaatcttctgagggccgtctcaaacatgcttcaaaaggcgaggcagaccctggagttctacccctgcacttctgaggaaattgaccatgaggatatcacaaaagacaaaacatccactgtcgaagcttgccttccgctcgagctcaccaagaatggatcctgtctggcttcaaggaagacctcgttcatgatggctttatgcctgagttcaatatacgaggatctcaagatgtatcaagtagaatttaagacaatgaacgcaaaattactgatggatccaaaacgacagatcttcttagatcaaaacatgctggcagttattgatgaactcatgcaggctcttaatttcaattctgagaccgtgccccagaagagtagtttagaggagccagacttttataagaccaagatcaagctgtgtatcctgttacacgcattccggattcgggcagttacgatcgacagagtgatgtcctatttgaacgcctcctag

SEQ ID NO: 24639 - DNA, 648 bp, Artificial Sequence
  Description of Artificial Sequence: Synthetic coding sequence
atgtggccccccggcagcgccagccagcccccccccagccccgccgccgccaccggtctccacccggctgctcgacccgtctctcttcagtgcagactgtcaatgtgcccagccagaagcctgctgttggttgccaccctagtgctcttggatcaccttagtcttgcgaggaatctacccgttgccactcccgaccccggtatgttcccgtgccttcaccactcccagaatttattacgggcagtaagcaacatgctgcagaagaacgagagttgtctgaattcccgggagacctccttcattacgaacggctcttgcttggccagccgcaaaacatcatttatgatggcattatgccttagttctatttatgaagacctaaagatgtaccaggtggaatttaaaacaatgaatgctaagctgctcatggacccaaagcgccaaattttcctggaccagaatatgctcgccgtgatcgatgaattgatgcaagctctgaacttcaattcagaaactgtccctcagaagagctcactggaggaacccgacttctacaaaactaagattaagctctgcattctgcttcatgcctttcgtatccgggctgtgacaatagatagggtcatgagctacctgaacgcctcttag

SEQ ID NO: 24640 - DNA, 489 bp, Artificial Sequence
  Description of Artificial Sequence: Synthetic coding sequence
atgcggatcagcaagccccacctgcggagcatcagcatccagtgctatctttgtttgttgctgaactcgcacttcctcaccgaagcaggcattcacgtctttatattaggctgcttcagtgccgggctgcccaagactgaggccaattgggtcaacgtcattagcgacttgaaaaaaattgaggacctgatccagtcaatgcacatagatgcaactctttatactgaaagtgatgttcatccttcatgcaaagtcactgccatgaaatgctttctgctagagttgcaggttatctccctggaatcaggtgatgcttcaatacatgacacagttgagaacctgatcatacttgcaaacaattcactctcctcaaacgggaacgtcaccgagtcaggctgtaaggagtgcgaagaactcgaggagaagaacattaaggagtttctccaatcgtttgtccacattgtgcaaatgtttatcaacacttcttag

SEQ ID NO: 24641 - DNA, 489 bp, Artificial Sequence
  Description of Artificial Sequence: Synthetic coding sequence
atgcggatcagcaagccccacctgcggagcatcagcatccagtgctatctgtgtttgcttcttaactctcatttcttgaccgaggctggaattcacgtgttcatcctaggctgctttagcgcaggcttgcccaagaccgaggctaactgggtgaacgtgatatcagatctcaagaaaatcgaagatttgatccaaagcatgcacattgacgcaacattgtacacagagagcgatgtacacccaagttgtaaagtcacagctatgaaatgcttcctcctggagctgcaggttataagcctggaatctggcgatgcaagcattcacgatactgtggaaaacctgataattttggctaacaactccctctcttcaaatggtaacgttaccgaaagtggctgcaaagaatgtgaagagctagaggagaagaacatcaaagagttcttgcagtctttcgtgcatatcgtgcagatgtttatcaatacgagctag

SEQ ID NO: 24642 - DNA, 408 bp, Artificial Sequence
  Description of Artificial Sequence: Synthetic coding sequence
atggtgctgggcaccatcgacctgtgcagctgcttcagcgccggcctgcccaaaacagaggccaactgggtgaatgtaatctccgatctgaagaagatagaggatctgattcagtcaatgcacattgacgccacactgtacaccgagagcgatgtgcaccctagttgcaaagttacagctatgaaatgtttcttactcgaattgcaggtgattagcctcgaatcaggcgacgcatcaattcatgatactgtagaaaacctcatcatactggccaacaactcgctgagtagcaatgggaatgtgaccgaatctgggtgcaaggaatgcgaagaactcgaggagaagaatataaaagagttcttgcagagctttgtgcatatagtccaaatgttcatcaacacaagttag

SEQ ID NO: 24643 - DNA, 408 bp, Artificial Sequence
  Description of Artificial Sequence: Synthetic coding sequence
atggtgctgggcaccatcgacctgtgcagctgcttcagcgccggcctcccaaaaacagaagctaattgggtgaatgtgatttctgatctcaaaaaaatagaggatctgatccagtccatgcatatcgacgcgacactttacactgagtccgacgtccaccctagctgtaaggttacagctatgaaatgctttctgttggagctgcaagtgatttccctggaatcgggtgacgcttccattcatgatactgtcgaaaatttaattattctggcaaataactccttgagcagcaacggaaacgtgactgagtccggatgtaaggagtgtgaagaactggaggagaagaatatcaaagagttccttcaaagcttcgttcatattgtccagatgtttatcaacacatcatag

SEQ ID NO: 24644 - DNA, 408 bp, Artificial Sequence
  Description of Artificial Sequence: Synthetic coding sequence
atggtgctgggcaccatcgacctgtgcagctgcttcagcgccggccttcctaaaactgaagccaactgggtcaacgttattagcgacctaaagaagatcgaagatctgatccaatccatgcacatcgacgccactctgtatactgagagcgatgtgcacccatcgtgtaaggtaacagcaatgaaatgtttcctgcttgagttgcaggtgatttccctggagtccggtgacgctagcattcacgatactgtggagaatctgatcatcctggcgaacaactcccttagtagtaacgggaacgtgaccgagtccggttgcaaagagtgcgaggagctagaagaaaaaaacattaaggagttcttgcagtcattcgtgcatatcgtgcagatgtttatcaatacatcgtag

SEQ ID NO: 24645 - DNA, 489 bp, Artificial Sequence
  Description of Artificial Sequence: Synthetic coding sequence
atgcggatcagcaagccccacctgcggagcatcagcatccagtgctacctgtgcctgctgctgaattcccattttctgaccgaagccggcatccacgtctttattctgggctgcttcagtgctgggctgccgaagactgaggctaattgggtcaatgtcattagtgatctaaagaaaatagaagatctaattcagtccatgcacattgacgctaccctgtatacagaatcagacgtccacccctcctgcaaggtgacggctatgaaatgctttctgttggaacttcaggtcatttccctcgagagtggtgatgcaagcatccatgataccgtcgagaatctaatcattctcgcaaataactccctgtctagcaacggaaacgtgacggagagcggctgcaaggagtgtgaagaactggaagagaagaatatcaaggagttccttcagtcattcgtccacattgttcagatgttcatcaacacctcctag

SEQ ID NO: 24646 - DNA, 582 bp, Artificial Sequence
  Description of Artificial Sequence: Synthetic coding sequence
atggccgccgagcccgtggaggacaactgcatcaacttcgtggccatgaaatttatcgataacaccctatatttcatcgcagaagacgacgagaacctggaatccgactacttcggaaagctcgaatccaagctctccgtgattcgaaatctgaacgatcaagtgctgttcattgatcagggcaatcgaccactgtttgaggacatgaccgactctgattgcagggataacgccccacgaaccatattcattatctcgatgtataaagattcacagccacgaggcatggccgtaaccatatcggtcaaatgcgaaaagatatctacattatcctgcgaaaataaaattatcagcttcaaggaaatgaatccccccgataatattaaagatacgaaatctgacatcatcttcttccagcggtcggtccctgggcatgataacaaaatgcaattcgagagttcgtcttacgaaggctacttcctcgcctgtgaaaaagaacgagatcttttcaagctgattttaaagaaggaagatgaactaggcgatcgcagtatcatgttcactgtgcagaatgaggattag

SEQ ID NO: 24647 - DNA, 570 bp, Artificial Sequence
  Description of Artificial Sequence: Synthetic coding sequence
atggccgccgagcccgtggaggacaactgcatcaacttcgtggccatgaagttcatcgacaacactctctacttcatcgagaatcttgaatcagactatttcggcaagctggaatcaaaactatctgttattcggaatctcaacgatcaggtgctgtttatcgaccaaggcaatcgccccctctttgaggacatgaccgatagcgactgtcgggataatgccccccgaaccattttcatcatcagtatgtacaaggattcacagcctaggggaatggctgtgacaatcagcgtaaagtgcgaaaagattagcacacttagttgcgagaataagattatatcattcaaggagatgaatccccctgacaacattaaggacactaagtctgacataatctttttccagaggagcgtccctgggcatgacaacaagatgcagtttgagtctagctcatatgagggttatttcttggcttgcgagaaggaacgcgatcttttcaagctgattctcaagaaggaagatgagttgggggaccgctctattatgttcacagtgcaaaatgaagattag

SEQ ID NO: 24648 - DNA, 582 bp, Artificial Sequence
  Description of Artificial Sequence: Synthetic coding sequence
atggccgccgagcccgtggaggacaactgcatcaacttcgtggccatgaagtttatcgataataccctatacttcatcgcagaggatgacgagaacctcgagtctgactactttggaaaattagagagcaagctcagcgtgatccggaatctgaacgaccaggttctgttcatagatcagggaaaccggcccttattcgaagacatgactgactccgactgtcgggacaatgcaccgcgcacaatattcataatttcaatgtacaaggattctcagcccaggggcatggctgtgactatctctgtcaagtgcgagaaaatttccacactgtcctgtgagaataagattatctcatttaaggaaatgaaccctccagataatatcaaagatactaaatcagacatcatattctttcagcgttccgttccaggacacgacaacaagatgcagttcgagtcatcaagctatgagggctattttctggcttgcgagaaagagagagatttgtttaagctaatcctaaaaaaagaagacgagctaggggatcgatctattatgttcacagtacagaatgaagattag

SEQ ID NO: 24649 - DNA, 1782 bp, Artificial Sequence
  Description of Artificial Sequence: Synthetic coding sequence
atggagaccccccccctgccccccgcctgcaccaagcagggccaccagaaaccgctagactctaaggacgacaatacagagaagcactgcccagtgacagtcaatccctggcacatgaaaaaagcatttaaggtaatgaacgaactccggtcacagaatctgctgtgtgatgtaacaatcgtggccgaagatatggagatatctgctcaccgtgttgtcctagcagcctgttctccgtacttccatgcaatgtttaccggtgagatgagcgaatcacgggcgaagcgcgttcggatcaaagaggttgacggatggactttgagaatgttaatcgactacgtgtacacagccgagattcaagtaaccgaagagaacgtgcaggtgttgctgcctgcagccggtctgctccaactccaggatgtcaaaaaaacgtgctgcgaattcctggaaagccaacttcatcccgtgaactgtctaggaatccgggcatttgccgacatgcatgcctgcaccgatttactgaataaagccaacacctacgcagagcagcactttgccgacgtggtactgtctgaagagttccttaatctgggcatcgagcaagtgtgttcgttgataagctcagacaagctgaccatctcatccgaagagaaagtgtttgaggcagtcatagcttgggtgaatcacgacaaggacgttaggcaggagtttatggccagactcatggaacacgtgcgtctgcctctcctgccccgggagtacctggttcagagggtggaagaggaagccctggtcaaaaactcttcagcatgtaaggattacctgattgaggccatgaaatatcatcttctgcctaccgaacagcgaatactcatgaaaagtgtacgtactcgcctccgcactcctatgaatttgccaaagttaatggtggtcgtgggcgggcaggctccgaaagccattagatctgttgagtgttatgattttaaggaagaacgctggcaccaggtcgccgaactgccaagccgaagatgtagggcaggaatggtgtacatggccgggctggtattcgctgtgggtggattcaacggatctctgcgcgtgaggaccgtcgactcttatgatccagtgaaagaccagtggacctccgtagctaacatgcgtgaccggaggagcactctcggcgctgcagtacttaatggactgctatacgcagtggggggctttgacgggtctacaggattgtcatctgtagaggcgtacaatattaagtcaaacgaatggttccatgtggcgcccatgaacactcggcgcagttccgtgggcgtgggggtagtggggggcctcttatacgcggtcggtgggtacgacggggcgtctcgacaatgtctttcaacggtggaatgttataacgcgacgacaaatgaatggacttacatcgcggaaatgtctacccgcaggtcgggagctggagtgggagtgctgaacaatctgctttatgcggttggagggcatgatggcccattggtgagaaagtccgttgaagtatatgacccaaccaccaatgcctggcgacaggtggccgacatgaacatgtgcagaaggaacgccggagtttgcgccgtgaacggtttactctacgtggtgggaggcgacgatggcagctgtaatctagcaagtgtcgaatattataatccaactaccgataaatggactgtggtctctagctgtatgtccactgggagaagttatgccggcgttactgtaattgacaaacccctctag

SEQ ID NO: 24650 - DNA, 1131 bp, Artificial Sequence
  Description of Artificial Sequence: Synthetic coding sequence
atgaaggagaacgtggccagcgccaccgtgttcaccctgctgctgttcctcaacacatgcctgctgaacggccaactcccaccaggcaaacctgagattttcaagtgccgatcccctaacaaggaaacgttcacatgctggtggcgccctggcacagacggcggactgccgacaaattattcactcacgtatcatcgcgagggcgagacactgatgcacgaatgtcctgattacatcaccggtggacctaatagttgccactttggcaagcagtacacctcaatgtggagaacctatataatgatggtcaacgccactaatcagatggggtcatctttttcggacgagctgtacgtggacgtgacttatattgtacagccggatccacccctagagctggccgtggaagttaagcagcccgaagaccgaaaaccgtacctttggataaaatggagtcccccgactctgatagacctgaaaaccggctggtttaccctgctctacgagattcggctcaagcccgagaaggctgccgaatgggagattcacttcgccgggcagcagactgagttcaaaattctcagccttcatccagggcagaaatacctggtccaagttaggtgtaagccggatcacgggtattggtcagcttggtcccccgccacttttattcagattccaagcgattttaccatgaacgacactacggtctggattagcgtcgctgtgctgagtgcagtgatctgcctgattattgtgtgggcagtggcgctaaagggctacagtatggtgacgtgcatctttcccccagtgccgggtcccaagattaaaggctttgatgctcatttgctggagaagggtaagtcagaggaactgctttcagccctgggatgccaagactttccaccaacctcagactacgaagacctgctggtcgaatatctggaagttgatgacagtgaagaccagcacctgatgtctgtgcattcaaaggagcatccatcacagggggatcccctgatgctgggtgcctcgcattacaagaacctgaagtcctacaggcctcggaaaatttcctcccagggcagactggcggtgttcaccaaggctactcttactaccgtccagtag

SEQ ID NO: 24651 - DNA, 414 bp, Artificial Sequence
  Description of Artificial Sequence: Synthetic coding sequence
atgggcctgaccagccagctgctgccccccctgttcttcctgctggcttgcgccgggaattttgtgcacgggcataaatgcgatataacattacaagagatcatcaagaccttaaactcacttaccgaacaaaaaaatactaccgagaaggaaacattctgtcgcgctgccacagtactgaggcagttctactcacaccatgaaaaggacacccgctgtctgggcgctacagctcaacagttccacagacacaaacagctaatcagatttttgaagagactggatcgtaacctctggggattggccggcctcaattcttgcccagttaaggaagcaaaccagagtactctcgagaacttcctggaaaggctgaagaccatcatgagagagaagtacagcaaatgttcctcctag

SEQ ID NO: 24652 - DNA, 639 bp, Artificial Sequence
  Description of Artificial Sequence: Synthetic coding sequence
atgaacagcttcagcaccagcgccttcggccccgtggccttcagcctgggactcctactagttctgcctgcagcctttcctgccccggtcccgcccggggaagacagcaaagatgtggcagcacctcatagacagccgctgacttcgagtgaaagaatcgataaacagatacggtacattctcgacgggatctctgccctgcggaaagagacctgcaataagtcgaacatgtgtgagagcagcaaggaagccctggctgaaaataatctcaatttacccaagatggcagagaaggatggatgctttcagtcgggttttaatgaagagacctgcctggtcaagatcataaccggattgttagaattcgaggtgtatctggagtatcttcaaaaccggttcgaaagcagtgaggaacaagccagggccgtccagatgtccactaaagtgctgattcagttcctccaaaaaaaagccaagaatcttgatgcaattactacgccggatcctaccacaaacgctagtctgctcacaaagctgcaagcccaaaatcagtggcttcaggacatgacgacacacctgatactcaggtcatttaaagagtttctgcagtcatcgttgcgtgcactgcgccagatgtag

SEQ ID NO: 24653 - DNA, 369 bp, Artificial Sequence
  Description of Artificial Sequence: Synthetic coding sequence
atgtgcgagagcagcaaggaggccctggccgagaacaacctgaacctccctaaaatggcagagaaagatgggtgttttcaatccggctttaacgaggaaacctgcctggtcaaaattataactgggctcctggagtttgaggtatacctggaatacttacagaaccgcttcgagtcatcagaggagcaagcaagagctgtgcagatgagcaccaaggtccttattcaattcctgcagaaaaaagttggtgtgagcagtttcccccaactgggcgtgggcgaggaccgcctgaaagattcagtcctcgacaattcagggatgcagtgtcatttccaaaagagaaggctgcacgtgaacaagagagtttag

SEQ ID NO: 24654 - DNA, 639 bp, Artificial Sequence
  Description of Artificial Sequence: Synthetic coding sequence
atgaacagcttcagcaccagcgccttcggccccgtggccttcagcctggggctgctgttagtcctgccagcggcatttccggccccggtgcctccaggggaagactcaaaagacgtggcagcgcctcataggcagccgttgacaagctcagaacggatcgataagcagattaggtatatcctggatggcatctccgcccttcgtaaagaaacatgtaacaagtcaaacatgtgcgagtcctctaaagaggctctggcggaaaacaacttgaatcttccaaagatggccgagaaagacggatgcttccagagcgggttcaatgaggagacttgcctggtgaaaattattaccgggctattagagttcgaagtctatttagaatacctccagaaccgttttgagagcagtgaggagcaggccagggccgtgcagatgtctacaaaggttctcatccagtttttacagaagaaggccaagaacctggacgccattacaacaccggaccccactaccaatgcttcccttctgacaaaattgcaggctcagaatcaatggctccaggatatgactacgcacttaattctgaggagttttaaagaattcctgcagagctcccttagggcactgcgccagatgtag

SEQ ID NO: 24655 - DNA, 597 bp, Artificial Sequence
  Description of Artificial Sequence: Synthetic coding sequence
atgaacagcttcagcaccagcgccttcggccccgtggccttcagcttagggttgctcctggtcctgcctgcagcatttcctgcacccgtgccgcctggagaggactcgaaagacgtggctgctccccacagacagccactgacctcctccgagcgtattgataaacagatacggtatattctcgacggcatctctgccttgcggaaggagacttgtaataagtctaacatgtgtgagtcgtctaaggaggctttggctgagaacaacctaaatctgcccaagatggctgagaaagacggatgcttccaaagcggctttaacgaggagacctgcttggtgaagatcattactggccttttagaattcgaggtgtacctggaatacctacagaatcgatttgagtcatccgaggaacaggctcgggctgtccagatgagtaccaaggttctcatacagtttctgcagaagaaggttggagtgagctcattcccccagctcggcgttggtgaagaccgcctgaaggactctgtgttggacaacagtgggatgcaatgccacttccaaaaacggcggctgcatgtgaacaagcgcgtgtag

SEQ ID NO: 24656 - DNA, 759 bp, Artificial Sequence
  Description of Artificial Sequence: Synthetic coding sequence
atgaacagcttcagcaccagcaagtgccggaagagcctggccctggagttacctgccgctgtcgaaccatgcgtcagagagggctgtgtcgcccaaggaggccttgcgggggggcaacagcagcgccaggctccaagctgcgctgtctcctcccccctgaggagtctgccctcaggtaccggggcatttggccccgtcgcattttcactgggtctgctgctggtcctccctgccgccttccccgccccagtccctcccggcgaggattccaaagacgtggccgcaccgcataggcagcccctaacctcctccgagcgaatagacaaacagatacgatacattctggatgggattagtgcacttcggaaggagacctgtaacaaatctaatatgtgcgaatccagcaaagaggctctcgcggaaaacaatttgaacctcccgaagatggctgagaaggatggttgtttccagtccgggtttaacgaagaaacctgtcttgtaaaaattataacaggactgctggagtttgaagtctacttggaatatctgcagaaccgcttcgagagtagtgaggaacaggcgcgggctgttcagatgagcactaaggtactcattcagtttctgcagaagaaagtgggagtgagctcttttccccagctcggcgtcggagaagataggttaaaggattctgtgctggataactctggcatgcagtgtcattttcagaaaagacgtcttcacgtgaacaaaagagtgtag

SEQ ID NO: 24657 - DNA, 459 bp, Artificial Sequence
  Description of Artificial Sequence: Synthetic coding sequence
atgaacagcttcagcaccagcgccttcggccccgtggccttcagcctcggcttactgctggtcctgccagccgctttccccgcccctgtgcctccaggcgaggactcgaaggacgtagctgcaccacatagacagcccttgacttcttcggaacgcatcgataagcaaattagatatatcctcgatggcatatccgctcttaggaaggaaacctgcaataagtccaacatgtgcgagagttcaaaagaggcgctcgcagaaaacaatctcaacctccccaaaatggctgagaaggacggctgtttccagtccggctttaacgaagaaacctgcttggtcaagataataacaggactgctagagtttgaggtgtaccttgaatatctccaaaataggttcgaatcctccgaagagcaggcccgagccgtgcagatgtccaccaaggttctcattcagtag

SEQ ID NO: 24658 - DNA, 300 bp, Artificial Sequence
  Description of Artificial Sequence: Synthetic coding sequence
atgaccagcaagctggccgtggccctgctggccgccttcctgatctctgctgccttgtgtgaaggcgctgtccttccccgctctgctaaggaactgcgttgccaatgcattaagacatacagcaagccctttcacccaaaattcatcaaagagctgagagtaattgagtctggcccccactgcgccaacaccgagattatcgtaaagctgtccgatggaagagagctctgccttgatccaaaggagaattgggttcagagggtcgttgagaagtttctcaaacgagccgagaattcatag

SEQ ID NO: 24659 - DNA, 2139 bp, Artificial Sequence
  Description of Artificial Sequence: Synthetic coding sequence
atggccggcggccccggccccggcgagcccgccgcccccggcgcccagcacttcttatacgaggtccctccctgggttatgtgcaggttttacaaggtaatggacgccctcgagccagcagattggtgccagttcgcagcgctgatcgtccgagaccagacagagctacgcttatgtgagcgctccgggcagcgaacagcctccgtgctctggccctggatcaatcgcaacgccagggtcgctgaccttgtccacattctgactcacctgcagctgcttcgggcaagagatataattacggcttggcatccgcctgcacctttaccctcccccggcaccactgccccgcggcctagtagtattccagcacccgcagaagcagaggcttggagtcccaggaaattaccctcatccgcgagtacttttctttcccccgcctttccaggatcccaaacccattcaggccccgagctgggtttagtcccctcacccgcgtcactgtggcctcctccaccgagtccagccccttccagtacaaaaccaggtccagagtcctccgtttccttgttacagggagctaggcccttcccattctgttggccactctgcgagatctctaggggcacccataacttttccgaagagttgaaaattggagagggagggttcggttgtgtgtacagggccgtcatgcgcaatacggtgtatgcagtgaaaaggttgaaagaaaatgccgaccttgaatggacagccgttaaacagagctttttaacagaagtggagcaactaagccgctttcggcatcccaacattgtcgactttgctggctactgcgcacagaatggcttctattgtctggtatacgggttcctacctaatggatccctagaagatcggctccactgccagacacaggcctgtccacccctgagttggccccaacgcttggatatcttgctaggaaccgcaagggccatccagtttctgcaccaggacagtccttctctgatccatggcgacattaagagctctaatgttctcctggacgagcgactgaccccaaagctaggagatttcggcctcgccagatttagccgctttgccggctcctctccgtcgcagagcagcatggtggcccgcacccaaaccgtcaggggaacactggcctatctgccagaagaatatatcaagacaggcaggctcgcagtcgacacagacacatttagctttggcgtggtcgtcctggagaccctcgccgggcagcgcgccgttaaaactcacggcgcccgcacaaaatatctcaaagatctagtggaagaggaggctgaggaggccggagttgccctgcgttccacccagagcactctacaggctggcctagccgctgatgcatgggccgccccaattgcaatgcagatttacaaaaagcatctggatcccaggcccggaccctgtccacccgagctgggactgggacttgggcagctggcgtgttgttgtttacaccgtcgggccaaacgaagaccgcccatgacacaggtctacgagcggctggaaaaactgcaggccgtcgttgccggcgtgcctggacattccgaagccgcaagttgcattcctccgtctccacaagaaaattcatacgtaagctctactggcagggcacactctggcgcagctccctggcagcctttagctgcaccgtcgggggctagcgctcaagcagcggagcagttacagaggggacccaaccagccggtggagtctgatgagtcactgggcggcctcagtgccgccctcagatcttggcatctaactccctcttgccccttggatcccgccccgctgcgggaggctggctgcccacagggtgacacggccggggagtcctcctggggcagcggtcccgggtcccgccccaccgctgtcgaggggcttgctttgggctcctctgctagctcaagctccgagcccccccagataattattaacccagcaaggcagaaaatggtgcagaagctggctctgtatgaggacggtgccctggattctctccaactgctgtctagttcaagccttccaggactcgggttagaacaggatagacagggtcccgaagagagcgacgagtttcagtcatag

SEQ ID NO: 24660 - DNA, 2082 bp, Artificial Sequence
  Description of Artificial Sequence: Synthetic coding sequence
atggccggcggccccggccccggcgagcccgccgcccccggcgcccaacacttcctctatgaagtgcccccttgggtcatgtgtcgcttctacaaagtcatggacgccttagagcccgccgactggtgccagtttggcggctggcggagagctgccggcgggcgagaagccaggggcctgctcgcacctacccccgacgccccacgacccgcagctgctcttatcgtgagagaccaaactgagctgagattatgcgaacggtccggccagaggactgccagtgttctctggccctggataaacaggaacgcaagggtggctgatctggtgcacatcctcacacacctccagctgctgcgggctcgggatatcataacggcctggcatccacctgccccactgcccagcccgggtacaactgcccctaggccatccagtatacctgcgccagcggaggccgaagcgtggtccccccgtaagctgcctagtagtgccagcacttttctgtccccagccttccctggaagccagacccatagtggacctgaactgggcttggtaccttctccagccagcctgtggccacccccaccatctcccgccccgtcaagcaccaagcctggtcccgagagctccgtgtctctccttcaaggggctagaccattccccttctgttggccgctctgtgagatctccaggggaacacataatttttccgaagaactgaaaatcggcgaaggcgggttcggctgcgtttaccgcgcagttatgcggaacacagtctacgcagtaaagaggctgaaagaaaatgctgacctagagtggaccgctgtgaaacagtcgttccttacagaggttgagcagctctccagatttcggcatccaaacatcgtagacttcgcagggtactgcgcccagaatgggttttattgtctggtgtacgggttcctgcctaatggctctttagaggaccggcttcactgtcagactcaagcttgccccccgctctcttggccgcagcgcctggacatcctactcgggactgcccgggcaatacagtttctgcaccaggactcgccatccctgatccacggtgacattaagtcctccaacgtccttctggacgaacgactgaccccaaaactcggcgatttcggtctagcacgtttcagccgatttgctgggagctcaccgtcccagtccagtatggtggccaggactcaaacggttcggggcacactggcctacctcccagaggagtacatcaagaccggaagactggccgtggataccgatacattctcatttggggtggtcgtgctagaaacccttgccgggcagagggctgttaagacacatggggctaggaccaagtatctgaaggatctagtagaagaggaggcagaggaagctggcgtggctcttagatccacccagtccacactccaggcgggtctggccgccgacgcctgggccgcacctatcgcaatgcagatctacaaaaaacatctaggacagctggcctgctgttgtcttcacagaagagccaagaggcgacctcccatgacccaggagaactcgtacgtgtcctccactggacgggcccattctggcgccgccccctggcaaccccttgccgccccctcaggtgcatccgcgcaagctgcggagcagctccaaagaggccccaaccaaccggtcgaaagcgatgaatccttgggagggctgtccgcagctttgcgcagttggcacttgacgcctagttgccccctcgaccctgccccgctccgcgaagccggctgcccccagggggacacagccggagagtccagttggggatccggcccaggcagcagacccaccgctgtggagggtctcgcgctcggatcttccgctagcagctcttctgaacccccccagattattatcaatccagcacggcaaaaaatggtacagaagctggcgttatacgaagatggtgccctggattctttacaactcctgtcgtcaagtagcctgcctgggctgggtttggagcaagatagacagggacccgaagagtcggacgagttccagtcctag

SEQ ID NO: 24661 - DNA, 2049 bp, Artificial Sequence
  Description of Artificial Sequence: Synthetic coding sequence
atggccggcggccccggccccggcgagcccgccgcccccggcgcccagcactttctctacgaggtgccaccttgggtcatgtgcaggttttacaaagtcatggacgcactagaaccggctgattggtgtcagtttgctgcactcatcgtgagagaccaaacagagctgaggctctgcgagcgatcgggacagaggactgcaagcgttctttggccctggattaataggaacgctagagtcgccgatcttgttcacattcttacacacctccaattgctcagagcccgtgacattatcactgcctggcatccccccgcacctctgccatctcccgggactaccgctccacggcctagctctatccctgctcctgctgaggcagaggcttggtctcctaggaagcttcccagctcagcctctacatttctttcccctgcctttcctggctctcagacacactcaggaccggagcttggcctcgtgcccagtccagctagtctttggcccccgccaccttctcccgccccgtcatctactaaacctggccccgagagttcagtgtccctgctacagggagcacggccctttccattttgttggccattatgtgagatcagccgaggcacacacaatttctctgaagagctaaaaattggggaagggggattcggctgtgtatatcgagccgtgatgaggaacaccgtatatgcagtgaagaggctcaaagagaacgctgatctcgaatggaccgctgttaaacaatccttcctgacagaggttgaacaactgtcaagattccgccaccccaatattgtggacttcgctggatattgtgcgcaaaacggcttctattgtctcgtgtacgggttccttccaaacgggagcctagaggaccggctgcattgtcagacacaagcctgccctcctctgagctggccacaaaggctggacattctcctcgggaccgctcgcgcgattcagttcctgcaccaggattccccatctctgatccatggcgatatcaagagttcaaacgtgctactggacgaacgactgacccccaagctcggagactttggactggccagattttcacgcttcgctggcagttcaccttcgcaatccagcatggtggcaagaacacagacagttcgaggaaccttagcttatttgccagaggaatacattaagaccggaaggctggcagttgatactgacaccttcagcttcggcgttgtggtgctggagactcttgctggccagagggccgtcaaaacccacggggccaggactaagtacttgaaagatctggtcgaagaggaggccgaggaggccggagtggctctgagatcaacgcaatccaccctgcaggctggactggctgccgacgcttgggctgcaccgatcgccatgcagatatataaaaagcacttggacccccggccaggcccctgccctcccgaactaggcctcggcttaggtcagctagcttgttgctgtctccaccggcgagccaagaggcggcccccaatgacccaggagaacagttacgtgagttcaacagggcgcgcgcattccggagctgccccctggcagcctctggctgccccatctggagcgtccgctcaggccgcggagcagcttcagcgagggccaaatcagcctgtggagtcagacgagagtctcggtggtctcagcgcagcgctgcgcagctggcacttaacaccctcttgtcctcttgatcccgcacctctgagggaggccggctgtccacagggggacacagccggcgagtcatcttggggctccggccccggaagccgcccgactgccgtagaaggtctggctctgggaagctccgcttcctcgtcgagtgagccgccgcagatcatcataaacccagctcgacaaaaaatggtacaaaaacttgccctgtatgaggacggcgccttggactcgctgcaactgctaagcagcagctccttgcctgggcttgggctcgaacaagatcgccaggggccagaagagtccgatgagtttcagtcctag

SEQ ID NO: 24662 - DNA, 2127 bp, Artificial Sequence
  Description of Artificial Sequence: Synthetic coding sequence
atggccggcggccccggccccggcgagcccgccgcccccggcgcccaacatttcctttatgaggtaccaccttgggtgatgtgccgcttctacaaggtcatggacgccctggaaccagctgattggtgccaattcggcgggtggcggagagcggccggaggaagagaggctcggggtttactagcacctaccccggatgctcctaggcccgcagccgccttgatcgtgagggatcaaacagaactccgattgtgcgaaagatcaggacagcggaccgccagcgtgttgtggccctggatcaaccgaaatgccagagtcgctgatcttgtccacattctcacccatctccagctactgagggcgcgcgacattattacggcatggcacccaccagcacccctgccctcccccgggacgaccgctcctagaccatcttctatcccagcccccgccgaggccgaagcttggtctccccggaagctgccaagtagcgcgagcacctttctctcaccggccttccccggatctcagacacattctggccctgagcttgggcttgtgccctcaccagcctccctgtggcctcctccccctagcccagcaccttcctccactaagcccggacctgagtctagcgtgagcctgctccagggggccaggccctttcccttttgctggccactatgtgagatatcgcggggaacacataacttcagtgaggagctaaagattggcgaaggagggttcgggtgcgtgtatcgagctgttatgagaaacactgtgtacgccgtcaagaggctgaaggagaatgccgacctggaatggaccgccgtcaagcagtctttcctgacggaggtggaacagctgagcagatttcggcacccaaacattgttgattttgcgggttactgcgcacagaacgggttttactgcttggtgtacggatttctgcccaacggttcacttgaagacaggttgcattgtcagactcaggcttgtccccccctatcatggccccaacggctggacatattactgggcaccgcaagggccatacagtttctacaccaggactccccaagcctgatccatggtgatattaagtcctccaatgtgctgctggacgaaaggctgacacccaaacttggcgattttgggctggcacgattctcaaggttcgctggctcttctccctcgcaaagctccatggtcgcccgtacccagacagtgaggggcacccttgcttaccttcctgaagagtacattaagaccggaagactcgctgtcgatacagatacattttcgtttggcgttgttgtcctggaaacactagcaggacaaagggctgtgaagacgcacggagcgcggaccaaatatttaaaagacctggtggaggaagaggccgaagaagctggcgtcgccctgaggtctactcaatctacactccaggccggcttagcggccgacgcttgggccgctcctattgctatgcagatctataaaaagcatctagatcccagacctggaccctgcccccccgagctgggtttgggcttggggcaactggcctgttgctgcctgcatcggagggccaagcggagacctcctatgacccaggaaaacagttacgtctcatcaaccgggcgggctcactccggtgccgctccttggcagcctctcgccgccccatccggcgcctcggcccaggctgcagaacagttgcagaggggccccaaccagcctgtggaaagtgacgagtccctggggggcctgtctgccgcccttcgatcttggcaccttacgccttcctgccccctggatccagcgcctctgagggaggctggatgcccgcaaggggatactgctggcgaatcttcttggggcagcggcccaggatccaggcctaccgccgtagaagggctcgctttgggcagcagcgcctcaagctcatccgaaccgccccagattatcatcaacccagcaaggcagaagatggtccaaaagctggctctatatgaggacggggccttggattctttgcagttactaagctcctctagcctcccgggcttgggcctcgaacaggacagacagggccccgaagaaagtgacgagtttcagtcctag

SEQ ID NO: 24663 - DNA, 1902 bp, Artificial Sequence
  Description of Artificial Sequence: Synthetic coding sequence
atggccggcggccccggccccggcgagcccgccgcccccggcgcccagcactttttgtatgaggttccgccttgggtgatgtgtagattttacaaggtcatggatgctctggagcccgccgactggtgccagttcgctgcactcattgtgcgggatcagaccgagctgagactgtgtgagcgctctggtcaacggacagcctccgtgctatggccctggatcaataggaacgctcgggtggccgatctggtgcacatacttactcacctgcagctcctgcgcgctcgagatataataacagcgtggcaccctcccgcaccattaccctcacctggtaccactgctcccagaccatcgagcattccggctccagccgaagcagaggcttggtcacctcgaaagttgcccagtagtgcgtccactttcttgagcccagcttttccaggctcacagacccattctggccccgagctgggattagtgccaagtccagcatctctctggccgccccccccttctcctgccccgagttctaccaagcctggccctgagtcctccgtgagcctgctgcagggggcccggccttttcccttttgctggccactctgcgagatctccaggggaacacataactttagtgaggaacttaagattggtgagggtggcttcggttgtgtgtaccgggctgtaatgcggaacacggtctacgcggtcaagcgactcaaagagaacgctgatctggagtggactgccgtgaaacagtcatttctgactgaggttgaacagctcagcaggtttcgtcatccaaatatagtggattttgccggatactgcgcacagaacggattctattgcctggtgtatggattcctgccaaacggatccctcgaggatcggctgcactgtcagacacaggcctgtccaccactttcctggcctcaacggctcgacatcctcctaggtactgcacgtgcaattcagtttttgcatcaagattcccctagcctaattcacggcgacatcaagagctctaatgtgttgttggatgagcgcctaacccctaaactgggagacttcggtctcgccaggttttcccgattcgctggctccagcccctctcagtccagcatggtggcacgcacccagacagtcagaggtaccctggcatatcttccggaggagtatattaagactggaaggttagcggtcgacacagataccttcagctttggggtcgtcgtgctcgaaacactagcagggcagagagctgtgaaaactcacggcgcccgcaccaagtatctggtctatgaacggttggaaaagctacaggccgtcgttgctggcgtgcccgggcatagtgaagctgccagctgtatccccccatcaccacaagaaaactcatatgtctcaagtacagggagagcccacagtggggccgcgccatggcaaccattagctgcaccctcgggagcctccgcacaggccgcggaacaattgcagcgaggccctaaccaacctgtcgagtcagacgaatctttaggaggtctgtcagcagctctcagaagctggcatctgacgccaagctgtcccctggatcctgcaccacttcgggaagcaggctgccctcaaggagatacagcaggagagtcaagttggggatccggccctgggtccaggccaactgcggtagaaggactcgctctcggaagctcagcatcctcaagctccgagccaccccagattataatcaacccggccagacaaaagatggtgcagaagctggccctgtatgaagatggagctttggatagcctccaactgctgagcagcagctctcttccaggactgggcctcgaacaggatcgccaggggcctgaagagtccgatgaatttcagtcttag

SEQ ID NO: 24664 - DNA, 1245 bp, Artificial Sequence
  Description of Artificial Sequence: Synthetic coding sequence
atgagcaagaagatcagcggcggcagcgtggtggagatgcagggcgacgagatgaccagaattatctgggaacttatcaaagagaaactcatattcccttacgtagagcttgacttacacagctatgacttgggaattgagaatcgtgatgccacaaatgaccaagtgacaaaagacgccgcggaggcaataaaaaagcacaacgtgggagtcaagtgtgccacgatcactcccgacgaaaagagggtagaggagttcaaacttaaacaaatgtggaagagcccaaatggaacaataagaaacatccttggcggtacagttttccgcgaggcgataatctgtaaaaacatcccgaggcttgtttctggatgggtgaagcctatcattatagggagacatgcgtatggtgatcagtacagagcaacagacttcgtggtaccagggccgggcaaggttgaaataacctatacaccctcagatggtacccaaaaagtgacatatcttgtgcacaatttcgaagagggcggcggtgtggctatgggcatgtacaaccaggataagtctatcgaggactttgcccacagctctttccagatggctctctctaaagggtggcctctgtacctgtcaaccaagaacacgatactgaagaagtacgacggcagatttaaagatatcttccaagaaatctacgacaagcagtataagagccagtttgaggcacaaaagatttggtacgaacatcggttaatcgacgacatggtggcacaggccatgaaaagcgagggaggattcatttgggcctgcaaaaattacgacggagacgtgcagagcgatagcgttgctcagggctacggctcgctgggaatgatgacatccgtcttggtttgtcccgacggcaaaacggtagaggcagaagctgcccatggtaccgtgacacggcattaccggatgtaccagaagggacaggaaactagcactaacccaattgcctctatctttgcttggacaaggggactggcacatcgggccaagctagataacaataaggaactggcgttttttgcaaatgcactggaggaggtttcaattgagacgattgaggccgggtttatgactaaggacttagcagcctgtatcaaaggtctgcctaatgtacagaggtccgactacctgaatacattcgaattcatggacaagctcggggagaatctcaaaatcaaactggcccaggctaagctgtag

SEQ ID NO: 24665 - DNA, 474 bp, Artificial Sequence
  Description of Artificial Sequence: Synthetic coding sequence
atgagcaagaagatcagcggcggcagcgtggtggagatgcagggcgacgagatgacacgcataatctgggagttaataaaggaaaagctgattttcccttatgtggaactcgacctgcacagctacgatttgggaatcgagaatcgagatgcaaccaatgatcaagtgaccaaggacgcggcagaagcaatcaaaaaacacaacgttggggtgaagtgtgctaccataacaccggacgagaagagggtggaggagttcaagttgaaacaaatgtggaagagccccaacggcaccatccgcaacattcttggcggtaccgtgtttcgtgaggccattatttgtaagaatatccctaggctggtctccggatgggttaagcccataattatcggccgtcacgcctacggtgatcagtacagggcaactgactttgtggtgccaggtccgggaaaggttgagattacctatacttag

SEQ ID NO: 24666 - DNA, 1245 bp, Artificial Sequence
  Description of Artificial Sequence: Synthetic coding sequence
atgagcaagaagatcagcggcggcagcgtggtggagatgcagggcgacgagatgacaaggattatttgggagttaattaaagaaaaactgatatttccgtacgttgaactagacctacactcatatgacctgggcattgagaatcgcgacgcgaccaacgaccaggtaaccaaggacgcagctgaggctattaagaaacacaacgtcggcgtgaagtgcgccactattactcctgacgagaaacgggtagaggagtttaaactgaagcaaatgtggaagtctccaaacgggaccatcagaaatattctggggggaacggtgttccgggaagccatcatttgtaaaaacatcccaagattggtgagtggatgggtgaaacctatcatcattggtcgacacgcctatggcgatcaatatagagcaacagattttgttgttccaggcccaggcaaggttgaaatcacatacacgccaagcgacgggacgcagaaagtcacttacctcgtgcataactttgaggagggagggggggttgctatgggcatgtataaccaggataagtctatcgaagacttcgcccacagtagcttccagatggccctctcaaagggatggccattgtaccttagtactaagaacaccatcctcaaaaagtatgacgggcgttttaaggatattttccaggaaatttacgacaagcaatacaagtcccagtttgaggcgcagaagatctggtatgagcatcgtctgattgatgatatggtcgcccaagccatgaaatctgagggcggatttatatgggcatgtaagaactatgacggcgatgtgcagtctgatagcgtggctcaagggtatggatccctgggcatgatgaccagtgtgctcgtatgcccagacggaaagaccgtcgaagcagaagccgctcacgggaccgtcacgaggcattacaggatgtaccagaaagggcaggaaacttctaccaaccctatagcaagtattttcgcttggacacgcggactggcccatagagctaagctcgacaataacaaggagctggcattctttgccaatgccctcgaggaagtcagtatagagactatcgaggccggttttatgacaaaagatctcgctgcctgcatcaaaggcctgcctaatgtacagagatccgactatctgaatacttttgagttcatggataaactgggggagaaccttaaaataaagctggcccaagcaaaattatag

SEQ ID NO: 24667 - DNA, 225 bp, Artificial Sequence
  Description of Artificial Sequence: Synthetic coding sequence
atgagcaagaagatcagcggcggcagcgtggtggagatgcagggcgacgaaatgacacggattatctgggaactaatcaaagaaaagctgatattcccgtacgtcgaactcgatctacactcatacgatcttgggatagagaatcgggacgctaccaacgaccaggttactaaagatgctgccgaagcgatcaagaaacataacgtcggagtcaagtgtgcttag

SEQ ID NO: 24668 - DNA, 1245 bp, Artificial Sequence
  Description of Artificial Sequence: Synthetic coding sequence
atgagcaagaagatcagcggcggcagcgtggtggagatgcagggcgatgaaatgacaaggatcatctgggaactaataaaggaaaaactgatctttccttacgtggagttggacctgcatagctacgacctcggaattgagaaccgggatgccaccaatgatcaggtgacgaaggacgctgctgaagcaatcaaaaagcataacgttggagtgaagtgcgccaccattacacctgacgagaagcgcgtagaggaatttaaacttaagcagatgtggaaaagtcctaacggaacaatacgtaacatcttgggcgggaccgtctttcgtgaagctattatatgtaagaacataccccgactggttagcggatgggtcaagccgataatcatcggaagacacgcctacggcgatcagtatcgcgcgacagacttcgtggtccctggacccggcaaggtggaaattacttataccccctccgatggtactcagaaggtcacgtaccttgttcataatttcgaggaaggtgggggcgtagcgatgggtatgtataatcaggacaagtccatcgaggacttcgctcatagctcttttcagatggcattaagtaagggctggccactgtacctgtcgacaaaaaacactatactgaaaaagtatgacggacgttttaaggatatctttcaggagatatatgacaagcaatacaagtctcagttcgaagcccagaaaatttggtacgagcaccggcttatagacgatatggtggcccaggccatgaagagcgaaggcggattcatttgggcttgcaagaattacgacggagacgtgcagtccgattccgtggcacagggatacggctcactcggaatgatgactagtgtcctggtctgcccagacgggaagactgtagaagccgaggcagctcatggaactgtgacaagacattatagaatgtaccagaagggccaggagacttcaaccaatcctattgcttcgattttcgcctggactaggggattggctcaccgggccaaactggacaataacaaagaactggccttttttgcaaatgcacttgaggaagtgtcaatcgaaacaatcgaagcaggattcatgacaaaagacctggcagcttgcatcaaaggcctcccaaatgtgcagagaagcgactacttaaacacttttgaattcatggataagctgggagagaacctgaaaattaagctagcacaggccaagctttag

SEQ ID NO: 24669 - DNA, 189 bp, Artificial Sequence
  Description of Artificial Sequence: Synthetic coding sequence
atgagcaagaagatcagcggcggcagcgtggtggagatgcagggcgacgaaatgactagaattatctgggaacttattaaggagaagctgatctttccttacgtcgagctagacctgcacagctatgacttgggcatcgagaacagagatgccaccaacgatcaggtaacaaaagatgcagccgaatag

SEQ ID NO: 24670 - DNA, 1359 bp, Artificial Sequence
  Description of Artificial Sequence: Synthetic coding sequence
atggccggctacctgcgggtggtgcggagcctgtgccgggccagcggaagccggccagcctgggcccccgctgcactaaccgcaccaacaagtcaggagcaacctcgaagacactatgcggataaaagaatcaaagtcgccaagccagtggtggagatggatggcgatgagatgacgagaatcatttggcagttcatcaaggagaagttaatactgcctcacgttgacattcagctgaaatatttcgacctcggcctgccaaatcgtgaccagaccgatgaccaagtaacaatcgattcagcgctggccacgcagaaatactcagtcgccgtgaagtgcgcaaccattaccccagatgaagcacgggttgaagagtttaaattaaagaaaatgtggaaatcacccaacggaaccattcgcaatatactcggcggaaccgtgttcagggagcctatcatctgcaagaacattccacgccttgtccctggatggactaagccaatcactatcgggcgccacgcacacggtgaccaatacaaagccaccgacttcgtagcggatagggctggcactttcaaaatggtgttcacaccaaaagacgggtcaggtgtcaaagagtgggaggtttataacttccccgccggcggcgttgggatgggcatgtataacactgacgagtccatctctggattcgcccattcttgttttcaatacgcaatccagaagaaatggccactgtacatgtctacgaagaataccatcctgaaagcatacgatggccggttcaaggacatcttccaggagatctttgataaacactataagacggactttgataagaacaagatctggtatgaacaccggttaatcgacgatatggtggctcaggttctgaaatcctctggcggcttcgtttgggcttgcaagaattacgacggggacgtccaatccgatattctcgcccaggggtttggctcacttggcctgatgacaagtgtcttagtgtgccctgacggcaaaaccattgaagctgaggctgcccacggaactgtcactagacactatcgtgaacaccaaaagggtcgccctacttccacgaatcccatagctagtatttttgcctggacccgcggattggagcacagaggcaaacttgatgggaatcaggatctgatcagatttgcacagatgctggaaaaagtttgcgtcgaaacagtcgagagtggagccatgaccaaggatctggctggctgcatccacggcctttccaacgtcaagttaaacgaacactttctgaatacaactgactttctagataccattaaatcaaatctggaccgagcgttggggcgccagtag

SEQ ID NO: 24671 - DNA, 969 bp, Artificial Sequence
  Description of Artificial Sequence: Synthetic coding sequence
atgtggaagagccccaacggcaccatccggaacatcctgggcggcaccgtgtttcgggagccaatcatctgcaaaaacatcccacgcctggtgcccggctggactaagcctatcacaataggcaggcacgctcacggggatcaatataaagccaccgattttgtagctgatagagccggaacttttaaaatggtgttcacccccaaagacggctctggcgtaaaggaatgggaggtgtacaatttccctgccgggggcgtgggcatgggaatgtataatacagacgagagtatctcagggtttgctcactcctgttttcagtacgctatccaaaagaaatggcctctttacatgtctactaagaacaccatcctcaaggcctacgatgggcgcttcaaagatatctttcaggagatttttgataaacattacaaaacagacttcgacaagaacaagatttggtacgagcaccggctcatagatgacatggttgctcaggtgctcaaatctagcggaggctttgtgtgggcctgcaagaactacgacggtgatgtccagtccgacatcttggcacaggggtttggaagcctcggcctgatgacctctgtgttagtgtgtcccgatggtaagacaatcgaggccgaagcagcccacgggaccgtgactcgccactatagagaacaccagaagggcagacccacttctaccaacccaattgcgagcatttttgcttggaccagaggcctggaacatcggggtaagctcgatggtaaccaggacctgataaggtttgcgcagatgcttgagaaagtttgtgtcgagaccgtggagagcggagccatgacaaaggaccttgccggctgcatccacgggctgagcaacgttaaattaaatgagcactttctaaacactaccgatttcctggacacaatcaagtcaaatctcgaccgtgctcttgggcgtcagtag

SEQ ID NO: 24672 - DNA, 1203 bp, Artificial Sequence
  Description of Artificial Sequence: Synthetic coding sequence
atggacggcgacgagatgacccggatcatctggcagttcatcaaggaaaagttgattctccctcacgtagatattcagttgaagtatttcgacttgggtctgcccaatcgagatcagacagatgaccaggtaaccatcgactcagctctggctacacagaagtactcggtggcagtgaagtgcgccacaattacaccggatgaagccagggtggaagaattcaagctgaaaaagatgtggaaatctcccaacgggacaattaggaacatcttaggcgggacggtctttcgggaaccgataatttgtaaaaacattcccagattggtgcccggttggactaaacccattaccataggccgccacgcacacggggaccagtacaaagctaccgatttcgtcgccgacagggcgggtacttttaaaatggtttttacacccaaagacgggagtggtgtcaaagaatgggaagtctacaacttccctgcaggaggggtcggcatgggcatgtataatacagatgagtctatcagcggcttcgcccactcctgttttcaatacgctatacagaaaaaatggcctctctacatgtcgactaagaatactatcctgaaagcatacgacggcaggtttaaagatattttccaggaaatcttcgataagcactacaaaacagattttgataagaataaaatctggtatgagcaccgcctgatcgacgacatggtggcacaggtgctgaagtccagcggcgggttcgtctgggcttgtaagaactacgacggagacgtgcagagcgacattttagcacagggctttggctccctcggactcatgactagtgtccttgtgtgtcccgacgggaagaccatcgaagcagaagctgcccatgggactgtcactagacactacagggagcatcagaaagggagacctacctccaccaaccctattgcttcaatatttgcttggactcgcgggctggagcaccgaggaaagctcgatggcaaccaggacctgatccggtttgcccaaatgttggaaaaggtatgtgtcgagacagtggagagcggcgcaatgacaaaagacttagcagggtgtatccatggactatcaaatgtgaagttgaacgaacatttcttgaacacaaccgactttctggataccataaagtccaacctggatcgagccctgggacgacagtag

SEQ ID NO: 24673 - DNA, 3657 bp, Artificial Sequence
  Description of Artificial Sequence: Synthetic coding sequence
atgcggagcccccggacccggggccggagcggccggcccctgagcttactcctggcccttctgtgcgctcttcgagctaaggtatgcggtgccagtggccaattcgaactggagattctatcaatgcaaaacgtaaacggggaactgcagaacggcaactgctgtggcggagcacgaaacccaggagacaggaaatgtacacgcgacgaatgcgacacatactttaaggtgtgcctgaaggaatatcaatcccgggtgaccgccggcggcccttgttcatttggatccggttccactcctgtaatcggggggaatacctttaatttgaaagctagcaggggaaatgaccggaacaggattgtgctgcccttctcttttgcatggccccgcagctacaccttgcttgtggaggcttgggacagttcaaacgacactgtacagccggattcaatcatcgaaaaagctagccacagtggaatgatcaatccgagtcggcagtggcagaccctgaagcagaacacaggcgtggcccacttcgaataccagattcgcgtcacttgtgacgactattattatggatttggctgcaataaattctgccgtcccagagacgattttttcggacactatgcttgtgaccagaacggcaataaaacttgtatggaagggtggatgggccccgagtgtaaccgggccatctgccgacagggttgttcacctaaacatggtagttgtaagctaccaggtgactgccgttgccaatatggctggcagggcctttactgcgacaaatgtatcccgcaccccgggtgcgttcacggtatatgtaacgaaccatggcagtgtctctgcgagacaaactggggcgggcagctttgcgataaagacttgaattattgtggcactcatcaaccctgtttgaatgggggaacctgttctaacacaggacctgataagtaccagtgctcatgtcctgaggggtacagtggccccaactgcgagatagccgagcatgcatgtctgtctgacccatgccataatcgaggatcctgtaaagaaacctctctggggtttgagtgcgagtgttctcccggctggacaggtcccacttgctctaccaacatcgacgactgcagtcctaacaattgcagccatggtggcacatgtcaggacctggtcaatggatttaagtgcgtatgcccaccacagtggaccggcaagacttgccagctcgatgctaacgaatgtgaagccaagccttgtgtcaacgccaaaagttgtaaaaacctcattgcctcatactattgcgattgtctgccgggatggatgggtcagaattgcgatatcaatatcaatgactgtttgggacagtgtcagaatgacgcctcttgccgggacctggtgaacggttaccgatgtatttgtcctccaggctatgccggcgaccattgtgaacgagatatcgacgagtgcgccagtaacccttgcctgaatggtggacattgtcagaacgagattaacagatttcaatgcctgtgtcccaccgggtttagcggcaacctgtgtcaactcgacatcgattactgtgagccaaatccctgccagaatggagcacaatgctacaacagagcctccgactatttttgtaaatgtcctgaggactacgaaggaaagaactgttcccacctcaaggatcactgtcggacaacaccctgcgaagtgatcgatagctgcacggtggcaatggcaagcaacgatactccagaaggggtaagatatatatcctccaacgtgtgtgggccgcatggcaaatgcaagtcacaatctggcgggaagtttacctgcgattgcaataagggctttaccggaacttattgtcacgaaaacattaacgactgcgagtctaatccctgtagaaacggtggcacgtgcatcgatggggtgaacagctataagtgcatctgttctgatggatgggagggcgcctactgtgagacgaatattaacgactgttcccagaacccatgtcacaacgggggcacatgccgcgacctcgtgaatgacttttactgcgactgcaagaacgggtggaagggcaaaacctgccattcccgcgactcgcagtgcgacgaggcaacatgcaataacggcgggacttgttatgatgagggcgacgcatttaaatgcatgtgtccaggaggttgggaaggtactacctgcaacatagccagaaactcttcctgcctgcctaatccatgtcacaatggaggcacctgtgtggtgaacggagaatccttcacgtgtgtgtgtaaggaggggtgggagggccctatctgtgctcagaacactaatgattgcagcccgcacccgtgttataatagtggaacctgtgtggatggggacaattggtataggtgtgaatgtgcccctggtttcgctggccccgattgcagaatcaatattaacgagtgccagtcttccccgtgtgccttcggggccacttgcgtggatgagattaatgggtacagatgcgtctgcccaccagggcattcaggggcaaaatgccaggaggtttcaggtagaccgtgtatcactatggggagcgtcatcccagatggtgccaaatgggacgacgactgtaatacctgccaatgtctgaatggccgtatcgcttgcagtaaggtgtggtgtggacctagaccctgcctgctgcacaagggacacagcgagtgcccgagtgggcaaagctgcatcccaatcctcgatgatcagtgttttgttcatccttgcacaggcgtaggcgagtgtcggtcaagtagccttcagccagttaagaccaagtgtacaagcgacagttattaccaggataactgcgctaacataacttttacattcaataaagagatgatgtcgcctggactgacgactgaacacatttgctcggagctgcgcaatctgaatatactgaaaaacgtgagcgcagaatactctatctatattgcatgcgagccatccccctcagccaataacgagatccacgtggccatctcagccgaggatatcagagatgacggtaatccaataaaggagatcacagacaaaataatcgacctggttagcaagagggacggaaatagcagcctcatagcagccgtagcggaggtgagagttcagaggagaccgctaaaaaatcgaaccgattttctcgtgcccctcctcagctccgtgctaaccgtcgcctggatatgctgcctcgtgaccgccttctactggtgtcttcgtaaacggcggaagcccggtagtcacacacattccgcttctgaggacaacacaacgaacaatgtgagagagcagctgaaccaaattaagaaccccattgagaagcacggagctaacaccgtgcccatcaaggactatgaaaataagaattccaagatgagtaaaattcggacgcacaactccgaggtggaggaggacgacatggacaagcaccaacagaaggcccgctttgctaaacagcccgcctacaccctggtggatagggaggagaaaccgcctaacggcaccccaactaagcatccaaattggactaacaaacaggataacagagatctggagtctgctcagtctttgaataggatggagtacatcgtgtag

SEQ ID NO: 24674 - DNA, 3180 bp, Artificial Sequence
  Description of Artificial Sequence: Synthetic coding sequence
atgatcaaccccagccggcagtggcagaccctgaagcagaacaccggcgtcgcacacttcgagtatcagattagagttacatgtgatgattattactacggtttcggctgcaacaagttttgtcggccaagagatgatttcttcgggcattacgcatgtgaccagaatggcaataagacctgtatggagggctggatgggtcccgaatgtaacagggccatttgccgtcagggctgctcgccaaagcatggatcttgcaaactgccaggggattgtcgctgccaatacggctggcagggcctctactgcgacaagtgcatcccacacccgggctgcgtgcacgggatatgcaacgaaccctggcaatgcttatgtgaaacgaactggggggggcaactgtgcgacaaagacctgaactattgtggtactcaccagccttgcctgaacggaggcacttgctccaacacaggacccgacaaatatcagtgttcatgtcccgaggggtactccggcccgaattgcgagattgcagaacatgcgtgcctttcggacccatgtcacaaccgggggtcttgcaaggaaacttctctggggttcgagtgcgagtgtagtcctggatggaccgggccaacatgctcaaccaatattgatgattgcagtccaaataattgcagccacggaggtacatgccaggatcttgtgaacgggtttaagtgtgtctgtccgcctcaatggacgggcaagacctgtcagctggacgccaacgagtgtgaggctaagccatgcgtaaatgccaaatcttgtaagaatttaattgcttcatactattgcgattgcctcccaggttggatgggccagaactgcgacattaatattaacgattgccttggccagtgtcaaaacgacgcctcatgcagggatctggtcaatggctatagatgcatctgtccacctggctatgcgggggaccactgcgaaagggatattgacgagtgcgcatcaaacccttgcctaaatggaggccactgccagaacgagataaataggtttcagtgtctatgcccaactggcttttcagggaatttatgtcaactggatattgactattgtgaacctaatccatgtcaaaacggagctcagtgttataaccgagcctccgattacttttgtaaatgtcctgaggattatgaaggcaagaattgttcacatctgaaggaccactgtcgcaccacgccctgtgaagtcatcgacagttgcactgtggccatggctagtaatgatactcccgagggtgtccgctatatctcttctaacgtctgtgggccacacggcaaatgcaaatcccagtcaggcggaaagtttacatgtgattgtaataaaggatttacagggacgtattgtcacgaaaatataaacgattgcgagagcaacccctgccgaaatggagggacctgcatcgatggggtaaattcttacaagtgtatctgttctgatggctgggaaggggcctactgtgaaacaaacatcaatgactgcagtcagaatccttgccataacggagggacatgtagagatctcgtgaacgatttttactgtgactgcaagaacggatggaaaggcaaaacatgccacagccgtgactcccagtgtgacgaagcaacgtgcaacaacggaggaacctgttatgacgagggagacgcatttaagtgcatgtgtcccggcggatgggagggcacaacatgcaacatcgcaaggaattcttcatgtctacctaatccttgccataacgggggcacttgtgtagtgaacggggagtccttcacttgcgtgtgcaaggaggggtgggagggcccaatttgcgctcaaaatacaaacgattgctctcctcacccatgctacaacagtgggacgtgcgttgatggggacaactggtacaggtgtgagtgcgcccctgggttcgcaggaccagattgtaggatcaatatcaatgagtgccaaagttcaccttgtgcctttggagcgacatgtgttgatgagatcaacgggtatcgttgtgtgtgtccacctgggcactcaggcgccaagtgccaggaagtgtctgggcggccctgtatcacaatggggagtgtcatccccgatggggccaagtgggatgacgattgcaatacatgtcagtgcctgaatggaagaatcgcctgctccaaggtgtggtgcggcccacgcccttgtcttttgcataaaggccattctgagtgtccgagtgggcaaagctgtatccccatcttagatgaccagtgttttgttcacccctgtaccggagtgggcgagtgccgctctagctctctgcagcctgttaaaactaagtgtacttccgacagctattaccaggataattgcgctaacatcacttttactttcaacaaggaaatgatgagccccggtctcaccacagagcatatttgtagtgaactgaggaacctgaacatcctgaaaaacgtttcggccgagtactctatttatatcgcctgtgaaccatccccctctgccaacaacgagatccacgtcgctattagcgcagaagacatacgcgacgacggtaacccaatcaaggaaattaccgacaagatcatcgatcttgtttccaagagagacggcaatagcagccttattgcggcagtcgccgaggtgcgggttcagagacggcccctcaaaaatcgcacagactttcttgtccctcttctgtcatccgtgctcacagtggcctggatttgttgcctggtcaccgccttttattggtgcctgagaaagcgcagaaaacccggcagtcatactcattcagcttccgaggataacacaaccaataatgtaagggaacagttgaaccaaattaaaaatccaatcgagaaacacggagctaatacagtgccaattaaggattacgagaacaaaaattcaaagatgtctaagattcgcactcacaatagtgaggtcgaagaagacgatatggataaacatcaacaaaaagcgaggttcgccaaacaacctgcctataccctagttgaccgggaagaaaaaccgccaaatggcacacctaccaaacatcccaactggaccaataagcaagacaatcgagatctcgagtccgcccagagtctgaaccgaatggagtacatcgtgtag

SEQ ID NO: 24675 - DNA, 3399 bp, Artificial Sequence
  Description of Artificial Sequence: Synthetic coding sequence
atgggcatggcctgcctgaccatgaccgagatggagggcaccagcaccagctctatctaccagaatggagacatctccggcaacgcaaattccatgaaacagatcgaccctgtgttgcaagtttatctctatcacagccttggcaaaagcgaagctgattatcttacattccccagcggagaatacgtggccgaggaaatctgtatcgccgcctcaaaggcctgtggcatcactccggtctaccataacatgttcgccctcatgtcagagacagaacggatttggtatccgcctaaccatgtgtttcacattgatgaatctactcgacacaacgtcttgtacagaatccgcttctacttcccacgctggtactgctccggtagcaaccgggcttaccgtcacggtatcagccgcggtgccgaagcgcctttgttggacgactttgtaatgtcctatttgttcgcccagtggagacacgatttcgtccatgggtggattaaggttcccgttacgcacgaaactcaggaggagtgcctcggcatggctgttctggacatgatgcggatcgctaaggaaaatgatcaaactccactggctatctacaactctatcagttacaagaccttccttcctaaatgtattcgagccaagattcaggattatcatattctgacccgcaagaggattcgatatcgtttcagacgcttcatacagcagttcagccagtgcaaagcaaccgcaaggaatctgaagctaaagtatctgatcaatctcgagaccctccagagcgccttctacacagagaagttcgaggtgaaggaacctgggagcggtccctcaggtgaggagatatttgcaaccatcatcatcactggtaacggcgggattcagtggtccaggggcaagcacaaagaaagtgaaaccctgacagagcaggatcttcaactttattgcgacttcccgaatatcatcgatgtgagcatcaagcaggccaaccaggagggcagcaacgagtcaagggtcgtgaccattcacaagcaagatgggaaaaacttagaaattgaactgtccagcttgcgcgaagccctctcttttgtgtccttgatagacggatactataggctaactgctgacgctcatcattacctatgcaaggaggtcgctcctcctgcagttctggagaacatccaatccaattgtcacggtcccatctccatggactttgccatctcaaaactcaagaaggctgggaaccagacaggtctctacgtactgagatgctctcctaaagactttaacaaatactttctcactttcgctgtggagagggaaaacgttatcgaatacaaacactgtctgatcactaagaatgagaatgaggaatacaacttgagtggcactaagaaaaacttcagctcattaaaggatcttttaaactgctaccagatggagacagttcgcagcgacaacatcatttttcaattcactaaatgctgtcctccaaaacccaaagataaatctaacttgcttgtcttccggacaaatggggtgagtgacgtgccaacttcgcccaccctgcaacgtcctacccacatgaatcagatggtgtttcacaagatccgcaatgaagacctcattttcaacgagagcctggggcagggaacctttaccaagatcttcaagggagtacggcgcgaagtgggggattacgggcagcttcacgagaccgaagtcttgctgaaggttcttgacaaggcccatcgcaactactcagagtctttcttcgaggcagctagcatgatgagcaaactttctcataagcatctggtgctcaattacggagtatgcgtctgcggagacgaaaacattctggtgcaagaatttgtcaagtttgggtcattggacacatacctcaagaaaaacaaaaattgcatcaatatcctttggaagctcgaggtggctaagcagctcgcttgggcaatgcactttctcgaagaaaatactcttattcacgggaacgtgtgcgcaaagaacattttgcttatccgcgaagaagatcggaagactggaaatccgcccttcattaaattatctgatcctggcattagtatcaccgtgcttccaaaggacattttgcaggagcgaatcccctgggtccccccggagtgtattgagaaccccaagaacttgaatttggccactgataaatggagctttggaacaaccctgtgggaaatttgctcaggcggcgataaaccactcagtgcgctggactcccaacgcaagctgcagttctatgaggaccgacaccagcttcctgctccaaaatgggccgagttagcgaacctgatcaacaattgcatggattacgagccggattttaggcccagcttccgggccattatccgcgacctgaatagcctttttactcccgactacgaactgctgacagagaatgatatgctgccaaatatgcggataggtgcactcggattctcaggcgctttcgaagacagagaccctacacaatttgaggagcggcacctgaagtttctgcagcagctgggaaagggaaattttggaagcgttgaaatgtgccggtacgacccactccaggacaataccggagaggtggtcgccgtgaagaagctgcagcacagtacggaagagcacttacgtgacttcgaacgcgaaatcgagattctgaagagtttacagcacgataacatcgtaaagtacaagggggtgtgttacagtgcgggacggcggaacctgaagctgattatggagtacttgccctatggttctttgagagactacctccagaagcacaaggagcggatcgaccacattaagcttttgcaatatacttcgcagatctgtaaaggtatggagtacctggggactaagagatatatccacagggacctggccacaagaaatatcctggtcgaaaacgagaaccgggtgaagattggggattttggactcaccaaggtactaccacaggacaaggaatactacaaggtgaaggagccgggtgaaagtccaatcttttggtacgctcccgagagcctcaccgaatctaagttctccgtcgcctctgacgtatggagttttggcgtggttctttacgaactgttcacatacattgagaagagtaaatctccacctgccgaatttatgcggatgatcgggaatgacaagcaaggccagatgatagtttttcacctgatcgagttacttaaaaataatggacggttaccgaggcccgatggttgtcccgatgaaatttatatgatcatgaccgaatgttggaacaataacgtgaaccaaaggccctcatttcgcgatctggctttgcgcgtagatcaaatccgagataacatggctggttag

SEQ ID NO: 24676 - DNA, 3399 bp, Artificial Sequence
  Description of Artificial Sequence: Synthetic coding sequence
atgggcatggcctgcctgaccatgaccgagatggagggcaccagcacttcttctatttatcagaacggcgatatttctggcaacgccaactccatgaagcaaatcgatccggtactgcaggtttatctgtaccacagtcttggcaagagtgaagcggactatctcacgttcccttcaggggaatatgtggctgaggaaatatgcatagccgctagtaaagcctgtggcataaccccagtatatcacaacatgtttgctctgatgagtgaaactgaacggatttggtacccaccaaaccacgtcttccacatagacgagagtacaaggcacaacgtcttgtaccggatccggttctacttcccacgttggtactgcagcggcagcaatcgagcctaccggcacggaattagtagaggcgccgaggctcccctgctggacgatttcgtgatgtcctacctctttgcccaatggcgccatgacttcgttcatggatggataaaagtgcctgttacacatgagactcaggaggagtgcctcgggatggctgtcctggatatgatgcgaatcgctaaggaaaacgaccaaactccgctagcaatctacaatagcatttcatacaagaccttcctgcccaagtgtatcagggcaaagatccaggattaccatattctgacaagaaaacgtatcaggtacaggttccggcggttcatccagcagttctctcagtgtaaagccacagccaggaacctaaagctgaagtatcttattaatttggagactttgcaatcagctttctatacagagaaatttgaggtgaaggaacctggttccgggccatcaggcgaggaaattttcgccacaatcatcatcacgggaaatggagggatacagtggagccgcggcaaacacaaagagtctgaaactcttaccgagcaagacctgcagttatattgtgattttccgaacattatagatgtgagcatcaagcaggccaatcaagaaggttctaatgagtcccgggtggttactatccataaacaggatggcaagaatcttgagatagagctctcctcgttgcgggaggctctcagctttgtatccctcattgatggttattacaggctgacagccgatgcccaccattatctctgtaaggaggtggcacctccagctgtgctggagaacatccagtcgaactgtcatggtccgatctccatggatttcgccatctctaaactcaagaaggctggcaaccagacaggcttatacgtcctgagatgctctccaaaggacttcaacaagtactttctgactttcgccgtggaacgtgagaacgtgattgagtacaaacactgcttaattaccaagaacgagaacgaggagtacaacttgtcaggaacaaaaaaaaacttcagttcccttaaagatctgctaaattgttaccagatggaaactgttcggagcgataatataatcttccaatttactaagtgttgtccgccaaaacccaaagacaagtcgaatctcctggtgttccggacaaatggcgttagcgatgtgcccacatctcccacactccagcgccccactcatatgaatcagatggtgtttcataaaatcaggaacgaagatctcatctttaacgagagtctcggccaaggtacatttactaagatcttcaaaggagtgcggcgcgaggtgggcgactacggacagctgcacgagaccgaggtcttgctgaaagtattggataaggcgcaccggaattactcagaaagcttcttcgaggcagccagcatgatgtccaagttgagccataagcacttggttctgaactatggggtttgtgtttgcggagacgaaaatattctggttcaagaattcgtgaaattcggctccctggacacatacctcaagaagaacaaaaactgtattaacatattatggaagctggaggtggcaaaacagttagcgtgggccatgcacttcttagaggaaaacactcttatccatgggaacgtctgcgccaagaatatcctgctcatcagggaggaggaccgaaagacgggcaatccaccctttataaaactgtctgaccccggcatctcaatcacggtcctgcctaaggatatcctccaggaacggatcccctgggtccctccagagtgtattgagaacccaaagaacctcaatctggcaacggataagtggagcttcgggacaactctgtgggagatatgttctgggggcgataaacctctgtcagcgctcgatagtcagcgaaagctgcagttttatgaagatcgccatcaactgccagcacctaagtgggcggagttggcgaatctgataaataactgcatggactatgaacccgatttccggccctcttttagggccattatcagagacctgaacagtttgttcaccccagattatgaattattaaccgaaaacgatatgctgccgaatatgagaattggcgccctcggattcagtggagcctttgaggacagagaccccacccaatttgaagaacgacatctgaaatttttacagcagttagggaaaggtaacttcggctcagtggagatgtgccgttacgaccccctccaggataacactggggaagtggtcgctgttaagaagttacagcactcaaccgaagagcacttgcgcgatttcgagagggagattgagatcctgaagtccctacagcatgataacatcgtgaaatacaagggggtgtgctacagcgccggacgaagaaatttgaagctgatcatggagtacttaccttatgggagtctgcgggattatcttcagaaacacaaggagaggattgaccatattaagctgctgcaatacacatcccagatctgcaagggaatggaatatctcgggactaaacggtacattcatcgcgacttggcaacgaggaacatcctggtggaaaacgaaaatagggtgaaaattggcgacttcggcttaacgaaggtgttaccgcaagataaggagtattataaggtgaaggaacccggggagagcccgatcttttggtatgctcctgagtccctgaccgaatcaaaattctcagtggcatccgatgtctggagttttggggtggtgttgtatgaactttttacttacatcgagaagtcgaaatccccccccgcagagttcatgagaatgattggcaatgacaaacaaggccagatgattgtttttcaccttatcgagctcctcaaaaacaatggacgcctgccacgtccagacgggtgcccagatgagatctacatgataatgacagagtgctggaacaataatgtaaaccagcggccctcttttcgagaccttgcactgagagtggaccagattagggacaacatggcaggatag

SEQ ID NO: 24677 - DNA, 2952 bp, Artificial Sequence
  Description of Artificial Sequence: Synthetic coding sequence
atgagctacctgttcgcccagtggcggcacgacttcgtgcacggctggattaaggtgccagttacgcatgagacccaggaagagtgtttaggaatggccgtcctggacatgatgcggatcgccaaagaaaacgaccagacgccactggccatctataacagtattagctacaaaaccttccttccgaagtgtattcgagcaaaaatccaggattaccacattctcaccaggaagaggatcaggtatcgattcaggcgctttatacagcagttttctcagtgtaaggccacagccaggaacctgaaactgaagtacctcatcaatctcgaaacgcttcagtcagctttctataccgagaaatttgaggtcaaggaacccggctctggccctagcggagaggagattttcgctaccattatcatcacaggtaatggaggcattcaatggtcccgaggtaaacataaggagagcgaaactctgaccgagcaggatctgcagctctactgtgatttcccgaatatcatagacgtgagtattaagcaggctaatcaggaaggatctaatgaatcaagggtggtcacaattcacaagcaggacggcaaaaacttggagatcgaattgtccagtctgcgggaggctcttagctttgtttctctgattgacggatattacaggctcactgccgacgcccaccattacctgtgcaaagaggtggcgcccccagccgtactcgaaaatatccagtccaactgtcacggcccgatttctatggactttgcaattagtaagttaaagaaggccggcaatcaaaccggtctatacgtgctccggtgttcccccaaagactttaacaagtactttctgacattcgcagttgaacgggagaatgttatagaatacaaacactgtctcatcacaaagaacgaaaatgaggagtacaacctctcagggactaaaaagaacttctcctcattaaaggatctcctgaattgctaccagatggagactgtgaggtcggataacataattttccagttcaccaagtgctgtccccccaagcccaaggacaagagcaatttgctagtgttccgaacaaatggggttagcgatgtgcccactagccccaccttacaaaggccgacccatatgaatcaaatggtgttccacaagattaggaacgaggaccttatctttaatgagtctctcggccagggcaccttcacgaagatatttaaaggagtgcggagggaggtcggcgattacggacagcttcatgaaaccgaggtcctgttaaaggtgcttgacaaagctcacagaaattacagtgagagttttttcgaggccgcatccatgatgtcgaagctatcacataagcatcttgtgctgaattatggagtctgcgtgtgtggcgacgaaaacatcctcgtgcaggagtttgtgaagtttggatcattggacacctaccttaagaaaaataagaactgtatcaacatcttatggaaattggaagtggccaaacagctggcttgggccatgcattttctggaagagaatacattgatccacggcaacgtatgtgcgaagaatatcctgctgattcgggaggaagatcggaaaacaggcaatcctccttttataaaactgtcagacccgggtattagtatcacggtcctccccaaagacattttgcaggagcgcattccgtgggtccctccagagtgcattgaaaaccccaagaatctcaacctcgctaccgacaagtggtcctttgggacaacgctgtgggagatttgtagcgggggcgataagcctctcagcgccttggattctcaaaggaagctccagttttatgaagataggcaccagctccccgccccgaagtgggccgagctcgccaacctcatcaataactgtatggattacgaaccagattttaggccctcttttcgggccataatcagggatctaaatagcctcttcacaccagattatgaattgctgaccgagaacgacatgctgcccaatatgagaattggtgctttgggtttttctggcgcgttcgaggatagggacccaacgcagtttgaggagaggcacctgaaattcctgcagcagctggggaaaggaaatttcggctccgttgagatgtgcaggtatgatcccctgcaagataataccggggaggtcgtagccgtgaagaaactccagcacagcaccgaggaacatctacgcgactttgagagagaaatagaaattctaaagtctctccagcatgacaacattgttaagtataaaggagtgtgctacagcgccgggagaagaaatcttaaattgatcatggagtatctcccttatggcagcctaagagattatttgcagaagcataaggagaggattgaccacatcaagcttctccagtatacttctcaaatctgcaagggcatggagtatttgggaacgaagcggtatatacaccgggatctcgccacacggaacattctcgtggagaatgagaatcgcgtcaagattggagactttggcctgacaaaagtcttgccacaggacaaagagtattataaggtaaaagagccgggcgaatctcccattttctggtatgcccccgaatcccttactgaaagtaagtttagcgtagcatctgatgtgtggtcatttggtgtggttctgtacgagttgtttacctatatagagaagtccaaaagcccgcctgctgaattcatgcgtatgattggtaatgataagcagggccaaatgattgtgttccacttaatagaacttctgaaaaacaacggccgtcttccacggcccgatggctgtcccgacgaaatttacatgataatgactgagtgttggaataataacgtcaaccagcgcccatcttttagagatctcgccctccgggtggaccaaatccgggacaacatggccggttag

SEQ ID NO: 24678 - DNA, 732 bp, Artificial Sequence
  Description of Artificial Sequence: Synthetic coding sequence
atgaccggcatcgccgccgccagcttcttcagcaacacctgccggtttggggggtgtggccttcatttccccaccctcgccgacctgatcgaacacatcgaggataaccacatagacactgatcctagagtcctggaaaagcaggagttgcagcagcctacatacgtagccctgtcttacattaatagattcatgacagacgccgctcgccgagaacaggagtcactgaagaaaaagatccaacctaaacttagcctcaccctatcttcttccgtgtcgaggggcaacgtcagcacccctcccaggcactctagtggctctctgactcctcctgtcactcctcctataactcctagctcctcatttcgcagcagtacgcccacagggtcggagtacgatgaagaagaagtggattatgaagagagtgattccgatgagtcatggaccactgagtcagctatctccagtgaggctattctgagctccatgtgtatgaacgggggtgaggaaaaaccatttgcttgtcccgtgccaggctgtaagaaacgctacaagaacgtcaacggcatcaagtaccacgctaaaaacgggcacagaactcaaattagggttcgaaaacctttcaaatgtcgatgtgggaaatcttacaagacagctcagggcctgcggcatcataccattaactttcatccccccgtctccgccgaaattatccgtaaaatgcaacagtag

SEQ ID NO: 24679 - DNA, 1044 bp, Artificial Sequence
  Description of Artificial Sequence: Synthetic coding sequence
atgtgcaccaagatggagcagcccttctaccacgacgacagctacaccgccacagggtacgggcgggcccctgggggtctctcactccacgactataagctgctgaaaccctctctagctgtcaatttggccgacccctacagatcgcttaaggcccctggtgcgcgagggcctggaccagagggcggaggaggtggatcctacttcagcggacaggggagcgacactggagccagtctgaaattggcttcatccgagctcgaacgtctaatcgtgccaaactccaacggggttatcacgacaacacccacgcctcctggacagtatttctaccccagagggggcggcagcggcgggggcgcaggaggagcaggagggggtgtgactgaggagcaggaaggtttcgcggacggcttcgtcaaggcattagacgacctgcacaagatgaatcatgttacaccgcctaacgtcagcttgggcgcgaccggtggacctcctgccggaccaggaggcgtgtacgccgggccggagccccctccggtgtacacaaacctgtcctcttattctcccgcttccgcatccagcgggggcgccggagccgcagtgggcacgggcagctcttaccccacgaccaccataagctacttgccccacgctcctccgttcgccggaggtcacccggcccagctgggcctgggaaggggagcgtctaccttcaaggaggaaccacaaaccgtgccagaagccagaagcagggacgccaccccccctgtgtctcccattaatatggaggatcaggaacgaataaaagtggaaagaaagagactgaggaacaggctagccgctacaaagtgcaggaagaggaaactggaaagaattgcccgtctcgaggacaaggtaaagacactgaaagcagaaaatgcgggcttgagctctacagcggggctgctgcgtgagcaggtcgcacagctgaaacagaaggtcatgacccacgtgtccaatggttgtcagttgctcctgggcgtgaaaggccacgccttttag

SEQ ID NO: 24680 - DNA, 996 bp, Artificial Sequence
  Description of Artificial Sequence: Synthetic coding sequence
atgaccgccaagatggagaccaccttctacgacgacgccctgaacgctagctttctgcctagcgagtccggaccatatggttactcaaacccgaaaattttaaagcagagtatgactcttaacctggcggatcccgtcggctcactgaagcctcacctcagagccaaaaattccgatctgctcacctcccccgatgtcgggcttctgaagctagctagtccggagcttgaaaggcttatcatccagtcatccaatggacatatcaccaccactcctaccccgacgcaattcctgtgcccaaagaatgtgaccgacgaacaagaagggtttgcagagggatttgtgcgggcattggccgagctgcattctcaaaacacgctccccagcgtgacaagtgccgcccagccggtgaacggagccggcatggtggcacccgccgtggcctcagtggctggcggatctggatctggaggattttcagctagcctgcacagtgagcccccggtgtacgcaaacctatctaacttcaaccctggtgccctgagctcaggcgggggggctcccagctacggtgccgctggactggccttccccgcacagccccaacaacaacaacagccaccacaccatctgcctcaacagatgcctgtccaacacccgaggttacaggccctgaaggaggagccgcagacagtccctgagatgccaggggagaccccgcccttgagcccaatcgatatggagtcccaggaacggatcaaagccgaacggaaacgaatgcgcaaccgtatcgctgctagcaagtgtcggaaacggaaactggaaaggatcgccagactggaggagaaagtcaaaactctcaaggcccagaactccgagctcgcgagcaccgcaaacatgcttcgggagcaagttgcccagcttaaacaaaaagttatgaaccacgtgaattccggatgtcagctgatgttgacccagcagctgcagaccttctag

SEQ ID NO: 24681 - DNA, 831 bp, Artificial Sequence
  Description of Artificial Sequence: Synthetic coding sequence
atgcgggccccccacctgcacctgagcgccgccagcggcgcccgggccctggccaagcttttgcccctgcttatggctcaactatgggctgccgaagcggctctgttgccccagaatgatactaggctcgatccagaggcatacggttccccatgtgctcgcgggtcacaaccttggcaggtgtctctatttaatggattgtcatttcattgtgccggcgtgctcgtcgaccagtcctgggtactcactgccgcccattgcggtaataaaccgctgtgggctagggtgggtgatgatcatttgctgcttttgcagggtgagcagctgcgacgaactactaggagtgtggttcacccaaagtatcatcagggcagtgggcctatcctgcctcgtcgcactgatgagcacgacctgatgctgttgaaactggcccggcccgtggtgctgggccctcgtgtcagagcattgcagctcccgtacaggtgcgcccagccaggggatcagtgtcaggtggcaggatggggaactaccgcagcaagacgtgtgaagtacaacaaggggctcacttgttcatccataaccattctgtcaccaaaggagtgcgaggtcttctatcccggggtagtaactaacaatatgatttgtgctgggctggatagggggcaggatccatgccaatcagatagcggagggcccctggtgtgtgacgaaaccctgcaaggaatcctgagctggggcgtttacccatgcgggtccgctcagcacccagctgtgtatactcagatctgtaaatatatgtcctggatcaataaggtgatccgctccaactag

SEQ ID NO: 24682 - DNA, 831 bp, Artificial Sequence
  Description of Artificial Sequence: Synthetic coding sequence
atgcgggccccccacctgcacctgagcgccgccagcggcgcccgggcgctggccaaactactgccattgctgatggcacagctgtgggcagcagaggccgcattgctgccacagaacgatacccgactcgaccctgaggcctacgggtcaccatgcgcaagaggctcgcagccgtggcaggtcagcctctttaacgggctgtcatttcattgtgccggagtgctagtcgaccagtcctgggtactaaccgcggcccactgcggtaacaagcccctctgggccagggtcggcgatgatcacctattgctcttacagggcgaacagttgaggcgcacaacaaggagcgtagtgcatccaaagtaccaccaaggtagcggacccatcctgcctaggcgaaccgacgagcacgaccttatgcttttgaagctggccaggcccgtcgtgttggggccacgcgtgcgtgctctgcagctgccctacaggtgcgcccagccaggagaccagtgtcaggtggccggatggggcaccaccgccgcacgccgcgtcaagtacaacaaaggtttgacatgcagcagcatcacgattctgtcccccaaggagtgtgaagtgttctaccccggcgtcgtgaccaataacatgatctgcgccggcctagaccgaggtcaggatccctgtcagagcgatagcggaggcccactggtgtgtgatgagaccctgcagggtatcctgtcttggggtgtttatccctgtggttctgctcagcaccctgccgtgtacacacagatttgtaagtatatgagctggataaacaaagtgatccgatcaaattag

SEQ ID NO: 24683 - DNA, 831 bp, Artificial Sequence
  Description of Artificial Sequence: Synthetic coding sequence
atgcgggccccccacctgcacctgagcgccgccagcggcgcccgggccctggctaaattgttaccgctgctaatggcacaattgtgggcggcggaggccgctttgctgccccaaaacgacacaagattagacccggaggcctacgggagcccctgcgcccgcggctctcagccatggcaggtgagtctgtttaacggactctcctttcattgcgccggtgtgttggtcgaccagagttgggttttgacagccgctcattgcggcaacaaacccctgtgggctagagtcggcgacgaccatcttctccttttacagggggagcaactgcgtcgcaccactcggagcgtcgtgcaccctaagtaccaccagggatccgggcctatcctccctagaagaaccgacgaacacgatctgatgctgttgaaactggctcgccccgttgtccttggaccccgggtgcgtgcgctgcagctgccctacagatgcgcgcagcccggcgaccaatgtcaggtagctggatgggggacgaccgcggcccgccgcgtcaaatacaataagggtctgacctgttcatcgatcacaattctctcccccaaggagtgtgaggtgttttaccccggtgtcgtcaccaacaacatgatttgtgctggtctggacagaggacaggacccttgccagagcgatagtgggggccccttggtatgtgacgagacactccagggtatcctcagctggggtgtgtatccctgtggatccgctcaacaccctgccgtgtacactcagatttgcaagtacatgagctggatcaataaagtgatccgatctaactag

SEQ ID NO: 24684 - DNA, 657 bp, Artificial Sequence
  Description of Artificial Sequence: Synthetic coding sequence
atgtgggtgcccgtggtgttcctgaccctgagcgtgacctggatcggcgccgccccgctcatcctgagtcgaattgtgggaggctgggaatgcgaaaagcactcacagccctggcaagttctagtcgcgtcaaggggccgggccgtttgcggcggtgtgttagtgcatccacaatgggtgctgacggccgcacactgcatccgcaagcccggcgatgatagctctcacgacctcatgttgctgcgcctatcagaacctgccgagttgactgacgctgtgaaagtgatggatcttcctactcaggaaccagccctcggaactacatgctatgcttctggctgggggtctattgaacctgaggagttccttacccccaagaaattgcagtgcgtcgatttacatgttattagtaatgatgtgtgtgctcaggtacacccacagaaagtgaccaaatttatgttgtgcgccgggcgttggacaggcggaaagagtacttgtagtggagactcaggaggtcccctcgtttgcaacggagttttacaggggattactagttggggaagcgagccctgtgcgctgcctgaaagaccgagcttatacacaaaggttgtacattacagaaaatggatcaaagacaccattgtggcgaacccctag

SEQ ID NO: 24685 - DNA, 1590 bp, Artificial Sequence
  Description of Artificial Sequence: Synthetic coding sequence
atgagcaccaacgagaacgccaacacccccgccgcccggctgcaccgatttaaaaataaaggaaaagatagcactgagatgcggaggcggcggatcgaagtgaacgtggaactgcggaaagcgaagaaagatgaccagatgcttaaaaggcgcaacgtgtcaagttttcccgacgatgccacaagtcccctccaggagaataggaataaccagggcactgtaaattggagcgtagacgacatcgtgaagggcattaattcttccaacgtggagaaccaacttcaagctacacaggccgcacgcaaactgttaagtagggagaagcagccacctatagacaacattattcgggcaggtcttatcccgaaatttgtatctttcctgggacggaccgactgtagcccaatccaattcgaatctgcctgggccctgaccaatattgcgtctgggacctcagagcaaacaaaggccgtcgttgacgggggagcaatcccagccttcataagcctgctggctagcccgcacgctcacatcagcgagcaggctgtgtgggcactgggaaatattgccggcgacgggagcgtgtttagagatctagtcatcaaatatggcgccgtggacccacttctggccctactggcggtgccggatatgtcctcactcgcctgcggatatctgcgtaacctgacctggaccctgagcaatttgtgtcgcaataaaaaccctgccccgcctattgatgctgtggaacagatcctgcccacgctcgtgcggttattacaccatgacgatcccgaagtgctagcagatacatgttgggctattagttacctgactgacggccccaatgagcgcatcgggatggtcgtgaaaactggggtggttcctcagcttgtcaaattattgggcgccagtgagctgccgatagtgacacctgctctgcgggcaatcggcaatattgtaaccggcaccgatgaacaaacacaggttgtgatagatgccggggcccttgccgtgtttccatcacttttaaccaatcccaaaaccaatattcagaaagaggcgacttggaccatgtctaacattactgctggccgacaggaccagatacaacaagtggtcaatcatggactcgtgccctttctagtctctgttctcagcaaggcggacttcaagacgcagaaggaagccgtgtgggcagtgacaaattatacttctggtggcaccgtcgagcaaatcgtgtatctggtccactgtggcattatcgaacccctgatgaacctcctgacagccaaagacactaaaattatcctcgttatactggatgctattagcaatatcttccaggcagccgaaaagttaggagagaccgagaaactctcgattatgattgaagaatgtggggggctcgataaaattgaggccctgcagaaccacgagaatgaatccgtttacaaagcctctttgagtttgattgaaaagtacttttcagtggaggaagaggaggaccagaacgtggtgcccgagaccacttctgaggggtacacctttcaggtacaagacggggcccccgggacgtttaacttctag

SEQ ID NO: 24686 - DNA, 1590 bp, Artificial Sequence
  Description of Artificial Sequence: Synthetic coding sequence
atgagcaccaacgagaacgccaacacccccgccgcccggctgcacagatttaagaacaaaggcaaagactcaactgagatgagaaggaggaggatcgaagttaatgtggagctccggaaggcaaaaaaggacgatcaaatgttaaaacggcggaatgtctcctctttccctgacgatgccacttcgcccctacaagaaaatcgaaacaatcagggtaccgttaattggtcagtggatgatatagtcaagggtattaactctagcaacgtggagaaccagctgcaggctacgcaagctgctcggaaattactgagccgggagaaacagcctcctatcgataacattatccgggcgggcctgattccgaagttcgttagctttctgggacggactgattgcagtcccattcagttcgaatccgcgtgggctctgacaaatatagcctccggtacaagcgaacagaccaaggcagtggtcgatggaggcgcgatcccagcatttataagcctgctggctagtccccacgctcatatttccgagcaggccgtttgggctctggggaacatagcaggcgatggtagtgtattccgggacctcgtaatcaaatatggcgcagtcgatcctttgctggccctcctagcagtcccggacatgagctcccttgcatgtggctatctaaggaatctgacttggacactgtccaatctctgtcgaaacaagaatcccgcgcctccaatagatgccgtagaacagattttacccaccctagtacgtttgctccaccatgacgacccagaagtgctggctgatacatgctgggctattagctacttaactgatggacctaacgaacgcattggaatggtggtgaagactggggttgtgccacaactggttaagctcctaggagcctcagaacttccaatcgtaactccagccttaagagcgatcggtaacattgtgaccggtaccgacgaacaaactcaggtcgtgattgacgctggcgccctggccgtttttccttctctcttgaccaaccccaaaaccaatattcagaaagaagccacttggacaatgtccaacattactgccgggcgccaggatcagatacagcaggtcgttaatcacgggctcgtgccatttctggtaagtgttctatctaaggctgactttaaaacacagaaagaggccgtgtgggccgtgaccaattataccagcggtgggaccgtggagcagatcgtctacttagtgcactgcggaattatagaacctttaatgaatcttttgaccgctaaagatacaaaaattatactggtaatcctagacgcaatatccaacatctttcaggccgctgagaagctgggagagaccgaaaagttgtcgataatgatcgaggaatgcggcgggctcgacaaaatcgaggccctgcagaaccatgagaacgaaagcgtgtacaaagcctccctgagtctcatagagaagtacttttccgtcgaggaagaagaggaccagaacgtcgtgccagagacgacaagtgagggttacacatttcaagtgcaggacggggctcccggaacttttaatttctag

SEQ ID NO: 24687 - DNA, 1968 bp, Artificial Sequence
  Description of Artificial Sequence: Synthetic coding sequence
atgcccctgaagtggaagaccagcagccccgccatctggaagttcccagtgcctgtcctgaaaaccagtagatcgactcctttatcccctgcctacattagccttgtggaagaagaagaccagcatatgaaattgtccctgggcggcagtgagatgggtttgtccagccacctgcagagttctaaggctggccccacccgtatttttacaagcaacacccattcctcagtcgtgctgcaagggttcgatcaattacggctagaaggcctgctctgcgatgtgactctaatgccgggtgacactgacgacgcttttccagtgcacagagtgatgatggcttctgctagcgactacttcaaggccatgttcactggcgggatgaaggagcaggatctcatgtgtatcaagctccatggtgtctccaaagttggtctgcgtaaaatcattgatttcatatacaccgccaaactaagtctgaacatggacaatctgcaggataccctggaggcagcctctttcctgcaaattctgcccgtattggacttctgcaaggtattcctaattagcggtgtgacactggataattgtgtcgaggttggaagaatcgcgaatacttacaacttaaccgaagtcgacaaatacgtcaattctttcgtactaaagaacttcccagccctgttatccaccggggaattcctgaaacttccctttgagaggctggcctttgttctgtcgtccaacagcctcaaacactgcaccgagttggaactcttcaaggccacctgtagatggctgcgactggaggagccacgcatggatttcgccgctaagttgatgaagaatatccgatttcctctgatgaccccccaggagctgatcaattatgtccaaactgtggattttatgcgaaccgacaatacttgtgtgaacctcctcctggaagcctccaattatcagatgatgccctatatgcaaccggttatgcagtctgaccgaaccgctatcaggtccgatacaacacatctcgtgactctcgggggagtcctgagacaacaactcgtggtgtctaaagagctgagaatgtatgatgagaaggcccacgagtggaagtccctcgcacccatggacgcaccccgctatcagcacggcatcgccgtgatcgggaacttcctgtacgtcgtcggcggccagtctaattatgacaccaaaggaaagacagccgttgacacagtgtttaggttcgacccaagatacaataagtggatgcaagtggcgtctcttaatgaaaaacgcacctttttccacctctccgccctcaaaggatatctatacgccgtcggggggagaaatgcggcaggggaattacccacggttgaatgctacaaccctaggaccaatgagtggacttacgtggctaagatgtccgagccacactatgggcacgctgggaccgtatacggaggcgtgatgtatatctctggaggtatcacccatgatacatttcaaaaggagctcatgtgcttcgatcctgatacagacaagtggatccaaaaggcccccatgacgaccgtgcgcggtttgcattgtatgtgcactgtgggtgagaggttatacgtgattggcggcaaccactttcgcggaaccagtgactacgatgacgtactgagctgcgagtactatagccctattctcgatcagtggacaccgattgctgccatgttacgcggccagtcagatgtgggcgtggccgtttttgagaataaaatatatgtagtcggagggtactcttggaataatagatgtatggtcgaaatagtccagaagtatgaccccgacaaagacgagtggcacaaggtgttcgatcttcctgagtccctcggagggattcgagcatgtaccttaaccgtttttccccccgaagagaccacacccagtccgagccgggagagccccttgtccgccccctag

SEQ ID NO: 24688 - DNA, 1815 bp, Artificial Sequence
  Description of Artificial Sequence: Synthetic coding sequence
atgggcctgagcagccacctgcagagcagcaaggccggccccacccgtatcttcacttcaaatacacacagctctgtggtgttgcagggctttgaccaactgcgccttgagggcttgctatgcgatgtcactttgatgccgggagacactgatgacgcttttcctgtgcacagagtgatgatggcctcagcgtctgactattttaaggccatgttcacaggtgggatgaaggaacaggacttaatgtgcatcaaactccacggcgtgagtaaggtggggcttaggaaaataattgacttcatctatacagccaagttgtccctgaacatggataacctccaggatactttggaagcagcatctttcttgcagatcctgccagtgcttgacttctgcaaggtattcctaatttcaggggtgacccttgataattgtgtggaggttggacgcatagctaacacatataacttgacagaggtggacaagtacgttaactctttcgtgctgaaaaatttcccggctctcctgtccacgggcgagttcttgaagctgccttttgaacgactggcctttgtcctttctagtaacagcctcaagcactgcactgagttggagttgtttaaggccacctgtcgttggttgcgattggaggagcctaggatggactttgccgctaaactcatgaagaacattaggttccccctgatgactccccaagaactcatcaactatgtgcagaccgtggacttcatgaggaccgacaatacatgtgtcaacctgctgctcgaagcaagcaattaccagatgatgccctacatgcagcccgtgatgcagtcagaccgtacagctatcagaagcgacacaacacatctggttactctcggcggcgtcctgcgtcagcagctggttgtaagcaaggagctacgaatgtacgatgaaaaggcccacgagtggaagtccttggcccctatggatgcacctaggtaccagcacggcatcgccgtgatcggaaacttcctatatgtggtgggcggccagagtaattacgacacgaagggtaagactgctgtggacacagtgttcagatttgatccgaggtacaataaatggatgcaggtggcctctttgaacgagaaacggactttttttcacctgtcagccctaaagggttacctgtacgctgtgggcggtaggaacgccgccggagagctacctactgtcgaatgttataaccccagaaccaacgagtggacttatgtcgcaaagatgtcagagccccactacggccacgccgggaccgtgtatggaggtgtaatgtacatcagcgggggaataacccatgataccttccagaaggagctgatgtgttttgaccccgatactgacaagtggatacagaaggcccccatgaccaccgtgagaggcttacattgtatgtgtaccgtcggagaacgactgtacgtgatcggcgggaaccatttcagagggactagtgattacgatgatgtgctatcctgcgagtactattctcctatcctggatcagtggacccctatcgcagccatgctgcggggtcagagcgacgtgggcgtggccgttttcgaaaacaagatttacgtagtgggcggctacagttggaacaaccgctgcatggtagagattgtgcagaagtacgatcctgacaaagacgagtggcataaagtgttcgacctccctgagtcactcggagggataagagcctgcactctcaccgtcttcccacccgaggagactactccatctccttctcgtgagtccccactgtcagccccctag

SEQ ID NO: 24689 - DNA, 1815 bp, Artificial Sequence
  Description of Artificial Sequence: Synthetic coding sequence
atgggcctgagcagccacctgcagagcagcaaggccggccccacccgtatattcacctctaacacgcattcatctgtggtgttgcagggcttcgaccagttgaggctggagggactcctttgcgacgttactttgatgccaggcgatactgatgacgcatttcccgtacaccgcgtcatgatggcttccgcctccgattattttaaagcaatgttcacaggaggcatgaaggagcaggacctcatgtgtatcaagctgcacggggtatcaaaggtgggcctgagaaagatcattgactttatctacacagctaaactttccttgaacatggataaccttcaggataccttggaggcagccagtttcctccagatcctgcctgttttggatttctgcaaggtgttcctgatttccggagtgactctggacaactgtgtcgaagtggggaggattgcaaatacttataatttaacagaggtggataaatacgtcaactcttttgtgctgaagaacttcccagccctgctgagcacaggtgagttcctcaaactccctttcgagagactggcttttgtactgagctccaattctctgaagcactgtacagaactggagttgtttaaggccacttgtcgatggctccggctcgaggagcccaggatggacttcgcagctaagcttatgaaaaatatccgatttccattgatgactcctcaggagctgatcaactacgtgcaaacagtagattttatgagaaccgataatacctgtgtgaatctactgctggaggcatccaactaccaaatgatgccctacatgcaaccggtgatgcagtccgaccggacggcaataagaagcgacaccactcacctggtaacactcgggggggtcctgaggcaacaacttgtcgtgagcaaggaacttaggatgtacgacgagaaggcccatgaatggaagagtttggccccaatggacgccccaagatatcagcacggtatagctgtcataggcaacttcttgtacgttgtcggtggccaatcgaattacgacactaaggggaaaacggccgtcgataccgtgtttaggtttgatcccaggtacaacaagtggatgcaggtagcttcattgaacgagaaacggaccttctttcatttatcagccttaaaagggtatctttatgccgtcggcggccgcaacgccgccggcgagttgcccacagtcgagtgttacaacccgaggaccaacgagtggacctacgtagccaagatgtctgagcctcattacggacacgctgggacagtgtacggcggagtgatgtacatttcaggaggcatcactcacgacacatttcagaaagagctgatgtgtttcgaccccgacactgataagtggatccagaaggcccctatgacaaccgtaagaggactgcactgtatgtgcacagtaggcgagaggctgtacgtgataggaggcaatcatttcagggggacctctgattacgacgacgtcctgtcctgcgaatactacagcccgattctggatcaatggacacctatcgccgcgatgcttcggggccagtccgacgttggagtggcggtgtttgagaataagatatatgtggttggcgggtactcttggaacaaccgctgtatggtcgagattgtccagaagtacgacccagacaaggacgagtggcacaaagtgttcgacttgcccgaatctttgggtggtatcagggcatgcacactcaccgtgtttccccctgaagagacaactccaagcccctctcgcgaaagccccctgagcgccccatag

SEQ ID NO: 24690 - DNA, 1815 bp, Artificial Sequence
  Description of Artificial Sequence: Synthetic coding sequence
atgggcctgagcagccacctgcagagcagcaaggccggccccaccagaatcttcacctccaatactcacagttccgtggtgctacaagggttcgatcagttacgcctggaaggtctgttgtgtgacgtaaccctgatgccaggcgacacggacgatgcttttcccgtgcacagagtcatgatggcttccgcttccgattacttcaaggctatgttcacgggtggcatgaaagagcaagacttgatgtgtatcaagctccacggtgtttcaaaagtgggcttgcggaaaattatcgattttatctataccgctaagctcagcctcaacatggataacctccaggatacacttgaggccgccagtttcttgcagattctcccggtacttgacttttgcaaagtgtttctgatcagtggcgtcacactcgataactgtgtcgaggtcggtaggatcgccaatacttacaacctcaccgaagtggataaatacgtcaacagctttgtgctgaagaactttccggcactcttaagtaccggcgagtttcttaaactgccctttgaacgtttagctttcgtactgtcctcgaattctctgaagcactgcacagaactggaactctttaaagccacctgtagatggctgcgtctcgaggaacctaggatggacttcgccgccaagctcatgaaaaacatcaggttccccctcatgactccccaggagctgatcaattatgtccagacagtggactttatgcgcactgataacacctgcgtcaatctgctcctggaggcgagtaattaccaaatgatgccgtatatgcaacctgtcatgcaatcggatcgcacggccattagatcagatactactcaccttgttactctcggtggggtgctccgacagcagctggtggtgtccaaagagctgcggatgtacgacgaaaaggcccatgaatggaagtccctcgctccaatggatgccccaagataccagcatggtatcgctgtcataggaaattttctctatgtggtcgggggccaatcaaactacgatactaaaggaaagaccgctgttgatactgtgtttcgcttcgacccccggtacaataaatggatgcaggttgcctccttgaacgaaaagcgcacttttttccacttatccgccctgaaggggtacctgtatgccgttggcggtagaaacgcagcaggcgaacttcctaccgtcgaatgttataatccccgaaccaatgaatggacgtacgtggcaaaaatgtctgaacctcattacgggcatgcaggcaccgtgtatggaggagtgatgtacatctctggaggaattactcatgacaccttccagaaggagctgatgtgcttcgaccccgatacggataagtggatacagaaggctccaatgacaacagtacggggattgcactgtatgtgcacagttggtgaacgtctctacgtaatcggagggaatcactttcgaggaacaagcgattacgacgacgttctctcttgtgagtactacagccccatattagatcagtggactcccatcgctgctatgttgagaggccagagcgatgtaggggttgccgtgtttgaaaacaaaatatatgtcgtgggaggatattcctggaacaatcgatgcatggtcgaaatcgtgcagaagtatgatccggataaagacgaatggcataaggtatttgacctgcctgagtccctcggcggtatcagagcatgcactctcacagtgttcccgccagaagaaaccactccatcccccagtagagagagtcccctgtctgccccatag

SEQ ID NO: 24691 - DNA, 1815 bp, Artificial Sequence
  Description of Artificial Sequence: Synthetic coding sequence
atgggcctgagcagccacctgcagagcagcaaggccggccccaccaggatttttacttccaatacccactcaagtgtggtgctccaggggtttgaccagttgcggctagaggggctgctctgtgatgttacgctgatgcccggggatactgacgacgcctttcctgtgcacagagttatgatggctagcgcttctgattatttcaaagctatgtttaccggggggatgaaagaacaggatttgatgtgcattaagctccacggcgtgtcaaaggtgggtctgcggaagatcattgattttatctatacagctaagctgagcctcaatatggataaccttcaggacaccctggaggccgcatcattccttcagatcctcccggtgctggatttttgtaaagtgttcctgatcagtggggtgacactggacaattgcgtcgaagtgggcaggattgcgaacacctacaacttgacggaggtggacaagtatgttaactctttcgtactgaaaaactttcccgctctgctaagcaccggtgagttcctgaaactgccttttgaacgactggctttcgtgctgtcttccaattccctcaagcattgtacggaacttgagctcttcaaagcaacgtgtagatggttaaggctggaagaaccgcgaatggactttgcagcaaagctgatgaagaatattcgctttccgctcatgactccacaagagttgatcaactacgtccagacagtggactttatgcggacagataacacttgcgtaaacctcctgctggaggcatccaactaccagatgatgccttacatgcagccagtgatgcagtccgacagaacagccattcggtcggataccacccatcttgtgacattaggcggcgtgttgaggcaacaacttgtggttagcaaggagctgcggatgtatgatgaaaaagcacacgagtggaaatcgctggctcctatggatgccccacgttatcagcatgggattgccgtaataggcaattttttgtatgtcgtgggaggccaatccaactacgacactaaggggaaaactgcagtggacactgtatttaggttcgaccccaggtataacaaatggatgcaggtcgcctctctcaacgagaaacgcaccttttttcatctgtccgccctgaaggggtacctgtacgccgtgggcggacgcaacgccgcaggagagctccccacggtggagtgctataacccaaggaccaatgagtggacgtacgtggcaaaaatgtccgaaccccactatggccacgctggaactgtgtacgggggcgtgatgtacattagcggggggatcacacacgatacctttcagaaggagctcatgtgttttgaccctgacaccgacaagtggatacagaaagcacccatgacgacagtgcgagggcttcactgtatgtgcacggtcggcgagcggctgtatgtaattgggggcaaccactttaggggcacctctgattatgacgacgtgctgtcttgcgaatattattcgcccattttggatcaatggacacccattgccgccatgctgcgggggcagtccgatgtgggcgttgctgtgtttgaaaacaaaatctacgtcgtaggcggctatagctggaataatagatgcatggtagagattgtccaaaagtacgaccctgacaaggatgagtggcataaagtgtttgaccttcccgagtccctcggaggaataagagcctgcacactgactgtctttccccctgaggaaactactccgtctccatcgcgcgagtcccccttatccgccccttag

SEQ ID NO: 24692 - DNA, 117 bp, Artificial Sequence
  Description of Artificial Sequence: Synthetic coding sequence
atgggcctgagcagccacctgcagagcagcaaggccggccccaccaggatatttaccagcaatacccactcatcagtggtgttgcagggatttgatcaacttagactggagggctag

SEQ ID NO: 24693 - DNA, 1815 bp, Artificial Sequence
  Description of Artificial Sequence: Synthetic coding sequence
atgggcctgagcagccacctgcagagcagcaaggccggccccaccagaatctttacatcgaacactcactcaagcgtcgtgctgcagggctttgatcaacttcgcctcgaggggctgctctgtgacgtgacactgatgcctggtgatacggacgacgcgttccccgtgcacagggttatgatggctagcgcttcggattatttcaaggctatgtttactgggggcatgaaggagcaggatttaatgtgtattaaactccatggcgtctccaaagtagggctccggaagattatcgacttcatctacacagccaagctttcccttaatatggataacctgcaagatactctagaagccgcaagcttccttcaaattctccctgttctggatttctgcaaagtctttctgatttccggtgtcacacttgataactgcgtcgaggtgggcaggattgccaatacgtataacctgactgaggtggataagtacgtcaactccttcgtgcttaagaatttcccggctctcctctccaccggagaattcctgaagctgcccttcgagcgtcttgcctttgtgctgtccagcaattctctgaagcattgtactgagctggaactgttcaaggctacttgcaggtggctgaggttggaggagcctagaatggattttgctgccaagcttatgaagaacatccgctttcctctgatgactccccaagagcttataaactacgtccagactgtagactttatgcggaccgacaacacttgcgtgaacctactgctcgaggcgagtaactaccagatgatgccttatatgcagccagttatgcagagcgaccggaccgcaattcgatccgacacaacccacctcgtcacactgggcggcgttctgaggcagcagctggttgtatccaaagagctccgcatgtacgacgaaaaggctcacgagtggaaaagtcttgcccctatggacgccccaaggtatcagcacggaatagccgtgattggaaacttcctctacgtcgtcggggggcaatcaaattatgacaccaaggggaaaaccgctgtcgacactgtgtttcgctttgacccgaggtacaataaatggatgcaggtagcgtccctgaatgaaaaacggactttttttcacttgtcggccctgaaaggctacctgtatgctgtgggcggacgtaacgccgctggcgagctgccaacggtcgagtgctacaatccaaggaccaacgagtggacttacgtggccaagatgtcggagcctcactacggccatgctggcaccgtgtacgggggtgtaatgtacatctctggcgggattacgcatgatacttttcagaaagagctgatgtgtttcgatcccgatactgacaaatggatccagaaggcacccatgaccaccgttagaggtctccactgcatgtgcactgtcggcgagagattgtacgtcatcggaggcaatcatttcaggggcacttccgattatgatgacgtgctttcgtgcgaatattactcccccatcctggaccaatggacacccattgcagccatgctgagagggcaatccgatgtcggcgtggccgtgttcgaaaacaaaatctatgtcgtgggaggctattcttggaataatcgatgtatggtcgaaatcgttcagaagtacgatcccgacaaggatgaatggcacaaagttttcgatctgcccgaatcgctcggcggaatccgtgcctgtaccctgacagtatttccgcctgaggaaactacccccagcccctcccgggaaagcccgctgagcgccccctag

SEQ ID NO: 24694 - DNA, 1977 bp, Artificial Sequence
  Description of Artificial Sequence: Synthetic coding sequence
atgatgcgggtgcagaccctgcgggagaagtgggcctactggcggcggagacagcttagtctgaaacaggccgatttcaaagacatctttaaaaagagcacaagcggcagcctggtcgaggaagaagaccagcatatgaagctgtccctcggcggatcagaaatggggttgagtagccacctgcagtcgtccaaggcaggaccaactcggatatttacttccaacacccattctagcgtggtgctgcagggatttgaccagctccgcctggaaggcctgctttgcgacgtgacactcatgcctggagatacagatgatgcgttccctgttcatagagtcatgatggcctcggccagcgactacttcaaggcaatgttcacagggggtatgaaggaacaggatcttatgtgcatcaagctgcatggtgtctcgaaggtcggcctcaggaaaattatagactttatctacaccgccaagttgagcctaaatatggataacctgcaggataccttagaagccgccagtttcctacagatcctgcccgtgctggacttttgcaaggtttttcttatctccggggtaactctggacaactgcgtggaagttgggcggattgctaatacgtataacttgactgaagtagacaagtatgtgaactcattcgttttaaaaaactttccagctctgctttccacaggagagttcctcaagcttcctttcgagaggctcgcttttgtattatctagcaactctctcaaacactgtaccgagctggagctttttaaagctacctgccggtggctgcgtctggaggagcctcgcatggattttgccgcaaagttgatgaagaatatccggtttccccttatgacgcctcaagaattgattaattatgttcagacagtagactttatgcgaactgataatacctgtgtgaacctgcttctggaagcaagtaattaccagatgatgccatatatgcaaccagttatgcagagcgataggactgccattcggtcagataccacccacctggtaaccttaggaggggtcctgaggcagcaattggtcgttagtaaggaattacgaatgtacgatgaaaaagcacacgaatggaagtcactggctcccatggacgctcctaggtaccaacacggtatcgccgtcataggcaactttctgtatgtagtgggaggacagtcgaattacgatacaaagggcaaaactgcggtggacactgtctttcgatttgaccctcgatacaataaatggatgcaggtggcctcactgaatgaaaaaagaactttcttccacctctctgcattgaagggatatctatacgctgtgggcggacggaacgcagccggtgaactacccacagtcgaatgttataatcctcgaactaacgagtggacatatgtggccaagatgtccgaaccacattatggtcatgcaggaaccgtttacggtggagtaatgtacatctccggcgggatcacccacgatacttttcagaaggaactaatgtgttttgacccggataccgacaagtggatccagaaagctcccatgacaactgtgagaggactccactgtatgtgcacggttggggagagactgtatgttatcggtggcaaccatttcaggggaaccagtgattacgatgacgtgttgtcatgcgagtactattccccaattctggaccaatggacacccatcgctgctatgctacgtgggcagtccgatgtgggcgtggctgtattcgagaacaagatctatgttgtaggagggtactcttggaataaccggtgtatggtggaaatagtgcagaagtacgatcctgacaaagacgaatggcacaaggtgtttgacctgcctgagtcgctgggcggtatcagggcatgtaccctgactgttttcccacctgaggaaacgaccccatccccttccagggagagccctttaagtgcaccttag

SEQ ID NO: 24695 - DNA, 1920 bp, Artificial Sequence
  Description of Artificial Sequence: Synthetic coding sequence
atggaccacctgcaccggggcgagctggtggccgccatcctgcggaaccgttccctggtagaggaagaggaccaacatatgaagctgtcactggggggcagcgagatgggactgagcagccacctccagtcaagcaaggccggccccactcgaattttcacgtcaaacactcattcatccgtagtattgcagggcttcgaccagcttcggctggaggggcttctgtgtgacgtgaccttaatgcccggtgacaccgacgatgccttccccgtgcacagggtcatgatggcaagcgctagcgactactttaaggctatgttcactggagggatgaaagagcaggacctgatgtgtatcaagctccacggggtctcaaaggtgggactgcggaagatcatcgatttcatttacaccgccaagctgtccttgaacatggacaacttgcaggacacactggaagccgcatctttcctacagatcctgcccgttctcgatttctgtaaggttttcctcatctctggtgtgacactggataactgtgttgaggtggggcggatagccaacacatacaatctcactgaagtcgataagtacgtcaacagcttcgtccttaagaacttcccggcattactttctactggagaatttctcaaactccctttcgagagactcgcgttcgtgctctcctcgaactcattgaagcattgcaccgagttggaactgttcaaggctacctgtcggtggctgcggctcgaagagccaagaatggatttcgcagcaaagctgatgaagaacataaggtttccccttatgaccccccaggaactgattaactacgtgcagactgtagacttcatgaggaccgacaatacctgcgttaatctcttgctggaagctagtaattaccaaatgatgccgtacatgcaaccagtcatgcagagcgacagaaccgcgatcaggagtgacacaacgcatctggtcactctgggcggcgtgctccgccagcagctggtcgtgagcaaagaactcagaatgtacgacgaaaaggcccacgagtggaagagtcttgctcccatggatgcccccagataccagcatggaatcgctgtcattggtaatttcctctatgtggtgggcgggcagtctaattatgatacaaaaggcaagacagccgtcgatactgttttcaggttcgacccaaggtacaacaagtggatgcaagtcgctagcttaaacgagaagcgcaccttttttcatttgagtgccctgaagggatatctgtatgcagttggcggcagaaacgcagcaggggagttgcctacggtggaatgttacaacccccgcaccaatgagtggacctatgtcgccaagatgagtgagccgcattatggacacgctggaaccgtctacggcggcgtgatgtacatcagtggagggatcacacatgatacctttcaaaaggaattgatgtgcttcgaccccgacacagacaaatggatccaaaaagccccaatgaccacagtcagaggactacactgcatgtgcacagtgggggagcggctgtacgtgatcggcggtaaccacttccgagggacctctgattatgacgatgtgctgtcatgcgaatactattccccaattcttgatcagtggacacccatcgctgccatgctccggggccagagcgatgtgggggtggctgtgtttgaaaataaaatctacgtcgtggggggttatagctggaacaatcgctgcatggtcgagattgtgcaaaaatacgatcccgataaggacgagtggcacaaggttttcgacctccctgagtctctgggcgggatcagggcctgcacactaacagtcttccccccggaagaaacgaccccctccccttcccgcgagtctccgctttcagccccatag

SEQ ID NO: 24696 - DNA, 1920 bp, Artificial Sequence
  Description of Artificial Sequence: Synthetic coding sequence
atggaccacctgcaccggggcgagctggtggccgccatcctgcggaaccgatccctggtggaggaagaggatcagcacatgaaactgtcccttggaggcagtgagatgggcctaagcagccatctgcagtcctctaaggccggcccaacacgtatctttacatccaacactcacagctcagtggttctgcaaggctttgatcaactgaggctggaagggcttctgtgtgacgtcaccttgatgcctggcgacaccgacgacgccttccccgttcaccgtgttatgatggcctctgcatccgactatttcaaggcgatgttcacagggggcatgaaggaacaagatttaatgtgcataaaacttcacggtgtcagtaaggtaggcctgagaaaaattattgattttatctacacagctaagctgtccctaaatatggacaatcttcaggacacccttgaagccgcatcctttctgcagatactgccagtgctggacttttgtaaagttttcctgatttctggagtgaccttggataattgtgtcgaggtaggaaggatcgccaatacctacaacttgactgaagtggataagtatgtgaatagctttgtgttgaaaaatttccccgctctgctctccactggagagtttctgaagcttccattcgagagactggcctttgtcctgtcaagcaatagcctgaaacattgcaccgaactggagctgtttaaagctacttgccgctggcttcgacttgaggagccgcgaatggatttcgcagccaagttaatgaagaacatccgctttcccctcatgacccctcaggagctaatcaactacgtgcaaacggtggactttatgcggactgataatacatgcgttaatttattgctggaagcatccaattatcaaatgatgccatatatgcaaccagttatgcagtctgataggacggctattcggtctgacactacacatttggttacactggggggagttttgcgacaacagttggtggtgtctaaggaactgaggatgtatgatgagaaagctcatgaatggaaaagccttgctcctatggacgccccccgctatcagcacggaatcgctgtcatcggaaatttcctgtacgtcgtgggcgggcaaagcaactatgacacaaaaggcaagaccgcagtcgataccgtgttcagattcgatccgaggtacaacaaatggatgcaggtcgcatctctaaatgagaagagaacgttcttccacctgagcgccttgaagggatatctctatgctgttggaggtcggaacgctgcgggagaactgccaactgttgagtgttataatccacgtactaacgagtggacctacgttgccaagatgtccgagcctcactatggacacgccggcactgtctatggcggagtgatgtatatctcaggtgggatcactcacgatacctttcaaaaggagctgatgtgttttgatcctgacacagacaaatggattcagaaagctcccatgacaaccgttcgggggcttcactgtatgtgtacagttggtgagaggctttatgttatcggtggtaaccactttcgtggaacatccgactatgacgacgtcctgtcttgcgagtattactcacctatcctagatcagtggacccctatcgccgctatgcttcgcgggcagagtgacgtgggagtggccgtgttcgaaaataagatatatgtcgtgggcggttattcatggaataatcgatgtatggtagaaattgtgcagaaatacgatccagacaaggacgaatggcacaaggtgttcgacctgcctgagtctctcggcgggatcagggcgtgtacactcaccgttttccctccggaagaaactacgccaagcccatcccgcgagagccctctatccgccccttag

SEQ ID NO: 24697 - DNA, 1842 bp, Artificial Sequence
  Description of Artificial Sequence: Synthetic coding sequence
atgaagctgagcctgggcggcagcgagatgggcctgagcagccacctccagagcagtaaggcagggccaacaaggattttcacttccaacacacacagctccgtggtgctgcagggtttcgatcagctgagactggagggactcttgtgtgacgtaaccctgatgcctggtgacaccgacgacgcctttccagtgcatcgggtgatgatggcatccgcctccgattattttaaagccatgtttacgggcgggatgaaggagcaggacctcatgtgcatcaaactgcatggggtgtctaaagtcggactccgcaagatcattgacttcatttataccgctaagctgtctctgaatatggataatcttcaggacaccctcgaggcggcctcctttctgcagatattacctgttctggacttttgcaaagtgtttctgatttccggagtcacactcgataattgcgtagaagttggcagaattgccaatacatacaatctgacagaggttgataaatacgtgaattccttcgtcctgaaaaacttccccgctttgctttcaaccggggaatttctgaagctaccttttgaaagattagcctttgttctgtcttccaactcactgaaacattgcactgaactggagctgttcaaagctacttgtagatggctacggctggaggagcccagaatggacttcgcggccaagctcatgaagaatatacggttccctctgatgactccccaggagcttatcaactatgtgcagactgtcgatttcatgaggacagacaacacttgtgttaacctactacttgaagctagcaattatcagatgatgccctacatgcagcctgtgatgcagtccgataggactgcaatccgatccgacactactcacttggttaccctgggaggggttctgagacaacagctggtggtgagtaaagagctgcggatgtatgacgagaaagctcacgaatggaagtcactggctcctatggacgcaccccgctaccagcatgggatcgcagttatcggcaattttttgtacgtcgtcggcgggcagtcaaactacgacacaaaggggaaaacagcagtggacaccgtgttcagattcgaccctagatataacaaatggatgcaggtcgcaagtttgaatgagaagaggaccttcttccatctgtcggcgctgaaaggctacttgtatgctgtgggaggccgcaatgcagccggagaactacccactgttgagtgttacaaccccagaaccaatgagtggacttacgtggcaaaaatgtccgagccacactacggacatgccggaactgtctacggtggcgtcatgtacataagtggcgggatcacacacgacacattccagaaggagctgatgtgcttcgaccctgatacagacaagtggatccagaaagcccccatgacaacggtgcggggactgcactgtatgtgcactgttggagagcgactgtacgtcataggcggcaaccacttcaggggtacctctgattacgatgacgtgctgagctgcgagtactatagtcctatccttgaccagtggacacccatcgccgccatgcttcgtggccagtcagacgtcggcgtagccgtttttgagaataagatttacgtcgttggcggctattcctggaacaatcggtgcatggttgagatcgtgcaaaagtacgaccccgacaaagacgagtggcacaaagtgttcgaccttcccgaaagccttggtggcatcagggcatgtacactgaccgtttttcctcctgaagagaccactcctagtccaagcagagaatctcccctgtccgccccatag

SEQ ID NO: 24698 - DNA, 1419 bp, Artificial Sequence
  Description of Artificial Sequence: Synthetic coding sequence
atgaccacctgcagccggcagttcaccagcagcagcagcatgaagggtagttgtggtattggcggtggcatcggggggggctctagcaggatctcctccgtgctcgcgggcgggtcctgtagagctccgagtacttacggaggggggctgagcgtcagctcgtcccgctttagcagtggcggagcctgcggactgggaggcggctacgggggtggtttcagtagcagttccagtagcttcggaagcggattcgggggaggatatggcggaggcctaggtgctggcttgggcggcggcttcggaggggggttcgccggcggagatggtctgctggtgggatcagagaaggtcaccatgcaaaatcttaacgaccggttggccagttacctggacaaggttcgagccttagaagaagctaatgctgatctggaggttaagatccgcgattggtaccagcggcagcgacctgcagagataaaagactacagcccttacttcaaaactatagaagacctgcgcaacaaaatcctaactgccacagtagacaatgcgaatgtgctgttacagatcgataacgcaaggttagctgccgatgatttccgcaccaaatacgaaaccgagctcaatcttcgcatgtctgtggaggcggacataaacggcctgagacgtgtcctggacgaactgactttagccagggctgatttggaaatgcaaattgagtcactgaaagaggagctagcctatctcaagaaaaaccacgaggaggaaatgaacgccctacggggtcaagtcgggggggacgtgaacgtggagatggacgcagcccccggcgtagatctctcaagaattcttaacgaaatgagagatcagtacgagaagatggctgaaaaaaacaggaaagacgccgaagagtggtttttcaccaagactgaggagctcaatagagaggttgccactaactcagagctggtgcagtcaggcaagagcgagatctccgaactgagacggactatgcaaaacctggagatcgagctgcaatctcagctttccatgaaagcctcgctcgagaactctctggaggaaacaaaaggacggtactgcatgcagctcgcccagatccaggaaatgatcgggtcagtcgaggaacaattagcacagctccgctgtgaaatggagcagcaaaaccaggaatacaaaattctcctggacgtgaagaccaggctggagcaggaaatagcaacctacagaagactcctggagggggaagatgcccatctgtcctcttcccagtttagctcagggtcacagtccagccgagacgtgacctccagctcccgccaaattcggaccaaggtgatggacgtacatgacggcaaagtggtgagcacacacgagcaggtgctacggaccaagaattag

SEQ ID NO: 24699 - DNA, 1293 bp, Artificial Sequence
  Description of Artificial Sequence: Synthetic coding sequence
atgagcttcaccacccggagcaccttcagcaccaactaccggagcctgggttccgtccaggctccatcctatggcgcgagacctgtttcttccgcagcgtcagtgtatgcgggcgccggcggatccggctcacgtattagtgtgtcaagatctacatcctttagaggcggaatggggagtggggggctggctactggcattgcaggcggactagcggggatgggaggtatccagaatgaaaaggagaccatgcaatcactaaacgacagactggccagttacctggatcgagttcggtccctcgaaacagagaaccggcgccttgagagcaaaatccgcgagcacctcgagaagaaaggccctcaagtgcgggactggtcccattactttaagatcattgaagatctgagggcacagatctttgcaaacaccgtagacaacgcaaggatcgtcctgcagatcgataacgcgcgactggccgcagatgattttcgagtaaaatatgaaaccgagcttgccatgcgccagtcagtcgagaacgacatccacggtctgagaaaagtgatcgacgatacaaacatcaccaggctgcagctggaaacggagatcgaagcccttaaggaggagctgttattcatgaagaaaaatcacgaagaagaggtcaaaggtctccaagcccagattgcttccagcgggctgacagtagaagtcgatgcacctaaaagtcaggacctggccaaaattatggcggacatccgagcacaatacgatgagctcgcgcgaaagaatcgggaggaactcgataaatattggagtcagcaaattgaagagtccacaactgtcgtcacgacccagtcagcagaggtgggcgcggccgaaaccactcttaccgagctgaggcggaccgtgcaatcactagagattgacctggatagtatgcgcaacctcaaggcttcactcgagaacagcctgagggaggtggaagctagatatgccctgcagatggagcaattaaatggaattcttctgcacttggagtctgagttggcccagactcgcgctgaaggccagcgccaagctcaggagtacgaggctctgctgaacataaaggtgaagctggaagcagaaattgccacttatcggcgcctgcttgaggacggcgaggattttaatctcggagacgcactggacagctctaattccatgcagaccatccagaagaccactacgaggcgcattgtcgatggtaaggtggtgagcgaaaccaacgacacaaaggtactgcggcattag

SEQ ID NO: 24700 - DNA, 1293 bp, Artificial Sequence
  Description of Artificial Sequence: Synthetic coding sequence
atgagcttcaccacccggagcaccttcagcaccaactaccggagcttggggtcagtacaagcccccagctacggtgcgagacctgtgagtagcgcggcatccgtttacgccggggcaggaggcagcggatccagaatctctgtgtctagatctacctcattccgaggtggcatgggatctggaggcctggctaccggtatcgctggtggactggctggaatgggagggatccaaaatgaaaaagagaccatgcagagcctaaatgatagactagcttcgtacctggatcgggttcgctctctcgagaccgaaaaccgacggttggagagcaagatacgcgagcatttagagaagaagggaccgcaagtgagagactggagccattatttcaagatcattgaggatctgcgggctcaaatctttgcaaacaccgtggacaacgctcgcatcgtactgcaaatcgataacgctagactggcggcagatgacttcagggtaaagtatgaaacggagctcgccatgcgacagtctgtggaaaacgacattcacggattgcggaaagtcatagatgacactaacattacccggctgcaactggagaccgaaatcgaagcgctgaaagaagaactgctgtttatgaagaaaaaccatgaagaggaggttaagggtcttcaggcccagattgcttcaagtggcctgacagttgaggttgatgcgccaaagtcccaggatctggcaaaaataatggcagacatccgagcacagtacgatgagctggctcgcaaaaatcgggaagagctcgacaagtattggtcccaacagatcgaggaatctacaaccgtggtcacaacccaaagcgcagaggtgggcgcagctgagaccacgctgacagagctccgacgcacggttcagtccctggagatagacctggacagcatgcgcaacctcaaggcttcactggagaattctcttcgcgaggttgaagcacgatacgcattacaaatggagcagctcaacgggattctgctgcatttagagtctgagctggctcagacgcgcgcggaggggcagagacaggctcaggagtatgaggccctgttgaatatcaaggtgaagctcgaagcagagatcgctacttataggaggttgctggaggacggtgaagacttcaatctgggagacgccctggatagttctaattctatgcagaccatccagaaaaccacaacaagaaggatcgtggatggcaaagttgtctccgagaccaacgatacgaaggtgttgagacactag

SEQ ID NO: 24701 - DNA, 1203 bp, Artificial Sequence
  Description of Artificial Sequence: Synthetic coding sequence
atgaccagctacagctaccggcagagcagcgccaccagcagcttcggtgggttagggggaggctccgtaagatttggccctggggtggcatttagggccccctccattcatgggggtagtggggggaggggcgtctcagtgagttccgccagattcgtgagctcttcgtcgtcaggcgcatacggcggcggttatggtggggtgctgaccgctagtgatgggttactggccggcaatgagaaactgaccatgcagaatttaaacgataggctcgcctcatacttggataaggtgagggccctagaggccgccaatggagaactggaagtcaaaattcgcgattggtaccagaagcagggccccggtccatccagggactacagtcactactataccaccatccaagaccttagagataaaattctgggggctacaatcgaaaactcgcggattgtattacagatagacaacgctcgccttgctgccgatgacttcagaaccaagttcgaaactgagcaggcactgcgaatgtcggttgaggctgacattaatggacttagaagagtccttgacgagttaactctcgcccgcaccgacttagagatgcagatcgaaggacttaaggaggaactcgcctacctgaaaaaaaatcacgaggaggagatatcaacactccgcggacaggtgggcggccaggtatcagtggaagtcgacagcgcgccgggaaccgacctagccaaaatcttgtctgatatgagatctcagtacgaggtcatggcagaacagaaccgcaaggacgccgaagcatggttcaccagccgcaccgaggaactcaaccgcgaagtcgcggggcatactgaacaactgcaaatgagtaggtcagaagtcacggatctccgcaggaccttacaggggctggagatcgagctgcagagccagctgtcgatgaaggccgctctggaggacaccctggctgaaaccgaagcgaggtttggtgcccaactggcacatatacaggcccttatttccggaatcgaggcgcagcttggcgacgtgagagcggattccgagcgccagaatcaggaataccagcggctcatggacatcaagagcaggctggagcaagagatcgccacatatcggagccttctagagggccaggaggaccattacaacaatctgtcggcgagcaaagttctctag

SEQ ID NO: 24702 - DNA, 591 bp, Artificial Sequence
  Description of Artificial Sequence: Synthetic coding sequence
atgaccagctacagctaccggcagagcagcgccaccagcagcttcggcggccttggtggggggtcagtgcgattcggtcctggtgtggctttcagagcacccagcattcatggtggtagcgggggcagaggcgtttcagtgtcctccgcacgttttgtgtcatccagctccagcggagcctacggcggaggctacggcggtgtgctgacagcctctgatggcctcctagcaggaaacgaaaaactgacaatgcaaaatctgaatgaccggcttgccagctatctggataaggttcgcgccctggaggcagctaacggcgaactggaaatcctgggcgctaccatcgaaaactcgagaatcgttctgcagattgataatgcccgactggctgccgacgactttcggacgaaatttgagaccgagcaggccctgcgtatgtcggtagaggccgatattaacggactccggagagtgctggatgagcttacccttgctcggaccgatctagagatgcagattgaaggactcaaggaggaactcgcttacttaaagaaaaaccacgaggaggagatctctacactaaggggatag

SEQ ID NO: 24703 - DNA, 1773 bp, Artificial Sequence
  Description of Artificial Sequence: Synthetic coding sequence
atgagccggcagagcagcgtgagcttccggagcggcggcagccggtccttctctactgcaagtgccattacacctagcgtcagtcgtaccagctttacctcggtctctcgctccggtgggggaggagggggaggctttgggcgtgtgtcactggcgggcgcatgtggggtcggcgggtatggcagcaggtccctctataatttgggggggtcgaaacggataagcatatctacttctgggggcagcttccggaaccggtttggcgctggtgctggaggtgggtatggatttgggggcggggccggcagcggtttcggtttcgggggcggggctggtggaggatttggtctgggcggcggagctggctttgggggcggcttcggcgggcctggcttcccagtctgcccacctggagggattcaggaggtcacagtgaaccagtccctcctgacacctttgaacctccagatcgacccatccatccagcgggtgaggacggaagaaagggagcagattaagactcttaataacaaatttgcctcattcatagataaggtgcggtttttggaacagcagaacaaggtgttggataccaagtggactctgctgcaggagcaaggaacaaaaacagtccggcagaatctcgagcccttgttcgagcagtacataaacaatttgcgacgacagctagatagtattgttggggaaaggggccggctagattctgaactccggaatatgcaggacctggtcgaagactttaagaataagtacgaggatgagattaataagcggacaaccgctgagaatgaattcgtgatgctgaagaaagatgttgatgctgcctacatgaacaaggtggaattggaggctaaagttgatgcactgatggatgagattaactttatgaaaatgtttttcgacgctgagctgagtcagatgcaaacacacgttagcgatacaagcgtggtcctgtctatggataacaatagaaacctcgacctggattctatcattgcagaggtgaaggctcagtatgaggagatcgccaaccgaagcaggaccgaagcagaatcgtggtaccagaccaaatacgaggaactccaacagaccgcaggccgccacggagatgacctcagaaatactaaacacgaaatctctgaaatgaaccgcatgatccagcgcctcagggctgaaattgacaatgtaaaaaaacaatgcgcgaacctgcagaacgcgattgcagacgccgagcagcggggagagctcgctttgaaggacgctcggaacaagctagcagaattggaggaggcactgcagaaagctaagcaggacatggcacggctgctccgggaatatcaggagctcatgaacaccaagttggctttagacgtcgaaatcgccacttacaggaaactgctggaaggagaggaatgtaggctctctggcgaaggagtggggcctgttaatattagtgtggtgacatcaagtgtatcatccggctacggatccgggtcaggctacggcggagggttggggggcggacttggcggaggtctgggcggcggcctcgccggcggatcttcaggctcttactattcatcatcatctggaggcgtgggcctgggcggtggactttccgtggggggcagtggattcagcgcctcctccggccgcggactgggagtgggctttggaagcggaggtgggagtagttcaagtgtgaagttcgtctcaaccacatcatccagcagaaagagtttcaaatcatag

SEQ ID NO: 24704 - DNA, 1668 bp, Artificial Sequence
  Description of Artificial Sequence: Synthetic coding sequence
atgagccggcagagcagcgtgagcttccggagcggcggcagccggtccttttctactgcatccgcgattacccccagtgtaagtcgcacatcgttcacttccgtgtctcggagtggtggggggggcggaggcggttttgggcgagtatccctcgcaggggcttgcggcgtgggggggtatggttttggtggtggcgccgggtccggtttcgggtttggcggaggggcgggcggagggttcgggctcggtggcggagccgggttcgggggaggctttggagggcctggttttccagtctgtccccccggcggcatccaagaagtcacagtgaatcagagtctccttacccccctgaacctgcagatagatccctccatccagagagttcgaacagaggaacgggagcaaatcaaaaccttaaataataagttcgcatccttcattgataaggtccggtttttagagcagcaaaataaagtcctggatacaaagtggacacttctccaggaacagggtactaagacagtgagacagaacctcgagccactgttcgaacagtatatcaacaacttgagaagacaactggattcaatcgtaggcgagagggggcggttggatagcgagctccgaaacatgcaggatttagtggaagactttaagaacaagtacgaggatgagatcaataagagaacaaccgcggagaatgagtttgtcatgcttaaaaaggacgtggacgccgcttacatgaacaaggtggaactggaggctaaggtggatgctctcatggacgagattaactttatgaaaatgtttttcgacgctgagctgtcccagatgcagacacacgtgtccgatacatctgttgtgctgagcatggacaacaacagaaacctggatctggattctattatagccgaggtgaaggcccagtacgaagagatcgccaatagaagtcggaccgaggccgagtcatggtaccagaccaaatacgaggagcttcagcaaacggcaggtcgccacggggatgacttgaggaatacgaaacatgagatcagcgaaatgaaccgcatgattcaaagattgcgcgctgagatcgacaatgtcaaaaagcagtgcgcaaacctgcagaacgccatcgcagatgcagagcagaggggagaactggctcttaaagacgctcgaaacaaattagcagagctcgaagaagccctccagaaggctaagcaggacatggcccgcctccttcgggaataccaagagttgatgaatacaaagctggctctggatgtcgagatcgcaacctaccggaagctgctggaaggcgaagagtgccggctaagcggggaaggagtgggacccgtgaatatatctgttgtgacctcctccgtgtcttctgggtatggatctgggtcaggctacggcggcggactgggcggaggattgggcggcggactgggaggagggctcgctggcggatctagcgggagttattattcttcctcctctgggggggtggggctcggcggagggttgtccgtgggcggttctggcttcagcgccagctctgggagaggcctgggtgtcggattcggttctggaggcggcagtagtagcagtgtgaaattcgtgagcactacaagctctagccggaagagctttaagagctag

SEQ ID NO: 24705 - DNA, 399 bp, Artificial Sequence
  Description of Artificial Sequence: Synthetic coding sequence
atgagccggcagagcagcgtgagcttccggagcggcggcagccggagcttttccaccgcctctgccatcaccccttccgtttctcgcacatcgtttacctccgttagtagaagcggtggaggcggcggtggcggcttcggacgggtgtctcttgctggcgcctgtggtgtagggggctacggctccagatctctgtataatctcgggggctctaagagaattagtatctccacatctggtggctcgtttcgaaaccggttcggagcgggcgctggcggcggctacggcttcgggggtggggccggttccgggttcggctttggaggaggggcagggggcgggtttggccttgggggcggggccggcttcggaggaggtttcggagggccaggtttctag

SEQ ID NO: 24706 - DNA, 1410 bp, Artificial Sequence
  Description of Artificial Sequence: Synthetic coding sequence
atgagcatccacttcagcagccccgtgttcaccagccggagcgccgccttcagcgggagaggagcacaggtccggctcagctcagccagacccggagggctgggttctagctcactgtatggacttggcgcatctcgccccagggtggccgtgagatccgcttacgggggccctgttggtgcgggtatacgtgaggtaaccataaatcagagtcttctagcgccgctgcgtctcgatgccgatccttccttgcagcgggttagacaggaagagagcgagcagataaaaacactcaataacaagttcgcttcttttatcgataaggtgcggtttctcgagcagcaaaataaactcctagagaccaaatggacactgctccaagagcagaaaagcgctaagagctcccgcctgccagacatattcgaagcccagattgccgggctgagaggccaacttgaggccctccaagtggatggcggtcgactggaggccgagcttcgatctatgcaggatgtggtcgaagatttcaagaataagtacgaagatgagatcaatcataggaccgcggccgaaaacgaattcgtggtgctgaaaaaagatgtagacgcggcgtatatgagtaaagtggagcttgaggccaaagtcgatgcgctgaatgatgaaataaatttcttgcggacactgaatgagactgaacttaccgaactccagtctcagataagcgatacgtctgtagtactgtccatggacaatagcaggagtttagacctggacggaattattgccgaagtgaaggcccagtatgaagaaatggccaagtgtagtagagcagaggccgaagcctggtaccagacaaaattcgaaacactgcaagctcaggccggaaagcacggagatgacctacggaacaccaggaacgagatcagcgaaatgaatcgtgctatccagagattacaagctgaaatcgacaacattaagaatcagagagcaaagctggaggctgcgatcgcggaggctgaagagaggggagaacttgccctaaaagacgccagagcaaaacaggaggagctcgaagctgctctgcagaggggcaagcaggacatggcacgtcagctgcgagaataccaggagctcatgtctgtgaagcttgctttggacatcgaaatagctacctaccgaaagcttctggagggcgaggaatccaggcttgcaggggacggtgttggtgctgttaatatttcagtgatgaatagcacaggcgggtctagttctggaggtggaattggcctgacccttggcggaacgatggggagcaacgccctgtcatttagctcctccgccggccccgggcttctgaaggcctactcaattaggaccgcctctgccagccggcgatctgctagggactag

SEQ ID NO: 24707 - DNA, 1338 bp, Artificial Sequence
  Description of Artificial Sequence: Synthetic coding sequence
atgagcatccacttcagcagccccgtgttcaccagccggagcgccgcctttagcgggaggggggcccaagtcaggctctcttctgcccgccctgggggcctgggcagctcatcactgtatggcctgggagccagccggccacgggtcgcccctctccgccttgacgctgatccaagtctacagagggtcaggcaggaggaaagcgagcaaataaaaaccctcaataataagtttgcatcttttatcgataaagtccgcttccttgaacagcagaataaattgctggagaccaagtggacattgttacaggagcagaaatccgccaaatccagtcggttgcctgacatcttcgaagcccagattgccggactgcgcggccaactggaagccttacaagtggacggcggccgattggaagcagagttgagatcaatgcaagacgtggtggaagactttaagaatcgctacgaagatgaaatcaaccacagaacagctgcagagaatgagttcgtggtcctgaaaaaagatgtggatgccgcatacatgagcaaagttgagctggaggcgaaagtggacgccctgaacgacgagatcaattttctaagaactttaaatgaaaccgaactcactgaacttcaatcacagatctccgacacaagcgtggtgctgtcaatggataactccaggtccctggatttagacggaatcatcgcggaggttaaggcgcagtatgaggaaatggctaagtgctcacgcgcggaggcagaggcctggtaccagaccaagtttgaaacattgcaagcacaggcaggcaaacacggcgacgacctgagaaatactcgtaatgagatcagcgagatgaatcgagccattcagcgactgcaggcagaaatagacaacattaaaaatcagagggcaaaattggaggcggcgattgccgaggccgaggagagaggagaattagccctgaaggacgcccgggcgaaacaggaagagctggaggccgccctgcaacgaggcaagcaggacatggccaggcagttgcgcgagtaccaggagctgatgagcgtgaaactagccctcgatattgaaatcgcaacttatcgtaagctgctggaaggagaagagtctcgcctggcaggcgacggggttggtgccgtgaatataagtgtcatgaattctactggcggcagttcctccgggggtggaattggcctgacccttggtggcactatgggctccaatgcgctgagcttttctagttccgctgggcctgggctgttgaaggcctatagtattcgcaccgcgagcgcctcaagaaggagcgctagggactag

SEQ ID NO: 24708 - DNA, 1212 bp, Artificial Sequence
  Description of Artificial Sequence: Synthetic coding sequence
atgagcatccacttcagcagccccgtgttcaccagccggagcgccgccttttccggtagaggcgcccaggttcgcttatccagcgcacggccaggcggattaggaagctcatctctctacgggcttggcgcgtcaaggcccagagttgctgttagatcagcgtacgggggccctgtgggggctggcatcagagaggtgactatcaaccagtccctcctggctcctctgcgccttgacgcagaccctagtctacagcgcgtgcgccaggaagagtccgagcagattaagacacttaataataaattcgccagcttcatcgataaagttagattcttagagcaacagaataagctgctggaaactaagtggacgttactccaggagcaaaagtcggcaaagtccagtcgtttgccggacatcttcgaggcccagatagccgggttgcgaggtcagttggaggctcttcaggtagacggaggtagactcgaggccgagttgcggtccatgcaggatgttgtggaagattttaagaacaagtatgaggatgaaattaaccatcggaccgctgcggaaaacgaattcgtcgtactgaaaaaggacgtggatgcagcctacatgtctaaggtggaactggaagctaaggtcgacgcactcaatgatgagattaacttccttaggaccctcaatgaaacagaaattcacgtgttgcaatcccacatctcagatactagcgtggtggtgaagttggacaatagccaggatctgaacatggattgcatcatagctgagataaaagcacaatacgatgatatcgtgacatgttcctgggccaaggcagagagctggtaccacggatgtctggagatgaaagctacagttatttggcacggagagaccgttggttgcacaaaggaagagatcaaggaactgactcacatgattcagcggctaatggctaaagtggaaaatgcaaaatgtcagaactcaaaactggaggtcgaagtgacgcaatccgaacagcagggcgaggtggcgctgtcggataacagatgcaagctagttgaactggagggaacaatgcagaaggccaggcagtatcaagaagtgatgaattcaaagcttgggctgaacgtcaaagccgcaagctcttgccacttgctggacggggaagagcaacgactgtgcgatggcatctccgcagtgaatatatag

SEQ ID NO: 24709 - DNA, 1452 bp, Artificial Sequence
  Description of Artificial Sequence: Synthetic coding sequence
atgagcatccgggtgacccagaagagctacaaggtgagcaccagcgggcctcgtgccttctcctcccgatcatacaccagcgggcccggaagcagaatttcaagttcatcatttagtcgcgtggggtcatcaaatttcaggggcgggctggggggcggatatgggggggcctctgggatggggggcataaccgccgtgaccgtgaatcagtctctgttatccccactggtcttagaagttgatcctaacatacaagccgtgcggacacaggagaaggagcagatcaaaacactcaacaataaatttgcttccttcattgacaaagttcgctttttggagcagcagaataaaatgctggagacaaaatggagtctactccagcaacagaagaccgcgaggtcaaatatggacaatatgttcgagtcatacatcaacaatctgagacggcagctagagacactcgggcaggagaagttgaaattagaagccgagctgggaaatatgcagggcctggttgaggatttcaaaaacaagtacgaagatgagattaacaagagaactgaaatggaaaacgagttcgttttgatcaaaaaggatgttgatgaggcctacatgaacaaggtcgagctggagagtcgactcgagggactaacggacgagattaatttcctacgacagttgtacgaagaggagatccgggaactgcagagtcagattagcgacacctcagttgtgttaagtatggacaactccagaagcttagatatggacagtatcatcgctgaggtaaaagcccagtatgaggatatcgctaataggtcacgcgcggaggctgagagcatgtatcagatcaagtatgaggagctgcagtctctcgcaggaaaacacggggatgacctgagacgcacaaaaacagaaatatcagaaatgaaccgaaacattagtcgcttgcaagcagagattgaagggctgaaggggcaaagggcaagtttggaggccgccatcgccgacgcggaacagcgcggtgagctcgcaatcaaggatgctaatgctaagctgagtgaactagaagccgctctacagcgggctaagcaagacatggctcgccagttgcgcgaatatcaagaacttatgaacgtgaagctcgcattggatatcgagatcgctacttataggaaactgctggagggggaagagagtcgcctcgaatccgggatgcagaacatgtctattcatacaaaaactaccagtggatatgctggaggcctgtcttctgcttatggcggcttgacgtcccccggattatcttattcacttggttcttcatttggctccggagcagggagctcttcatttagcagaacttcttcctctagagcagtcgtggtaaaaaagatcgaaacccgtgacggcaaactggtctctgagagctcagacgtgcttccgaagtag

SEQ ID NO: 24710 - DNA, 822 bp, Artificial Sequence
  Description of Artificial Sequence: Synthetic coding sequence
atgagcatccgggtgacccagaagagctacaaggtgagcaccagcggacccagggccttctcatccagatcatacacctccggtcccggatcccggatttctagcagcagtttttccagggtcggttcgtccaatttcagaggaggcctcggcgggggatatgggggcgcttctgggatgggcggaatcacagccgtgaccgttaaccagtccctgctgtccccgctagtcctcgaagtcgatcctaatattcaggcggttaggacacaggagaaggaacagataaagaccctgaataacaaatttgcctcctttattgataaagtgaggttcctcgagcagcagaataaaatgctggagaccaaatggtccctactgcaacagcaaaaaaccgcccgtagcaacatggacaatatgtttgagtcttacataaacaatttacggcgccagctggagaccttgggccaggagaaacttaaactggaggcagagctcggcaatatgcaagggctcgtagaggattttaaaaataaatacgaggacgagatcaataagcggacagaaatggagaatgaattcgtgctgattaagaaagacgtggacgaggcatacatgaataaggttgagctggaatcccgactggaaggactgactgatgagattaatttcctccggcagctgtacgaggaagaaatcagagagctccagagccaaatttcggacacaagcgtcgtgctgtcgatggataatagtagatctctggatatggactcaatcatcgctgaggttaaagcacaatacgaagacatcgcaaacaggtag

SEQ ID NO: 24711 - DNA, 1452 bp, Artificial Sequence
  Description of Artificial Sequence: Synthetic coding sequence
atgagcatccgggtgacccagaagagctacaaggtgagcaccagcggccctcgcgcgttcagctccaggtcttacacctcaggcccaggaagccgaatttcgtcctcctccttctcccgggtaggctcttcaaatttcaggggtggcctcggtggcggctacggcggcgcgtcgggtatgggagggattaccgccgtgacagtgaatcagtctcttctttcacctttagtgctggaggttgatcctaacattcaggcagtgcgaactcaggagaaggagcagataaaaacactcaacaacaagttcgccagtttcattgataaggtcagatttctggagcaacaaaacaagatgcttgaaacaaaatggtcactcctccagcagcaaaagacagcaagaagcaatatggacaacatgtttgaatcctacatcaataatttacgccgccagttggagactctggggcaagagaaattgaaactcgaggcggagctggggaacatgcagggtctagtggaggactttaaaaataagtatgaggatgaaattaataagcgaaccgaaatggaaaacgaattcgttctgatcaagaaagacgtggatgaagcatatatgaataaggtggagctggaatcacggctcgaaggtttaacagacgagattaattttctgcggcagctgtacgaggaggagattcgcgagttgcagtcgcagattagcgataccagcgttgtattgtcaatggacaacagtcgcagcctcgacatggactctattattgctgaggtcaaagctcagtacgaagacatcgctaatcgctcccgtgccgaagccgagtctatgtaccagatcaaatacgaagagttacagtcattggctgggaagcacggtgacgatttgcgccgtactaagactgaaatctcagagatgaaccggaatatttcacgtctccaagctgaaattgagggcctaaaggggcagagagccagccttgaagccgcaatagcagatgccgagcagcgcggtgaactagccattaaggacgcgaacgcaaaactatcagaattagaagccgctctccagcgggcaaagcaggacatggccaggcagcttcgcgagtatcaagagctgatgaatgtcaagctggccctggatatcgagatcgctacatacaggaaacttctggagggcgaagagtcccggttggaaagcgggatgcagaatatgtccatccacacaaagaccacctctggctacgctggagggctctctagcgcttacggcggtctgacctcgcctggactgagctactcactcgggtcctcctttggttccggcgctggtagttcaagcttttcccgcacctcatcatctcgcgcggtggtggtcaaaaagatagaaacgagggacggcaagttggttagtgagtcaagcgacgtcctccctaagtag

SEQ ID NO: 24712 - DNA, 534 bp, Artificial Sequence
  Description of Artificial Sequence: Synthetic coding sequence
atgagcatccgggtgacccagaagagctacaaggtgagcaccagcggcccaagagcatttagtagccgcagttatacaagtggtcccgggtcccgcatcagtagtagtagcttttcgcgggtgggcagtagtaatttcagagggggactgggcggggggtatggtggtgcttccggaatgggggggattaccgctgtcacagtcaaccagagtctgctgtctcccttggtgttagaggtagaccccaacatccaggccgtgcggacgcaggaaaaggagcagattaagaccctgaacaataaattcgccagtttcatcgacaaagtcagatttctcgagcagcaaaataaaatgcttgagacaaagtggagtcttctccagcagcagaagactgccaggagcaacatggataatatgttcgagagctatataaacaacctgagaaggcagctggagactctcggtcaggagaaactgaaactcgaggccgagcttggcaacatgcagggactcgttgaggatttcaagaattag

SEQ ID NO: 24713 - DNA, 1536 bp, Artificial Sequence
  Description of Artificial Sequence: Synthetic coding sequence
atgaacggcgtgagctggagccaggacctgcaggagggcatcagcgcatggttcggaccacccgcctctactccagcttcaactatgtcaatccgcgtcactcagaagagttacaaagtgagcacctcaggtccccgcgctttctcctctagatcctacacctccggcccaggttcaaggatcagtagttcaagcttcagccgtgtcggctccagcaacttcagaggagggcttggggggggatacgggggggcgagcggcatgggtgggataaccgctgtgacggtcaatcaatctctccttagtcccctggtgctggaagtggaccctaacatccaggctgtgaggacacaagaaaaggagcagatcaaaacgttgaataacaaattcgcatccttcatcgacaaggttagatttttagagcagcagaataagatgctcgagacaaagtggagccttctgcagcagcaaaagacggctcggtcaaacatggataacatgttcgaatcctatataaataatctcagaagacagctggaaacacttggacaggaaaaattgaagctggaagctgagctgggcaatatgcagggtctagtggaagacttcaagaacaaatatgaagacgagatcaacaagcgaacagagatggagaacgaatttgttctgatcaaaaaagacgttgatgaagcctacatgaataaagtggagttagaatcgcgtttggaaggcctcacagatgaaatcaactttctgagacagctctatgaggaggagatccgagaactgcagagtcaaatctctgacactagcgttgttttaagcatggataattcacgctctctcgacatggatagcattattgcggaggttaaggctcagtacgaagatatcgcgaataggtcaagagcggaagccgagtccatgtaccagatcaagtacgaagagctgcagtctctcgctgggaagcatggagacgacctgaggagaaccaaaacagaaatttccgaaatgaacagaaatatctcccgacttcaggccgaaattgaaggcctgaaaggccagcgcgccagcttggaggctgctattgccgatgcagagcaacggggcgagctcgcaataaaagacgccaacgccaaactgtctgagctggaggccgcgctgcagagggccaagcaagacatggcacgacaactccgagaataccaggagctgatgaacgtcaagcttgccctggacatagaaattgcgacttacagaaagttactcgagggggaggagtcaagactggaaagtggaatgcaaaacatgtctattcacacaaaaactacctctggctatgctgggggcctttcatcagcttacggcggcctgacctctcccggtttgtcctacagcctgggatcctctttcggatccggcgcaggctcatcttcattctctcgcacttctagcagcagggccgttgtggtgaaaaaaattgagacaagggatggaaagctcgtgtcggagagctctgacgtcctgcctaaatag

SEQ ID NO: 24714 - DNA, 1452 bp, Artificial Sequence
  Description of Artificial Sequence: Synthetic coding sequence
atgagcatccgggtgacccagaagagctacaaggtgagcaccagcggcccccgcgccttcagctctcggtcatatacctctggtccgggtagccggatcagctctagttccttttccagggtggggtccagtaacttccgggggggactagggggcggatatggcggcgcgagtgggatgggcgggattactgcagtgaccgtcaatcagtcgctgctctcccccctggtgttagaggtagatcctaatatacaagccgtaagaactcaagagaaagagcagattaaaacactgaataataagtttgctagcttcatcgacaaggtccgcttcctggagcaacagaacaaaatgctggagacaaaatggtccttgttgcagcagcagaagaccgctaggtctaacatggataacatgttcgagtcgtatattaacaacctcaggaggcagctggaaacactggggcaggagaaacttaagctggaggcagagctgggcaacatgcaggggttggtggaggattttaagaataaatacgaggatgagattaataagaggaccgaaatggagaacgaattcgtgctgattaaaaaagatgttgacgaggcttacatgaacaaggtcgaactggaatcccgcctcgaaggccttactgacgagataaatttcctccggcagctctatgaagaggagattagggaactacagtcacagatctccgacacatccgtggtgctgtccatggataattctagaagcctggatatggactccatcatcgcagaggtgaaggcccagtatgaggatatcgccaaccgtagccgggcagaggctgaatctatgtaccagatcaaatacgaggagctacaaagtctagcagggaagcacggtgatgacctgcgtaggacgaagactgagatctcggagatgaataggaatatcagccgcctccaggctgagatagagggattaaaaggacagagggccagcctggaggcagccattgctgatgccgaacagaggggtgaactggcaatcaaagacgctaatgcgaagctgtcagaactcgaggccgccttgcagcgcgctaaacaggacatggcccgccagttgcgtgagtatcaggaattgatgaacgtgaagctggctttggacatcgagattgcaacttaccgcaaacttctagagggcgaagaatctagacttgaatcaggcatgcagaatatgagtatccacaccaaaaccacttctggatatgcaggtgggctgagtagtgcctacggaggccttacctcaccaggcctgagttattccctcggatccagctttgggagcggtgccggatcgtctagttttagtaggactagctcatcacgcgcggtggtggtgaagaagatcgaaaccagggacggcaagctggtttccgaatcctcagacgtgctccctaagtag

SEQ ID NO: 24715 - DNA, 4071 bp, Artificial Sequence
  Description of Artificial Sequence: Synthetic coding sequence
atgcagagcaaggtgctgctggccgtggccctgtggctgtgcgtggaaacaagagcggcttccgttggcctcccaagtgtgagtctcgacctgcccaggctgtccatccaaaaggacattctgactatcaaggccaacacaactctccaaatcacgtgtcgaggacaacgtgatctagactggctgtggcccaataaccagagcggctccgaacagagggtggaagtgactgaatgcagcgacggattgttctgcaaaaccctgactatcccgaaggtaattgggaatgataccggggcatacaaatgtttctaccgcgaaacggatttggcaagtgtgatatatgtctacgttcaagactaccgctctccttttatcgcctctgtgtccgatcaacatggggtggtttacattactgaaaacaaaaataaaacagtcgtgattccatgcttggggtcgatatccaacctgaatgtgtccctgtgtgctcgataccctgaaaagagatttgtgccagacgggaaccggatctcctgggatagtaagaaaggttttacaatccccagttacatgatctcatacgcagggatggtgttctgcgaagcaaagattaacgacgaatcttatcaatcaattatgtatatagtcgtcgtggtgggctatcggatctacgacgtagtgctctctccaagtcacggaattgaattatcggtaggagagaagctcgtgcttaattgtacagccaggacggaattgaacgtgggaatcgattttaactgggaatacccctctagcaaacaccagcacaaaaagctggtgaatagagacctgaagacacagagtggatcggaaatgaaaaaattcctgagcaccctcactatagacggcgtgactcgcagcgaccaaggtctctacacctgtgccgcgtcttccgggcttatgaccaagaagaatagcacatttgtgagagtgcatgaaaaaccgttcgtcgcttttgggagcgggatggagagcctcgttgaggccaccgtgggcgaaagggttaggatcccagcaaagtatttagggtaccccccccccgaaattaaatggtacaagaacggcatcccactcgaatctaatcatacaataaaagccgggcatgtgctgactatcatggaagtgtctgagagggacactggtaactacactgttatcctgacaaaccccatctctaaggagaagcaatctcacgtggtctccttggtagtgtacgtgcctcctcaaatcggagagaaatcactgatctctccggtggactcgtaccagtacgggaccactcagacacttacctgcaccgtttatgccataccacccccacatcacatacattggtactggcagctcgaggaagagtgcgctaatgaaccaagtcaggctgtgtccgtgaccaatccttacccatgtgaagagtggcggagcgtggaggattttcagggtggtaataaaatagaagtgaataagaaccagtttgctttgattgagggaaagaataagaccgtctccacactggtgattcaggctgcaaatgtatccgcactgtacaaatgcgaagctgttaacaaggtaggacgcggcgaacgggtgatcagttttcatgtgacaagaggtccagaaattacacttcagcctgatatgcaacccactgagcaggaaagcgtctcactgtggtgtaccgccgatcgcagcacattcgagaatctgacttggtataagttaggaccccagccattaccaattcacgtcggagagcttcccacgcccgtgtgtaaaaacctcgacacgctatggaagcttaatgccacaatgttttccaacagtactaacgatatcctcataatggagttgaaaaacgcgtcgctgcaagaccaaggggactatgtctgtctggcacaagaccggaagaccaagaaaagacattgcgtggtccggcagctaacagtgctggagcgcgtcgctcccacaattacggggaacctggagaaccagacaacatcgattggcgagagcatagaagtatcctgcactgcctctggtaatccaccaccccagattatgtggttcaaggataacgagaccttggttgaggatagcgggatcgtgttgaaggatggcaatcgaaaccttacaatcaggcgagtccgaaaagaggacgagggcctttacacctgccaggcctgctccgtcctgggctgtgctaaagtcgaggccttcttcataatcgagggtgcacaggaaaaaactaatctggaaattattatcctggtaggaaccgccgtgattgcgatgttcttctggttactcctggtaataattctccggactgtgaagcgggccaacggtggagagttaaagacaggatacctctctatcgtcatggaccctgatgaactgccgttagacgagcactgcgaaagattgccctacgacgcttccaaatgggaatttccgagagacaggctcaagttaggaaagcctttaggcaggggggcttttggacaggtgattgaggccgacgcatttggaatcgataagactgctacctgccgaactgtcgccgtcaagatgttgaaagaaggggccacacactctgaacacagagcattaatgtccgagctcaagatcttgatacatatcggtcaccatttgaacgtggtcaacttgttaggtgcttgcaccaaacccggagggcctcttatggtcatcgtagagttctgcaaatttggaaacctgagcacttacctccggtctaaaaggaatgaattcgtaccctacaagacaaaaggggcccgcttcaggcagggtaaagactacgtgggggccatccccgtggacctgaagcgacgccttgactccatcaccagcagtcaaagttcggcgagttctgggttcgttgaagagaaatccctgtcagacgtagaggaagaggaagcccccgaagacctctataaagatttcctaacccttgagcatttaatatgttatagcttccaagtggcgaagggaatggagtttctggcctctcgcaaatgtatccaccgcgacttggcggcgcggaacatattgctgtccgagaagaacgttgtgaaaatatgtgatttcggactggctcgcgatatctataaggaccccgactacgtacggaagggagacgcccgtctgcccttgaagtggatggccccagagaccatttttgatcgcgtgtatactattcagagcgacgtctggagcttcggagtactgttgtgggaaatcttctctctgggagcctcaccctatcccggcgtgaagatcgacgaagaattttgtaggcgattgaaggaaggcaccaggatgcgcgcccccgactacaccactccagaaatgtatcagaccatgttagattgttggcacggagaaccatcccagagaccgacattctccgagctggtggaacacctgggaaacctcctgcaagccaatgctcaacaagacggtaaagattacattgtccttccgatttcggaaacactgtccatggaagaggacagcggcctgagcctgccaacgtccccagtgtcctgtatggaagaagaggaagtctgcgatccgaaattccattacgataatactgccggaatctcacagtacctgcagaattccaaacgaaagtcccgtcctgtctccgtgaaaactttcgaggacattcccctcgaagagccagaagtcaaggtgataccagacgacaatcagactgatagcgggatggttttggcttccgaggaactgaagacactcgaagatcggaccaagttgtccccatcttttggcggcatggttcctagcaagtctagagagtcagttgcttccgaggggagcaaccaaacatctggctaccaatccggttatcactccgacgacacggatactacggtgtattctagtgaggaagcggagctgttgaagcttattgaaataggcgttcagacaggctcgaccgcacagattttgcagcctgacagcgggacaacccttagcagtccccctgtgtag

SEQ ID NO: 24716 - DNA, 6630 bp, Artificial Sequence
  Description of Artificial Sequence: Synthetic coding sequence
atgtggaacgacatcgagctgctgaccaacgacgacaccggcagcggttatctgagtgtaggttctcgcaaagaacatgggactgccctttaccaagttgatttattggtcaagatcagcagtgagaaggcctcactcaaccctaaaatacaggcgtgttcactgtctgatggctttattatcgtagcagaccaatcagtgatcttgctggactccatttgtaggtccctgcagctacatttagtgttcgacacagaggtcgacgtggtgggactgtgccaggaaggcaagttcctgcttgtaggcgagagatccgggaatctacacctgattcacgtgacctcaaagcagaccctcctgaccaatgcctttgtgcagaaggccaacgatgaaaatcgccgcacataccagaatcttgtcatcgaaaaagacgggtcgaacgaaggcacctattacatgttgttactgacttacagcgggtttttttgcattactaacttgcagctgctgaaaattcagcaggcgatcgaaaacgtggacttttcaactgctaagaagctgcaggggcaaatcaaaagttcttttatatcgaccgaaaactaccataccctgggctgtttgtcactggtggctggggacctcgcatcggaagtccctgtcataattgggggtaccggcaattgtgccttctcaaaatgggagccagacagctcaaagaaaggaatgaccgtcaagaatttgattgacgccgagatcataaagggtgcaaagaaatttcagctcattgacaacttacttttcgtgctggataccgacaatgttctatctctgtgggatatttatacactcaccccagtctggaactggccaagtctgcatgttgaagagttcctgctgactacggaagccgactccccatcctcagtcacatggcaaggcattacgaatttaaagctgatcgccctgaccgcctccgctaacaaaaagatgaagaatctcatggtgtactcactcccgaccatggagattctctactctctcgaggtgtccagcgtatcctctctcgttcagacagggatttccactgacactatttatcttctagagggcgtgtgtaaaaatgatccgaagttgtccgaagactcagttagtgtcctggtccttcggtgcctgacagaggccctcccagagaaccggctgtctcggcttctgcataagcatagatttgccgaggccgaaagctttgcgatacagttcggcctcgatgtcgagcttgtatataaagtgaagtctaaccacattctggaaaagctggcactctcctccgtggacgcaagtgaacagacagagtggcagcaactggtggatgatgcgaaagagaacctccacaaaatacaggatgacgagtttgtagttaattattgcttgaaggcccaatggatcacatacgagacaacccaggagatgttgaactatgccaagaccaggctgcttaagaaggaagacaagacagccctcatttattcagacggactaaaggaggtgcttcgggctcatgcaaaattgacaactttctatggggcatttgggcctgaaaagttctctggcagctcctggatcgaattcctcaacaatgaagacgacctaaaggatatatttctgcaactgaaagagggtaacctggtgtgcgcacaatacctctggctccgacatcgcgccaatttcgaatccagattcgacgttaagatgctcgagtcccttttaaacagtatgtctgccagcgtgtctctccagaagttatgcccatggtttaaaaacgacgtgattccgtttgtgaggcgcactgtccccgaaggacagattattttagcaaaatggctcgagcaggcagccagaaatctggagctgacagacaaggctaactggcctgagaacggccttcagctggctgagatctttttcacagctgaaaagaccgacgagcttggcctcgcaagcagctggcactggatatcactcaaggactaccagaatactgaggaagtttgccagttaaggactttggtaaataatctgcgtgagctaatcactctgcatagaaagtataactgtaagctcgctctgtccgactttgagaaggagaacaccaccacgatcgttttccgaatgttcgacaaagtactggccccagaactaattccctccatcctcgaaaaatttatcagggtgtacatgagagaacatgacctccaggaagaagagttgctgttgctgtatatcgaagacttacttaataggtgttctagcaaatctactagcctgtttgagactgcctgggaagccaaggctatggcagtgattgcgtgcctctcggacactgaccttatattcgatgccgtactgaagattatgtatgctgccgtggttccctggtccgccgcagtggagcaactggttaaacagcatctggagatggatcatccgaaggttaagctcctgcaagagagttacaaattgatggagatgaagaagttgctgcgcggttatggcatacgtgaagtgaaccttctcaataaggagatcatgcgggtcgtccgctacatcctaaagcaggatgttcctagctcactggaggacgctctgaaagtcgcgcaggctttcatgctgtctgatgacgagatttatagtctacgcattattgatctcattgacagagaacagggcgaggattgcctgctcctgttgaagtcccttccccccgcagaagccgaaaagacagctgagagggtcatcatctgggcccgcctcgcgctgcaggaagagccagatcacagcaaggaaggtaaggcttggcggatgtctgtggccaaaacaagcgtggacatactcaaaattctatgcgacattcagaaggacaacttacaaaaaaaagacgaatgtgaggagatgttgaagttgttcaaagaggtcgccagtctccaggaaaacttcgaggtctttttaagttttgaggactactccaactcctccctggtcgccgacctccgcgagcagcacatcaaggctcacgaggtcgcccaggccaaacacaaacctggctccactcctgaacccatcgcagccgaggtaagaagccctagtatggagagcaagctgcaccgacaggccttggcccttcagatgtcaaaacaggagctggaagccgagctgacattgagggcactgaaggacggaaatatcaagacggcccttaaaaaatgttctgacctgttcaaataccattgcaacgctgacactggaaagctgctgttccttacttgtcaaaagctctgccagatgctcgccgataatgtccctgtgaccgtgcccgttgggctcaatttgccttccatgattcacgacttggcttcccaggctgccaccatctgttcccctgatttcctgttggacgccctggagctctgcaagcataccctgatggctgtagagttgtcccgtcaatgtcaaatggatgactgcggaatcctgatgaaagcctccttcgggacacataaggacccctacgaggagtggagttactccgatttcttcagtgaggatgggatcgttcttgagagccagatggttctgcccgtgatctatgaactaattagttctctggttccgctggctgaatcaaagcgttatccactggagtctacttcattaccctattgctcgctcaacgagggcgatggcctcgtactaccagtgatcaactctatctcggccctcctccaaaacctgcaggagtcctcacaatgggaactggctctccgcttcgtagtggggtcatttggcacctgtcttcagcatagcgtgtccaatttcatgaatgctaccttgtccgagaaactgttcggcgagacaaccctcgtgaaaagccgccacgtggttatggaacttaaggagaaggctgtcatattcatacgggagaatgccacaaccctattgcacaaggtatttaactgtaggctagttgatctcgatctggccttggggtactgcaccttactcccacagaaggacgtctttgaaaatctctggaaactgatcgataaagcatggcagaattacgacaagattctcgcgatcagcctcgtggggtcagaactggcctccctgtaccaagaaatcgagatgggactgaagttcagggaattgagcaccgatgcccagtgggggatccggttgggaaagttagggatttctttccagccagtctttagacagcatttcctgacaaagaaagatctgatcaaggccctggttgaaaatatcgatatggacaccagtctgatcctggaatactgctctacattccaacttgattgtgacgcggtgctgcaattgttcattgagaccctgctccataatacgaacgcaggacaggggcagggcgacgcgtctatggattccgccaagcgtcgccatcctaagctgttggcaaaagcactagagatggttccattgctgactagcacaaaggaccttgtgatctccctgtcaggaatcctgcacaaacttgacccctacgattatgagatgattgaagttgtgctgaaggtgatagagagagcggacgagaagatcaccaatatcaacattaatcaagctctgtctattcttaaacatctgaagtcttatagaaggatcagccctcctgtggatttggagtatcaatatatgttggagcacgtcataaccctaccctcagccgcacagactagactcccttttcacctgatttttttcgggaccgcccagaacttctggaaaatcttgtccacagagctttccgaagagtcattccccactcttctgctgatttcgaagctaatgaaattctcccttgatacactgtacgtatcaaccgcaaagcatgtctttgagaaaaagctgaaacccaagcttctcaagctgactcaagccaaaagcagcacactgattaataaggaaatcaccaaaatcacccagacaatcgagtcttgcctgctgtccatcgttaaccccgaatgggccgtggctatcgcaattagcttggctcaggatattccggaggggtcattcaagatctccgcactgaaattctgcttgtatctagccgaaaggtggctccagaatattccttctcaagatgagaaaagagagaaagcggaagcactcctgaagaagctgcacattcaatatcgaagatctgggacagaggccgttctgatcgctcacaaactcaatacagaagagtatctgagggtaatcggaaagccagctcacctgattgtgtctctgtacgaacaccctagtattaatcaaaggatccagaattccagcggcacagactacccggacattcacgccgcggcgaaggagatagctgaagtgaatgaaattaatctcgaaaaggtctgggatatgcttttggagaaatggctgtgcccttctaccaagcctggtgaaaagccctccgagttattcgaactgcaagaggacgaggcacttcgccgcgtacagtatttgttactgagccgacccatcgactatagctcccgcatgctgttcgtatttgcaacctccacgacaaccaccttaggtatgcaccagctgacgtttgcccatcgcaccagggccttgcagtgcctgttctacctggctgacaaggagactattgagtccctcttcaagaaaccaatcgaagaagtaaagagctacctccggtgtatcacgtttctcgcgagcttcgaaactctgaacatccctatcacctatgaattattctgctcctctcctaaagaagggatgatcaaagggctgtggaagaaccatagtcacgaatcaatggcagttcgcctggttaccgaactttgcctcgagtataagatttacgacctccaactctggaacggactcttgcagaaattactaggcttcaacatgatcccctatctgaggaaggtactcaaagctatttcgtctattcactcattgtggcaagtgccgtatttttctaaagcgtggcagagggtaatacagatcccgttgctgagtgccagctgcccccttagccctgatcagctgtctgactgctccgaaagcctcatcgccgtcctagagtgtcctgtttcgggggatttggatttaatcggagtagcccgccagtatattcagctcgagcttcctgccttcgctctggcctgcctaatgctgatgcctcactctgagaaacgccatcagcagattaagaactttctaggatcatgtgacccgcaagtcattctgaagcagcttgaagaacatatgaacaccgggcagctggcaggcttcagccaccagatacggtctctcatcctcaataatatcatcaacaaaaaggagttcgggatattggcgaaaacgaaatacttccaaatgcttaagatgcacgcaatgaatacgaataatatcacggaactcgtcaactacttggccaatgatctaagtctggacgaggcctcggtgttgatcactgaatactcaaagcattgtggcaaaccggtgccacctgacacagctccgtgcgaaatcctgaaaatgttcttgtccggtttaagttag

SEQ ID NO: 24717 - DNA, 1332 bp, Artificial Sequence
  Description of Artificial Sequence: Synthetic coding sequence
atgctggagcacgtgatcaccctgcccagcgccgcccagacccggctgccatttcacctgatctttttcggaacagcacagaatttctggaagatcttgagcacggaactgagtgaagaaagctttcccactctgttgctcatcagcaagctgatgaaatttagcctagataccctatatgtctcaaccgcgaagcacgtctttgagaagaagctgaagcctaaacttctgaaactcacccaagccaaatcctcgactctcataaacaaagaaattactaagatcacccagaccatcgaatcctgcctgctgtctatcgttaaccccgagtgggctgtggccattgctatctctttggcccaagacatccctgagggctcctttaagataagtgcccttaagttctgtctctacctggcggagcgatggctccagaacattccctcccaggatgagaagagagagaaagctgaggccctgctgaaaaagcttcacatccagtacagacgatctggcaccgaggccgttcttatcgcccataagcttaatactgaggagtaccttcgagtcattggtaaaccagctcacctgattgtgtccctgtacgaacacccatctattaatcagcggatccagaattcatcagggactgactatcccgatattcacgccgctgccaaggaaatagctgaggtaaatgagataaacctggaaaaggtatgggacatgctattggagaagtggctgtgcccttcaacgaagcccggtgaaaagccgtctgaattattcgagctgcaggaggatgaggctctacgaagggtgcagtacctgttactctcgcgcccgattgattattcatcccgtatgctctttgtgttcgccacgtctacaacaacgacattaggaatgcaccagcttacattcgctcatcgcacaagagcgctgcaatgtttattctatctggccgacaaggaaacaatcgagagcttgtttaagaagccaattgaggaggtcaagtcctacctgcgctgtatcacatttctcgcttccttcgagactctgaatatccctatcacctatgaactgttctgctcctctcccaaggaggggatgataaagggactctggaagaatcatagccatgagtctatggctgtgagactcgtcaccgagctgtgcctagaatacaaaatctacgacctgcagctctggaatgggctcctgcaaaagctgctcggctttaacatgattccataccttagaaaagtgctgaaggctatctcctctatccacagcctatggcagcgctggcgatcatgctacgtagcttag

SEQ ID NO: 24718 - DNA, 417 bp, Artificial Sequence
  Description of Artificial Sequence: Synthetic coding sequence
atgaacagcctggtgagctggcagctgctgctgttcctgtgcgccactcactttggcgagccgcttgagaaggtggcctcagtgggaaactcccgcccaacaggccagcagctagaaagtctggggctcctggcacctggagaacaatctctgccttgcaccgaaaggaagcctgcggcgactgctcgcctctcacggcggggaaccagcttaagccccccaccggaatccagcggtagcccccaacagcccggactctctgctcctcactcacgacagatccccgctccccagggagccgtactggtgcaaagggagaaagatctccctaattataactggaattccttcggcctgcgctttgggaaacgggaagcggcccctggaaaccacggtagaagtgccggccggggttag

SEQ ID NO: 24719 - DNA, 771 bp, Artificial Sequence
  Description of Artificial Sequence: Synthetic coding sequence
atggcccaccggccccccagccccgccctggccagcgtgctgctggccctcttactctctggggcggcaagggctgccgagatcgtagggggccacgaagcacagccccacagccgtccgtatatggctagcttgcagatgcgcggaaaccctggatcacacttctgcggaggcacactgattcacccgtcttttgtgcttactgctgcacactgcctgagggacatccctcagcgcttggtgaacgtcgtcttgggagcacataatgtcagaacccaggaacctacacagcagcacttcagtgtcgctcaggtttttctgaacaattatgatgccgaaaataaacttaatgacgttctactgattcagttgtcctcacctgccaatctgtcagcgtctgtagcaacggtgcagcttccccagcaggaccaaccagtgcctcatggcacccagtgcctagcaatggggtggggccgggtcggagctcatgaccccccggcacaggtattacaggaactcaacgtgaccgtggtgacgtttttttgccggcctcacaacatttgcacttttgttcctcggagaaaagcgggcatatgtttcggcgacagcggcggtcctctgatttgtgatggaatcattcaggggatcgactccttcgttatatggggttgcgccacacgtctgttcccagattttttcacaagagtagccctgtatgtcgattggatccgcagtacgctaaggcgtgtcgaagctaaaggccgcccctag

SEQ ID NO: 24720 - DNA, 2937 bp, Artificial Sequence
  Description of Artificial Sequence: Synthetic coding sequence
atggcccacaccaccaaggtgaacggcagcgccagcggcaaggccggcgacatactttccggagaccaagataaggagcagaaggacccgtacttcgtcgaaaccccttatgggtatcagctggaccttgactttctaaaatacgttgacgatatccaaaagggcaacacaattaaaagactaaacatccagaagagacggaagccatctgtcccctgccccgagccccggacaacctccggccagcaaggcatctggacatctaccgagagcctgagttcctccaacagtgatgataataagcagtgtccaaacttccttattgcaagatcacaggttactagcactcctatctccaaaccccctccacctctggagacaagtcttcctttcctgaccatccctgaaaaccgccagctccctccaccatctccgcaactacccaagcataacctgcacgtgacaaagaccttgatggaaacacgccggagactcgaacaggagcgcgccaccatgcagatgacccctggcgagttccgcaggccgaggctggcatcttttggaggaatgggcacgacatcatcgctgccaagctttgtgggctctgggaaccacaaccccgccaagcaccagctgcagaacggttaccagggaaatggagactacggttcatacgcccccgctgcacctaccaccagttccatgggaagttccatacgacactccccattgtcatcggggatctcaaccccggttaccaatgtcagccccatgcacctgcagcacataagagaacagatggccattgcattaaaaagactgaaagagctggaagagcaggtcaggacaattccggtgctccaggtgaagatatcagtgctccaggaggaaaaacgccagctcgtctctcagctgaaaaaccagcgtgctgccagccagatcaatgtatgtggagtgcggaaaaggtcttactctgccggcaatgcaagccaactcgaacaactgtctagagcgcggagatctggaggcgagctttacattgactatgaagaggaagagatggaaacagtcgaacagagcacacagaggattaaagagtttagacagctcaccgcggatatgcaggccctggagcagaaaatacaggacagttcttgcgaagcttcatccgagttgagagaaaatggggagtgccgtagcgtcgctgtgggggctgaagaaaacatgaacgatatcgttgtgtaccaccgcggcagcagaagctgcaaagatgctgctgttggtacgcttgtcgaaatgaggaactgtggagttagcgtgacagaagcaatgctcggggtgatgacagaagctgataaagagattgagctccagcagcagaccattgagagtctgaaagagaaaatctacagattggaagtgcagctcagagaaaccacccatgaccgtgagatgaccaaactaaagcaggaactccaggcggctggaagccggaagaaggtagacaaagctaccatggctcagccgcttgtgtttagcaaggtggtggaggctgtggtccagaccagggatcagatggttggaagccatatggacctggtggacacgtgtgtgggcacctccgtggaaactaatagcgtcggtatcagctgccagcctgagtgtaaaaataaggttgtggggcccgagctgcccatgaactggtggattgtgaaagaaagggtggagatgcatgaccggtgcgccgggaggtcggtcgagatgtgcgacaagtcggtatctgtggaggttagtgtgtgcgagactggaagtaacacagaagaaagcgtgaacgacttgacccttctcaaaacaaacctcaacttaaaggaggttcgaagtatcggctgtggggactgcagcgtggacgttacagtctgttctcctaaggagtgcgccagtcggggggtcaatactgaagccgtgtcgcaggtggaggcggcagttatggctgtgccacggaccgcagaccaggatacctcaacagacctcgaacaagtgcaccagttcaccaacaccgagactgctacccttatagagtcctgtaccaacacctgtctttcaaccctggataaacaaacttcaacgcagacagtggaaaccagaaccgtagcggtcggcgagggtcgcgtaaaggatatcaatagttctaccaaaacacgaagtattggcgttgggactttgctctccggccattcagggttcgacaggccaagtgccgtgaagactaaggagtctggcgtgggtcagattaacataaatgacaactacctcgtaggtctcaaaatgcggactattgcatgcggcccaccccagctgacagttggtcttaccgcgagcagacggtctgttggtgtgggcgacgatcccgtcggcgagtccctggagaacccccagcctcaggcgccactgggaatgatgacaggtctggaccactacatagagaggatccagaagttactggctgagcagcagactttgttagctgaaaattactcagagttagctgaggcttttggtgaaccacatagccagatggggagcctcaattctcagctgatctctacactgagctccatcaactctgtgatgaaaagcgcctccactgaggaactgcgcaaccccgactttcagaagacaagccttggtaaaattaccgggaactacctgggctacacttgtaagtgcggtggccttcagtctggatcccccctgagctctcaaactagtcagccagagcaggaggtcggcacatccgaagggaagcctatcagctctctggatgcctttccaacacaggagggaactctatcgccggtcaatctgaccgacgaccagatcgcggcgggcttgtatggcaatttttcacattcacagagtttggcttccggcttctag

SEQ ID NO: 24721 - DNA, 831 bp, Artificial Sequence
  Description of Artificial Sequence: Synthetic coding sequence
atgctgagcgcctgcaacctgctgaagaacaccatcaacgaccccaaagcattgacctccaaagacatgaggttctgcctgaatacgcttcagcacgaatggttcagggtttcctctcagaagtctgctatccctgcaatggtaggggactacattgccgccttcgaagcaatctccccagatgtgctgcgttatgtaattaatctggcagatggcaacggcaacactgctctccattacagcgtgtcgcactcaaacttcgagattgtgaagcttctgctggatgccgacgtttgcaacgtggaccatcaaaacaaggccggctatactcctatcatgctagcggcactggccgctgtagaggcggaaaaggacatgcgaattgtagaggagctttttggatgcggtgacgttaatgcaaaagcttcacaggccgggcagacagcgttaatgcttgccgtgtcgcacggcagaatcgatatggttaaggggctcctggcatgtggggccgacgtgaacatacaagacgatgagggctccacagccctaatgtgtgctagtgagcacggccatgttgaaattgttaagttgctcttggcacagcccggatgcaatggccatctggaggacaatgacgggtcgactgcgctgtccatcgccctggaggccggacacaaggatatcgccgtgctgctttatgcccatgttaattttgccaaagcccaatctcctgtgagcgtggtccacctggcctttgttaatcgcttgaagagcactcgcctggtggatccattgccccccggtatagatggtcggcagattctttgctag

SEQ ID NO: 24722 - DNA, 993 bp, Artificial Sequence
  Description of Artificial Sequence: Synthetic coding sequence
atggccgagggccaccacgccgtgaacatcgagggcctgaagagcgcccgagtggaggatgagatgcaggtgcaggagtgcgagcccgagaaagttgaaatcagggagcgttacgagctttctgagaaaatgctctctgcttgtaacttgctaaagaatacaatcaatgaccccaaagccctaacatctaaggatatggggcaagtacagtggttgactcctatgatccctactctgagggaagccgatgccggcggcagtcacgagaggttctgcttaaatacactgcagcacgagtggttccgggttagctcccagaaatctgccatccccgctatggttggcgactatatagccgccttcgaagctattagtcccgacgtgctcaggtacgtgataaatctggctgacgggaacgggaacactgccctacattacagcgtttcccatagtaactttgagatcgtcaagttactgctcgatgccgacgtctgtaacgtcgaccaccagaataaagccggatatactccaatcatgctggccgcacttgccgccgtggaagccgagaaagatatgcgtatcgtcgaggagctgtttgggtgtggcgacgtaaacgcgaaggcgtcacaggccgggcagaccgcactgatgcttgccgttagccatggcaggatcgacatggtaaagggtctgctggcttgcggggccgatgtgaacatccaggacgatgagggtagcaccgcactcatgtgcgctagtgagcacggacacgtggaaatcgtgaagttgctactggcccagcccgggtgtaatggtcatctggaagacaacgacggcagtactgcgctttctatagcccttgaggcagggcacaaggatatcgccgtcctgctatatgcccatgtaaacttcgccaaggcccagtctcccggcactccacgactgggacggaaaacctcccctggtccaacacaccgcggaagcttcgactag

SEQ ID NO: 24723 - DNA, 3585 bp, Artificial Sequence
  Description of Artificial Sequence: Synthetic coding sequence
atggagacccggcggcggctggagcaggagcgggccaccatgcagatgacccctggtgaatttagaagaccacggctggctagcttcggcggcatgggaactacatcgtctctcccctctttcgtgggtagcggtaaccataaccccgcaaaacaccagctgcaaaacgggtaccagggcaacggcgattatgggagctatgctccagctgctccaaccacctcgagcatgggatcctccattcgtcactctcccctgtccagcggcatatcgactccagtaactaacgtctctcccatgcatctgcaacacatccgcgaacagatggctattgctctgaagcgccttaaagagcttgaggaacaggtccgaaccatcccagttttgcaggttaaaattagcgtgttgcaggaggagaagagacagttggtgagccagctgaagaatcaaagagccgcatcacagataaacgtctgcggagtcaggaaaagaagctacagcgctggaaatgcatcccaactagagcagctgtcccgggctcgccgctcgggcggagagctgtacattgactatgaggaagaggaaatggaaacagtagaacagagtactcagagaatcaaagagttccgtcaattgaccgctgacatgcaggcgctcgagcagaagatacaggattcttcttgcgaagcctcaagcgagttacgggaaaacggcgagtgtcggagtgtggccgtcggcgctgaggaaaatatgaatgacatcgtcgtataccaccggggatctcgatcctgtaaagatgctgcggtaggcacacttgttgagatgcggaattgcggggtctccgttaccgaggctatgctcggcgtgatgacagaagccgataaggagatcgaactccagcagcaaaccattgagagcctgaaggagaaaatctataggctcgaagtgcagttaagggaaacaacacatgatagagaaatgacaaaactgaaacaggagctgcaggccgctggttctcggaagaaagttgacaaagcgactatggcccaaccccttgtgttttcaaaggtagtggaagccgtggtacaaaccagagaccagatggtaggaagccacatggatctggtcgacacgtgtgttggaaccagcgtggagacaaacagcgttggaatttcatgtcagcctgagtgtaagaacaaggtggtcggtcctgagctgccaatgaactggtggatagtgaaagagagggtcgagatgcacgataggtgtgcagggagaagtgtggagatgtgcgacaagtcagtgtcagtcgaagtctcagtttgcgagaccggctcgaatacggaagaatccgtcaatgatctgacattactcaagaccaaccttaacctgaaggaagtgagaagtatcggatgtggagactgttccgtggatgtgaccgtttgttcacccaaagagtgcgccagtaggggcgttaacaccgaagcagtgtcccaggtggaggcagcagtaatggccgtgccgcggactgccgatcaggatacgagcacagatctcgaacaggttcaccagttcaccaacacagaaacagcaacactcattgagagttgcaccaacacctgcctgtcaacactggacaagcagacttcaactcaaactgtggagacccggactgtggccgtgggggagggccgcgttaaggacattaacagtagtactaagacacgttccattggggtcggaaccctgctgagtggccatagcgggtttgaccgcccatctgcagtgaaaaccaaggagtccggggttgggcaaataaatataaacgacaactatcttgtcgggttgaaaatgagaacaatagcttgcggccctccgcagctgacagttgggttgactgcttctcgacggtctgtcggggtgggcgatgaccccgtcggtgaaagccttgagaacccgcagcctcaagctcccctggggatgatgaccggcctggatcattatatcgagcgtatccagaaactgctggctgagcaacaaacgctgctggctgaaaattattcggaattggccgaggcatttggcgagccccattcacagatggggagtctaaactctcagctgattagtactttgtctagcatcaattctgtgatgaaaagcgcttccaccgaggaactacgaaatccggactttcaaaaaacaagcttaggcaaaataacagggaattacttgggctatacatgtaaatgcggtgggctgcaaagcgggagtcccctaagcagccagacaagtcaacctgagcaggaagtgggtactagtgaagggaaaccaataagtagcttggacgccttccccacacaagagggcacactgagtcccgtgaacttgactgacgaccagatcgctgcgggcttgtacgcctgcacaaataatgagtcgacacttaagagcatcatgaagaagaaagacggaaataaagactcaaacggagccaagaagaacttgcagttcgtgggaattaacggagggtacgagaccacctcttcagatgacagtagcagcgacgaaagctcttcaagtgagtccgatgatgaatgcgacgtgattgagtacccactggaggaagaagaagaggaggaagacgaggatactagagggatggcagaagggcaccacgctgtgaacattgagggcctcaagtcagcccgggtagaggatgaaatgcaggtccaagaatgtgagcctgagaaggtggaaattcgggaaagatatgaactcagcgaaaagatgctgtcggcttgcaatctactcaaaaacactatcaacgaccctaaggctcttacttcaaaagacatgcgtttctgcttaaataccctgcagcacgagtggttccgcgtttcttcacaaaaatctgccataccggctatggtgggagactacattgccgcttttgaggccatcagtcctgacgtcctgcgatatgtgattaatctggctgatggaaacggcaatacagcattgcattatagtgtaagccactcaaattttgaaatcgtcaagcttttgcttgacgccgatgtttgcaatgtcgatcaccagaacaaggctggttacacaccaatcatgctggccgcactcgccgcagtggaagctgagaaagacatgcggatcgtcgaggaactctttggctgcggcgacgtgaacgcgaaagcctcacaggccggacaaactgcgctcatgctggctgtatctcacggcaggatcgatatggtgaagggcctactagcttgcggagcagatgttaatatccaagatgacgaaggttccacagcacttatgtgtgcaagtgaacatggtcatgtagaaatcgtaaaattactgttggcacagcccgggtgtaatggccatctggaagacaatgacggatctacggcactttcaatcgctctggaggccgggcacaaggacatcgcagtgctgttgtacgcacatgtcaactttgcaaaagcgcagtctcccgggactccgaggctgggccggaagacaagccctgggcccacccatagaggcagctttgactag

SEQ ID NO: 24724 - DNA, 4059 bp, Artificial Sequence
  Description of Artificial Sequence: Synthetic coding sequence
atggcccacaccaccaaggtgaacggcagcgccagcggcaaggccggggatatcttatcaggcgatcaggacaaagagcagaaggatccctatttcgtggaaaccccttacggatatcagctagatctggacttcctgaagtacgttgatgatatccagaaaggaaacacaattaagcgattaaacatacagaagagaaggaaacctagtgtcccttgtccagaaccacgaaccacttccgggcagcagggcatctggaccagtacagaaagtctttcctcgagtaattcagacgacaacaagcagtgtcctaactttctgattgctagatctcaggtgactagcaccccaatcagcaaaccacctcccccgttggaaacgagcctcccattcctgactatccctgagaacagacagctacctccaccttccccccaactccccaagcataacctgcatgtcaccaagacacttatggaaaccaggaggcgattggagcaggaaagagcaaccatgcagatgacaccaggggaattccgacgcccccgtctggcttctttcgggggtatgggaactactagcagcctgccgtcttttgtgggctctggtaatcataaccctgccaagcaccagcttcagaacgggtaccagggaaacggcgattacgggtcatatgcaccagcagcacccacaactagctcaatgggaagctcaattagacactctcccttgagctctggcattagtaccccggtaactaatgtgtctcccatgcatctgcagcatatacgggagcagatggctatcgcactcaaacgactcaaagaattagaagagcaagtgagaactattccggtgcttcaggttaagatatcagtactgcaggaagagaaaaggcagttggttagtcagttgaaaaaccagcgggccgcctctcagataaacgtctgtggcgtgaggaaaaggtcatactcagcaggcaacgcatcccagcttgaacaactctcgagggccaggagatccggcggcgagctgtacattgactatgaagaggaggagatggagaccgtggaacagagcacccagaggatcaaagagtttaggcagctcaccgcagacatgcaagccttagaacagaaaatccaggattcatcctgcgaggcatcaagcgaactccgggagaacggggaatgcagatcagttgccgtgggcgccgaagaaaacatgaatgatatagtggtgtaccacagaggttctcggtcttgtaaagacgcagccgtcggtactcttgtagagatgcgcaactgtggtgtgtcggtaactgaggccatgctgggagtgatgacagaggcagataaggagattgagctgcagcaacagaccattgagagtctgaaggaaaaaatctatcgcctggaagtgcagctcagggagacaacccacgaccgggaaatgactaaattaaagcaggaactgcaggccgccggctcgaggaagaaagtcgacaaggccaccatggcgcaacccctggtcttttctaaagtcgttgaggcagtggtacagactagagaccagatggttggctcccatatggacctggtcgatacatgcgttggaacatcagtagagaccaactccgttggaatcagttgccagccagaatgcaagaacaaggtcgtgggtccagaattgccaatgaactggtggatcgtgaaggagcgggtcgagatgcacgacaggtgcgctggccgaagcgtcgagatgtgtgacaagtccgtcagcgtcgaagtgtctgtttgcgagaccggcagtaatacagaagaatcagtgaacgatctgaccctcctgaaaactaatctgaatcttaaggaggtgaggagcattgggtgcggagattgcagcgtggatgtgaccgtatgttcacctaaagagtgcgccagccggggcgtaaacactgaggctgtgtctcaggtcgaagcagccgtgatggcagtgccccggacagctgaccaggatacaagcactgatctggaacaagttcatcagttcaccaacaccgagacggctaccttaatcgagagttgtaccaacacttgcctgagcaccctggacaagcagacatcgacccagactgtcgaaacgaggaccgtggctgttggcgaaggtcgcgtgaaggacatcaactcctccacgaaaaccaggagcattggcgttggaactttgctgtctggccactcaggattcgatcgacctagcgctgtaaaaaccaaggaaagcggcgtggggcaaattaatatcaacgataattatcttgtgggactaaagatgaggaccattgcctgcggcccaccccagctaaccgttggcctaacagcttcacgtcggtccgtaggggtgggcgatgaccccgtgggcgaatctctcgaaaatcctcaaccccaggctcccttgggtatgatgaccgggctggatcattacattgaaagaattcaaaagctgctggccgaacaacagactttgctggctgagaattactccgaactggcggaagcgtttggggaaccacactcacagatgggcagcttaaacagccagttgatatctacactgtcctccatcaatagcgtcatgaaatctgcctccactgaggaattacgtaaccctgatttccagaagactagtctgggtaagatcaccggcaattacttagggtatacttgtaagtgtggcggtctgcagtctggcagtcccctgagcagccagactagccaacccgagcaggaagtagggacgtcggaaggcaagcccattagctccctcgatgcctttccaacccaagagggcaccctgtcccctgtcaacctcaccgacgaccagatcgcggcaggcctatacgcctgtaccaacaacgagtctactctgaagtctattatgaagaagaaggacggtaacaaagatagcaacggagcgaagaaaaacctccagttcgtgggaattaatggcggctacgagacaacttctagcgatgactccagctctgatgagagtagctcaagcgagtcggacgatgaatgtgacgtaattgagtaccccctagaagaagaggaggaggaggaagacgaagatacccggggcatggccgaggggcaccacgcagtcaacatcgagggtttgaaatccgctagagtggaggacgagatgcaggttcaagaatgcgagcccgagaaagtagagatccgggaacgttacgagctttcagaaaaaatgctctcagcatgtaaccttctcaagaacacgataaatgatcctaaagctttgaccagcaaagacatgcgattctgcctcaatacactacagcacgaatggtttagagtttccagtcagaagtcagccattccagccatggtgggcgactatatagctgcattcgaagcaatcagtcccgacgttctacggtatgtaattaatctcgctgacggcaacggaaacactgccctccattattcagtgtctcacagcaactttgagattgtaaaactcctgttggatgccgatgtgtgcaacgtcgatcaccagaataaggcagggtatactcccataatgctcgccgcactggccgctgttgaagcggagaaagacatgcgtatcgtagaggagttgttcggctgcggagacgtcaatgcaaaagccagccaagccggccagacggcactaatgctcgctgtttctcacggcaggattgatatggtcaagggcctcttggcttgcggggcggacgtaaatatacaggacgacgagggttctacagcactgatgtgtgcctccgagcatggacacgttgagatcgtgaagctcctcctggcacagcctggctgtaacggacaccttgaggacaacgatgggtcaaccgcactgtctatcgctctggaagcggggcataaggacatcgccgtcttgttgtacgcccatgtgaatttcgccaaagcacagtcccccgggacacctaggttgggcaggaagacttcccctggccctacccaccgtgggagctttgactag

SEQ ID NO: 24725 - DNA, 4059 bp, Artificial Sequence
  Description of Artificial Sequence: Synthetic coding sequence
atggcccacaccaccaaggtgaacggcagcgccagcggcaaggccggggatatcctctcaggtgatcaggataaagagcagaaagacccgtacttcgtggaaactccgtacgggtatcaactggacctggattttctgaaatacgttgacgatattcagaagggaaacactattaagcggctaaatattcagaagaggcggaagcccagcgtaccctgtccagaacctcgcactacctcaggccagcagggaatatggaccagcacggaatctctgagctcgtccaatagtgatgacaataagcagtgccctaatttcttgattgcgaggagtcaggttacttcaacccccatctccaaacctccgccaccgctggaaacttctttaccttttctgactattccagagaacaggcagctgcccccgccgagcccacagctacccaagcataatcttcacgtcaccaaaacactgatggagactcgcaggcgattagagcaagaaagagcaactatgcagatgacacccggcgaattccgcaggccccggctcgcctcgttcggtgggatggggactactagctcactcccatcctttgtgggctcaggtaaccataatccggcaaagcaccagctgcaaaatggctatcaggggaatggcgactatggaagctatgcacctgcagcccctactactagctcaatgggaagtagtattcgccactcccccctatcttctgggatatccacacctgtgaccaacgtctcccccatgcaccttcagcatatacgggagcagatggctattgcgcttaaaaggctgaaagagctggaagaacaggtgaggaccatccctgtgttgcaggtcaaaatctctgtgcttcaggaggagaagcggcagcttgtttctcaattgaaaaaccaaagagctgcaagccaaattaacgtttgcggcgtgcggaaacgctcttattctgccggaaacgcgagccaactcgagcaactttctcgcgccagacgcagcgggggggaactttacattgactacgaagaagaggagatggagaccgtagaacagagcacccagcgaattaaggagttcaggcagttgaccgccgacatgcaggcattagagcagaagatccaggattccagctgcgaagcctcttccgagctgagagagaacggcgagtgtcgaagcgtggccgttggagccgaagaaaacatgaacgatatcgttgtgtatcacaggggctcccgctcgtgtaaggacgctgctgtcggaaccctggtggaaatgcgcaactgcggtgtgtcagtgactgaggcgatgcttggtgttatgaccgaggccgataaagagatcgagctccagcagcaaacaatcgaatcgctgaaagaaaagatatacaggctggaggtccagcttcgcgagactacccacgaccgagagatgaccaagcttaagcaggaactgcaggccgcgggatctcgaaaaaaggtggataaggctacaatggctcaacctctcgtattctctaaggtagtggaggccgtggtccagacgcgcgaccaaatggtgggctcacacatggatctcgttgatacatgtgtggggacttccgtggaaaccaatagtgttggaataagttgccagcccgagtgcaagaacaaggtcgtgggtccggagctgcccatgaattggtggatcgtgaaggagagagttgaaatgcacgaccggtgcgctggccgcagtgtagagatgtgtgacaagtccgtgagtgttgaagtgagcgtctgtgagaccgggtctaacacagaggaaagcgtcaatgatctgaccctcctgaaaacaaatcttaacctgaaggaggtcagaagtatcggctgtggagactgctccgtggatgtcacagtgtgcagccctaaggaatgtgcatctagaggtgtgaatacggaagccgtatctcaggtagaggccgctgttatggcagttccgcggaccgccgaccaggatacttcaaccgatctggagcaagtacatcagtttactaacactgagactgcaactttgatcgagagctgcacaaacacatgcctaagcaccctggacaagcagacaagcacccagactgtcgaaacacgtaccgtcgcagtcggagagggcagagtcaaggacataaattcaagcactaagacgcggagcattggcgtgggcacccttttgtccggccactcaggcttcgaccggccgagcgccgtaaagacaaaggagtcaggggttgggcagatcaacatcaatgacaactacctggttggcctgaagatgcgtaccattgcctgtggaccccctcagttgaccgtgggcctcaccgcatcacgccgctctgtgggcgttggagatgaccccgttggagagagcctggagaacccacaacctcaagctcccctcggtatgatgactggtttggatcactatatcgaaaggattcagaaactcctggctgagcagcagacgctcctcgctgaaaattattcggaattggccgaagcattcggggaacctcacagccagatgggcagcttgaattcgcagctcataagtacactatctagcattaactctgttatgaagtcagcctctacagaagagcttcgcaaccctgacttccagaagactagcctgggtaagattactggcaactacctggggtacacatgcaaatgcggaggactccaatcagggtcaccattatcaagccagacatcacaacctgagcaggaagttggcactagcgaaggcaagccaatctcgtcactggatgcgttcccaactcaggaaggaacattaagccctgtgaatctgacggacgatcagatcgctgctgggctgtatgcctgcaccaacaacgagagcactctgaaatccatcatgaagaaaaaagacggaaacaaagatagcaacggggccaaaaagaatttgcagtttgtgggtattaacgggggctatgagactacttcttcagacgactcaagttcagatgagagttcctccagtgaatccgacgatgagtgtgacgtgatagaataccccctggaggaggaggaagaagaagaagatgaagacaccagaggtatggccgagggccatcacgcagtgaatatcgagggcctgaagtctgctagggtcgaagacgagatgcaggtgcaggaatgcgagcctgagaaagtcgaaatccgggaacgctatgagctgtcggaaaagatgctctccgcatgtaatctcttaaagaatacaatcaacgatcctaaggccctgacaagtaaggacatgaggttttgcctgaacaccctccaacatgagtggtttagggtaagtagccaaaagtccgcgattcctgcaatggtgggagactatatagccgctttcgaagccatcagcccagacgtgctgcgctacgtgatcaatcttgccgacggcaacggaaacaccgctcttcattattctgtgtcccactccaattttgaaatcgtgaagctgctattggatgcagatgtctgcaacgtcgatcatcaaaataaggccggctatactcccatcatgcttgccgccctggccgccgtcgaagctgagaaagacatgcgcatcgtcgaggagctgttcgggtgcggcgacgtcaatgccaaggcgagccaagctggccagacagctctgatgctggcggtatctcatggcaggattgacatggtcaagggattgttagcgtgtggcgccgacgtgaatatccaagatgacgaaggctctaccgccctgatgtgcgcatctgaacatgggcatgtggaaatcgtaaagttactcctcgcccaacctggctgcaatggacacctggaagacaacgatggaagcacagccctgtccattgccttggaagctggtcacaaggatatcgctgttttgttgtacgcccatgtaaattttgccaaggctcagagccctggtacacctagactgggcaggaaaacgtcaccaggccccacacatcgggggagttttgactag

SEQ ID NO: 24726 - DNA, 1197 bp, Artificial Sequence
  Description of Artificial Sequence: Synthetic coding sequence
atgaagaagaaggacggcaacaaggacagcaacggcgccaagaagaatctgcaatttgtaggaatcaatgggggctacgaaacgacaagttcagatgactcttcaagcgatgagagcagctctagcgaaagtgatgatgagtgcgatgtcattgaataccctctggaggaagaagaggaagaggaagatgaagacacacgcggaatggcagaaggccatcatgctgtcaacattgaggggctgaaatctgcacgggtcgaggacgaaatgcaggtgcaggagtgcgaaccagagaaggttgaaataagggagaggtatgaactatccgaaaaaatgttatcggcctgtaatctcctgaagaacaccattaatgatcccaaggcactaacctcaaaggatatggggcaggtacagtggctgacacctatgattccaacccttcgggaagccgatgcaggaggctcacatgagaggttttgcctgaacactcttcaacatgagtggtttagggtgtcatctcaaaaaagcgccattcccgcaatggtcggcgactatattgccgccttcgaagctatatcccccgatgtattgaggtatgtcattaaccttgctgacgggaacggaaatacagcactgcattattccgtgtcacacagcaactttgagatcgtaaagctattgctagatgctgacgtttgtaatgtcgaccaccagaacaaggcgggttacacgcccattatgctggccgccttggcggcggttgaggctgaaaaagatatgcgaatcgtcgaagagctattcggctgcggggatgtaaacgccaaagcttctcaggctgggcaaacagctcttatgctggcagtcagtcacggccggattgacatggtaaaaggcttgctggcatgtggcgccgacgtgaacattcaggacgatgagggctccacagctctgatgtgtgcaagtgagcatggccacgtggaaatagttaaactcctgcttgctcagccagggtgcaacggccacctcgaggataacgatggcagtaccgctttaagtatcgcactggaggccggccacaaagatattgcagtgctgttgtacgcgcatgtgaattttgcaaaggcccaatctcccggaaccccacgtttgggacgcaagacatcaccagggccaacccaccgtggctcattcgattag

SEQ ID NO: 24727 - DNA, 2211 bp, Artificial Sequence
  Description of Artificial Sequence: Synthetic coding sequence
atgggcaaccccgagaacatcgaggacgcctacgtggccgtgatcagaccgaagaatacagcaagccttaactcccgcgagtatagggcaaaatcttacgaaattctgctacatgaggttccaattgagggacaaaaaaagaaacggaagaaagtgctgctcgaaacgaaactgcaaggcaacagcgaaattacccagggtattctagattatgtggtagagaccacaaagccgatttcccctgccaatcagggaatccggggaaaaagagtggttctgatgaagaaatttccactggacggggaaaaaatgggcagggaagcatcattgtttattgtgcctagtgtagttaaggataatacaaagtacacatacacaccaggctgtccgattttctactgcctgcaggacattatgcgggtgtgctcagaatcctccacgcattttgccaccttgacagcacgcatgctgattgccctcgataagtggttagacgaaagacacgcccagtcccacttcattcctgccctgtttcgtccctcccctctggagcgcatcaagaccaatgtaatcaacccagcgtacgccacggagtccggtcaaacagaaaacagcttgcacatgggctactccgcccttgaaattaagagcaaaatgcttgccttggaaaaagctgatacatgcatttacaaccctttattcggctcagacttgcagtacactaatagagttgacaaggtagtcattaacccttactttggccttggagccccagactattccaaaattcagattcctaagcaggaaaagtggcagcggagcatgtcatctgtgacagaggacaaagaacggcaatgggtagatgatttccccctgcaccggtcggcatgcgagggggacagcgagctgctgtcgagattactgagcgaacgcttttcagttaatcagctggacagcgaccactgggcacctatacattacgcttgttggtacggcaaggtcgaggccacacgaattctccttgagaagggcaagtgtaaccctaacttgctaaacggccagctttcgagtcctcttcattttgctgctggagggggtcatgctgagatcgtacagatccttctgaatcatccagagacagatcgccatattacagatcagcagggtaggagtcctctcaatatttgtgaggagaacaaacaaaataactgggaggaagcagccaagctcctgaaggaagcgattaacaagccctatgagaaagtgcgaatctatagaatggatgggtcctacagatctgtggaactgaaacacggcaacaacaccactgtgcagcagattatggagggaatgcgactgtcacaggaaactcaacagtatttcaccatttggatttgtagcgagaatctttccttacagttgaagccttatcataagcccctccagcatgtgcgagactggcctgagattctggcagagctgacgaacctggatccacagcgcgagacgccacagctctttctgcggcgtgacgtccgtctgcctcttgaggtggagaagcaaatcgaagatcccctggcaattctcattctgttcgatgaggccaggtataatctgttgaaaggattctatacggcacctgatgccaaactgattacactcgccagtttattactgcagatcgtgtacggtaattacgaatctaagaaacacaaacaggggttcttgaacgaggaaaacttaaagagcatcgtcccggtaaccaaactgaaatcaaaggccccgcactggacgaaccgcatcctgcatgagtacaaaaacctttccactagtgaaggcgtgtcaaaagagatgcaccatctgcaacggatgttcctgcagaactgctgggagatccctacttatggcgctgcgttctttaccgggcaaatcttcaccaaggccagcccttcaaaccacaaggtgatcccagtgtacgtgggcgttaatataaaaggcctgcatctcctgaacatggaaactaaggccctactgatctccctgaagtatggctgctttatgtggcagctcggggatacagatacctgctttcagatacacagcatggaaaataagatgagcttcattgtccatacgaagcaggccggcctggtagtgaagttgttgatgaagctcaacgggcagctgatgcctacagaaagaaattcctag

SEQ ID NO: 24728 - DNA, 2067 bp, Artificial Sequence
  Description of Artificial Sequence: Synthetic coding sequence
atgggcaaccccgagaacatcgaggacgcctacgtggccgtgatccgccctaagaatacagcctctctgaactcaagagagtatcgcgccaaatcctatgagatactccttcacgaagtaccaatcgagggacagaagaagaagagaaaaaaagtattactggaaacgaagctgcaaggcaattcagagattacacagggcatcctcgactatgtcgttgagaccactaagccgataagcccagctaatcaggggataagggggaaaagggtcgttttaatgaaaaagtttccgctggatggcgaaaagatgggaagggaagcttctttgttcatcgttccatcagtggtgaaagataatactaaatatacctacacaccaggatgccccatattctattgcctccaagacatcatgcgcgtgtgttcagaatcttccacacactttgccacactgacagctaggatgctcatcgcccttgacaaatggttggatgagagacatgcccaaagtcacttcattcctgcactctttcgaccttctccactggaacggatcaagaccaacgtgataaatcctgcctacgccacggagagtggtcagacagagaattccctgcacatggggtactcagcacttgaaatcaaatccaagatgttagccctggaaaaagctgacacctgcatctacaacccactctttgggtcagacctgcagtacaccaaccgcgtggacaaggttgtcataaatccatattttgggcttggggctccagattattccaagattcaaatccctaagcaagaaaaatggcaacgatccatgtcaagcgtgaccgaggacaagtatgggaaggtggaggctacccgcatactgttggagaaagggaaatgtaacccgaatctgttaaacggtcagctaagttcccctctgcactttgccgctggcggagggcacgccgagatcgtgcagattctgttaaaccatcccgaaacggacagacacattaccgatcaacagggcaggagccccctgaacatttgtgaagagaacaagcagaataactgggaggaagctgccaaactgctaaaggaggccattaataagccttacgagaaggtccgtatctaccggatggacgggagctaccggagcgtggaactgaagcacggaaataataccactgttcagcagatcatggaaggaatgcgtctgagccaggagacacagcagtactttaccatctggatttgtagcgagaacttatcccttcaacttaagccctatcataagccactgcaacacgttagggattggcccgagatccttgcagagttaacaaatctggacccgcaaagagaaactccgcagctattcttgagaagggacgtgcgtctgcctttggaggtggagaaacaaatcgaggatcctttagctattttgatcctattcgacgaggcaaggtacaatctgttgaaaggcttctacaccgcccccgacgccaagcttatcacccttgcctcgctccttttgcagatcgtgtatgggaactatgaatccaagaagcacaaacagggcttcttgaacgaggagaatctcaaaagtattgtaccagtgacaaagttgaagtctaaggcaccgcactggaccaacaggatactgcatgagtacaagaacctttccaccagtgagggtgtgtccaaagaaatgcaccacctccagagaatgttcctgcaaaattgctgggagatacctacctatggagcagccttcttcactgggcagatcttcactaaggcctccccttctaatcacaaggtcattccagtgtatgtcggtgttaatattaagggcctgcacctgctgaatatggagaccaaggcactcctgatcagtctcaagtatggatgcttcatgtggcagctgggtgacaccgatacctgttttcagatacacagtatggagaataaaatgtcctttattgtccatacaaagcaggcaggcctggtagtaaagctgttaatgaaactgaacgggcaattgatgcccactgagagaaactcctag

SEQ ID NO: 24729 - DNA, 2211 bp, Artificial Sequence
  Description of Artificial Sequence: Synthetic coding sequence
atgggcaaccccgagaacatcgaggacgcctacgtggccgtgatcagacccaaaaatactgcctcgctaaactcaagagaataccgagccaaatcttacgagatccttctgcacgaagtaccgattgagggtcagaagaaaaaacggaaaaaggtcttgttggagacaaagttgcagggaaattccgagattacgcagggcattctggactatgtcgttgagacgacaaagccaatatcacccgctaaccaaggcattcggggtaaaagagtggtcctgatgaaaaagttccctcttgatggcgaaaagatgggaagggaagcaagtctcttcattgtgccttccgtagttaaggacaatacgaagtacacatacaccccgggttgccctatattttactgcctccaggacattatgcgagtttgcagcgaatcgagcacacacttcgccacactcaccgctagaatgttgatcgcgctagataagtggttagacgagagacacgcccagagtcacttcatcccagccttgtttaggccaagccctcttgaaaggatcaagacaaacgttattaaccctgcatatgctactgagagcggccaaaccgagaattctctccatatgggatactccgcactggagatcaaaagcaaaatgctggcactcgagaaagccgacacgtgtatctacaaccccttattcggaagcgatctccagtacacaaatcgcgtggataaggtggttatcaacccatatttcggattgggcgctcccgactattccaaaattcagatccccaaacaagagaaatggcagaggagcatgtccagtgtcaccgaggacaaggaacgtcaatgggttgacgactttcccctgcacagaagcgcttgtgaaggcgacagcgagctgctcagcaggctcttgtctgagcggttcagcgttaaccaactggacagcgaccattgggcccccattcactatgcctgctggtatgggaaggttgaggcaacccgcatcctgctggagaagggcaagtgtaatccaaacctccttaacgggcagttaagctccccactgcacttcgcggccgggggcgggcacgccgagatcgtccagatactgcttaaccacccagagacggaccgccacattacggaccagcaggggcgaagcccactgaacatctgtgaagaaaataagcagaacaactgggaggaggccgcaaagctgctgaaggaggctatcaacaaaccatacgaaaaagtacggatctaccgaatggatggctcatacagatctgtggaactcaagcacggtaacaacacgaccgttcaacagatcatggaaggcatgcgcctgtcccaggagactcaacaatactttacaatctggatctgctctgagaatttgagccttcaacttaaaccgtaccacaagcctttacagcacgttcgagattggcccgagatcttggcagagctgaccaaccttgatccacagcgagaaacacctcagctgttcttgcgcagagatgttagactccccctggaagtagaaaaacaaattgaagacccgttggcaattctgatcctgtttgacgaggcgcgctacaaccttttgaaagggttctatacagcacccgatgcaaagcttatcaccctggcgtctctgctgctacagatagtttatggaaactatgagtcgaagaaacacaaacagggttttctgaacgaagagaatctgaaatccattgtgccagtgaccaagttaaaaagcaaggctcctcattggacaaaccggatattgcatgagtacaagaacctctccacctccgaaggcgttagcaaagagatgcaccacctgcagagaatgtttcttcagaactgctgggagataccaacctacggcgccgccttcttcacggggcagatcttcacaaaagcttccccttcaaatcataaggtcatcccagtgtacgtgggagttaatattaaaggcttgcatctgttgaacatggagacaaaagccttgctgatttctttaaaatatggctgcttcatgtggcagctgggcgataccgatacctgtttccagatacacagtatggaaaacaaaatgagtttcattgtccataccaagcaagcaggattagttgtcaaattgctcatgaagctgaacggacagttaatgcctacagagcgtaattcatag

SEQ ID NO: 24730 - DNA, 2211 bp, Artificial Sequence
  Description of Artificial Sequence: Synthetic coding sequence
atgggcaaccccgagaacatcgaggacgcctacgtggccgtgatcaggcctaaaaacaccgcgagcctgaactctcgcgaatacagggctaagtcttatgaaattctcttgcatgaagtgccgattgagggccagaaaaaaaagagaaagaaggttctgctggaaaccaagctacagggcaatagtgaaatcactcaagggatcttggactacgtggtcgagacaaccaagcccatcagtcccgccaatcaaggtatccggggcaagagagtggttctgatgaaaaagttccctttagatggtgagaagatgggacgagaagccagtttattcatcgtgcctagtgtagtgaaggacaacacaaaatacacttatactcctggctgtcctatcttttattgtttgcaagacatcatgcgggtgtgctcggagtcttccacccacttcgcaaccctcactgctaggatgttaatcgctctggataagtggttggatgagaggcatgcacaaagtcacttcattcctgccttgttcaggccctcccctctcgagcgcataaagaccaacgttatcaaccccgcttatgccaccgaaagcgggcagacagaaaatagcctgcacatgggatattctgccctggagataaaatcaaagatgctagctctggagaaagcggacacctgtatctacaaccccctgtttggatcagacctccagtataccaatcgcgtcgacaaggtcgttatcaatccctactttgggttgggggcaccagattatagcaagatccaaatccccaaacaggaaaaatggcagcgatcaatgagctcagtgactgaggacaaagaacggcagtgggtggacgatttcccacttcacagatctgcttgtgaaggggattcggagctgctcagccgcctgctctccgagaggttctctgtcaatcagcttgactctgatcactgggcccccattcactacgcctgctggtacggcaaagtggaagccacacgaatattgctggagaaaggcaagtgcaatccaaacctgttaaacggccagctgtcttccccacttcatttcgcagctggtggcggacacgcggagatagtgcaaatactcctcaatcatccagaaaccgatcgacacatcacagatcaacagggtaggtcacctctgaatatttgcgaagagaacaaacaaaataattgggaagaggctgccaagctgctcaaggaggccataaataaaccgtacgaaaaagtacgtatctataggatggatggtagttatcgcagtgtcgagctgaagcacggaaataatacaactgtccaacaaattatggaagggatgaggctgagtcaggaaacgcagcaatacttcacgatttggatctgctctgagaatctaagcctgcagttaaagccataccacaagccccttcaacacgtcagggattggcctgaaatactggccgagcttacaaacctggacccccagcgagagacacctcagttgttcctgcggcgggatgtaagactgcctctggaggtggagaaacagattgaagatcccctcgccattctgattctttttgacgaagcccgatacaatctcctcaagggcttctatacagcccctgatgccaagctcattaccctcgcctcccttctgctgcagatcgtgtatggcaattacgaatctaaaaagcataagcaggggtttctgaatgaggaaaatcttaaatccattgtccccgtgaccaagctcaagtccaaggcccctcactggaccaatcgtatcttacacgagtacaagaatctcagcacctctgagggcgtcagcaaggagatgcaccatctgcagaggatgtttctccagaactgctgggaaatccccacctatggcgccgctttctttacaggccagatatttacaaaagccagccctagcaatcacaaggttatcccggtctatgtgggtgtgaacatcaaaggtcttcatctgctgaatatggagacaaaggctctactgatcagtctgaagtatgggtgttttatgtggcagctcggagacacggacacttgtttccagattcatagcatggagaataagatgagctttatcgtccacactaaacaggccggcctcgtggtgaagctgctgatgaaactgaatggtcagcttatgccgacggagagaaacagctag

SEQ ID NO: 24731 - DNA, 2211 bp, Artificial Sequence
  Description of Artificial Sequence: Synthetic coding sequence
atgggcaaccccgagaacatcgaggacgcctacgtggccgtgatccggcccaaaaacaccgctagccttaacagcagagaatatcgcgctaaatcctacgagatcttgctccatgaggtccctattgaaggtcagaagaagaaacgaaaaaaagtgcttctggaaacaaagctgcagggcaacagtgagattacacaggggattctcgactatgtggtcgagacaactaagcctatctctcccgctaaccaaggaatacgggggaagcgggtggttctgatgaaaaaatttcctctggacggggagaaaatgggaagggaagcctccctattcatcgttccctctgtagtaaaagataacaccaaatatacttataccccaggttgtcccattttttactgcttgcaggatattatgagggtctgcagtgagagttccactcactttgcaacactcaccgcacgcatgttaatcgccttggataagtggcttgacgagagacacgcccagtctcacttcattccagcactttttcgaccctcccccttagaacggatcaaaaccaatgtcatcaacccagcatatgccaccgagtctgggcagaccgagaactctctccacatggggtactccgcacttgagatcaaatccaagatgctcgcactcgagaaagcagacacttgcatttataacccgctcttcggctctgaccttcagtatacaaaccgggtggataaggtggtgatcaatccatactttgggctgggtgcacctgattacagcaagatccagatacccaagcaggagaagtggcaaaggtccatgtctagcgtgaccgaagataaagagaggcagtgggtcgacgactttcccttgcacaggtccgcctgtgaaggggattcagagctgctgagcagactcctcagtgaaaggttttctgtaaatcagctggacagcgatcattgggcaccaatccattacgcttgctggtatggcaaggttgaagccacgcgaatcctgctggaaaaaggaaagtgtaaccctaatctcctgaatgggcaactttcttcaccactgcattttgcagccggaggggggcacgccgaaatcgtgcagatcctgctgaatcacccggagactgatcgacacattacagaccagcaaggaaggtctccccttaacatctgcgaagagaacaaacagaacaactgggaggaggccgccaaactgctgaaggaggccattaacaagccgtacgaaaaagttcgtatttatcgcatggacggatcgtaccgatccgttgaactaaagcacggcaataatactaccgtacagcagattatggagggcatgcgtctgtctcaggaaacccagcagtatttcacaatttggatttgctcagaaaatttgtctctgcagctgaagccctaccataagcccctgcagcatgtgagagattggccggagatcttggcggaacttactaacctcgatcctcagcgggaaacaccacagctgttcctgcgcagagatgtcagacttcctctcgaggtggagaaacagatagaggacccactcgcaattttgatccttttcgacgaagcccgctacaacctgctgaaaggcttctataccgcccctgacgccaaactcatcaccttggcctccttgctcctgcagattgtgtacggcaactacgagagcaaaaagcataaacaaggtttccttaatgaagagaatctaaaatccattgtccccgttaccaaattgaaatccaaagctccacactggacaaatcggatcctccacgagtacaaaaacttgtctaccagtgaaggagtgtccaaggagatgcatcacctgcagagaatgtttctgcagaactgctgggagatccccacctatggtgcagcttttttcacaggacaaatcttcaccaaggcaagcccttctaatcacaaagtgataccagtctatgtgggggtcaacattaaggggctccatctgctcaatatggaaacaaaggctctgcttatatctctgaagtacggctgctttatgtggcaactcggcgacactgacacctgcttccagatacattcaatggaaaataagatgtcgtttattgtgcataccaaacaagctgggcttgtcgtcaagctgctgatgaagttgaacgggcaactgatgcccactgagaggaatagttag

SEQ ID NO: 24732 - DNA, 210 bp, Artificial Sequence
  Description of Artificial Sequence: Synthetic coding sequence
atgggcaaccccgagaacatcgaggacgcctacgtggccgtgatcagacccaagaatacagcttctctgaactcccgggagtaccgagccaaatcttacgaaatattattgcacgaagtccctattgaaggccagaagaaaaagcgaaaaaaggtgctcctggagacgaagcttcagggaaattctgagattacacagggaattctgtag

SEQ ID NO: 24733 - DNA, 1698 bp, Artificial Sequence
  Description of Artificial Sequence: Synthetic coding sequence
atgggcaaccccgagaacatcgaggacgcctacgtggccgtgatcagacccaagaacacagccagcttgaacagccgtgagtaccgggcaaagagctacgaaatcctgttgcacgaagtgccaatcgagggacagaaaaagaaacgcaagaaagttctgcttgagaccaagctgcaaggaaacagtgagatcacacaggggatactggattatgtcgtcgagactaccaagccaatatcccctgcaaatcaaggtataagaggcaagcgagttgtgctgatgaaaaagtttcctctcgacggggaaaagatggggagagaagccagtctgttcattgtcccctctgttgtgaaagacaacaccaagtacacatacacccccggctgccccatcttttactgcctccaggacatcatgagggtgtgttccgagtcatccacgcacttcgccacattgaccgcaaggatgcttatcgccttggataaatggcttgatgaaagacacgcccagtcacacttcatacccgcactattccgcccgtcaccgctggaacgaatcaagaccaacgtgatcaatcccgcgtacgctaccgagagtgggcagaccgagaactccctccacatgggatattctgcgctggaaattaaaagtaaaatgcttgcactggagaaggctgatacttgcatctacaatcccctcttcggtagcgacttgcagtacactaacagagttgataaggtggtaataaacccatacttcggactcggcgctcccgactacagcaaaatacagattcctaaacaggaaaaatggcagcgatccatgtcctcggtgactgaggataaggaacgccagtgggtcgatgactttccgctgcatcggagcgcatgtgaaggggactcagaactgttgagcaggctgctatcagaacgcttcagtgtgaatcagctcgatagcgatcactgggcccccattcattacgcctgttggtacggcaaggtggaggcaacacggatcctgctcgaaaaaggcaaatgtaacccaaatctgctgaatggccaactgagttccccactgcactttgcagcaggtgggggacatgcggaaatcgtgcagatcctgctaaaccaccctgaaacagataggcatattaccgatcaacaagggcgcagtccgttgaacatttgtgaggaaaacaagcagaataactgggaggaagcagccaagctgctgaaggaggctatcaataagccttacgagaaggtgagaatttaccgcatggacggaagttacaggtccgtcgagctgaagcacggaaacaacactacggttcaacagatcatggagggcatgaggctctcacaggagacccagcagtactttacgatatggatctgctccgaaaatctgagcctccaactaaagccttatcataaaccgctgcagcatgtccgggattggccggagatactggcagagctcacaaatttagacccccagagggagacacctcagttgttcctcaggagggatgtgaggcttccactggaggtcgagaagcagatcgaagacccactcgctattctgatactcttcgatgaggcacgatataacctactgaaaggattttacactgcccctgatgccaagctcatcactctggccagcctactgctgcagagcctgtggaaactttag

SEQ ID NO: 24734 - DNA, 78 bp, Artificial Sequence
  Description of Artificial Sequence: Synthetic coding sequence
atgggcaaccccgagaacatcgaggacgcctacgtggccgtgatcagacccaagaacaccgctagtctgaacagctag

SEQ ID NO: 24735 - DNA, 39 bp, Artificial Sequence; identical to SEQ ID NO: 11271
  Description of Artificial Sequence: Synthetic coding sequence

SEQ ID NO: 24736 - DNA, 117 bp, Artificial Sequence
  Description of Artificial Sequence: Synthetic coding sequence
atgggcaaccccgagaacatcgaggacgcctacgtggccgtgatccggcctaaaaataccgcaagcctgaattccagggagtatagagctaaatcctatgaaattctacttcactag

SEQ ID NO: 24737 - DNA, 297 bp, Artificial Sequence
  Description of Artificial Sequence: Synthetic coding sequence
atgggcaaccccgagaacatcgaggacgcctacgtggccgtgatccgccctaaaaacactgcgtctttgaatagccgcgagtatagggctaaatcatatgagatacttcttcacgaagtacccatagagggacagaaaaaaaaacgcaaaaaggtcctgctggagacaaagctgcagggcaactccgagatcactcagggaatccttgattacgtggtggaaacgactaaacccatttcacccgccaatcagggaatacggggaaaaagggtggtgctgatgaaaaagttcccctag

SEQ ID NO: 24738 - DNA, 555 bp, Artificial Sequence
  Description of Artificial Sequence: Synthetic coding sequence
atgggcaaccccgagaacatcgaggacgcctacgtggccgtgatcagacccaaaaatacagccagtttaaacagccgcgagtatcgggcgaaatcctacgagatccttcttcatgaggttcccatagaaggccaaaaaaagaaacgaaaaaaggtgctgctggagactaaactccagggcaattctgagatcacgcaaggaatcctggactatgtggttgaaacgacgaaacccatcagtcccgccaatcaaggcatcagggggaagagagtggtgctcatgaagaagtttcctctcgacggagagaaaatgggcagagaggcctcgctattcattgtcccttccgttgtgaaagacaataccaagtatacatataccccgggttgccctattttctactgcctgcaagacattatgcgggtgtgcagcgagagttctacgcacttcgctactctgaccgcccgaatgctgatcgctttagacaaatggctggatgaacggcatgcccagtcacatttcatcccggccctcttcaggccgagcccgctcgaatag

SEQ ID NO: 24739 - DNA, 339 bp, Artificial Sequence
  Description of Artificial Sequence: Synthetic coding sequence
atgggcaaccccgagaacatcgaggacgcctacgtggccgtgatcagacctaaaaatactgcgtctctgaattcccgcgagtatagggctaagagttacgaaatcctgcttcacgaagtgcccatcgaaggccagaaaaaaaagcggaaaaaggtgctcctcgaaacaaagctacaaggcaactccgagattacacaggggattttggattatgtggtggagactaccaagcccatctcgccagcaaatcagggcatacgcgggaagagggtggtgctcatgaagaaattcccccttgacggcgagaaaatgggaagagaggccagcctgtttatctag

SEQ ID NO: 24740 - DNA, 105 bp, Artificial Sequence
  Description of Artificial Sequence: Synthetic coding sequence
atgggcaaccccgagaacatcgaggacgcctacgtggccgtgatccggcctaagaacacggccagtctgaactctagagaatatagagctaaaagttacgagtag

SEQ ID NO: 24741 - DNA, 177 bp, Artificial Sequence
  Description of Artificial Sequence: Synthetic coding sequence
atgggcaaccccgagaacatcgaggacgcctacgtggccgtgatccggcccaaaaacaccgctagcttaaattctagagaatatcgtgctaaatcatacgaaattttactccatgaagtgccgattgaggggcagaagaaaaagcggaaaaaggtgttactcgaaacaaagctatag

SEQ ID NO: 24742 - DNA, 489 bp, Artificial Sequence
  Description of Artificial Sequence: Synthetic coding sequence
atgggcaaccccgagaacatcgaggacgcctacgtggccgtgatccggcctaagaatacggctagtctgaacagccgggagtaccgcgccaagagttatgagattttactccacgaggttcctattgaagggcagaagaagaagagaaagaaggttttactggagacaaagctgcaaggaaactcagagatcactcagggcattctcgattatgttgtggaaacaacaaaacctatttctcctgctaatcaggggatccgaggcaagcgcgtggtcctgatgaaaaaatttcctcttgacggggagaagatgggccgggaagcctccctgtttatcgtgccaagcgtggtaaaggataacactaagtatacatacacaccgggatgtcctatcttctattgcctacaggatattatgcgggtgtgttcagagtcctcgacacattttgccacgctgactgcccgaatgctaatcgctctggacaagtag

SEQ ID NO: 24743 - DNA, 732 bp, Artificial Sequence
  Description of Artificial Sequence: Synthetic coding sequence
atgggcaaccccgagaacatcgaggacgcctacgtggccgtgatcaggcctaaaaacaccgcatccctcaacagccgggaatacagagcgaaatcctacgaaattctattgcatgaggttcctatcgaagggcaaaaaaagaaacggaaaaaggttctactggagacaaaattgcaaggcaatagtgagatcacacagggcattctcgactatgtcgtggagacgaccaaacccatctcccccgctaatcaggggattaggggcaagagggtcgtgctgatgaagaagtttcctttggacggagaaaagatggggagggaagccagcctgtttattgtccctagtgtcgtaaaggacaatacaaagtacacttacacccccggctgccccatattttactgcctccaggatatcatgcgagtgtgtagcgagtcatctactcactttgccactctgaccgctcgcatgttaatcgccctcgacaagtggctggacgagcggcacgcccagtcacactttattcctgcactttttcggccatccccacttgagcgcattaaaacaaacgtgattaatccggcatatgccacagaatccggacaaacagagaactctcttcacatgggttactcagccctggaaattaagagcaagatgttagccctcgaaaaagccgacacatgtatatacaaccctctgtttggcagcgacttgcagtatacgaataggtag

SEQ ID NO: 24744 - DNA, 198 bp, Artificial Sequence
  Description of Artificial Sequence: Synthetic coding sequence
atgggcaaccccgagaacatcgaggacgcctacgtggccgtgatccgcccaaaaaacactgcgtctctgaattcacgggaataccgggcaaagtcatacgagattctcctgcatgaggtacccattgagggacagaagaaaaagaggaagaaagttttgctagaaacgaaactgcaaggcaacagcgagatcacctag

SEQ ID NO: 24745 - DNA, 1089 bp, Artificial Sequence
  Description of Artificial Sequence: Synthetic coding sequence
atggccaccgccgagaccgccctgcccagcatcagcaccctgaccgcccttgggcctttcccagatacacaggatgacttcctcaagtggtggaggagcgaagaggcacaggatatggggcccgggccaccagacccaacagagccgccacttcatgtaaaaagcgaggaccagccaggggaagaagaagacgacgagcgcggggctgacgctacatgggacttggacctcctcctaacaaatttcagtggaccagaaccaggcggcgctccacaaacctgcgccctggcaccgagcgaagcatcaggagcgcagtacccacctccacccgagaccctgggtgcgtacgccggtggcccgggactcgtcgccggcttgctgggcagcgaagaccacagtggctgggttcggcccgcattgcgcgcccgggcgccagacgccttcgtcggacctgcactagcgcctgccccagccccggagcccaaggcactcgctctgcaaccggtctaccccggacccggtgcagggtcttcaggaggatattttcctaggacggggctctcagttcctgcagccagcggagctccctacggtttgttgagcggataccctgctatgtacccggctccccagtatcagggacacttccagctatttagagggctgcaggggcccgccccaggtccagccacctccccaagttttctcagctgcctgggtcctgggacagtcgggactggcctgggcggaactgctgaggatccaggtgtgatagccgagacggcaccgagcaaacggggcaggaggtcctgggcccgaaagcggcaagcagctcacacttgcgcccaccccggctgtggcaaatcctacactaagagtagtcacctaaaagcccaccttcggacacacacgggagaaaaaccttacgcgtgcacatgggaaggctgcggttggagatttgcccgcagcgatgaacttacacggcattaccggaagcacaccggacagaggccatttcgctgtcaattatgtcctagggccttttccagatcagaccacctcgctcttcatatgaagagacatctgtag

SEQ ID NO: 24746 - DNA, 999 bp, Artificial Sequence
  Description of Artificial Sequence: Synthetic coding sequence
atggccaccctgaaggaccagctgatctacaacctgctgaaggaggagcagacgccccagaataagattacggtggtgggtgtcggtgcagtcggtatggcctgcgccatttctatcctgatgaaggacttggccgacgaactggcactggtggatgtgatcgaagacaagctgaagggcgagatgatggacctgcaacacggatctctcttcttaaggactcccaagatcgtgtcagggaaagattataacgtcacagcaaattctaaactcgtgatcatcactgcgggagcgcggcagcaggaaggggaaagtcggctgaacctggttcagcgcaatgtcaatatctttaagttcattattccaaatgtggtgaagtattccccaaattgtaaactgctgattgtcagtaaccctgttgacatcctgacttacgttgcatggaaaatctccgggttccctaaaaatagagtgatcggatcggggtgcaatctcgacagtgctcggttccgatacctgatgggcgaacgactgggtgtgcatcccttgtcttgccacggctgggtcttgggagagcacggagattctagtgtgcctgtctggtctggaatgaatgtggctggagtgtctctgaaaactctccatccagacctggggactgataaagacaaggagcaatggaaagaagtgcacaaacaggtggtggaaagcgcctacgaagtgattaagcttaaagggtatacatcctgggcaatcgggttatctgtggctgacctggcagagtctattatgaagaatctgaggcgggtacaccctgtgtctactatgattaaaggcctctatgggatcaaggatgacgtgtttttaagtgtaccctgtattctggggcaaaacggcatctcagacttagtgaaagtaacccttacatctgaggaagaagcaaggctgaagaaaagtgccgacaccctgtggggcatccaaaaagagctgcagttctag

SEQ ID NO: 24747 - DNA, 825 bp, Artificial Sequence
  Description of Artificial Sequence: Synthetic coding sequence
atggccaccctgaaggaccagctgatctacaacctgctgaaggaggaacagacaccacagaacaaaatcacagtggtgggggttggggcagtggggatggcatgcgccatctccatcttaatgaaagacttagccgacgagcttgccctggtagatgtaattgaggacaaattgaagggggaaatgatggaccttcagcacgggtccttgtttctgaggaccccgaagattgtgtcaggtaaagactacaatgtgacagcgaacagcaagttagtaatcataacagcaggcgcacgacagcaggaaggggagtcgcgactcaatttggttcagcggaatgtcaatatttttaaattcataatccccaatgtggtgaagtattcccctaactgtaaactgctgatcgtgagtaaccctgtggacatcttaacttacgtggcctggaagatttctggctttcccaagaatcgagtgataggctccgggtgcaacttggacagcgccagatttcggtaccttatgggtgagcggcttggggtgcaccccctgtcttgtcacgggtgggttttaggagagcacggcgactccagcgtcccagtctggtctggaatgaatgtggcgggcgttagtctcaaaaccctgcatccggatctggggacagacaaagacaaggaacagtggaaggagtgtcggtatactcttggagaccctaaaggggcagccatacttaagtcatctgatgtgattagttttcattgtctggggtacaacagaatcctggggggcggttgcgcctgttgccctttctatctcatctgcgattag

SEQ ID NO: 24748 - DNA, 999 bp, Artificial Sequence
  Description of Artificial Sequence: Synthetic coding sequence
atggccaccctgaaggaccagctgatctacaacctgctgaaggaggaacagacaccccagaacaagatcaccgtagtgggtgtgggcgccgtggggatggcctgcgctatcagcattttgatgaaagatctcgccgacgaacttgctcttgtggatgtgatagaggacaagttgaaaggcgaaatgatggacctacagcatggatccctgttcctcaggacccctaaaatagtttcgggaaaagattacaatgtgactgccaactctaagctggtaataatcacagccggcgcgcggcagcaggagggggagtccagattgaatttggtccaacggaacgtcaatattttcaagtttatcattcccaacgtggtcaaatattcccccaactgcaaactgctgattgtgagtaatcctgtggacattttaacatacgtggcttggaagatctccggattccccaaaaacagagtcattggctccggttgtaacttggattccgcaagattccggtacttaatgggagaaagactgggagtgcatccactgagctgccatgggtgggtgctgggagagcacggcgacagctctgtccccgtctggtcgggcatgaatgttgccggggtttctctgaagacactccatcccgaccttggaactgacaaagacaaagaacagtggaaggaggtgcataagcaggtcgttgaatctgcctacgaagtaataaaactcaaaggctacactagctgggccatcgggttaagcgtggccgatctggccgagtccatcatgaagaatctacggcgagtgcaccccgtgtccaccatgataaagggcctgtatggcattaaagacgacgtgttcctttccgtgccttgcatcctgggacaaaacggtatttctgacctggtcaaagtaacactgaccagtgaggaagaagcgaggctcaagaagtcagccgacaccctgtggggaatccagaaggaactccagttttag

SEQ ID NO: 24749 - DNA, 825 bp, Artificial Sequence
  Description of Artificial Sequence: Synthetic coding sequence
atggccaccctgaaggaccagctgatctacaacctgctgaaggaggagcagacccctcagaacaagatcaccgtagtgggtgttggtgcagtgggcatggcttgcgccatcagtatccttatgaaagacctggcagacgagcttgcgttagtagacgtgattgaggacaagctgaaaggagagatgatggacctccagcacggttctcttttcctgaggacaccaaaaattgtatctggaaaagtggatattctgacctacgtcgcctggaaaatcagcggctttcccaagaatcgcgtgatcggctctggctgcaaccttgacagtgcccgctttaggtacttaatgggagagcggcttggagtgcatcccctctcttgtcacggctgggtgcttggagaacacggagatagcagcgtgccggtgtggagcgggatgaacgtggcgggggtcagtctgaagacactgcaccctgatctcggcactgacaaggacaaagaacagtggaaagaagtccacaagcaggtggtggagagcgcttacgaggtcattaaactcaagggatatacctcctgggcgatagggctgtctgtcgctgatcttgccgagagtatcatgaaaaacctccgccgcgttcatcccgtgtcaactatgatcaaaggtctgtacggcattaaagacgacgtttttttatctgtgccatgtattctggggcagaatgggatctccgacctggtgaaggtgacgctgacttcagaggaagaagcgaggttgaagaaatcggcagacacgctttggggaatccagaaggagttgcagttttag

SEQ ID NO: 24750 - DNA, 918 bp, Artificial Sequence
  Description of Artificial Sequence: Synthetic coding sequence
atggccaccctgaaggaccagctgatctacaacctgctgaaggaggagcagacgccccaaaataaaatcacagtggtcggggtcggagccgttggtatggcttgcgccatctccatcctgatgaaggacctcgctgacgaattggctattgtgtctgggaaagattataatgtaacagctaacagcaagttagtaattatcactgctggagcccgacagcaggaaggtgaatctcgtctaaacctggtccagcggaatgtcaacatcttcaaattcataatcccaaatgtcgtgaaatacagccctaattgtaagcttctgatagtgtcaaacccagtggacatcctaacttacgttgcctggaaaatttctggctttcccaagaatcgagtcatcggttccggatgcaacctagactccgcccgctttcgctacctgatgggcgagaggctgggcgtgcatccgctgtcttgccatggctgggtgctcggggagcatggcgatagctctgtaccggtgtggagcggaatgaacgttgccggcgtctccctgaagaccctgcaccccgatctggggacagataaagacaaggagcaatggaaagaggtccataaacaggtcgttgagtcagcatacgaagttattaaactgaagggctacacctcttgggcaataggcctgtctgtggccgacctggctgagagtattatgaagaatctgaggcgggtgcacccagtttccaccatgataaagggcttgtatgggattaaagatgacgtatttctgagcgttccgtgtatcctggggcagaacggcatcagcgatctggtgaaagtgaccttaactagtgaggaggaggcacgtcttaagaagtcagcagacacgttatggggcatccagaaagaacttcagttctag

SEQ ID NO: 24751 - DNA, 435 bp, Artificial Sequence
  Description of Artificial Sequence: Synthetic coding sequence
atggccaccctgaaggaccagctgatctacaacctgctgaaggaggagcagaccccgcagaataaaatcactgtggtcggggttggggcagtgggaatggcgtgtgctatttctatactcatgaaggacctcgcagatgaactagcattagttgatgtgattgaagacaaactgaagggtgagatgatggacctccagcatggcagcttgtttcttaggacaccgaagattgtttcagggaaagactacaacgtgacagctaacagtaagctggtaataattacagccggcgctaggcaacaggagggcgaatcgcgattgaacttagtccaacgaaacgtcaatatcttcaagttcattatacccaatgtggtgaagtactcccctaactgcaagctcttgattgtgagtaatcccggggaagccttcgactag

SEQ ID NO: 24752 - DNA, 345 bp, Artificial Sequence
  Description of Artificial Sequence: Synthetic coding sequence
atggccaccctgaaggaccagctgatctacaacctgctgaaggaggaacaaactccacagaataaaatcactgtagtcggggtcggtgctgtgggcatggcttgcgctatatccattctgatgaaggacttggcggacgagttggcattggtggacgtgatcgaggacaagctgaagggtgaaatgatggacctgcagcatggctccttgttccttagaacacctaaaatcgtttccggaaaggattacaatgttacagcaaatagcaaactcgtcatcatcacagctggtgctagacagcaagagggagagtcacgcctaaatctggtccagcggaacgtgtag

SEQ ID NO: 24753 - DNA, 219 bp, Artificial Sequence
  Description of Artificial Sequence: Synthetic coding sequence
atggccaccctgaaggaccagctgatctacaacctgctgaaggaggagcaaacaccccaaaacaagattactgtggtcggcgtgggcgccgtcggcatggcctgcgctatctccattttaatgaaagacctggctgatgaactagccctcgttgacgttattgaggacaaacttaagggtgagatgatggatcttcagcatggttccctctttctgtag

SEQ ID NO: 24754 - DNA, 1086 bp, Artificial Sequence
  Description of Artificial Sequence: Synthetic coding sequence
atgggcgagcccagcggcggctacacctacacccagaccagcatctttttgtttcatgcaaagatccccttcggttccaaatctaacatggccaccctaaaggaccagctcatctacaatctgctcaaagaggaacagacacctcagaacaagattacagttgttggggttggcgccgtgggaatggcctgtgccatctccattctcatgaaggatcttgccgacgaattagcactggtcgatgtgatcgaagacaagctcaagggagaaatgatggacctgcagcatggaagtctgttcctgcggacacccaagatcgtgagtggcaaggactacaacgtcacggctaacagtaagctcgttatcatcaccgccggggccaggcagcaggagggcgaatcaaggcttaatttggtccagaggaacgtgaacatcttcaagttcattatacctaacgttgtgaagtacagcccaaactgtaagctcttgatcgtatctaatccagtggatatcttaacatatgtcgcctggaagatctccggattcccaaaaaacagagttatcggatctggatgcaaccttgactcagccagatttaggtatctcatgggggaacgtttgggagtgcacccactcagctgccacggctgggtgctgggagaacatggggactcaagtgtgcccgtgtggagtggaatgaatgtagcgggtgtttctctgaaaaccctccatccagacctaggcactgacaaggacaaggaacagtggaaggaggtgcacaaacaggttgtagagtcagcctacgaagtcatcaagttgaagggctacacaagctgggctattggactttctgtggcagacctggctgaatctatcatgaaaaacctgagacgcgtgcacccagtgtccactatgatcaaaggactgtatggcatcaaggatgacgtctttcttagtgtaccatgtatcctaggacagaacggcatttctgatctggtgaaggtcacacttacgagcgaagaggaagctcgcctgaagaaaagtgctgacacattgtggggaatccagaaagagttgcagttttag

SEQ ID NO: 24755 - DNA, 999 bp, Artificial Sequence
  Description of Artificial Sequence: Synthetic coding sequence
atggccaccctgaaggaccagctgatctacaacctgctgaaggaggagcaaacgccccagaataagataacagtcgtcggagtaggggctgttggtatggcttgcgcaattagcattttgatgaaagacttagcagacgaactcgccctcgtggacgtaatcgaggacaagctgaaaggagaaatgatggacctgcaacacggatccctctttcttagaactccgaaaattgtttccggcaaagattataatgtgacagctaacagcaaattagtaataatcaccgccggcgctagacagcaagagggcgaaagccggctgaacctggtccaaagaaatgttaacatcttcaagtttatcatacccaatgtggtgaaatattcaccaaattgcaagcttctcatcgtgagtaaccctgtagatattctgacctatgtagcttggaaaataagcggctttcccaaaaaccgggtcatagggtcaggctgcaacctggactcagccagattcagatatttgatgggagagcgtctgggcgtgcaccccctatcatgccatgggtgggtactgggggaacatggcgattctagcgtccccgtttggtccggcatgaatgttgcgggagtatccctgaagacgctgcatcccgacttggggactgacaaggataaagagcagtggaaggaggtgcacaaacaagtggtcgaatcggcctacgaggttattaaattgaagggttacacgagttgggccatcgggctgagcgtggcagatctggctgaatcaataatgaagaacctgaggcgtgttcaccccgtttcaaccatgataaagggattatacggtatcaaggacgatgttttcctgtctgtcccctgtattctgggacaaaacggtatcagcgacttggtcaaggtgactcttaccagcgaggaggaggcccgcctcaagaagtctgcagacactctgtggggtattcagaaagagctccaattctag

SEQ ID NO: 24756 - DNA, 474 bp, Artificial Sequence
  Description of Artificial Sequence: Synthetic coding sequence
atggccaccctgaaggaccagctgatctacaacctgctgaaggaggaacaaaccccccaaaataaaatcactgtggtcggagtgggggcggttgggatggcctgcgctattagcattcttatgaaagatttggcagatgagctcgcactcgtggatgtgattgaggataagctcaagggggaaatgatggacctccagcacggctctttgtttctcaggacaccaaagatagtatcaggcaaggattataatgtaactgctaatagtaagttagttataatcaccgccggggcccgacaacaggaaggcgagtctcgccttaatctggtgcagcgcaatgtgaacatctttaaattcatcatcccaaacgtggtgaagtactctcccaattgtaagctcctgattgtaagcaatcccgtggacatcctcacgtatgtggcatggaaaatttccggcttccctaaaaacaggtag

SEQ ID NO: 24757 - DNA, 804 bp, Artificial Sequence
  Description of Artificial Sequence: Synthetic coding sequence
atgggcagcgcctgcatcaaggtgaccaagtacttcctgttcctgtttaatctgatctttttcattttgggggctgtgatcctgggatttggagtctggatcttggctgataagtccagtttcatcagcgtacttcagactagctcctcctctctgcgtatgggcgcgtacgtctttatcggagtgggagcggtgacaatgctgatggggtttcttggctgtatcggcgcagtgaatgaggtgaggtgcctgctagggctttatttcgccttcctgctgctgatactgattgcccaagttacagctggcgcactgttctactttaacatgggcaaactgaagcaggaaatgggaggaatcgtcaccgaactgatccgggactacaactcatcccgcgaggactccctccaagacgcttgggactatgtgcaggcacaagtgaaatgctgtggttgggtctccttttacaactggaccgataacgctgaactgatgaacagacctgaggtgacatatccctgttcctgtgaagtgaaaggagaagaagacaacagcctgtccgttcgaaagggattttgcgaagctcccgggaatcggacccaatcggggaaccacccggaggactggccagtgtatcaggagggatgcatggagaaggtccaggcatggctccaggagaacctcggtatcatccttggcgttggggttggcgtggcaatcattgagctgctgggaatggtcctctctatttgcctctgtagacatgtgcactcggaagactacagcaaagtgcctaagtactag

SEQ ID NO: 24758 - DNA, 3393 bp, Artificial Sequence
  Description of Artificial Sequence: Synthetic coding sequence
atgaagcggagcgagaagcccgagggctaccggcagatgcggcccaagacttttcccgcctccaactatactgtatctagccggcagatgctgcaggagatcagggagagcctgcgtaacctgtcaaagccttccgacgctgccaaggccgaacacaacatgtccaaaatgagtacagaggaccccaggcaggtgcggaacccacccaaattcggaacacaccacaaggctctgcaggagattcgcaactctttactgcctttcgctaatgaaacgaacagctccaggtcaacctctgaggttaaccctcagatgctccaggatttacaggctgctggttttgacgaggatatggtgatccaggcgttacaaaagaccaacaacaggtctatcgaggccgcaatagagtttatcagtaaaatgtcgtaccaggaccccaggcgcgaacagatggcggccgcggccgcgaggccaattaacgcctccatgaagcctggcaatgtccaacagtcagtaaaccgtaagcaatcctggaaaggttccaaagaaagcctggttccacagcggcatgggccccctctgggagaatcagtcgcatatcacagtgagagtcctaacagtcaaacagatgttggtcggcccctgtccggctccggcatctcggcttttgtgcaagcacacccctcgaacggccagcgcgttaatccaccgcctcctccccaggtgcggagtgttacccccccaccccccccccgtgggcagacaccgccgccaagagggacaactccgccaccgccttcctgggaacccaattcacaaaccaagcgatactcaggcaacatggaatatgttatcagtagaatctcccccgtccctcccggcgcgtggcaagagggttaccctcccccgcctttaaatacaagccccatgaacccaccaaatcagggacagagaggcatttcgagtgtaccagtgggacgtcagccaattattatgcaatcaagctcgaagttcaacttcccaagtgggagaccaggaatgcaaaacgggacaggccagacggactttatgatacatcaaaatgtcgttccagcggggaccgtcaatagacaaccaccccctccctaccccttaacagctgccaacggacagtctccctctgccctacaaacagggggtagcgccgcgcccagcagttataccaacgggtccatcccccaatctatgatggtgcccaacaggaactcacacaatatggagctttacaacatcagcgttcccggcctgcaaacaaattggccccagtccagcagtgcccctgcccagagctccccttcctccgggcatgagatcccaacgtggcagcccaacattcctgtgcggagtaacagtttcaacaacccactcggtaatagggcttcacattctgctaactcccagcccagtgctacaaccgtcacggcgattacccccgcccctattcagcaaccggttaagagcatgcgggtgcttaaaccagaactgcagactgctttggcaccgacacatccctcgtggatcccccagcccattcagacagttcaacctagccccttcccagaaggtacggctagtaacgtgaccgtgatgccccccgtggcggaagcgcccaactaccagggaccacccccaccgtacccgaagcatttgctccatcagaatcctagcgtgcctccgtatgagagcatcagcaagccttcaaaagaagatcaaccttccctgccaaaagaggacgagtctgaaaagtcttacgaaaatgtcgattctggggataaggagaaaaagcagatcaccacaagtcccatcacggtgcggaagaacaagaaagatgaagaacgccgggagtctcgcatccaatcatattccccgcaggcattcaagttttttatggaacaacacgtggagaatgttctgaagtcccatcaacagagattgcatcggaaaaagcagctagagaatgaaatgatgcgggttggcttgagtcaggatgcccaggaccaaatgcgtaaaatgttgtgccagaaagagagtaactacatacggctcaaaagagcaaagatggataagtccatgtttgtgaagattaaaactctgggcataggagcatttggggaggtgtgcctggctcgcaaggtggacaccaaagcgctttacgcaacaaagaccttacgcaagaaggacgtgctgctccggaatcaggtcgcccacgtcaaggcggaacgggatatcctggccgaagctgataacgaatgggtcgttagactatactacagctttcaggataaagacaacctttactttgtgatggactatatacccggcggggatatgatgagcctgttaatccgcatggggatctttccagaatcattagcccggttctatattgccgagctcacctgtgcagttgagtcagtccataaaatgggttttatccatagggacataaaaccagataatattctcattgatcgcgacggacacatcaaactgaccgactttggactttgtaccgggtttcgctggacccacgacagtaagtactaccagagcggtgatcaccctcgccaagattcaatggatttttcaaatgagtggggagatccatcctcttgccgctgtggagatcgacttaagcctctggaacgaagagctgctagacagcatcaacgctgcttagcgcatagcttagtgggcaccccaaactacatcgctcccgaagtgttattacgcacaggctacactcagttgtgtgattggtggagcgtcggagtcatactctttgagatgctggtcggtcaacctcctttcctggcccaaacgcctcttgaaacacagatgaaggtgataaattggcagacaagcctgcatatcccgcctcaagcaaaattaagcccagaagcttcagatctcataatcaaactgtgcaggggacccgaagacaggctgggaaagaacggcgctgacgagatcaaggcacacccattttttaagactatcgacttttcctctgatcttaggcagcagtctgcttcctatattccaaagattacccacccaacggacacttctaattttgatcccgtggatccagacaagctgtggtccgacgataatgaagaggaaaacgtcaatgacaccctcaatggctggtataagaatgggaaacacccggagcacgctttctatgagtttacattccgacggtttttcgatgataacgggtatccttataattacccaaagccaattgaatacgagtatattaactcccaaggttccgagcagcagtcagacgaggatgaccagaataccggaagtgagattaaaaatcgagacctggtgtacgtgtag

SEQ ID NO: 24759 - DNA, 2073 bp, Artificial Sequence
  Description of Artificial Sequence: Synthetic coding sequence
atgaagcggagcgagaagcccgagggctaccggcagatgcggcccaagacttttccagcctccaactatacagtttcaagtcggcagatgctgcaggaaatccgcgaatcgctgaggaacctgtctaaaccaagtgatgccgctaaggcagagcacaacatgagcaagatgtcgaccgaggatccgagacaggtgcgcaatccccccaaatttggcacccaccacaaagcactccaggagattagaaactcattgctaccgtttgccaacgagacaaacagcagtcgttctacttccgaggtgaatccacagatgttgcaggacctgcaggccgctggattcgacgaagatatggtgatccaggccttgcagaagactaacaaccggtctatcgaggccgcaatcgagtttataagtaagatgtcctatcaggaccccaggagagaacagatggccgccgccgccgccagacccatcaacgcctcaatgaaaccaggtaacgtgcagcagtccgtcaaccgcaagcagagctggaaggggtccaaggaatcgttggtgccccagagacatgggccccccttgggcgagagcgtggcatatcactccgagagccccaactcccaaaccgacgttggaaggcccctctcggggagtggtatttccgcgtttgtgcaagcccacccttccaacgggcaacgggtcaatcccccccctccccctcaggttcgttcagtgactcctccacctccccccaggggacagacccccccaccccgcgggaccacgccacccccgccctcatgggaacctaattcccagacaaaacggtattcggggaacatggagtatgtgatttccagaatcagccccgtcccacctggggcatggcaggaaggatatcccccacctcccctgaacacatcccccatgaaccccccaaatcagggacagaggggcatttcctccgtgcctgtcggaaggcagcctattattatgcagagctcttccaaattcaatttcccaagcggaaggcctggaatgcagaacggcaccggacagacagattttatgattcatcagaacgtggttcccgctggtactgttaaccggcagcccccccctccataccctctcacagccgcaaacggccagagtccttctgcactccagacaggcggatctgccgcccctagcagctacaccaacggatccatcccccaaagtatgatggtccccaaccggaactcgcacaatatggagctgtataatatctcagtcccgggtctgcagacaaattggccacagtcctcgagtgcacccgcccaaagcagcccctctagcgggcatgagattcccacatggcagccaaacattcccgtcaggtcaaacagcttcaacaaccccttgggaaatcgcgccagccactccgctaattcccaaccgagcgctaccactgtgaccgccattacccctgccccaatccaacagcctgtaaagtctatgagagttcttaagccggaacttcagacggccctggctcccacgcacccaagctggatacctcagccgattcagactgtgcaaccctctcccttcccggagggaaccgccagcaacgtgacggtcatgcctcctgtggctgaagctccaaactaccaaggtccacctcccccatatcccaagcatctcctgcatcagaatccttcggtgcctccgtatgagagcattagtaaaccttctaaggaggaccagccctcactgcctaaggaggacgaatcagaaaagagttacgaaaatgtggactccggtgataaagagaaaaaacagataacaaccagccccataaccgtgcggaaaaacaaaaaagacgaggagaggcgcgaatcgaggatccagtcttattctccacaagcttttaagttctttatggaacagcatgtcgagaatgtgcttaaaagtcatcagcagcgccttcatcggaagaaacaactggagaatgagatgatgagggtgaagcctttcaagatgagtatctttattttaaaccatctgtttgcctggtgtctattctag

SEQ ID NO: 24760 - DNA, 3393 bp, Artificial Sequence
  Description of Artificial Sequence: Synthetic coding sequence
atgaagcggagcgagaagcccgagggctaccggcagatgcggcccaaaaccttcccagccagtaattacaccgtctcttcaaggcagatgctgcaagagattcgcgaatctttacggaacctctcaaagccgtcggacgccgccaaggccgaacataacatgagcaaaatgagtaccgaggatcctcggcaggttagaaacccccctaaattcggcacccatcataaagcgttacaggagatacgaaactcgctgttaccatttgcgaacgagactaactcatcaaggtctacatccgaggtgaacccccagatgctacaggatctgcaggccgctgggttcgatgaagatatggtcatccaagcactgcagaaaacgaataatagatctatcgaagctgcgattgagttcatttctaagatgagctaccaggacccacggcgggaacaaatggcagcagccgccgcccgccccattaacgccagtatgaagcccggcaacgtgcagcaatccgtgaataggaaacagagctggaaaggctctaaggagtcccttgtgccccagaggcacgggccccccttgggggagtcagtcgcctaccattccgaatctccaaactcacagactgatgtcggtcgccccctctccggatccggtatttccgcctttgtacaagcacaccctagtaatggccaacgtgtgaaccctcctccccctcctcaggtgaggagcgtcaccccacctcctcccccgaggggccagacaccgccacctcggggcacaactcccccccctcctagttgggaacctaactctcagaccaagcggtactctggtaacatggagtatgtgatatcccgcatttccccagtaccacccggggcttggcaagagggctacccacccccccctctgaataccagtcctatgaacccaccaaatcagggtcagagagggatatcctctgtgcccgttgggagacagccaatcatcatgcagtctagctccaagttcaacttcccttcgggaagacctggaatgcagaatggcaccgggcaaaccgatttcatgatccatcagaatgttgtgcccgccggcaccgtgaaccgccagcctccgcctccttatcccctcaccgccgcgaacggtcagtccccaagcgcactgcagactgggggttcagctgccccctcctcctataccaatggatctattccacagtcaatgatggtcccgaatcgaaattcgcacaacatggagctgtacaacatctctgtgcctggtctgcagacaaactggcctcagagctctagtgcgcctgcacagtcctccccatcttccggccacgagatccctacctggcaaccaaacattcccgtccggagcaatagctttaataatccattgggtaacagagcctctcacagcgcgaacagccagccttcagccactacggttacagccatcacaccggcccctatccaacagccggtgaaaagcatgagggtcctgaagccagaacttcagactgccctagccccaacacatccctcttggattccccaaccaattcaaactgtgcaacccagcccattccccgaggggacagcaagtaatgtgaccgtcatgcctcccgtcgctgaagcccccaattaccaagggcctccgcctccgtaccctaaacacctgctgcatcagaacccgagtgtccctccttacgagtcgatttccaaaccctctaaggaagaccagccttcgttacctaaggaggacgagtctgagaagagctatgagaacgtcgattccggcgacaaagagaaaaaacaaatcaccacatcacctatcactgtacggaaaaacaagaaggacgaggagagacgggaatctcgcatacagtcctattccccccaagccttcaaattcttcatggaacaacacgtggagaacgtgttgaaaagtcatcaacagagactgcaccgcaaaaaacaacttgagaatgagatgatgagggttggcctctcacaggacgcccaggaccaaatgagaaagatgctctgtcagaaggagtccaattacattagactcaaaagggctaagatggacaagtcaatgttcgttaaaatcaagactttgggcattggcgcgttcggcgaggtatgtctggcccgcaaggtggataccaaagccttatacgccacgaaaacgctgagaaagaaggatgtgttgctgcggaatcaagtagctcacgtcaaagcagagcgagatattctagccgaggctgacaatgagtgggtggtacgcttatactacagcttccaggacaaagacaatttgtactttgttatggattacatcccagggggcgatatgatgtcgctccttatccgtatgggcatcttcccagagtcgttggcccgcttttacattgctgagcttacctgtgccgttgagtctgtacacaagatgggattcattcatcgagacattaaacccgataatatcctgatagaccgtgatggacatattaaactgaccgacttcggcctgtgtactgggttccgctggacacatgatagcaaatactaccagtcaggcgaccacccccggcaggactctatggattttagcaacgagtggggagacccgagctcttgtcgatgcggagataggctgaagccgctagagaggcgtgctgccagacagcatcagaggtgtctggcacattcgctggtcgggacccctaactatatagctcctgaggtgttgctcaggaccggatatacccaattatgcgattggtggtcagtgggtgtgatactttttgaaatgctcgttggtcaaccacctttcctcgcacagactcccctcgagactcagatgaaggtgataaactggcagacaagcctgcatatacctccccaagccaagctctccccggaagcttccgacctgattattaaattatgcagaggacctgaagatagactgggcaaaaatggcgccgatgaaatcaaagctcaccccttctttaaaaccattgacttctcctctgatcttcgacagcaaagcgcatcatacataccaaagattacacaccctacagacacatctaactttgacccagtcgacccggacaagttgtggagcgatgataacgaagaggaaaacgtcaatgatactctgaatggctggtataaaaatggcaaacaccctgaacacgcgttctatgaattcaccttcaggcgctttttcgatgacaatggctacccctataattaccctaagcccattgagtatgaatatatcaacagccagggcagtgagcaacagtctgatgaagacgatcagaacacaggttctgaaattaagaaccgggacctggtgtacgtttag

SEQ ID NO: 24761 - DNA, 3267 bp, Artificial Sequence
  Description of Artificial Sequence: Synthetic coding sequence
atgcggcccaagaccttccccgccaccacctacagcggcaacagcaggcaacgactccaggagattagagaggggctgaaacagcctagcaaatcatcagttcaggggctgccagctggcccaaactcggacaccagcctggatgccaaggtcctcggcagcaaggacgccacacgtcagcagcagcagatgcgcgctacacccaaattcggtccgtatcagaaagccctacgggaaatacgttactcgctgttgccatttgcaaacgaatccggtacctccgccgccgctgaagttaacaggcagatgctgcaagaactcgtcaatgcaggctgtgaccaagagatggcaggccgagccctgaagcaaacaggctctagatccattgaggccgccctcgagtatatttcgaagatggggtacctcgatccgcggaatgagcaaatcgtcagggtgattaaacagacctccccaggcaaggggcttatgcccacccctgtaacgcggcgcccgagcttcgaagggactggggacagttttgctagttatcatcaactctccggcactccatacgagggacccagctttggtgcagacggtccaacagccctcgaggagatgcctcgcccctacgtggattatctgtttcccggagtgggtccccacggaccgggtcaccaacatcagcatcctccaaaaggttacggggctagtgttgaagccgccggagcacacttccccctccagggggctcactatggcaggccacatctgctcgtacccggagagcccctcggttatggagtgcagagatccccctctttccagtctaagactccccctgagacggggggctatgcctctctgcccaccaaaggacagggaggtcctccgggcgccggtctggcatttcccccccctgccgccggcctttatgtcccccacccccaccataagcaagccggcccagccgcacaccagctccacgtcctcggcagtaggtctcaagtatttgcatcagacagccccccacagagtcttcttaccccgtcaaggaattccctgaacgtcgatctgtacgaactaggatcaacctccgtccagcaatggcctgccgccacattggcccggagagattcacttcagaagccagggctggaagcaccaccacgggctcacgtggcattccgacccgactgcccagtgccatctcgcaccaattctttcaatagtcaccagccaagacctggaccacccggcaaagcagagccttcgctcccagcacctaacactgtcaccgctgtgactgccgcgcacatcttacaccccgtgaaaagcgtgagagttttacggcccgagcctcaaacggccgtgggcccttcacatccagcttgggtcccagccccagcacccgcgcccgcaccagcacccgccccggctgctgagggccttgacgcaaaggaagagcatgcactggccctaggcggcgccggggcgtttccactggacgtggaatatggaggaccggacagacgatgccccccacctccctatcccaagcaccttttgctgcggagcaagtcagaacagtatgacctggattcgctctgtgccggaatggaacaaagtttgagggccggtcccaacgaaccggaaggtggagataagtcgagaaaaagcgccaagggcgacaagggcgggaaagacaagaagcagatccagactagcccagtgcctgttaggaagaacagcagggatgaggagaaaagagaatcccggatcaaatcctacagcccatatgcattcaaattttttatggagcagcacgtagaaaatgttatcaagacctaccaacagaaggtaaatagacggctgcagttagagcaggagatggctaaggcaggcctgtgtgaggctgaacaggaacaaatgcggaagatcctgtatcagaaagagagcaattacaaccgcctgaagagagcaaagatggataagtccatgttcgtgaagatcaagacattgggcattggggccttcggggaagtgtgtctagcatgcaaggtcgatacccatgccctatatgctatgaaaacacttaggaaaaaggatgtgctcaacagaaaccaggtggcacacgtaaaggccgagcgcgacattctggctgaggcggataatgaatgggtcgtgaagctgtactattctttccaggacaaagactcactctattttgtgatggactatatacccgggggagatatgatgtccctgctgatcaggatggaagtcttccccgagcacttggccagattttacatagctgagttgactctggcaatcgagtcagttcacaagatgggttttattcacagggacattaaaccagataatattttgatagacctggacggtcacatcaaactgactgatttcgggctgtgtactggatttaggtggactcataacagcaaatactatcaaaagggaagtcatgttcgacaagatagcatggagcctagtgatctgtgggacgatgtgtcaaactgccggtgcggcgataggttaaaaacactggagcagagagctcgcaagcagcaccagagatgtctcgctcattccctcgtaggcactccgaactacatcgccccagaggtgctgctccggaagggctacactcagctgtgcgactggtggtctgtgggggtcattctttttgagatgttggtgggccagccacctttcctggcccctacccccactgaaacccagctgaaggttattaactgggaaaatacgttacacatccccgcacaagtaaaactgtctccagaagccagggaccttataacaaagctgtgttgttccgccgaccaccgcctgggaaggaacggcgccgatgacctcaaggcccacccctttttcagtgccatcgacttctcctctgatattaggaaacagcccgccccctatgtgcctacaatctctcaccctatggataccagtaactttgacccagtagacgaagagagcccatggaatgatgccagcgaaggatcgaccaaagcttgggatactctaacctctcctaacaataagcacccagagcacgccttctacgaattcacatttaggagatttttcgatgataacggctatccatttagatgccccaaaccatccggggctgaagctagccaggccgaatctagtgatctcgaaagctccgatctggttgatcagacggaaggatgtcagcccgtttacgtttag

SEQ ID NO: 24762 - DNA, 3267 bp, Artificial Sequence
  Description of Artificial Sequence: Synthetic coding sequence
atgcggcccaagaccttccccgccaccacctacagcggcaacagcagacagaggctgcaagagatccgggaaggtcttaagcaaccatcaaaaagctctgtgcagggcctgcccgccggccctaactctgacacatccctggacgccaaagtgctggggtccaaggatgccaccaggcagcaacagcaaatgcgggccaccccaaaattcgggccataccagaaggcactgcgggagattcggtacagcctgctacctttcgccaacgagtctggaacttctgctgctgccgaggtgaacagacaaatgctccaagagctggtcaatgctggctgcgatcaggagatggccggccgagcccttaaacagacaggatcccgctctatagaggcggcacttgagtacatttccaagatgggatatctggaccccaggaacgaacagattgtgagggtcatcaaacagactagtccaggcaaaggactgatgcccacccccgtcacgcgaagaccttctttcgagggaacgggggattccttcgcctcttatcaccagctgagtggtaccccctacgaaggaccgtccttcggggccgacggaccaacagctctagaagaaatgcccagaccttacgtcgattacctgttcccaggcgtcggccctcacggccccggacaccagcatcagcaccctcccaaaggttacggcgcatctgtcgaagcagcaggagcccatttccccttgcagggcgcacattatgggcggccccacctactcgtccccggcgaacccttagggtatggcgtgcagcgatccccatccttccagagtaaaaccccccctgagacgggcggttacgcgagtctgcccacaaaaggccagggaggaccaccaggggctgggctcgccttccctccccctgccgccgggctgtacgtgccgcacccacaccataagcaggctgggcccgccgcacatcaattacatgtgttgggaagcaggagtcaggtttttgcctccgactcgccaccccaatccctgctgacgcccagccggaattccctgaacgtggacctttacgaactgggtagtaccagcgtgcagcagtggcccgccgcgaccttggcaaggcgagattccttgcagaaacccggactggaggcaccccctcgagcccatgtagccttcaggccagactgccccgtaccaagtagaactaactcttttaacagtcaccaaccacgccccggaccccccggaaaggcagagccttcgctgcccgctcctaatacagtgacagctgttacggctgcacacatactgcaccccgttaaatcagtcagagttctgagacctgaaccacagacagcggtcggtcctagccacccagcttgggtgccagcccctgcgccggccccggcccccgcccccgcacccgctgctgagggactcgatgctaaggaggagcacgcgcttgcgctggggggagcgggtgcctttccattggacgtggaatatggcggaccggaccgacgctgccccccaccaccatacccgaagcatcttttgttgcgttcaaagagcgaacagtatgaccttgacagtctctgtgccggtatggagcaatctttacgtgctggacctaacgaacctgagggcggcgacaagagccgaaagtccgcaaaaggcgacaagggtggcaaggacaagaaacaaattcagacatctcccgtgccagtgcggaaaaattccagggacgaggagaaacgggaatcccgaattaagtcttactctccgtatgcattcaagttttttatggaacagcacgtggaaaatgtcatcaaaacttaccagcagaaggtgaacaggcgccttcagttggagcaggaaatggctaaggctggactctgtgaggcggagcaggaacaaatgagaaaaatcctctaccagaaggagagcaactataataggcttaaacgcgcaaagatggataaaagtatgttcgtgaagatcaagacacttggtattggagcctttggcgaggtgtgcctggcgtgtaaagtggacactcatgcattatatgccatgaaaactcttagaaaaaaggacgtgctgaatcgcaatcaggtggcccacgttaaagctgaacgtgacatattagccgaggccgacaatgagtgggtggttaagttgtattactcttttcaggataaggactctctgtacttcgtcatggactacattccaggtggggacatgatgtcactcctgattcggatggaggtgttcccagaacatttggcccgcttttacatcgcagagttaacccttgcgattgaatctgttcataaaatggggtttattcacagagatatcaagcccgataatatcctgatcgaccttgacggtcatattaaattaacagacttcggcctctgcacaggtttcagatggacacataattcgaaatattatcagaagggctcacacgttagacaggatagcatggagccgtccgatctgtgggatgacgtgtccaactgtcgttgtggtgatcgactcaaaacccttgaacaacgggccaggaagcagcatcagaggtgcctggcccattctctcgtgggcactcctaattacatcgcacctgaggtcctcctccgcaagggctatacgcagttatgtgactggtggtccgttggcgtgattctgtttgaaatgttggtgggccagcctccttttctggcacctacacccactgagactcagttgaaggtgatcaactgggagaacactcttcatatcccagctcaggtcaagctctccccagaggcaagggacctaattaccaagctatgttgtagcgctgaccaccgcctaggccgcaacggggcagatgatctaaaagcacacccattctttagcgcaatcgactttagtagcgacattagaaaacagccagcaccttatgtcccgacaatatctcaccctatggatacttccaacttcgacccagtcgacgaggagagcccttggaacgatgccagcgagggaagcaccaaggcttgggacaccctcacctctcctaacaacaagcaccccgagcatgctttctatgagtttactttcaggcggtttttcgatgataacggatacccgttccgctgccctaagccaagtggtgctgaggcttcccaggcagagtcctcagatttagagtccagcgaccttgtggaccagaccgaagggtgccagccagtctatgtctag

SEQ ID NO: 24763 - DNA, 972 bp, Artificial Sequence
  Description of Artificial Sequence: Synthetic coding sequence
atggcctacgtgcccgcccccggctaccagcccacctacaaccccaccctaccttactaccaacccatcccgggtggactcaacgttgggatgtctgtgtacattcagggagtggcatcagagcacatgaagaggttctttgttaacttcgtggtgggccaggatcccggaagtgacgtcgcatttcattttaaccctcgattcgacggctgggacaaggtagtgttcaataccctccagggaggtaagtggggctccgaagaacggaaacggagcatgccttttaagaaaggtgcggcgttcgagcttgtattcatcgtcctggccgagcactataaggtcgtcgtgaatggcaatcccttctacgaatatggccatcgcctccccctccagatggtgactcatctgcaggtggatggtgatctgcagctgcaaagtattaatttcattggtgggcagcctctccgacctcagggcccgccaatgatgcctccttatcctgggcctggccattgtcatcaacagctgaattctcttccgactatggaaggccccccgacatttaaccctcctgtcccctatttcggacggctgcaggggggactaacggcccgaagaacgatcatcatcaaaggctatgtacctcccaccggcaagagtttcgctatcaacttcaaagtgggaagctcgggcgacattgctctccacatcaacccacgcatgggaaacggcactgttgtgcgaaacagcctcttgaatggcagctggggcagcgaggagaaaaaaatcacacacaacccattcggacctggccaattctttgatctctccattcggtgcggactcgaccggtttaaagtttatgcgaatggacagcatctcttcgactttgcacatcggctgagcgcattccagagggtggacactctggagatccagggggacgtgaccctcagctacgtgcaaatttag

SEQ ID NO: 24764 - DNA, 1530 bp, Artificial Sequence
  Description of Artificial Sequence: Synthetic coding sequence
atgaacaacgaggaggacctgctgcaggaggacagcacccgggacgagggaaatgaaacggaagcgaactcaatgaacacacttcgacggacaaggaagaaggtcacgaaaccctacgtgtgctcgacagaggtgggagaaacggatatgagcaattcaaacgattgtatgcgcgattccagtcagatcctcacgcctcctcagctgtcttcccggatgaagcatattagacaggccatggcaaagaatcgattgcaattcgttcgattcgaggcaacggatttgcacggagtcagtcggagtaagacaattccagcccactttttccaagagaaggtatcccatggcgtctgtatgccgcgaggatacctagaagtcatcccaaaccccaaggacaatgaaatgaacaatatcagggcaacttgctttaatagtgatatcgtcctgatgcctgagctcagtaccttccgggtactgccatgggcggatcggaccgctcgtgtgatatgcgacacgttcacagtcactggcgagcccttgctaacttcaccccgctatattgcaaagcgacagttaagtcatctgcaggccagtggtttttctctcctgagtgccttcatttacgacttctgcatcttcggcgtacccgagatcttgaacagtaagataatttcttttcccgcccttaccttcttgaataaccacgaccagccgtttatgcaagagctcgttgacggcctttaccacacgggcgcaaacgtcgagagtttttctagcagcacccgtccgggacagatggagatttcatttttacccgagtttgggattagttctgctgataatgccttcaccttaagaacaggcgttaaagaggtggctaggaagtacaactatattgcctcctttttcatagagaccgggttctgcgacagtggcatactgtcacactctctgtgggatgtagaccgcaaaaaaaacatgttttgctcaactagcggcaccgaacagctgacaattacaggtaagaaatggctcgctgggttacttaagcatagtgccgctctgagctgtctgatggctccctctgtttcatgcaggaaacgctacagcaaagatcggaaagaccttaagaaaagcgtccccactacttggggctacaatgataattcctgcattttcaacataaagtgtcatggcgagaagggaacccgtattgagaacaagttggggagcgcaaccgcaaatccttatctcgttctggcggccacagtggctgctgggctggatgggttgcatagttcaaacgaggttctggcgggcccagacgagagcactgacttttaccaagtagaaccttccgagatcccattgaagcttgaggatgctctggtggccttggaggaagatcagtgcctgagacaagcgcttggagagactttcattagatactttgtggcgatgaaaaagtatgagctcgagaatgaagaaatcgctgcggagcgcaataaattcttggaatatttcatctag

SEQ ID NO: 24765 - DNA, 627 bp, Artificial Sequence
  Description of Artificial Sequence: Synthetic coding sequence
atgaacaacgaggaggacctgctgcaggaggacagcacccgggacgagggaaatgagactgaagcgaactcaatgaacacacttcggagaacacgaaaaaaggtaacaaaaccgtacgtatgcagcacagaggttggagagacagatatgtctaacagcaatgattgcatgcgagactctagtcagatactgacaccccctcagctcagcagtagaatgaaacatataaggcaggccatggctaaaaaccgccttcagtttgtgcgattcgaagctaccgacctacacggggtgtcaagaagtaaaaccatccccgctcacttcttccaggaaaaggtttcacacggggtatgtatgccccggggctatcttgaagttatccctaatccaaaggacaacgaaatgaacaatatcagagcaacctgcttcaatagcgacatcgtgttgatgcctgagctgtccacttttcgtgtgctgccttgggccgaccggaccgctcgggttatttgtgataccttcactgtcaccgtatcggggatgtcaattggaaggaagacctgctctgccgctctgcttgaattgtcctcatcaaggagcctgggtaaaaacggttggcaagattcatag

SEQ ID NO: 24766 - DNA, 504 bp, Artificial Sequence
  Description of Artificial Sequence: Synthetic coding sequence
atgcactggggcaccctgtgcggcttcctgtggctgtggccctacctgttctatgtccaagccgtacctatccagaaagtccaggacgataccaagacgctaataaaaacaattgtgacaagaatcaatgatatttcgcacacccagtccgtcagcagcaaacagaaggtgacaggactcgatttcatccctgggttgcacccaatactaacactgtccaaaatggatcaaactctggccgtgtaccagcagatcttaacaagcatgccttcgcgcaacgtcatccagatcagcaacgatctagaaaacttgcgtgatctgctgcatgtattagcgtttagtaaatcctgtcatctgccctgggcgtctggtctggagacactggactccctgggaggggttctcgaagcatctggatattctactgaggtcgtcgctttgtccaggctgcaggggtctctacaagacatgctgtggcagcttgacctgagtcctggctgctag

SEQ ID NO: 24767 - DNA, 1791 bp, Artificial Sequence
  Description of Artificial Sequence: Synthetic coding sequence
atgggcagcgtgagcagcctgatcagcggccacagcttccacagcaagcattgccgcgcatctcaatataaattaagaaagagcagccaccttaagaagctcaatcggtattccgatgggctcctacggttcgggttctcgcaggacagcggccacggtaagtcctccagcaaaatgggtaagtccgaagatttcttttatattaaagtcagccagaaggcaagaggtagccaccaccctgactacactgccttaagtagcggagaccttggcggccaggctggagttgatttcgatcccagtaccccccccaaattaatgcccttttccaatcagttggaaatgggcagtgagaaaggtgctgtgagacctacggccttcaaaccagtgctccctagatctggtgctatccttcacagctcaccagagtcagcatcccaccagctccaccccgccccacccgacaagcctaaggagcaggagctaaagcctggactctgcagcggggccttatcggacagcgggcgaaactccatgagctccctccctacccactctactagctccagttatcagttggatcccctggtgactcctgttgggcctacttccagatttggcgggtccgcacataatattacccagggaattgttttgcaagactcaaacatgatgagccttaaagccctgtccttttctgacggcggaagcaaactagggcactctaacaaagctgacaaaggcccaagctgcgtgaggtcccccatctccacagatgagtgctctattcaggagctagaacagaagctgttagagcgggagggtgcactgcaaaagctccagcgatcatttgaggagaaagagctcgcttcctctctggcatatgaggagcggcctcggcgatgtcgagatgaattagagggacctgagcccaagggcggaaataagttgaagcaggcctcccagaaaagtcaacgcgctcagcaggtcttacatttacaagttctccaacttcagcaagagaagcgccagttgcggcaggagcttgagtctttgatgaaagaacaggacctccttgaaaccaaactcagatcctatgagcgcgaaaagacaagctttggacccgccctggaggaaactcaatgggaggtgtgccagaagtcaggggaaatctcactgctgaaacagcagctgaaagagtctcagacagaggtgaatgcaaaagcgtcagagatacttggcttgaaggctcagcttaaggatacgcgcggaaagttggaaggtctggaactgagaacacaggacttggagggcgccctgaggaccaagggcctcgaattagaggtgtgcgagaacgagctgcagcgaaagaaaaacgaggcagagctgcttagagaaaaagtaaacctgctagaacaggaactgcaggagctaagagctcaggccgccctagctagggatatgggtccgcctacttttcccgaggacgttccagcccttcagcgggagctcgaaaggcttagagccgaacttcgagaagagcggcagggccacgatcaaatgagtagtgggtttcagcatgaacgtctagtttggaaggaagaaaaagaaaaggtgatccagtaccagaagcagctgcaacaaagctacgtggccatgtaccagcggaaccagcgcctagagaaagccttacagcagttagcacggggcgattctgctggcgaacctctggaagtggacctggagggggctgatattccttacgaagacattatcgctactgagatctag

SEQ ID NO: 24768 - DNA, 231 bp, Artificial Sequence
  Description of Artificial Sequence: Synthetic coding sequence
atgggcagcgtgagcagcctgatcagcggccacagcttccacagcaagcactgccgcgcctctcagtacaagttgcgcaagagcagtcatttgaagaagctgaatagatacagtgatggcctcctccggtttggcttcagtcaagatagtggtcacggaaaggccatgactcgttgcccacgcgcctccagtatgtctggcagctgcggtagacggcggagacgaaggtag

SEQ ID NO: 24769 - DNA, 1722 bp, Artificial Sequence
  Description of Artificial Sequence: Synthetic coding sequence
atgggcagcgtgagcagcctgatcagcggccacagcttccacagcaagcattgtcgcgcctcacaatacaaactgcggaagtccagccacctgaagaagctgaacagatacagtgatggcctgttgcggttcggcttttcacaggacagtggacatggtaagagttccagcaagatgggtaagtccgaggattttttttacataaaggtgagtcaaaaggctagaggctcacaccacccggactacacagctctcagttccggggacctgggcggccaagctggtgttgactttgatccttcaacacctcccaaattaatgcccttctctaaccagctggagatgggttccgaaaagggcgctgtacgcccaaccgcttttaagccagttctaccacggtcaggagcaattctgcattcatctccagaatctgcctctcaccagctacaccccgcacctcccgataagcccaaggaacaggagctgaagcccggactctgctcaggcgccctctccgactctggccgcaatagcatgtcttcgctgcctacacacagtacgagttcttcttatcagctcgaccccttagtaaccccagttggaccaacaagtaggtttggaggcagtgcacacaatatcactcaagggatcgtcctgcaggactccaatatgatgtccctcaaagcactctcgttcagtgacggcggatccaaactgggacattcaaacaaggccgataaaggcccctcttgtgtccggagtcccataagcacagatgagtgttccatacaagagctcgagcaaaagctgttagagcgcgagggggctctgcaaaagctgcagaggtcctttgaggagaaagaactggcctcaagccttgcctatgaagaacgaccacggcgttgtcgagacgagctggaggggccagagccgaagggggggaacaaactgaaacaggcttcccaaaaatctcaacgggcacagcaggtcctccacctgcaggtccttcaattacagcaggaaaagaggcaactgagacaggagctggagtccctcatgaaggaacaagaccttctcgagaccaaactgcggagctatgagcgcgaaaagactagcttcggacctgcccttgaggaaacccagtgggaggtgtgccagaagtccggcgaaatctcactgctgaagcagcaactgaaagaaagccagacagaggtcaatgcaaaggcctcagaaattctcggcctgaaggctcaactgaaggacactcgaggcaagttggaaggacttgagctgcgtactcaggatttggagggggccttgcgaaccaaggggctcgaactggaggtgtgtgagaacgaactgcaaaggaagaagaatgaagccgaactactcagggaaaaggtgaatctgctggagcaggagctgcaggagctgcgggcgcaggccgccctggccagagatatgggtccacccacttttccagaagacgtccctgctctccaaagagaactcgaacgactggtgtggaaagaggagaaggaaaaggtaattcaataccagaagcaactccagcaatcatatgtggccatgtatcagcggaaccagcgtctcgaaaaagctttacagcagctggcccgcggggactccgctggggagcctctggaggtcgaccttgagggagccgacatcccatacgaagacatcatcgctactgagatttag

SEQ ID NO: 24770 - DNA, 1791 bp, Artificial Sequence
  Description of Artificial Sequence: Synthetic coding sequence
atgggcagcgtgagcagcctgatcagcggccacagcttccacagcaaacactgtagagcgtcccagtacaaactccgtaagtcatcccacctgaagaagctcaacagatacagtgacgggctgcttagattcggcttcagtcaggactcagggcacggcaagagctctagcaaaatggggaaaagtgaggattttttttatatcaaggtgtcccagaaagcccgcggctcccatcaccctgattatactgcgcttagcagcggggacttaggcggtcaggccggggtagattttgacccttcgacacccccaaagctgatgcctttctctaaccaactcgagatgggaagtgaaaaaggagctgtcagaccgacagccttcaagcccgtgctgcctcggtctggtgctattctccattcttcgcctgagtccgcctctcatcagctgcatcctgccccccccgataaacctaaagagcaagagctcaaacccggcctgtgctctggagcactgagtgactccgggagaaactctatgtcctcactccctacacacagcacgtcaagctcttatcaactggacccactggttacccccgttgggccgactagtcggtttggcggtagcgctcataacatcacgcaggggatcgtgttacaggacagcaacatgatgtcactaaaggctctcagcttcagcgacggaggctccaaattgggtcactccaacaaggcagataaggggccaagctgtgtgcgctcacccatctccactgacgaatgcagtatccaggagctcgagcagaagctgctcgagagagaaggagctctgcagaagctgcaacgcagttttgaagagaaggagctcgcatctagcttggcctacgaggagaggcctcggcggtgcagagatgagctcgaaggcccggagccaaagggcggcaataagctcaagcaggcttcccagaaaagtcagcgtgcacagcaagtactgcacctccaagtattgcagctgcaacaggaaaagagacagctgcgacaggaattggagagcctgatgaaggaacaagacctgcttgaaacaaagctgcgcagctacgagagagagaagacctcctttggcccagcacttgaagagacacaatgggaggtgtgccagaagtctggagagatttcactactcaagcaacagctgaaggaatcccagactgaggtgaacgccaaggcaagtgagattctcggcctgaaagcccagcttaaggacacccgcggcaagctggagggactggagcttagaacacaggatcttgaaggggcattgcgtacaaagggactcgagctggaggtgtgtgaaaacgagctgcagagaaagaagaatgaggccgaacttctcagggaaaaggtgaatttgctcgagcaggagctccaggaacttagggcccaggcagcactggcaagagatatgggtccgccaacgttcccagaagatgtacctgccctccaacgcgagctggagagactgagggcagagctacgagaggagcgccagggacacgatcaaatgtcatcaggattccagcatgaaaggctcgtatggaaggaagaaaaggagaaggtcatccagtaccagaagcagctgcaacagtcttacgtcgcaatgtatcaaagaaatcagagattggaaaaggccctgcaacagctagctcgcggtgacagcgccggcgagccattggaggtggacctggagggagcggatataccctatgaggatatcattgcaactgaaatctag

SEQ ID NO: 24771 - DNA, 1614 bp, Artificial Sequence
  Description of Artificial Sequence: Synthetic coding sequence
atgggcagcgtgagcagcctgatcagcggccacagcttccacagcaaacactgcagggcaagccagtacaagcttcggaagtctagccacctaaagaaactgaatcgatactcagatggactgctgaggttcgggttcagccaagattccggacacggcaagagcagttccaaaatgggcaaatctgaggatttcttctatatcaaggtcagtcagaaagcgcgcggtagccatcatccggattacactgccctctccagcggtgatctgggagggcaggcaggcgttgacttcgaccccagtacccccccaaagctgatgcctttctcgaatcagcttgagatgggatccgagaaaggagctgtcaggccaaccgcctttaaacctgtgcttccaaggagcggggcaatattacattcatctcccgaatcagcctctcaccaactgcatccggctccaccagataaacccaaggagcaggaactcaagcctggactttgcagtggggctctctccgatagcgggagaaatagtatgagttctctgccaacacactcaacatcatcaagctaccagctcgatccactagtcacccccgtgggccccacatcacgtttcggcgggagcgcccacaatataactcaaggaattgtcctccaggatagcaatatgatgtcactaaaagccctttccttttccgacggcgggagtaagcttggccactccaataaggccgacaaggggccctcttgtgtaaggagcccaatttcaactgatgaatgttctatccaggagctggaacagaaactgctagaacgcgaaggggcactacagaagctgcagcgatcatttgaagagaaggagttggccagtagcttagcctatgaagagcggccacggcggtgtcgtgatgagcttgaaggccccgaaccaaagggaggcaacaagcttaagcaagcgtctcagaaatcccagcgagcccagcaggtgttgcatctgcaggtattgcagctccaacaggaaaaacgccagctgagacaggagctagagagcttgatgaaggaacaggaccttctggaaacaaaactgagatcctacgagagggagaagacttcctttggccctgctctcgaggagactcagtgggaggtgtgccagaaatcaggagagatatcactgctgaagcaacaattaaaggaaagccagactgaagtcaacgccaaagcaagcgaaatcctgggtctgaaggcccaacttaaggacactagggggaaactagagggccttgaacttcggactcaggacctggaaggcgcccttcggaccaaagggttggagctcgaagtatgcgaaaatgaactacagcgaaagaaaaacgaggcagagctcttgcgtgaaaagcacgaaagactggtgtggaaagaagagaaggagaaggtgattcagtaccaaaagcagctccagcagtcgtatgtagccatgtatcagcgaaatcaacgactcgagaaagcgctgcaacaacttgcacgcggcgattcggctggcgagccgctcgaggtagatcttgaaggtgcagacattccttacgaggatattattgcgaccgaaatttag

SEQ ID NO: 24772 - DNA, 1005 bp, Artificial Sequence
  Description of Artificial Sequence: Synthetic coding sequence
atgaccgagaacagcgacaaggtgcccatcgccctggtgggccccgacgatgtggagttctgttcccctcccgcctatgccactttgactgtcaagccgtcgtcccctgcacgtctcctgaaagttggggctgtagtattgatctccggcgccgttttgttactgtttggagccatcggtgctttttatttctggaagggcagtgattcccatatctacaacgtgcactataccatgagtattaatggcaagctccaggatgggagcatggaaattgacgctgggaataacctggaaacttttaaaatgggctctggagccgaggaggccatcgccgtaaacgactttcagaacggcataaccggtatccgcttcgccgggggagagaaatgttatatcaaagcccaagtcaaagccaggattccggaggtgggggctgtcacaaagcagtctatatcatcaaaactggaaggaaaaattatgcctgtgaaatatgaggagaactcactaatctgggtagccgtggatcagcccgtgaaggataacagctttttatccagcaaagtgctggaactgtgtggggatttgcccattttttggctgaagcccacttatcccaaagagatacagcgtgaaagaagagaagtggtacggaagattgtacctactaccacaaagcggccccactcgggacctaggtccaatccaggtgcgggtaggcttaataacgaaacacgaccctccgtccaggaagactcacaagccttcaatccggataatccttaccaccaacaagagggcgagagcatgactttcgaccctcggcttgaccacgaggggatatgctgtatcgaatgtaggagatcttatacacactgccagaagatttgtgaacccttgggtgggtattacccatggccctataattaccagggctgtaggtcggcatgcagagtcattatgccatgctcgtggtgggtcgccaggatcttggggatggtttag

SEQ ID NO: 24773 - DNA, 390 bp, Artificial Sequence
  Description of Artificial Sequence: Synthetic coding sequence
atgagcatcaacggcaagctgcaggacggcagcatggagatcgacgctgggaataacctagagacatttaaaatgggatccggcgccgaggaagctattgcggtgaatgacttccagaatgggattactggcattcgtttcgctggaggcgagaagtgttacatcaaagctcaagtgaaagctagaatcccagaagtgggtgctgtgaccaagcaatccattagttctaaactggaaggcaagatcatgcccgtgaagtacgaggaaaattctcttatctgggtagcggtggaccagcctgtgaaggacaacagcttcctgtctagcaaggtattggagctatgtggcgacctgcccattttttggctgaagccgacctaccctaagtag

SEQ ID NO: 24774 - DNA, 1002 bp, Artificial Sequence
  Description of Artificial Sequence: Synthetic coding sequence
atgaccgagaacagcgacaaggtgcccatcgccctggtgggccccgacgatgtggaattttgctctccacccgcgtatgccactctaaccgtgaaaccatctagtccagctaggctgcttaaggtgggcgccgtggtactgatttctggggctgtgctgctgttgttcggtgccatcggggcgttttatttttggaaagggtcggacagtcacatttataacgtgcactacaccatgagtattaatgggaagctgcaggacgggtcgatggagattgatgcgggaaataacctcgagactttcaagatggggtcaggtgccgaggaggcaattgccgtgaacgacttccaaaacggtattaccgggatacgttttgctggaggggagaaatgttacataaaggcgcaggttaaagcgcgcatccctgaagtgggagccgtcaccaagcagtcaatctcctcgaaactggaggggaaaataatgcccgtgaaatacgaggagaactctctgatctgggttgccgttgaccagccagtaaaggacaacagctttctgtcctcgaaagtgctggagctttgcggcgatctccccattttctggttgaaacctacctacccaaaggaaattcagcgcgaacggcgcgaggttgttcggaagattgttccaacgaccaccaaacgcccacactctggtcccagaagtaatcctggcgccggtcgactgaacaatgagacaaggccctcagtccaggaggactcccaggcctttaacccagacaacccgtatcaccaggaaggagagagcatgactttcgatccccggctcgaccatgagggaatatgctgcatcgaatgcaggcgatcttatacccattgccagaaaatctgcgagcccctcgggggctattatccctggccctataactaccaggggtgtagatcagcctgcagagtcatcatgccttgtagctggtgggtagcccgcattttggggatggtatag

SEQ ID NO: 24775 - DNA, 408 bp, Artificial Sequence
  Description of Artificial Sequence: Synthetic coding sequence
atgaacgaggtgatcatctacaacgtgctgctgctgcggaccatctcatgtatctctgagacctacggccactacctcattcattgtccttctaaaatatcacccgagctgctgaaaaaggagtcaattacaaattcttatgctcatttccaaatatacaatgtgcattacacaatgtcgattaatgggaagctgcaagatggcagcatggagattgacgcgggcaataacctggagactttcaaaatgggaagcggcgccgaagaagctattgccgttaatgacttccaaaatgttagtattttccatgcattccgggaatttaatcaagccagccttagggattttagcaactcccggagatcctctgtctcgcacacacaccccaacggaaattgctcactgtag

SEQ ID NO: 24776 - DNA, 2760 bp, Artificial Sequence
  Description of Artificial Sequence: Synthetic coding sequence
atgcagcggagcatcatgagcttcttccaccccaagaaggagggcaaagcgaagaagccagagaaagaggctagcaattctagccgggaaaccgaacccccaccaaaggccgctctgaaggagtggaatggcgtagtgagcgaatcagactctcctgtcaaacggcctggccgaaaggcagcaagggtgttaggtagcgagggcgaagaagaagacgaggccctgtcacccgctaaaggccaaaaacccgcgctggactgcagtcaggtgagtcctcctagacctgccacatctccagagaataatgccagcctgtcggacaccagtcctatggatagtagccccagtgggatccctaagagacgaacagcgcggaagcaactccctaagcggaccattcaggaggtcttagaggaacagagtgaggacgaggaccgggaggccaagagaaaaaaggaggaggaggaggaggagacccccaaggaatccttaacagaagccgaggtggcaactgaaaaggagggcgaggatggtgatcagcccacaacccctcccaaacctcttaaaactagcaaggctgaaacaccaactgaaagcgtcagcgagcctgaggtcgccactaaacaagagctgcaagaagaggaagaacagacaaaaccaccgcggagggctcctaaaactctaagctccttcttcaccccccgcaagcccgccgtaaaaaaagaggtcaaggaggaagaacccggcgcaccaggtaaggagggggccgccgaaggacccttagacccttccggttacaaccctgcaaaaaacaactatcaccctgtggaagatgcctgttggaagcccggccagaaagtgccatatctcgctgtggcccgcaccttcgaaaagatcgaggaggtgagtgctaggcttcgaatggtcgaaactctctcaaatctgctccggagcgttgtggccctttccccacctgacttattgcccgttctgtacctgtctctgaaccatttaggccctccacagcaggggctggagttgggagtgggcgacggagtgcttctgaaagcggtggctcaggcaactggcaggcaactagagtcagttcgtgccgaggcagctgaaaaaggggatgtcggcctggtggctgaaaatagcagatctacacagcggcttatgttgccacctccaccacttaccgcatccggcgtgttctccaaatttcgagatatagcaaggctaacgggcagcgccagtacagccaagaagattgacattataaaaggcctcttcgtggcttgtcgccacagcgaggcgcggtttattgcccggtccttgagtgggaggttgaggctgggtcttgcggagcaatccgttcttgccgccttaagccaggcagtctccctgactcctcccgggcaagagttcccgcccgctatggtggacgccgggaaaggcaagactgccgaggcaagaaaaacttggttagaggagcagggtatgatactcaagcagacattttgcgaggtcccagatttggacagaatcattccagtgctgctggaacatggcctggaaaggcttccagaacattgcaagctttcaccaggtataccactcaaacctatgctggcccatcccacacgcgggatcagtgaggtgctgaaaaggttcgaggaggctgcctttacctgcgagtacaagtatgacggccagcgcgcgcagattcatgccctggagggcggggaggtgaagattttcagtagaaaccaagaggacaacactggtaagtacccggacatcatttccagaatccccaagatcaaactgccgtcagtgaccagctttatcctggacacagaagccgtggcctgggacagggaaaaaaaacagattcagccgtttcaagtcttgactacacgaaaaaggaaggaagttgatgcctctgaaattcaggtacaggtctgcctctacgccttcgacctgatttatttaaacggcgaatctctggttagagagccactgagtaggcggcgccaactcttgcgggaaaacttcgtcgaaacagagggagaattcgtcttcgcaacatcgctggatacaaaagacattgaacagatcgccgagttcctggaacagtccgttaaggattcctgcgaaggcctgatggtcaagaccctggatgttgacgccacctacgaaatagccaagcgcagtcacaattggctcaagcttaagaaggactatctggatggcgtcggcgatacattggatctggtcgtgatcggcgcctatcttggacggggaaaaagagctggacggtacggcggtttcctcctcgccagctacgacgaggatagcgaagagttacaagctatatgtaagctggggacggggttcagcgacgaagaacttgaagagcaccaccaatccctgaaggcacttgtcctgcccagcccaaggccttacgtgcgtatcgatggggcggtcattcccgaccattggttagacccctctgctgtatgggaagtgaagtgtgccgacttaagcctgtccccaatctatcccgcagctagggggcttgtcgattcagataagggaatttctttaaggttcccccgttttatcagagtgagggaggacaaacagcctgaacaggccaccactagcgcgcaagtggcctgtctgtataggaaacagtcccagatccagaaccagcagggtgaggacagtggttccgaccccgaggacacctactag

SEQ ID NO: 24777 - DNA, 2667 bp, Artificial Sequence
  Description of Artificial Sequence: Synthetic coding sequence
atgcagcggagcatcatggccgccctgaaggagtggaacggcgtggtcagcgaatcagattcacccgtcaaacgaccaggaaggaaggctgccagggtgctgggaagcgaaggcgaagaagaggatgaggccctgagcccagctaagggacaaaaaccagctctcgattgctcacaggtgagcccgccaagacctgcaacttcccctgaaaacaatgcctccctgtccgatacttcacccatggacagctcaccctcaggcatcccaaaaagacgcactgcccgtaaacagctccccaagaggacgatccaagaagtccttgaggagcagtccgaggacgaagatagggaagcaaaaagaaaaaaagaggaagaggaggagaccccaaaggaaagtttaacagaagccgaagtagctaccgaaaaggagggagaggacggagaccagcctacaaccccaccaaagcccctgaagacctccaaggccgaaacaccaacggaaagtgtgagcgaaccagaagttgcaacaaagcaggaacttcaggaagaggaggagcagacgaagcccccccgccgggcgcccaagaccctatcttccttcttcaccccacggaagccggccgtgaaaaaggaggtaaaggaagaggagccaggcgcacctggtaaagaaggagcggctgaagggcctctggacccttccggatacaaccctgcaaaaaataattatcatcccgtggaagacgcatgttggaagcccggacagaaggtgccctatttggcagtcgcacggacattcgaaaagatcgaagaggtttcggcacgcttacggatggtcgagacactttccaacttgctgagaagcgttgtagctctgtccccaccagatctgctgcccgtcctttatctgtccctgaaccacctgggtccaccacagcagggcttagagctaggggtcggcgacggagtactcctcaaagctgtggcccaagctacaggaaggcaactggaatcagtgagggccgaggctgcagagaagggagatgttggtctggtcgccgaaaactcacgaagtacacagagacttatgcttccccccccccccctgactgcatctggcgtgttctcaaagtttcgcgatatcgcccgactaacaggatctgcatctaccgcaaagaagatcgacatcattaagggattgttcgtagcttgtaggcattccgaggcaagattcatcgctagaagtttatcaggaagactgaggcttggattggctgagcagtctgtcttggcggccctatctcaggcagtatcactgaccccccctggccaggagttcccacctgctatggtcgatgccggtaagggaaaaacagctgaagcgcgcaaaacatggctggaggaacagggcatgattctaaaacagacgttttgcgaggtaccggatctggaccgcattattcccgttctgctcgagcacggcttggagaggctccccgaacactgtaaattatcaccgggaatccctcttaaaccgatgttggcacaccccactagagggatttctgaggtcctaaagagattcgaggaagcagcctttacttgtgaatataaatatgatggacagcgagcacagattcacgcgctggagggcggtgaggtcaaaattttctctcggaatcaggaagataatacaggaaagtatcctgacattatttcgagaatcccaaaaatcaaactgccatctgttactagctttattctcgatacagaggctgtcgcttgggaccgcgagaaaaagcaaatacagccctttcaggtcctaacgacgcgtaagcgaaaggaggtagatgcctcagaaatccaggtccaggtgtgcctgtacgcgtttgacttgatttatctaaatggcgagagtttagtacgcgaacccctgtcccgtcgacgtcagttgctaagggaaaatttcgtcgagacagaaggtgagttcgtcttcgccactagtctggacacaaaagatattgagcaaattgcagagttcttagagcagagcgttaaggattcttgtgagggcctgatggtcaaaacacttgatgtggatgcaacatacgagatcgctaaacggtctcataactggttgaagcttaagaaagattacctagatggggtgggcgataccctggacctggtcgtaatcggggcatacctgggcagaggcaagcgagcgggcaggtacgggggctttctactggctagttacgacgaggattctgaggaactgcaggccatatgcaagctgggcactggctttagcgacgaggaactcgaggaacaccaccagtcgttgaaagcccttgtccttccttccccccgcccgtacgtacggattgacggcgccgtcattcccgatcactggctggacccctccgcagtctgggaagtgaagtgcgcagatctcagcctctcacctatttatccggccgcacgaggactggtggatagcgacaaaggcataagcctgcggtttccgcggttcattagagtgcgggaagacaagcaacccgaacaagccaccacgagcgctcaggtggcttgcttgtatcgaaaacagtcccagatccaaaaccagcagggcgaagatagtggcagcgatcccgaggacacttactag

SEQ ID NO: 24778 - DNA, 2556 bp, Artificial Sequence
  Description of Artificial Sequence: Synthetic coding sequence
atgcagcggagcatcatgagcttcttccaccccaagaaggagggcaaggctaaaaaaccagagaaagaggcgagcaactcctctagagaaacggagccacctcctaaagccgcccttaaggagtggaacggggtggtgtccgaatcagactcgcctgtgaaacggcctggcagaaaagcagctagggtactcggaagcgagggggaggaagaggacgaagcgttatctccagccaagggacagaagccagccctggattgttcccaagtttccccacccagacctgccacttctcccgagaacaatgcttctctttctgatactagcccaatggattctagccccagcggaatcccaaaacgacgaacggaagccgaaactccaacagagagcgtatccgagccagaggttgctaccaagcaagagctacaagaagaggaggagcagaccaagccacccagaagagcgcccaagactttaagctctttcttcacccccagaaagcccgctgtgaagaaggaagttaaagaggaggaacccggggcccctggcaaggaaggtgccgcagaggggccgttagatcccagcgggtacaaccccgcaaagaacaattaccacccggtcgaggatgcctgctggaagccaggacagaaggtcccctacctggcagtggctcggacattcgaaaaaatcgaagaagtgagtgcaaggttacggatggttgagactttatcgaaccttttaaggtcagtggtggcactgtctccgccagatctgcttcctgtgctgtatctgtctttgaaccatctgggtccacctcagcaggggctcgaactgggcgttggcgatggcgtcttgctcaaagcagtggcccaggctaccgggagacagcttgagagcgtaagagctgaagcagcagagaagggtgatgtgggtctcgttgcggagaactccagatccacccaacggttaatgctcccccctcctcctctcaccgcctctggtgtctttagtaagttcagggacattgccaggctgactggaagcgctagtactgccaagaagatagacattattaaagggctctttgtcgcgtgccgccattccgaggcccggttcattgcgagatcactgagcggccggctgcgccttggtcttgcagagcagagtgtgctggccgccctgagtcaagccgtctctctgacacccccgggtcaggagtttcctcccgccatggtggatgcaggcaaagggaaaaccgccgaagctcgcaagacctggttagaggaacaagggatgatcctgaagcagacattttgtgaggtgccagatctcgatagaattattcctgtgctgctggaacatgggctcgaacgccttccagaacactgcaaattgtcacctggcatacccctgaagcccatgcttgcacaccctacaagaggcatatctgaggtcctgaagagattcgaggaagcggcatttacgtgtgaatacaaatacgacgggcagagagctcagatccacgcgttggaaggcggagaggtaaagatcttcagtaggaatcaagaagataacaccggcaagtatccagacatcatcagcaggatccccaagatcaagctgccctcggtcacaagtttcatactggataccgaggccgtcgcgtgggaccgggagaagaagcagatacaaccttttcaggtgctgacaacaaggaagagaaaagaagtcgacgcctctgagattcaggtgcaagtctgtttgtatgcatttgacctcatttacctcaacggagagtcgttggtacgcgaacccctttcccgaagaaggcaactgctgagagaaaattttgtagaaacagaaggcgagttcgtttttgcaactagtctagatacaaaagatatcgagcagatagccgagtttcttgaacagtcagtgaaagatagctgcgagggattgatggtcaagacactcgacgtggatgccacctacgaaattgccaaacggagtcacaactggcttaaattgaagaaggactatctcgatggagtaggagatactcttgacttggtcgtaattggcgcatacttgggacgtggcaaacgtgctggccgctacggcggattcttgctggcttcttacgatgaggattctgaggaactgcaagccatatgcaagcttggtactggtttttccgacgaggagctggaggagcaccaccagtcccttaaagctctggtgctccctagtcctcgcccatatgttagaattgacggtgccgtgataccggatcactggctggatccctccgccgtgtgggaggtgaagtgtgccgacttatccctgtctccaatctatcccgctgctcgcggattggtcgactcagataaaggaatcagtcttcgtttcccccgcttcatccgtgttagggaagataaacagccagagcaggcgacaacatccgcacaggtagcctgtttgtaccgtaaacagtctcagattcagaatcagcaaggcgaggatagtggcagcgaccccgaggacacttattag

SEQ ID NO: 24779 - DNA, 1248 bp, Artificial Sequence
  Description of Artificial Sequence: Synthetic coding sequence
atgcagcggagcatcatgagcttcttccaccccaagaaggagggcaaagctaaaaagcccgaaaaggaagcttctaatagtagtagagaaacagaacctccacccaaggccgccttgaaggaatggaacggtgtggtatcagaatccgatagccctgttaaacgccccggccgtaaggcggcccgagtgttaggttcagaaggggaggaggaggacgaggccctgagtccagccaaaggccaaaaaccagccctggattgctcacaggtttctccaccccgaccagccacttcaccagagaataatgctagtctttcggacactagccccatggactcgtccccttctgggatcccaaagcgccggactgaggaagagactccaaaggagagcctgaccgaagccgaggtggcgactgagaaggaaggggaggacggagaccagcccacgacccctccgaagcccttgaaaacttctaaggccgagaccccgacagagagcgtttcggaaccagaggtggccacaaagcaagaactccaggaagaggaagaacagacaaagccgcctcgccgggcccccaagaccctctcttcattctttactcccaggaaaccagccgtgaagaaggaggttaaggaggaggagccaggtgccccaggaaaggagggggccgcggaaggcccactcgatcccagcggctataaccctgccaaaaataattatcacccagtcgaggatgcatgctggaagccaggccagaaggtcccctacctggctgtagctagaacatttgagaagattgaggaagtgagcgcacggctgagaatggtggagacattgtccaatttgttaagaagtgtggtagctctgtcccccccagacttattgcctgtgctctacctgtcgttgaaccatcttgggcccccacagcagggcctggaacttggggtaggtgatggtgtattactcaaagcagtggcacaggccactggacgcgaacgtcgggaaaccaggagtcataactgccatccacggcacccacacccgaggagccctctgaaagtgggtagttggtcccctagcggactgagacagcctaggaaagccacctggggatggtggccgcgtacagctgccgcacccagaggctcttgctgtcaccaccttcgtagcctgccccccgggagttcagcatcatcagccacctcaccaggcagcctggcggtgttgccccagccacgcaggtag

SEQ ID NO: 24780 - DNA, 2499 bp, Artificial Sequence
  Description of Artificial Sequence: Synthetic coding sequence
gtgtgctgccccggcagcggcgcccgggaccagcggaaggcccggctgaccgatgaggaaaagtgttggacagggagagagaacagcgacgccaatatgcagagaagtattatgagctttttccaccctaagaaggaggggaaggctaaaaaacctgagaaagaagcttccaattcaagccgggaaacagagcctccacccaaggccgctctcaaggagtggaatggcgtggtatcagaaagcgactctcccgtgaagaggcccggcagaaaggcagcccgcgtcctcggctcagagggggaggaggaggacgaggctctctccccagcaaagggacagaaacccgcactggactgtagccaagtctcgccgcctagacccgccaccagccccgagaacaacgcgagtctaagtgacacgtccccaatggacagctccccgtctggaattccaaagcgccggaccgcccgtaagcagctgccgaagcggaccatccaggaggtgcttgaggaacagtctgaggacgaggatcgcgaggctaaacgaaagaaagaagaggaggaggagacccccaaggaaagcctgactgaagctgaggtggctacggagaaggaaggggaagatggagatcagcctaccaccccaccaaagcccctgaaaacatcgaaagcagaaacacctacagagtccgtgtctgagcctgaagtggccaccaagcaggagctgcaggaagaagaggagcagactaaaccccctcgcagagctccaaaaactctgtcttctttcttcacaccccgcaaacccgccgttaagaaggaggtcaaggaggaagagccaggcgccccgggtaaagagggcgctgccgaaggtccactcgaccctagcggttataaccccgcaaagaataattaccaccccgtggaggacgcatgctggaaacccgggcagaaggtgccctatttggctgttgcccgcacctttgaaaaaatcgaagaagttagcgcacggctgcgaatggttgagacactgtccaacctactgagaagcgtcgtggccctaagtcccccagacttgctccccgtgctttacctcagcttgaaccatcttggccccccccagcaaggcctcgagttgggtgttggcgatggcgtgctgctgaaggccgtggcgcaggcaactgggcgtcagttagagagtgttcgggcggaagccgcagagaagggggacgtcggtctcgtcgccgaaaatagcaggtctacccagcgtttgatgctgcccccaccgcctctcaccgcatcaggcgtattttctaaatttcgagacatcgccagactcactggatcagctagcacagcaaaaaagatcgacatcattaaaggtttgtttgtcgcctgtagacactccgaggcaagatttatcgcaagaagcctgagcgggcgtttgcgccttgggttagccgaacaaagcgtgctcgcggccttgtcccaggcagtatcattgactcctccaggtcaggagtttccccccgccatggtcgacgcaggtaagggcaagacagctgaggcgcgaaaaacgtggctggaagaacagggtatgatcctgaaacagaccttctgtgaagttcctgatcttgaccgcattatccccgtgctgctggagcacggcctcgagcgattgcctgagcattgtaaattgtcccccggtattccactcaaacccatgctcgcccatcccacacggggcatatccgaggtgctgaagagattcgaggaagccgcctttacctgcgagtataagtatgatggtcagcgcgcacaaatccatgctctcgagggcggagaggttaagattttcagcagaaaccaggaagataacaccgggaaataccccgatatcatatcccgcatccccaagatcaagctaccgtctgtcaccagcttcattctggatactgaagctgttgcctgggatagagagaagaaacagattcagccctttcaagtgcttacaactcggaaaaggaaagaggtggacgcctctgagatacaggtgcaggtgtgcctatacgcattcgatctgatttatctaaatggggaatctctggtcagagaacccctcagccgccgccgccagttgttaagggagaacttcgtggaaaccgagggagaatttgtgtttgccaccagtcttgacaccaaagatattgagcagattgctgagtttctggagcaatccgtgaaggactcatgtgagggcttgatggtcaaaacactcgacgtcgatgctacctacgagattgcgaagaggtcacacaactggctcaaactgaaaaaagactacttggacggcgtgggggacacactggatttagtggtaatcggggcgtatttgggtagggggaaacgcgccggccggtacggggggttcctgctggcatcctacgacgaggactctgaggagctgcaggcgatttgcaaagtgctggggaattggggttag

SEQ ID NO: 24781 - DNA, 2850 bp, Artificial Sequence
  Description of Artificial Sequence: Synthetic coding sequence
atgagcctggccttcaagatcttcttcccccagaccctgcgggccctgtctagaaaggaactgtgcctcttcagaaagcatcattggcgtgacgttcggcagttctctcaatggtccgagacagatctgctgcacgggcacccgttgttcctccgcaggaaacctgtgctgagcttccaaggctcacacttaaggagccgcgccacctacctggtctttttaccagggctgcacgtgggcctgtgttccggcccgtgtgagatggcggagcaaaggttctgtgtggactacgctaaaaggggtaccgcaggctgcaagaagtgtaaagagaagatagttaagggtgtctgcagaattgggaaagtggtcccaaatccattctccgagtctggcggcgacatgaaggagtggtaccacatcaaatgcatgtttgaaaaactggagcgcgccagggcaaccacaaagaaaatcgaggatcttacggaactcgaagggtgggaagaactggaagataacgaaaaagaacaaatcacgcagcacatcgccgacttgtcatccaaggccgcaggtactccaaaaaaaaaagctgtggtccaggccaagctgacaactactggccaggtgacgtctcctgtaaagggagcgtcctttgtgacatcaacgaacccacgcaagttttcaggcttctcagcaaaacctaacaactctggagaagccccttctagcccaacaccaaagaggtctttatcctcaagtaaatgcgatccaaggcacaaggattgcttactcagagagttcagaaagctttgtgccatggttgctgataacccgtcatacaataccaagacccagattattcaggatttcctgcgcaagggctctgcaggagacggctttcacggagacgtttatttgactgtgaaactgctccttccaggcgtgatcaaaacggtctataacctgaacgataagcagatagtgaagttgttttcccgtatcttcaattgcaaccctgacgacatggcccgcgacctcgaacagggggacgtgagtgagacgattcgggttttcttcgagcagagtaagagcttcccccccgcagctaagtcactgctgaccatccaggaggttgatgagttcctactaagattgtctaaactgactaaagaagatgagcagcaacaagcactgcaagacatcgcctctcgatgcactgctaatgaccttaagtgcatcatccggctgattaagcatgaccttaagatgaacagtggggctaagcacgttctggatgccttagaccctaatgcctatgaagcatttaaagccagtagaaacttgcaggatgtcgttgaaagagtgctgcataatgcccaagaggttgaaaaggaacctggccaacggagggccctttccgtacaggcatccctaatgacaccagtccagcctatgctggccgaggcttgcaaatccgttgagtacgcaatgaagaagtgccctaatgggatgtttagcgagatcaagtatgacggtgagagagttcaagtgcataaaaacggcgaccacttctcttacttttccagaagtctgaaaccagtactgcctcacaaagttgctcactttaaggattatattccccaggcttttcccgggggacactccatgattctcgattctgaagtcctcctgatagataataagaccggtaagccactgccctttggaaccctgggcgtacataagaaggccgcgttccaagacgccaacgtttgtttatttgtgttcgactgcatatattttaacgacgtgtccctaatggatcggccgctatgcgaacggaggaaattcctccacgacaatatggtagagatccccaacaggatcatgttttcagagatgaagcgagtcaccaaggctctggacctagccgacatgattaccagagtaatccaggagggcttagagggcctggttctgaaagatgtgaaagggacatacgaacctgggaaaagacactggttaaaggttaaaaaagattacctgaacgagggtgcaatggccgacaccgctgacctggtggtgctgggtgcattttacgggcaggggagcaagggggggatgatgagtatcttcttgatgggctgttacgatcccggttcccagaaatggtgtaccgtaacaaagtgtgcgggcggccacgatgacgccactttggcccgactgcagaatgagctggatatggtgaaaatctccaaagacccgagcaaaattcccagttggcttaaggtgaataagatctactaccccgactttatcgtccccgatccaaaaaaagctgctgtgtgggaaatcacgggagccgaattctcaaaatcagaagcccataccgctgacggtatttcgattagattccccaggtgtacgcggatcagagatgacaaagactggaaaagtgccacgaaccttcctcagttgaaggagctgtaccaactgagcaaagaaaaggccgacttcaccgtggtcgcaggggatgaaggatcgtcaactactggtgggtcaagtgaggagaataaaggcccctcagggtctgccgtcagcagaaaggctccaagcaaaccatccgcctctactaaaaaagccgagggaaagttatctaactctaattcaaaagacggaaatatgcagaccgcaaaaccctccgctatgaaggtgggagagaaactcgccacgaagtcctcgcccgtcaaagtgggggaaaaacgaaaggctgccgatgaaacgctttgccaaacaaaacggagacctgcctctgaacagcgagggaggactgtaccggctggcagacggtag

SEQ ID NO: 24782 - DNA, 3030 bp, Artificial Sequence
  Description of Artificial Sequence: Synthetic coding sequence
atgagcctggccttcaagatcttcttcccccagaccctgcgggccctgagccgcaaggaactgtgcctgtttcgcaagcaccactggagggatgtccgacagttctcacagtggagcgagacagatctcctccatgggcaccctctcttcctcaggagaaagcccgtcctatcattccaaggatctcatctgaggtctcgcgccacctacctggtatttctgcccggcctccacgttggactgtgctccgggccatgtgagatggctgagcagcgtttttgtgtagactatgccaagcgtggaaccgcgggctgcaaaaaatgcaaggaaaagatcgtaaagggggtgtgcaggataggaaaggtagtgccgaaccctttttccgagtctggaggggatatgaaggaatggtatcacattaagtgcatgttcgaaaagcttgagagagctagggccacaacaaagaaaatagaagacctcaccgaactggagggctgggaagagctggaagataatgagaaagaacagatcacacagcatatcgcggacctatccagtaaagcggccggtaccccgaagaagaaagccgtggttcaggcaaagctaacgaccaccgggcaggtcacatcaccggttaagggcgcatcatttgtgacgtctaccaacccaagaaaattcagtgggttcagcgccaaacccaataactcaggggaggctccttcctcacctacgccaaagcggagcctgtctagttctaaatgcgaccctcgccataaggattgtctgttgagggagttccgaaaactctgcgcaatggttgccgataaccccagttacaacacaaagacccaaatcattcaggacttccttagaaagggcagcgcaggtgatggcttccacggagacgtctatctgacagtgaaactgttgctacccggggtgattaagactgtctataatctgaacgataaacagatcgtcaagctgttttccaggatattcaattgtaatcctgacgacatggcaagagacctggagcaaggggatgttagtgaaactattcgtgtttttttcgaacaatccaaatcatttccacccgcggctaagagcttactgacgatacaggaagtagacgagtttctgctgagactctcaaagttaaccaaagaggatgagcagcagcaagccctacaggacatcgcatctagatgtacggccaatgacctgaagtgtattatcaggttaatcaaacacgatcttaaaatgaacagcggagcgaaacacgtcctggatgcactggacccaaatgcatacgaagcctttaaggcctccagaaacctacaggatgtcgtcgaaagggtgctgcacaacgcacaagaagtcgagaaggagccaggccaaaggcgggccttatctgtccaggctagcctgatgactcctgtgcagcctatgcttgctgaagcgtgcaaatccgttgaatatgccatgaagaagtgcccaaacggcatgttttctgaaattaagtacgatggagagcgggtgcaggtccacaagaatggggatcacttcagctacttctcacggtctctcaaaccagtccttccacacaaagtggcccatttcaaggactatatcccccaggcttttccgggcggacatagcatgatcctcgacagcgaggtgctcctgatcgataacaaaacggggaaacctttgccgttcggtactctgggggttcacaaaaaggccgcatttcaggacgctaacgtctgcttgttcgtgtttgattgcatctatttcaacgatgtgtccttgatggacaggccattgtgtgagcgaagaaagtttctccatgacaacatggtggaaatacccaaccggattatgttctcggagatgaagcgcgttaccaaagctctcgacttggccgacatgattacgcgcgtcatccaggaagggcttgagggcctggtgctgaaggatgttaagggcacctacgagcccggcaagcggcactggttaaaagtgaaaaaagattatcttaacgagggggctatggccgacacggccgatctagtggtccttggggccttttacggtcagggatcaaaggggggaatgatgtccatctttctcatgggatgttatgacccgggtagccaaaagtggtgcacggtaactaagtgcgcgggtggtcatgacgatgcgaccctcgcacgtctgcaaaacgaactcgacatggttaaaatttcaaaagacccgtccaaaattccttcatggctcaaagtgaacaagatttattatccagattttatcgtgccagacccaaagaaagccgcagtgtgggaaatcactggcgccgagttctccaagagcgaggcccacaccgccgacggtatttcaatccggttccccagatgtacccgaatcagagacgacaaagattggaaatcagccaccaacctcccccagctcaaagaactttaccaactgtccaaggagaaagcagacttcactgttgtggccggtgacgaaggatctagcactaccggtggttccagcgaagagaataaaggtcccagcggcagcgccgtatctagaaaggccccctccaagccctccgcctccacaaagaaggctgagggcaaactgtctaactccaactccaaggacggaaatatgcagacggcaaaaccttcagctatgaaggtcggagagaagcttgccacaaaaagcagtccagtgaaagttggtgaaaagagaaaggctgctgatgaaacactgtgccagacaaaggtcctcctcgatattttcactggcgtacggctttatctccccccttcaactccagatttttcacggctcagaagatacttcgtggccttcgacggagatctggttcaggagttcgacatgaccagcgctactcatgtcctgggctcacgggacaaaaatcctgctgcacagcaagtgagcccagagtggatttgggcctgtattaggaaaagaaggcttgtcgccccctgctag

SEQ ID NO: 24783 - DNA, 2736 bp, Artificial Sequence
  Description of Artificial Sequence: Synthetic coding sequence
atggccgccagccagaccagccagaccgtggccagccacgtgcccttcgcggacttgtgttctacgctggagagaatccagaaatcaaagggccgcgctgagaagattcgccacttcagggagttcctcgatagttggcgaaaatttcacgacgcattgcataagaaccataaagacgttacggattcattttacccagccatgagactcatcctgccgcagctggaaagagagcggatggcatacgggatcaaagagaccatgcttgctaagctgtatatcgaactcctcaacctgccaagagatgggaaggatgcactcaagctgctcaattaccgaacccctactggcacccatggagatgccggcgacttcgcaatgatcgcctattttgtgctgaaacctaggtgtttgcagaaaggatcactcacaatccagcaggtgaacgacctcctagactctatcgcctctaataactccgccaagcggaaagacctcatcaaaaagtccctgctgcagcttatcactcaatcttctgcactggaacaaaaatggttgatcaggatgatcataaaagacctgaaactgggcgtctcacagcagacaatcttctcagttttccacaacgatgctgcggaattgcacaacgtgacgaccgacctagagaaagtgtgccgtcagctgcatgatccatccgtgggtctgagcgatataagcatcaccctcttctccgccttcaaacccatgctcgctgcaatcgcggatatcgaacacattgagaaagatatgaaacatcagagcttctacatagagactaagctggatggggaacggatgcagatgcataaagacggagacgtgtataaatacttcagcagaaacgggtataattacaccgaccagttcggagctagcccaaccgagggtagcctaactccctttatacataacgcattcaaagctgatattcagatatgcatcctggacggagaaatgatggcctacaatcccaatacccaaaccttcatgcagaaaggcacaaaatttgacatcaagaggatggtagaggatagcgatctacagacttgttattgtgtttttgacgttcttatggtaaataataagaagctgggacatgagaccctgagaaaaagatatgaaatcctctcatccatattcaccccaatcccaggacggatcgagatcgtacagaaaacacaggcacacactaagaatgaagtcatcgatgccctcaacgaagcaatcgacaagagagaggaaggaataatggtaaagcaaccattatccatttacaaacctgacaagaggggcgaggggtggctgaaaatcaagcctgaatatgtgtcaggattaatggacgagctggacatcctcattgttggcggctactggggaaaggggtcccgcggtggcatgatgtcccatttcctgtgcgctgtggctgagaagcctcctcccggcgagaagccctccgtgttccatacactgagccgagtcgggtccggctgtaccatgaaggaactctacgacctcgggctaaagctcgcgaaatactggaaacccttccatcgtaaagctccgccatcttccattctgtgcgggaccgagaagcctgaggtctatatcgagccttgtaacagtgtcattgtacagattaaagccgccgagatcgtcccctctgacatgtacaagaccggctgcacacttcgcttcccaaggattgagaaaattagagacgacaaggagtggcacgaatgtatgactctcgacgacctggagcagttaaggggcaaagcctcaggcaaattagcctctaagcatctgtatatcggtggagatgacgagcctcaggaaaaaaagaggaaagccgcccccaagatgaagaaggtcatcgggattatcgaacatctcaaggcccctaatctgactaatgttaacaaaatttctaacatcttcgaagatgtagagttctgtgtgatgagcggaacggactcacagccgaaaccagacttggagaaccggattgctgaattcggtgggtatatcgtgcagaaccctgggcccgatacttactgtgtgatagccgggtctgagaacattagggtgaagaacataattctaagtaacaagcacgacgtagtaaagccagcctggctgcttgaatgtttcaagacaaaatcctttgtgccctggcagccacgcttcatgattcatatgtgcccatcaaccaaagagcactttgccagagaatatgactgttacggcgactcatactttattgatacagacctgaatcagctaaaagaggtgttctccggcattaaaaactccaacgaacagactcccgaggaaatggcttcgttgattgccgacttagaatataggtattcctgggattgttccccactctccatgttcagacggcataccgtgtatctcgatagctacgctgtgattaacgatttgagcacgaagaacgagggcacacggttggccattaaggcacttgaactgaggtttcacggagccaaggtggtctcttgtctcgctgaaggtgtgtcccatgtcatcattggcgaggaccattcgcgagtcgccgattttaaagcgttcaggcgcacttttaaacgcaagtttaaaatcctgaaagagtcctgggtgacagattccattgataagtgcgaacttcaagaggagaatcagtatcttatatag

SEQ ID NO: 24784 - DNA, 2736 bp, Artificial Sequence
  Description of Artificial Sequence: Synthetic coding sequence
atggccgccagccagaccagccagaccgtggccagccacgtgccctttgcagacttgtgtagcaccctggaaaggatccagaagtctaaagggagggctgagaagattaggcacttccgagagtttctagactcctggagaaaattccacgacgcgctgcacaagaatcacaaagacgtgaccgatagcttttatcctgctatgcgcctgatccttcctcagctcgaaagggaaaggatggcctacggcataaaagagaccatgctcgccaagctctatattgaactgctaaatttgccacgggacggaaaagatgctctgaagctgctcaactaccgaacacctacagggacacatggcgacgccggggactttgctatgattgcgtacttcgtactcaaaccccgctgcctgcaaaaaggctccctaacaattcagcaggtgaatgatctcttagattccatcgcttccaacaacagcgccaaaagaaaagacctgataaaaaagtctcttttgcagctcattacccagtccagcgctctcgagcagaaatggttgattagaatgatcataaaggatttgaagctgggcgtgtcacaacagaccatcttctccgtctttcataatgacgcagcggaactgcataatgtgacaaccgacttagagaaggtgtgcaggcagcttcatgacccctctgtgggactgagtgacatcagcatcaccctgttctcagcatttaaaccgatgttggcagccatcgccgatatagagcacatcgaaaaagacatgaagcatcagagtttttatatagaaaccaagctcgatggcgagcggatgcagatgcataaggacggcgacgtctacaagtatttcagtcggaatggctataactacactgaccaatttggcgcttctcctaccgaaggttcactaacacccttcatacacaacgcctttaaggcagacatccagatttgcatattagacggggagatgatggcctataatccaaacacccagacattcatgcagaagggcacaaaattcgatataaagagaatggtagaggattctgatcttcagacttgctactgcgtgttcgatgttcttatggttaacaacaagaaactcgggcacgaaacccttcgtaaacggtatgagatccttagcagcatattcaccccaattcccgggaggatcgagatagtgcagaaaacacaagcccatactaaaaacgaagtcatcgatgccttgaatgaagccattgataagcgggaggaaggtatcatggtcaaacaaccgctgtctatctataagcctgacaagcgaggtgagggttggttaaaaattaaacccgaatacgtctctggactgatggatgagttggacatccttattgtaggcggttactgggggaagggctcgcgaggtggtatgatgagtcattttctgtgcgccgtggcagaaaaaccccccccaggggagaagccaagtgtgtttcacacgctttctagagtgggcagcggatgcacgatgaaagagctgtatgacctcggactgaagctggctaagtattggaaaccattccatcggaaagctccaccttcatcgattctgtgcggtacagaaaagcccgaggtctatatcgagccttgcaattccgtgatagtgcagataaaagccgctgaaattgtaccatccgatatgtataagacagggtgtaccctgagattcccccggatagagaagatcagggacgataaggagtggcacgaatgcatgaccctggacgacttagaacaactccgcggaaaggcttcagggaaactagcatccaagcatctatatatcggcggcgatgatgaaccccaggagaaaaaaaggaaggcagcgcctaagatgaaaaaagtgatcggcattatagagcaccttaaagctcctaacctcacgaatgtgaacaagattagcaacatttttgaggatgtagagttttgcgtcatgagtggaacggattcacaacctaagccagacctcgaaaacagaatcgcggaatttggaggctacatcgtgcagaacccagggcctgacacttattgcgtgattgccgggagcgagaatatcagagtgaagaatatcattttgtctaataagcacgacgtggtgaagccagcttggctccttgagtgttttaagacaaagagtttcgtgccctggcaaccaaggttcatgattcatatgtgtccaagcaccaaagaacactttgcacgagaatacgattgctatggtgacagttacttcattgacacagatctaaaccagcttaaagaggtgttctctggaattaaaaacagcaacgagcagacacctgaggaaatggctagccttatagcggacctcgagtataggtatagctgggactgcagccccctgagcatgtttcgtcggcatactgtgtacctggattcctacgccgtaatcaacgacttatccaccaagaatgagggaacaaggctcgccatcaaggctctcgagttgcggttccacggtgctaaagtggtcagctgcctcgctgagggggtgtcacatgtcataataggcgaggatcactccagagtcgccgactttaaagccttcagaagaacctttaagcgaaagttcaagattttgaaagagtcttgggtgacagatagcatcgacaagtgcgaactgcaagaggaaaaccagtaccttatttag

SEQ ID NO: 24785 - DNA, 2736 bp, Artificial Sequence
  Description of Artificial Sequence: Synthetic coding sequence
atggccgccagccagaccagccagaccgtggccagccacgtgccctttgccgacttgtgttctacactggaacgtatacagaaaagcaaagggagagctgagaaaataaggcatttccgggaatttctggacagttggaggaagtttcacgacgcacttcacaagaaccataaagatgtgacggactcattttaccctgccatgcggctgatcctgccccagctcgaacgggagcgcatggcttatggtataaaggaaactatgctggccaagttatatatagaactccttaacctcccacgcgacgggaaggacgccctgaaacttctgaactatcggacaccgacaggaacacatggtgacgccggagactttgcaatgatcgcctatttcgtgttgaagccacgatgcttgcagaaaggttccctcacaattcagcaggtcaatgaccttttggattcgattgctagtaataattctgccaaacgaaaagacctaatcaagaaatctttgctgcagcttatcacacagagtagcgcacttgaacagaagtggctgatcagaatgattataaaggacctgaaattaggggtgtcgcagcaaacgattttcagtgtctttcataatgatgctgcagagctgcacaacgttactacagatctcgaaaaggtttgtcggcagctgcacgaccctagcgtaggtttgtctgacatctcaatcacactgttcagcgcctttaagcctatgctagcggccatcgcagatattgaacatatcgagaaggatatgaaacatcagagtttttacatcgaaaccaagttggatggagagcggatgcaaatgcataaggacggcgatgtttataagtacttcagcaggaatggatacaactacactgatcagttcggcgcttcccccactgaggggtccctgaccccctttatccacaatgccttcaaagccgacattcagatctgtattttagacggcgagatgatggcgtataatcctaatactcagacattcatgcagaaaggtactaaatttgacatcaagaggatggtggaggacagtgacctgcagacctgttactgcgtttttgacgtcctcatggtgaacaacaaaaagttaggacacgaaactctgaggaaaaggtacgaaatcctgtcatccatttttactcccattccaggaagaatcgaaatagttcaaaagactcaggctcataccaagaatgaggtgatcgacgccctgaatgaggccatcgataagcgtgaagagggcattatggtgaaacagcccttgtcgatctataaacccgacaaacggggcgaaggttggctcaaaattaaacctgaatatgtctcgggcttgatggacgagcttgatatcctgatcgtcgggggatattggggcaaggggagtcgtggcgggatgatgagccactttctttgcgcggttgccgagaaacctccccctggagagaagccatccgtgttccatacactttcgcgcgtgggttcgggatgtaccatgaaggagctctacgaccttgggctgaaactggccaagtattggaagccttttcacagaaaggctcctccgtctagtatcctgtgcggcacagaaaaacctgaggtttacattgagccttgcaacagcgtgattgtccagatcaaagctgcagaaatcgttccgtctgacatgtacaagacagggtgtaccttgagattcccccgtatagagaagatcagagacgacaaggagtggcacgaatgtatgaccctcgacgatctggaacaacttcgtgggaaagcctccggtaagctggcatccaagcacctatacatcggtggcgacgatgagccacaggaaaagaaacggaaggcagcccccaagatgaaaaaggttatcggaatcatagagcacctgaaagctccaaaccttacaaatgtcaataaaatctcgaatatcttcgaagacgtggagttctgtgtcatgagcgggactgatagccagcccaaacccgatctcgagaatcgaattgccgaattcggcgggtatatcgtccagaacccaggaccagacacctactgtgtgatcgccggatctgagaatataagagtgaaaaatatcattctctctaataaacacgatgtggtcaaacctgcgtggttacttgagtgcttcaaaaccaagagctttgtcccatggcagccgcggtttatgatccatatgtgcccatccactaaggaacatttcgcaagggagtacgattgttatggagactcgtactttattgacactgacctgaatcagctcaaggaagtcttttcgggcattaaaaactcgaatgaacagacacctgaggagatggcttccctgatcgccgatttggagtaccggtattcctgggattgctctcccttgagtatgttccgacgacataccgtgtatctggactcttatgcggtgattaatgatctgtctaccaaaaacgagggtactcggctggcgatcaaagctctggagcttcggttccatggagcaaaggtggtatcttgtttagctgagggtgtgagtcacgtcatcataggggaagaccattcgcgagtggccgactttaaggcattcaggcggaccttcaagagaaaatttaagatattaaaggaatcatgggtcacagattctatcgacaagtgcgaactgcaagaggaaaaccaatacctaatctag

SEQ ID NO: 24786 - DNA, 1944 bp, Artificial Sequence
  Description of Artificial Sequence: Synthetic coding sequence
atgcggctgaccctgctgtgctgcacctggcgggaggagcggatgggagaagaagggtcagagctgccagtctgcgcgagctgtggacagaggatttatgacggacagtacctacaggccctgaatgcagattggcatgccgactgctttcgttgttgtgattgtagtgcttcactgtctcaccagtactatgagaaagatggtcagctgttctgtaagaaagactactgggctagatatggagagagttgtcatggatgctcagaacagatcacaaaaggtctcgtcatggtggccggtgaactaaagtaccaccctgagtgtttcatttgcctgacctgtgggacttttattggcgacggtgacacctacaccctggtcgagcatagcaagctgtactgtgggcactgttattatcagactgtggtgaccccggttatcgaacagatcctcccagactcaccagggtcgcaccttccacacacggtcactctcgtgagcatacccgcttcgtcacacggaaaacgcggcctatccgtttcgatcgacccccctcatggacccccaggctgtgggacagaacactcccacacagtgagggtgcagggagtggacccaggctgcatgagtccagatgtgaagaattctatccacgtgggggatcgtatactggagatcaatggcacgccaatccggaacgtgcccttggacgaaatcgacctgctcatccaggagactagcagacttctccagctcactctggaacatgacccacacgacacactgggccatggactgggccctgagacttctcccctctcctccccagcttacacccctagcggagaggccggctcttccgcacgccagaagcccgtgctgcgaagctgcagcatcgaccgctccccgggagccggcagcctggggtctcccgccagccagagaaaagaccttggaaggtcagagtcgctgagggtggtgtgtcggccacaccggatttttcgtccatcagatcttattcacggggaggtgttgggtaaggggtgctttggccaggctattaaggtaacgcaccgggaaaccggcgaagtaatggtgatgaaagaactcattcgcttcgatgaggagacacagcgaacttttcttaaagaggtcaaagttatgcgctgtctcgagcaccctaatgtgctgaagttcattggggtgctttacaaggacaagcggctgaactttattaccgaatacattaagggaggaacactgcgaggtattattaaaagcatggatagccagtacccttggagccaacgcgtgtcatttgctaaggatatagcatccggcatggcatatttgcattcaatgaatatcattcaccgcgatctgaactcacataactgcttggtacgtgagaacaaaaacgtggttgtggccgattttgggctggcaaggttgatggtggacgaaaaaacacaaccagaggggctgagatctctgaagaaaccggacaggaaaaaaagatataccgtggttggaaatccatattggatggctcccgagatgatcaatgggagatcatacgatgagaaagttgacgtcttttccttcgggattgtactctgcgagatcatcgggcgggtgaacgcagaccccgattatcttcccagaactatggacttcggtctaaatgtgcgcggcttcctcgataggtattgcccccctaattgcccgccttctttttttcctattaccgtgcggtgttgtgacctggaccctgagaaaagaccaagttttgtgaagttagagcattggctcgaaactctccggatgcatctggccggccacctgccactgggtcctcagctcgaacagctcgatcgtgggttttgggaaacctaccgaaggggagaaagcgggctgcccgcacatcccgaggtaccggattag

SEQ ID NO: 24787 - DNA, 1944 bp, Artificial Sequence
  Description of Artificial Sequence: Synthetic coding sequence
atgcggctgaccctgctgtgctgcacctggcgggaggagcggatgggcgaagaaggatctgaactacctgtctgcgcatcatgcggtcagcggatctacgacggacaatacctgcaggccctgaatgcagactggcatgcagactgctttcggtgctgtgattgttctgctagcctcagccaccaatactatgagaaagacggacaactcttctgtaaaaaggactattgggccaggtacggagaaagctgccacggatgtagcgagcagatcaccaaggggcttgtaatggttgccggggagctgaaataccatcctgagtgcttcatctgcctgacatgcggcacctttataggtgacggcgacacttacacactggttgagcatagtaaactctactgtggccactgttattaccagacggtcgtgacgcccgtgatcgagcaaatcttgcccgattcccctgggtcacacctgccacacaccgttacgttagtgtctataccagccagttcgcatgggaaacgaggactgtccgtgtcaattgacccaccccatggcccccccggttgcggcactgagcactcgcacaccgtgcgggtgcagggagtggaccctggctgcatgagtccagacgtcaagaactctatacacgtgggagatcggatactggaaatcaatggtacgccaatacggaacgtcccacttgatgagattgacctcctgatccaggaaacttctcgcctccttcaattgaccctggaacatgacccgcatgacacactggggcacggattaggccccgagacatccccgctctcttcccccgcctacactccatctggtgaggcgggcagctccgcccgccagaagcccgtcctgaggtcctgctcaatcgataggagccccggcgccgggagtctcggaagcccagcgtcacaaagaaaagacttgggcaggtcggaatctcttcgggtcgtctgtagaccccataggatattcaggccttcagatctgattcacggagaagttttgggcaagggatgtttcggccaggccattaaagtgacacaccgtgaaactggagaggtcatggttatgaaggaactgatcagatttgacgaagaaacacagcggacgtttttaaaagaggtgaaggtaatgcggtgtctcgaacaccccaacgttctgaaattcatcggagtactctataaggacaaacggctgaattttatcacggaatacataaagggcggcacattgaggggcatcattaagtctatggatagtcagtacccctggtctcagagagtttcattcgccaaggatatagctagtgggatggcgtaccttcactctatgaatatcatccacagagatctgaacagccataattgcctggtcagggagaacaaaaacgtggtcgtggccgacttcggattggcgagactcatggtggacgagaagacccagcccgaaggcctgcggagcctcaagaaacccgataggaagaaaaggtacactgtcgtcggaaacccctactggatggctcccgagatgattaacggcaggtcctacgacgagaaagtcgacgtgttcagtttcggcatagtgctctgcgaaattatcgggcgcgttaacgccgaccccgactatctgcccaggactatggactttggcttgaacgttcgagggtttctagacagatattgtcccccaaattgcccaccctctttttttccaatcacagttagatgttgtgatctggatcctgagaagcgcccttcctttgtgaaacttgagcactggctggagacccttcggatgcatttggctggacacctgcccctcgggccccagttggaacagctcgaccgagggttctgggaaacatatcgcaggggggaaagtggcctgccggcccacccggaggtgcccgattag

SEQ ID NO: 24788 - DNA, 1842 bp, Artificial Sequence
  Description of Artificial Sequence: Synthetic coding sequence
atgctgctggccagcgccccccggcggcggcggttcctgcagcgggccaagtgctgtgattgctccgccagcttatcacaccagtactatgagaaagatggacaattgttttgcaagaaagattactgggccagatatggcgagagttgccatggttgctcagagcaaattacgaagggcctagtcatggtggccggcgagctcaagtatcatcccgagtgctttatttgtctgacatgtgggacctttatcggggacggtgatacttacacgctagtcgaacactcaaagctctactgtgggcactgctattaccagaccgtggtgacccctgtcattgagcagattctcccagatagccccggatcgcacttgccccatacagtgacgctggtgtctatcccggcgtcctcacacggcaagaggggactgtcagtttccattgaccccccccacggcccccccggatgtggaactgagcactctcatactgtgcgtgtccagggtgttgaccctggctgtatgtcgccggacgtaaagaactccatacatgttggagacaggattcttgaaattaacggtactccaattcggaacgtgcccctcgacgagatcgacttgttgatacaagaaacttcgaggctgctgcagctcacactggagcacgaccctcacgacacgcttggccacgggctgggacccgagacttctcctctgtcctcacccgcctacacccccagcggtgaggcggggtcctccgccaggcaaaaaccagtcttgcgttcttgtagcatcgatcggtcaccaggagctggatcactgggatctcccgcctcacagcgcaaggacctgggtcggtccgaatcgcttcgcgtcgtgtgcaggccacatagaatcttcaggccttcggatcttattcacggagaagtcctcggcaaaggatgcttcggtcaggctattaaggtgactcatcgcgagacaggggaggtgatggtgatgaaggagcttataagattcgacgaagagacacagcgtacttttctcaaagaggtcaaggtgatgagatgccttgaacacccgaacgtgctgaagttcataggtgtgctgtacaaagataagaggttgaatttcattacagaatatattaaaggggggaccttgcgcggcattatcaaatctatggactctcaatacccttggtcccagagagtcagctttgctaaagacatagctagcggaatggcttatctgcactcgatgaacataatccacagagacctcaacagccacaattgcctggttcgcgagaataaaaacgtggtggtggctgattttggattggcacgtctaatggtagatgaaaaaacccagcctgagggtctgagatccctaaagaaacccgatagaaagaagcggtataccgttgtggggaacccgtactggatggctccggagatgataaatggtagatcatacgacgaaaaagtggacgtctttagcttcggcatcgtactttgcgagatcattgggagggtcaacgccgaccccgattatttacctagaactatggacttcggactaaacgtgagaggcttcttggatcggtattgtccaccaaattgtcccccgagttttttccctatcacagtccggtgctgtgaccttgaccctgagaagagaccatctttcgtgaaactggagcactggctggagactctgcgtatgcatttagccggtcacctgccactcggcccccagctggagcagctggatagaggcttctgggaaacgtaccgcaggggggagtccggcctgccagctcacccagaggtaccggattag

SEQ ID NO: 24789 - DNA, 471 bp, Artificial Sequence
  Description of Artificial Sequence: Synthetic coding sequence
atgatggtgctggacaaggaggacggcgtgcccatgctgagcgtgcaaccaaaaggaaagcagaaagggtgtgcagggtgcaatagaaaaatcaaagatagatacttgcttaaggcgctggacaaatactggcatgaagactgcttgaaatgtgcgtgctgcgactgtcgcttaggggaggtggggtcgaccctgtacacaaaagccaacctcatactctgccgaagagactatttgcgactgttcggcacaacagggaattgtgccgcctgttctaaattgatcccagcattcgagatggtgatgagggcacgcgataacgtgtatcacctggactgctttgcatgccagctgtgtaatcaaagattctgcgtgggcgataaatttttcctcaagaataatatgatactgtgccagatggactacgaggagggtcagctcaacgggacctttgaaagccaggtacaatag

SEQ ID NO: 24790 - DNA, 468 bp, Artificial Sequence
  Description of Artificial Sequence: Synthetic coding sequence
atggtgctggaccaggaggacggcgtgcccatgctgagcgtgcagccaaaaggaaagcagaaggggtgtgctggttgtaatcgcaagataaaagaccgctatctcctcaaagccctggataaatattggcatgaggattgtttaaagtgcgcctgttgtgattgcaggctcggcgaagtcggatctactctctatacaaaagctaatctgattctgtgcagacgagattaccttagactgttcggcacgaccggcaactgcgcagcttgcagcaagcttatccccgcgttcgagatggtgatgcgtgcccgcgacaacgtgtaccacctcgattgttttgcctgtcaactctgcaaccagagattctgcgtgggtgataagttttttttgaaaaacaacatgatactttgccagatggactacgaagaaggccaactgaacggaacttttgagtcgcaagtgcagtag

SEQ ID NO: 24791 - DNA, 684 bp, Artificial Sequence
  Description of Artificial Sequence: Synthetic coding sequence
atggagggcagcgccgtgaccgtgctggagcggggcggcgccagcagtcccgcggagaggaggtcaaagcggcggagaagatctggcggcgacggtgggggaggcggtggcgctcgtgcccccgaaggagtgagggctcccgcggccgggcagcccagagcaacaaaaggggcacccccccccccagggacacctcccccaagcccaatgtcaagcgcaatagaaaggaagtccctcgaccctagcgaagagcccgtggatgaagtgctccagatccctcccagcctgctgacctgtggcggatgccaacagaatattggggataggtatttcctgaaggcgattgaccagtactggcacgaggattgtctgagttgtgacctctgtggctgtaggctgggggaggtgggtcggagactgtactacaaattgggccgcaaactgtgccggagggactaccttagactctttggccaggacggtctgtgtgcctcttgcgacaaacgcattagggcgtatgagatgaccatgagagtgaaggataaggtgtatcatctggagtgtttcaagtgtgctgcctgccagaaacacttttgcgtgggggaccgctacctcttgatcaacagcgatattgtctgcgaacaagacatatacgagtggactaagatcaacgggatgatctag

SEQ ID NO: 24792 - DNA, 477 bp, Artificial Sequence
  Description of Artificial Sequence: Synthetic coding sequence
atgagcagcgccatcgagcggaagagcctggaccccagcgaggagcccgtggacgaggtactgcagatcccaccctccctcctgacctgcggaggatgtcagcaaaacatcggcgacagatactttttgaaggcaattgaccagtattggcacgaggattgcctcagttgtgatctctgtgggtgccggttaggcgaggtcggtagacgtttgtactacaaacttggcagaaagctctgtagacgggattatttacgactgttcggacaggatgggctgtgtgcatcgtgtgacaagcggatcagagcatacgagatgaccatgcgggtaaaagataaagtttatcatctggagtgcttcaagtgtgctgcctgtcagaagcacttctgtgtaggcgatcgctatttgctcattaattcagatatcgtgtgcgagcaagacatatatgaatggactaaaatcaacgggatgatatag

SEQ ID NO: 24793 - DNA, 1677 bp, Artificial Sequence
  Description of Artificial Sequence: Synthetic coding sequence
atgcaccggggcggccagcccctgaagaagcggcggggcagcttcaaaatggccgaacttgatcagttgccagacgagtcttcctccgcaaaagccctggttagcctgaaggaggggtctttatccaatacttggaatgagaagtatagctccttgcagaaaactccggtgtggaagggcagaaatacatcaagcgccgtagaaatgccttttcggaattcaaagcggtcccgactgttcagtgatgaggacgatcgccagattaacaccaggagtcccaagcgcaatcagcgggtcgccatggtgcctcagaagtttacagcaaccatgagtaccccagataaaaaagcctctcagaagatcggattcagactccgaaatctgctcaagcttcctaaagctcacaaatggtgcatctatgagtggttctatagcaacatcgataagcccttattcgagggcgataatgatttttgtgtttgtctgaaggaaagctttccaaatctcaagacaagaaaactgactagagtagaatggggtaaaatcaggagactcatgggtaaaccgcggcgatgttcatccgccttcttcgaagaggagcggagcgcccttaagcagaagcgccagaagattagacttttgcagcagcgaaaggtggccgacgtcagccagttcaaggacctgcccgatgaaatccctctccccctggtgatcggcaccaaagtcaccgccaggctgaggggtgtccatgacgggctattcactggccaaattgatgcagtggatacgctaaacgctacttaccgcgtgaccttcgatcgaaccggtctggggacccataccatacctgattacgaagtgctgagtaacgagccccacgaaacaatgccaatcgccgcattcgggcagaagcagagaccctccagattcttcatgactcccccccgactccattacaccccccctcttcagtcacctataatagataacgaccctctcttggggcagtctccctggcgctccaagatctctgggtccgacaccgagactttgggcgggtttccggtggagtttctgatacaagtaacacgactctccaaaatcttgatgatcaagaaagaacacataaagaaactccgggagatgaataccgaggcagaaaagctgaagtcgtactccatgccaatttcaatagaattccagaggcggtacgccacgatcgtcttggaactagagcagctgaacaaagatttgaataaggtgctgcataaagtgcagcagtactgctatgaattggcaccagaccagggactccaacccgcggaccagccaactgatatgaggcggcgctgtgaagaagaggcccaggaaattgttcgccacgcaaatagtagcacagggcaaccatgcgtagagaacgagaacctcactgatttgatcagtaggcttacggctatcctccttcaaatcaagtgtctggcagaaggcggcgacctcaatagttttgagtttaagagcctgaccgatagcctgaatgacataaagtccaccatagatgcatcaaacatctcatgttttcaaaataacgttgagatacatgttgcccacatccaatctgggctctctcagatggggaacttgcatgctttcgccgcaaacaacaccaatcgggactag

SEQ ID NO: 24794 - DNA, 1524 bp, Artificial Sequence
  Description of Artificial Sequence: Synthetic coding sequence
atggccgagctggaccagctgcccgacgagagcagcagcgccaaggccctggttagcctcaaggagggctcattgtctaacacctggaacgaaaagtattcttcactccagaaaactccggtgtggaagggcaggaacacaagctctgccgtggaaatgaaattcaccgcgaccatgtcaaccccagacaagaaagcttcccagaaaattggatttcgactgcgaaatttactgaaattgccaaaggcacacaaatggtgtatttacgaatggttctacagtaacattgataaaccacttttcgaaggggataacgatttctgtgtgtgtctgaaagaatccttccccaatctgaagactaggaaactgaccagggtagagtggggtaaaatacgtcgcctcatgggtaagccgcgacggtgcagcagcgccttcttcgaggaggaacgttccgcattgaagcagaagagacaaaagatccgcctcctgcaacagcgcaaagttgcggatgtctcccaatttaaggacctgcccgacgagatccccctccccctggttattggtaccaaggtgacggctcgcctgcgcggggtccatgacggcctgttcaccggtcagattgacgcggtggatactctgaacgccacctaccgcgtgacattcgatcggactggcttgggcacgcacactatcccagactacgaagtgctgtcaaatgagccgcatgaaaccatgcctattgctgcttttggccagaaacagcgaccatccagattttttatgacccccccacggctgcactacacccccccactgcagtcgccaatcatagacaatgatcctcttttagggcagtccccatggagaagtaagatctcggggtctgatacagagaccctagggggattcccggtggagtttttaatacaggttactagactgagcaaaatattgatgataaaaaaagaacacattaagaaactgagagaaatgaacactgaggctgagaaactgaaatcttactccatgccaattagtatcgagtttcaacgccggtacgccactatcgtgctggaacttgagcagttaaataaggacctgaataaagtgctccacaaggtgcagcagtactgttacgagctggctcccgaccaagggctgcaaccagccgaccagcccaccgatatgagacggcgttgtgaggaggaagcccaagaaatcgtgcggcacgctaatagttctacaggtcagccctgtgtggaaaacgaaaacctcactgacctgatttcccggcttacagctatcctactccaaattaaatgcctcgcagagggtggcgatctcaatagtttcgaatttaaatctctgaccgacagcttgaacgatattaagagcacgattgacgcatccaacatctcatgctttcagaataacgttgagattcacgtagcccacatccagtccggattgtcacagatggggaacttgcacgccttcgcagctaataatacaaacagggattag

SEQ ID NO: 24795 - DNA, 1572 bp, Artificial Sequence
  Description of Artificial Sequence: Synthetic coding sequence
atgcggccccggaccgagggcttcttcccccccgccggcgccagcctgccgttcagcacccggaataaacagcccgccgtgccagctgccgcagctagggcggctgagcacgcgcccggtgccggccccggtagagattctggggccggcacagccccgccggcgctccgtcgcagggcctctccctgcgggttgctccctcctttcttgccacctggtagcgcaggtggcggcggcggaggtgcccggagaggaccccccagcgccgctccacccccccgagcgggggctgggggtgccggccccgccagcgccagcagaggtggctccagcgctgctcggaggcggggtcagcgcgctcctcacagcaatttaccaaggaaagatagcctccggccaaccatgcacaggggcggacagcctctgaagaaacgcaggggcagcttcaagatggcggagttagaccagctccctgatgagtcctcatccgctaaggctcttgtcagtctcaaggagggttcactaagcaacacttggaacgagaagtatagcagcttgcaaaaaaccccagtgtggaagggcaggaacacttcctcagcggttgagatgccattcaggaattccaagcgttcaaggttattcagcgacgaagatgatcgacagatcaacacgcgctcacctaaaaggaaccagcgggtcgccatggttccacagaagtttactgcgacaatgtctacacctgataagaaggcgtcacagaaaatcggtttcaggcttcggaatttgcttaaactgccgaaggcacataagtggtgcatatatgaatggttctatagcaacattgataagccactatttgagggtgataatgacttctgtgtgtgtctgaaagaaagtttccccaatctgaagactagaaagttaacgcgggtcgagtggggcaaaatcaggcgactgatggggaagccgcgacggtgcagctctgccttcttcgaggaggagagatctgccttgaagcaaaaaagacagaagattcgcctgctgcagcagcgcaaggtggcagacgtgtctcagttcaaggacctgccagatgaaatccctctgcctcttgtcattggcacgaaggtaacagcccgattgcgcggggtgcatgacggactgtttactgggcagatagacgccgtggatactctgaatgcgacttaccgtgtgacgtttgacagaacagggctgggcacccacaccatacccgattatgaggtgctgagcaatgaacctcatgagacaatgccaatcgctgcatttggacagaaacagcggccgtcgcgcttctttatgacgccaccacgactgcattacacacctccattgcagtccccaatcattgataatgatccactcctgggacaaagcccatggcggagtaagatttctggctccgataccgagaccctaggggggtttccagttgagtttcttatccaggtgacgagactttccaagatcctgatgattaaagggacttaccaggaaattaagggcaacgagcacaggagccggaagatagggtag

SEQ ID NO: 24796 - DNA, 1842 bp, Artificial Sequence
  Description of Artificial Sequence: Synthetic coding sequence
gagaccgccgagcagaacagcagcctggccgtgggcctgaacgaccagttacacgacctgagtcggtccaggtcaccagccgcacgatctagcgcatctaacattagggagcgtcgagctagaattgcccgcggccgctgggatcgagtcccggacgtggcgacccgcagggggcttttaaggcctgccgtttccgggaaggtgcgcggaagaaggcgcccgtcaaatgtcgggttcgggaactgcagcagcgcaaaggctctggtgtccctgaaggaagggtctctctctaacacctggaacgagaagtatagttctcttcaaaaaacaccagtgtggaaaggccggaatacctcttctgctgtggagatgccttttcggaactccaagaggtctagacttttcagtgacgaagacgacaggcaaataaacacaaggtcgccaaaaagaaaccagcgcgtggccatggtgccccaaaagttcacggcgaccatgtccactccagacaagaaggctagccagaagataggctttcgtcttcgcaacttattaaaattgccaaaggcgcacaagtggtgcatttacgagtggttctactccaacatagacaagcctctcttcgaaggtgacaatgacttttgtgtgtgcctcaaggaaagctttcctaaccttaaaacacgtaagctgacacgcgtagagtgggggaagattaggcgcctaatgggcaaacctcgcagatgttccagcgccttttttgaggaagaacggtccgccttgaaacaaaagcgccagaaaattcggttgcttcagcagaggaaggtcgcggacgtcagtcagtttaaggacctcccagatgagatccctctaccactggtgatcggcaccaaggtgacagccaggttgagaggtgtccacgatggtctatttaccgggcagatcgatgcagtggacactctgaacgccacctatcgcgtcacctttgatagaacagggttgggcacccatacaattcctgattatgaagtactttcaaatgaaccccacgagacaatgcctatcgccgcattcggccagaagcaaagaccttctagattttttatgacccctccacggctgcactatacaccacctctccagtcccccatcattgacaacgatcctctgctgggacagtctccctggcgttcaaagataagcggtagcgatactgaaactctaggggggtttcccgtcgaattcctgatccaagttacaagactgagcaagattctcatgatcaagaaggaacatattaagaaactccgtgagatgaacacagaagctgaaaaactgaagagctacagtatgccaatatctatcgaatttcagcgccgctacgcaaccatcgttcttgaacttgaacagctgaataaagaccttaacaaggtcttacacaaagtccagcaatattgttatgagttagctccagatcaaggtctccaaccagcagatcagcctacggacatgcgcagacgttgcgaggaggaagcccaggagatcgtgagacatgcaaattcatcaaccggccagccatgcgtagagaacgagaaccttaccgacctgatctcacgactcacagcgatactgcttcaaataaaatgcctcgccgagggaggcgaccttaactcttttgagttcaagtcgctgacagacagcctgaatgatattaagagcactattgacgccagcaacatctcatgcttccagaataacgttgagatccatgtagctcatattcagtctggcctgagccagatgggaaacttacacgcattcgccgccaataataccaatagagattag

SEQ ID NO: 24797 - DNA, 13800 bp, Artificial Sequence
  Description of Artificial Sequence: Synthetic coding sequence
atgagcgagttcctgctggccctgctgaccctgagcggcctgctgcccatcgcccgagtactgaccgtgggcgcagaccgtgaccagcagttatgcgacccaggagaattcctgtgccacgaccatgtcacctgcgtgtcgcaaagctggctgtgcgacggcgacccagattgtcccgatgattcagacgaaagcctcgatacttgccccgaggaagtggagatcaagtgcccactgaaccatattgcctgtttaggaacaaacaagtgcgtgcatctctctcagctgtgtaacggggtgcttgactgcccagacggatatgacgagggagtccactgtcaggaattgctgagcaactgccaacagctgaactgccaatataagtgcaccatggttcgcaactccacccggtgttactgcgaagatggctttgagattaccgaggatgggcggagctgcaaagaccaggacgaatgcgctgtctacggaacatgctcccagacttgccgaaacacgcacgggagctatacctgctcatgtgtggaggggtatttgatgcagccagacaacaggagttgcaaggcgaaaatagaacccactgatcgtcccccaatactgttgatcgcgaattttgagaccatcgaggtgttctacctcaatggctctaaaatggcgactctttcttctgtcaacggcaatgagatccacaccctggacttcatctataacgaggacatgatctgctggattgagtcaagggagtctagtaatcagctgaaatgtattcagatcacaaaggcaggaggcttaaccgatgagtggaccattaacatacttcagtcctttcacaacgtacagcagatggccatcgactggttgacacgaaacttgtatttcgtcgatcacgtgggggacagaatctttgtgtgtaatagcaacggcagcgtttgtgtgaccctgattgacttagagctgcacaatccaaaagccatagcagtggatcctatcgcgggcaaactgttttttactgattacggcaacgtcgcaaaagtggagagatgcgatatggacggaatgaaccggactcggatcatcgactccaaaacagaacagccagcggcactggctttggatttggtgaacaaactggtttattgggtggatttatacctcgattacgtgggagtggtggattaccagggcaagaatcggcacaccgttatccagggcagacaggtgcggcacctgtacgggatcacagtcttcgaagattacctctatgccactaacagcgacaactacaacatcgtgcggatcaaccgcttcaacggaacagacatccactccctgatcaaaattgagaacgcatggggtataaggatttatcagaaacgaacacaacccactgtgcgaagtcatgcttgcgaggtggatccgtacggtatgccaggaggttgcagccatatatgccttctctcatctagctataaaactaggacttgccggtgcaggaccggcttcaacctcgggtcagacggacgatcctgcaagcgcccaaagaacgagctcttcctcttctacggcaaaggccggccaggtatcgttcgtgggatggacctcaacaccaaaatcgctgatgagtacatgattccaatcgagaacctagtgaacccccgtgccctggatttccacgccgagacaaattacatctatttcgccgataccacatcattcctgatcggccggcaaaaaattgatggcaccgagagggaaacgatcctgaaggatgatctggacaacgtggaagggatcgctgtggattggatcggaaacaatctctattggactaatgacggccaccggaaaacaattaatgttgcgcggttggagaaggcttcccaatctagaaaaacccttctagagggggaaatgtctcacccccgagggattgtggtggatcccgtcaatggatggatgtactggacggattgggaggaggatgagatcgatgactccgtgggtcggatcgagaaggcctggatggatggctttaataggcagatcttcgttacttcaaagatgctgtggcctaacggactcactttggattttcacactaacactctgtattggtgtgatgcctactacgaccatatcgagaaggtgtttctcaatggtacgcataggaagatagtgtactctggccgggagctaaatcacccatttggcctgtcacatcatggcaattacgtgttctggactgactatatgaatggaagcattttccagcttgacctgatcaccagcgaggtgactctcctgagacacgagagaccccctctatttgggcttcagatctatgatccgagaaaacagcagggtgacaatatgtgtagagttaataatggggggtgcagcacgctgtgcctggctattcccggtgggcgcgtttgtgcttgcgccgataatcagttgctagatgagaacggtactacatgtactttcaatccgggagaggccttgccccatatatgtaaagcgggagagttccgatgcaaaaatcgccactgcattcaggcaagatggaagtgtgacggcgacgacgactgccttgacgggagcgacgaagactctgttaactgctttaaccacagctgtcccgacgaccagtttaaatgtcagaacaacaggtgcatccccaagcgttggctgtgcgatggcgcgaatgactgcggcagtaatgaggacgagtccaaccagacgtgcacagctagaacatgtcaagtggatcagttttcatgcggtaatggccgctgtatcccacgcgcttggctctgtgacagggaggacgattgtggggaccagactgatgagatggcctcttgtgagtttcctacctgcgagcctctaacacagtttgtgtgcaagagcggcagatgcatttcatcaaaatggcattgcgatagtgatgacgactgcggagacggttcagatgaggtggggtgcgttcacagctgttttgataaccagttccggtgctcatctggccgttgcattcccggacattgggcgtgcgacggggacaacgattgcggagattttagcgatgaggcacaaataaactgtacaaaagaagagatacacagcccagcaggttgcaacgggaacgagtttcagtgccatcccgacggaaactgtgtccccgacctgtggcgttgtgacggcgagaaagactgtgaggacgggagtgacgaaaagggctgcaatggcacgatcaggttatgtgatcacaagacgaagttctcttgctggtcaaccggccgttgcattaacaaggcatgggtgtgcgacggagacatcgactgtgaggaccagagcgacgaggacgactgtgattcgttcctttgtggccctccaaaacacccatgtgcgaacgacacctcagtctgtctccagcctgagaaactatgcaatggcaaaaaagattgcccggatggctcggacgaaggatacctgtgcgacgaatgttccttgaataacggcgggtgctctaaccattgctctgtcgttccaggaaggggaattgtgtgctcttgccccgaaggcttacaattgaacaaggataataaaacttgcgaaattgtcgattactgttccaatcatctcaaatgctcgcaggtgtgtgaacagcacaagcataccgtcaagtgttcgtgctatgaaggatggaaacttgatgtcgatggcgaatcctgcacgtctgtagaccctttcgaggcttttataattttcagcattaggcatgagatcaggcgaatcgacttgcataaacgcgattattcattgttggtcccaggccttcgtaatactattgccctcgacttccattttaaccaatctctcttgtactggactgacgttgttgaagatcggatctataggggaaaactgtctgagagcgggggagttagcgccatcgaagtggtggtagagcatggcctggccacccctgaaggtctcaccgtagactggattgccggtaacatctactggatcgattcaaacttagaccagatcgaggtggccaagctcgatggaagccttcggactaccctcatcgcaggagctatggagcacccacgggccattgccttggacccccgatatggcatcttgttctggactgactgggatgctaacttccctcgaatcgagagcgcctctatgagtggggctgggcggaaaactatttacaaagacatgaagacgggcgcttggcccaatgggctgacagtcgatcacttcgaaaagaggattgtttggacagacgccaggtccgacgccatctactcggccctgtacgatgggacaaatatgatcgaaattatcagaggtcacgagtaccttagccaccctttcgctgtgagcctgtatggcagtgaggtgtactggaccgactggaggacaaatactctctccaaggctaataagtggacaggccagaatgtttctgttatacagaaaacctcagcccagccttttgatctacagatttatcacccttcccgtcagccgcaggcccctaacccgtgcgcagctaatgacggcaagggtccctgctcacacatgtgcctgattaaccacaataggtccgcagcctgtgcttgtccacatctgatgaagctaagcagcgataagaaaacttgctatgaaatgaaaaaattcctgttgtacgcacgtcggagcgaaatccggggagtggacatagataacccatactttaatttcataaccgccttcacagttcctgacattgacgacgtcacagtgatagacttcgacgcctcagaggaaaggttgtactggaccgacatcaagacccagaccatcaaaagagcttttatcaacgggacaggccttgagacagtgatatccagggacatccagtcaataagaggcctggctgtggactgggtgagcaggaatttgtattggataagctcagaatttgatgagacgcagattaacgtcgcgcggcttgatggatctctgaagacatccatcatacacgggattgacaaaccccaatgtctggctgcacatcctgtgaggggaaaactctattggacagacggaaataccattaatatggcaaatatggatggaagtaattccaagatcctgtttcagaatcagaaggagcctgtcgggttgtccatcgactatgttgagaacaagctatactggattagcagcggaaacggcacaattaatcgctgtaatctcgatggaggcaaccttgaggtgatcgagagcatgaaggaagagctaacaaaggccacagctctgaccatcatggacaagaaactatggtgggctgaccagaatctggcacaactgggcacctgcagcaagcgcgacgggcggaaccctacgatccttaggaataagaccagcggagtagtgcatatgaaggtgtacgataaggaggcgcagcaaggatccaactcttgccaacttaacaatggaggctgttctcagctgtgcctgccaacctctgagactacaaggacttgcatgtgcacagtaggatattacctgcagaaaaacaggatgtcgtgtcaggggatagagagtttcttgatgtattcggttcacgagggaattcgtgggatcccactggagccttctgataagatggacgcattgatgccgatttcaggtacgtctttcgccgtcggaattgacttccatgccgagaatgacaccatctactggactgatatgggctttaacaagatctcccgcgcaaagagggatcagacctggaaggaagatatcatcactaatggcctgggaagggtagaaggcattgccgtggactggattgcgggcaacatctattggacggaccacggcttcaatctgatcgaggtcgctagattgaacggtagcttccgctatgtgattatctcccagggcctcgaccagccacgatcgatcgctgttcaccccgaaaagggtttgctgttctggaccgagtgggggcagatgccctgcattggcaaagctcgcctcgacggcagcgagaaagtcgttctggtcagcatgggcatagcatggcccaatggaatcagtatagattacgaggaaaataagctgtactggtgcgatgcccgcacagacaaaattgaacggatagatctcgaaacgggtggcaatcgggagatggtgcttagcgggagtaacgtcgacatgttttccgtcgccgtctttggcgcatacatctattggagcgacagagcacacgctaatggatccgtgagacggggccacaagaacgatgcaacggagactattacaatgcgcacaggactcggggttaatctgaaagaggttaaaatctttaatcgggtccgggagaaaggaacaaatgtttgtgcacgggacaatggcggctgtaagcaactctgcctttaccgcggcaactcacgaagaacctgtgcgtgtgcccatggctatctggcggaagatggagtgacttgcttgagacacgagggctacctgttatattcaggtaggactattctcaagtctattcacctttccgacgagacaaacctgaattctcccattcgcccatacgaaaatccccggtacttcaagaacgttatcgccctcgcgttcgattacaaccagaggcggaaaggcacgaacagaatcttttatagtgatgcccatttcggcaacattcagttgatcaaagataactgggaagacagacaggtgatcgtggagaacgtcgggagcgtggagggcctagcataccaccgtgcttgggacacgttgtactggacttcaagcactacctctagcatcaccaggcacacggtggatcagacacggcctggagcttttgaccgggaagccgtcatcacaatgagcgaagacgaccacccccacgtgctcgctttagatgaatgccagaatttaatgttttggaccaattggaacgagcagcacccatccataatgcgatctactctcactgggaaaaatgcccaggtggtagtctccacggacattctcacccctaatggcctgacaattgactacagggcggagaaattgtacttcagcgacggcagtctgggcaaaattgagcgctgcgagtacgacggttcgcagcgccacgtaattgttaagtctgggcctggaaccttcctgtcgctcgcggtgtatgacaactatatcttttggtcagattggggccgtagagctatactgcgatccaataagtacactggaggagacacaaaaatcctccggagtgatattccccatcagccgatgggcataattgctgtggccaatgacaccaacagctgcgagctctcaccttgtgcacttctaaacggagggtgtcacgacctgtgcttgctcactcctaatggccgcgtgaattgtagctgtagaggcgataggatcctcttggaggacaatagatgtgtcaccaaaaattcaagttgcaacgcatactccgaatttgaatgtggaaatggggagtgcatcgattaccagctaacctgtgacgggatccctcattgcaaggacaaaagtgacgagaagttgttgtactgtgagaatagatcttgccgacgcggctttaaaccttgctacaatcgacgatgtatccctcacgggaagctctgcgacggggagaatgactgtggagataattctgacgaactggattgcaaggtttccacatgcgctacagtggaattccgttgcgctgatggtacatgtatcccccgcagtgcccggtgtaaccagaacatcgactgcgccgacgcctctgatgaaaaaaactgtaataataccgattgcactcatttttacaaattgggggtaaaaacaaccgggtttatccgatgtaacagtacatccctgtgtgtgctgccgacatggatatgtgatgggtccaatgattgcggtgattattcagatgaacttaaatgtccagtacagaacaaacataaatgcgaggagaattatttctcctgtcctagtggtcgttgcatcctcaacacgtggatctgtgacggacagaaggattgcgaggatgggagggacgagttccactgcgattcaagttgctcttggaatcagttcgcttgttctgcccagaaatgcatcagtaaacattggatctgcgacggagaagatgattgcggtgacgggctggacgagagcgattcgatttgtggggctattacctgcgcagccgacatgttctcctgccagggctccagggcctgcgtacctcggcactggttatgcgacggtgaaagggactgtccagatggctcagacgaactcagcactgctggatgcgctcccaataatacatgcgacgaaaatgccttcatgtgtcacaataaggtctgtatccctaagcaatttgtgtgcgatcacgatgacgattgcggcgacggtagcgacgaaagccctcagtgtgggtaccgccagtgtggaaccgaggagttttcttgtgccgatggtagatgcttactgaacactcagtggcagtgcgatggagactttgactgccctgatcacagtgatgaagcacccctcaatcctaaatgcaaatcagccgagcagagctgtaacagctctttttttatgtgtaagaacggccggtgtatcccatctggaggcctgtgcgataacaaggacgactgtggagacggctcagacgagagaaattgccacatcaacgagtgtctgtcgaagaaagtctcgggatgttcgcaggactgtcaagatcttcccgtctcctacaagtgcaagtgctggccgggatttcaattaaaagatgacggtaagacttgtgtcgacattgatgagtgctcatccgggttcccttgcagccagcagtgcatcaatacttacggcacctacaaatgtctgtgcactgatggttatgagatacagccagacaaccccaacggctgcaaaagtttgtccgacgaagagccttttctgattctcgctgatcaccacgagattagaaaaatcagcacagatggatctaattacaccctgctgaagcaagggcttaacaacgtgatcgcgattgatttcgactatcgcgaggagttcatctattggattgactcctccaggccaaatggatccagaattaaccggatgtgtttgaacggatctgacatcaaagttgtgcataacactgccgtgcccaacgcgttggctgtggactggatcggtaagaacctgtattggtctgacaccgaaaagcggatcatcgaggtttctaagttaaacggcctgtacccaacgatcctggtgagcaagagactgaaattcccccgggatctttcgctcgatcctcaggccggctacttatattggatagattgctgcgagtaccctcacatcggcagagtggggatggacggcactaaccagtcagtcgttattgagacaaaaatatcccgccccatggcactgacaatcgactacgtgaaccggagattatattgggctgatgaaaaccatattgagttcagcaatatggatgggtcccatagacacaaagtcccaaaccaggatataccaggcgtgatcgcattgactctatttgaagactatatctactggacagacgggaagacaaaatcactgtcccgagcacacaagacctccggggccgatagactatccttgatttatagctggcacgcaatcactgatatccaggtatatcacagttaccggcaaccggatgtctccaagcatctgtgtatgattaataacggagggtgttcacacctgtgtctgctggcacccggcaagacacatacctgtgcttgcccaaccaacttctatctcgctgccgataatagaacatgtctttcaaactgtactgcatcccagtttagatgcaaaaccgacaagtgtatcccattctggtggaagtgcgataccgtcgatgactgcggcgatggatctgatgaacccgacgattgccccgagtttaggtgtcaacccggcagattccagtgtggaacaggcctctgtgcactgcctgcctttatttgcgacggggaaaatgactgtggcgacaacagtgatgaactcaactgcgacactcacgtctgtctgagtggccagttcaagtgcactaagaaccagaagtgcattccagtgaacttacgctgtaacggacaggatgattgcggcgatgaggaggatgagagagactgcccggaaaacagctgctcccctgattatttccagtgcaagactacgaaacattgcatttccaagctgtgggtatgtgacgaagacccagactgtgcggatgcaagcgacgaagccaactgtgacaaaaagacttgcggacctcatgaattccaatgtaaaaataacaattgcataccggatcattggagatgcgatagtcagaacgattgttctgacaattctgacgaggaaaattgtaaacctcagacttgcacactgaaggactttttgtgtgccaacggggactgcgtgagcagccggttctggtgtgacggagattttgactgtgccgacggcagtgatgaaaggaattgcgaaacctcctgtagtaaagaccagttccggtgtagtaatggacaatgcatacctgctaaatggaaatgtgatggtcatgaagactgtaagtatggagaagacgagaaatcctgtgaacccgcaagccctacctgttcgagcagagagtacatctgtgcaagcgatggatgtatttctgcctcgctcaaatgcaacggggaatacgactgcgcggatgggtccgatgaaatggattgcgtgaccgagtgtaaggaagatcagtttcgatgtaaaaataaagcacattgtatcccaatccggtggctctgtgacgggatccatgactgcgtagatggatccgacgaagagaactgcgagagagggggaaatatttgccgagcagacgaattcttatgtaataatagcctctgcaagttacacttctgggtgtgtgatggagaagacgactgtggagacaattctgacgaggcccctgacatgtgtgtgaagtttctttgcccttctactcggccccatagatgccggaacaaccgaatctgcttgcagtccgaacagatgtgcaatggcattgatgagtgcggggacaatagcgacgaagatcactgcgggggtaaactgacctacaaggccagaccttgcaaaaaagacgaatttgcctgttctaacaaaaagtgtattcccatggatctgcagtgtgatagattagacgattgtggtgacggatccgacgagcaaggatgcagaattgcccctactgagtacacttgtgaggataatgtgaacccatgcggagatgacgcttattgcaatcaaatcaagaccagcgtcttctgtcggtgcaaaccaggattccaacgcaatatgaagaatagacagtgtgaagaccttaacgagtgccttgtcttcggcacctgcagtcaccagtgtattaatgtggagggctcttacaaatgcgtgtgcgaccagaactttcaggaacggaataatacttgcatcgcagaagggtcagaggatcaggtcctctacatcgcgaacgataccgatatattgggcttcatctacccttttaattactctggcgatcaccagcaaatctctcacattgagcacaattctaggatcactgggatggacgtctattaccagagagacatgatcatttggagcacgcaatttaatccgggaggtatcttctacaaaaggatccacgggcgtgaaaagcgacaggccaactcaggactaatctgcccagagtttaagagaccccgggatatcgctgtcgattgggttgctggtaacatttattggaccgatcactcgaggatgcactggttctcttattatacaacccactggacctcgctgcgttattctatcaacgtgggccagctgaacggcccgaactgcactagactgctgaccaatatggcgggtgaaccatatgccattgccgtgaatcccaaaaggggtatgatgtactggactgtcgtaggcgaccactcgcacattgaagaggctgccatggacggtaccctgcgtaggatcctggtgcagaagaacctgcaaaggcctactggactcgccgtagattattttagtgaacgcatttactgggctgacttcgagctgtccatcatcgggtcagtgctgtatgatgggtccaattcagtggtttccgtaagttctaagcaaggcctgctgcacccccaccgaatagatatcttcgaagattatatctacggcgccggccctaagaacggcgtgttcagggtccaaaaatttggccacgggtccgtagagtatctcgccctgaatatcgacaagactaaaggagtcctgatttcccaccggtacaagcaattggacttgcctaatccttgccttgacctggcctgcgagttcctatgtttactgaatcctagcggcgcaacttgcgtatgccccgaaggtaaatatcttataaacggcacttgtaatgatgactcactgcttgatgattcttgtaaactgacatgcgagaacggtggcaggtgcattcttaacgaaaagggggacctgcgatgtcattgctggcctagttatagcggtgagcgctgcgaggttaaccattgttccaactactgtcagaacggtggtacctgcgtgcctagcgtgctgggccgccctacttgtagctgcgccctggggtttaccggacctaactgcggtaagactgtatgtgaggatttctgtcagaacgggggtacctgcatcgtgacagccggcaatcagccatattgtcattgtcagcctgaatatactggagatcgctgtcagtactacgtatgccatcactactgtgttaattccgaatcttgtaccattggtgacgacggttccgtggaatgcgtatgccctacacgctacgagggacctaaatgcgaggtcgataagtgtgtacggtgtcatggcggccattgtattatcaacaaggatagcgaagatatcttttgcaattgcactaacggcaagatcgcttctagttgtcagctctgcgacggttattgctacaatggaggcacttgccagctggacccagagacgaatgtccccgtctgcctttgtagtaccaactggagtggcacacagtgcgaaaggccagcgccgaagtctagtaaatctgaccatatcagcacccgaagtatcgccatcatcgtgcctctggtgctgcttgtgactctgatcacaactttagtgatagggctggttctgtgcaagagaaaacgacgtacaaaaactatcagaagacagcccattattaatggcggtataaatgtcgagatcgggaacccgagctacaacatgtatgaggtcgaccatgatcacaacgatggaggacttctggatcccgggtttatgattgaccctaccaaggcacggtatatcggcggggggccaagcgcctttaaactgcctcatacagctccgccgatctacctgaacagcgacctgaagggccccctaacagcaggtccgacaaactattccaatcctgtttacgctaagctctacatggacggccaaaactgtcgcaacagcctcggctctgttgatgagcgcaaggagctcctccccaagaaaatagagattggaatacgggagactgtcgcttag

SEQ ID NO: 24798 - DNA, 2349 bp, Artificial Sequence
  Description of Artificial Sequence: Synthetic coding sequence
atgagcgagttcctgctggccctgctgaccctgagcggcctgctgcctatcgcacgcgtcctaacagttggtgccgatcgggatcaacagctgtgtgacccgggagagtttctgtgccacgatcatgtgacgtgtgtgtcccagagctggctgtgcgatggtgacccagattgtccagatgacagcgacgagagtctggatactagtcggacgtgtcaggtagatcagttctcctgcggcaacggacgttgcatcccccgcgcttggttgtgtgatcgagaggacgactgcggggatcagacagacgaaatggccagttgtgaatttccaacctgcgagcccctgacgcaatttgtgtgcaagtccggccgctgtatctcttccaagtggcactgcgacagcgatgacgattgcggggatggcagcgatgaggtgggctgcgttcactcctgttttgataaccagttccgctgctcttccggacgctgcattccaggtcattgggcctgcgacggagataacgactgcggtgatttcagcgatgaagctcaaatcaattgcacaaaagaggaaattcatagcccagccgggtgtaacggaaatgaatttcagtgtcacccggatggcaattgcgtccccgacttatggagatgtgatggcgagaaggactgcgaggatgggagcgatgaaaaggggtgcaacggaaccatcaggctgtgtgaccacaagactaaatttagttgttggagcacagggagatgcattaataaggcctgggtgtgtgacggggacatcgattgcgaagaccaatcagatgaggatgattgtgattcctttctctgcggccctcctaagcacccctgtgcgaacgatacaagcgtctgtctccagccagagaagctttgtaacggaaaaaaagactgccccgatgggtcagatgaaggatacctgtgcgatgagtgtagcttgaacaatggtgggtgcagcaaccactgttccgtcgttccgggtcgcggcatagtctgttcctgtccagagggattgcagcttaataaggacaacaagacttgcgaaatagtggattactgcagcaaccatctgaagtgttcacaggtttgcgagcaacacaaacacacggtcaagtgtagttgttatgaaggatggaaactggacgtggatggcgaatcgtgtacaagcgtggatcccttcgaggctttcattatattctctatccgccacgagataagacgcattgacctccataaacgcgattactccttgctcgtacccggcctcagaaacaccatagcactagatttccatttcaatcagagcctgctctattggacagacgttgtagaggatcggatttaccgagggaagctgagtgaaagtggaggcgtttccgcgatcgaggtcgtcgtggaacacggcctcgctacccctgaaggcctgacagttgactggatcgccggcaatatctactggattgactcaaatctagatcagatcgaggtcgcaaaattagacggatccctgagaacaactttgatcgctggcgctatggagcacccgcgggcaattgcattggatccccggtatggtatcctcttctggactgattgggatgctaattttcctcgcatcgagtccgcctcaatgtccggagccggacgcaaaacaatctacaaagacatgaagaccggcgcctggccgaatggactaaccgtcgaccattttgagaaaaggattgtgtggaccgacgcaaggagcgatgctatctatagcgcgctgtatgatgggacaaatatgattgagattatccgcggtcacgagtatctctctcacccatttgcagtcagtctgtacggttctgaagtgtattggactgactggcgtaccaatactctgtccaaggcaaataaatggacagggcagaatgtaagcgtcatccagaagacgtctgctcagccgttcgatcttcagatttaccatcccagtcggcagccccaggccccaaatccatgtgcggcaaacgacggaaagggaccctgctcccatatgtgccttataaatcacaaccgcagtgccgcatgcgcttgtccccatctgatgaagctgagctctgacaagaagacttgttacgagatgaagaagtttctgctttatgcccggaggtccgagatacgcggcgtggatattgataatccctacttcaattttattacagcatttaccgttcccgatattgacgacgtaacagttattgattttgacgcaagcgaagagaggctgtattggactgatataaagactcagacgatcaagcgtgccttcattaatggctag

SEQ ID NO: 24799 - DNA, 13614 bp, Artificial Sequence
  Description of Artificial Sequence: Synthetic coding sequence
ttcctgcacagcggccccgaggaggtggagatcaagtgccccctgaaccatatcgcatgcctgggcaccaacaagtgcgtacatctcagccagctttgtaacggcgtgcttgactgtcccgatggatacgacgaaggtgtgcattgtcaaggagagtccatctgtcagcagctcaactgcactatgtataaatataaatgcacgatggtgagaaatagcaccaggtgctactgtgaagacggcttcgagatcactgaggacggacgaagctgtaaggatcaggacgagtgtgccgtctatggcacttgtagtcagacctgccggaatacgcacggaagttacacctgctcctgtgtagaaggctatctaatgcagccagataatagatcatgcaaagccaagattgagcctaccgaccggccccctatattgttgatagctaacttcgagactattgaagtgttttacctcaatggaagcaagatggccacactgagctctgtcaatgggaacgagatccacacccttgacttcatctacaatgaagacatgatttgctggatcgagtctagggagtccagtaaccaactaaaatgtattcaaattactaaggccggcggacttactgatgaatggacaattaacatcttgcagtcgtttcataatgtgcagcagatggctatcgactggctgactcggaacctgtattttgtcgaccatgtgggggatagaatctttgtatgcaacagcaacgggtccgtctgcgtcaccttaatcgatttagaactgcataatccaaaagctatcgccgttgaccctattgctggtaagctcttctttacagattatggaaacgtggcgaaagtcgaaaggtgtgacatggacgggatgaaccgcacaagaataatcgattctaaaaccgagcagccagccgccctcgcgcttgacctggtcaataagcttgtatactgggtggacttgtacttagactatgtgggcgtggtcgactatcaggggaagaatcgacacacggttattcaaggccggcaggtgaggcacctgtacggaataacagtcttcgaagactatctctacgcaactaattccgataactacaacattgtgcgcattaatcgttttaatggcaccgatatccacagtttgatcaaaattgagaatgcatggggaatcaggatttaccaaaagcggactcagcccactgtgagatcacatgcttgtgaagtcgacccctacggaatgccagggggctgcagtcacatttgcctgctatcctccagctataagacacggacctgtaggtgtcggactggctttaatctggggagtgatggcaggagctgtaaaaggccaaaaaacgaactgttcctgttttatgggaagggaaggccgggcatcgtacggggcatggatctcaatactaaaatcgccgacgagtacatgatcccaatcgagaatctagtaaaccctcgagccctcgattttcatgccgagacgaactatatttattttgcggataccacaagcttcttgattggaaggcagaagatagatggcacagagcgtgagacaatactcaaggacgacttagacaacgtggaggggatcgctgtggattggatcgggaacaacttatactggacgaacgacggacaccgtaagaccatcaacgtagcgcggctggaaaaagcaagccaaagtcggaaaactttgctggagggggaaatgagccaccctcgcggtattgtagtggacccagtcaacggatggatgtactggaccgactgggaagaagacgaaattgacgacagcgtgggccgcatagaaaaagcgtggatggatggtttcaatcgacagattttcgtcacctccaaaatgctctggccaaatggactgacactcgacttccacactaacactctctattggtgtgacgcatattatgatcacatcgagaaggtcttcctgaatggaacccatcgaaagatcgtctactcgggccgcgagctgaaccacccattcggattgtcacaccacggcaactatgtgttctggaccgattatatgaatggttctatcttccagcttgacctgattacttccgaggtgaccttgttgcgtcatgagaggccacccctctttggcttgcagatatatgacccccggaaacagcaaggcgacaacatgtgtcgtgtgaataacggcgggtgtagtacactctgcctcgccattccagggggccgtgtgtgtgcttgcgctgacaatcaactcctcgatgaaaatggaacaacatgcaccttcaaccccggggaggccttgccccacatctgtaaggctggggaattcaggtgtaaaaatagacactgcatccaggcgcggtggaagtgcgacggcgacgacgattgtctagatggatcagacgaggatagcgtgaattgttttaatcatagttgtcctgatgaccaattcaagtgccagaataacagatgtatccctaaacggtggctttgcgacggagccaacgactgtggaagtaatgaagacgagagtaatcagacatgcaccgccagaacctgtcaagttgaccagtttagctgcggaaatggccgctgcattccacgggcctggctatgcgatcgggaggacgactgcggtgaccaaactgatgaaatggccagctgcgagttccctacgtgtgaaccgcttacccaattcgtgtgcaagtccggacgctgcattagttccaaatggcattgcgactctgacgatgactgcggagacgggagcgacgaggtgggctgtgtccattcttgtttcgacaatcagtttagatgctctagcgggaggtgcattcccgggcactgggcttgtgatggcgacaacgactgtggagacttttctgacgaagctcagatcaattgtaccaaggaggagatccatagtcccgctgggtgcaacgggaatgaatttcagtgtcatccggatggaaactgtgtcccagacctgtggaggtgcgatggagagaaagactgcgaggatggcagtgacgaaaagggatgcaacggaacaatccgcctgtgcgatcataaaactaaattttcttgctggtcaaccggtagatgtattaacaaagcatgggtctgcgatggcgatatcgactgcgaagaccagagtgacgaagatgattgtgatagttttctatgtggaccacccaagcacccctgtgcaaatgacactagtgtgtgcctgcagccagagaaactgtgcaatggcaagaaagactgtcccgatggatctgatgagggctacctgtgcgatgaatgctccctgaacaatggcggatgttcaaatcattgctctgtcgtgcccggacgcggcatcgtgtgctcttgtccagaaggtctccagcttaataaagacaacaaaacgtgtgagatagtcgactattgctccaaccaccttaaatgtagccaggtatgtgagcaacacaaacatacagtaaaatgctcttgttatgagggctggaaattagatgtggacggcgaaagctgcacaagcgttgacccattcgaagcttttataatctttagcatcaggcacgagattcggagaatcgacctacataagcgggattacagcctgctggtacccggactccgtaatacaatcgcactggattttcattttaaccagtccctgctgtactggaccgatgtggtggaagacagaatctatcgcggaaagctgagcgaaagtggcggcgtgagcgctatcgaagtagtcgtcgagcacgggctggccacccccgaaggactgactgtggactggatcgcagggaacatctattggatcgacagcaatctcgatcagatcgaagttgccaagctcgatggctcactgcgaacaaccctgatcgccggtgccatggagcaccctagagccatcgcccttgatccaaggtacggcatcttgttttggacggattgggacgcaaacttccctcggattgagtccgcttccatgtccggcgccggtaggaaaaccatctacaaggatatgaaaaccggggcctggccaaacggtcttactgtggatcacttcgagaaacggattgtctggacagatgcacgaagtgatgccatctattctgccctgtacgatggtacaaatatgatcgagataattaggggtcatgagtatctgagccatcctttcgctgtttccctgtacgggtccgaagtttactggaccgactggagaacaaataccctatccaaggctaataagtggacaggacagaacgtgtcggtgatccaaaagacctccgcccagccctttgacctccaaatatatcatccatcacggcaacctcaggctccaaatccttgcgctgctaatgatggtaagggaccctgtagccacatgtgtctgattaaccacaatcgatctgcagcatgtgcatgtccccacctaatgaaactgtcttcagataaaaaaacttgctatgagatgaagaagttcttgttgtacgccagacgctccgagattcgcggcgtggacatcgacaacccttattttaatttcatcacagcttttaccgtgccagacatcgacgacgtcaccgttatcgatttcgacgcttcagaagagaggctgtactggaccgacatcaaaacacagacgataaagagggcctttatcaatggcactggactggaaaccgtcatatcccgcgacatccaatccattcgcggcctggccgtcgattgggtgagccgtaatctgtattggattagcagcgaattcgacgagacccagatcaatgtggcccgcctcgacggtagtctcaaaacatctatcattcacggaatcgacaaaccacagtgtctcgcagcccatcccgtgaggggcaaactttattggacagacggaaatacgatcaacatggctaatatggacggctcaaacagcaaaatcttgtttcagaaccaaaaagaaccggtgggactcagtatcgactacgtggagaacaagctgtactggatctcctccggaaacgggacaatcaacagatgcaatttagacggaggcaacttggaagtcatcgagagcatgaaggaagagttgacgaaagcgacagccctcactatcatggacaagaagctgtggtgggcggaccaaaacctggctcaactcgggacgtgctccaaacgggacggacggaatcctacaattcttcgcaacaagacctcaggcgtggtgcacatgaaagtctatgataaggaggcgcagcagggaagcaatagttgccaactcaataatggtgggtgtagccagctttgtctgcctactagtgagaccacacggacgtgcatgtgtaccgtaggctattatctgcagaagaaccgcatgagttgtcaaggtatcgagtcttttctcatgtacagtgtccacgagggcattcgtggcatcccactggagcccagcgacaaaatggatgccctcatgccaattagtggtacatcattcgctgtggggatcgattttcatgccgaaaacgacactatttattggaccgacatgggattcaacaagattagcagagccaaacgtgatcagacttggaaggaagatataataacaaatggtctcgggcgagtcgaaggcatcgctgtcgattggatagcgggaaacatatattggaccgaccatggtttcaacctgatcgaagttgcccgcttgaacggctcatttcggtacgtcatcatttcacaggggttggatcagccccggtccattgcggttcatcccgagaagggcctcctcttttggaccgaatggggtcagatgccgtgcatcgggaaggctcgcctggatgggtctgaaaaagtggtgctggtgtccatgggtatcgcatggcctaatgggatttctattgactatgaggaaaataaactctactggtgtgacgcccgaacggataaaatcgagcgcattgacctcgagacgggtgggaacagagaaatggtcctgagtggctccaatgtcgatatgttttcagttgccgtttttggggcatatatttattggagtgatagagctcacgctaacgggagtgtcagaaggggccataagaacgatgctacagaaactatcacgatgcgtactgggctgggagtgaatcttaaagaggtgaagattttcaaccgggtaagggaaaaaggaaccaacgtctgcgctcgagacaatggtggatgcaagcagttatgcttgtatcgaggcaatagtaggagaacctgtgcttgcgctcacggctacttggcagaagacggagtcacttgcctgcggcatgaaggatatctcctgtattctggcaggacaatcctgaagagcatacatctcagtgatgaaacaaaccttaattcccctattagaccctatgagaacccacgatatttcaaaaacgtgatcgctctggcttttgattataaccaacgtcgaaaaggcaccaaccggattttctacagtgatgcccactttggaaatatccaactgataaaagacaattgggaagataggcaggttatcgttgagaatgtcggatctgtagaaggactcgcttatcaccgagcctgggataccctgtattggacgagctccacaacaagctcgataactcgacatacagttgaccagaccagaccaggagctttcgacagggaggccgttattaccatgagcgaagacgatcatccacacgtattagccctcgatgagtgtcagaatttgatgttctggacaaattggaacgaacagcatcctagtatcatgaggtctacattaactggcaagaacgcccaggtcgtggtgtcgacagatatcctgacgcctaatgggcttacaatcgattatagagcggagaaactttactttagcgacggcagtctaggcaaaattgagagatgcgagtatgacgggagccagaggcatgtaatcgtaaaaagcgggcccggaaccttcctaagtctggctgtgtacgacaactacatcttctggtctgactggggacgccgtgccatacttcgctctaataaatataccggcggcgacactaagattctgcgctcagatatcccgcatcaacccatggggattattgccgtcgcgaatgacacgaattcctgcgagctttctccatgcgccctcttgaacggtggttgtcacgacttgtgtttactcactcccaatgggcgggtgaactgttcctgtaggggggacagaatactgctggaggacaacagatgtgtgactaagaactcttcatgtaatgcttattctgagttcgaatgtggcaatggggaatgcatagattaccagctgacctgcgacggcattccccactgtaaggacaagtctgacgagaaactgctctattgcgagaatcgaagctgccgcagaggcttcaaaccctgctataatcgacggtgcatacctcacgggaagctttgtgacggcgaaaacgactgcggcgacaactctgacgaactggactgtaaggtcagcacttgcgcgacggtggaattccgctgtgcagacggtacttgcatacccaggtccgcccgctgcaaccagaacatcgattgtgccgatgctagcgatgaaaagaattgtaacaatacggactgcactcatttttacaaattgggggtcaagacaacaggctttatcaggtgtaatagcacatcactgtgtgtgctaccgacctggatttgtgatgggagcaacgactgcggcgattactccgacgagttgaaatgcccagttcaaaataagcataaatgcgaggaaaattacttctcctgtccttccggaagatgcatcctaaacacgtggatctgtgatggacagaaagactgcgaagatggacgggacgagtttcactgcgatagtagttgctcctggaaccagtttgcctgctctgcacagaaatgcattagtaagcactggatatgtgatggcgaagatgactgcggggacggacttgacgaatcagatagcatctgtggggcaattacatgtgcggcggacatgttttcatgtcaagggtcgagggcttgcgtacctcgtcattggctatgtgacggggagcgcgactgccccgatgggtcggatgaactctcaactgccggttgtgccccgaacaacacctgcgatgagaatgccttcatgtgtcataacaaggtctgtataccaaaacaattcgtgtgtgaccacgatgacgactgtggcgatggatccgatgagagccctcaatgcggctaccgacagtgcggtaccgaagaattcagttgcgctgatgggcgctgcctactgaatacgcaatggcagtgcgacggcgattttgactgtccagatcacagtgacgaggcccctctcaatccaaaatgcaaaagcgccgagcagtcctgcaatagcagcttttttatgtgtaaaaatggtaggtgtatcccatccggtggtctgtgtgataacaaagatgattgtggtgacggctctgacgaaagaaattgccacattaatgagtgtttgtccaaaaaggtttcaggatgtagccaagactgccaggacctccccgtgagttataagtgcaagtgttggccgggatttcagctgaaagatgacggaaagacgtgtgtggacattgacgaatgctccagcgggtttccctgtagccaacagtgcataaacacctacgggacttacaaatgcttatgcaccgatggctatgagatacagcccgacaacccaaacggttgtaagtctttatcggatgaggaaccctttttaattttggcagaccaccacgaaatccggaaaatctcaaccgacggctctaactatactcttctcaaacagggcctaaacaatgtcatagccatagattttgactaccgcgaagaattcatctactggattgattcctcccggccgaatgggagtaggattaaccggatgtgcctgaatggatcggacataaaagttgttcataacacagccgtccccaacgccctcgccgtggactggatcggcaaaaatctctattggtcagacaccgagaaaaggataattgaagtgtccaaactgaacggcctttatccaactatcttggtgtcaaagagactgaagtttcccagggacctctcacttgacccccaggctggatatttgtattggatcgattgttgtgaatatccccatatcggccgggtggggatggatggcactaaccagtccgtggtgatcgagacaaaaatttcacggcccatggccctgacaattgactacgtgaacagaagactatactgggcagacgaaaaccacattgaattttcgaatatggacggtagtcaccgccacaaagttccgaaccaagatattcctggagtaatcgccctaacactgtttgaggactacatatactggactgacggtaaaactaaatccctcagtcgtgcccacaaaaccagcggcgcggacagattgtccctcatttattcttggcacgccatcactgatatccaggtgtaccactcgtatagacaacccgatgtgtctaagcacctttgtatgattaacaacggcgggtgcagccatctgtgtctgctggcgcccgggaaaacccacacttgcgcttgccctaccaacttttatctggccgcagacaatcggacgtgcttatctaattgcacagcctcccagtttagatgcaaaactgacaagtgcatccccttctggtggaagtgcgatacagtcgatgattgcggcgacggatcagacgagccagatgactgcccggagtttcgctgccagcccggaaggtttcagtgtgggaccggtctatgcgcactgccggcatttatctgcgacggggaaaacgactgcggcgacaattctgacgagctgaattgtgacacacatgtgtgcctgtccggacagtttaaatgtactaaaaatcaaaaatgtatacccgtaaacctacgatgcaatggacaggacgactgcggggatgaggaagatgaacgggactgcccagaaaattcctgttctcccgactattttcaatgtaaaaccactaagcattgtattagcaaactgtgggtgtgtgacgaagatccagattgcgccgatgcttcagacgaggctaattgtgataagaaaacatgtggcccgcatgagttccagtgcaagaataataattgcatccctgatcactggcgctgcgattctcagaatgattgttcagacaacagtgacgaggagaattgcaagccgcagacctgtactctgaaagacttcctgtgcgctaatggcgactgtgtgtcttctcgcttttggtgcgacggggatttcgattgcgccgatggctccgacgaacgcaactgtgagacatcctgcagtaaggatcagttcaggtgctcgaacggccaatgcatccctgcgaaatggaagtgtgacggccatgaagactgcaaatatggcgaggatgagaagtcctgtgaacccgcctcacccacctgtagtagcagggagtacatctgtgcctctgacggttgtatttcggccagcctcaagtgtaatggtgaatatgactgcgccgatggctccgatgagatggactgtgtcaccgagtgtaaagaggaccagttcagatgtaaaaacaaggcccattgtattcctatccgctggctgtgtgatggaattcatgactgcgtcgacgggtcggatgaggagaattgcgaaagaggcggcaacatctgtagagccgacgagttcctgtgcaacaactcactctgtaaactgcacttctgggtgtgtgatggcgaggacgattgcggggataactctgacgaggccccagatatgtgcgttaagttcctgtgcccttcaacacgaccccaccggtgtaggaacaatcgaatatgcctacagagcgagcagatgtgcaatggaattgacgagtgtggggataatagtgatgaggatcattgcggtggaaagcttacttacaaggcccggccttgtaagaaggatgaattcgcttgtagtaacaagaagtgtatcccaatggatctgcagtgcgaccgtcttgacgattgtggagacggctccgatgaacagggctgcaggattgctccaaccgagtacacctgcgaagataatgtgaatccgtgtggcgacgatgcttactgcaatcaaatcaagactagtgtgttctgcaggtgtaagccggggttccagaggaacatgaagaatagacagtgtgaggatctgaatgagtgtctggtgtttgggacctgtagccaccagtgtatcaacgtcgaagggagttacaaatgtgtgtgcgaccagaactttcaagaaagaaacaacacttgcatagctgagggcagcgaggaccaggttctgtacatagccaacgacaccgacatcttgggcttcatttacccattcaactatagcggggatcaccaacaaatttcccatatagagcacaacagccggattaccgggatggatgtctactatcaaagagatatgatcatttggagtacgcagtttaaccccggaggaatcttttacaaaagaatccatgggcgcgaaaagcggcaggctaatagcggactgatctgccctgaattcaagaggcctcgagacatcgcagtcgattgggttgctggaaatatctattggacagatcatagtcgtatgcactggttctcctactacacgacacactggacctcattgagatactctataaatgtcgggcaacttaacggcccaaattgcactcgattgctgacaaatatggctggtgaaccctacgcaatcgcagtaaaccccaagagaggaatgatgtactggactgtagttggagatcactctcacattgaggaagccgccatggatggaacgcttcgcagaattctggtccagaaaaatttacagagacctacagggttggccgttgactatttcagcgagcggatctattgggcggacttcgagctatcgatcattggtagcgttctgtatgatggatcaaattcagttgtgagtgtttccagtaagcagggcctgctgcacccacaccgcatagacatctttgaggattacatttatggcgctgggccaaagaacggggttttcagagtgcagaagttcggccacggaagcgtggagtatttagctctgaacatagataagacaaaaggtgtgctgatatcccacagatacaagcaactggacttgcctaatccctgcttggacctggcctgcgagttcctctgcctgctgaaccccagcggagccacttgtgtctgtcccgagggcaaatatctcataaacggcacatgtaatgatgatagtctgctggacgactcatgcaaacttacatgcgaaaatggcggccgttgtatattgaatgaaaaaggcgatcttaggtgccactgctggccaagttacagcggggaacgctgtgaagttaatcattgtagcaattattgtcagaacggcgggacatgcgtgccttcagtccttggacgacctacgtgtagctgcgctctggggttcacaggaccaaactgtggcaagacagtttgcgaagatttctgccaaaatgggggtacctgtattgtgactgcaggcaaccagccatattgccactgccagcctgaatataccggagacaggtgtcagtactacgtatgccatcattattgcgtgaattctgagtcgtgcaccataggcgatgacggctctgtggaatgtgtgtgtcccactcgatatgaaggtcccaaatgtgaggtggataagtgcgtcagatgccatggggggcactgcattatcaacaaggattcagaggacattttttgtaattgtaccaacggaaaaatcgcttctagttgccaactatgcgatggctactgctacaatggaggaacttgtcaattagatcctgaaactaatgtaccggtctgcctctgttccacgaactggtccggcacccaatgtgagcggcctgcaccgaagtcgtccaaatctgaccacatctctacgagatccatcgccatcattgttcccttggtgttgctggtcaccctcatcacaaccctggtgattggtctggtcctgtgcaagagaaaacgaagaacgaagactatccggaggcagccgattattaatggggggatcaatgttgagatcggaaatccaagttataatatgtatgaggtagaccacgaccacaatgacggcggacttttggatcccggtttcatgattgatccaaccaaggcacgttacattgggggaggtccctccgctttcaaactcccccacaccgcaccaccaatctatctgaactctgacctgaaggggcctttgaccgccggaccaacgaattatagcaaccctgtgtatgctaagctgtatatggatggacaaaactgcagaaactctctcggatcggtcgatgagcgaaaagaactgctgccaaagaaaattgaaattggaatccgtgagaccgtcgcttag

SEQ ID NO: 24800 - DNA, 843 bp, Artificial Sequence
  Description of Artificial Sequence: Synthetic coding sequence
atgtgccccccccaggcccaggccgaggtgggccccaccatgaccgaaaaggctgaaatggtgtgtgccccgagtccagccccggcccccccacctaagccggcctcccccggtccccctcaggtggaggaagtgggacaccggggtggctcatcccccccaagacttcctcccggtgtcccggtcataagcctcggccatagccgcccccctggagtggccatgccaaccaccgagctgggaacgctgcgcccccccctgctacaactttccacacttggtacagccccaccaaccctggccctgcactaccacccacaccccttcctcaatagcgtttatattgggccagctggaccattttccatctttccttcaagcaggctaaaacggcgccccagccattgtgagctggacctggcagaaggacaccagccgcagaaggtggctcggagggtcttcacaaactctagagaacggtggagacagcagaacgttaacggcgcgtttgccgaactgcgcaagctcctgccaactcatcctccagatcgcaagttgtctaagaatgaggtactccggctggctatgaagtacatcggtttcctggttagacttctcagagaccaggccgccgcactggcagctggacctactccccccgggcctagaaagagaccggttcaccgcgtccccgacgacggggcacggagaggctctggccgccgcgctgaggccgccgccagatcacagcctgcaccccctgccgaccccgacggcagccctggaggcgcagccaggcctatcaagatggaacagacagctctttcccccgaggtgcgctag

SEQ ID NO: 24801 - DNA, 1620 bp, Artificial Sequence
  Description of Artificial Sequence: Synthetic coding sequence
atgggctgcggctgcagcagccaccccgaggacgactggatggagaacatcgatgtatgtgagaattgccattatcccatcgtcccactggacggaaaggggaccctgcttattcgcaatgggtccgaggtgagagacccactcgtcacttatgaaggcagcaatcctccagcgtctccattacaggacaatctggttattgccctccattcctacgagcctagccatgatggggacttgggatttgaaaaaggtgagcagttacgtatactggaacaatcaggcgagtggtggaaggcccagagcctcaccactgggcaagagggcttcataccattcaatttcgtagccaaggccaatagcttggagcccgaaccgtggttctttaaaaatctgtcgcgtaaagatgctgaaaggcagttgcttgcccctggtaatacgcacggcagttttctgatacgcgagagtgagtcaaccgccgggagtttttctctcagcgtgcgtgattttgaccagaaccagggcgaggtggtaaagcactataagatccgcaacttggataacggtggcttctatatttctccccgcatcacctttccagggcttcatgaacttgtgcgccactatacaaatgccagcgacggcctttgtacaagactgtccagaccctgtcagactcagaaaccgcagaaaccatggtgggaggatgagtgggaagttccaagagaaaccctcaagctcgtcgagaggttgggggccgggcagtttggtgaggtctggatgggttattataacgggcacacgaaagtcgccgtcaagtccctcaagcagggcagcatgtcccccgatgcatttctggccgaagctaatctcatgaagcagctccagcatcagaggctggtacggctatatgcagtcgtgactcaggagcctatttacatcattacagagtatatggaaaatgacaccctcttggacagccagctggaggagaaaggcctcggggcctcaccatggggaaaccttgggcagcagctgctcttgttgccaacaggatctctcgtggatttccttaagacaccttccggaatcaagctcaccatcaacaagttgctcgacatggccgctcagatagccgaaggcatggctttcatcgaagaaaggaattacatccaccgcgatctgcgagctgccaacattctggtctctgacaccctttcatgcaaaatagccgactttggcctggcccgacttatcgaggataacgagtatactgctcgtgagggcgctaaattcccgattaaatggactgcacccgaagctattaactacggaacgtttacgatcaaatctgatgtctggtccttcgggattctacttactgagatcgtgacccatgggcgaattccttatcccgggatgacaaatccggaggtaatacagaacctggaacgcggatacaggatggttcgcccagacaattgcccagaggagctttaccagcttatgcggctctgttggaaagaacgccccgaggacagacccaccttcgactacctgagaagcgtactggaggacttttttaccgctactgaaggtcagtatcagccgcagccatag

SEQ ID NO: 24802 - DNA, 1530 bp, Artificial Sequence
  Description of Artificial Sequence: Synthetic coding sequence
atgggctgcggctgcagcagccaccccgaggacgactggatggagaatattgatgtttgcgagaactgtcactaccccattgtgccccttgatgggaagggcactctgttgattcgtaacggtagcgaggtccgcgaccctttggtgacgtacgagggctccaacccccctgcaagtccactgcaagacaacttggtgattgccctgcacagttacgagccaagtcacgacggcgatctgggcttcgagaagggcgagcaactgagaatattagaacaaagcggagagtggtggaaggctcagtctctcacaactggccaggagggctttattcctttcaactttgttgcaaaagccaacagcctggagccagaaccgtggttttttaaaaacctgtcacgaaaagacgccgaaagacagttgctcgcccctggtaatactcacggatctttcctgattagggaatcagaatccaccgcagggtcattctccctgagcgtgcgcgattttgatcaaaatcagggcgaggtggtgaagcattacaaaattcgaaatctcgataacgggggcttttatatatccccgagaataacattcccgggtctgcatgagttggtgagacactacaccaatgcctccgacgggctgtgcacacggctcagccgcccatgtcagactcagaaaccgcaaaaaccctggtgggaagatgaatgggaagtccctagagaaactctgaaactcgtggaaagattgggggctggccagttcggagaggtgtggatgggttactacaatggccacaccaaagtagccgtgaagtcactaaagcaggggtcaatgtctcctgatgcttttcttgccgaggcaaacctgatgaaacagctacagcaccaaaggcttgtccgcctgtatgctgttgtgacccaggagcctatctatattattactgaatatatggagaacgggagcctagtggatttccttaagacgccctctgggatcaaattgaccatcaacaagctcctagatatggcagcgcagatcgcggagggaatggcattcatcgaggaaagaaactacattcacagggaccttagagctgctaatattctcgtctcagatacactcagctgtaagatcgcggatttcggcctggctcgtcttatcgaggataatgaatacacagccagagagggagcaaagtttcccatcaagtggactgcacccgaagcgatcaactacggcacatttacaattaagagcgatgtgtggagcttcggcatcctgttgaccgagatcgtgactcacgggcgcatcccatatcctggcatgacaaatcctgaagttatccagaatctggagcggggctacagaatggtcaggcccgataattgcccagaggagctgtatcagctgatgcgtctttgctggaaggagcgccccgaggaccgtcccacgtttgactaccttcggagcgtcctggaagacttttttactgcaaccgagggccagtaccagcctcagccttag

SEQ ID NO: 24803 - DNA, 1551 bp, Artificial Sequence
  Description of Artificial Sequence: Synthetic coding sequence
atgggctgcggctgcagcagccaccccgaggacgactggatggagaacatcgacgtttgcgagaattgtcactacccgattgttcctctggatgggaagggaaccctgctgatcaggaacggaagtgaagttagagacccacttgttacctatgaaggcagcaaccctcctgcttcacctttgcaaggtgacccacgccaacaaggcctgaaagataaggcgtgcggcagcctcgccgtaggcttccacctgagtccaacttactttctgcccggactagcattcctggtgcctcatccagtgacaccaggctttctgccaatacctgctcgcttttctttgatgccacttgtgtttaccgataatctggtgatcgccctgcactcttacgagccaagtcacgacggagatctcggtttcgagaagggggagcagctgcgcattctcgaacagagcggcgaatggtggaaggcccagtctttaacaacaggtcaggaagggtttatacctttcaattttgttgccaaggctaatagtctggagcccgagccgtggttctttaaaaatctgtcccggaaagacgccgaacgacagctcttagcacctggtaacacccacgggagtttccttattcgtgagtccgaaagtactgccggtagtttttctctgtctgtgagagacttcgaccagaaccagggtgaggtagtcaagcattataagatccggaacctagacaacggagggttctacataagcccacggattacattcccaggtcttcatgagttggtcaggcattatacacggtactacaacggacataccaaggtagctgttaagtcactgaagcagggctctatgagtcctgatgcgtttttggccgaggctaatctgatgaagcagctccagcatcagcggctggtgaggctgtacgcggtcgtgacacaggagcctatctatattatcactgaatacatggaaaacggttccctggtggatttccttaagactccctcaggcatcaagctgactatcaacaaactcctggatatggcagcgcagattgcagagggcatggcttttattgaagagagaaattatatacacagggatctcagagccgcaaacatcctcgtttccgatactttatcttgcaagatcgccgacttcggtctggcccggctgatcgaggacaacgagtacacagcccgggaaggagccaaattcccaataaaatggaccgcacctgaggctattaattacggtaccttcacaataaagagtgacgtgtggagtttcggcattcttttgactgagatagttactcacggccgtatcccctatcctggaatgactaaccctgaggtgattcagaacctggaaaggggctaccggatggtcaggccagacaactgtcctgaggagctgtaccaattgatgagactgtgctggaaagaaagaccagaggataggccaacgttcgactatttaagatccgtgctggaggacttctttaccgccaccgaaggccagtaccagccacagccatag

SEQ ID NO: 24804 - DNA, 750 bp, Artificial Sequence
  Description of Artificial Sequence: Synthetic coding sequence
atgggctactacaacggccacaccaaggtggccgtgaagagcctgaaacaggggtcaatgagccccgacgcctttctggccgaagctaatctaatgaagcagctccagcatcaacggctggtacggctctatgctgtcgtgacccaggagccaatttatatcataacagaatatatggaaaacgggagcctggtggatttcttgaaaactcctagcgggattaagctgactattaacaaactgttggacatggccgcccagattgccgaagggatggccttcatcgaggagcggaactatatacacagagacctgcgggcagcaaacatcctggtgtcagacactctatcatgtaaaatcgctgacttcggcctcgcacgtctgatcgaagacaatgaatatacagcccgcgaaggcgccaagttccccatcaagtggactgcaccagaagctattaattacggcacctttactattaaatccgacgtgtggtcatttgggatcctattgactgaaattgtgacccacggaagaattccctacccagggatgaccaatcccgaggtgatccagaacctggaacgcggatacaggatggtaagacccgataattgtcccgaagaactgtaccaattgatgaggctatgttggaaagagaggccagaggaccggccgaccttcgactaccttcgcagcgtcctagaggatttcttcacagcaaccgaaggccaataccaaccccagccttag

SEQ ID NO: 24805 - DNA, 1611 bp, Artificial Sequence
  Description of Artificial Sequence: Synthetic coding sequence
atgggcatccccggcagccacaacctgcggtacttctggaacttccccggacagggcccaatcatctcagacgtcggaggggcagatttaggaggagcccccagtgcccctagctctattccgtcaggtactatgggctgcgggtgtagttcacacccagaggatgactggatggaaaatattgatgtctgcgagaattgccattaccccatcgtgcccctggacgggaaaggcactctcctgatccgtaacggatcagaagtgagggaccccttagtgacctacgagggatccaacccccccgcatctcccctgcaggataacttggtaattgccctacactcatacgagcctagtcacgacggcgatctggggttcgaaaagggggaacagctccggatcctcgaacagtctggcgaatggtggaaggcacagtcccttacaacagggcaggaaggatttatacctttcaactttgtcgcgaaggcaaactcccttgaaccggagccttggttctttaagaacctgtctagaaaagatgcagagcgacagcttctggcccccggaaatacccacgggtcattcctgatcagggaatcagagagtaccgccggaagcttctcgctttctgtgagggattttgaccagaaccagggcgaagtggtgaaacactataagataagaaaccttgacaatggtgggttctacatttcccctaggattaccttcccaggactgcacgaactagtgagacactatacgaatgcaagcgatgggttgtgcaccaggctgagtcgcccctgtcagactcagaagccccagaagccatggtgggaggatgaatgggaggtcccacgcgaaaccttgaagctagtggagcggttgggtgccggacagtttggggaggtgtggatgggctattataacggtcataccaaggtggccgtaaagagccttaagcagggttctatgtcaccggacgctttcttagcagaggccaatcttatgaagcaattacaacaccagcgcctggtcagactgtacgccgtggtgacccaggagcctatctatatcatcaccgaatatatggagaacggctctctcgtcgattttctgaagacaccatccggaataaagctcaccattaacaagctgctcgacatggcagcccaaattgctgagggaatggcttttattgaagaacgaaattatatacatagggacctgcgcgctgctaatatactggtgtcagacaccctgagctgcaagatcgctgattttgggctggctaggcttattgaagacaacgaatataccgcaagggaaggagcaaaatttccgataaagtggactgcccccgaggcaatcaattacggcactttcacacatggccgcatcccatacccagggatgaccaatcccgaggtgatccagaatctcgagagaggatacagaatggtgagacctgacaattgcccagaggagctctatcagcttatgaggctgtgctggaaagagcgcccggaagaccgacctacttttgattacctgcgatctgtgctcgaagatttcttcactgccacagagggtcagtaccagcctcagccttag

SEQ ID NO: 24806 - DNA, 1200 bp, Artificial Sequence
  Description of Artificial Sequence: Synthetic coding sequence
atgccccagctgagcggcggcggcggcggcggcggcggcgaccccgagttatgcgctacagacgagatgattcctttcaaggatgagggggaccctcagaaggagaagatcttcgcagagatatcacatcctgaggaggagggagacctggccgacatcaaatccagcctggtgaacgaaagcgaaattatccctgcaagcaacgggcacgaagtggcaaggcaagcgcagacctctcaggaaccttatcacgacaaagcacgcgagcacccggatgacggaaagcaccccgatggcggcttgtataataagggtccgagctatagtagttactctggatacataatgatgcctaatatgaataatgatccgtatatgtctaatggatctttatcccctccaattccaaggaccagcaataaggtccctgttgtgcaaccttcccatgctgtccacccgcttactcccctgataacctactcagatgaacatttctcccctggatcacaccctagccacatcccgtccgacgtcaattctaagcagggcatgagcagacatcctccagcgccagatattcctacattctaccctctgtcacccgggggcgtgggtcagattacaccacctctgggttggcaagggcaacctgtctacccaataactggaggcttcaggcagccctatccatccagcttatcagtcgataccagcatgagccggttctctcatcatatgatacctggccctcctgggccacacaccactgggattcctcatcctgccatcgtgaccccccaggtgaagcaggagcacccccacacagactcagatttgatgcacgttaagccacagcacgagcagcggaaagagcaggagcccaagcggccccatataaagaaacctttaaatgcctttatgctttacatgaaggaaatgcgggccaatgttgtcgctgagtgtactcttaaggaaagcgcagccatcaaccagattttgggtcggagatggcatgccctgtcacgggaagagcaggccaaatactatgagttggcacggaaagagaggcagttgcacatgcagttataccctggctggtcagcacgggataactacggtaagaagaagaaaagaaagagggagaagctgcaggagagcgctagcggaacaggcccccgcatgacggccgcatacatttag

SEQ ID NO: 24807 - DNA, 1161 bp, Artificial Sequence
  Description of Artificial Sequence: Synthetic coding sequence
atgccccagctgagcggcggcggcggcggcggcggcggcgaccccgagttgtgcgccaccgatgaaatgatcccatttaaggatgagggtgatccccagaaagagaagattttcgccgagataagccatccagaagaggaaggcgatctggccgacataaagagcagcctggtaaatgagtccgaaatcataccagcatctaatggccatgaagtcgcccgccaggcccaaacctctcaggagccgtaccatgacaaagcacgggaacaccccgatgacggcaagcaccctgacggcggactctataataagggaccatcttacagcagctactcaggctacataatgatgccaaatatgaataatgacccctacatgtccaacgggagtttgagcccacccatacccaggacatctaataaagtaccagtggttcagccgagtcatgcggtacaccccctaacaccccttattacatactccgacgagcacttttctcctgggtctcacccaagccacatcccgtcagatgttaattcaaaacagggaatgagccggcacccaccagctcctgatattcccactttctaccccctctccccaggaggcgtgggccagataaccccaccgttaggctggttctcccatcatatgatacccggcccacctggtccacacacaactggcataccccaccccgcaatcgtgacaccccaggttaaacaggagcacccacacaccgattctgatctgatgcatgtaaaaccacagcatgaacaaaggaaagaacaggaaccaaagcgcccacatatcaagaagccccttaatgccttcatgctctacatgaaagagatgcgtgccaacgtggtggctgagtgtactctgaaggagtcagccgctataaaccaaatactaggccgacgctggcatgctctgtcccgcgaggagcaagccaaatactatgaactggctcgcaaggagcgacagctgcatatgcagctgtaccccggctggtcagcgagggacaattatggtaagaagaagaagagaaaaagggaaaagctgcaggagagcgcgagcggcggcaaacggtcctctttcccaacctgtaaggcaaaagctgcgacaccgggccctctgttggagatggaagcttgctag

SEQ ID NO: 24808 - DNA, 1116 bp, Artificial Sequence
  Description of Artificial Sequence: Synthetic coding sequence
atgccccagctgagcggcggcggcggcggcggcggcggcgaccccgagctatgtgccacagacgaaatgatcccattcaaggatgaaggagacccccagaaggagaagatcttcgcggaaatcagccatcctgaggaggaaggtgacctcgccgacatcaagagctctttagtgaacgaatcagagattatcccagctagcaatggccacgaagttgcccgccaggctcagacgagtcaagagccataccatgataaagcacgcgagcaccccgacgatgggaaacacccagacggtgggctgtataataagggacctagttattcatcatacagcggatatataatgatgcctaatatgaataacgatccctacatgagtaatggctcactcagtcccccaatcccaaggaccagtaataaggttcctgtggtccagccttcccacgccgtccatccactcaccccacttatcacttattcagacgaacatttctctcccgggagtcatccaagccatattccaagtgacgtgaattctaaacagggcatgagcagacatccccccgcccctgacatccccacattctacccactgtctcctggaggcgtggggcagattactccacccctgggatggtttagtcatcatatgattccaggcccgccagggccccacactaccggaatacctcaccctgccattgtaacgccacaggtgaaacaagaacacccacacactgacagcgacctcatgcacgtgaagccgcagcatgaacaaaggaaggaacaggagccaaagaggccgcatatcaaaaagccgcttaatgccttcatgctgtacatgaaagagatgagagcaaatgtggtggccgaatgcacgttgaaggaaagcgctgctattaaccagattctcgggagacgatggcatgccttatcacgcgaggaacaggcaaaatactatgagctggcacggaaggagagacaattgcatatgcagttatatcccggctggtccgctcgcgacaattatggcaaaaagaagaaacggaagcgagaaaaattacaggagtcagcctccggaactggccctaggatgacagcagcttacatctag

SEQ ID NO: 24809 - DNA, 912 bp, Artificial Sequence
  Description of Artificial Sequence: Synthetic coding sequence
atggccgaggtggcccggcaggcccagaccagccaggagccctaccatgataaagcaagggaacaccctgacgatggaaagcacccagacggaggactgtacaacaagggaccgtcctattcatcctactctggctatattatgatgcccaatatgaacaatgatccttatatgagcaatggttctctcagcccgcctatcccgcgaacgtccaacaaagtgccggtggtacaacccagtcacgctgtgcacccactgacaccccttataacatatagcgacgagcattttagccccggcagccacccttcacatattccgtccgatgtgaactcaaagcagggcatgagcaggcacccgccagcccccgacattccaaccttttatccgttaagtccagggggagtggggcagattacacctccccttggttggttcagccatcatatgatacccggccctccggggccgcacacaaccggtatcccccacccggcaatcgttactcctcaggtgaaacaggagcatcctcatactgatagtgacttaatgcacgtgaaaccacaacacgaacagcggaaagaacaggagccaaagaggccacacatcaaaaaaccacttaatgcatttatgctatatatgaaggaaatgcgggcgaatgtggtcgcagaatgcactttaaaggaaagtgcggccatcaatcagatactgggccgcagatggcatgcattgtcccgggaggagcaggcgaagtactacgaattagctagaaaggagcggcagctccacatgcagctgtatcccgggtggtcagccagggacaattatggaaagaagaaaaaaagaaagcgcgagaagctccaggagagtgctagtggaaccgggcctcgtatgaccgcggcgtatatctag

SEQ ID NO: 24810 - DNA, 1500 bp, Artificial Sequence
  Description of Artificial Sequence: Synthetic coding sequence
atgaacgacgaccccagcatggaggagaacggcgtggagcgggtgtgtccggaaagcctcctgcagagccgtgagtattcctctctgccccttccccgtcacacatcctccacggatggtaccatcactagctctgatccgggactggagatactgaatatggcatcttgcgacttggaccgaaacagcctgtgcaagaaagaggaagatacccgcagtgcctcaccaacaattgaggcccagggaacctctcctgctcacgataacatcgccttccaggactcgacttccaaggacaagaccattctaaacttggaggccaaagaagagcccgaaacaatcgaggaacataagaaggagcatgctagcggagacagcgtggtgtcgccattgcctgtcactacggtgaagtcagtcaatctgcgccagtccgagaatacaagtgccaatgagaaagaggtggaagccgagttcttacgtctctccttgggcttcaaatgtgactggtttacactggagaaacgcgttaagctcgaggaacggagccgcgacctggctgaagagaacctgaaaaaagaaataacaaactgtttaaaactgttggagagtcttacacccctctgtgaagatgataaccaggctcaggaaattatcaagaaactagaaaagagcattaagtttttatcccagtgtgcggctagagtggccagtcgagccgagatgctaggggctatcaatcaggagtcccgtgtgtctaaggcagttgaggtgatgattcagcatgtagagaatttaaaacggatgtatgccaaggagcacgccgagctcgaggagttgaaacaagtgctactgcaaaatgaaagaagctttaacccactcgaagacgacgacgattgccagattaagaaaaggtcagcttcccttaatagcaagcccagcagcctcaggagggtgacaattgcatctctgcctagaaatattggtaatgccggaatggtcgccgggatggaaaataacgatcggttcagtcgccgcagcagcagttggagaatcctgggctctaaacagtcagaacatcggcctagcctgccccgcttcatatccacgtacagctgggcagatgcggaggaagaaaaatgtgagttgaagaccaaggatgatagcgagccgtccggagaagagaccgtcgagagaaccaggaaaccatctctgtccgaaaagaagaacaaccctagcaagtgggatgtttccagcgtctacgatacaatcgccagttgggcgactaatctgaagtcttcgatcagaaaggctaataaggccctttggctcagcatagcctttattgtactttttgcagcattgatgagtttcctgaccggacaactgtttcaaaagtcagtcgacgcagctccgacacaacaggaagactcttggacatctttggagcatatcctctggccattcacgcggctgaggcacaacggccccccccctgtgtag

SEQ ID NO: 24811 - DNA, 1500 bp, Artificial Sequence
  Description of Artificial Sequence: Synthetic coding sequence
atgaacgacgaccccagcatggaggagaacggcgtggagcgggtgtgccccgagtccctgctgcagagtagagaatacagttccctgccgctgccccggcatacctctagtactgatggaaccattacttccagcgatccaggactggagatcctgaatatggcctcttgtgacctggatcgtaatagcctctgtaagaaagaagaggatactcggtcagcaagccccaccatcgaggcccaagggactagccccgcccacgacaacatcgcatttcaggacagcacaagcaaggacaagacaatcctgaatctggaggccaaggaggaacccgaaaccatcgaggaacacaagaaagagcatgcctccggcgactccgttgtttccccactacccgttactactgtgaaatcagtcaacctcagacagtccgagaatacgagtgctaacgagaaggaagtagaagccgagtttttgcgcctctctctcgggttcaagtgcgattggttcaccttggaaaagcgagtcaagctggaggagcggtccagggacctggcagaagaaaacttgaagaaggagatcacaaattgtctgaagctgttggagagtttgactcctctgtgtgaagacgataaccaggctcaggaaattatcaagaagttagagaaatcaatcaaatttctgtcccagtgtgctgcaagagttgcgagcagggcagagatgcttggggctatcaatcaggagtcccgcgtgtccaaagccgtggaggttatgatacagcatgtggaaaatctgaaaaggatgtacgcaaaagagcacgccgagctcgaggagcttaaacaggtgctgcttcagaatgaacggtcctttaatccactggaggacgatgacgactgccagattaaaaaacggagtgccagcttgaatagtaagccaagctcactgcgtagggtgactatcgcctcactaccgagaaacatcggcaatgccggaatggtggcaggtatggagaacaacgacagattctcccgacgttcttctagctggcgcatactcgggtcgaagcaaagtgagcatcgccccagccttcccagatttatcagcacgtattcttgggctgatgccgaggaggaaaagtgtgaactgaagaccaaggatgactctgaaccctcaggggaggaaacagttgaacgtactaggaaaccatccctgtccgaaaaaaaaaataaccctagtaagtgggatgtttcaagcgtatacgacaccatagcaagctgggcgaccaacctgaagtctagcatacgaaaggccaataaagctttgtggctcagcattgctttcatcgtgctgttcgctgccctgatgagcttcctgacagggcagttgttccagaaatctgtggatgccgctcccacccagcaagaagatagttggacatcactcgagcacatcctctggccctttacccgcttacgccacaatggccctccaccagtttag

SEQ ID NO: 24812 - DNA, 1500 bp, Artificial Sequence
  Description of Artificial Sequence: Synthetic coding sequence
atgaacgacgaccccagcatggaggagaacggcgtggagcgggtgtgtcccgagtccctgcttcagtcccgggaatacagtagtcttccactgccccggcatacctcctctactgacgggacaattacctcctctgatcccggcctggaaatcttgaatatggcatcttgtgacctggatcgcaactctctgtgcaaaaaagaggaggatacaaggtccgcctcccctaccattgaggcgcaggggactagccctgcacacgataacatcgcattccaggacagcacctccaaagacaaaactattctgaacctggaggccaaagaagaacccgaaactatcgaggagcataagaaggaacatgcctccggggactccgtggtctcaccactgccagtaacaacggtgaagtcagtgaatttgcgtcagagcgaaaatacctccgcaaatgaaaaagaggtcgaagccgagttcctgcggctcagcctgggatttaagtgcgactggttcacactggagaagagggtgaagctagaagagagaagtagggacttggcggaagagaatctcaaaaaagagattaccaattgcctgaagctcctcgaaagtctaaccccgctatgtgaggacgacaaccaggcacaggagatcatcaagaagttggaaaaatccatcaaatttcttagtcagtgtgccgctcgagttgccagccgcgccgaaatgctgggtgccattaatcaggagtcaagggtgagcaaagcagtggaggtcatgatccagcatgtggaaaaccttaaacggatgtatgctaaagagcatgccgaattggaagagctcaaacaggttctgctgcaaaacgagcggagctttaatccactggaggacgacgacgactgtcagattaagaaaagatccgcttcccttaactccaagcccagcagcttaagacgtgtcacgattgctagcttgccccgcaacatcgggaatgcgggcatggttgcgggtatggagaataatgatagattctccaggcgtagctcttcatggcgaatcctggggagcaaacagagcgaacaccgaccatcccttcctaggttcattagtacgtactcctgggccgatgctgaggaggagaaatgtgagctgaaaacaaaggacgactcagagccgagcggcgaagagacagtcgagcggactcgtaaaccgtctctttctgagaagaaaaataatccctctaagtgggacgtgtcctcagtctacgatacaatcgcctcctgggccaccaatctgaagtcaagcattagaaaggccaataaagctctttggctgtcaatagcctttatcgttctgtttgctgcgctcatgagctttctgacgggacagttgttccagaaatcggtggacgcggcgccaacgcagcaggaagatagttggacgtctctggagcacatcttatggccatttaccaggctgcggcacaacggacccccccccgtttag

SEQ ID NO: 24813 - DNA, 234 bp, Artificial Sequence
  Description of Artificial Sequence: Synthetic coding sequence
atgaacgacgaccccagcatggaggagaacggcgtggagcgggtgtgcccggaatcactcttacagtcccgcgaatattctagtctgcccctgcccaggcacacaagttcaaccgacgggacgatcacctcctcagaccccggtctggaaattctcaacatggcatcatgcgacttggatcgaaatagcctgtgcaaaaaagaggaggacacacggtccgcgagtccgacttag

SEQ ID NO: 24814 - DNA, 27 bp, Artificial Sequence
  Description of Artificial Sequence: Synthetic coding sequence
atgaacgacgaccccagcatggagtag

SEQ ID NO: 24815 - DNA, 618 bp, Artificial Sequence
  Description of Artificial Sequence: Synthetic coding sequence
atgaccccccccgagcggctgttcctgccccgggtgcggggcaccacccttcatctgttgctgctgggactgctgctggtcctgctaccaggcgcgcagggcctccctggcgtcgggctgactccttccgcagcccagaccgctcgtcagcatcccaagatgcacctcgctcactcaaccctgaagcctgccgcgcacctcatcggtgacccgtcgaagcagaactctctgctgtggagggcaaacacggatagagccttcctgcaggacggtttctctctctccaataactccttgctggtacccacaagcggcatctactttgtgtatagtcaggtggtctttagcggaaaggcatactcaccgaaagccactagtagtcccctgtacctggcccacgaggtgcagctctttagtagtcagtatcctttccatgttcctttgctgtcttctcagaagatggtctatcctgggctccaggagccttggctccatagcatgtatcatggcgctgcattccagctgacgcagggcgaccagctctccacacacactgacggcatcccgcaccttgttctttcgcccagcaccgtgtttttcggggcctttgccctatag

SEQ ID NO: 24816 - DNA, 618 bp, Artificial Sequence
  Description of Artificial Sequence: Synthetic coding sequence
atgaccccccccgagcggctgttcctgccccgggtgcggggcaccacactccatctgcttctgctgggattgctcctagtactgctgcctggagcccagggcctgccgggagtgggcctgacacctagtgccgcacagacagcgagacagcatcccaagatgcacctggctcattcaactttgaagcccgcggcccacctgatcggcgaccccagtaaacagaatagcttactgtggagagcaaacactgacagagccttcctccaggacgggttttccctctcaaacaacagcctcttagttcccactagtggaatctatttcgtgtattcacaagtagtgtttagcgggaaggcctactctccaaaagctactagctcacccctgtacctcgcccacgaggtacagctgttttcttcccaataccctttccacgtgccccttctatcatctcagaaaatggtttaccccggtttacaggagccctggctccattctatgtatcatggggccgccttccaactgacccagggcgaccagctctctacacacacagatggtattccacatttggttcttagtcccagtactgtattctttggagccttcgccttatag

SEQ ID NO: 24817 - DNA, 417 bp, Artificial Sequence
  Description of Artificial Sequence: Synthetic coding sequence
atgaccccccccgagcggctgttcctgccccgggtgcggggcaccaccctacacctcttactgttgggactgcttctcgtgctcctgcccggagcccagggtttacctggggtcggcctcactcccagtgctgcccagacagcacgccaacaccccaagatgcatcttgcacactcaaccctcaaacctgccgcccatctgattggcgacccgtccaagcagaacagcctgttatggcgtgccaacaccgatagagccttcttgcaggatggattctctttatccaacaactcattgcttgtgccgacaagtggcatctacttcgtctatagtcagggatcttcaccacccctgctgtggccctttcagcagttgaagtccagcctgataaaatcacctgaactgagcaaaaaatag

SEQ ID NO: 24818 - DNA, 2010 bp, Artificial Sequence
  Description of Artificial Sequence: Synthetic coding sequence
atggagggcaacaagctggaggagcaggacagcagccccccccagagtacgccggggcttatgaaaggaaacaagcgcgaggagcagggactcggtccggaaccagctgcaccccagcaacccacagctgaggaggaggctctcatcgaatttcatagatcttatcgggaactgttcgagttcttttgcaacaacacgacaattcatggtgcaattagacttgtgtgttcacagcacaaccgcatgaaaaccgcattctgggccgtgctatggctgtgcaccttcgggatgatgtattggcagttcggattactgttcggagaatatttctcctacccagtcagcctgaatattaacttaaacagtgataaactggtgttccccgcagtgactatatgcacgctgaatccctatcgctatccagaaattaaggaagaattggaggagctggacagaataaccgagcaaaccctgtttgatctctacaagtattcctccttcacaaccctggttgctggtagccggagtaggcgggatctgagagggactttacctcacccactccagcgcctccgggtgcctcctcccccccatggcgccaggagggcccggagtgtagctagctccctccgcgacaataaccctcaggtggattggaaagactggaagatcggctttcaactgtgcaaccagaacaagagcgattgtttctatcagacgtattctagcggcgtggacgccgtgcgagaatggtatcggtttcattatatcaacattttatcccggctacctgagactttaccgtccctggaagaggacacactgggtaattttatctttgcctgccgcttcaatcaagtgtcctgcaaccaggcaaactacagtcacttccaccatcctatgtatgggaactgctacacctttaacgataagaacaattccaatctctggatgtcatccatgccaggtattaacaatggtctctcactgatgctgcgtgcagagcaaaatgactttattcctcttttgtctaccgttactggcgcaagggtcatggtgcacggccaagacgagcccgcgtttatggatgatgggggattcaatttgcggcctggagttgaaacatccatatctatgcgcaaggagaccctggaccgactaggtggcgattacggcgactgcacaaagaatggaagtgatgtgcccgtggaaaacctgtacccatccaaatatacacagcaggtttgcattcactcgtgctttcaagagagcatgattaaagaatgcggttgcgcatatatcttttatccaagacctcagaacgtagagtattgcgactatagaaaacattcttcttggggctattgctactacaagttgcaggtagattttagctcagatcatctaggatgcttcacaaaatgccgtaagccttgcagcgtgactagctatcagttaagcgccggatacagccgctggcctagcgttacctcccaggagtgggtgttccagatgctgtctaggcaaaataattacacagttaataataaaagaaatggggtggccaaggtaaacatcttttttaaagaattaaattacaaaaccaacagcgagtccccgtctgtgaccatggtgacattgctgtcaaatcttggctcacagtggagcctgtggtttggtagctctgtgttgtcagtggtagagatggccgaactggtattcgacctgctcgtgataatgttcttgatgcttttacgccgcttccgatcaaggtattggtcgcccggcaggggagggcggggggcccaggaggtggcgagtaccctagccagctctccacctagtcacttctgcccacacccaatgtctctgagtttaagccagcccggacccgccccgtcaccggcccttactgccccaccacccgcatatgcaacactgggccctaggccttcacccggcggtagtgcaggtgcctcctctagtacttgccctctaggcgggccttag

SEQ ID NO: 24819 - DNA, 987 bp, Artificial Sequence
  Description of Artificial Sequence: Synthetic coding sequence
atgggcctggaggagatcgccccctgcaccagcaagcggaagacccagtgccgttgccagccagggatgttctgcgccgcctgggccctggagtgtactcactgtgagttactcagtgactgccctccgggcaccgaggccgaactaaaggacgaggttggaaaaggaaataaccactgcgtgccttgtaaggcaggtcactttcagaacacgtcgagcccgagtgcccgttgccagccccacacaagatgtgaaaatcaggggctcgtggaagcagctcctggcacagcgcagtccgatacaacgtgcaagaaccctctggaacctctgccgccagagatgtcaggtacaatgctgatgctcgctgtcttgctgccactggcctttttcttattgctcgctacggtgttctcctgtatctggaagagtcaccctagcctgtgtagaaagctgggcagtctccttaagcgcagacctcaaggcgaaggacctaaccctgtggcagggagttgggagccccctaaggcccacccatactttcctgacctcgtgcagccattactccctatcagcggtgacgtctctcccgtcagcacggggttgcccgctgcccccgtcctggaggccggtgtaccccagcagcagtctcccctcgatcttactagagaaccacaattagagcctggagaacagagccaagtggctcatgggacgaacgggattcacgtcacaggcggctccatgaccatcaccgggaatatctacatctataacggcccagtcttgggcggcccccccggtccaggtgatcttccagcgaccccagagcctccctaccccattcctgaagagggggaccccgggccaccaggcctttctacccctcatcaggaggatggtaaagcttggcacctggccgagacagaacattgtggcgctacgccaagcaataggggacccaggaaccaattcatcacacatgactag

SEQ ID NO: 24820 - DNA, 1725 bp, Artificial Sequence
  Description of Artificial Sequence: Synthetic coding sequence
atggccctggcccggggcagccggcagctgggcgccctggtgtggggcgcctgcctctgcgtactcgtgcacggccagcaggctcagcccggccagggttcagaccccgcaaggtggcgacaacttatccaatgggaaaataatggtcaagtatattcactcttgaacagtggtagtgagtacgtccccgccgggccacagcggagcgagtcctcatcacgtgttctgctggccggggccccccaggcccagcaacgacggtcacacggcagcccccggaggagacaggcgccaagcttgcccctgcctgggcgtgttggttcagacactgtgaggggacaggcccggcaccccttcggcttcggacaagtgcctgacaactggagagaagtggccgtgggcgacagcaccggaatggcccgtgctcgaaccagcgtctcccagcaacggcatggaggttccgcttcttcggtgtcagcatctgccttcgccagcacttatagacagcagccctcctacccacagcagtttccctatccccaagccccctttgtgagccaatacgagaattacgaccctgcttcaagaacctacgaccaggggtttgtctattatcgtccagctggggggggagtgggggcaggtgccgccgccgtagccagcgccggggttatttatccctatcaacccagggcaaggtacgaagaatatggcggcggagaagagctgcctgagtacccaccccagggtttctaccccgcccccgaaagaccatatgtgccaccaccaccaccaccccccgatgggttagatagaagatacagtcacagtttgtatagcgagggaacacctggctttgaacaggcgtatcccgacccggggcctgaggccgcccaagcgcacggcggtgatccacgacttggctggtaccccccatacgcgaacccccccccagaagcttacggacctccacgcgctttggaacccccgtatctgcccgtccggagctctgacaccccacccccaggaggagaaaggaatggagcacagcagggtaggctgtccgtgggtagcgtctaccgtcctaaccaaaacgggcgggggctcccagatctcgtacccgacccgaactacgtgcaggcctccacctacgtgcagcgagcgcatctctacagcctgcgttgcgcagccgaagagaagtgccttgccagcacagcttacgctcctgaggcgacggactatgacgtgagggttttgctgcgttttccacagcgcgtgaagaaccaaggcaccgcagatttcttacccaatcgcccccggcacacgtgggaatggcactcctgccaccagcactatcactctatggatgagttctcacactacgacctattggatgccgcaacagggaaaaaggtggctgaggggcacaaagctagtttttgtttggaggattcaacctgtgactttggtaacttgaagcggtacgcatgcacttcacatactcagggtctttcccccgggtgttacgacacctataatgccgatatcgattgtcagtggatcgacatcaccgatgtccagcctggcaattacatactgaaagtacacgtgaatcccaagtatatcgttcttgagagcgattttacaaacaatgtggtcagatgcaatattcactatactgggagatatgtgtccgcaaccaactgcaagatcgtccagtcgtag

SEQ ID NO: 24821 - DNA, 1311 bp, Artificial Sequence
  Description of Artificial Sequence: Synthetic coding sequence
atggcccgggcccggaccagcgtgagccagcagcggcacggcggcagtgcgtccagcgtgagcgcttccgcatttgcatccacttacaggcaacagccttcctacccccagcagtttccgtacccacaggcacctttcgtaagtcagtatgaaaattatgaccctgcatccaggacttatgatcaaggatttgtctactatagacctgcgggaggtggcgtgggggctggtgccgcagctgtcgctagtgccggtgtgatatacccttaccagccgagagcccggtacgaggagtatggggggggtgaagagctccccgagtacccgccacaaggcttctaccctgcccctgaacgcccctacgtgccccctccccctccaccccctgatgggctcgaccgacggtactcacactcactttatagcgaaggaactcctggcttcgaacaggcgtacccggatccgggcccggaagctgcccaagctcatggtggagaccccagactggggtggtatccgccctatgccaaccccccccccgaagcctatggccctccccgcgccctggagcctccgtatcttcctgtgagatctagcgatacccccccccctggaggagaacgaaacggagcacagcagggtagactgtcagtggggagtgtgtatagacctaaccagaacgggcgaggcctgcctgacttggtgccagacccaaactacgtccaggccagtacatacgttcagagagcgcacctctactcactgcgctgcgccgctgaagaaaagtgtctagccagcacggcgtacgctccggaagccaccgattatgacgtgcgcgttctactgagatttccacagcgcgtgaaaaaccaggggacagccgactttttgccaaacagaccacgtcacacttgggagtggcactcttgccaccagcactatcatagcatggatgaatttagccactacgacctgctggatgcggctacagggaagaaagttgccgaaggacacaaggcaagtttttgcctggaagacagcacgtgtgattttggaaatctaaaacgctacgcttgcaccagtcacacccagggcttatcaccgggatgctatgacacgtacaatgcagatatcgattgccagtggatcgacatcacagacgttcagccgggcaattatattctcaaagtgcacgtcaatccaaaatatatcgtgctagagtctgatttcaccaataatgtggtgcggtgtaatatacactacacaggccgttacgtatcggcgacaaattgcaagattgtccagtcttag

SEQ ID NO: 24822 - DNA, 636 bp, Artificial Sequence
  Description of Artificial Sequence: Synthetic coding sequence
atgaccaccctgacccggcaggacctgaacttcggccaggtggtggcagatgtgctctgtgagtttttagaggtggcagtgcacttgattctatacgtgcgagaggtgtatcccgtaggaatatttcagaaacgaaagaagtataacgttccagttcaaatgtcctgccaccctgagctcaaccagtacatccaggataccctgcactgtgtgaaacccctcttggagaagaatgatgtggaaaaggtcgtggtagtgattctcgacaaggagcacaggccggtcgaaaaatttgtctttgaaattacccagcctccattacttagcatttccagcgattcacttctcagccatgtcgagcagctgctgcgcgcatttattctgaagatctcggtctgtgacgcagtgttagaccacaatccacctggctgcacatttaccgtcctagtgcacactagggaggctgccacccggaacatggagaagatccaggttatcaaggacttcccctggatcttggctgatgaacaggatgtgcacatgcacgatcccagactgatccctctgaagacgatgacatcagatatcctgaaaatgcagctctacgtcgaagagcgtgcacacaaggggtcatag

SEQ ID NO: 24823 - DNA, 318 bp, Artificial Sequence
  Description of Artificial Sequence: Synthetic coding sequence
atgaccaccctgacccggcaggacctgaacttcggccaggtggtggctgatgtgctgtgcgaatttctggaagtagccgtgcatctgattctttacgtgagagaggtgtaccccgtggggatctttcagaaacggaagaaatataacgtgcctgtacagatgagctgccaccccgagctaaaccagtacattcaggacacattgcactgtgtgaagcccctgctggagaaagtgagagtccactgggctccgcagccatcccatcctatgctgactccagttcccgtttgctcacagagtaactctgggatgggatag

SEQ ID NO: 24824 - DNA, 531 bp, Artificial Sequence
  Description of Artificial Sequence: Synthetic coding sequence
atgaccaccctgacccggcaggacctgaacttcggccaggtggtggccgacgtgctgtgcgaatttctcgaagtggccgtgcacctcatcctgtacgtgagagaggtctacccggtggggatatttcagaagcggaaaaaatacaacgttccagtccagaatgatgttgagaaagtcgttgtggtcatcctggataaggagcatagacccgtagagaagttcgtttttgagatcacccagcccccgcttctttctatttcaagcgactccctgttgtcgcatgtggaacaactcctcagagcctttattttgaagatcagtgtgtgcgacgcagtcctcgatcacaacccgcctggggtgagcacaccacatccactgtttccatggcatttccatggttacctgggcctggtgtgcgtgccccgctccatgtttggttgcagtgaaacccaccttttcctcaccttgcgggttcatttgctgtgggaggccagcctgatcgactctacatggctcccttctccttattag

SEQ ID NO: 24825 - DNA, 636 bp, Artificial Sequence
  Description of Artificial Sequence: Synthetic coding sequence
atgaccaccctgacccggcaggacctgaacttcggccaggtggtggcagacgtgctgtgtgagttcctagaggtcgccgtgcacttgatactatacgtgagagaagtctatcccgtggggatatttcaaaagagaaagaaatacaatgttcctgtccagatgagctgtcatccggagctgaatcagtatatacaggatacccttcattgcgttaagcctctactcgaaaaaaatgacgtggaaaaagtggtggtggtgattctggataaagaacacagacctgttgagaaatttgtctttgagatcactcagccacctctgctctcaatttcgtccgactcattactcagccatgtggagcagctgctgagagcattcattcttaaaatcagcgtatgtgatgctgtgctggaccacaatccgccagggtgtaccttcacagtgctggtccacacccgcgaggcagcgacccgcaacatggaaaagatacaggtgatcaaagatttcccctggatcctcgccgacgaacaagacgtgcatatgcatgatcctagattaatccctttgaaaactatgacttcagacatccttaaaatgcaattgtatgtggaagaacgcgcgcataagggatcttag

SEQ ID NO: 24826 - DNA, 675 bp, Artificial Sequence
  Description of Artificial Sequence: Synthetic coding sequence
atgaccaccctgacccggcaggacctgaacttcggccaggtggtggcagatgtcctctgcgagttccttgaagtggcagtacacctaatcctctatgtgcgggaagtgtacccagtgggtattttccagaagcgtaagaaatacaacgtgccagttcagatgtcctgccatcctgagctgaaccagtatatccaagacactctccattgcgtcaagccattattagagaagaacgacgtggagaaagtcgtggtcgtcattctggacaaagaacaccggccagtggagaaatttgtgttcgagataacgcagccccctttgctgtctatcaggtgggcagctcccgctcctcgcccactggccggcatcagcagcgacagtttgctatcccacgttgaacaactgctccgagcgtttatcctaaaaatctcagtctgtgatgcagttttggaccacaaccctcctggatgtacctttaccgttctggtccacactcgggaggccgcgaccagaaacatggagaagatccaggttatcaaggattttccttggatcttggctgatgagcaggacgtgcacatgcatgaccctagactaatccctctgaagaccatgacctcggacatcctgaaaatgcagctatatgtcgaggagagagcccacaagggcagctag

SEQ ID NO: 24827 - DNA, 675 bp, Artificial Sequence
  Description of Artificial Sequence: Synthetic coding sequence
atgaccaccctgacccggcaggacctgaacttcggccaggtggtggccgatgtcctgtgcgagttccttgaagtcgcagtgcacctcatcctctacgtgagggaagtttaccctgtcgggatttttcagaaaaggaagaagtataacgttcctgtgcaaatgtcatgccaccctgagctgaaccaatacattcaggataccctgcactgcgtgaagcctctgcttgagaagaacgacgtggaaaaggtggttgtcgtaattctggacaaagaacaccgcccagtggagaaattcgttttcgaaatcacacagcctcccttgctgtccatccgctgggcagccccagctccaagaccactggctggaatcagctcagactccttactgtctcacgtggagcaattgctcagggccttcatcttgaagatcagcgtctgcgacgccgttctcgaccacaacccgcccgggtgtaccttcactgtcctcgttcacacgcgcgaggcagctacacgtaatatggaaaaaattcaggtgattaaggactttccttggattttggccgacgagcaggacgtgcacatgcatgaccctagattaataccgcttaagaccatgacctctgatattctgaagatgcagttgtatgtggaggagcgggcccacaagggctcctag

SEQ ID NO: 24828 - DNA, 636 bp, Artificial Sequence
  Description of Artificial Sequence: Synthetic coding sequence
atgaccaccctgacccggcaggacctgaacttcggccaggtggtggccgatgtcctgtgcgagtttcttgaggtggctgtgcatctgattctttacgttagggaggtatatccagtaggcatattccaaaagagaaagaaatataacgtccctgtgcagatgagttgtcatccagagttaaatcagtacatacaggatacactccattgcgtcaagccattactggagaagaacgatgtggagaaggttgtagttgtgatcctggataaggaacataggccagtggagaagttcgtatttgagataacgcaacctcccctcttgtctatctcctctgacagcctgctgtctcatgtggagcagctcctgcgagcattcatactgaaaattagtgtatgtgatgcggtactcgaccacaatccgccgggctgtacttttaccgtgctggtccatacaagagaagccgccacccggaacatggaaaagatccaggtgattaaggatttcccctggatactggcggatgagcaggacgtgcacatgcatgacccccgtctgattcccctcaagactatgacttcagacattttgaagatgcagctgtacgttgaggagcgggcacataaaggatcatag

SEQ ID NO: 24829 - DNA, 597 bp, Artificial Sequence
  Description of Artificial Sequence: Synthetic coding sequence
atgaccaccctgacccggcaggacctgaacttcggccagggccgggaggccggtcccgcaggacccggagcgggagccagcggcccggcaggtttccttgagagagccactggtctctgcccacccgctgttgtggccgacgtgctttgcgaatttctggaggtggcagttcatctgattctgtacgtgagagaggtctatcccgtcgggatattccagaaacgaaaaaagtacaacgtgccagtgcagatgtcctgccatccagagctgaatcagtacatccaggacacccttcactgcgtgaaaccacttctggaaaagaatgatgtagagaaggttgtggtggttattcttgataaggagcatcgccctgttgaaaagtttgtgttcgagatcacccagcctccccttttatcgatttctagtgacagcctcctatcccacgttgaacagctgctgcgggctttcattctgaaaatcagcgtctgcgacgctgtgttggaccataacccccctgggtgtacgttcaccgtcttagttcacactagggaagctgcaactcgaaacatggagaagatccaggtgatcaaggtgtag

SEQ ID NO: 24830 - DNA, 504 bp, Artificial Sequence
  Description of Artificial Sequence: Synthetic coding sequence
atgaccaccctgacccggcaggacctgaacttcggccaggtggtggccgacgtgttatgcgaatttctggaagtggccgtccacctcattctctatgttagagaggtctaccccgtcgggatcttccaaaaacgcaaaaagtataacgtgcccgtgcaaatgagctgtcatccagaactgaaccagtatatccaggatactctccactgcgtgaagccactgttagagaaaaatgatgtggagaaagtagttgtggttatactggacaaagagcacagacctgtcgagaagtttgtcttcgagataactcaaccaccactgctctcaatctccagcgacagcctgctgtctcatgttgaacagctgttgcgtgcgttcatcctgaaaatttccgtgtgcgacgccgtgctcgatcacaatcctcccggttgcaccttcacagtgttggtccacacgagggaagctgcaactaggaacatggaaaagattcaggtcattaagtag

SEQ ID NO: 24831 - DNA, 3159 bp, Artificial Sequence
  Description of Artificial Sequence: Synthetic coding sequence
atggccggcatggacagcggcaacctgaagaccgcccggctgtggcgtgacgctgctctcagagcaaggaagctcagaagcaatttgagacagctgacgctgacagcagccggggcctgtccaggcgccggagccgatgccctcgagtcccctgcttctcctcaactcgtgcttcctgccaatctgggcgacatagaggctctcaatttaggtaacaatggtctggaggaagtgcccgagggacttgggtctgctttgggcagccttcgagtgctcgtgctccgcaggaaccgttttgctcggctgcccccagccgtagccgagctggggcatcacctcaccgagcttgatgttagtcacaatcggttaaccgccctaggggctgaagtggtgtccgccctccgggaactgcgcaaactcaacctgtctcataatcagcttcccgcacttcccgctcagcttggagccctggctcatttggaggagctagacgtgtcattcaatcgattggcgcatctgcccgattcgctgtcctgtctttcacgcctgcggacactggatgtggaccacaaccagttaacggcctttcctcgccagctgctgcagctggtcgcgctggaggagctagacgtatcatctaaccgcttgcggggcctgcccgaggatattagtgccctcagagcccttaaaatcttgtggctcagcggtgctgagctggggacactcccggcggggttctgtgaacttgcttcactggaatcgctcatgttggacaataatggtctccaggccctgcccgctcagttcagttgcctgcaacgcctgaaaatgctcaatttaagttccaacctgttcgaagagttccctgccgcactcttgcctctcgctggcctcgaggaactgtatttatcgcgcaatcagctgactagcgtgccttccctgatcagcggactcggccggctcctgaccctttggttagataataatcgcattcgctacctgcctgactccatagtggagttgacggggctcgaggagcttgtgctgcaggggaaccaaattgcggtactgcctgaccatttcgggcagctctcccgtgtagggttgtggaaaattaaggataatccactgattcaaccaccgtacgaggtctgtatgaagggcataccatatattgccgcctatcagaaggagctggctcactcacaacctgccgtccagccccgacttaaacttcttctgatgggtcataaagcagctgggaagacactactccgacattgtctgaccgaggagagagtagaagggtgtcccggagggggcgacaaggaaaaatgctacccacctagcccaccccctgtgagcaagggcattgaggtgacttcttggaccgcagatgcctctagggggctccgattcatagtgtacgacttggccggagatgagtcctacgaggtgatccagcccttcttccttagccctggtgccctgtacgtgctggtcgtgaacctagcgacctatgagcctcgccacttccccaccactgttggctcgttcctccatagggtgggagcacgcgttcctcacgcagtggtctgcattgtaggcacacacgcagacctttgcggtgagcgcgagcttgaggagaaatgcctcgatatacaccggcagatagcccttcaggagaagcatgacgccgagggactgtcgcgcctggccaaggtggtggatgaagcattagctagagacttcgagctacggtccgcttcacctcatgctgcatattacggcgttagcgataagaatctgcgccgtaggaaggcccactttcagtatctactgaaccaccggctgcaaatcctttcccccgtgctgcccgtgagctgccgagatccaagacatcttagaagacttcgcgacaaactgctgtctgttgcagagcacagagagatattccccaacctgcacagagtgctcccccggtcctggcaggtgctcgaagaactgcattttcaacctcctcaagcccagcgcctgtggctgtcctggtgggatagtgctaggctgggactgcaagccggactgaccgaggatcgtctgcagtcagcgctgtcataccttcatgagtccgggaagctgctatacttcgaagactcacccgcgttgaaagagcacgtgtttcacaatcttacacgattgatcgacatcttaaacgtctttttccagcgcgacccaagtctgctcctgcacaagttactcttggggaccagtggggagggcaaggccgagggagaatcctccccgcctatggctcggtctacgccatcgcaagagctgttgcgcgcgactcagctgcaccagtatgtggaaggatttctgctgcacgggctgttgcccgcccatgtgattagattactgttgaagccccatgtgcaggcgcagcaggatttgcagctgctcttggagttactcgagaaaatgggcctttgctactgtctcaacaagccaaagggcaaacctctgaacgggtcaaccgcgtggtataagttcccttgctatgtgcaaaacgaagtgccccacgccgaggcatggataaacggcaccaacctggctgggcagtcctttgtggcggagcagttgcagatcgaatatagctttccgtttacattcccactggggctgttcgcccggtactctgtgcagataaatagccacgtggtgcatcggtccgatggcaagttccagatcttcgcctacagaggaaaggtccctgtggtcgtgtcctaccgtccagctagaggcgtgttgcagcctgataccctgagcatagccagtcacgccagtttgccaaacatctggacggcatggcaggctataaccccacttgtggaagagctgaacgtgctgctgcaggagtggcccggactgcactacaccgtgcatatattatgctccaagtgcctgaaaagggggagtcccaacccacacgcttttcctggcgagctgttatcgcaaccccgccccgagggtgtggctgaaattatctgccctaagaacggatcagagagggtcaatgtggccctcgtgtacccacccacccctaccgtgatatcaccatgttctaagaaaaacgtaggtgaaaaacataggaatcagtag

SEQ ID NO: 24832 - DNA, 549 bp, Artificial Sequence
  Description of Artificial Sequence: Synthetic coding sequence
atgggcaagggccggttcgacgagaaggagaacgtgagcaactgcatacagctcaagacttccgtgattaaggggatcaagaatcaactcattgaacagtttccaggaatcgaaccatggttaaatcagattatgcctaaaaaagaccccgtcaagatagtgcgatgtcatgaacatattgagatcttaacggttaatggcgaactgctgtttttccggcagagagaaggtcccttctaccccactttacgactgttgcataaatatccgttcatcctgccgcaccagcaagtcgacaagggcgccattaaattcgttctgtcaggggccaatatcatgtgcccagggttgacatctcctggcgctaaactctatcccgccgctgtggacacaattgtagcaattatggctgagggcaaacagcatgctctgtgcgtgggcgtgatgaaaatgtccgcagaagatatcgagaaggttaacaaagggattggcattgagaatatccattaccttaatgacggtctttggcacatgaagacatacaaatag

SEQ ID NO: 24833 - DNA, 546 bp, Artificial Sequence
  Description of Artificial Sequence: Synthetic coding sequence
atgttcaagaagttcgacgagaaggagaacgtgagcaactgcatccagctaaagacaagtgtcataaaaggcatcaaaaatcagctaatcgagcagtttccagggattgagccatggttgaatcagattatgccaaaaaaggatcccgttaaaatagtacgatgtcatgaacatatcgagatactcacagttaacggggaactgctgttctttcgccagagggagggtcccttttacccaaccctgcgcctgctacacaagtacccattcatattgccacatcaacaggtagataaaggagcaattaagtttgtgctgtcaggagccaatataatgtgtccagggttaactagtcctggcgccaaactgtaccccgccgccgttgatacgatcgtggcaatcatggcagaggggaaacagcacgctctttgtgtcggagtgatgaagatgtctgccgaagatattgaaaaagtgaataagggcatcggaatcgaaaatatacactacttaaacgacggactttggcacatgaagacttataaatag

SEQ ID NO: 24834 - DNA, 2226 bp, Artificial Sequence
  Description of Artificial Sequence: Synthetic coding sequence
atggccctgttcaccccctggaagctgagcagccagaagctgggcttttttcttgttacattcggctttatctggggcatgatgctgctacactttactattcaacaaagaactcagcctgagtcttccagcatgttgcgggagcagatcttagatctatctaagagatatataaaagctctggctgaggagaaccgcaatgtggtggatgggccctacgccggcgtcatgacagcctatgaccttaaaaagacccttgcggtcctcctggacaacattctgcagagaatcggaaaattagagtctaaagtggacaatcttgtcgtcaatggaacagggaccaattcgactaactccacgactgcggtgccctctcttgttgctcttgaaaagattaatgtggccgatataatcaacggggctcaggaaaaatgcgtgctcccccctatggatgggtatccccactgtgaagggaaaatcaaatggatgaaggacatgtggagatctgacccatgttatgccgattacggagtggatgggtctacttgtagcttttttatctatctgtcggaggttgagaactggtgtccccatctgccctggcgcgcaaagaatccgtacgaggaggccgatcataactctctggccgaaataaggacagactttaacatcttgtactcgatgatgaagaaacacgaggaatttaggtggatgagactaagaatccgacgcatggctgatgcatggatacaggctatcaagagcctggcggaaaagcagaacttggagaaaagaaagcgtaagaaggtccttgtccatcttggccttcttaccaaagagtcaggcttcaaaatcgcggaaaccgccttctcaggcggcccattaggagagcttgtgcagtggtcggaccttattaccagcttgtacttgcttggacatgacatcaggatctcagcttctctggccgaactcaaggagattatgaaaaaggtagtgggcaatcgttctggctgcccgaccgtaggcgacagaattgtcgagctgatctacatagacatcgtaggattggcccagttcaaaaaaacgttgggaccttcatgggtgcactaccagtgcatgctgagagtccttgacagcttcggcaccgagccggagtttaaccatgcaaactacgcacagtccaagggccacaaaaccccatggggcaaatggaacctaaatcctcagcagttttacacgatgttccctcatactcccgacaacagtttcctgggatttgtggtggaacagcatttaaatagtagtgacattcaccacattaatgaaatcaaacggcagaatcaatctttggtatacgggaaggtggatagtttctggaaaaacaagaaaatctacctagatatcatccatacttatatggaggtgcacgcaacagtgtatggatcgtccacaaaaaatattccaagctatgttaagaatcacgggatcctctctgggcgcgacctgcaatttctcctgcgggaaaccaagctgtttgtcggactgggatttccttatgaggggccggcacccttggaagctatcgccaatggctgtgcttttctgaacccaaaatttaatccacccaaaagctctaagaacactgactttttcattgggaaacccactctccgggagttgacaagtcagcatccttatgcagaggtttttatcggcagaccacatgtgtggactgtggatctgaataaccaggaagaggttgaggacgcagtgaaggccattctgaaccagaagattgaaccgtacatgccttacgaatttacatgtgaagggatgcttcagagaatcaatgcctttattgaaaaacaggacttttgtcacggacaggtcatgtggccccctctgtctgctcttcaggtgaaattggcagagcctggtcagtcttgtaagcaagtctgccaggagagccagcttatttgcgaacctagtttcttccaacacctcaacaaagacaaagacatgttgaagtataaggtgacctgtcaatcttctgaattagctaaggatattttggttccatcatttgaccccaagaacaagcattgtgtgtttcagggcgaccttctccttttctcatgcgcaggggcccaccctagacaccagagagtgtgtccctgcagagatttcattaaggggcaggtggcactgtgcaaggactgtctgtag

SEQ ID NO: 24835 - DNA, 2226 bp, Artificial Sequence
  Description of Artificial Sequence: Synthetic coding sequence
atggccctgttcaccccctggaagctgagcagccagaagctgggcttcttcctcgtaacctttggatttatttggggaatgatgctattgcacttcaccattcaacagcggacgcagcctgagtcctctagtatgctaagggaacagatcttggacctgtccaagcgatatattaaggccctggctgaagaaaatcgaaacgtcgtggacggaccatacgcaggggttatgacagcatacgatctcaagaagaccctggctgttctgctcgacaatattctgcagcgtattgggaagctcgagtctaaggtcgacaaccttgtggtgaatggaacagggaccaactcgaccaactctacgactgccgttccttccttggttgcattggaaaagataaatgtagctgacatcattaacggagcccaggagaagtgtgtgcttcctcccatggacggctacccacattgcgaggggaagatcaagtggatgaaggacatgtggcgctctgatccttgttacgccgattacggagtcgatggaagtacatgctctttctttatctatctttccgaggtggagaactggtgccctcatctgccatggcgcgccaaaaacccatacgaggaggcggaccataattcgctcgctgaaatcaggacagacttcaatatcctgtactccatgatgaaaaagcatgaggaattccggtggatgcgccttcgcattagacggatggctgatgcatggatacaggcaatcaaaagcctggcagagaagcagaacctggaaaagcggaaacgtaaaaaagtcctggtacacctgggcttgctgactaaagagtccggatttaagatcgctgagactgctttcagtggtggtcccctgggagagctagtccagtggagtgacctcattaccagcctctatttattgggacatgatatcaggattagtgctagcctggccgaattgaaggagataatgaaaaaagtggttggcaaccggagcggctgtcctacagtcggagacagaatagtcgaactgatctatatcgacatcgtggggctagctcagttcaagaagaccctgggcccctcatgggtgcattatcagtgcatgctaagagttctggacagtttcgggaccgaacctgagtttaatcatgccaattacgcacagtccaaaggtcacaagacaccttgggggaagtggaatttgaatccacagcagttctacaccatgtttccccacacaccggataacagttttttggggttcgtcgttgaacagcatctaaatagttctgacatccaccacattaacgaaattaaacgccagaaccagagtctggtctatggaaaagtggattctttctggaagaataaaaagatctatctggacattattcacacctacatggaagtgcacgccacagtttacgggtctagtacaaagaacatcccaagttatgttaagaatcatggtatcctgagcgggcgggacctccaatttttgctgcgtgaaactaagctgttcgtggggcttggattcccctacgagggtcccgctcctctggaggccattgctaatggctgcgctttcctcaatcccaagttcaaccctcccaaatccagtaaaaacacagatttctttattggaaagcccacattgagggagctaacttctcagcatccatacgccgaggttttcatcggccgtccccacgtttggaccgtcgatctcaacaaccaggaggaagtcgaagatgccgtgaaagcaatactgaatcagaagattgaaccctacatgccctatgaatttacttgtgaagggatgctgcagcgtattaatgcattcatcgaaaagcaagacttttgccacgggcaggtgatgtggccccctctctccgccctacaggtgaagcttgctgaacccgggcaatcctgcaagcaagtgtgccaggagtcacaactaatatgcgaacccagcttcttccaacacctgaacaaggataaagatatgctaaagtacaaggtgacgtgccagtcatcagaactcgcaaaggacattctcgtgccaagctttgatcccaagaataagcattgcgtcttccagggagatttgctgctttttagttgcgccggtgcacacccccggcatcagcgcgtatgtccatgcagagatttcatcaaggggcaggttgcgctgtgtaaagattgcctgtag

SEQ ID NO: 24836 - DNA, 1410 bp, Artificial Sequence
  Description of Artificial Sequence: Synthetic coding sequence
atgcacagcttcccccccctgctgctgctgctgttctggggcgtggtgagccattcctttcccgccaccctggagactcaagagcaggacgtagatcttgtgcaaaagtaccttgagaaatactacaacctgaagaatgatggcaggcaggtggagaagcgcaggaactctggcccggtcgtcgagaaactgaagcagatgcaggagtttttcgggcttaaggtgaccgggaaacctgatgcagaaacactgaaggtgatgaaacagccccgttgtggcgtgccagacgtagctcagtttgttctaacagagggaaacccgagatgggagcagacccatctgacctatcgaattgagaactatactccagatctgcctcgcgccgacgtggaccatgctatagagaaagctttccaactgtggagcaacgtgacgccactaacgttcacaaaggtgtcagagggacaagcagacataatgatcagctttgtgcggggtgatcatagggataactccccattcgacggtccaggaggaaacctcgcgcatgctttccagccaggtcctggcattgggggggacgcgcacttcgacgaggatgaacggtggaccaacaactttagggagtataacctgcaccgcgtggccgcgcacgagctgggccatagcctaggtttatctcacagcacagacatcggcgcgttgatgtatccgtcatatactttttccggagacgtacagctcgcacaggatgatattgatggcatccaggcaatttatggcaggtcacaaaatcccgtgcagcccattggacctcagaccccaaaggcttgcgattccaagctgacatttgacgccattacaactattcggggcgaggtgatgttttttaaagaccggttctatatgcgaaccaatcccttctaccctgaagtggagctgaatttcatctccgtcttttggccccaactgcccaacggactcgaggccgcttacgagtttgccgaccgtgatgaggtgaggttctttaaaggcaacaagtattgggcagtgcaggggcagaatgtgctgcatgggtatccaaaagatatttacagtagttttggattcccgagaacagtcaaacatatcgacgccgccctgtctgaggagaacaccggcaagacttatttttttgtggccaataagtattggagatacgatgaatacaaaagaagcatggatcccggatatcccaagatgatcgcacacgacttccccgggatcggccataaagtggacgctgtgtttatgaaagacgggttcttctatttttttcatgggacccgacagtacaagttcgatccgaaaactaagaggattctgaccctgcagaaggccaattcttggttcaactgtcgaaagaactag

SEQ ID NO: 24837 - DNA, 1431 bp, Artificial Sequence
  Description of Artificial Sequence: Synthetic coding sequence
atgatgcacctggccttcctggtgctgctgtgcctgcccgtgtgctctgcatatcctcttagcggtgccgcaaaggaggaagatagcaataaggacttggcccagcagtatctcgagaaatattataacctagagaaagatgtaaagcagtttagacggaaggattccaatttgattgtgaagaagatccaaggcatgcagaagttcctaggacttgaagtgacaggcaagctggataccgacaccctggaggttatgagaaaaccaagatgcggggtgcccgatgtggggcatttcagtagtttccctgggatgcccaaatggaggaagacccaccttacttatcggattgtgaactataccccggacctaccacgtgacgccgtagactccgccatcgaaaaagcactcaaagtctgggaggaagttacccccctgacattttccaggctgtatgagggcgaagccgatatcatgatctctttcgcagtgaaagagcacggcgacttttactcattcgatgggcctggccacagcttagcacacgcttacccccctggccctggtctatatggcgacattcacttcgacgatgacgagaaatggaccgaagacgcgagtggtactaatttgtttttagttgcagctcatgagctggggcactccctgggcctctttcatagcgctaatacggaggcccttatgtatcccctgtacaactccttcactgagcttgcccaattcagactgtcccaagatgacgtcaacggtattcagtcgctgtacggcccacccccggcttccactgaggaacccctcgtccctacgaagtcagtacccagtggatctgaaatgccggccaagtgcgatccagccttgtcgtttgacgctatctccaccctgcggggcgagtaccttttctttaaagatcggtatttttggcggcgctctcactggaaccccgaacctgagttccatctaatttcggctttttggccttctctgcccagttacttggacgccgcctatgaagtgaactcgagagatacggtgtttatcttcaagggcaacgagttctgggccataagaggcaatgaagtgcaggctggatacccccgaggtattcacaccctcggcttcccccccacaatccgcaagattgacgcagccgtcagtgacaaggagaagaagaaaacttacttctttgcagccgataaatactggcgatttgacgagaattcgcagtcgatggaacaggggttccctaggctcatagccgacgattttccaggggtcgaacccaaggttgacgccgtgcttcaggctttcggattcttctattttttttctggtagctcacaatttgagttcgatcctaatgccagaatggtgacacatattcttaagtctaattcttggctgcattgctag

SEQ ID NO: 24838 - DNA, 930 bp, Artificial Sequence
  Description of Artificial Sequence: Synthetic coding sequence
atgccccggcactgcagcgccgccggctgctgcacccgggacacccgtgaaacacggaaccggggaatcagcttccataggctccctaaaaaggataatcccaggcgtggcttgtggctcgctaattgccagcgccttgatccctctggacagggcctgtgggaccccgcctcagaatatatctacttctgttcaaagcacttcgaggaagattgctttgagctcgtggggatcagcggctaccatagactgaaggaaggagccgtgccaactatctttgaatctttttccaagttacgtagaactacgaaaaccaagggacactcgtacccacccggccccgcagaagtgtccaggttgagacgctgtcgcaagagatgttctgagggtcgcgggcctacgacgccattctctccccctccacctgccgacgtgacgtgcttccccgtggaagaggctagcgcaccagccactctcccggcttcacccgccggacgtttggagcccgggttatcatctcccttctcagatctgctgggacccctcggggcacaggccgatgaagcgggatgctctgcccagccaagcccggaacggcagccttccccacttgagcctcgtcccgtgtcccctagcgcctatatgctgcgcctgccccctccggcaggggcttacatccagaatgagcactcttaccaggtgggaagtgctttactctggaaaagacgagcagaagccgctctcgacgcactggacaaagcccaacggcaactccaggcatgcaagaggagagagcagagactgagactaagactgaccaagctacaacaggaacgcgccagggagaagcgtgctcaggcggacgctcgccagaccctgaaggaacatgtgcaagattttgcaatgcaactgtcatcctcaatggcttag

SEQ ID NO: 24839 - DNA, 1416 bp, Artificial Sequence
  Description of Artificial Sequence: Synthetic coding sequence
atgcaccccggcgtgctggccgccttcctgttcctgagctggacccactgtcgggccctaccactgcccagcggaggggacgaggatgatctgtcggaagaggatctgcagttcgcagaacggtatctgagaagttattatcacccaacaaacttggccggcattctgaaggagaacgccgcttcctctatgaccgagcgattgcgggagatgcagtccttcttcggactggaggttactggaaagttggatgacaacaccctggatgtaatgaaaaaacctcgatgcggggtgcctgacgttggcgaatataacgtgtttccgagaaccctcaagtggagtaagatgaatctgacctacaggatcgtaaactacacgccagatatgacccacagtgaggtggagaaggccttcaagaaggcttttaaggtgtggtctgatgtgacgccactcaattttacccggctgcacgatgggatcgccgatattatgatctcctttggaattaaggaacatggggacttctatcccttcgatgggcccagcgggttgcttgctcatgcgttccctccgggacctaactacggaggagatgcgcactttgatgatgacgaaacctggaccagctcttccaaaggctataacctcttcctcgtagctgcacacgagttcggccattctttaggtctcgatcacagcaaagatccaggggcactgatgttccccatctatacatacacaggtaagtcccactttatgttaccggatgacgatgtgcagggaatccagagtctctatgggcctggcgacgaggatccaaatcctaaacatcccaagactcctgacaaatgtgacccctccttgtcactcgacgcaattacgagtttacggggcgagacaatgatttttaaagacagatttttttggcgccttcacccccagcaggtcgatgcagagttatttctgacgaagtccttctggcccgaattgcctaaccggatcgatgctgcctacgagcaccccagtcatgaccttatcttcatcttcagaggccgtaaattctgggcattgaatgggtatgatattttggaaggttatccaaagaaaatttccgaacttgggcttcctaaagaggtaaaaaagatttccgccgctgtgcactttgaagacacgggaaaaaccttgcttttttctggaaaccaagtatggaggtacgacgataccaaccatataatggacaaggactatcctcgactgatcgaggaagattttcccggcattggggacaaagtggatgctgtatacgaaaaaaatggctacatttatttttttaatggaccgatccagttcgagtattccatatggtcaaataggattgttagagtcatgccagcaaactctatcctgtggtgttag

SEQ ID NO: 24840 - DNA, 1470 bp, Artificial Sequence
  Description of Artificial Sequence: Synthetic coding sequence
atgcaccccggcgtgctggccgccttcctgttcctgagctggacccactgtagggccttgcccttgccgtccggaggtgacgaggatgacctcagcgaggaagatctgcaatttgcggaaaggtatctccgttcatattatcacccaactaatctggccggtatacttaaggaaaacgccgccagctcaatgacagaacgcctgcgtgagatgcagagcttttttggtctcgaggtgactggtaaactggacgataacacactggatgtgatgaagaagccaaggtgcggagttcccgacgtcggggagtacaacgtgttcccaaggactctgaagtggtctaagatgaacctgacgtatcgcatcgttaattacaccccggatatgactcacagcgaggttgagaaagcctttaagaaagcttttaaggtgtggagcgacgtgacacccctcaatttcacccgactacacgacggcattgcagatatcatgatctcctttgggattaaggagcacggtgacttttatcccttcgacggcccttcaggactactcgctcatgcatttccgccagggcccaattatgggggagatgcacatttcgacgatgacgaaacatggacctccagctctaaggggtacaatttattcttagtggcagcacacgaattcggacacagccttggcctcgaccactctaaggatcctggcgcactgatgtttccaatatacacatacactggcaagagccactttatgctgccagatgatgatgtacagggaatccaatccctttacggacccggggacgaagaccctaatccgaagcaccctaagaccccagacaagtgtgaccccagcttatctctggatgcaatcacctctctgagaggagaaacaatgatctttaaagaccgatttttctggaggctgcacccacaacaggttgacgcagagttgtttctgaccaaatctttttggccagagttgcccaacaggattgatgccgcttatgagcatcccagtcacgacctgatctttatcttcaggggaagaaaattctgggcgttaaacgggtatgacattcttgaagggtatccaaagaaaatcagcgagctaggtctgcctaaagaggtgaaaaaaatcagcgctgccgtccacttcgaggataccgggaagaccctgctcttcagtggtaatcaggtttggcgctatgatgacactaatcacattatggataaggattacccccgtctgatcgaagaggattttcccggcatcggtgacaaggtggacgccgtttatgaaaaaaatgaatctcactcggtgactcaggcaggtgttcactgccgaaacttgagcagcctgcaacctccccctcccggctttaaacgctttagctgcctgtctttgtggtcctcttgggattaccgcctttatctgttcttccagagaactcacacagtgtag

SEQ ID NO: 24841 - DNA, 1152 bp, Artificial Sequence
  Description of Artificial Sequence: Synthetic coding sequence
atgcaccccggcgtgctggccgccttcctgttcctgagctggacccattgtagggccttgccactgccctccggaggggacgaggacgatctatctgaggaagacttacagttcgcggaacgctacctacgcagctactatcatcctaccaatttagcagggatcctgaaggagaatgccgcaagttccatgacagagcgactgagagagatgcagtcatttttcgggctggaagtaacaggtaagctggatgataacactctggacgtaatgaaaaagccgcggtgtggcgtgcccgacgtgggtgaatacaacgtcttcccacgcaccctgaaatggtccaagatgaatcttacctataggattgttaactatacaccagatatgacacactctgaagtcgagaaggcctttaaaaaagcctttaaggtctggagcgacgtcacaccactcaatttcaccagattacacgatggtatagcggacatcatgatctcgttcgggatcaaggagcatggcgatttctaccctttcgacggtccttcaggcctgctagcgcacgcctttcccccgggaccaaactacggcggagatgctcattttgacgacgatgaaacatggacctcttcgtctaaaggctacaacctgttcttggtggctgcgcacgagtttggacacagcctaggcctagaccacagcaaggaccccggcgctctgatgttccccatctatacatatacaggcaagtctcactttatgctccccgatgacgacgtgcaaggtattcaatcactttacggtcccggagacgaggacccaaaccctaagcatcctaaaacccctgacaaatgcgatcctagcctgtctctggacgctataacgtcactccggggggaaaccatgatcttcaaagaccgattcttctggaggctgcatcctcagcaggtggacgcggagctgtttctcacaaagtccttctggcccgagctacccaaccgaattgatgctgcgtacgaacatccctctcacgaccttatatttatttttcgaggccgaaagttttgggctttaaacgggtacgacatcctggaaggctacccgaaaaaaatttccgagctcggcctgccaaaggaggtgaacaagctgcagtag

SEQ ID NO: 24842 - DNA, 1749 bp, Artificial Sequence
  Description of Artificial Sequence: Synthetic coding sequence
atgagccccgccccccggcccccccggtgcctgctgctgcccctgctcacccttgggaccgccttagccagccttggcagcgctcagtcatcgtccttttcccctgaggcatggctacagcagtatggctacctcccgcccggcgatttacggacacatacccagcgtagtccccaaagcttgtcagcagcaatcgccgcaatgcagaaattctatggattacaggtcaccggaaaagcggatgcggatacaatgaaggcaatgcgtcggccccgctgtggggtcccagataaatttggggctgagatcaaagcaaatgtccggagaaaacgttatgctattcagggcttaaaatggcagcataacgaaataacattctgtatccaaaactacaccccaaaggtgggagagtacgcaacttacgaagctattaggaaggcattccgcgtttgggaatccgccacaccattgagatttagggaagtgccatacgcctatattagggagggacatgaaaagcaagccgatattatgatattttttgctgaagggttccacggcgatagtacacctttcgatggggagggcggtttcctggcccatgcctacttccctggtccaaatattgggggagatacacatttcgacagcgcggagccctggactgtacggaacgaagacctgaacggaaacgatattttccttgtggccgtccatgagcttgggcatgccctggggctcgaacattccagcgatcctagtgcaattatggcccccttctatcagtggatggatacagaaaactttgtgctgcctgacgacgatcggagggggattcaacagttgtatgggggggagtctgggttccccaccaaaatgcctccacagcctcggaccacctccaggcccagtgttcctgacaagcccaagaatcctacttacgggccgaatatttgcgacggcaatttcgataccgtcgctatgctgaggggtgagatgtttgtattcaaggagcgctggttttggagggttcgcaacaaccaagtcatggatgggtatcccatgccgattgggcagttctggagggggctaccggcatccattaacacagcgtatgaaaggaaagatgggaagttcgtttttttcaaaggagacaaacactgggtctttgatgaggcctccctggaacccggataccctaagcacattaaggagctcggacgcggcttgcctacagacaaaatcgacgccgccctattctggatgccaaacggaaagacctacttttttaggggcaataaatactaccggttcaatgaggagttgagagctgtggacagcgagtacccaaaaaacataaaggtctgggaagggatccccgaaagccctcgcgggagcttcatgggcagcgatgaagtcttcacatatttctacaagggcaacaagtattggaagtttaataatcagaagctgaaggtcgagcccgggtatcccaaatctgccctaagagactggatgggctgcccctctggcgggcggccagacgaaggcactgaggaagaaactgaagtcatcattattgaagtggacgaggagggcggcggcgccgtctccgcagctgcagtcgtcctccctgtgcttctgcttctgctcgttctggccgtgggcctggctgtcttcttctttagaaggcacggcacccctcggaggctgctgtattgtcagcgctctctactggataaggtgtag

SEQ ID NO: 24843 - DNA, 2052 bp, Artificial Sequence
  Description of Artificial Sequence: Synthetic coding sequence
atggccagcggccccggcagccaggagcgggagggcctgctgatcgtcaagttggaagaagactgtgcgtggtcacaggaacttccacctccagatcccggtcctagtcctgaagcaagtcacttgaggtttaggcggttcaggtttcaagaagcagccggtccccgcgaggcccttagtcgactgcaggagctttgccatgggtggctgaggcctgagatgcggaccaaggaacagatcctcgaacttttagtgctggaacaattcctaacgatattgccccaagagatccaaagccgggtgcaggaactgcatcccgagtcaggagaagaggctgtcactctggttgaggatatgcagcgtgaactgggccgtctgcggcagcaggttacaaatcacggcagggggaccgaggtgctcctggaggaaccgctgcctctggaaactgccagggagagtccatccttcaagttggaacctatggagaccgagagaagtccaggccctaggctgcaggaactgctgggcccttcccctcagcgggacccccaagcagttaaggaacgggccttgtccgcgccttggctatctctcttccctccggaaggcaacatggaagataaagaaatgacaggcccgcagctccccgaatccctggaggacgtggccatgtacatctctcaggaggagtggggacaccaggatccctccaagcgcgcactgagcagagacaccgtccaggaatcctacgagaacgtcgacagtctggaatctcatatccctagccaggaagtgccaggaacccaggtgggccaggggggaaagttgtgggatcctagcgtgcagagctgcaaagagggcttgtccccacgcggccctgccccaggggaggaaaagttcgaaaacctggagggggttccctccgtgtgcagtgaaaatatacaccctcaggtgctgctgcccgatcaggcaaggggtgaggttccatggtcacctgaattgggccgtcctcatgatcggagccaaggcgattgggcgccgccccctgagggaggcatggagcaggcgctggcaggcgcctcatctggaagagagctgggcaggcctaaggagctacaaccgaagaagctgcatctgtgccccctttgtggtaagaacttcagcaataattcgaacctgatacgacaccagagaatccatgctgcagaacggctttgcatgggcgtagactgcaccgagatctttggagggaaccctcgatttctgtctctccatagagcccatctcggcgaagaggcccacaagtgtctcgaatgcggaaaatgtttttcacagaacacacacctcacacgccaccagcgtacacacactggggagaagccgtaccagtgtaatatctgtggcaaatgcttcagctgtaatagcaacctccaccgtcatcagagaacccacacaggtgagaagccttacaagtgccctgagtgtggagaaattttcgctcacagctctaatctgttacggcatcaacggatacacaccggcgagagaccctataagtgtcctgaatgcggcaagtctttctctaggagttctcatttggttatacacgaaaggacacatgaacgggaaaggttatatcctttcagtgagtgtggcgaggcagtgtcagactcaaccccttttctcaccaatcatggagcccataaagctgagaagaaactgtttgaatgcctgacatgcggcaagtcctttaggcaggggatgcacctaacccggcaccagaggactcacacaggagagaaaccgtataaatgcacgctgtgcggggagaacttctcccatcgtagcaatctgatccggcatcaacggatccacacgggagaaaaaccttacacctgtcatgagtgcggcgactctttctctcactcctccaacagaattaggcacctgcgcacccatactggagaaagaccgtacaagtgctcggaatgtggggagagtttttccagatcctcacggctcatgtcccaccaacggacacataccggctag

SEQ ID NO: 24844 - DNA, 1755 bp, Artificial Sequence
  Description of Artificial Sequence: Synthetic coding sequence
atgcagaagttcttcggcctgccccagaccggcgacctggaccagaacacaatcgaaacaatgagaaaaccaaggtgcgggaacccagatgtggctaattacaacttcttccctaggaagcctaaatgggacaaaaatcaaattacctatcgaatcatcggctatactccagacctggacccggaaaccgtcgacgatgcatttgccagggctttccaggtgtggagcgatgtgacaccactgagattctccaggatacacgatggggaggccgatatcatgatcaattttgggcggtgggaacacggcgatggctatcccttcgacgggaaagacggcctgttagcccatgctttcgcccctggcacgggtgttggtggtgactcccacttcgacgatgacgagttatggaccctcggggaaggccaagtcgtgagggtcaaatacgggaacgctgatggtgagtactgcaagtttccctttcttttcaacgggaaggagtacaattcttgcaccgatacgggtagatcagatggctttctgtggtgtagcaccacttacaattttgaaaaagatggcaagtacggattctgcccccatgaggcgctgttcactatgggggggaatgcagagggacagccatgcaaattccccttccggttccagggtacatcctatgacagttgtacaacagagggccgcaccgatggctataggtggtgcggcacgacagaggactacgatagagacaaaaagtacggcttttgtcccgagacagctatgagcacagtgggtggaaatagcgagggggctccctgtgtgttcccatttactttcctggggaataagtacgaatcctgtacgtccgcagggcgcagcgatggcaaaatgtggtgtgcaaccacagcgaattacgatgacgaccgcaagtgggggttctgtccggaccagggatactccttgtttctagttgctgcccatgaattcggccacgctatgggattggaacacagccaagaccctggtgccctgatggctccaatctacacatacacaaagaacttccgattgtctcaggatgacatcaaaggtatacaggagttatacggggccagtccagatatcgaccttggcaccgggcccacaccaaccctaggaccagtcactccagagatatgcaagcaggacatcgtctttgacgggatcgctcaaatacgcggcgaaatcttttttttcaaagatcgcttcatctggcggacagtaactccccgcgataaaccaatgggcccactgctggtcgcaaccttctggcctgaactgcctgaaaaaatcgacgccgtctatgaagcaccccaagaggagaaggccgtattctttgctggtaacgagtactggatttactccgccagcacactggaacgggggtaccctaaacccctcaccagtctaggtttaccaccggacgtgcagagagtggacgccgcttttaattggtctaaaaataaaaaaacgtacatttttgcgggcgataagttctggaggtataacgaagtgaagaagaagatggaccctggatttcctaagttgatagctgacgcatggaatgctatcccagataatctggacgccgtcgttgatctgcaagggggcggacattcctacttttttaaaggcgcttattacctcaagctcgaaaatcaatctctgaaaagcgtgaaattcggatccatcaagtctgactggttgggttgctag

SEQ ID NO: 24845 - DNA, 1434 bp, Artificial Sequence
  Description of Artificial Sequence: Synthetic coding sequence
atgaagagcctgcccatcctgctgctgctgtgcgtggccgtgtgcagtgcctacccattggatggcgccgcgcgcggggaggatacttccatgaacttagtccagaaatatcttgaaaactattacgacttaaagaaggatgttaagcaatttgtccggcggaaagacagtggcccggtcgtaaagaagattcgggagatgcagaaatttttggggctggaggtgacaggcaagttggactctgacacgttggaggttatgcggaagcctcgctgcggcgtccctgatgttggtcatttcagaacctttccggggatccccaagtggcggaagacgcatcttacttatcgcatcgtcaactacacacctgacttacctaaggacgctgtggactcagcagtggaaaaagccctaaaagtctgggaagaagtgacaccactcacctttagtcgcctatatgaaggcgaagctgatattatgatatccttcgccgtgcgcgagcacggggatttctacccatttgacggaccgggcaatgtgctggcacatgcttacgcccccggtcctggcattaacggagacgctcactttgacgatgatgagcaatggactaaagataccacaggaacaaacctgtttctcgtggccgcccacgagatcggccatagtctaggcctcttccatagcgctaacaccgaggccctcatgtacccactgtaccactcattaactgatctcacccgctttaggttgagtcaggacgacattaacggtattcaatccttgtacggccctcctcctgacagtcctgaaaccccactcgtgcccaccgagccggtgcctccagagcctggcactcctgctaactgcgaccccgccctctccttcgatgccgtgagcacactgagaggagagatcctgatatttaaagacaggcatttctggaggaagtctctgagaaagctggaacctgagctccatctgatatctagtttttggccttctctgccgagcggcgtggacgccgcttacgaggtgacctctaaggaccttgtgtttatctttaagggcaatcagttttgggctattcgcgggaatgaagtccgcgcgggttatcctagaggaattcacacccttgggtttcctccgactgtgcgaaaaattgatgcagccatttcagacaaagaaaagaataaaacatatttctttgtggaggataaatattggagattcgacgagaagagaaatagtatggagccgggatttcccaagcagatcgcggaagacttcccaggcattgatagcaaaatcgatgctgtttttgaagagttcgggttcttttatttttttacggggagttcccagcttgaattcgatccaaatgcgaaaaaggttactcacacgttaaaaagcaattcttggctgaattgctag

SEQ ID NO: 24846 - DNA, 804 bp, Artificial Sequence
  Description of Artificial Sequence: Synthetic coding sequence
atgcggctgaccgtgctgtgcgccgtgtgcctgctgcccggcagcctggccctgcctttgccccaggaggcggggggcatgagcgagcttcagtgggagcaggctcaggattacctcaagcggttctacctgtatgactccgagacaaaaaacgcaaactcgcttgaagcaaagctgaaggaaatgcagaagtttttcgggctgcctattaccggcatgttgaactccagagttattgaaatcatgcagaagccccgctgcggcgtacctgatgttgccgagtactctctgttccccaacagccccaagtggacctctaaggtagtcacatatcgcattgttagctacacccgagacctccctcatattacagtagacagactcgtctccaaagccttaaacatgtggggtaaagagattcctttgcacttcaggaaggtagtctgggggaccgccgacataatgataggattcgccaggggagcgcacggggatagctatcccttcgacggacccggcaacacgctcgcgcatgccttcgctccaggcactggcttgggaggtgatgcacacttcgatgaggacgagcgctggacagacggaagctccctggggatcaattttctgtatgctgccactcatgagctgggccatagtttgggcatgggccactcctcagaccctaatgctgttatgtaccctacttacggcaatggtgatccacaaaactttaaactgagtcaagacgatatcaaggggattcagaagctctatggaaaacggtccaactctagaaagaagtag

SEQ ID NO: 24847 - DNA, 2124 bp, Artificial Sequence
  Description of Artificial Sequence: Synthetic coding sequence
atgagcctgtggcagcccctggtgctggtgctgctggtgctgggctgttgcttcgccgcaccaagacagaggcagtctactttggttctgttcccaggcgatctgaggacaaatctgaccgaccgccagcttgccgaggagtacctgtaccggtacggatacaccagggtggctgaaatgcgcggggaaagcaagtcgctagggcctgccttgttactcctgcagaagcaattgtccctgccagagaccggtgagctggactccgccactttaaaggctatgaggaccccacgatgcggtgtgcctgacttaggtcggttccagacgttcgagggcgacctgaaatggcaccatcataacatcacatactggattcagaattacagcgaggatttgcccagagcggtcattgatgacgccttcgccagagccttcgccctgtggagcgccgtaactcccctgaccttcacaagagtgtactcacgagacgcggacatcgtgattcaattcggagtggcagaacacggagatggataccctttcgacggaaaagatgggctccttgcacatgcattccctccaggtccaggcattcaaggggacgcacacttcgacgacgatgagctgtggtcgctaggtaagggcgttgtggttccaaccaggtttgggaacgccgatggggccgcttgtcacttcccctttattttcgagggcaggagttactccgcttgcacaactgacgggaggtctgacggtctgccgtggtgctccaccaccgccaactatgacacagatgacaggttcggcttctgccccagcgagaggctctacacacaggacggcaatgcagacggtaagccctgtcagttcccattcatttttcagggccagtcttacagcgcgtgcactactgatggacgtagcgacggttatagatggtgtgctacgacagcaaactatgacagagataagctgtttggcttttgccccaccagagccgacagcactgttatggggggcaatagcgcaggggagctctgtgtgttcccatttacattcctgggcaaggagtacagcacctgtacgtccgagggaagaggcgacgggaggctctggtgtgctaccacatctaactttgacagcgacaagaaatggggcttttgcccagatcaaggatactccctgtttctcgtggccgcccacgaattcggccatgctctgggtctggatcactctagcgtgcccgaggctctcatgtaccctatgtatagattcaccgagggccccccactccataaggacgacgttaacgggattcggcacctgtatggaccgagacctgagccagagccacggcccccaacgactacaacaccccagccgaccgcgcctcccaccgtttgcccgaccgggcccccaactgttcatcctagtgagagacctactgccgggccgacaggtcctccctcagcgggtcctacaggcccaccaacggccggccctagtactgctacgactgtgcccctgtcccccgtggacgatgcttgcaacgtgaacatttttgacgccatcgctgagattgggaatcaactttacctgtttaaggacggcaagtattggcggttcagtgagggccgggggagccggcctcagggtccctttttgattgccgacaagtggccggccctgccaaggaagctcgactctgtctttgaagaacgcctttcaaaaaagctcttttttttttccgggagacaggtgtgggtgtacaccggagcaagtgtgctcggccctcgaagattagataagctcggcctgggagccgacgtggcccaggtcaccggggcactgcggagcggccggggtaaaatgttgctattctctggccggcggctttggcgctttgacgtgaaagcgcaaatggtagacccccggtctgccagtgaggtggatcgcatgttcccaggagtgcctctggatacccacgacgtcttccagtatagggagaaagcatatttctgccaggaccgcttttactggcgggttagctctcggtcagagctgaaccaggttgaccaagtgggatacgttacatacgatatcctgcagtgtcctgaagattag

SEQ ID NO: 24848 - DNA, 834 bp, Artificial Sequence
  Description of Artificial Sequence: Synthetic coding sequence
atgggcggcaacagcgccggcgagctgtgcgtgttccccttcacctttctcggtaaggagtactccaacttcgattcggataagaaatggggcttttgtccggatcagggctattctttatttttggttgcagctcacgagtttggacatgccttaggtctggaccactcaagcgttcctgaggctctcatgtaccctatgtacagatttactgaaggccctccactccataaagacgatgtcaatggaattcgccacctttacgggccacgtcccgagccggagccacgccccccgaccacaactacaccccaacctacagcaccccccactgtatgccccacaggcccccccaccgtgcacccaccgttcctcattgcggataagtggcctgcacttcctcgcaaactcgatagtgtatttgaagagcgtcttagcaagaagcttttctttttctccggccgacaggtctgggtttataccggggccagcgtcctgggaccacgccgactcgataaactgggccttggagcagacgtggcacaggtcacgggagccctccgcagcgggaggggtaagatgcttctcttcagcgggcgtcggctgtggcgttttgacgtcaaagcacaaatggtcgaccctaggagcgccagtgaggtggacagaatgttccctggtgttcccttagatactcatgacgtgttccagtatcgagaaaaggcttatttctgccaggaccgattctactggcgagtgtcctcacgaagtgaacttaaccaggtggaccaggtggggtacgtgacgtatgatattctgcagtgcccagaggattag

SEQ ID NO: 24849 - DNA, 324 bp, Artificial Sequence
  Description of Artificial Sequence: Synthetic coding sequence
atggccggcgaggacgtgggcgccccccccgaccacctgtgggtgcatcaggagggcatctaccgggatgagtaccagagaacatgggtagcagtggtagaagaggaaaccagttttctgcgcgctagggtgcagcagatccaagtgccattaggggacgcagcccgccccagccatttactgacatcacaactgccgttgatgtggcagctctacccagaggagcggtacatggataacaattctcgtttgtggcagattcaacatcacctcatggtgaggggcgtacaggaactgctgctgaaactgttacccgatgactag

SEQ ID NO: 24850 - DNA, 324 bp, Artificial Sequence
  Description of Artificial Sequence: Synthetic coding sequence
atggccggcgaggacgtgggcgccccccccgaccacctgtgggtgcaccaagagggcatctaccgggatgagtaccaacgaacgtgggtggcggtggtcgaagaagaaacttctttcctccgggcccgtgtgcagcagattcaagtgccgctgggagatgcggctcgcccttctcacttgctgacctcacagctcccactgatgtggcagctgtacccagaagagaggtatatggataacaactcaagactttggcagatccaacaccatttgatggtgcgcggagtacaggagttgctacttaagctgctgcccgatgattag

SEQ ID NO: 24851 - DNA, 1329 bp, Artificial Sequence
  Description of Artificial Sequence: Synthetic coding sequence
atggtgcggagccggcagatgtgcaacaccaacatgagcgtgcccactgacggagcggtgaccacgagtcagatcccagccagtgagcaggaaaccctcgtccgccccaagcctctcctgctgaaactgctgaagagcgtgggggctcagaaagatacatacacgatgaaggaagttcttttttacctcggccaatacatcatgacgaagcgtctctacgacgagaagcagcaacatatagtgtattgttcgaacgatttattaggggatctctttggagtcccctccttctccgtgaaggagcaccgcaagatctacacaatgatctaccgtaacctggtggtagtgaaccagcaggaagagaactctgacgagctcagtggagagcggcagaggaagcggcataaatccgatagtatcagcctaagtttcgacgagagcctcgccctgtgtgtgatccgggaaatttgctgcgagaggagctcctccagcgagtcgaccggaacaccctcaaatcctgacctagatgccggtgtgagcgaacacagcggagattggctggaccaagactcagtgtccgaccaatttagcgttgagttcgaagtggagtccttggattctgaagattattctctgtctgaagaggggcaggagctttcggacgaggatgacgaggtgtatcaggtgaccgtttaccaggccggtgagtctgacacggattcctttgaggaggacccagagatctctctggctgattactggaaatgtacgtcatgtaatgaaatgaacccaccactgccatcccattgtaatcggtgctgggccttgcgcgaaaattggctgcccgaggacaagggcaaggacaaaggggagatctcagagaaagctaagcttgaaaactctactcaggcagaggaaggtttcgatgtacccgattgcaaaaagacgatcgtaaacgatagtagagagagctgtgtggaggaaaacgacgacaagattacacaggcttctcagtcccaggagtccgaggactatagccagccctcaacatcttcatccatcatttacagctcacaagaggatgttaaggaatttgaacgcgaggagactcaggataaggaggagtctgttgagagctccttgcccctgaatgccatcgagccgtgtgtcatctgccagggccgaccgaagaatggatgcatcgtgcatgggaagacaggtcacctcatggcgtgctttacctgtgctaaaaaactgaagaagcgcaataagccatgtccagtgtgtaggcagccgatccagatgattgtgttaacatatttcccatag

SEQ ID NO: 24852 - DNA, 1311 bp, Artificial Sequence
  Description of Artificial Sequence: Synthetic coding sequence
atgtgcaacaccaacatgagcgtgcccaccgacggcgccgtgaccacgtcccaaatccctgccagcgagcaggaaactttagtgaggcctaaaccactgctcttgaaactcctgaagtccgtcggtgcccagaaggacacttatacaatgaaagaagtattgttctacctgggacagtatatcatgaccaagcgcctatacgatgagaagcaacaacatattgtgtattgttcaaatgacctgcttggcgatctgttcggcgtaccctcattttctgtgaaagagcatagaaagatttataccatgatctacaggaacctggtggtcgttaatcagcaagaggagaattctgacgagttgagcggagaacgccagcggaagcggcataagtctgactcgatttccctgtcgtttgacgaatctctggcactgtgcgtgattcgcgagatttgctgtgagaggagtagcagctccgaaagcactggcaccccgtccaatccagacctggatgcgggggtaagtgagcactcaggagattggctggaccaggacagtgtgagcgaccagttcagcgttgagtttgaggtggagtcactagattctgaagactacagcctgtctgaggagggacaggagctttccgacgaggacgacgaagtgtaccaggtcacggtgtaccaagctggggaatcagatactgactcctttgaggaagatcctgagatttcactcgctgactactggaaatgtacaagctgtaatgagatgaatcctccattacccagccactgcaatcgctgttgggccctacgagaaaattggctgcctgaagacaaagggaaagataaaggtgagattagcgagaaagctaagctggagaacagcacccaagctgaggagggcttcgatgtacctgattgcaagaagacaattgtcaacgactcccgggagagctgtgtggaagaaaatgatgacaagattactcaagccagtcagtcccaggagagcgaagattacagccagccctccacctccagttcgatcatctactcctcacaagaggacgtgaaggaattcgagcgagaggagacccaggataaagaagaaagtgttgaatcttcccttccacttaatgccatcgagccctgtgtgatctgtcaagggcggcctaaaaacggctgcattgtgcatggtaagactggtcacctcatggcctgctttacctgcgctaagaagttaaagaaacgcaacaagccttgtccagtgtgtcgacagccgatccagatgatagttcttacctatttcccgtag

SEQ ID NO: 24853 - DNA, 966 bp, Artificial Sequence
  Description of Artificial Sequence: Synthetic coding sequence
atgtgcaacaccaacatgagcgtgcccaccgacggcgccgtgaccactagtcagatacctgcatctgagcaagagacactggtgaggcctaagccccttctgctgaagctgctcaagtccgtgggggcccagaaggacacctacacgatgaaggaggatctggacgcgggcgtgagtgagcacagcggagattggctagaccaagactctgtgagcgaccagttcagtgtggagttcgaggtcgagtccctggactctgaggattacagcctctctgaggagggccaggaactgtcagacgaggacgacgaggtgtatcaggtgactgtgtaccaggccggtgagtctgataccgacagcttcgaggaagaccccgagatctcccttgcagactactggaaatgtacttcttgtaacgaaatgaatccgccgctcccttcacattgcaatcgctgctgggctcttcgggagaattggttacctgaggacaaaggtaaagataaaggggaaattagtgaaaaagcgaaactggagaacagcacgcaagctgaggaggggtttgatgttccggactgcaaaaaaactattgtaaacgactccagggaaagctgtgtagaggagaatgacgacaaaatcacacaggcatcccagagccaagagagcgaagattattcacagccaagcacgtcttctagtatcatttatagctcgcaagaggacgttaaagaattcgaacgggaggagactcaagataaggaagaatcagttgagagcagcctgcccctcaatgcgatcgaaccctgcgtcatatgtcaaggccgacctaaaaacggttgcatagtccacggcaagaccggtcatctgatggcatgtttcacttgcgctaaaaaattgaaaaaacgaaacaaaccatgtcctgtctgtcgacagccaatacagatgatcgtattgacctacttcccatag

SEQ ID NO: 24854 - DNA, 1359 bp, Artificial Sequence
  Description of Artificial Sequence: Synthetic coding sequence
atggtgcggagccggcagatgtgcaacaccaacatgagcgtgcccactgacggtgcagtgacaacctcacagataccggccagcgagcaggaaactctggtaaggccaaaaccgctgctgctgaagcttctgaagtctgtgggagcgcagaaagacacatacaccatgaaagaaaaaatctacaccatgatctaccggaatttagtcgtggtaaaccagcaggagagtagtgattcagggacttccgtgtctgaaaaccggtgccacctggaaggcgggagtgaccaaaaggacctggtgcaggaacttcaagaggagaaaccaagttcttcccatctggtgtcacggccttctacctcatcccgtcggcgcgccatcagtgagacagaggaaaatagtgatgaattgtctggggaaagacagcggaagcgccacaaatctgactctatcagcctgtcatttgatgagagtttggcactgtgtgtgatccgggaaatatgttgtgagcgttcgtcgtcatctgaaagcacaggtacaccctcaaatccagacttagatgctggcgtatccgagcacagcggtgactggttagaccaggacagcgtgtctgatcagttcagcgtcgaattcgaggttgagagtctggacagcgaagactactcgctgagcgaggagggccaagagcttagcgatgaggatgacgaggtttatcaggtgaccgtctatcaagctggcgaaagcgacacagactcttttgaagaggatcccgagatcagcttagccgactattggaaatgtacctcctgcaacgagatgaatcctcccctgccctcacattgcaataggtgctgggccttgagagagaattggttacccgaagacaagggtaaggacaagggggaaatttccgaaaaagccaaactggagaattccacccaggccgaagaggggttcgacgtgccagattgcaaaaaaacaattgtcaacgacagccgcgaaagctgtgtcgaggaaaacgatgataagatcacacaagccagccaaagccaggaaagcgaagactatagtcaaccatctaccagcagtagtatcatatattcttctcaggaggacgtgaaagagttcgaaagggaagaaacccaagataaagaagagtctgtcgagtccagcctccctttgaatgctatcgaaccatgcgtaatttgtcagggcagacctaaaaacggctgtattgtgcatgggaaaactggacaccttatggcatgcttcacatgcgctaagaaactcaagaagaggaacaagccttgtcctgtgtgtaggcagcccatccagatgatcgttctgacctattttccctag

SEQ ID NO: 24855 - DNA, 771 bp, Artificial Sequence
  Description of Artificial Sequence: Synthetic coding sequence
atgtgcaacaccaacatgagcgtgcccaccgacggcgccgtgaccacctctcaaattccagcatccgaacaggagacactggtccgccccaaaccccttcttctcaaattgctcaaaagcgtgggagcccagaaagatacttacacaatgaaagaggtcctgttctacttaggccagtacataatgaccaaacggttatatgatgaaaaacagcaacatatcgtctactgttctaatgatctactgggcgacctgtttggcgtgccgtcattcagcgtcaaggaacataggaagatctatactatgatctaccgtaatttggttgtggtcaaccaacaggagtcctctgacagtgggactagcgtatccgaaaataggtgccacctcgaaggaggatcagatcagaaagatctggtgcaggaacttcaggaagagaaaccatcatcctcgcatcttgttagtcgtcctagcacatcctctagacgtagggcaatttctgaaacagaggagaactccgacgaattgagtggcgaacgacaaagaaaacgtcacaagtctgatagcatttcactcagctttgacgaatctctggccctatgcgtgatcagagagatttgctgtgaacgatcctcctcctccgagtcaacaggtacaccttccaaccccgatctactccttggcgtgtaccaggtcacggtgtatcaggcgggtgagtcagacaccgactcattcgaggaagaccctgaaattagcctggcacactatctgtag

SEQ ID NO: 24856 - DNA, 798 bp, Artificial Sequence
  Description of Artificial Sequence: Synthetic coding sequence
atgagcgtgcccaccgacggcgccgtgaccaccagccagatccccgcaagcgagcaggaaactttagatctggacgccggtgtgtctgagcactccggggactggctggaccaggatagtgtgtctgaccagttcagcgttgagtttgaggtggagtccctcgatagcgaggactactccttatccgaggaagggcaggaactttcagatgaggatgatgaagactactggaagtgtacatcttgcaatgaaatgaacccgcctttgccatcgcactgtaatcgctgctgggccctccgggagaattggctgcccgaagacaaggggaaggataagggtgagatctctgagaaggcgaaactagaaaactctactcaggcagaggaggggtttgacgtacctgactgtaaaaagaccatcgtgaatgactcaagagagtcctgtgtcgaagaaaacgatgacaaaatcacacaggcctcccagtcccaggaatctgaagactactctcagcccagcacaagtagctctattatctatagctcacaggaggacgttaaagaatttgagcgggaagaaactcaggacaaggaagaaagcgtggagagctctctgccactgaatgcaatagagccctgcgtcatttgccagggcagacctaagaatggctgtattgttcatggaaagacaggacatcttatggcctgtttcacttgcgccaagaagctcaagaagcggaacaagccttgccccgtgtgtcgtcaacctattcagatgatagttttaacttacttcccctag

SEQ ID NO: 24857 - DNA, 1401 bp, Artificial Sequence
  Description of Artificial Sequence: Synthetic coding sequence
atgtgcaacaccaacatgagcgtgcccaccgacggcgccgtgaccacgtcacaaattccagcaagcgaacaggaaacactcgttcttttctaccttggccagtacataatgactaaacggttgtacgacgagaagcagcaacacattgtgtattgcagtaatgatctgttgggcgatctgtttggtgtccctagcttttctgtaaaggagcataggaaaatatacaccatgatctataggaatctcgtggttgtcaatcaacaagaatcttccgacagcggaactagtgtgagcgaaaacaggtgtcacctggaaggcggcagtgatcaaaaagacctggtgcaagaactccaagaagagaagcctagctcatctcacttagtgtctcgaccttccacgtctagccggagacgggccattagtgagacagaggagaactcagatgagctgtcaggggagcggcagaggaagcgtcacaagagcgatagcatttccttgtcattcgacgagtccctcgccctgtgtgtcattagggagatttgctgcgaaagaagctcctcctccgaaagcacaggaaccccctccaatccagatctggatgctggggtgtcagaacattcaggggactggttagaccaagatagtgtttctgaccagttttcagtcgagtttgaagtagagtccttggattccgaggattattccctcagcgaagaaggacaagaacttagcgacgaggatgacgaagtttaccaagtcaccgtctaccaagcaggtgagtccgatacagattcttttgaggaggacccagaaatcagcttggcggactactggaaatgtacatcatgcaatgagatgaacccgccactacccagtcattgcaacagatgctgggcccttcgagagaattggctgcccgaggataaaggaaaggacaagggcgaaatcagcgaaaaagccaaattggagaattctacacaggccgaggagggcttcgatgtgccagactgtaaaaagaccattgttaatgatagtagggagtcttgtgttgaggaaaatgacgacaaaattactcaggcatctcaatcacaggaaagcgaagattattcacagcccagcacctcaagttccataatttacagttctcaggaggacgtgaaagagttcgagcgggaagaaacgcaagataaagaagagtccgtcgagagctcccttcccttgaatgctatcgagccttgcgttatctgccaaggaaggccaaaaaacggatgtattgtgcacgggaaaacaggacacctaatggcttgttttacctgcgcaaagaaactgaagaagcgcaataaaccatgtcctgtgtgtcgccagccgatccaaatgattgtgctcacgtactttccatag

SEQ ID NO: 24858 - DNA, 966 bp, Artificial Sequence
  Description of Artificial Sequence: Synthetic coding sequence
atgtgcaacaccaacatgagcgtgcccaccgacggcgccgtgaccacatctcagatcccagcaagcgagcaggaaaccttggtgagacctaaacctctgctcctgaagctcctgaagtccgtcggggcccagaaggacacatacactatgaaggaggatcttgatgctggagtcagcgagcactcaggagactggcttgaccaagacagcgttagcgatcagttctccgtggaatttgaggtagaatcccttgatagcgaggattacagtctgtccgaagaggggcaggaactgagcgacgaggatgacgaagtctaccaggtcactgtctatcaggctggcgagagtgacaccgactcattcgaggaagaccccgaaatctcgctggccgattactggaagtgcacatcatgcaacgaaatgaatcccccattgccttcgcattgtaatcgatgttgggcgctacgggaaaactggctgccagaagacaagggaaaggataaaggggaaatcagcgaaaaagctaaactggagaatagtacgcaagccgaagaaggttttgatgttcccgactgcaagaaaacgatcgtgaatgattcccgcgaatcgtgcgttgaagagaacgatgacaagatcacccaggcatcacagtcccaggagagcgaggactactcccagccatcaacctctagttcaattatctacagctcacaggaggatgtgaaagagttcgagagagaagagactcaagataaggaagagtctgtagaatcgtcgctgccccttaacgcgattgaaccttgcgtgatctgtcaaggcaggcccaaaaacggttgtatcgtgcatggcaagactggacatttgatggcatgcttcacttgcgcgaaaaagctcaagaaacgcaacaagccatgccccgtctgtagacagcccatccagatgattgtgctcacatatttcccttag

SEQ ID NO: 24859 - DNA, 480 bp, Artificial Sequence
  Description of Artificial Sequence: Synthetic coding sequence
atgtgcaacaccaacatgagcgtgcccaccgacggcgccgtgaccacgtctcagatccccgctagcgagcaagagactctggtaaggcctaagcccctccttctgaagctgctcaagagcgtcggggctcagaaggatacttacaccatgaaggaagaccttgacgctggcgttagcgagcatagcggagactggttagatcaggacagtgtctcagatcagttctcggtggagtttgaagtggagtctctcgattccgaggactacagtttgtctgaagagggccaggagctgtccgacgaggacgacgaggtctaccaagtgaccgtgtaccaggccggtgagagtgatacagactctttcgaagaggaccccgagataagcttagccgattactggaaatgcctgaaaaagaggaataaaccttgtcctgtctgccgccagccaatccagatgattgtattgacatacttcccttag

SEQ ID NO: 24860 - DNA, 891 bp, Artificial Sequence
  Description of Artificial Sequence: Synthetic coding sequence
atgtgcaacaccaacatgagcgtgcccaccgacggcgccgtgaccacatcacagatccctgccagtgagcaggagaccctcgaccttgatgccggcgtcagcgagcactctggcgattggttggatcaagattccgtctctgaccaattcagcgtcgaatttgaggttgaatccctggactctgaggattactcacttagcgaagaaggtcaggaactcagtgatgaggacgacgaggtgtaccaggtgaccgtctaccaggcaggcgaatccgataccgacagctttgaggaagaccctgaaatcagccttgctgactactggaagtgcaccagctgcaacgagatgaacccacctctgccaagccattgtaataggtgctgggccctgcgcgaaaattggcttcccgaagataagggaaaggacaaaggcgagatttcagagaaagctaagttagaaaattcaacacaagctgaagaaggtttcgatgtgcccgactgcaagaaaaccatcgtcaatgactcccgcgaaagctgcgtggaggagaatgacgacaaaatcacccaggccagccaatcccaggagtcagaggattattcacagccaagcacgtcttccagcataatatactccagccaggaagatgtgaaagagtttgaaagagaagagacacaggataaagaagaaagcgtggagagctctctgcctctcaacgccatcgaaccttgcgttatatgccaagggagaccgaagaacggttgcatcgtgcatggcaagaccggccacctgatggcttgcttcacctgtgccaagaaactcaagaagaggaacaagccttgcccagtgtgtaggcagccaattcagatgattgtcctgacatacttcccatag

SEQ ID NO: 24861 - DNA, 732 bp, Artificial Sequence
  Description of Artificial Sequence: Synthetic coding sequence
atgtgcaacaccaacatgagcgtgcccaccgacggcgccgtgaccactagccaaattcccgcgtcggagcaggaaacccttgtgagacctaaaccgctgctactcaagctgcttaagagcgtcggggcccaaaaggacacatacacaatgaaggaggactattggaagtgcacgtcctgcaatgagatgaacccccccttgccttctcactgcaacaggtgttgggcactacgtgagaattggctgcccgaagacaagggaaaagataaaggagagatatcagaaaaagccaagctcgagaactccacccaggcagaggaagggttcgatgttccagattgcaaaaagacaatcgttaacgactctagggaaagttgtgtcgaagagaacgatgacaaaatcacccaggcaagtcaatcccaggaatccgaagattattcgcagccgtccacaagttcctcgatcatctatagttcccaggaagacgttaaggaatttgaacgtgaggaaacccaagacaaggaggaatcggtggagtcaagtctccctctgaatgccatagagccctgcgtcatctgccaggggaggccaaaaaacggttgcattgtgcatgggaagactgggcaccttatggcctgcttcacctgcgctaaaaaactaaaaaaacgcaataagccctgcccggtctgtcgtcaacccattcagatgatcgtgcttacatattttccatag

SEQ ID NO: 24862 - DNA, 657 bp, Artificial Sequence
  Description of Artificial Sequence: Synthetic coding sequence
atgtgcaacaccaacatgagcgtgcccaccgacggcgccgtgaccaccagccagattcccgccagcgaacaggagaccttagattactggaagtgtacgagctgcaatgaaatgaatccccctctgccttcccactgtaataggtgctgggctctgcgcgagaattggctgccagaggataagggaaaggacaagggagagatctccgaaaaggccaagctagagaactccacacaagccgaggagggcttcgacgtgccagactgcaaaaagacaattgtgaacgacagcagagagtcctgcgtggaagaaaacgacgataagattacccaggccagccagtctcaagagagcgaggattattctcaacccagcacctcaagctcaatcatctatagcagccaggaagacgtaaaggagtttgaacgggaagagacgcaagataaggaggagagcgtcgagagctccctccctctgaacgctatcgagccgtgcgttatttgccaggggcgccccaagaacggctgtattgtccatggcaagaccggccacttaatggcctgcttcacatgtgccaaaaaattgaaaaaacgaaacaagccttgcccagtgtgcagacaacccatccagatgattgttctaacatacttcccttag

SEQ ID NO: 24863 - DNA, 657 bp, Artificial Sequence
  Description of Artificial Sequence: Synthetic coding sequence
atgtgcaacaccaacatgagcgtgcccaccgacggcgccgtgaccacatcccaaattccggccagcgagcaggaaactctcgactattggaaatgtactagttgcaatgagatgaatccccctctgccgtctcattgtaacaggtgctgggccctccgtgagaattggctgcccgaggacaaaggaaaagacaagggtgagatttctgagaaggcgaaattagagaacagcacacaagcagaggagggcttcgatgtccccgattgtaagaagactattgtgaatgacagtcgcgagagctgcgtggaggaaaatgatgataagatcacacaggcaagccagtcacaggagtcagaagactattcccaaccctccacgagctcatctatcatatatagttctcaggaggatgtgaaggagtttgaacgggaggaaacacaggataaggaagagagcgtggagagcagtctgcctctgaacgccattgaaccttgtgtgatctgccagggaagaccaaagaatggctgtatcgtgcatgggaaaaccgggcacctaatggcgtgcttcacctgcgctaagaagctcaagaagaggaacaagccatgcccggtgtgccggcagccaattcagatgattgtgcttacctactttccctag

SEQ ID NO: 24864 - DNA, 771 bp, Artificial Sequence
  Description of Artificial Sequence: Synthetic coding sequence
atgtgcaacaccaacatgagcgtgcccaccgacggcgccgtgaccacaagtcagatccctgccagcgagcaggagacgctcgtgagacccaagccactccttctgaagctactgaagtctgtcggagcccagaaagatacttacacaatgaaggaagtgcttttctatctgggccagtacataatgacgaaacgactatatgacgaaaaacagcagcacatcgtctattgcagtaacgaccttctcggcgatctgttcggagttcccagtttttccgtcaaggagcacagaaaaatctacaccatgatctaccgcaacttggtggtggttaatcagcaggagagcagcgattcaggtacaagcgtgagtgagaaccgatgccacctggaaggtggcagcgatcagaaggatctggtgcaggaattacaggaggagaagcctagttcttcgcacttggtgtcacgtcccagcacatcttccagaagacgggccatcagcgaaactgaagagaactctgacgagctgtccggtgagcgccagaggaaacgtcacaagagtgattctatctctctttcattcgacgagagtttagctctgtgtgtgatacgagagatttgctgcgaacgaagttcaagtagcgaatcaacaggcacaccaagtaaccctgatctcgacgccggcgtgtaccaggtgacagtctaccaggcaggcgaatccgacactgatagtttcgaggaggatccggagatctccttagccgactactggtag

SEQ ID NO: 24865 - DNA, 813 bp, Artificial Sequence
  Description of Artificial Sequence: Synthetic coding sequence
atgtgcaacaccaacatgagcgtgcccaccgacggcgccgtgaccaccagccagatccccgccagtgagcaggaaactttggatcttgacgcgggtgtatcagagcattctggggactggctggatcaggattccgtctcggaccagttctcggtggaatttgaagttgagagcttagactctgaggactacagtctgtccgaagaaggacaagaactttccgacgaggatgacgaggactactggaagtgcacgagctgtaatgaaatgaatccaccactgcccagtcattgcaataggtgttgggcacttcgggagaactggctgcccgaagacaaaggaaaggataagggcgagatatccgaaaaggcaaagctcgagaactctactcaggccgaggaagggtttgacgtcccggactgtaagaaaacaattgtaaacgacagccgggaaagctgcgtcgaggagaacgacgataaaattactcaggcctcccagagccaggaaagtgaagattattcccagccgtcaacgagctcgtctatcatctactcatcacaggaggacgtgaaggagtttgagagggaggagacccaagataaagaagaatcggtggagtcttccctcccgctgaacgcgatcgagccatgcgtcatttgccaaggaaggcctaagaatggctgcatcgtacacggaaaaacgggccacctgatggcctgttttacatgtgccaaaaaactcaaaaagcggaataagccctgccccgtttgccgccagcctatccagatgattgtgttaacatactttccttag

SEQ ID NO: 24866 - DNA, 1494 bp, Artificial Sequence
  Description of Artificial Sequence: Synthetic coding sequence
atggtgcggagccggcagatgtgcaacaccaacatgagcgtgcccacggacggtgccgtcactacgagccagatccccgcatctgagcaagaaacgctcgtgagacctaaaccattactgctcaagcttctgaagtctgtcggagctcaaaaggacacatatacaatgaaggaagtgctgttctatctgggccagtacattatgactaagagattatacgacgagaaacaacaacacattgtttactgtagcaacgacctgctgggagacttattcggagttccatccttttccgtcaaagaacaccgcaagatatacacgatgatctacaggaacctggtcgttgtcaaccagcaggaaagcagcgactcaggcacttccgtttcagagaatcgttgtcatctggaggggggcagtgatcaaaaagatctcgttcaggagctgcaagaggaaaaaccatcttcatcccatctggtgagtcgtccatccacctcaagtcgaagaagagctattagtgaaaccgaggagaatagtgatgagttgtccggtgaaagacagaggaaacggcataagtcagacagcatctcactctcctttgacgagtctctcgccctgtgcgtaataagggaaatttgctgcgagcgcagcagctcgagtgaaagtactgggaccccaagcaaccctgacctagatgccggcgttagcgagcactccggcgattggttggatcaggattccgtcagcgaccaattcagcgtagagttcgaagtggagagccttgatagcgaggattactcattgtccgaagagggccaggagttgtccgatgaagacgacgaagtttaccaggtcaccgtgtaccaggccggagagtccgatacggatagtttcgaggaggaccccgagatcagtctagctgactactggaagtgcacgtcttgcaacgaaatgaatccacccctgccgagtcattgcaaccgctgttgggccctgcgggaaaactggttgccagaagacaaggggaaagataagggcgagataagcgagaaggccaaactggagaattctacacaggccgaggagggtttcgatgtaccagactgcaagaagaccattgtcaacgatagccgggagagctgcgtggaggaaaacgacgacaagatcacccaggcatcgcagagccaggagtccgaggattactcgcagccctctacgtccagctctatcatctactcttcacaggaggatgtgaaggagtttgaaagggaagagacccaagataaagaggaaagcgtcgagagcagtctgcccttgaatgctatcgaaccttgcgtcatttgccaaggccgacctaaaaatggttgcatagttcacggcaagacgggacatctgatggcgtgcttcacctgcgcgaaaaagttgaaaaaaaggaataagccctgtcctgtgtgtagacaaccgattcagatgatcgtgctcacgtatttcccttag

SEQ ID NO: 24867 - DNA, 393 bp, Artificial Sequence
  Description of Artificial Sequence: Synthetic coding sequence
atgtgcaacaccaacatgagcgtgcccaccgacggcgccgtgaccaccagccagatccctgcttcagagcaggagaccctcgttcgccccaagcctctgttacttaaactccttaaaagcgttggggcccagaaggacacatatacgatgaaggaatttgagagagaagagacccaggacaaagaggagagcgtggagagtagcttgcccctgaatgccatagagccatgtgttatctgtcaggggaggccgaaaaatggatgcattgttcacggaaagacgggacatctgatggcttgttttacctgcgccaagaaactgaagaagcggaataaaccttgcccagtatgcagacaacctatccaaatgatcgtcctgacttattttccctag

SEQ ID NO: 24868 - DNA, 774 bp, Artificial Sequence
  Description of Artificial Sequence: Synthetic coding sequence
atgtgcaacaccaacatgagcgtgcccaccgacggcgccgtgaccacatctcaaatccccgctagcgagcaggagactctggtgagacctaaaccgttgctgctgaagctccttaagagtgtcggcgcccaaaaagacacatataccatgaaggaggtgctattctacctgggacaatatattatgacgaaacggctctacgatgagaagcagcagcatatcgtttactgtagcaatgacctcctgggcgatctcttcggcgttcctagcttctcggtcaaggagcaccgaaagatttacactatgatctacagaaatctggtggtggtgaaccaacaggagtcttccgacagcgggactagtgtctctgaaaacagatgccacttagagggcggcagcgatcagaaggatcttgttcaggagctgcaggaagagaaaccttcctcatctcacctggtgtcccgaccatctacaagcagtcgtagacgtgctattagtgagacagaagagaactccgacgagctgtccggcgaaagacaacgcaagagacataaatccgactctatttccctgtcatttgatgaatctctggcgctgtgtgtgattagagaaatctgctgtgaaaggagctctagttctgaaagcaccgggacgccttctaatcctgatctagatgctggggtgagcgaacacagtggagactggttggaccaagactcagtgtcagaccagttctccgtggaatttgaagtcgagtctctggatagtgagtag

SEQ ID NO: 24869 - DNA, 891 bp, Artificial Sequence
  Description of Artificial Sequence: Synthetic coding sequence
atgtgcaacaccaacatgagcgtgcccaccgacggcgccgtgaccacatcccaaatcccagcgtccgagcaggaaaccctggatctggacgccggagtgtcagagcatagtggcgactggcttgaccaggattcggttagtgatcagtttagcgtcgagttcgaagtcgaatcacttgacagcgaagactacagcctttccgaagagggtcaggaactgtccgatgaagatgatgaagtttaccaggtgacagtataccaggctggtgaaagcgatactgacagcttcgaagaggacccagagataagtctggccgactactggaaatgtacctcctgtaacgagatgaaccctcctctgccatcgcactgtaacagatgttgggctttaagggaaaattggctgccggaagacaagggcaaggacaaaggtgaaatcagcgaaaaggcgaaactggagaattctactcaagcagaggaaggatttgacgtgcctgactgcaaaaagacaatcgtcaatgattcccgtgagtcctgtgtggaagaaaacgatgacaaaattacacaagcctctcagtctcaggagtccgaggactattcacaacccagcacaagttctagtatcatttactccagccaagaagacgtcaaggagttcgagagggaggaaacccaggacaaagaggaatctgtggaatccagccttcctcttaacgcgattgagccctgcgttatatgtcagggccgcccaaaaaacggatgtattgtgcatgggaagacgggacatctaatggcttgtttcacatgcgcaaaaaaattgaagaaacggaataagccatgccccgtgtgtaggcagcccattcagatgattgtgctcacatactttccctag

SEQ ID NO: 24870 - DNA, 1341 bp, Artificial Sequence
  Description of Artificial Sequence: Synthetic coding sequence
atgtgcaacaccaacatgagcgtgcccaccgacggcgccgtgaccacctcgcagatccctgcttccgagcaggagacactagtgcgccccaaaccactgttgcttaagctgctcaagagcgttggggcccagaaggacacatacacaatgaaagagaagatatataccatgatttaccgaaacctggtggtggtgaatcagcaggagtctagtgacagtggcacatcagtgagtgaaaataggtgccatcttgaggggggcagtgaccagaaggacctagtgcaggagctgcaggaagaaaaaccgtcctcaagccaccttgtgtctaggccaagcacgtcaagcagaagacgggcaattagtgagacggaggaaaactcagacgaattatcgggcgagcggcagcgaaagaggcacaagtctgactccatcagtctgagttttgatgagagcctcgcactgtgtgtgataagagagatctgttgcgagaggagcagctctagcgagtctacaggcactccaagcaaccctgacctggacgctggcgttagtgaacactccggcgattggctcgatcaggattctgtgagtgaccagttcagcgtagagttcgaagttgagagcctggactcagaggactatagcctgtcggaggagggccaggagctgagcgatgaagacgatgaggtctatcaggtgaccgtataccaggctggcgaatccgacactgacagctttgaggaagatcccgaaatatcgctggctgactactggaagtgtacctcatgcaatgagatgaacccgcccctgccgtcacattgcaaccggtgttgggccctgcgagagaactggttgccggaggataaaggtaaagacaagggggagatcagtgagaaggcaaagctcgagaactcaacccaggcagaagaggggttcgacgtccctgactgtaagaaaacaatcgtgaacgactcccgagagagctgcgttgaggagaacgatgacaagatcacccaggcaagtcagtcacaagaatctgaagactactctcagccttctacatcatcaagcatcatatatagtagtcaggaagacgtgaaagagttcgaacgtgaagaaactcaggacaaggaggagtcggttgagagttctctgccactgaatgctatcgagccttgcgtcatctgtcagggacgacccaaaaacggatgcattgtccacggtaaaacaggacatcttatggcctgtttcacctgcgccaagaagctgaagaaaaggaataagccgtgcccagtgtgtcgacagcctatccaaatgattgtgctaacgtatttcccatag

SEQ ID NO: 24871 - DNA, 642 bp, Artificial Sequence
  Description of Artificial Sequence: Synthetic coding sequence
atgcccaacttcgtggtggactggcgggtgtacaccgacagcctgtttctgactgtcgattttggtctgtgtgccgaggagagctctacctccaggaaaagaacaacagaggatgacatacccactttgcctacctcagaacacaagtgtatccacagcagagaagacgaagacttaatcgagaaccttgcgcaggacgaaacatccagactggatctgggtttcgaagaatgggacgtggcagggctcccgtggtggttcctgggaaatttacgcagtaactacacaccgcgctctaacggatccacagatctacagacaaaccaggatgtaggaacagctatagtcagtgacaccacagatgatttgtggttcctgaatgaaagtgtcagtgagcagctgggagttggcatcaaagtagaggcagccgacacagagcaaacttccgaagaggtgggtaaggtctctgacaaaaaagtcattgaggttgggaagaatgacgacctagaagacagtaagtcgctgtccgacgatactgatgtggaagtgacatcggaggatgagtggcagtgcacagaatgcaagaaattcaattctccatcaaagcgttactgcttccggtgttgggccttgcgaaagtag

SEQ ID NO: 24872 - DNA, 396 bp, Artificial Sequence
  Description of Artificial Sequence: Synthetic coding sequence
atgaccagcttcagcaccagcgcccagtgcagcaccagcgacagcgcctgccggattagtcctgggcagatcaaccaggttcggcctaaactcccattgctgaagatactccacgcggctggagcgcaaggtgagatgttcactgtgaaggaggtaatgcattatctcggacaatatatcatggtcaagcagctctacgaccaacaggaacagcacatggtgtactgtggtggggatctgttaggcgaattactggggaggcagtcattcagcgttaaggatcccagtcccctttacgatatgctgcgcaagaatctggtgacactggcgacggctactactgagatggggcatctgttctgccggatcagtcatgctcttgagctcgctgattag

SEQ ID NO: 24873 - DNA, 1473 bp, Artificial Sequence
  Description of Artificial Sequence: Synthetic coding sequence
atgaccagcttcagcaccagcgcccagtgcagcaccagcgacagcgcctgtagaatctcacctgggcagattaaccaggtccggccaaagttaccactattaaagatcctgcatgcagccggcgcccagggcgagatgtttaccgtgaaagaggttatgcattatctgggtcaatacattatggtaaaacagctctacgaccagcaggaacaacatatggtctattgcggaggggacctgctgggggagctcctgggcaggcagtcattctcagtgaaagacccaagtcccctctacgatatgctgcggaaaaatctggtgactttggcaacagccacaaccgatgcagctcagactctcgcactcgctcaagaccactcaatggatataccttcccaggatcagctgaaacagagcgcggaagaatccagcacttcccgtaaaaggacgactgaggatgacatccccacactgccaacctcagaacacaaatgcatccattccagggaagacgaggatctcatagaaaacctggcccaggacgagacttccaggttggatttgggtttcgaagaatgggacgtggcaggcctgccttggtggtttctagggaatctgcgctcaaattacacacctaggagcaacggcagcaccgaccttcagacaaaccaggatgtgggcactgccattgtgagcgatacaacagatgacctttggttcctgaacgaatcagtgtcagagcagttgggggtgggaattaaggtagaggcagcggatacagagcagacatcggaagaagttggaaaggtgtccgacaaaaaagtgattgaggtgggaaaaaacgacgatctggaggactcaaaatcattgtctgatgatacagacgtcgaagtcacatctgaggatgaatggcaatgtaccgagtgcaaaaagttcaatagtccttccaaaagatattgtttcagatgctgggctctgcgcaaggattggtacagcgactgcagtaagctaacacactcattgtcaacctccgatattactgcgattccggaaaaggaaaacgaagggaatgatgttcctgactgcagaaggacaatatcggcccctgtggtgagaccaaaggatgcgtatatcaaaaaagaaaacagcaagctcttcgacccctgcaattcagtggaatttctcgacctagcacacagctcagagtcccaggaaacaatctcttcaatgggcgaacagttggataaccttagcgagcagaggaccgacacagaaaacatggaggactgtcaaaacttgttaaagccatgttctttgtgcgaaaaacggccccgggatggaaacattatacacggtcgcacagggcatctggtcacctgctttcactgcgctagacggttaaaaaaagccggcgccagctgtcccatttgcaagaaagaaatacaattggtgataaaagtcttcattgcctag

SEQ ID NO: 24874 - DNA, 495 bp, Artificial Sequence
  Description of Artificial Sequence: Synthetic coding sequence
atgaccagcttcagcaccagcgcccagtgcagcaccagcgacagcgcgtgccgtattagccctggtcagatcaatcaggagaacgaaggtaacgacgtgcctgactgtcggcgtacgattagcgcacccgtcgtcagaccaaaagacgcttacatcaagaaagaaaattcgaagctgttcgacccttgcaatagtgtagagttcctcgaccttgctcacagctctgaatcgcaggagactatttctagcatgggggagcagctggacaacctgtctgagcaaaggactgacaccgaaaatatggaggactgtcagaatctgctcaagccttgtagcctctgtgagaagagacctagggacgggaacattattcacggaaggaccggccatctggtaacatgcttccactgtgccagaagactgaaaaaggctggtgcctcatgccccatttgcaagaaggaaatccaattagtgatcaaggttttcattgcttag

SEQ ID NO: 24875 - DNA, 423 bp, Artificial Sequence
  Description of Artificial Sequence: Synthetic coding sequence
atgaccagcttcagcaccagcgcccagtgcagcaccagcgacagcgcctgcagaatatcaccgggccaaatcaaccaggtccggcccaaactgcctctgctgaagatcctgcacgccgcaggcgcccaaggggagatgtttacggtgaaggaagtaatgcattaccttggccaatatattatggttaagcaactgtatgatcagcaagaacagcatatggtctattgtggtggcgacctgctcggagagctgctggggcgccagagttttagtgtaaaagaccccagcccattgtatgatatgcttaggaagaatctcgtcacgcttgcaacagccacgacggcgaagtgcaggggcaagtttcactttcagaagaaaaactatcggagacgataccctcacaccgcctacctgcgcgcatag

SEQ ID NO: 24876 - DNA, 516 bp, Artificial Sequence
  Description of Artificial Sequence: Synthetic coding sequence
gacctgatcgagaacctggcccaggacgagaccagccggctggacctgggcttcgaggagtgggatgtggccgggctgccttggtggtttttaggtaacttacggagtaattacacaccaaggtccaatggctctacagatctgcagacaaaccaggtcatcgaggtggggaaaaacgacgatctcgaagacagcaagagcctgtccgatgatacagacgtcgaggtcacatctgaagacgaatggcagtgcacagaatgtaagaaattcaactcgcctagcaagcggtattgctttagatgctgggctctaaggaaggactggtattctgattgtagcaaactcacacatagcctgtccacaagcgatattacggctatccccgaaaaggagaacgaaggaaatgacgtccctgactgtcgaaggactatttccgctcctgtggtgaggcctaaagatgcgtatattaagaaagagaattctaagttgttcgatccctgcaactcagtcgagtag

SEQ ID NO: 24877 - DNA, 1323 bp, Artificial Sequence
  Description of Artificial Sequence: Synthetic coding sequence
atgaccagcttcagcaccagcgcccagtgcagcaccagcgacagcgcttgcagaatttcccctggacagatcaaccaggtgaggcccaaactcccattgctcaagatcctgcatgcagccggcgctcagggtgaaatgttcactgtgaaggaggtgatgcattacctgggacagtatatcatggtaaaacaactgtacgaccagcaagaacaacatatggtctactgtggtggtgacctgttgggagagctgctcggtcgccagtcgttctcggtgaaggacccatcccctttgtacgatatgctcaggaaaaatctggtgactttggcgacggccacgaccgacgctgcacagaccctcgctctggcacaggatcactctatggatatcccctcccaggatcagctgaagcaatccgctgaagaaagttccacatctagaaagcgcactacggaagatgatattcctaccctgccaacatcagagcataagtgtattcacagcagggaggatgaagatctgatagagaatcttgcacaggacgaaacttcgcggttggatctcggctttgaagaatgggacgtggccggcctgccatggtggttcctagggaatttgaggagcaactataccccaaggagcaacggtagcacggacctgcaaactaatcaagtgatagaagtgggcaaaaacgatgatcttgaggactcaaagtctctttccgacgataccgacgtggaggttacctctgaggacgaatggcagtgcaccgagtgtaagaagtttaacagtccaagtaagcgatactgctttcggtgttgggccctgcggaaagattggtacagcgactgcagcaagcttacgcatagcctttccacatctgatattactgctatcccagaaaaggagaacgagggtaatgatgtacctgattgccgccggactatatccgccccagtcgtacgtcccaaggacgcgtatattaaaaaggaaaacagcaaactgtttgacccgtgtaactctgttgaatttctggatcttgcccattcctcggagagtcaagaaactatctccagtatgggagaacagttggacaatctgtcggagcagaggacagatactgaaaacatggaagattgtcagaatctgctgaagccttgtagcctgtgtgagaagcggccacgcgatggaaacatcattcacggccgaaccgggcatttagtgacttgctttcactgcgcacgtcgtctgaaaaaggccggcgcaagctgtccgatctgcaaaaaggagattcagcttgtgataaaggtgtttatcgcttag

SEQ ID NO: 24878 - DNA, 384 bp, Artificial Sequence
  Description of Artificial Sequence: Synthetic coding sequence
atgaccagcttcagcaccagcgcccagtgcagcaccagcgacagcgcctgccgtataagccctggccagatcaaccaggtccggcctaagttgcctctcctgaagattctacacgctgcaggcgctcagggagaaatgtttacagtgaaggaagtaatgcactacctcgggcagtatatcatggtaaaacaactgtacgatcagcaggagcaacatatggtgtactgcggcggggacctgctgggggaactgttgggccgacaatcattttctgtgaaagatccctctcccctgtatgacatgttgcgcaaaaacttggtgaccctggccaccgcgacaactggatgccagaggagagtgaatgggccccagagggcttggtag

SEQ ID NO: 24879 - DNA, 462 bp, Artificial Sequence
  Description of Artificial Sequence: Synthetic coding sequence
atgaccagcttcagcaccagcgcccagtgcagcaccagcgacagcgcctgtcgaatctcaccaggccagatcaaccaggtccgccctaaactccctttgctaaagatccttcatgcagcaggggctcagggagaaatgtttacagtgaaggaggtcatgcactacctggggcagtacattatggttaaacagctctacgatcagcaggagcagcacatggtttattgtggcggggacctgcttggcgaactgcttggccgtcagagcttctcagtgaaggatccatcccctctgtacgacatgctaaggaagaacttagtgactctggccacagcgactacaggcagccaatacggctacagtaagtcccgtcctactgaggcgaagtgtcgcggcaagtttcacttccagaaaaagaattaccgacggagatacccacacactgcctatttgcgggcctag

SEQ ID NO: 24880 - DNA, 7650 bp, Artificial Sequence
  Description of Artificial Sequence: Synthetic coding sequence
atgctgggcaccggccccgccgccgccaccaccgccgccaccacctccagcaacgtcagtgtgcttcaacagtttgcctctggtctaaaatcacggaatgaggaaacaagagccaaggccgccaaagagctacagcactacgtgacgatggaactgcgtgagatgagccaggaggaaagtactcgcttctacgaccagctaaatcaccacatattcgaactggttagttcttcggacgcgaacgagcgcaagggaggcatattagctatcgccagtttaattggggtggaggggggaaacgccacacgaatcggacgatttgctaattacctccgcaatctactccctagcaatgaccctgtcgtgatggagatggcaagtaaagccattgggcgattggccatggccggagacaccttcacagctgagtacgtcgagtttgaggttaagcgcgccctggaatggttaggggcagaccgcaacgagggccgcaggcacgcagccgtgcttgttctgcgagagctggctatctctgtgcctaccttcttctttcagcaggtccaaccatttttcgataatatcttcgtcgcagtgtgggatccaaagcaggctattcgtgaaggcgccgtggcagcattaagagcctgtctgatcctgacgactcagagggagcccaaggagatgcaaaagccccagtggtaccggcataccttcgaagaagcggagaaagggtttgatgaaactttggctaaggagaaagggatgaatagagatgatcggatccacggcgcactgttaatcctgaacgaacttgtgagaatctcttccatggagggggagcgcttgcgcgaggagatggaggagatcactcaacaacaactcgtgcacgacaagtattgcaaggatttgatgggcttcggcaccaaaccaagacatatcactcccttcacaagttttcaagccgttcaaccacagcagtcaaacgctcttgttgggctgctggggtacagtagccatcaggggttgatggggtttggcaccagcccgtctccggcaaaaagcacgctggtggagtcccgctgctgtcgagatctaatggaggaaaagttcgaccaagtatgtcagtgggtcctgaaatgtagaaacagcaaaaatagtctgattcagatgacaattcttaacctacttcccagattggccgcttttcggccgtctgccttcacagacactcaatatctccaggacacaatgaaccacgtcctgagttgcgtaaaaaaggaaaaagaacgtacagccgcctttcaggcgctgggtctactgagcgtggctgtgaggagcgagttcaaggtgtacctaccacgtgtcttagatataataagggccgcgctgcctccgaaagattttgcccacaagcggcagaaggcgatgcaggtagatgctacggtattcacttgtatttctatgctggcacgtgcgatggggcctggcattcagcaggacattaaagagcttctcgagcctatgctcgccgtcggactctcgccagcgctgaccgcagtgctgtacgatctgtccaggcagatcccacagctgaagaaagacatacaggatgggctccttaagatgcttagtctcgtgctgatgcacaagccactgcgccacccgggaatgcccaaggggttagcccaccaactggcctctccaggactgactaccctaccggaggcatccgatgtcggatccatcaccctggcattgcgcactctgggctcattcgaattcgaggggcactccctgacacagttcgtcaggcattgcgccgatcactttctgaattcagagcataaggagataagaatggaggcggcccgaacatgtagccgcctgctcacaccgtccattcatctgattagcggacacgcacacgttgtctcccagaccgcggtacaggtggtggcagatgtactttcgaaactgctcgtggtcggcataaccgaccctgatccagacatccgctactgcgttctcgcatccctcgacgagcggtttgacgcgcaccttgctcaggctgagaacctccaggcattgtttgtggctctgaatgaccaggtattcgaaattcgggagctggccatttgcacagtgggacggctatcatcgatgaaccccgcattcgtcatgcccttcctcagaaagatgctgatccagattctgacagagctggaacactccggtatcgggcggataaaggagcagtcggctaggatgctggggcatctggttagcaatgcgccccggctgataagaccttacatggagcctattctgaaggcattgattttgaagttgaaggaccctgatcccgacccgaacccaggggtgatcaataacgtcttggctactatcggagagctggcacaggtatccgggctggaaatgaggaagtgggttgatgagctgttcatcatcatcatggacatgctgcaggactccagtcttctcgccaagaggcaggtcgccctttggaccctgggccagctcgtcgcctcgaccggatatgtcgtggagccctaccggaagtacccaacactactagaagtcctgcttaatttcttgaagacagagcagaaccagggcacaaggagggaggccattcgcgtcctcggtctgcttggagctctggatccatacaaacacaaggtaaacattggcatgattgatcagagccgggacgcttctgccgtgtccctgtctgaatccaagtctagccaggattcctccgactacagcacatctgagatgctcgtgaatatggggaatctgcctctggacgagttctaccccgccgtctcaatggtcgccctaatgagaatattcagggatcagtcactttcccatcaccacaccatggtcgtccaagccatcactttcatcttcaaatcattgggacttaaatgcgtacagtttctgcctcaagtcatgccaacgttcctgaatgtgatcagagtgtgcgacggcgcaatccgtgaattccttttccagcagctcggaatgctggtgtctttcgtgaagtcccacatccggccctatatggacgagattgttactctgatgcgggagttttgggtgatgaatacaagtatacagagcacaattatactgctgatagaacagatcgtcgtagcactgggcggagagttcaaactgtaccttccacagctaataccgcacatgctccgggttttcatgcatgataactcacccggccgcatagtttccatcaaattactggccgccatccagttgtttggagccaaccttgacgattatctgcatctgctgttgcctccaatcgtgaagctcttcgacgccccagaagctccgctgccctccagaaaggcagcactagagaccgtcgatagactgaccgagtccctggactttacagactacgcgtctagaatcatccaccctatcgtgagaactctcgatcagagtccagagctcaggtctacggccatggatacactctctagcttagtcttccagctgggcaagaagtaccagatattcataccgatggtgaacaaggtgctcgtccgccacaggataaaccatcagagatacgacgtattaatatgtagaattgtcaagggatacaccctggctgacgaagaggaagacccccttatctatcaacaccggatgcttcggtctggccagggggacgcactggcctccggacccgtggaaaccggacctatgaaaaaactccatgtcagtacaataaatcttcaaaaggcctggggagcggctcgcagagttagtaaggacgattggctcgaatggctgcgccgcctgtcactagagctgctcaaggactctagttcccccagtctgcgttcatgctgggccttggcccaggcatacaacccaatggcacgggacttgtttaacgcggcatttgtgtcctgctggtctgaactgaacgaggatcaacaggatgaactcattaggtcaattgaacttgctctcacctcacaggacattgcggaagtcactcagacgctacttaacctggcagaattcatggagcattccgacaagggccccttgcctcttcgcgatgacaacggaatagtgctgcttggcgaacgagccgccaaatgtagggcctatgctaaggctcttcattacaaggagttggaattccagaaaggacctacgcccgccatccttgaatccctgatttccatcaataataaattgcagcaacccgaagccgcagccggagtgttggaatatgcaatgaaacactttggcgagctggagatacaggcaacctggtacgagaagctgcatgaatgggaggatgctctggtggcgtacgataagaagatggacaccaataaagatgaccccgaactgatgctgggccggatgcgttgcttggaggccctgggtgaatggggacagttgcatcagcagtgttgcgaaaagtggactcttgtgaacgatgaaacccaagctaagatggccagaatggctgccgcagccgcctgggggttgggtcagtgggactcaatggaagaatatacctgtatgatcccgcgcgatacacatgacggagcattctatcgggcggtgctcgccctccatcaggacctgttctccctggcacagcagtgtatcgataaagcacgtgatctactggacgcagaactgactgctatggctggcgaatcctacagtagggcttatggggccatggttagctgtcatatgctaagtgagcttgaggaagtgatccagtataaactggtgccggaacggagagaaattattcggcagatctggtgggaacgcctccagggctgccagaggatcgtagaggactggcagaaaatactcatggtgaggtcactagtggtgtccccccacgaagatatgcggacatggctgaagtatgctagcctctgcggaaagagcggaagattggccctggctcataaaactctcgttctgttgctgggagttgatccttctcgacagctggatcaccctctcccaactgtccacccccaggtgacgtatgcatatatgaaaaacatgtggaaatctgcaagaaaaattgacgccttccagcacatgcagcactttgtgcagaccatgcagcagcaagctcagcatgctatcgccaccgaagatcagcagcataagcaggagctacacaagttgatggcaaggtgcttcctgaagttaggagagtggcagctcaatttgcaggggattaatgagagtacgattcccaaggtcctccaatattattcggcggctaccgagcatgaccgctcttggtataaagcctggcacgcctgggccgtaatgaacttcgaagccgtgttacactacaaacaccagaaccaagcacgagacgagaagaagaagctccggcatgcctctggggccaatatcactaatgcaacaacagcggccacaactgcagccaccgctactacgaccgcgtctactgaaggctcaaattctgagtcagaggccgagtcgactgaaaacagccctactccttccccccttcagaagaaagtaacagaagatttatctaagacactcctgatgtacaccgtgccagccgtgcagggattcttccgctccatctcgctaagtcgcggaaacaacttacaagacactctgcgggtgctgaccttatggttcgactatggccactggcctgacgtcaatgaagcgcttgtggaaggcgtaaaggctatacagattgatacctggttgcaggttattcctcagctcatcgcacgcatagacacgcccaggcctctggtggggaggctaattcaccagctgctcaccgatataggcagatatcatccccaagccctcatctacccacttacagtggcaagtaagtccacaaccaccgccaggcataatgccgcaaataaaatcctgaagaacatgtgtgagcattcaaataccctagtccaacaggcaatgatggtgtcagaggagctgatccgagtggctatcttgtggcatgagatgtggcacgaggggctggaagaggccagtaggctatattttggtgagcggaacgtgaaggggatgtttgaggtcctggagccattgcatgctatgatggagagagggccccagaccctgaaagagacctctttcaaccaggcctacggcagggatctaatggaagcccaggagtggtgccgaaagtatatgaaatccgggaacgtgaaagatctgacacaggcatgggatctgtattatcacgtctttaggaggatctctaaacagctgcctcaattgacgtcgctggagctgcagtatgtgagccccaaactgctgatgtgtcgggacctggagctggctgttcctggcacctacgatcccaaccagccgattatccggattcagagtattgctcccagccttcaagttatcacatccaagcagcgccctcgcaaactcaccctgatggggtcgaacggacacgagttcgtgtttctactgaaggggcatgaggatttacgccaggatgaacgagtcatgcaactcttcgggctggttaatacgctgctggccaatgaccctacttcattgcggaaaaacctgtctatccagagatatgcagtgatcccactgtccacaaatagcggacttatcgggtgggtgccccactgtgacactttgcatgccctgattagagattatcgagagaaaaagaagatcctcctcaacattgagcatcgtattatgctgagaatggcacctgactacgatcatctcaccctgatgcagaaggttgaagtctttgagcatgcagttaacaacacagccggtgacgacctcgccaagctgctgtggctaaaatctccaagttctgaagtgtggtttgatcgtagaaccaactatactcggtctttggcagttatgtccatggtcggctacatcctggggttgggcgatagacatccctccaatctgatgctcgatcgactgtccgggaaaatcctccatattgatttcggagactgcttcgaggtggccatgacaagggaaaagttcccagaaaagataccatttaggctgactcgcatgctaaccaatgccatggaggtcaccgggctggatggcaattaccgcatcacctgccacactgttatggaggtattgcgggagcacaaggattccgtgatggctgtgctagaggcctttgtgtatgatcctttgttgaattggagactaatggatacaaacactaagggaaataaaaggagcagaactcgaactgattcatatagtgctgggcagtccgtggaaattctggacggcgtggagttgggcgagcccgcacataagaaaacgggtactacagtgccggagtccatccattctttcattggtgacgggctggtgaagccagaagcactgaataagaaggctatccagattatcaatagggtgagagataaactgaccggccgcgatttttcccatgatgatacgcttgacgtgcccacgcaagtggaactcctgattaagcaggcaacttcccacgagaatctttgccaatgctatatagggtggtgccccttttggtag

SEQ ID NO: 24881 - DNA, 2265 bp, Artificial Sequence
  Description of Artificial Sequence: Synthetic coding sequence
atgaacttcgaggccgtgctgcactacaagcaccagaaccaggccagagacgaaaaaaaaaagcttaggcatgcctcgggggccaacattacaaacgccacaactgcagccaccaccgcggccaccgcgacaacaaccgctagcaccgagggatccaactcagagtcggaagcggaatcaactgagaactcccctactcccagcccgcttcagaagaaggtcacagaagacctttcaaagaccctcctgatgtacaccgtgccagcagtgcaaggtttctttagatccatcagcctgtcacgagggaacaacctccaggacacccttagggtcctgaccctgtggtttgactatgggcactggcctgacgttaacgaagctctggttgaaggggtgaaggcaatccagattgacacctggctgcaggtcattccacagttgatagccagaatcgatacacctcgccctttagtcggtaggctcatacaccagcttctgaccgatattgggcgataccaccctcaagctctgatctaccctctgacggtcgccagcaaatccacaaccaccgcgagacacaacgccgccaacaaaattctgaagaacatgtgcgaacattctaataccctggtgcagcaagctatgatggtgagtgaggaactgatccgcgttgccattctctggcacgagatgtggcacgaaggtctagaggaggcctctcgcctgtatttcggcgagcgaaatgtgaagggaatgttcgaagtgctggagccgctgcatgcaatgatggagaggggcccgcagaccctgaaggaaacctcttttaatcaagcgtatgggagggacctgatggaagcccaggagtggtgtcgcaagtatatgaaatccggcaatgtgaaggaccttacacaggcctgggacttgtactatcacgtcttccggaggatcagcaagcaacttccgcaactgacgagcctagaactccaatatgtgtctccgaaattgcttatgtgccgcgacttggagctggccgtgcctggcacgtacgatccaaaccagcccataattagaattcagtcaatcgcgccgagcctccaggtcatcaccagtaaacagaggccccggaagctgactttgatgggatctaatgggcatgagttcgttttcctgcttaagggacacgaggacttgagacaagacgaaagggtgatgcagctgttcggcctagtgaacacactgctggctaatgaccccacaagcctccgcaaaaacttatcaatccagaggtatgctgtcattcctcttagtacaaattcaggcctgatcggttgggtgccacactgcgatacgttacatgccctgattcgggactatcgcgagaagaagaaaattctcctgaacatagagcatagaatcatgctgcgtatggcaccagactacgaccaccttactcttatgcagaaagttgaggtgtttgagcacgcagtgaataatactgccggggacgatctggcaaaactgctctggctgaagagtcccagcagtgaagtgtggtttgaccgccgtactaactacactcggtccctcgccgtgatgtctatggtggggtacatactgggtctcggagaccgacatccatctaacctgatgctggaccggttaagtggaaagattctgcacatcgattttggcgattgtttcgaggtggctatgacacgcgaaaaattcccagagaagattccatttagactaactcgcatgctgactaacgcgatggaggtgaccggccttgacggtaattaccggatcacctgccataccgtaatggaggtgctgcgcgagcataaagatagcgtgatggcggtgctcgaggcgttcgtgtatgatcccctcctgaattggcggctgatggataccaacacaaaggggaataaaagaagccgcacaagaactgacagctactctgctggccagtcggtggaaatcttggacggcgtagagctgggtgagcccgcccacaagaaaactggcacgacagtgcccgagagcatccattcctttattggcgatggcctggtgaagcctgaggccctcaacaagaaggcaattcagatcattaacagagttcgcgataagttgacgggcagagatttctcccacgacgacacgcttgacgtcccaactcaggtggagctgcttattaagcaggcgacttctcatgaaaatttatgtcagtgctatataggatggtgcccattctggtag

SEQ ID NO: 24882 - DNA, 486 bp, Artificial Sequence
  Description of Artificial Sequence: Synthetic coding sequence
atgctggaccggctgagcggcaagatcctgcacatcgacttcggcgactgtttcgaagtcgcgatgacacgcgagaagttcccggagaagattccctttcgccttactcgcatgctcactaatgcgatggaggtaacaggtttggatgggaattatcggattacttgccataccgtaatggaagttcttcgagaacataaggacagtgtgatggcagtattggaggctttcgtgtacgaccccctcttgaactggcgactcatggatacaaacactaaaggcaataaaagaagcaggaccagaaccgattcatacagcgccggacagtccgtggagatcctggacggagttgaactcggcgagcctgctcataagaaaacgggaactaccgtacccgaaagcatccacagcttcatcggtgatgggttagtgaagccagaggccctgaataaaaaggccatccaaatcatcaaccgcgtgaggtag

SEQ ID NO: 24883 - DNA, 5187 bp, Artificial Sequence
  Description of Artificial Sequence: Synthetic coding sequence
atgctgggcaccggccccgccgccgccaccaccgccgccaccaccagcagtaatgttagtgtccttcagcagttcgctagtggccttaagtcgcggaacgaggaaacccgagccaaagctgcaaaagaactccagcactatgtgacaatggagctgagggagatgtctcaggaggagtcgacccgtttctatgatcagctgaaccatcacatttttgagttagtttcatcgagcgacgcaaatgagaggaaaggagggattctcgcaattgcctcacttatcggggtagaaggaggaaatgcgaccagaattggcagatttgcaaattatttacgcaatcttctgcccagcaacgatcccgtggtgatggagatggcctccaaagccatcggtcgcctcgccatggccggtgacactttcactgccgagtatgtcgagttcgaagtgaagagagctcttgagtggttgggggctgaccgaaatgaaggccggagacatgctgctgtgctcgtgttgcgtgagctggctattagtgtgcctacctttttctttcagcaggtgcaaccatttttcgataacatcttcgtggcagtttgggatcctaagcaggctattagggagggcgcagtggcagcactcagagcatgtcttatactgacgacgcaaagggagcccaaagaaatgcagaagccgcagtggtatagacatacctttgaggaggctgagaagggcttcgatgagaccctagccaaggaaaagggcatgaatagagatgaccgaatacatggggccctgttaatcctgaatgagcttgtccggatctcgtccatggaaggtgagcgcctgcgtgaagagatggaggagattacccagcagcaattggtacatgacaagtattgtaaggatctgatggggtttggcaccaaaccgcgccacattacacctttcacttctttccaggcggtgcagccccagcagagtaacgctctggtcggactcctcgggtattcctcccaccagggactcatgggattcggaacctccccaagcccagcaaagtcaaccttggtggagagcaggtgctgtagggacctaatggaagagaaatttgatcaggtctgccagtgggtccttaagtgccgcaatagcaaaaactcgctgattcagatgacaatcctaaatctcctccctcgtctggccgccttcagaccctctgccttcacggacacacagtatctccaagatactatgaatcatgtgttgtcatgcgtaaaaaaggaaaaagaaagaactgccgcttttcaggcactgggactcctctcagtagctgtgagaagtgagtttaaggtctatctgccacgcgtactagacatcatacgggctgcccttcccccgaaagattttgcccacaaaaggcagaaggcgatgcaggtggatgctactgtcttcacgtgcatttcaatgctggccagggccatgggccctgggatccagcaggatattaaggaactactggagccgatgctggcagtaggcctgagccctgcgcttactgccgtgttatatgatctgagtaggcagataccccagttgaagaaagacattcaagatgggctgttaaaaatgctctcattggttctcatgcacaagcccctgcgacatcccggaatgcccaagggcctggctcatcagctggcgtccccaggccttacaactctgccagaagcttccgacgtcggctcgatcacactcgccctgcgcactctggggagcttcgaatttgagggacatagcctgactcagttcgttaggcactgcgcagaccacttcctcaacagtgaacataaggaaattaggatggaagctgcacgcacatgtagccggctccttaccccatcgatacatctaatttccggtcacgctcacgtcgtctctcagacagccgtgcaggtcgtggccgatgtcctgagtaaactgctcgtagtcgggatcacggatcctgatcccgacatacgatactgcgtgctggcgtcgttggatgagcgctttgacgcgcatctggcccaagctgaaaatctgcaggctttgttcgtcgccttgaacgatcaggttttcgaaatccgggagctcgctatctgtacagtgggcaggctgtcttccatgaacccagcttttgtcatgcccttcctcagaaagatgttgattcaaatacttactgaattggagcacagtggtatcggccgcattaaggagcaatctgcgcggatgctgggacatctagtctcaaacgcgcctcgactgatcaggccctacatggagccaattctgaaggcactgatcttgaagttgaaggacccagaccctgatcctaaccctggcgttattaacaatgtgcttgccacaattggagaactcgctcaggtgtccggtctcgagatgcggaagtgggttgacgagctctttatcatcatcatggatatgctgcaggacagcagtctgttggccaagaggcaggtggcactgtggacacttgggcagcttgtcgccagcaccggctacgtagtcgagccatataggaaatatcccacattgctggaagtgctcctgaactttctgaagactgagcagaaccaaggtacccggcgcgaagcaatcagagttttgggactcttgggggctcttgacccctacaagcacaaagtgaatataggtatgatcgaccagagcagagatgcttctgcagtttctctcagcgagtcaaagtcgtcccaggattcatccgattactccacctccgaaatgctcgtaaacatgggcaacctgcctctggatgaattttatcccgccgtcagcatggttgcattaatgagaatcttccgggatcagtcgctttcacaccaccacactatggttgtccaagcaatcacatttatcttcaagtcccttggcctgaagtgtgtgcaatttctgccacaggtgatgccaaccttcctgaatgtaatccgggtttgcgacggggcaataagagaattcctcttccagcagctagggatgctggtgtctttcgtgaagtcccacattcggccctacatggacgagatcgtgacactcatgcgggagttctgggtaatgaataccagcattcagtctacaatcatccttctgatcgaacagattgtagtcgcgctgggaggggaatttaagctttatttgccacagcttatccctcatatgctaagagtgtttatgcatgataattcaccaggacgcatcgtgagcattaagctgttggccgcgatacagcttttcggcgctaacctcgatgattatctgcacctcctgttgccccccattgtcaagctcttcgatgcccccgaggctcccctgccatctaggaaggccgctctagagaccgtggatcgtctcacagagtctctcgatttcacggattacgccagccgcataatccatccaatagtgcggacactcgaccaatctccagaactgcgcagtactgctatggacacactcagttcccttgttttccagttgggcaaaaaataccagatttttattccaatggtaaataaggttctcgttaggcacaggatcaatcaccaacggtacgatgtcctgatctgtagaatagttaagggctatacgttagctgatgaagaagaagaccccttaatatatcagcacagaatgcttcggtccggacaaggcgatgctttggcctctggacctgtagagactggaccgatgaagaagctgcacgtctcaactataaacctgcagaaagcttggggggccgctagaagagttagcaaagacgactggcttgagtggctacgcaggctctcattagaacttctcaaggacagctcaagtccaagcttgcggtcctgctgggccctggctcaggcgtacaacccaatggcccgcgacctgtttaacgcagcatttgtgagttgctggagtgagctgaatgaggaccagcaagatgagctgattcgatccatcgaattggccctgacaagccaggatatagctgaggttacacagacgctcctaaacttggccgagtttatggaacattccgataaggggcccctgcccttaagagacgataacggaatagtactgctgggggagcgggctgctaagtgtagggcctacgctaaagcgttacattacaaggagttggaattccagaagggtccaacacccgccattttggaatcccttatttctattaataataaactgcaacagccggaggcagctgctggggtcttggagtacgccatgaaacattttggcgaattggagatacaagccacctggtatgagaagctccacgagtgggaggacgctctggtggcttacgacaaaaagatggatacaaacaaggatgatccagaactcatgctcgggagaatgcggtgtctggaagcgctgggggagtgggggcaactgcaccagcaatgttgtgagaaatggactctcgtcaatgatgagacccaagccaaaatggcgaggatggccgccgccgcagcttgggggttgggacagtgggactcaatggaggagtacacatgcatgataccccgagatacacacgacggggctttttacagagcagtcctcgcgctgcatcaggatctgttcagtctggcacagcagtgcatcgataaggctcgggacctcttagatgccgagttgacagccatggcaggtgaatcctactcaagagcttatggagctatggtgtcgtgccacatgcttagcgagttagaggaagtaatccaatacaagctcgtgccagagcggcgggagattatcagacagatctggtgggagcgcctgcaaggctgccagcgaatcgtggaagattggcagaagattcttatggtacggagcttggtggtttccccacacgaggacatgcgtacatggttgaaatatgcgagcctgtgtgggaaaagcggaagactagcaattgcccccctgaacatgggcacagcaaattccgcacaacccagatcccttagatcctggaggacatggatccgcatcctggattgtaaggacacagaagacgccgacctgacgcctgcaacctaccccaaaacttcattggtgtgtggtcagcagcagaagtgcctgcaggaccgccctaagtag

SEQ ID NO: 24884 - DNA, 6270 bp, Artificial Sequence
  Description of Artificial Sequence: Synthetic coding sequence
atggaggacacccaggccatcgactgggacgtggaggaggaggaggaaacagaacaatcatccgagtcattgcggtgcaatgtggagcccgtggggagactccacatcttttccggagcccatggccctgagaaagattttcccctgcatctcgggaaaaatgtagtcgggagaatgcccgactgctctgtggcacttcctttcccgtcaatctccaaacagcacgcagaaattgaaatcctcgcatgggacaaggcacctattcttcgagattgtggcagtctgaatggcactcagatcttaaggcctccaaaagtcctttcacccggtgtgagccatcgtttaagggaccaggaactgattctgttcgcagatctgttgtgccagtaccatagattagacgtgtccctgccgtttgtgagtcggggcccactgaccgtcgaagagaccccccgggtgcagggggagacccagccccagcgactactactggctgaggatagcgaagaagaagtcgactttctaagtgagaggcgcatggtcaaaaagagcagaacaacctcctcgtccgtgatcgtgcccgaaagcgacgaggagggacactcgcccgtcctgggtggcctgggaccccctttcgcatttaatctgaattccgacactgacgtcgaagaagggcagcaacctgctactgaggaggctagcagcgccgcccgtcgcggagcaacggtcgaggcgaagcagtcggaggcagaagtggtcactgaaatccagctggaaaaagaccagccactggttaaagaaaaagataatgatacaaaagtcaaaaggggtgccggaaacggcgtggtgccagccggagttattctggagaggtcacagccgcctggagaggattcggatactgacgtcgatgacgacagtcgcccacctggacgaccagccgaggtccaccttgagagagcacagccattcggtttcatcgattccgatacagatgcagaagaggagaggatccctgccacccccgttgtgatcccgatgaagaaaaggaagattttccatggggtcggcacacgaggcccaggtgctcccggactggcccatctccaggagtcccaggctggaagtgatacggacgtggaagagggaaaggccccacaagccgtccctttggaaaagtcccaggcatctatggtcatcaacagcgatacagatgacgaagaagaggtgtcagcagcgcttacattagcacatctgaaggaaagccagcccgcaatatggaacagggacgctgaagaagatatgccccagcgcgtggtgctactccagcggagccagactacaacagagcgggattctgacacagatgtggaagaggaagaattgccagtggagaacagagaagcggtgttaaaggaccacaccaaaatcagggctttggtgagggctcactcagaaaaggatcagcctccctttggagacagcgacgatagtgttgaggctgacaagagctcacccggtatccacctggagcgatctcaggcgagcaccacagtggacatcaatacccaggtggagaaggaggtgcccccgggaagcgccataatccatattaaaaagcaccaggtgagtgtcgaggggactaatcagacggacgtgaaggcagtaggggggccagcgaaattgctggttgtttctctggaggaggcttggcccctgcacggtgactgtgagactgacgctgaggaaggcacctcccttaccgccagcgttgttgcagatgtgagaaagtcccagctgccagcagaaggtgatgccggagcagaatgggcggccgccgtgctgaaacaggaaagggcccatgaggtgggcgcccaggggggtccgcctgtcgctcaggtcgaacaggacctgccaatcagtcgagagaacctgactgacctggtggtagacacggatacactcggggaaagtactcagccgcaacgggaaggcgctcaggttccaaccgggcgggaaagagaacagcacgtgggtggcaccaaagactcagaggacaattacggagactccgaggatcttgacttgcaggctacacaatgttttctagagaatcagggcctggaagctgtgcagtcaatggaggacgagcctacacaagcatttatgctgaccccaccacaagaactggggccatcacattgctcttttcagacaaccggcaccctagacgagccatgggaggtgctcgccacacaacccttttgtctcagagagtccgaggatagtgaaacacagccgtttgacacccatctggaagcttacggtccatgcctgtccccgccgcgtgccatccctggagatcagcatcccgagtcccctgtccacaccgagccaatggggattcagggacgcggaagacaaactgttgataaggtgatgggcattccaaaagagactgccgagagagtagggcccgagcgggggccattagagagggagacagaaaagctcctcccagaacgccagaccgacgtgacaggtgaggaggagttgaccaaggggaagcaggacagggagcagaagcagttactggccagagacacacagcggcaggaaagcgataagaacggtgaatccgccagccctgaaagggacagagaatctctaaaggttgaaatcgagacgtccgaggaaattcaagagaagcaggtacaaaaacagactctcccctcaaaagcctttgaacgcgaggttgagaggcctgtagcaaatcgggaatgcgaccccgcggagctggaggaaaaagtcccaaaagtgatcttggaacgagacactcagcgtggggaacctgaaggtggcagtcaggaccagaagggccaagcaagctctccgactcctgagcctggggttggcgcaggtgatcttcccggccccacctctgccccagtgcccagcgggtcacaaagcggcggaaggggtagccccgtgtccccacgtagacaccagaagggcctgttgaattgcaagatgcccccagcagagaaagcctccagaatccgcgcggcggaaaaagtgtcgcggggcgaccaggagtcccctgatgcttgtttgccgcctacagttccggaagcacccgctcccccacagaagccgcttaattcgcagagccagaagcacctggccccccccccactactgtcccctttgcttccgtcaataaaacccacagtgcggaagaccaggcaagatgggagccaggaggccccagaagcaccactcagttcagaactcgaaccctttcaccctaaacctaagattcggacacgaaagtcgtctaggatgaccccttttcctgcgacctccgccgccccagaacctcacccgtctacgagcaccgcccaaccagtcacccccaagccaacatcccaggcgaccaggtcacgcacaaatagatcatctgtgaaaactccggagccagtagtgcccaccgcccctgaactgcagcccagcacgtccactgaccaacccgtcacatccgaacccacttcacaggtgacaagggggagaaaatcccgatccagcgtgaaaacacccgaaactgtggtccccacagctttagagctccaaccttctacatctactgaccggcctgttacatcggaaccaactagccaggccaccaggggcagaaagaataggtcttctgtcaagacccctgaacctgtcgtgcccaccgccccagaattacagccctcgacaagtaccgatcagccagtgacatccgagccaacttaccaggcaacgcggggtaggaagaatagatctagcgtcaagactcctgagcccgttgttcctaccgcgccggaattaaggccctcaacatccaccgatcggcccgttacaccgaagcccacaagtcgtaccactcgatctaggaccaacatgtcatcagttaaaactcccgagacagtggtcccaacagctcccgaactgcaaattagtacgagcacagaccaacctgtgactccaaaaccgacttccaggaccacaaggtcaagaacaaacatgagctccgtgaaaaaccccgagtctacggtacctatcgctcctgaactgccacctagtacaagtactgaacagcccgttactccagaacctacctccagggctacacgcgggcgaaagaatagaagcagcggcaagaccccagagacacttgtgccaaccgcccccaagttggagccttccacttcaaccgatcaacccgtgactcctgagcctacctcacaggctacaagggggcggacaaaccgttcttccgtgaaaacccccgagacagtcgtccctaccgcgcccgaactgcagcccagcactagcacggatcaaccagtcactcctgagccaacatctcaagctacgaggggcaggacggatcggtcatctgtcaagacccctgagacagtcgtcccaaccgcaccggagctgcaagctagtgcaagcacagatcaaccagtcactagtgaaccaacctctcgaacgactagaggccgtaagaatcggtcaagcgtgaagacccccgagaccgtcgtgcccgctgcgcctgagctgcaaccatcaacaagtacagaccagccggtgacacccgagccaacaagtagagcaactcgtggcaggacaaacaggagcagcgtgaaaactccggaaagcatcgtgcccattgcccccgaactccaaccgtcgacgtcaagaaaccagctcgtgactccagaacctactagccgcgcaacacgatgtcggaccaaccgctcttccgtcaagaccccagaaccagtagtgcctacggcacctgagccccaccccaccacctctacggatcagccagttacacctaagctgacatcaagagccacacgaaggaagacaaatcggagtagtgtcaagacgcctaagcccgtggagcctgccgcaagcgacctcgagccttttacaccgacggatcaatctgtgacccccgaggccattgcccagggcgggcagtccaagacactgcgctctagtaccgtcagagctatgccagtgccaacgaccccagagtttcaatctcccgtgactaccgaccaacctatcagcccagaacccatcactcagccgtcttgcattaaacgtcagcgggctgcaggtaatcccggctctctcgctgcaccaatcgatcacaaaccctgttctgcgcctctcgaacctaagtcgcaagcttcaagaaatcaaagatggggggccgtgagggccgccgaaagtcttaccgcaatcccggaacccgcaagcccacagctcctggagactcccattcacgcaagtcagatccagaaggtcgagcccgccggccgtagcagatttacacctgagctgcagcctaaagcatcccaatccagaaaacggagtctggcaacaatggattccccgcctcaccaaaagcaaccccagagaggggaagtgtctcagaagacagtgattatcaaagaggaagaagaggatacagctgaaaagcctggcaaggaggaggacgtggttacccctaagcctgggaaacgcaaacgagatcaagccgaggaggagcctaataggatcccttcccgaagcctacgcagaaccaaactgaaccaggagtctactgcacctaaggttctgttcacgggtgtcgtagatgctaggggtgaaagagcagtactagccctgggtggcagtctggccggatccgctgcagaagctagccacctcgtgaccgatcggatccggcggaccgtgaagttcctgtgtgccttgggccgcggtattcctatcctctcacttgactggcttcaccagtctcgcaaagctggattttttttaccacctgacgagtatgtggtaactgatcccgaacaggagaagaactttggattttcgcttcaggacgccttgagtcgggcaagagaacggcggttgctggaggggtatgaaatctacgtcacgcccggagtacaaccgccaccgcctcagatgggtgaaatcatctcctgctgcgggggtacctacctgccgtctatgccccggagctacaagccccaaagagtggttattacatgcccacaggacttcccacactgctccatccctctgagggtcggactgcccttattgtcacccgaatttctgctcacaggtgtgcttaagcaggaggctaaacccgaggccttcgtgttatcacccctggaaatgagcagcacgtag

SEQ ID NO: 24885 - DNA, 489 bp, Artificial Sequence
  Description of Artificial Sequence: Synthetic coding sequence
atggaggacacccaggccatcgactgggacgtggaggaggaggaggagactgagcagtcctctgaatccttacgctgcaacgtggaacctgtgggtagattgcatatcttctccggggcacacggtcccgagaaagattttccactgcacctgggcaaaaacgtggttggaagaatgcctgactgctccgtcgctctaccctttcctagcataagtaaacaacatgcagaaatagaaattctggcgtgggataaagctcccatactgagagattgtggttccttgaatgggacacagatcctgcgccctcctaaggtcttatctcctggcgtgagtcatcgcctaagggaccaggaactgattttgttcgcagaccttttgtgtcagtaccataggctcgatgtgtcattgccattcgtgtctcggggtccactgaccgtagaggagaccccaagagtccagggcgaaacacagccgcagaggttatag

SEQ ID NO: 24886 - DNA, 384 bp, Artificial Sequence
  Description of Artificial Sequence: Synthetic coding sequence
atggaggacacccaggccatcgactgggacgtggaggaggaggaggaaacagagcagagctccgaaagtctacggtgcaatgtagaacccgtggggagacttcatattttttccggggcccacggacccgaaaaggacttccccctccatctcggaaagaacgtagtgggcagaatgcctgattgtagtgtggccctcccattcccctctatttcaaagcagcacgccgagatcgagattcttgcctgggacaaggcccctattctgcgtgattgcggtagcttgaatggcacgcagatcctgcgtccaccgaaggtgctttcacctggggtgtcccaccggctgagagatcaggagctgattttgttcgcggacctgctgtag

SEQ ID NO: 24887 - DNA, 921 bp, Artificial Sequence
  Description of Artificial Sequence: Synthetic coding sequence
tgacacgtgggcggcaccaaggacagcgaggacaactacggcgactcagaagatcttgatctgcaggccacgcagtgtttcctcgaaaatcaaggactggaagccgttcagagcatggaagacgagccaacacaggctttcatgctgactcctccccaagagctgggtcccagccactgctcgttccagactacaggtctcttgaattgcaaaatgcctcctgccgagaaagcctcaagaatacgagcggccgaaaaagtgtcgcgaggtgatcaggaatcccctgatgcctgccttccacccaccgtgccggaggctcctgcaccgccgcagaaaccactgaatagccaatcccagaaacacctggcacctcccccactattgtcaccgcttctcccaagcatcaagcccacggtaagaaaaacacggcaggacgggtcacaggaagcgcccgaagcccctttgagtagtgagctggaacctttccacccaaaacctaagattaggacacgcaagtcgtcacgaatgactccatttcccgcaacatctgccgcacctgagccccatccatcaacatcaacagctcaacccgttacgccaaaacccacatcacaggccactcggtctcggactaatcgaagctctgtgaagacgcccgagcctgtggtgcctacagcccccgagctccagccctcaacctctactgatcaaccggtgacgtctgagccgactagtcaggtgactaggggccggaagagcagaagctctgtgaaaacccctgagactgtggtaccaacagcactggaactgcagccatccaccagcaccgatcgccccgtgacttctgagcccacaagccaggccacccggggtaggaagaacagatcgagtgtgaagacccccgagcctgtagtgccgtag

SEQ ID NO: 24888 - DNA, 342 bp, Artificial Sequence
  Description of Artificial Sequence: Synthetic coding sequence
atggaggacacccaggccatcgactgggacgtggaggaggaggaggaaaccgaacagtcctctgagagcctgcgttgcaatgtggaaccagtggggagactacatatcttcagtggggcccacgggcccgagaaggatttccctctccaccttggtaaaaacgtggtgggcaggatgccggactgcagcgttgccttgccctttccgtctatctccaagcaacacgcggagatcgagatcttagcctgggacaaagcccctattctgagagactgtggatctttgaacggtacccagatactgcgtccacctaaagtgctgtcccctggtgtgtctcattag

SEQ ID NO: 24889 - DNA, 5409 bp, Artificial Sequence
  Description of Artificial Sequence: Synthetic coding sequence
atggaggacacccaggccatcgactgggacgtggaggaggaggaggagacagaacaaagtagtgagagtctacgctgtaacgtggagccagttggacgattacacatcttcagtggggctcacggtcccgaaaaagacttcccactacaccttggcaaaaatgttgtcggaaggatgcccgattgctcagttgcgttgcccttccctagcatcagtaagcagcatgctgaaatcgaaattctggcttgggacaaagcgccaattctgcgggactgtggaagccttaacggcacccaaattcttcgccctcctaaggtcctttcccctggagtttctcatcggttgcgggaccaggagctgatcctgtttgctgatctcctctgccagtatcacagacttgacgtcagcctaccttttgtgtcgcgaggcccattgactgttgaagagaccccaagagttcagggcgagactcagcctcaaaggctcctcctggccgaagatagtgaggaggaagtcgactttctgagtgagagacgcatggtgaaaaaatcccgaaccactagcagttccgtgattgtgcccgagtcagacgaagaggggcactcccctgtcttaggcggtctggggcccccatttgcgtttaatttgaatagcgatacggatgtggaggaggggcagcagcccgcaactgaggaagcctcctctgctgcacgacgcggcgccaccgtggaagcgaaacagagtgaagctgaagtggtcaccgaaatccagttagaaaaggatcaaccacttgtaaaggagaaggataacgacacaaaagttaagcggggagcagggaatggagtagtccctgcaggtgtcatcctcgaacgcagccagcctcctggggaagacagtgacaccgacgtcgacgacgactctaggccacctggacgtccagcggaggtgcatttggaacgcgcacagccatttgggttcatcgattccgatacggacgccgaagaggaacggatcccagccaccccggtggtcattccgatgaagaagcgcaaaatattccatggtgtgggcacccggggacctggcgcaccagggctcgcccacctgcaagaaagtcaagcaggctcagataccgatgttgaggaaggcaaagcacctcaggccgtgcctctggagaagtcccaggcaagcatggtgattaattccgacactgacgatgaggaggaggtgagtgccgcattaactctggcacacctgaaggaaagccagcccgccatctggaatcgcgatgctgaggaagacatgccacaacgcgtggtgctcctgcagagaagtcagacaaccacagaaagggattccgacaccgatgttgaggaagaggaactacctgtagagaatagggaagcagttctgaaggatcataccaagatccgcgcattagtgcgagctcatagcgagaaggaccagccccccttcggcgactccgacgactccgtggaagcagataaaagcagtccaggcatacacctggagaggtcacaagcttccactaccgtggacatcaatacacaagtagagaaggaggtgcctcccggtagtgccatcattcatattaagaaacatcaggtgagcgtggaagggacaaaccagaccgacgtgaaagctgtgggtggccccgccaaactcctagtggtgtccctggaagaagcctggcccttgcacggtgattgcgaaacagatgcagaagaggggacctctctcacggcgtccgtcgttgccgatgttcgcaagtcccagctgcctgccgaaggtgatgctggagccgaatgggccgccgctgtgcttaaacaggagcgcgctcacgaagtgggagcccagggcgggcccccagtggctcaggtcgagcaggacttaccaatttcccgtgagaatctcaccgacctggtggtggacacggatacactgggcgagtctacccagcctcaacgcgaaggcgcacaggttcccaccggtagagaacgagagcaacacgtcggcggaactaaagattcagaggataactacggagattcagaggatttggacctgcaggccacccagtgcttcctggagaatcagggcctggaggcagtgcagtccatggaggatgagccaacccaggcatttatgctaactcctcctcaagagctgggtccctcccactgctcattccaaacaactgggacgcttgacgaaccctgggaagtattggcgacccaacctttctgtctacgtgagagtgaagatagtgaaactcagccatttgacacccacctggaggcttatggaccctgtctctcacctcctcgggcaattccgggggaccaacatccagagtcacctgtgcacactgagcccatgggcattcagggacgtgggagacagacggtcgataaggtgatgggaattcctaaggagaccgccgagcgggtagggccagagcgtggacctctcgaaagagagacggagaaactgcttcccgagcgacagactgacgtcacgggagaagaggaactcacaaaggggaaacaggatcgggagcagaaacagctgctggccagagatacccagaggcaggaatctgataaaaatggagaatccgcttctccggaacgtgatagggaaagtctaaaagtggaaatcgaaacaagtgaggagatacaagagaagcaggtgcaaaagcagacattgccctcaaaagcgttcgaaagggaggttgagaggcccgtggccaatcgggaatgtgatccggcggagcttgaagagaaggtgcccaaagtcatcctggaaagagacacacagcgcggcgagccagagggaggtagccaggaccaaaaagggcaagcctccagccctacacccgagcctggggtcggggccggcgaccttcctggacccacaagcgctccagtccccagcggttcacaatcaggcggtaggggctcgcccgtttctccgagacggcaccagaaagggctgctaaactgcaagatgccccccgctgaaaaagcttctcggattcgcgccgccgaaaaggtcagccgtggtgaccaggagtcacccgatgcttgtcttcctcctacagtaccagaagctccagcccccccacagaagcctctgaattctcagagtcagaaacacttagctccaccacctttgttgagtcccttactaccgtctatcaagcctaccgtgaggaaaacccggcaggatgggagtcaggaggctcccgaggcccccttatcaagtgaattggagccattccatcccaagccaaaaattaggacaagaaaaagctcacggatgacacctttccccgccacctcagccgccccaaagttggagccttctacatctaccgaccaacctgtgaccccagagccaaccagtcaggcgacacggggccggactaatagatcgtctgtgaagacacctgagacagtggtgccaactgcaccagaactccagccatccacttctaccgatcagcctgtgacgcccgagcctactagtcaagccacgagaggtaggaccgatcgatctagtgtcaagacgcctgaaacagtcgtgcccactgctcccgagctgcaagccagcgcctctacagaccagcctgttacttcagagcctaccagtagaacaaccagagggcgcaagaacaggtcctctgttaagactcctgaaactgtggtgccggcagcaccagagcttcagccatcaaccagtaccgatcagccggtaacacccgaaccaacttcgcgcgcaactcgcggccggaccaatcgcagctcggtgaaaacccccgagtcgattgtgcctatcgcaccagaactgcaaccctctacatcgcgtaaccagctcgtgactcctgagccaacttcgcgcgccacccgttgcagaacaaacagaagctccgttaagactcccgaacccgtggttcccaccgcccccgaaccccacccaaccacttccacagatcaacctgtgacccccaagctgacgagtcgagctactcgccgtaaaaccaaccggagttccgtcaaaactcctaagcctgtggaaccggccgcctcagacctcgaaccctttacccctacagatcagtcagtcacaccagaggcaatcgcacagggagggcagagcaagactctgagatcatccactgtcagagcgatgcccgtccccaccacccctgaatttcagtcacccgtgacaacagaccaacctattagtcctgaaccaatcactcagcccagttgcatcaaacggcaaagggccgctgggaatcctggctctctcgcagccccaattgaccacaaaccctgctctgctcccctcgagcctaagagtcaggcctcacgtaatcaacggtggggtgcagtgcgcgcagccgagtccctgaccgctatcccagaaccagcctcacctcaacttctcgaaacacctatccatgcatcccagatacagaaggttgagcctgccggccggtctaggtttactcctgaattacagcctaaggcgagccagtcccggaagcggagcctcgcaaccatggacagccctccccaccagaagcagcctcagcgaggtgaggtctctcagaaaacagtaatcataaaggaagaagaggaggacacagcagagaagcctggcaaagaagaagatgttgtaacccctaaacctggtaagcggaaaagggatcaagccgaggaagaacctaaccggatcccctcaagatcactccggagaaccaaactgaaccaagagagcacagctcccaaggtcctgttcacaggagtcgtggatgctcgtggggagcgagctgtgctggcccttggagggagcctagcagggtcggccgcggaggcctctcatctggttaccgacagaattcggagaactgttaagtttctgtgtgccctgggacggggcattcccattctgtctttggactggctgcatcaatctcggaaagccgggtttttcctgccccccgatgagtacgtggttaccgatcctgaacaggaaaagaactttggcttctctctacaggatgcactgtcccgggcaagggaacgccggctactggagggatacgaaatttatgtgacacccggtgtgcagcccccacccccccagatgggcgaaattatctcctgttgcggaggcacctacctgcctagcatgccacgcagttacaagccccaacgggtagtgattacctgtccccaggatttcccccattgctctattccactccgagtaggactgccgctcctgtctccggaatttctgttaaccggcgtcctgaagcaagaggcaaagccagaagccttcgtcctgtctcccttggaaatgagtagcacctag

SEQ ID NO: 24890 - DNA, 666 bp, Artificial Sequence
  Description of Artificial Sequence: Synthetic coding sequence
atggaggacacccaggccatcgactgggacgtggaggaggaggaggaaactgaacaatccagcgagtccctccgttgtaacgtcgaaccagttggcaggcttcacatttttagtggtgcccacggtcctgagaaggactttccactacacctgggaaagaacgttgtgggtcgaatgcccgattgctcggtagcactgccattccccagcatcagtaagcaacatgctgagatcgagatcctggcttgggataaggctcccatattgcgcgattgtggcagtcttaatggcacccaaatcttgagttcctcgctccccccaccccagactagcctgttgcccctatccctgcgcttacgcttgctgggtgaagaacaaatagaccccttgagccgccttctcaaacaactctccccacagccactgtcctataggcttcccccccctcaaacgtccctatcgcctcttagcccccatctgggcccgctaggggaggagaaaatcgggcccctatctcgccctttaaaacagctttgtccacaacccctgtcaagctctctgcctcccccccaaacaaacttaagtccgctgtccccacatcttggtccactgggcgcaggacaaattgggccccttagtcgtccgttgaatcagctttccctctag

SEQ ID NO: 24891 - DNA, 738 bp, Artificial Sequence
  Description of Artificial Sequence: Synthetic coding sequence
atggaggacacccaggccatcgactgggacgtggaggaggaggaggagaccgagcagtccagcgagagtctccgctgtaacgttgagccagtcggcagactgcatatttttagcggcgcccacggtccagaaaaggactttcctctgcaccttggcaaaaacgtcgtgggacgtatgccggactgcagcgtggcgctgccatttcccagtatctcaaagcaacatgccgaaattgaaatcttggcgtgggataaagctcctatccttcgggattgcggaagtctgaatggcacacagatcttacgccctccaaaagttctgtcacctggggtgtcacatcggctgcgcgaccaggagctgatcttattcgccgacctgctgtgtcaatatcaccggttggacgtgagcctgcctttcgtttctcggggcccactcacagtggaagagacccccagggtacagggtgagacacagccacaacgtttacttttagctgaagattccgaagaggaggttgattttctttcagagagacggatggttaagaaatcaagaaccactagcagctcagtgatcgtgcctgagtcagatgaagaaggccacagcccagtccttggcggacttggaccaccttttgctttcaatctgaacagtgatacagacgtggaggaaggtcaacaaccggctacagaggaagcctcctccgccgctaggagaggcgcgacagtggaggcttag

SEQ ID NO: 24892 - DNA, 735 bp, Artificial Sequence
  Description of Artificial Sequence: Synthetic coding sequence
atggaggacacccaggccatcgactgggacgtggaggaggaggaggaaactgaacagtcgtctgagtccctgcgttgcaatgttgaacctgtcggacggctgcatattttctcaggcgcccacgggccagagaaagactttcccttgcacttgggcaaaaatgtggttggcagaatgccggattgctctgtcgccctaccctttcccagtatttccaaacagcatgccgagatagaaatacttgcatgggacaaggccccaatactgcgcgattgtgggtccctgaatggcacacaaatcctacgaccaccgaaagtgctaagcccgggggttagtcaccggctacgggatcaggagctgattctcttcgcagatctgctctgtcaataccaccgactggacgtgtctctgccctttgtctcacgcggccccctgactgtcgaagagacgccaagggtgcagggcgaaacacaaccgcaacgcctgctgctggccgaggactctgaggaggaggtggactttctgagcgagagaagaatggttaagaagagcagaacaacttcttctagcgtgatcgtgccagaatcagacgaggagggccacagtcccgtcctgggtgggcttggccccccgttcgctttcaacctgaactcagatacagacgtggaagaggggcagcaaccccaccgcggcgggctgctatcatgccagaagcggtgtcactgtcgggggtag

SEQ ID NO: 24893 - DNA, 5478 bp, Artificial Sequence
  Description of Artificial Sequence: Synthetic coding sequence
atggaggacacccaggccatcgactgggacgtggaggaggaggaggaaaccgaacagagcagcgagtcactgagatgcaatgtcgaacccgtaggccgccttcacatattcagcggggcgcatggcccagagaaagacttccccctacatctcggtaaaaatgttgtcggccgcatgcctgattgtagtgttgctctccctttcccaagcatctcaaaacagcacgcagaaattgaaatcctggcctgggacaaggcccctattctccgagattgcggtagcctgaatggaacccaaatactccggccccctaaagtgctttcacctggagtgtcccatcgactgcgagatcaagagttaattctgttcgcagacctcctctgtcaatatcacagactggatgtatcactaccattcgtgtcacgaggccctctgactgtggaagagactccacgggtgcagggcgaaacacagccgcagcgcctcttacttgccgaggactcagaggaagaagtggattttttgagtgagcgaaggatggtcaagaagagtaggactacctccagttcggtcattgtccccgaaagcgacgaggagggacactctcccgtcctgggcggtcttgggccaccgtttgcctttaacttaaatagcgacacagatgtggaagaaggacagcaacccgccaccgaagaagcctcctcagccgcaaggagaggggccactgttgaggctaaacagagcgaagccgaggtggtgaccgagatccaacttgaaaaagaccagcccctcgtaaaggagaaggataacgacaccaaagtgaaacggggagccggtaacggggtcgtaccagctggcgtaatcctggagcgttctcaaccaccaggagaggatagcgatacagatgtggacgacgattccaggcctccgggcaggcccgcagaggtccatcttgagagggcccagccgttcggattcatcgactctgatacagatgcggaggaggaacgcatccccgctaccccagtggtgatccccatgaagaagcggaaaatctttcacggagtgggtaccagaggacccggcgctccgggcttagcccatttacaggagtcacaagccgggtctgatacagacgtggaggagggaaaagcaccccaggctgtgcccctggagaagtcccaggcttccatggtgataaactcagacaccgacgatgaagaagaagttagcgccgcactgactctcgcccacctcaaagaaagccagccagccatatggaatcgcgatgccgaggaagacatgccgcagcgagtcgttttgctgcagaggagccaaacaaccactgagagggatagcgacactgatgttgaagaggaggaactccctgtggagaaccgcgaggcagtgctgaaagaccataccaagatcagggctctggtgcgggcacattccgaaaaagaccagccaccctttggggactcagatgattccgttgaggcagataagagcagccctggaattcatctggagcgttcacaggcctccactacggttgatataaacacacaagtcgaaaaagaggtccctcctggcagtgccatcattcatataaagaagcaccaggtttccgtagaaggaaccaaccagacggatgtgaaagccgtaggaggaccagctaaactgctcgtagtgtctctcgaggaggcttggcctttacacggggattgcgaaactgacgccgaggagggcactagtctgactgccagcgttgtggctgatgtgcgcaagtctcagctgccagccgagggagacgctggagcagagtgggcagccgccgtgctcaaacaggagcgcgcacatgaggtcggggcccagggtggaccaccagttgctcaggtggaacaggatttgcccattagccgtgagaatttgacggacttggtggtggataccgatactttaggagagagcactcagccacagagagagggggcccaggtgcctacaggaagagagcgcgagcagcatgtgggtggcactaaagacagcgaagacaactacggcgatagcgaagacttggatctccaggctactcagtgttttctcgagaaccagggcctcgaagccgttcagtctatggaggacgagcccacacaagctttcatgctgactccgccacaagaactagggccgagtcattgcagtttccagaccaccggcctgcttaactgcaagatgcctcccgcagaaaaggcgagccggatccgagctgccgaaaaggtctctaggggagaccaagaaagtccggacgcatgcctccctccgacggtgcccgaggcacccgcgcctcctcaaaaacctcttaatagccagtctcaaaaacatctggcaccccccccactgctgtcaccattgctcccctccatcaaacctacagtgaggaaaaccagacaggacggttcccaggaggccccagaggcacccctgtcatctgaacttgaacccttccacccgaaaccaaaaatacgcacccggaaaagttctaggatgacaccatttcccgcgactagcgccgccccggagccccatccgtctacttccaccgctcagccagttacccccaagccaacctcccaggctacccgctctcggaccaaccgctcatccgtgaaaactcccgagcccgtggtcccaacggcccccgagctgcagccctcgactagcacagatcagccagtgacctcagaacccacctcccaggtcacgagggggagaaagtctcggtctagcgtaaaaactcccgaaactgttgtacccacggctcttgaacttcagcctagcactagcactgatcggcctgtgacttccgagcctacatctcaggccacacggggccggaagaaccggtcatccgttaaaactccggagccagtggtgcctactgcaccagaactccagcctagtacgagtaccgatcagccggtgacctcagagcccacctaccaagctacccgtggcagaaaaaacagaagctctgtgaagacgccggagccagttgtgcccacagcgcccgagttgcgaccgtccacttcaacagaccgcccggttacacctaaacccactagccgcacaaccaggtctcgcacgaatatgtcatccgtgaaaacgcctgagaccgtcgtcccgaccgccccggagctccaaatttcgacctcaactgaccagcccgttactcctaagccaacttcccgaacaacccggtctcggactaatatgtctagcgtgaagaaccctgaatctacagtgcctattgcccccgaactgcctccgtccacaagtacagaacagcctgttacaccagaacctacaagtcgggcaacacgtggtcgcaagaatagatcctctgggaagactcccgagacccttgttccaactgcacccaagctggaaccttcaacttccacagaccagccggttacccctgagccgaccagccaggccaccagaggccggacgaacagaagctcagtgaaaactcccgagaccgtggtgccaacagctccagagctccagccatctacctctaccgaccagcccgtcacccccgagcctacatctcaagccacaagaggtaggacagatagatcctccgtgaagactccggaaaccgtcgtgcctacggcccccgaactgcaggcctcagcctctaccgaccaaccagtgacgtctgagcccaccagtcggacaacccggggccggaaaaacaggtctagcgttaaaacaccagaaacagtggtgcctgccgcaccagaactgcaaccctccacctcaactgaccagcccgtcacgcccgaacccactagcagagccacgcgcgggcgcacaaaccggtccagcgtgaaaactcctgagtctatcgtgcccatcgctcccgaacttcagccgtcaacctcacgtaatcagctggtcacaccggagccaacttctcgtgctacacgttgtcggaccaatcgctctagcgtgaagacaccagaaccagtcgtcccaactgccccagaaccccaccccaccacaagcaccgaccaaccagtgacgccaaagctgaccagtcgggcaacgcggagaaaaacgaaccgtagtagcgtcaaaactcctaaaccagttgagccggccgctagcgatctcgagcccttcacccctactgatcaatctgtgaccccggaggctattgcccagggcggccagtctaagaccttgaggtcttccacagttcgcgcaatgcccgtcccaacgactcctgagttccagtcacctgtgacaacggaccagcctatttctcccgaaccgatcacccagccaagctgtattaagcgacagcgggctgccggaaaccccggaagtctggcggcaccgattgatcacaaaccttgctccgccccactggagcctaagtcccaagccagtaggaaccaacggtggggggcagtccgggcagctgagagcctcaccgccattccggagcctgcttcaccccagttgcttgagacacctatccacgcctcccaaatccagaaagtggagcccgcaggccggtctcgcttcaccccggaactacaacctaaggccagccaaagccgcaaacgaagtttggcaactatggatagccctccacaccagaagcaaccacagcggggtgaggtatcacaaaagactgtgatcatcaaagaagaagaggaggatacagcagagaaaccagggaaagaggaagatgtcgttactcccaaacctggcaagagaaaaagggatcaggctgaggaagagcctaatcgcatcccatcccgaagcctccgaagaacaaaacttaatcaagaatccaccgccccaaaggtcctgttcaccggtgtcgttgacgcccggggggaacgcgctgtcttagctttgggcggatccctggctgggagcgcagcggaagcttctcatctggtcaccgaccgcattcgacgcactgtgaaattcctgtgtgcactgggccggggcatccccattctcagtctcgactggctgcatcagtcgagaaaggctgggttcttcctgccgcctgatgaatacgtcgtaacagatcctgagcaggaaaagaactttggcttttcattgcaggacgctttgagtagggctcgggaacgcaggctgctggagggctatgagatttacgtgacaccaggcgtccagcccccacccccacagatgggggaaatcatctcttgctgcggtggcacttaccttccatctatgcccagatcgtacaagccacagcgggttgtgattacctgcccccaggactttccccactgttctatcccacttcgtgtgggtctgcctctacttagccctgagtttctgttaaccggagtgctgaagcaagaggcaaaaccagaagcctttgttttgtccccccttgagatgtcaagtacttag

SEQ ID NO: 24894 - DNA, 4968 bp, Artificial Sequence
  Description of Artificial Sequence: Synthetic coding sequence
atgtaccaccggctggacgtgagcctgcccttcgtgagccggggccccctgactgttgaggaaacccctagggtccagggcgaaacccagcctcagcgcctcctcctcgctgaggactccgaagaggaggtggactttcttagcgaacgcagaatggtcaaaaaatccagaactacgtctagttccgtcattgtgcccgagtctgacgaggaaggccacagccctgttctcgggggtctgggaccacctttcgctttcaatctgaattcagacactgacgtggaagaggggcaacagcccgccaccgaggaggcttctagtgccgctagacgaggtgcgacagtggaggcaaaacaatccgaagctgaagtagtcacagagattcagctcgaaaaggaccagcccttggtcaaagaaaaagacaacgatactaaagtaaaacggggcgctggcaatggcgtggtacctgccggagttattctggagcgttcccagccccccggcgaggatagtgataccgacgtggacgacgactcacggccaccaggtagaccagccgaggtgcacctcgaaagggcccaacctttcggattcatcgacagtgacaccgatgccgaagaggaacgcatcccggctacccctgtggtgataccaatgaaaaaacggaaaatatttcatggggttggcacgcgcggcccgggagccccgggactggctcacttgcaagagagccaagctgggagcgatacagatgtcgaggaggggaaagcaccgcaggcggtgcccctggaaaaaagtcaagcttctatggttattaacagcgataccgacgacgaagaagaagtcagcgcagccttaacgcttgctcacctgaaggaatcgcagcccgcaatctggaatcgcgacgctgaagaagatatgccccagcgggtcgtgctgctgcagcggtcgcagacaactaccgagcgggattcggatacggatgtcgaggaagaggagctgccagtcgaaaatcgagaggcagtattgaaagaccacacaaagattcgggcacttgtacgggcccattctgagaaagaccagccacctttcggggactccgatgacagcgtggaggctgacaaatcgtccccaggaatccacctggagcgctcccaggcgtctactacagtggatatcaatacccaggtggagaaagaggttccacccgggtccgccattatacatattaaaaagcaccaggtctctgtcgaaggaacaaaccagacggacgtcaaagcagtcggaggtcctgctaaacttctggtagtgagcctcgaagaagcctggccgctgcacggggactgtgagacggatgcggaagaaggaacttcactcaccgcttctgtagtggccgatgtgagaaagtctcagcttcccgccgaaggcgacgcgggtgctgagtgggcagccgccgtgctaaagcaggagcgcgcacacgaagtgggcgctcagggaggaccacccgtggcccaggtggagcaggaccttccgatctcccgtgaaaacctaacagatttggtagtcgacacagatacactgggtgaaagtacccaaccgcagcgtgaaggcgcgcaagtaccgaccggccgggaacgcgaacaacatgtggggggaacaaaggactccgaggataactatggcgatagtgaggatctggatctacaggctacccagtgcttcctggaaaatcaggggcttgaagtgcagtccatggaagacgagccgacacaggcctttatgctcacccctcctcaggagctgggcccatctcactgtagcttccagactactggccttctgaactgcaagatgccgcctgcagagaaggcgtctcgtatcagagcggcagagaaggtgtctaggggcgatcaggaaagcccagacgcctgtcttccgcccaccgttcccgaggctcccgccccaccacagaaaccattgaatagccagtctcagaagcatctagccccccccccccttttgagtcccctccttcctagcatcaagcctaccgtgagaaagaccagacaggatggatctcaggaagcccctgaagcacccctgtcgagcgagcttgagcccttccaccccaaaccgaaaattcgaacacggaagagcagccggatgacccctttccccgcaaccagtgccgctccagaaccacacccaagcacttctacagcgcaaccagtcacacctaaacccacctcccaggccactagatcccgcacgaataggtcttccgtcaagacgccagaacccgttgtcccaactgctccagaactacagcctagtaccagtaccgaccagcccgtcacaagtgagcccacctcacaagtcaccaggggacgtaagagccgctcctctgttaaaactccagaaacagttgtaccaactgctcttgaactccaaccctctaccagcacagacaggcccgtcacgtctgaacccactagtcaggcaacacgcgggaggaaaaaccgatcgtcagtcaaaactcctgagccagtggttccgaccgctcctgaactgcaaccgagcacaagtactgaccagcctgtcacgtctgagcccacataccaagccactcgcggacggaagaatcggagctcggttaaaacccccgaacccgtggttccaactgctcctgaactacgcccgagcacctctactgaccgtcccgttacccctaaaccaacgtccaggactaccagatcgaggaccaacatgagctcggtgaagaatccagaatcgacggtccctatcgcgcccgagttgcccccctccacatctacagagcagcccgtcacccctgagccaaccagcagggcaacacgcggaaggaagaataggtcaagcggcaaaacaccggaaacattagtgcccactgcacctaagttggaacccagcacctctacagatcagccagtcacaccagaacccacgagtcaggccaccagaggaaggacaaacaggagctctgtcaagacaccagaaaccgtggtcccaaccgcccctgaactacagccttccacaagtaccgatcaacccgtgacccccgaacctactagtcaggctactaggggccgaacagaccggtcatctgttaaaaccccggaaactgtcgtgcccaccgccccggaactccaggcgagcgcttctaccgatcagcctgtgaccagcgagccaacaagtagaactacccgaggccggaagaaccgctccagcgttaaaactcccgagaccgtcgtcccagctgcccccgagctgcagccctccacctcgactgaccagcccgtgacacctgaaccaactagtcgggctaccaggggccggaccaaccgaagcagtgtgaagactccagaaagcatcgttccaattgcaccggaactgcagccttcaacgtctcgtaatcagttggttacacctgaacctacctctcgggctacgcggtgcagaacaaaccgaagcagcgtaaagaccccagagcccgtggtgcccacagcccctgaaccgcatccgactaccagcaccgaccagcccgtaactcctaagctcaccagccgtgccactcggaggaaaaccaaccggtcttctgtcaagacacctaagccagttgaaccagccgcgtctgatctggagccatttacacctacagatcagagcgtcacacctgaggccatcgcacaagggggacagagtaagactctgcgcagctccaccgtccgagccatgcccgtgccaacgaccccagaatttcaatcccctgtgacgacggatcaacccatctcaccggagcccatcacacagccaagttgcattaagagacagcgggctgccggcaatcctggatcgttggcagctccaattgaccacaaaccttgtagtgctccgctggaacctaaatctcaggcctcgcgcaaccagcggtggggggcagtgagggctgcggagtcccttacagccattcctgagcccgcatccccccagctactcgagaccccgatacatgcctctcagattcagaaagtggagcccgctggccggtcgcgcttcacgcccgaactgcaacccaaggcctctcagagccgcaaaagatctctagccacaatggactctcccccccatcagaaacaaccgcagagaggagaggtgagccagaaaacagtgatcatcaaggaggaggaagaggatactgcagaaaaacccggtaaggaagaggacgtcgtcactcccaagccgggaaagcggaaacgcgatcaagctgaggaagagcccaatagaattccttccagatcactcagaagaacgaagctcaatcaggaaagtacggccccaaaggtcctcttcaccggggttgttgatgcgcgcggcgagagagctgtcctggcgttgggtggttccctcgcaggatccgcagctgaagcctcccacctggtaacggaccggattaggaggaccgtgaagttcctctgcgcgttaggtcgcggcattcccatcctgagccttgactggcttcaccagtctaggaaggcaggttttttcctgccacctgacgagtatgtggtgactgaccccgaacaggagaaaaactttggtttctcattgcaggacgccctcagccgcgccagagagagaagactgctggaggggtacgagatatatgtcactccaggcgtgcaaccaccaccacctcagatgggagagataatcagctgctgcggaggtacctacctgccctcaatgcctcggagctataagccgcagcgggtagtgatcacctgtcctcaggattttccccactgcagcattccactacgggtgggcctcccactcctttccccggaattcctcctcaccggcgtactcaagcaagaggccaaacctgaggctttcgtcttatcgccgctggagatgtcatctacttag

SEQ ID NO: 24895 - DNA, 1941 bp, Artificial Sequence
  Description of Artificial Sequence: Synthetic coding sequence
atgggcctgccccggctggtgtgcgccttcctgctggccgcctgctgctgttgtccaagggtggcaggcgtgccaggagaggcagagcagccagcacccgagctggtcgaagtcgaggtgggaagcacagcattactcaaatgcggcttgtctcagtcccagggaaatctgtctcacgtagattggtttagcgtccataaggaaaaacggaccctgatttttcgcgtgagacagggccaggggcagagtgaacccggcgagtacgagcagcgactgagtctgcaggacaggggagcgacactggccctgacacaagtcaccccccaagacgaacggatcttcttgtgccagggtaaaagacctcggtcacaggagtacagaattcagctgcgggtctacaaagctccagaggagccaaacatccaggtgaaccccctgggtatccccgttaactctaaggaacctgaggaggttgcgacctgcgtaggcagaaatggctatcccatcccgcaggttatatggtacaagaacgggcggcccctcaaagaggagaagaaccgggtgcacatccaaagttctcagacagtagagtcaagcggcctgtacaccctccaaagtatcctcaaggcgcaactggtaaaggaagataaggacgcgcaattttactgcgagctcaactacaggctgcctagcgggaaccacatgaaggagagtagagaggtcacagtgcccgtcttttaccccaccgagaaagtgtggctagaagttgagcctgtcgggatgttgaaggagggggacagggtagaaattcgatgtctcgctgatgggaatccgcccccccacttctcaatctccaagcaaaacccttctactagggaggccgaagaggagaccaccaacgacaatggggtgttggtgcttgagccagcccgaaaggagcactcaggcagatacgagtgtcaaggcctggatttagacaccatgatctcactgttatctgaaccgcaggagttgctcgtgaactacgtgtccgacgtccgagtctcacctgccgcaccagaacgacaggaggggagttcgcttaccttgacatgtgaagctgaatcctcccaggatttagagttccaatggctgcgggaagaaaccgggcaggtcctagaacggggtcctgtgctgcagctgcatgatttgaagagggaagcaggcggaggataccgttgtgtcgcttcagtgccttcgatcccgggattgaacagaacacaactcgtcaatgtagcaatttttggcccaccatggatggcttttaaggaacgcaaggtatgggtgaaggaaaacatggtcttaaacctgagttgcgaagctagtggccacccgcggcccaccatctcgtggaacgtcaatgggacagccagtgagcaggaccaggacccccagcgcgtgttatcaactcttaacgtgctggtcactcccgagctgctggagactggtgtagagtgcaccgccagtaacgaccttggcaaaaacacatccatcttgttcctcgaacttgtgaatcttaccactctgacccctgattccaatactaccaccggtctttctacatccaccgcatcccctcacacacgtgcaaatagcacgtcgacagaacggaaactgcctgagcccgagagccggggcgtcgtgattgtagcagtcattgtgtgcattctagttctcgcagttcttggggcggtcctctatttcctgtacaagaagggcaagctaccttgtcgacgatctgggaagcaagagattactctgcctcccagcaggaagagtgagcttgtggtggaggttaaatctgacaaactacccgaagagatgggcttgctgcagggcagctctggggacaaacgagcgcctggcgaccaaggcgagaagtacatcgatttgagacattag

SEQ ID NO: 24896 - DNA, 1584 bp, Artificial Sequence
  Description of Artificial Sequence: Synthetic coding sequence
atggtgtacatcgtgcggcagttcctgctgtacaacgtgagcggcagcgtctatttggatcagctgatcgtgctgttgaccgctaagttttccatcctgcgcattgccgggagccgggtacaccacagtcccttctcagggcatctcgatgggtgtagtttcctgtccctgcaacactccctacatacaagtctggatatgagcagacatgaaaatgtgtttctgggcctgacgctcagctccaaatccgccggtcttaaagggtttcagctagccttcgtacccgggctattacagggaacaggcggatatctcgacgggcccctgcccacacctgtcgataacccccgtgttgggttggaggtcgggctgcgattgtcgctaccgccactgcctccctgcccgggcgtacatatccaatcaagccaaactgtggaaagctcaggcctgtacaccctgcaatctatcctgaaggcacagctggtgaaagaagacaaagacgcacaattctattgcgagctgaattaccgtctgccgtccggaaaccacatgaaagagtcccgtgaggtaacagtacctgtgttctacccaactgagaaggtttggctggaggttgaaccagtggggatgctgaaagagggagaccgggtggagattcgttgcctcgccgatggaaatccacccccccatttttcgatctccaaacagaaccccagcaccagggaggctgaggaagagacaaccaatgacaacggtgtgctggtgttggaacccgcacgtaaggagcattcgggccgatacgaatgccagggcctggatctcgataccatgatctcgctgctttcagagcctcaggagttgctggtgaactacgtgagcgatgtgagggtgagtcccgccgcccctgaacgtcaggaaggttcttccctgacactgacatgtgaagctgagagcagccaggacctggaattccagtggttgcgtgaagagactggccaggtcctcgaaagaggccccgttttacaactgcacgatcttaagcgagaggcgggaggaggttatcgctgtgttgccagcgtcccaagcattcctggactgaatcgcactcagctggtgaatgtcgccatcttcgggccgccctggatggcatttaaggaacgaaaggtttgggtgaaagaaaatatggtgttgaaccttagttgtgaggcgtctggtcacccacgcccgaccatctcctggaacgtcaacgggacagcatcggagcaagaccaagacccccaaagggtcctctccacactgaatgtgctggtgacaccagaactattggagactggtgtcgaatgtaccgcctctaacgatcttggcaaaaacacgagcatcctgtttttggagctcgtgaacctaaccacacttactcccgatagcaatacaaccacgggcttgtctacatcaaccgcctcaccccacactcgcgcaaacagcacgagcaccggcaagcctgggttagctagggaacagggttgcgcacgggcctccttcctcccgtgcccatctcccgaaagtcccgtccagaaaggggagtag

SEQ ID NO: 24897 - DNA, 141 bp, Artificial Sequence
  Description of Artificial Sequence: Synthetic coding sequence
ggcgtggtgatcgtggccgtgatcgtgtgcatcctggtgctggccgtgctgggcgccgtgctctacttcctgtataaaaaaggcaaacttccctgcaggagatcaggtaagcaggagatggaaagaaacacatccatatag

SEQ ID NO: 24898 - DNA, 2253 bp, Artificial Sequence
  Description of Artificial Sequence: Synthetic coding sequence
atgggcaagagcgagagccagatggacatcaccgacatcaacacccctaaacccaagaagaagcagcggtggacccccctagagattagcctctcagtcctcgtgctgctcctgacgattatcgcagtgactatgatcgcactgtatgctacgtacgacgatgggatctgcaagagtagcgactgcatcaagtctgcggcgagacttatacagaacatggacgccacgacggagccgtgcacagacttcttcaagtacgcctgcgggggctggctaaaacgcaacgtgatccccgaaacttccagtcgttatggcaatttcgacatactcagagatgagctggaggtcgtgctgaaggatgtgctacaggagccaaaaaccgaggatatagtcgctgtgcagaaggccaaagctttatacagatcttgcatcaacgagagcgcgatcgactcgcgcggcggcgaacccctccttaaattattgccagatatatatgggtggccagtcgcgacagaaaactgggagcaaaaatatggcgcatcatggactgccgagaaagctattgcacagctcaactccaaatacggcaagaaggtactcataaatctctttgtcggtaccgacgataagaattccgtgaaccacgttatccacatcgatcaaccccgcttgggcctcccctcaagagactactacgaatgtacaggcatctataaggaggcatgcacagcctacgttgattttatgatctccgtcgctaggctcattcgacaggaggagcggctgccaatcgatgagaatcaacttgcgcttgagatgaataaggtgatggaattagaaaaagaaatcgcgaatgctaccgcgaagcccgaagacaggaacgatcccatgctgctgtacaataaaatgaccctcgcccagatccagaataattttagcctggaaattaacgggaaaccatttagttggcttaactttacgaacgagataatgtccaccgttaacatctcaatcacaaatgaggaagacgttgtggtctatgcgcccgaatatctcactaaactgaagcctatccttacaaaatattctgcaagggacctgcagaacctgatgagctggcgattcatcatggacctcgtttcttcactaagcaggacgtataaagaatccagaaacgcatttcggaaagccctgtatgggaccacctctgagacagccacttggcgacgatgtgctaactatgttaacggcaatatggaaaacgcggtgggtaggctgtacgtggaagccgcctttgctggcgagtcaaagcatgtcgtggaggatcttatagcgcagatccgtgaggtgttcatccagaccttggacgacttgacctggatggatgctgaaactaagaagcgagcagaggagaaggccctggccatcaaagagcgaatcggctatccggacgatattgtttcaaatgacaacaaactcaacaatgaatacctggagcttaattacaaagaagatgagtattttgaaaatataattcagaacttgaaatttagccagagcaaacagttgaaaaaattgagagaaaaggttgacaaggatgagtggatttccggtgcggcagttgtgaacgccttttacagcagtggccggaaccaaatcgtttttcccgctggcattctgcagcctccatttttttctgcacagcagtcaaactcgctgaactatggcggtataggaatggtcatcggccatgaaattacacatggttttgacgacaacggccgcaatttcaataaagacggagatctcgtggattggtggacacagcagagcgcatctaactttaaagagcagtcccagtgcatggtttatcagtatggcaatttctcctgggacttggcaggcgggcagcatctgaatggaataaacaccctcggcgaaaatatcgctgacaatggcgggctcggccaagcctatcgtgcctaccagaattacatcaagaaaaacggagaggaaaagcttctgccaggactggatctgaatcacaagcaattgttcttccttaactttgctcaggtatggtgtggaacttatcgacctgagtatgccgttaatagcataaagactgacgtccattctcccgggaatttcaggatcattggcacgctccagaactcagccgagttctcagaggcttttcattgtagaaagaacagctacatgaacccagaaaagaaatgccgcgtctggtag

SEQ ID NO: 24899 - DNA, 2253 bp, Artificial Sequence
  Description of Artificial Sequence: Synthetic coding sequence
atgggcaagagcgagagccagatggacatcaccgacatcaacacccctaaacctaaaaaaaaacagaggtggactcctttggagatcagcctctctgttctcgtgctgcttcttactatcatcgctgtaacaatgattgccctctatgcgacctacgatgacggtatctgcaagtccagtgactgtatcaaatcggccgcgcgcttgatccagaatatggacgcaactacagagccctgcactgattttttcaaatatgcttgcggagggtggttaaaaaggaatgtcattcccgagactagcagccgatatggcaatttcgacattttacgtgatgagttagaggtggttctgaaggacgtcctccaggaaccaaaaactgaggatatcgtagctgtgcagaaggccaaggcactgtacagatcctgtatcaatgagtcagcaatagactctcggggcggggagccgctgctgaaactcttacctgacatctacggctggcccgtcgcgacggagaactgggaacagaaatatggagcctcatggacggcagagaaggcaatcgcccagctgaacagcaaatacggcaagaaggtgctgatcaatctcttcgttggaactgatgacaagaattcagtgaaccatgtgatacacatagaccagcctcgactgggactaccttctcgtgattactacgagtgcaccggaatctataaagaggcctgcaccgcttatgttgacttcatgataagcgttgctcgcctgattcggcaggaagagcgattgcccatcgatgaaaatcagctggcactcgaaatgaacaaggtaatggaactggagaaggaaatcgctaacgccacagccaagcccgaggatagaaacgacccaatgcttctgtataacaaaatgaccctagcccagattcagaacaatttctcactggagattaatggcaaacctttttcttggctgaattttacgaatgagattatgtctaccgtaaacatttcaatcacaaatgaagaggacgtggtggtgtacgcaccggagtacttaaccaagctcaaacccatccttactaagtactccgcccgcgatctgcagaatttaatgagttggagatttataatggacctcgtgagctccttgtcccgcacatacaaggagtcaaggaatgcattccgtaaagcactgtatggaacaacttccgagacagctacttggcgtaggtgtgctaactatgtgaatggtaatatggaaaacgctgtcggccgcctttacgtggaggcagctttcgccggcgaaagcaagcatgtggtcgaggacctgattgcccaaattcgcgaagtctttatccagacgctggacgacctcacctggatggacgccgagacaaagaaacgagccgaggagaaggctctcgccatcaaggagcggattgggtacccagacgacattgtgagcaatgacaataagttaaacaatgagtatctagagcttaactataaggaagacgagtacttcgagaacataattcaaaacctgaaattctctcaatcgaaacagcttaaaaagctgcgggaaaaggtggataaggacgaatggatctcgggtgctgcggtcgtgaatgccttctactcttcaggccggaaccagatagttttccccgccggcatcctgcaacccccatttttctccgcccagcagtcgaacagtttaaactatggtggcataggcatggtcattggccacgagataacccacggcttcgacgacaatggacgaaattttaacaaggacggagacctggtcgactggtggacccagcagagcgcatctaacttcaaagagcagtcccaatgtatggtttatcaatacgggaatttttcttgggaccttgcaggcggtcagcatctgaacggtatcaatactcttggggaaaacatagccgacaacggcgggttgggccaggcctatcgcgcctaccagaattatattaaaaaaaatggtgaggagaagttgctgccaggactcgacctgaatcacaagcaactgttcttcttgaactttgctcaggtttggtgtggtacttaccgccctgagtacgccgtgaatagcattaagaccgacgtccattctccgggcaatttccgcataattggcacccttcaaaactctgctgagttcagcgaagcattccattgccggaaaaactcatatatgaaccctgagaagaaatgtcgagtgtggtag

SEQ ID NO: 24900 - DNA, 2253 bp, Artificial Sequence
  Description of Artificial Sequence: Synthetic coding sequence
atgggcaagagcgagagccagatggacatcaccgacatcaacacccccaagcctaaaaagaaacagcggtggaccccactcgagatctccctctcggtcctggttctcctcctgaccatcatcgcagtgactatgattgctctctatgcaacctatgatgacggaatttgtaaaagtagcgattgcattaaaagcgccgcaagactcatccagaatatggacgcaactaccgagccctgtaccgacttctttaaatatgcctgcggcggttggctgaagcggaatgtcatccccgagacctcctctcgctacgggaactttgacattctgcgcgacgaactcgaggtggtgttgaaagatgtgctccaagagcctaagaccgaggatatcgttgctgtccagaaggcgaaggcactctacagatcctgcattaacgaatctgctatagattcccgcggtggagaaccattgctcaaattactgccagatatttatggctggcccgtggctactgagaattgggagcagaaatatggtgcaagttggaccgcggagaaggctatcgcacagctgaacagcaagtatggaaagaaggttctaatcaacctgtttgtcggaaccgacgataagaacagcgtaaatcacgtgatccacatcgatcagcccagactgggcttacccagtagagactactacgagtgcactggcatttacaaggaggcctgtaccgcatacgtcgattttatgatatccgtcgcaagactaattcgccaggaggagagactgcccattgatgaaaaccagctggccttggagatgaacaaagtaatggagctggagaaggagatcgcaaacgctactgcaaagcccgaggatagaaacgaccctatgctgttgtataacaagatgactctggctcaaattcagaacaatttctcactggaaattaatggcaagcctttttcatggctcaatttcacaaacgaaataatgtctaccgtgaacatcagcatcaccaacgaggaggacgtggtggtctacgcaccggagtacctaacaaagctgaaacccatcttgacaaagtatagtgcgagagatttgcaaaacctgatgagttggcgcttcatcatggaccttgtctcgtcactctctagaacttacaaagagtcacgcaacgcgtttcgaaaggccctctacggcaccactagcgaaacggcaacgtggaggcgctgcgcaaattacgttaacgggaatatggagaatgccgttggcagactgtacgtggaagcagcatttgctggggagtctaaacatgtggttgaagatctgattgctcagattcgggaggtgtttatccagactcttgatgatttgacgtggatggacgccgagacgaagaaacgagctgaggagaaagccttagcaataaaggaacgaatcgggtatcctgacgatatcgtgagcaacgataacaagttaaataatgagtacttagagctgaactacaaggaggatgagtacttcgagaacattatccagaatctgaagttctcccaaagtaagcagctaaaaaagctgagggaaaaggtggacaaagacgaatggatttccggcgctgccgtggttaatgcgttctactcttcaggaagaaaccagatagttttccccgccggtatactacagcccccattctttagcgctcaacaatccaattccctcaattatggggggatcgggatggtcatcggtcatgagataacccacggcttcgacgacaacggcaggaactttaataaagatggtgatctggttgactggtggacacaacagtctgcaagcaattttaaggaacaaagtcagtgcatggtttatcagtacgggaatttttcctgggaccttgccggcggacaacatcttaacggcattaataccctgggtgagaatatcgctgacaacggcggcctcgggcaggcctaccgcgcataccagaattatattaaaaaaaacggagaagaaaagttgctgccgggcctcgacctcaaccataagcagctgttctttctcaatttcgctcaggtgtggtgtgggacatataggcccgaatatgctgttaatagcattaagacagatgtccattcaccgggcaatttccgaatcatcggcacgctgcaaaacagcgcagagttctctgaggctttccattgccggaagaactcttacatgaacccagaaaaaaagtgtcgggtgtggtag

SEQ ID NO: 24901 - DNA, 486 bp, Artificial Sequence
  Description of Artificial Sequence: Synthetic coding sequence
atgggcaagagcgagagccagatggacatcaccgacatcaacaccccaaaacccaagaagaagcagcggtggaccccccttgagatctcactctctgttcttgtcctgttgctcaccattattgccgtgactatgattgcgttatatgcgacctacgatgacggtatctgtaaatcttctgactgcattaagtcggccgcccggctgatccagaatatggacgcaacaactgagccttgcaccgattttttcaagtatgcttgtggcggttggttgaaacgcaatgtcatccccgaaacatcttccaggtacggcaatttcgacatactccgggatgagttagaagtcgtgctgaaagacgtgctacaagaacctaaaacagaggacattgtggcagtgcaaaaggccaaggcgctctatcggtcctgtatcaacgaatctgcaattgatagcaggggaggagagcctttgcttaaactcctctag

SEQ ID NO: 24902 - DNA, 282 bp, Artificial Sequence
  Description of Artificial Sequence: Synthetic coding sequence
atgggcaagagcgagagccagatggacatcaccgacatcaacacccccaaaccaaaaaaaaaacagaggtggactcccctcgaaatttccctgagcgtccttgtcttactgcttacaattattgcagtcaccatgattgctctttacgccacatatgacgacggaatctgtaagtctagcgattgtatcaagagtgctgcccgactcattcagaacatggatgctaccaccgaaccctgcactgatttcttcaagtatgcatgtggtggttggttgaagtag

SEQ ID NO: 24903 - DNA, 702 bp, Artificial Sequence
  Description of Artificial Sequence: Synthetic coding sequence
atgggcaagagcgagagccagatggacatcaccgacatcaacaccccgaaaccaaagaagaaacaacgatggacacccctggaaatttctctgtccgtgctggttctgctgctgaccattattgctgtcacaatgatcgctttgtatgctacttacgacgatggaatttgcaagtcctcggactgcatcaaatctgccgccaggctgatccagaatatggacgctacaactgagccctgcactgacttcttcaagtacgcgtgcggaggctggctaaagagaaatgtgatacccgaaacttcttcaaggtacgggaattttgatattctcagggatgagctcgaagtggtcttaaaggatgtcctccaggaacctaaaaccgaagatatcgtggctgttcagaaagccaaggctctgtaccgctcctgtattaatgaatctgctattgacagccgcggtggggagccgctgctgaaactgctgcccgacatctacggatggcctgtggccacagaaaattgggagcagaagtatggcgcctcctggactgcggagaaggccatagctcaattaaatagcaagtatggcaagaaggtgttgatcaatctgttcgtgggcaccgatgacaagaacagcgttaatcatgttatccacattgaccagccccgactggggttaccaagcagggactattatgaatag

SEQ ID NO: 24904 - DNA, 360 bp, Artificial Sequence
  Description of Artificial Sequence: Synthetic coding sequence
atgggcaagagcgagagccagatggacatcaccgacatcaacacccccaagccaaaaaagaaacagcggtggactccactggaaataagcctgtccgtgctggtgctgctgctgacgataattgcagtgactatgattgcactatatgcaacgtatgacgacgggatatgtaaatcatccgactgtataaaatcggcagccagactgatacagaacatggacgccacaaccgagccctgtaccgatttctttaagtacgcttgcgggggttggctgaaacggaacgttatccctgagacttcttcccgatatggaaattttgatatcctgcgcgacgaattggaggttgttcttaaatag

SEQ ID NO: 24905 - DNA, 2253 bp, Artificial Sequence
  Description of Artificial Sequence: Synthetic coding sequence
atgggcaagagcgagagccagatggacatcaccgacatcaacacccctaagcccaagaaaaagcaacggtggacaccgctcgagatcagtctgtccgtgttagtactgctgcttaccatcattgcagttactatgatagccctctacgcaacgtacgacgacggcatctgcaagagcagcgactgcatcaagtccgccgcccgcttgatacagaacatggatgcaaccacagaaccctgcacggattttttcaaatatgcctgcggtggatggctaaaacggaacgtaattcccgagaccagtagcaggtatggcaattttgatatcctgcgagatgagctcgaagtggttctaaaggatgtgcttcaggaaccaaaaaccgaggatatcgtggccgtgcaaaaagcaaaggccctgtaccgaagctgtataaacgaatctgccatcgattctcgggggggagagcccctcctgaaactccttcctgacatctatggttggccagtggcaacagagaactgggaacaaaaatatggggcctcctggacagccgaaaaagcaatcgcccaactgaattcaaagtatggcaagaaggtgctgatcaatctcttcgtgggtactgatgacaagaactctgtgaatcacgtgatccacatcgatcagccacgacttggactgccatcacgtgactactacgagtgcactgggatctacaaggaagcctgtaccgcctacgtcgacttcatgatttccgtggcgcgattgatccggcaagaggagcgactgcctatcgacgagaaccaattggcactggagatgaataaggtgatggagctggagaaagaaatcgccaatgctaccgctaagccggaggataggaacgacccaatgctcctctataataaaatgaccctcgcccagattcagaacaatttctcacttgaaatcaatggaaaacctttcagctggctgaatttcacaaatgagatcatgagcacagtgaacatcagcattacaaacgaagaggatgtggtcgtttatgctcctgaatatttaacaaaactgaagcccatcctgacaaaatattccgcccgagacctacaaaatttaatgtcttggcgctttatcatggatctcgtgtcatccctttctcgcacctataaggagtctaggaacgcttttaggaaggccctgtacggcactacttccgagaccgcaacttggcggagatgtgccaactacgtcaacggtaatatggagaacgccgtaggtcggctatatgtggaggcggcattcgcaggtgaatccaagcacgtcgttgaagatcttattgctcagattagagaggtctttattcagacactcgacgatcttacctggatggatgccgagacgaaaaagagagccgaggagaaagctcttgccatcaaagagaggatcggttacccagacgatatagtatcaaatgacaataaactgaacaatgaatacctggagctcaactataaggaggatgagtactttgaaaacatcatccagaacttgaagttctctcagtccaagcagctcaagaagctccgagaaaaagtggataaggatgagtggatctccggcgcagccgttgtgaacgcattctatagctctgggagaaaccagatcgtttttcctgcagggatacttcagccgcccttcttttctgctcagcagagcaactcactcaactatggtgggatcggcatggttatcggccacgagattactcacggttttgatgataatgggagaaacttcaacaaagacggggacctggtggattggtggacccagcagtcggccagcaactttaaagagcaaagccagtgcatggtttaccaatatggaaacttcagctgggacctggccgggggccaacacttaaatggaatcaataccctgggcgagaacatagcagataacggaggtctcggacaggcttacagagcatatcagaattacattaagaagaatggggaggaaaagttgcttcctggactggacctcaaccacaaacagctgtttttcttgaattttgctcaagtctggtgtggcacctaccggcctgagtacgccgtgaattcaatcaagaccgacgtccactcacctggtaatttcaggattattggcactctgcagaattctgccgaattttcagaagcattccactgtcgcaagaactcctatatgaaccccgagaagaagtgtcgcgtgtggtag

SEQ ID NO: 24906 - DNA, 2253 bp, Artificial Sequence
  Description of Artificial Sequence: Synthetic coding sequence
atgggcaagagcgagagccagatggacatcaccgacatcaacacccccaagcccaaaaagaagcaaaggtggaccccacttgagatttctctctctgtgctggtgctgttgttaaccattattgctgtgacaatgatcgccctgtacgcaacctacgacgatggtatttgtaagtcttctgactgtatcaagtctgccgctcggctgattcaaaacatggacgctacaacagaaccatgtaccgacttttttaagtatgcctgtggtggctggctgaagcgcaacgtcatacctgagacctcttctagatatggcaacttcgatatcttaagggacgagcttgaagtggtacttaaggacgtgctgcaggaacctaaaactgaggacattgtggcagttcagaaagccaaggccctttataggagttgtataaacgagagtgctatagacagcaggggcggagagcccctcctgaagttgctccccgacatttacggctggcccgtggcaactgaaaattgggagcagaaatatggagcaagttggacagcagagaaggctattgcccagcttaactccaagtatggcaagaaagtgttgattaatttgtttgtgggaaccgacgataaaaattccgtgaatcatgtaatccacattgaccagccgcgcctgggactgcccagccgcgattactacgagtgcacgggaatctacaaggaggcttgcactgcctacgtcgatttcatgatatccgtcgcacggctcatacgtcaggaagagcgcctgcccatcgatgagaaccagctagctttggagatgaataaagtcatggaactggaaaaagagattgccaatgctactgcaaagccagaggaccgaaatgacccgatgcttctgtacaacaaaatgaccttagctcagatccagaacaactttagccttgagataaatggcaaaccattctcatggctgaacttcaccaatgagatcatgtctacagtaaatatcagtattacgaacgaggaagacgtggtggtctacgctcccgagtacttaactaaacttaaacctatcctcacgaagtacagcgcccgcgacttgcaaaatcttatgtcatggaggttcatcatggacttggtgtccagtctgtcccgtacatacaaggagagccgcaatgctttccggaaagccctttacggtacaacctcagagacagctacctggcgcaggtgtgccaattacgttaatggaaatatggagaacgctgtgggcaggctgtatgtagaggctgcttttgcaggagagtcaaaacatgtcgtggaggacctaatagcccagatccgggaagtttttatccaaacactggacgatctgacatggatggatgctgagaccaagaagagagccgaggagaaggcgctggctatcaaagagcgcattgggtatcctgatgatatcgtgagcaatgacaacaagttgaacaatgaatacctggagcttaattataaggaggacgaatactttgagaacatcattcagaatttgaagtttagccaaagcaagcagctgaagaaacttcgagagaaggtggataaggatgaatggatctcaggggccgcggtggtgaatgcattctactcctctgggcggaaccaaatcgtgttcccggccggcatattgcagcccccattcttcagtgcacagcagtctaacagcctaaactacggggggatcggcatggtgatcgggcacgaaatcacccacggtttcgacgacaatggaagaaactttaacaaggacggagacctggtagactggtggacccaacagtcagcctcgaatttcaaggaacagagccagtgcatggtgtaccagtatggcaacttctcctgggatttagctggtgggcagcaccttaatgggattaacacactgggcgaaaatatcgccgacaacgggggactgggacaggcctaccgagcttaccaaaattacattaaaaagaatggggaagaaaaactgcttccaggactcgacttgaaccataagcaactgttttttttaaattttgcccaggtgtggtgtggcacgtacagacccgagtacgcagtgaactccatcaagactgatgtgcattcccctggaaattttcgtattatcggcaccctgcagaatagcgctgaattcagcgaggctttccattgccggaaaaattcatatatgaatccggaaaagaagtgccgtgtatggtag

SEQ ID NO: 24907 - DNA, 48 bp, Artificial Sequence; identical to SEQ ID NO: 11443
  Description of Artificial Sequence: Synthetic coding sequence

SEQ ID NO: 24908 - DNA, 894 bp, Artificial Sequence
  Description of Artificial Sequence: Synthetic coding sequence
atgaccaccccccggaacagcgtgaacggcaccttccccgccgagcccatgaaaggtccaattgcaatgcagtcagggcccaagcctttatttcgtcgcatgtcctctctggttggccccacccagtcctttttcatgcgtgaaagcaagactttgggagcagtgcagatcatgaacggactgtttcacatagctcttggcggacttctgatgattcccgccggaatatatgcccccatctgcgtcacagtgtggtatcctctttgggggggtatcatgtacataatttccggcagtctgcttgccgccacagaaaagaattcccgaaagtgcctggtgaagggcaagatgatcatgaattccctgtccctgtttgcagccatcagtgggatgattctctctattatggatattcttaacattaagattagccacttcctcaaaatggaatcactcaactttatcagagctcacacaccatacattaatatctataactgcgagcctgctaaccccagcgaaaagaactccccttcaacacagtactgttactctattcagagtctgtttttgggcatcctctcagtcatgcttattttcgctttttttcaggaactggtcatcgccgggattgtcgaaaacgaatggaagcgcacttgttcgagacctaagagtaacatcgtcctgctcagcgcagaggagaagaaagagcagactatagaaatcaaggaggaggtggtgggtctgacggaaacgagttcccagcccaagaatgaagaggatatcgaaatcataccgattcaggaggaggaggaggaggaaactgaaaccaactttcctgaacccccgcaggatcaagagagctcgcccattgaaaatgacagctctccctag

SEQ ID NO: 24909 - DNA, 894 bp, Artificial Sequence
  Description of Artificial Sequence: Synthetic coding sequence
atgaccaccccccggaacagcgtgaacggcaccttccccgccgagccgatgaagggccccattgcgatgcagtctggacccaagccactgtttcggcgcatgtcaagcttagttgggccaacccagtctttttttatgagagaatccaagaccctgggcgccgtacagatcatgaacggcctgttccatatcgcccttggcgggttgttgatgatccctgcggggatctatgcacctatctgtgtgaccgtgtggtacccgttgtggggtggcataatgtacatcatttctggcagtttacttgcagcaacagagaaaaattcacgaaaatgtctggtgaaggggaaaatgattatgaacagcttgagcctctttgccgcaatttccggcatgatcttgagcattatggacatcctaaacattaaaatttcacatttccttaaaatggagagccttaacttcatcagagcccatacgccatacatcaacatctacaactgcgagcctgccaatcctagcgaaaagaacagcccatccacccagtattgttattcaatccaatccttgtttctggggatcctgtccgtgatgcttattttcgcgttttttcaggagttggttatcgcgggaatcgtagagaatgaatggaagaggacatgttctaggccgaaatcaaatatcgtgcttttgtccgccgaggaaaagaaagagcagaccatcgagatcaaggaggaggtcgttggactcacggaaaccagctcacagccgaagaacgaggaagacattgaaataatcccaatccaggaagaggaagaggaggagacagagactaatttcccagaaccaccacaggatcaggagagtagccccattgaaaatgactcttcgccttag

SEQ ID NO: 24910 - DNA, 24 bp, Artificial Sequence
  Description of Artificial Sequence: Synthetic coding sequence
atgaccaccccccggaacagctag

SEQ ID NO: 24911 - DNA, 855 bp, Artificial Sequence
  Description of Artificial Sequence: Synthetic coding sequence
atgaccaccccccggaacagcgtgaacggcaccttccccgccgagccaatgaaaggtcccattgcgatgcagagcggaccaaagcccctgtttcgccgtatgtcctctctggtgggcccaactcagtctttcttcatgcgcgagagtaaaactctgggagctgtgcaaatcatgaatggcctcttccacatcgccttgggaggtctactaatgattcctgcaggtatctacgcaccaatctgtgtgaccgtttggtacccactctggggcggcattatgtatatcatctcaggctcgctgttggcagccacagagaagaacagccggaagtgccttgtgaagggcaaaatgatcatgaacagcttgtctctcttcgccgccatcagtggcatgattcttagcataatggacatcctcaatataaagatctctcacttcctgaaaatggagtccctcaattttatccgagcccatactccttatattaacatctataactgcgaacccgcaaatccttctgaaaagaattcaccaagtacccagtactgttactctatacagtcactcttcctggagctggtaatcgcaggcatagtggagaatgaatggaagagaacttgctcacgcccaaaaagtaatatcgtgttgctcagcgctgaggagaagaaagaacagactattgagatcaaagaagaggtcgtcgggctcaccgaaactagttctcagccaaagaacgaagaagacatcgagataattcctatccaagaggaggaagaagaagagacagaaactaactttcccgagcctccccaggaccaggaatcctctccaattgagaatgatagtagtccttag

SEQ ID NO: 24912 - DNA, 21 bp, Artificial Sequence
  Description of Artificial Sequence: Synthetic coding sequence
atgaccaccccccggaactag

SEQ ID NO: 24913 - DNA, 894 bp, Artificial Sequence
  Description of Artificial Sequence: Synthetic coding sequence
atgaccaccccccggaacagcgtgaacggcaccttccccgccgagcccatgaaagggcccattgcaatgcagtccggacctaagcccctgttcagacgcatgagcagcttggtcggaccgacccagtcattttttatgagggaaagtaaaaccttaggtgcggtgcagatcatgaacggtctgttccacatcgctctcggcggcctgctgatgatacccgcgggcatatatgcaccaatctgcgtgacagtgtggtacccactgtggggcggcatcatgtatattatttccggatcccttctcgccgctaccgagaaaaacagcagaaaatgcctggtgaaagggaagatgataatgaactctctgtcgcttttcgcagctatttccggaatgattcttagtatcatggacattttaaacatcaagatctcacacttcctgaagatggagtctttaaatttcattagagctcacacaccgtatattaacatctataattgtgagccggcaaaccctagtgagaaaaactccccctccacacagtactgttactctatacaatcattgttcctggggatattaagtgtgatgctcattttcgcgttctttcaggaacttgtgatagcagggatagtcgaaaacgagtggaagcgcacgtgtagcaggcctaaaagcaatatagttctcttgtccgcagaggaaaaaaaggaacagacgatcgaaattaaggaagaggtggttgggcttactgaaacgagttctcagccaaaaaatgaggaagatatcgaaataatccccattcaagaggaggaggaggaggaaactgaaactaatttccctgagcctccacaggaccaggaatctagccccatcgaaaatgactctagtccctag

SEQ ID NO: 24914 - DNA, 930 bp, Artificial Sequence
  Description of Artificial Sequence: Synthetic coding sequence
atggacgaccagggctgcccccggtgcaagaccaccaagtaccggaatccctcacttaaacttatggtgaatgtctgcggccacaccctgtgtgaatcttgtgttgatttactcttcgttcgaggcgccgggaactgcccagagtgtggcacacctctgaggaagagtaacttccgggttcaattgtttgaggatcccaccgtggataaagaagttgagattcggaagaaagttttgaagatatacaacaagagggaggaggactttcctagcctaagagaatataatgacttcctggaagaggtggaggagattgtctttaacctcacaaataacgtggacctggataacaccaagaaaaagatggagatctatcagaaggaaaacaaagacgtgatccagaaaaataagctgaagttgacaagggagcaggaggaactcgaggaagccctggaggtcgaacgccaggagaacgaacagcgcagactgtttatccagaaggaagagcagctgcagcagatccttaaaaggaaaaataaacaggctttcttggatgaactggagagttcagatttaccagtggcattgctactggctcaacataaggatcgcagtacccagctggaaatgcaattggaaaagcctaagcccgtgaaacctgtcaccttttcaaccggcatcaaaatggggcagcatatcagtctggccccaattcataagctggaggaggcactttatgagtaccagcctctacagatagagacctacggcccgcacgtgcctgagctagagatgctgggtaggctgggctatttaaaccacgtgcgagcggcatctccccaggacctcgcaggcggatacacgtctagtttggcatgccatagagctttgcaggacgcctttagtggcttattttggcaaccgtcatag

SEQ ID NO: 24915 - DNA, 804 bp, Artificial Sequence
  Description of Artificial Sequence: Synthetic coding sequence
atggacgaccagggctgcccccggtgcaagaccaccaagtaccggaacccatccctgaaactgatggttaacgtatgcggtcacactctgtgtgaaagttgtgtagaccttttattcgtgaggggggccgggaattgtccagaatgcgggacacctctgagaaagtctaatttccgcgtgcagctcttcgaagatcctacagtggataaggaagttgaaatacggaagaaggtgctgaaaatctataacaagcgcgaagaagattttccctctctgagagagtataacgacttcctggaggaagtggaagagatagtctttaacctcacaaataacgtagacctcgacaacactaagaagaaaatggagatataccagaaggagaataaagatgttatacaaaaaaataagctgaaactgacccgcgaacaggaggaactcgaagaagccttagaggtggaacgacaagagaatgaacagcgtagactcttcatccagaaagaggaacagttgcagcagatcctcaagagaaaaaacaaacaggcatttctcgatgaactcggacaacacatatccctggccccaattcataagttggaggaggcactttatgaatatcaaccacttcagattgaaacatacggcccgcacgtaccagagctggagatgctcggcaggcttggctatttaaaccatgtcagagccgcctccccacaggatctggccggcgggtatacaagctctctggcgtgtcaccgcgcgctccaggacgccttttcaggtctgttctggcaacctagctag

SEQ ID NO: 24916 - DNA, 510 bp, Artificial Sequence
  Description of Artificial Sequence: Synthetic coding sequence
acccgggagcaggaggagctggaggaggccctggaggtggagcggcaggagaacgaacagcggcgcctgttcatacagaaggaggaacagttgcagcaaatactgaagaggaaaaataaacaggctttcctggatgagttggagtcgtctgatttgcccgtcgcccttctgcttgctcagcacaaggaccggagtacgcagctggaaatgcagcttgaaaaaccaaaaccagtaaagcctgttacgttctcaactggaatcaaaatggggcagcacatctctctcgccccaatccataagttggaggaggccctctatgaatatcagccactccagatagagacctatggaccacacgtacccgagcttgagatgctggggcgcctcgggtatttgaatcatgtacgggctgcatctcctcaggacctcgctggggggtatacatcctccctagcctgccatcgcgcactgcaagatgcgttcagcggtctgttctggcaaccctcctag

SEQ ID NO: 24917 - DNA, 3963 bp, Artificial Sequence
  Description of Artificial Sequence: Synthetic coding sequence
atgttcggcctggaccagttcgagccccaggtgaacagccggaacgcgggacagggcgagcgcaacttcaacgagactggcttatcaatgaatacccacttcaaagccccagcctttcacacaggcgggcctcctggccccgttgatccagcaatgagcgcgcttggcgagcctccaattctgggtatgaatatggaaccctatgggttccacgctaggggccatagtgaactgcatgcaggcgggttgcaagctcagcctgttcacggcttctttggcggccaacagcctcaccacgggcaccccgggtcccatcacccgcatcagcatcacccccacttcgggggcaacttcggcggccccgaccccggggctagctgcctgcatggcggtaggctgctgggttacggtggcgccgccggaggactgggaagccagccaccctttgctgagggctacgagcacatggcggagtctcagggacccgaatcttttggtccacagcgaccgggtaatcttcccgactttcactctagcggggcgtcctctcacgctgttcctgctccatgtctcccacttgaccagtcccccaatcgtgctgccagcttccacggccttccttcttcatccggtagcgactctcacagtctcgagcccaggagagtcaccaatcaaggggccgtcgatagcctggagtacaactaccccggggaagcaccttccggacacttcgatatgtttagtcctagcgactccgaaggacagctaccgcactacgcagctggccgtcaggtccccgggggcgcattcccgggagcttcagccatgcccagagccgccggaatggtcgggttgtcaaagatgcacgcacaacccccccaacagcagcctcagcagcagcagcaaccgcagcagcagcagcagcagcatggagttttctttgagaggttttctggcgcgcggaagatgcccgtcggcttggagccaagcgtcggttcgagacatccgctcatgcaaccgcctcaacaggcgcctcctccacctcagcaacagccgccgcaacaacctccacagcaacaacctccgcccccccctggcctactggtgcgacagaattcatgtccaccggcccttccccgtcctcagcagggtgaagccggaactccatctgggggcctgcaggatggcggtccgatgctcccttctcaacacgctcagtttgagtatcccatccataggctggagaatagatccatgcatccatatagtgagcccgttttctccatgcagcacccgcccccccagcaagctccaaaccaaagacttcagcacttcgatgcaccgccatacatgaacgttgctaagaggccccgtttcgactttccaggcagcgccggcgtggaccggtgcgcctcctggaatggaagcatgcacaatggcgcgttggacaatcacctatcgcccagcgcttaccctggcctgcctggcgaattcaccccccctgtaccggatagttttccatctggcccccccttacagcatccggcccctgaccaccagtctctgcaacagcaacaacagcaacagcaacagcagcaacagcagcagcagcagcaacagcaacagcaacagcaacaacagcagcagcaacgccagaacgcagcgctgatgataaagcagatggctagtaggaatcagcagcagcgactgagacagcccaatctggcgcagcttgggcatcccggcgacgtgggtcaagggggcctggtccacggaggccccgtggggggcctggctcagcctaactttgagagagagggcgggtccacgggtgccggaaggcttggaaccttcgagcagcaagctccccacctggctcaggagtcagcgtggttcagcggtcctcaccctccgcccggagatctcctgcctaggaggatgggaggctctggactgcctgccgattgtggcccacatgatccttctctggctcctcctccacctccaggaggtagcggtgttctctttcgggggccccttcaggaacctatgcgcatgccgggcgagggtcatgtccctgcccttcctagccccggactgcagttcggtggaagcttaggaggccttggccaattgcaatctcctggagcaggcgttggtctgccgagcgccgcgagcgaaagacgccctccaccaccagacttcgcaaccagcgccctgggcggccaacctgggttccctttcggtgccgcaggtaggcagtcaacgccccatagcggtcccggtgttaattctcctccgtcggctggcggcggggggggttcttccgggggaggaggcgggggcggtgcctacccaccccagccagactttcagccgagtcagagaacttcggccagcaaacttggggcactgagtctcggcagcttcaacaagccttcaagcaaagataatctcttcgggcagagctgccttgccgcgctgagcacagcatgtcagaacatgattgcttcccttggcgcccccaatcttaatgtcaccttcaacaagaagaatccccccgagggcaagaggaagctttctcagaatgaaaccgacggagccgcagtagccggcaaccctgggtctgactatttcccaggcggcaccgctccaggcgccccagggcccggtggccccagcgggacgtcatccagcggcagtaaggcctcaggtccaccaaatccgccagcccagggggacggcacctctctctctcctaactataccctcgagagtactagcggaaacgatggtaagcccgtgtctggcggaggggggaggggcagaggacggcgaaagcgggacagtggccatgtttcaccagggacattctttgacaagtacagcgccgctcctgactccggtggagcccctggagtgtcacccggccagcagcaggcctctggtgccgcagtcggtgggtcctcagccggggagactcgcggcgcacctacccctcatgaaaaggctctcaccagtcctagctgggggaaaggggccgaactacttttgggcgaccaaccagatttgattggcagtctggacgggggggcaaagtccgattccagctcccccaacgtgggagagttcgcatcagatgaggttagtaccagttatgcgaacgaagacgaggtgagctcctctagcgacaatccccaggcccttgtcaaggcctctcggtctcccctggttaccggcagtcccaagctgccacccaggggtgtaggggcgggagaacacggtcccaaggcaccaccgcccgcgcttgggctcggcattatgtctaattctactagcactcccgattcctatgggggcggtggtggacccggccaccctggcactcccggactggaacaggtcagaacgccaacatcatcttctggcgcaccgcccccagatgagatccatccacttgaaattctgcaggcgcaaatccagctgcagaggcaacaattctccatatctgaggatcaaccactgggattgaaagggggcaagaaaggagagtgcgctgtgggcgcctctggtgctcagaatggagattctgagctcggttcctgctgcagcgaggctgtaaaatccgcaatgtccactattgatctcgacagcttgatggctgagcactccgctgcatggtatatgcctgctgacaaggccttggttgatagtgccgatgatgataagactctcgctccgtgggaaaaggccaaaccacagaatcctaatagcaaggaagcacacgatttgcccgccaacaaagcatcagcgagtcagcctgggagtcatctgcagtgtctgtccgtccactgtacagacgatgtcggggacgcaaaggctcgtgcaagcgtgccaacatggagaagtctgcacagcgatatctcgaacaggttcggcacttttgtggcggcattaacctag

SEQ ID NO: 24918 - DNA, 4227 bp, Artificial Sequence
  Description of Artificial Sequence: Synthetic coding sequence
atgaaggcccccgccgtgctggcccccggcatcctggtgctgctgttcacacttgtgcagaggtcaaatggcgagtgcaaagaagcgctcgccaaatctgagatgaacgtcaatatgaaataccagctcccaaattttaccgctgagaccccgattcaaaacgtgattctccacgaacaccacatttttctgggggccacaaattacatttatgttcttaacgaggaagacctgcagaaagtcgcggaatacaaaaccggccccgtgctggaacacccggactgtttcccctgtcaggattgctcctctaaggcgaacctttctgggggtgtatggaaggacaatatcaacatggctctcgtggtcgatacctattatgacgaccagctcatctcctgcggcagcgtgaatagggggacctgccaaaggcatgtctttccacataatcacacagccgacatccagtcagaagttcactgcatattctcacctcaaatagaagaaccctcccaatgccctgactgcgttgtgtcggccctgggagccaaggtgctgtctagtgtgaaagatcggtttatcaatttcttcgtcggaaacacaatcaattcatcatattttccagatcatcccctgcactcaatttctgtgcggcgcctcaaagagacaaaggacggtttcatgtttttaacagaccagagctatatcgacgtcttgcccgagtttagggactcatatcctatcaagtacgtccatgccttcgaatctaataatttcatctatttcttgacagtacagcgcgagacactcgacgctcagacttttcatactcgaatcattcgtttttgctccataaattctggattgcactcctacatggagatgcctctcgaatgtatcctcactgagaaacgaaagaagcgtagtactaaaaaagaggtgtttaacatcctgcaggccgcttatgtgagtaaacccggcgctcagcttgcgcggcagataggagcctcgctcaacgacgatatcctgtttggcgttttcgcccagtcaaagcctgacagtgccgagcccatggataggtctgcaatgtgcgcctttcctataaagtatgtcaatgacttcttcaacaaaatagtcaacaaaaataatgtccggtgcctccagcatttttatggccctaaccatgagcattgcttcaaccggacgctgctgcggaattcttccggatgcgaagcccgcagagatgagtacaggacagagttcacaaccgcactgcagagggtggatctgttcatgggtcagttttcagaggtcctactgactagcatctccacctttatcaagggtgacctgactatcgcaaacctcggtacaagcgaggggcgatttatgcaagtggtggtcagtagaagcggtccttctacacctcatgttaattttctgctcgattctcacccagtgtctcccgaagtgatcgtcgagcacaccctgaaccaaaatggctacaccctcgtgattactggaaagaagatcacaaaaatacctctgaacgggctgggctgtcgccattttcagagctgctctcagtgtctgtccgcaccgccattcgtccagtgcgggtggtgccatgataagtgcgtacgatctgaagaatgccttagtgggacctggactcaacagatctgtctaccggccatatacaaagtctttccaaacagcgcccctctggaagggggtactcgcctgactatctgtggctgggattttggattccggcgcaacaataaatttgatctcaagaagacgcgcgtactgttaggcaatgaaagttgcacactcacgctctccgaaagtactatgaacacactgaagtgcactgtgggacctgcaatgaataagcactttaacatgtccattatcatctctaacggacacggaaccacccagtatagtacattctcctacgtggaccctgtgatcactagcattagccccaagtacggtcctatggccgggggtaccctcctaaccctaactggtaactatttgaactctgggaactctagacacatttccatcggaggaaagacatgtaccctgaaatccgtttcaaatagcatcctggaatgctacacccctgcccagacgatttccaccgagtttgccgttaaacttaagatcgatctggccaatagagagacttccattttttcctatcgtgaagaccccatcgtatacgaaattcaccctaccaaatctttcatttccacttggtggaaagagccactgaatatcgtgagcttcttgttttgtttcgccagcggcggaagcaccatcaccggcgtggggaaaaatcttaacagcgttagcgtgcccagaatggtcattaatgtgcacgaggctgggcgcaatttcacagtagcctgtcaacatagatctaatagcgagatcatttgctgtacaaccccaagcctgcagcaactgaacctgcaactgcccttaaagaccaaggccttcttcatgctggatggaattctgtcaaagtacttcgatctcatttacgttcataatcccgtattcaaaccttttgaaaaaccggtgatgattagcatggggaacgagaacgtgctggaaatcaaaggaaatgatattgatcctgaggccgtgaagggggaggtgctcaaggtgggcaacaagtcctgcgaaaacatccatttacacagcgaggcagtgctttgcacagtgcccaatgatctgctaaaacttaattcagagctgaatatcgagtggaaacaggctatctcctcgacagtgttggggaaagtcatcgtccaacccgaccagaatttcacagggctcatcgcaggggtcgtgtcgattagcaccgccctcttgctgctgctgggctttttcctctggctcaaaaaacgtaagcaaattaaggatctgggtagcgaacttgtacgctatgacgccagagttcacacccctcaccttgaccgtctggtgtctgccaggagcgtgtctccgaccacagagatggtgtctaacgagtctgtagactatcgcgcaacattccccgaagaccagttccctaattcaagccaaaacggctcttgcaggcaggtgcagtaccccctgactgacatgagccccatccttacttctggagactctgatatatccagcccactccttcaaaacacggttcacatcgaccttagcgctttgaacccagagttagtccaggccgtgcagcatgtagtgattggtccctctagcttaattgtgcacttcaatgaagtgattgggcgtggtcatttcggttgcgtttatcacggtactctgcttgacaacgatggaaaaaagattcattgcgcagtaaagtcactcaaccgaataacggacatcggtgaagtgtctcagttcctcacggaggggattattatgaaggacttttcacaccccaatgtgctgtcactgctcgggatctgtctccgatctgagggatctccactggtggttcttccttacatgaagcacggtgacttgcgcaacttcatacgtaatgagacccacaacccgaccgtaaaggacctcataggttttggcctccaggtggccaaggggatgaaatatctggcgagtaagaaatttgtccaccgagatctggccgctcggaactgcatgcttgatgagaagttcacagtgaaggtagctgacttcggccttgccagagatatgtatgataaagagtattacagcgtacacaataaaactggagctaaactgcctgttaaatggatggcccttgagtcattacagacccagaagttcacaactaagtcagatgtctggagcttcggcgtcctgctttgggaactcatgaccaggggagccccaccttaccccgacgttaatacctttgacatcactgtctacctgctgcagggacgccggctgctgcaaccggaatattgtcctgatccattgtatgaggtcatgttaaagtgttggcaccccaaggctgaaatgaggccatctttctcggaactagtcagccgtatcagcgctatattctccacattcattggggaacactatgtacatgtcaacgccacctatgtcaacgtgaaatgtgtggcaccgtacccatctttactgtcttccgaagacaatgcggacgacgaggtagatacgaggccagcctctttttgggaaacgagctag

SEQ ID NO: 24919 - DNA, 4173 bp, Artificial Sequence
  Description of Artificial Sequence: Synthetic coding sequence
atgaaggcccccgccgtgctggcccccggcatcctggtgctgctgttcactctggttcagcgctcaaacggcgagtgcaaggaagcactagcaaagtctgagatgaatgtcaacatgaagtaccagttgcccaatttcacagccgagactcccatccagaatgtgatcttgcacgagcaccacatcttcctcggcgctacaaactatatttacgtgcttaacgaagaggacctgcagaaggtcgcggaatataagactggaccggttctcgaacaccccgattgctttccctgccaagattgctcatccaaagcaaatctgtctggcggagtttggaaagacaacatcaatatggctctcgtcgtggacacgtactatgatgaccagctgatctcttgtggcagcgtgaatcggggcacatgtcagcggcacgtgttccctcacaaccacactgctgacattcaatctgaagtgcattgcattttttcaccgcagatcgaggagccatcccagtgtcctgactgtgttgtgtctgcactgggggccaaggtcttgtcctctgttaaggatagattcatcaactttttcgtcggcaacactattaactcctcatactttcctgatcatcctctgcacagtatcagcgtgcgtcggcttaaggagacaaaggatggattcatgttcttgacagaccaatcttacattgatgtgctccctgagttccgtgactcttacccgataaagtacgtccacgcattcgaatcaaataacttcatatatttccttacagtccagagagagactctcgacgcccaaactttccacaccagaattataagattctgcagcattaattcaggtctgcatagctacatggaaatgcccctcgaatgcatcttgaccgagaagcgtaagaaaagatctacgaagaaagaggtgttcaacattctgcaggcagcatatgtgtctaagccaggcgcgcagttagctaggcagattggcgctagtctaaacgatgacatcctttttggcgtgtttgctcagtccaaacctgacagtgccgaacccatggacagatcagcgatgtgtgcatttcctattaaatacgtaaatgacttctttaataagattgttaataaaaacaacgtgaggtgcttgcagcacttttatggccctaatcacgaacattgtttcaaccgcactctcctccgtaactccagtgggtgcgaggcccgtagagatgagtatcggaccgagttcaccaccgctctccagcgggttgatctctttatgggccagttctcagaggtcctgcttacctctatctctacctttattaaaggagatttaaccattgccaacctcggaacctctgaggggagattcatgcaagttgtagtgtctcgctctggaccctctacgcctcatgtgaactttttactggattcccatcctgtttcaccagaagtgatcgttgaacacaccttgaatcagaacggctacaccctagtgataacaggcaagaaaatcacaaagatccctctcaatgggctgggttgtcgccactttcaatcctgctcgcaatgtctttctgccccccctttcgttcagtgcggttggtgccatgataagtgcgtgcgttccgaggaatgcctgtccggaacctggacacagcaaatatgtttgcctgccatctataaggtcttccccaactccgccccgttggagggtggaacgcgattaacaatttgtggctgggacttcggctttaggcgcaataataaattcgaccttaaaaagacccgggtgctgctcggcaacgaatcctgcacacttactctgtccgagagtaccatgaacacactgaagtgcacagttggacccgcgatgaataaacacttcaacatgagcataattatcagcaatgggcatggaaccacgcagtacagtacattcagctatgtggatcccgtgattacgagtatctcgccgaaatatgggcctatggccggcggaactctgctaactttaacaggcaactacttaaattcaggcaatagtcgccacataagcatcggaggaaagacctgcaccctgaagagtgtcagtaattcaatcctcgaatgttacacgcccgcgcagacaatatcgacagaatttgccgttaaactcaagattgatcttgccaatcgtgagactagcatctttagttatcgggaggatcccattgtttacgaaattcaccccactaaaagcttcatttctggcggaagcacaattacaggagtcggcaagaatttaaattccgtatctgtaccgcgtatggttatcaacgtgcacgaggccgggcgtaactttaccgtagcttgccagcatcggtctaactccgagataatctgctgcacaaccccatcactgcaacagctcaacctgcagctgccgcttaagaccaaggcattctttatgctggatggaattctgtctaaatattttgacctgatctatgtgcataaccctgtgttcaaaccattcgagaagcccgtgatgatctccatggggaatgagaacgtcctggagatcaagggcaatgacattgaccctgaagcggtcaagggcgaggtgctgaaagtgggaaataagagctgcgaaaacattcatctccactctgaagctgtgctctgcacagttcccaatgatctgttgaagcttaattcagaactgaacatcgagtggaagcaggcgatctcctctaccgtgctgggaaaagtcatcgttcagcccgatcagaactttaccgggttaatcgctggcgtggttagcattagcaccgcactactgctcttgctcgggttctttctctggctcaaaaaaagaaagcaaatcaaggatctgggctcagagctcgtgagatatgatgcgagagtccatacgccccatctggacaggctggttagtgcgcggtcagtgtcacccaccacagaaatggtttccaatgaaagcgttgactatagagcgacgtttccagaagatcagtttcccaattcgagccagaatggttcctgtcgacaagtgcagtaccccctcactgacatgtcacccattctgacctcgggagattcagacatttccagcccactgctccagaacactgtgcacatcgatctaagcgcactgaatccagagctggtgcaagccgtgcagcacgttgttatcgggcccagttctcttatcgtgcattttaacgaggttataggaaggggtcacttcggatgcgtgtaccatggaactttgttggataatgatgggaagaaaatccactgcgctgtgaaaagtctgaataggattaccgacatcggagaggtctctcaattcctgaccgaaggaatcattatgaaggactttagtcatcccaacgttctatcgttgctaggcatctgtttgcggtcagaagggtcccctctggtagtattgccttacatgaagcacggagacctcagaaactttatacgtaatgaaacccataacccaacagtgaaagaccttattggcttcgggttgcaagtagctaaaggcatgaagtatctggcatctaaaaagttcgtccacagggatctggccgctagaaattgcatgctggacgagaagtttacagtgaaggtagccgatttcggactagctcgggacatgtacgataaagagtactactctgtacacaacaaaactggggcaaaactgcccgtcaagtggatggccctcgagagcctccagacccagaagtttaccactaagagtgatgtgtggagtttcggcgtcctcctgtgggagctgatgacaaggggagcaccaccataccccgatgtaaatacgttcgatataactgtttacctgcttcaaggtaggcggctcttgcaacccgaatactgccctgacccactttacgaagtgatgcttaaatgctggcaccccaaggccgagatgcggcctagcttttctgaactggtgtcgaggatctccgccatttttagcacatttataggcgagcactacgtgcacgtgaacgctacttatgtgaacgtgaaatgcgtggcaccctatcctagcttgcttagtagcgaggacaacgccgacgacgaggtggacactcgcccagcaagcttttgggaaacttcgtag

SEQ ID NO: 24920 - DNA, 2295 bp, Artificial Sequence
  Description of Artificial Sequence: Synthetic coding sequence
atgaaggcccccgccgtgctggcccccggcatcctggtgctgctgttcaccctggttcaacggtccaatggagagtgtaaagaggctctcgccaaatctgagatgaatgtgaatatgaagtaccagctgcccaacttcaccgcggaaactcctatccagaatgtgattttacacgagcatcatatattcctcggggccacaaactatatctacgtgctgaatgaagaagacctgcaaaaggtagcagaatataagaccggacccgtgctcgagcatcccgattgttttccctgccaagattgtagctctaaagcgaatctcagtgggggggtgtggaaggataacattaatatggccctggtggtcgacacgtattacgacgaccaactgatatcttgtgggtcagttaatcgtgggacatgccaaagacatgtttttcctcacaaccacaccgccgacattcagtcggaagtacactgtattttttcccctcaaatagaagaacctagccaatgccctgattgcgtggtgtcagcactcggagcgaaagttctgtcttcagtaaaggatcgatttatcaatttcttcgttgggaacaccatcaactccagttatttccctgaccatccgctgcactcaatttcagtgcggcggttaaaggaaactaaggacggctttatgttcctcaccgaccagtcttacatagacgtcctgcctgaattcagagactcctaccccattaaatatgtgcacgcttttgagagcaataatttcatttacttcctcaccgtgcagagagaaactctggatgcacaaacatttcatactagaatcatccggttctgttccatcaacagcggactacattcatacatggaaatgccgctggagtgcatccttacggagaagaggaagaagcgttctacaaagaaggaagtcttcaacatccttcaggctgcctatgtttccaaacccggggcacaactcgcacgccagatcggcgcgagtctgaacgacgatattcttttcggcgttttcgcccagtccaagccagattcagccgagccgatggaccgctcggcaatgtgtgcgttccctattaaatacgtcaatgacttcttcaacaaaattgtgaataaaaataacgtgaggtgtttacaacatttttacggaccgaatcatgagcactgctttaacagaacactcttgcgaaattcaagcggctgtgaagcacgcagggacgaatacagaacagaatttactactgccctgcaacgggtcgatttatttatggggcagttttcggaggtgttactgacttccattagcacgtttatcaagggggatctgactatcgccaatctgggtacttccgagggtcggtttatgcaggtggttgtttctaggagcgggccctcaacacctcacgtcaatttcctgctcgattcccacccagtgagtcctgaggtgattgtggagcacaccttgaaccagaacgggtataccttggttattacgggcaaaaagatcactaaaattccgcttaacggcctgggttgtaggcactttcagtcgtgcagccaatgtctttcagcgccaccttttgttcagtgcggttggtgccacgacaaatgcgtccgatcagaagagtgtctgagtggcacttggacccagcaaatctgtctccccgctatttacaaggtgttccccaattccgcccccctggaaggaggcacccgcttaacgatctgtggatgggactttggcttccggagaaacaacaagtttgacctgaagaagaccagagtcctgcttggcaatgaatcctgcactctgactctgtctgagagtaccatgaacactctgaaatgcaccgtcggcccagctatgaataaacatttcaacatgtcgatcattatctcaaacggtcacgggacaactcaatactctactttcagttacgtggaccctgtgattacctcgatatcccccaagtacggtccgatggctggaggcacactattaaccttgacaggtaattacctgaactcagggaactcccggcatatttctataggtggcaagacctgtaccctgaagtccgtgtccaattccatcctagagtgttacacgcctgcccagacaatttccactgagtttgcagtgaaactaaaaatcgacctggccaatagggaaacctccatcttttcctatagggaggatcccatagtatatgaaatacatccaacaaagagtttcatccggcatgtgaatattgcgctgatacagaggtag

SEQ ID NO: 24921 - DNA, 783 bp, Artificial Sequence
  Description of Artificial Sequence: Synthetic coding sequence
atgaaggacttcagccaccccaacgtgctgagcctgctgggcatctgcctccgctcagaaggatcgccactggtggtgctcccatatatgaaacatggagatttgcggaatttcattaggaatgagacccataatcccaccgtaaaggacctgatcggctttggcctgcaggtagctaaagggatgaagtatctggccagtaaaaaattcgtgcacagagacctggccgcgaggaactgcatgcttgatgagaagtttacagtgaaagttgccgactttggccttgcccgggacatgtacgacaaagaatactatagcgtgcacaataagaccggagcgaaactgccagtcaaatggatggccttggaatcactacagacccaaaaattcaccacaaaaagtgatgtgtggtccttcggagtgcttctctgggagttaatgaccaggggcgctccaccctatcccgacgtgaataccttcgacatcactgtctatctgttgcaagggaggcgactactgcaacccgagtactgtcctgatccactttatgaagtcatgctcaagtgttggcaccctaaagcggagatgcgcccctccttttcagaacttgtgtctagaattagcgctattttttccaccttcatcggggaacactatgtgcatgtgaacgcaacatatgtcaacgtcaaatgtgtggccccgtatccgagcctcctgtcatccgaggacaatgccgacgacgaagtagatacacgcccagcctccttttgggagacctcctag

SEQ ID NO: 24922 - DNA, 1749 bp, Artificial Sequence
  Description of Artificial Sequence: Synthetic coding sequence
atggccgcccggagctggcaggacgagctggcccagcaggccgaggaggggtctgcacgacttcgcgagatgctctctgtgggactgggattccttaggaccgagctcgggctggatctaggcctggaacccaaacgttacccagggtgggtcatactggtgggcactggggccctgggcctgctgctgctgtttcttttgggttatggatgggccgcggcctgtgctggcgccagaaagaagaggaggtcccctcccagaaaacgcgaggaagcagccgcagtgccagccgcagcccccgacgacctggcccttttgaaaaacctgagatcggaagagcaaaaaaaaaaaaacaggaaaaagctgtcagaaaaacccaagccaaacggccggactgtagaagtggctgagggcgaagccgtgcgaaccccacaatcagtgacagccaaacaaccccctgaaatcgacaagaagaacgagaaaagcaagaagaacaagaaaaagtctaaatcggacgctaaggcagtccagaattcctcacgccacgatggtaaggaggtggatgaaggtgcctgggaaacaaagatatctcacagggagaaaagacagcagagaaagcgggataaggtcctgactgattctggatctctggacagcacaatccccggcatcgagaatacaataaccgtgaccactgaacagttgactaccgccagttttcccgtgggttccaagaaaaacaaaggggactcccatctaaacgttcaagtgagcaacttcaagagtggaaaaggggattccaccttacaggtaagttcaggattgaatgagaatttaacagtgaacggcggagggtggaatgaaaagtccgttaagctcagttcccagatctcggccggagaggaaaagtggaatagcgtaagtcctgcctctgcaggtaagcggaagacagagccctctgcatggagccaggacactggggacgccaacactaacggcaaagactggggaagaagctggagtgaccgcagcatattttcaggcatcgggtcaacggcagaaccagtgagtcagtccaccaccagtgactatcagtgggacgtctctcgcaaccaaccttacatcgatgatgaatggagcggactgaatggtctatcatctgctgatccaaatagcgattggaatgcacctgccgaagaatgggggaactgggtggatgaggagagggctagcctacttaagtctcaagaacccattcccgatgaccaaaaagtgagcgatgatgacaaagaaaaaggcgagggcgctctcccaaccggcaaatccaaaaagaaaaaaaagaaaaagaagaagcagggggaggataatagcaccgcacaagacactgaggagctcgagaaagagatccgcgaagacctccccgtgaatacctccaagacgcgtcccaagcaggagaaagccttcagcctgaagactatctcaacgtctgatccggccgaggtgcttgtgaaaaactcacaaccaattaaaacactgccacccgcaacaagcaccgagccgagtgtgatcctgtccaagagtgatagtgataagtcctcatctcaggtgcccccaatcctgcaggagactgacaaatcgaaaagcaacacaaagcagaattcggtgccccctagtcagacaaaatcagagacctcctgggagtctcctaaacagattaaaaagaagaaaaaggcgcgacgggagacctag

SEQ ID NO: 24923 - DNA, 2148 bp, Artificial Sequence
  Description of Artificial Sequence: Synthetic coding sequence
atggccgccaacatgtaccgggtgggcgactacgtgtacttcgagaattcatcaagtaatccctatttgatccggcgtatagaggagctgaacaagacggcaaacggcaatgtggaagcaaaggtggtgtgcttttatagacggagagatatcagttcaacattgatcgccttagctgataagcacgcgacactatccgtgtgctataaagccggaccgggtgctgacaatggggaggagggagagatcgaggaggaaatggagaatcctgagatggtcgatttacccgagaagctgaagcaccagctgcgacacagggagctgttcctgtcacgtcagcttgaaagcttgccagccacgcacattcgaggcaagtgcagtgtaaccttgttgaatgagacggaatcacttaagtcttacttggagcgagaggacttctttttctacagtctcgtatacgacccccagcagaagactctacttgcagataagggagaaattagggtggggaaccggtaccaggctgacattaccgacctgttgaaagagggggaagaggacggtagggaccagtcacggctggaaactcaggtgtgggaggcccacaatccccttacagataagcagattgaccagttccttgtggttgcaagaagcgttggtactttcgcccgggctctggattgcagcagcagcgtgcgacaaccctcactgcacatgtcagcagccgccgcttcgagggacattaccctatttcatgcaatggacaccctacataaaaacatttacgacatctctaaagcaatcagcgcactggtaccacaggggggtcccgtcctgtgtcgtgacgaaatggaggagtggtctgcctctgaggctaacctgttcgaagaggccctggagaaatacggcaaggacttcacagacattcagcaggactttctgccatggaagtccctgacttcaatcatcgaatactactatatgtggaagacgactgatagatatgtgcaacagaaaaggttgaaggctgctgaggccgaaagcaaattaaagcaagtctatatcccaaattacaataagccgaatcctaaccagatcagcgtcaacaatgtgaaggctggagtcgtgaatggcaccggcgcaccgggccagtcgccaggcgccggaagagcttgtgaatcatgctatactactcagagctaccagtggtactcctggggccctcctaatatgcagtgcaggctgtgtgcatcctgttggacttactggaaaaagtatgggggcctgaagatgcctactagactggacggcgagaggcccgggccgaaccgcagcaatatgtcaccacacggactccctgcacggtctagtggctcgcccaaatttgccatgaaaaccagacaagcattctatctgcatacgacaaagttgactcgcatcgcacgcagattatgtcgggagattttgcgtccatggcatgcggccagacacccctacctgccaattaatagtgccgctatcaaagctgagtgcaccgctcgtctgcccgaagcatctcagtctcccttggttttaaaacaggccgtcaggaagccccttgaagccgtgctaagatacctggagacccacccccggcctccgaagccagatccggtcaagtctgtaagttccgttttgtcttctctgacaccagctaaagtggctccggtgattaacaatggtagccctaccatattaggaaaacgcagctacgagcagcacaatggagtggatggaaatatgaaaaaaagactccttatgccatcccgcgggctggccaaccacggacaggcccgacacatgggcccttcacgcaatctcctgcttaatggcaagagctacccgacaaaagtcaggttaatacgcgggggctcgctgccacccgtcaagcggagacggatgaactggattgatgcccccgatgacgtgttctacatggctactgaggagacacggaagattcgaaaactcctatcaagctccgagacaaagcgagccgccagacgcccgtataagccaattgcactcaggcagagtcaggctctcccacccagacccccgccacccgcaccagtcaacgatgagcccatcgtcatcgaagactag

SEQ ID NO: 24924 - DNA, 1887 bp, Artificial Sequence
  Description of Artificial Sequence: Synthetic coding sequence
atggtggacctgcccgagaagctgaagcaccagctgcggcaccgggagctgtttctatctcgccagctggaatccctccctgcaacccacatacgcggaaaatgctcagtgaccttgcttaatgagacagagagtctcaagtcctatctggaacgcgaggattttttcttttatagtctggtctacgaccctcagcaaaagacattgctggctgataaaggtgagattcgggtcggaaaccggtaccaggctgatataactgacctgctgaaagagggggaggaagatgggcgcgaccagagtagactcgaaacccaggtgtgggaggctcataacccgttgacagacaagcagattgatcaatttctagttgtggcaaggtctgtggggaccttcgctcgggctctcgattgtagttcttccgttagacagccctcgctgcatatgtccgcagctgcagcctctagagatattactctgtttcatgcaatggacaccttacataaaaatatttacgacatctctaaggctatctccgccctggtgccccagggagggccagtactttgtcgagacgagatggaggaatggtccgcctccgaggccaatctcttcgaagaggctttggagaagtatggcaaagacttcacagatattcagcaggatttcctaccctggaagagtctgacatcaattatcgaatattactacatgtggaaaacgacagaccgctatgtgcagcagaagcgactaaaagcagccgaagcagaatcgaagctgaaacaggtgtatatccctaactacaataaacctaatccaaaccagatatctgtgaacaatgtcaaggcaggcgtagtgaatgggactggagcccctggccagtccccgggggctggccgcgcatgtgagtcttgctacaccacacaatcctatcagtggtatagctggggtcctccgaatatgcagtgtcgcctttgtgccagttgctggacttactggaagaagtatggcggcttgaaaatgccgactcggcttgacggagagagacccggtcctaaccggtctaatatgagccctcacggcttgcctgcccgcagttctggttcccccaaatttgcgatgaagacccgtcaggccttctacctgcataccactaaactcacacgtattgcccgccgattatgtagggaaattctccggccatggcacgccgcccggcatccttacctccctataaattcggcggctattaaggccgaatgcacggctcgtctgcccgaagcgtcacagagccccctggtgcttaaacaggccgtgcggaagcctctggaggccgtactgaggtacctagagacgcatcctaggcccccaaaaccagaccctgtcaaatccgtctcctctgtgttgtcatctctcaccccagcaaaggtcgctccagtgatcaataacggttccccaaccattctgggcaaaaggtcctacgaacagcacaatggtgtagacgggaatatgaagaaacgcctgctgatgccatcgcgaggaacttcttccggtttggccaaccacggccaggcccggcacatgggaccctcccggaacctgctcctgaacgggaaaagctatcccacaaaggtcagactcatccgagggggctccctgccccccgttaaacgcagacgaatgaattggattgacgcacccgacgacgtattctacatggctactgaggaaactcgaaaaatcaggaaacttctttcaagctcagagacgaaaagggccgctagacgaccctacaaacccatagctttgcgacagtcacaggctttgccacctcgacctccacctcccgctcctgtgaacgacgagccaattgtgattgaagactag

SEQ ID NO: 24925 - DNA, 768 bp, Artificial Sequence
  Description of Artificial Sequence: Synthetic coding sequence
atgaagacccggcaggccttctacctgcacaccaccaagctgacccgcatcgcccgacgactgtgcagggagattctcaggccctggcacgccgctcggcatccctacctcccaattaattctgctgccatcaaggcagagtgtaccgcccgactccccgaggcctcacaatctccactggttctgaaacaggctgtccgcaaacccttggaggccgttttgcggtacctggagacacatccaaggcctcccaagccagatcccgtaaaatccgtatctagcgtgttatcctcactgacccctgcaaaggtggccccagtcattaataacggcagccctaccatcctggggaagagatcctatgagcaacataacggcgttgatggaaacatgaagaaaagactccttatgccgagtagaggcacctacctgggcctggccaaccacggtcaggccagacatatgggaccctccagaaacctgttactgaatggtaagagttaccccaccaaggtaagacttattcgaggcggctccttgcccccggtgaagaggcgccgaatgaattggatagatgcaccagacgatgttttttacatggcaaccgaggagactagaaaaatcaggaagctgctcagttcctcagagaccaaacgggccgccaggcgcccttataaacccatcgccctccgacaaagtcaagctctacccccccgtccccccccccctgcaccggtaaatgacgagccaatcgtcattgaagattag

SEQ ID NO: 24926 - DNA, 1293 bp, Artificial Sequence
  Description of Artificial Sequence: Synthetic coding sequence
atggccgccaacatgtaccgggtgggcgactacgtgtacttcgagaatagctcctctaacccctatctgataaggcggattgaggagttgaataagactgcaaacggtaatgtcgaggctaaagtcgtgtgtttctacaggcggcgcgatatctcaagtacactgattgcacttgccgataagcacgccacgcttagtgtttgctacaaggcaggcccgggggcagacaatggagaagaaggtgagattgaagaggaaatggagaaccctgagatggtcgatctgcccgagaagcttaaacatcagctcaggcacagggaactatttctgagtaggcaactggagtcccttcctgcaactcatatcagaggcaaatgttccgtcactttgctgaacgaaaccgagtcccttaagtcctacctcgaacgggaggacttctttttctactccctggtgtacgacccccagcaaaagactttactggccgataagggagaaattagggtgggaaatagataccaggcagacatcaccgatctgcttaaagagggtgaggaggatggtcgtgaccagtcccgcttagagacacaagtgtgggaggcacacaatccgctgaccgacaagcagattgatcaattcctggttgtggccaggagtgtcgggacattcgcacgcgctctcgactgcagctcttctgtcagacaaccatcattgcatatgagtgcagctgcagcgagtagagacatcactttgttccacgcaatggatacgctgcataaaaacatctatgatatcagcaaggctattagtgcactggtgcctcagggtggccccgttctgtgtcgcgacgagatggaggagtggtcagcctcagaagcaaatttgtttgaggaagcgctggagaaatatggaaaggacttcacggatatacaacaagacttcttgccctggaagagtctcacttccataatagaatattattacatgtggaaaaccactgacaggtacgtgcagcagaagcgtctgaaggccgcggaggctgagtcaaaactgaaacaggtctacatcccaaattacaataaacctaatcccaaccagatttcagtgaacaacgtgaaggccggcgtcgtgaatggaaccggcgcccctgggcagtcacccggtgccggccgcgcctgcgagagctgttatatgtcaagtctgcgcatactgctggacatactcgaagaaatctggtggctcgagaacgccaacccagtccggtggagggaggcccgtaccaagcctcaatag

SEQ ID NO: 24927 - DNA, 1422 bp, Artificial Sequence
  Description of Artificial Sequence: Synthetic coding sequence
atgctgcggcccgtgatcgaggaggagatcagcatgctgggcgagattacacatttgcaaacaatatcagaggatctcaaatcattaacaatggacccacataaattaccatcaagctcagagcaggtgatactggatctgaaaggtagcgattattcctggtcttatcagaccccaccttccagcccgtcaactacaatgtcgagaaagtcttccgtgtgttccagtctgaactccgtgaatagcagtgattcccggtcctctggatcccactctcactcccctagctcccactatcggtatcgcagctccaatttggcacagcaggcaccagtcaggctctcaagcgtttcttcgcacgactctggtttcatcagtcaagacgcattccagtctaagagcccgagcccaatgcctcccgaggcgccaaatcagagacgtaaagaaaagagggaacctgatccaaatggtggcgggcccacaaccgcatctggccccccggccgccgccgaggaagctcagaggcctcgttcgatgactgtgtctgccgctactcggcctggggaggagatggaagcctgtgaagagctggctcttgctctcagtcggggcctccaactagacacccagaggagttcaagggacagccttcagtgctcctcagggtactcaacgcaaactaccaccccttgttgcagcgaagatacaattccttcacaggtgagcgattacgattattttagcgtgagtggagaccaggaagccgatcagcaggagttcgacaagtcaagcacaattcccagaaactctgacatctcgcagtcctaccgccgaatgttccaagccaagaggccggcttccaccgcggggctgcccactacactgggccctgcgatggttacacctggcgttgctaccatcaggagaacacccagcactaaaccaagcgttcggagaggtactattggcgcaggcccaatccccatcaaaacacctgtcattcctgtcaagaccccgacagtcccagacctaccaggcgtccttcccgcacctcccgatggtccagaagagcgtggagaacacagtcccgagtctccatctgtcggcgaaggaccacagggcgtgacctcaatgccctcaagtatgtggagtgggcaggcttccgtaaaccctcccttacccgggccaaagccatcaatccctgaagaacataggcaagccatacctgaatccgaggcagaggatcaggaacgggagcccccctctgcaaccgtatctccgggacagatcccggagagcgatcccgcagacctcagtccacgggacacccctcaaggagaggacatgctgaatgccattagaagaggcgtgaagctgaaaaagaccaccaccaacgaccgtagtgctcctaggttctcctag

SEQ ID NO: 24928 - DNA, 2193 bp, Artificial Sequence
  Description of Artificial Sequence: Synthetic coding sequence
atggaggccgtgatcgagaaggagtgcagcgccctgggcggcctgttccaaaccattattagcgacatgaaggggtcttaccccgtttgggaagacttcatcaataaggctggcaaactgcaatcccaactccgcacaaccgtcgtcgcggccgccgcgtttttagatgccttccagaaagtggctgatatggccaccaacacccggggcgggacacgggagattggtagtgcactgacacgaatgtgtatgagacatagaagtattgaggccaaactgaggcagttctcgtccgctctaatagattgtctgattaacccactgcaggagcagatggaggagtggaaaaaagtggccaatcagcttgataaggaccacgctaaagagtacaagaaagctcgccaggagatcaaaaaaaaatcatctgacacccttaagttgcaaaagaaggccaagaaaggccgcggagatattcaaccacagctggattcagcccttcaggacgtgaacgataaatatctgctgctggaggagacagagaagcaggcggtccgaaaggcactcatagaggaacgcggacggttctgtacttttatttcaatgctgaggcccgtcattgaggaggagatcagcatgctgggcgagattacacacctgcagaccatcagtgaggatctgaaaagcctgactatggacccgcataaactcccatcctctagtgaacaggtcatcttagatcttaagggatcagattactcctggagctatcagacccctcccagcagcccctcaacaacaatgtcacgcaagtcttccgtgtgttctagcctcaatagtgtcaatagctctgactcacgctccagtggcagccactcgcactcaccatcctcacactatagatatcggtccagtaatctggcccagcaggccccagtcaggcttagctcagtgtcttcccatgactcaggattcatctcccaggatgcctttcagagcaagtctcctagtcctatgcccccagaagccccgaatcagaacagcagctcgagcgcttcctctgaggcgagtgagacctgccagagcgtgtctgagtgctcttcacccacttctgtatcaagtggaagtactatgggggcgtgggtttcaaccgaaaaagactgggccaagccaggtccctatgaccagcctctggtcaacaccctgcaacgacggaaggaaaaaagagaacctgaccctaacggtgggggccctacaacagcgagcggaccacctgctgccgccgaggaagctcagcggccccgctcgatgactgtcagtgccgcaaccaggccgggtgaagagatggaggcttgcgaagaactagccctggccttaagtcgcggactgcagctggatactcaacgctcctctagagatagcctgcagtgttcatctggttactcaactcagacaactactccctgctgtagtgaggacaccattcctagccaagtatctgattatgattactttagcgtctccggtgaccaggaagctgatcagcaagaatttgacaaaagctccaccatccccaggaactccgacatcagccaaagctaccgtcgcatgtttcaggcaaagcggccagcctccaccgctggcttgcctacaacactgggccccgccatggttacacctggggtggccacgattagacgtaccccttccacgaaaccctctgtgcgccgcgggactatcggtgccgggccaattccaattaagacaccggtgatcccagtgaaaactccaactgtaccagacttgccaggagtcctccctgcgccacctgacggcccagaagaaagaggtgagcattcgcccgaatctccatcagtgggtgagggaccacagggtgtcacttccatgccatcctcaatgtggtctggccaggcttcggtgaatcccccccttcccggacccaagccatcaatacccgaggaacatagacaggctattcctgagagcgaggctgaggaccaggaaagggagccccccagcgccacagtttcgcccggccagattccagagtcggacccagccgatctgagcccacgggacactccccagggtgaagacatgttgaatgcaattcgccgcggcgtaaaactcaagaaaaccaccactaacgatcgttctgccccccggttctcctag

SEQ ID NO: 24929 - DNA, 1590 bp, Artificial Sequence
  Description of Artificial Sequence: Synthetic coding sequence
atgagccggaagagcagcgtgtgcagcagcctgaacagcgtgaacagctccgatagccgctcatctggctctcacagtcactcgcccagctcacattataggtatcggagttcaaacttggcacagcaggccccggttcgcctctccagcgtttccagccatgatagcggcttcatatctcaggacgcatttcaaagcaagtcaccttctcctatgcctcctgaggcccctaatcagaactcctctagttctgcatcttctgaggcatccgagacttgtcagtccgtgagtgaatgttctagccctactagtgtatctagcgggtcaaccatgggggcatgggttagcacagagaagctgagcaatggattttctcactattccctgtcttccgaatcacacgtgggtcccactggcgcgggattattccctcactgtcttcctgctagtcgccttctgccacgagtcactagtgtgcacctccccgactatgcacattactacaccatcggcccaggcatgttccctagttcccagatccctagctggaaagattgggcaaaacccggaccttatgaccagcccctggtgaatacgctccaacgccgtaaggagaagcgcgaacctgaccctaacggtggaggacccacaactgcctctgggccaccagccgcagccgaagaagctcaaaggccccgcagtatgacagtgtccgccgccacccgcccaggcgaggagatggaagcatgcgaagaactggcccttgcactctcccgagggctacagctggatacccagcgctcctctcgggatagcctgcagtgcagctcaggctacagcacgcaaactacaacaccatgctgctccgaagacactattcccagtcaggtgagtgattatgactactttagcgtctcaggagatcaggaagcggaccagcaggaatttgacaagtctagcaccatcccccggaattccgacatttctcagagctacaggaggatgtttcaagctaaacggccagctagtaccgccggtctacctaccacgctggggccagcaatggtgacacctggcgtcgccaccatccgcagaacccccagcacaaagccatcggtgagacgaggcacaatcggcgcaggccctatccccattaagacccctgtgatccctgtgaaaactcccaccgtgccagatctgccaggcgttctacccgccccccctgacggcccggaggagaggggcgaacacagtcctgagtcacccagtgtgggggagggaccacagggcgtgacttcaatgccatcctctatgtggagcgggcaagcctctgtcaatcctcctctgccaggtcctaagccttccataccagaggaacacagacaggccatccctgaatccgaggcggaggatcaagaacgcgagcctccatccgcgaccgtctctcccggacaaatcccagagagcgacccggcagacctgtcccctagggataccccccaaggcgaggacatgctcaatgcaattcggaggggcgtcaaactgaagaaaaccactacaaatgacaggagtgccccacgtttttcctag

SEQ ID NO: 24930 - DNA, 2268 bp, Artificial Sequence
  Description of Artificial Sequence: Synthetic coding sequence
atggaggccgtgatcgagaaggagtgcagcgccctgggcggcctgtttcagaccattatctccgacatgaaaggtagttacccagtgtgggaagacttcattaacaaggccgggaagctgcaaagtcagctacggacaaccgtggtggcagccgctgcttttctcgacgcatttcaaaaggtggcagacatggctacaaacacgcgtggaggaacccgggagatcggctctgccctcacgagaatgtgtatgcgtcaccggtctatcgaagcgaagctgcgacaattctctagcgccctgatcgattgcctgatcaaccctctccaggaacaaatggaagagtggaaaaaggtcgcaaatcagctggataaggaccatgctaaagagtacaagaaggccagacaggaaatcaagaagaaatcttctgatacgcttaagttacagaagaaagcgaaaaagggtcggggtgatatacagccccaactggactccgccttacaggacgtgaatgacaagtacttgctgctcgaagagacggaaaagcaggcggttcgaaaagcattaatcgaggaacgtggccggttctgcacatttatttcaatgctgcggcccgtgatagaggaagaaattagcatgctgggtgaaatcacacacctccaaaccatttctgaagatcttaaatctctcaccatggacccacataagttgccatcctcctcggaacaagtaatcctagaccttaaaggaagtgattactcatggtcatatcaaacccctccaagcagcccctccactaccatgagccgaaagtcaagtgtgtgtagcagtctgaattctgtgaactctagtgactctcggagtagtgggtcacacagtcactcgccctcctctcattaccgctataggtcaagcaacctggcccagcaggctcccgttcgtctgagctctgtgtcaagtcatgattcaggctttattagccaagatgcctttcagagcaaaagtccctctcctatgccacccgaagctccaaaccaactctcgaacggcttctcacactactctctgtctagtgaatcccacgtgggtccgacaggggccggcctgttcccccactgcctgccagccagccgcctgttacccagggtgacttccgtccatctccccgattacgctcactactacactatcggtcctggaatgttccccagttcccaaatcccgtcatggaaggactgggccaagccgggcccctatgaccagccattagtcaatacactgcaaaggaggaaggagaagagagagccagatccgaatgggggtggacccaccaccgcttccgggccccccgcagcagccgaggaggcccagagaccaaggagtatgacggtgagcgccgctacccgccccggcgaagagatggaggcctgtgaggagctggcccttgcattaagccggggcttgcaactcgatacacagagatctagcagggactcactccagtgttctagtggctacagtacacagacaactactccttgttgttccgaagatactattccctcacaggtttccgattacgattacttctcagtgagcggggatcaagaggccgatcaacaggaatttgacaagtcttctaccatacctaggaattcagacatatctcagagttaccggcggatgttccaggcgaagcgtcctgcttccacggcaggcttgcccacaaccttggggccggcaatggtcacgccaggggtggcaaccattcgcaggaccccttccacaaagccttctgtgagaaggggcacaattggtgcgggacccatcccaataaagacaccggtaattcctgtgaagacaccaacagtgcctgacctacccggcgtgctccccgctcctcctgacggccccgaggaacggggagaacatagtcctgagagtccttctgttggggaaggaccgcagggcgtcacaagcatgccgtcatctatgtggtcaggccaagctagtgtgaatccccccttgcccggtccgaaaccgtccattccagaagaacaccggcaggccatcccagaatcagaagcagaagatcaggagagggaaccacccagcgccacagtttctcccggccagataccagagtcagaccctgccgacctttctcccagagacactccccagggggaggatatgctcaacgccataagacggggtgtgaaactcaagaaaaccacaactaacgaccgaagtgcgccgcgcttctcatag

SEQ ID NO: 24931 - DNA, 1437 bp, Artificial Sequence
  Description of Artificial Sequence: Synthetic coding sequence
atggccggcgtggaggaggtggccgccagcggcagccacctgaacggcgatctggacccagatgaccgcgaggagggcgcggcctctacagcagaggaggctgcaaagaaaaaacggagaaaaaagaagaagtctaagggcccctcagctgctggtgaacaggagcctgataaagagtcgggtgcctccgtggacgaagtggcaaggcagctggagagatctgctttggaagacaaggagagagatgaagatgacgaggacggggacggggatggtgatggtgctacaggtaagaagaaaaagaagaagaagaaaaaaaggggcccaaaggttcagaccgatccacctagtgtccccatttgcgatctctatcctaatggtgtgtttccaaaaggccaggagtgtgaatacccaccaactcaggatggacgcacagccgcttggcgcaccacttccgaggaaaagaaggctctggaccaggcctcagaggagatttggaatgactttagagaagccgccgaggcccaccgacaggtcaggaagtatgtaatgtcctggatcaaacctggaatgaccatgatagaaatttgtgagaagctggaagattgctcccgtaaattgattaaagaaaacggattgaacgcaggactggctttccccacagggtgttcccttaataactgcgccgcccactacactcctaatgccggggacacaactgtcctccagtacgacgatatctgtaagatcgattttggtactcacatcagcggccggatcatcgattgtgctttcactgtgacgttcaatcccaagtatgacactctcttgaaagctgtgaaagatgcaactaatacggggatcaaatgtgccgggatcgatgtcaggctctgcgacgtcggtgaggctatccaggaggtgatggagtcctacgaagtggagatcgatgggaagacctaccaagtgaaaccgatacgcaacctgaatgggcacagcattgggcagtatagaatccacgccggtaagacagtgccaatcgtgaagggaggcgaggcaactcgtatggaagaaggagaggtgtacgctattgaaacattcggctccaccgggaagggcgttgtccacgatgacatggagtgttcacattatatgaaaaactttgatgtcggccatgtacccattcgactgccccgaacaaagcatctactgaacgtgatcaatgagaattttggtacgctggcgttctgcagacgatggctggaccggctgggagaaagtaaatacttgatggctctcaagaatctctgcgaccttggaatcgtcgacccatatcctccgctgtgcgatataaaggggtcatatacagcacagttcgagcatacgatcctcctgcgccccacctgtaaagaagttgtgagcagaggcgatgattattag

SEQ ID NO: 24932 - DNA, 1743 bp, Artificial Sequence
  Description of Artificial Sequence: Synthetic coding sequence
atgggcaccaccggcctggagagcctgagcctgggcgaccggggcgccgcgcctacagtgacctcttccgagcgactggtgccagaccccccgaacgacttaaggaaggaggacgtggcgatggagctcgaaagagtgggggaagacgaagagcagatgatgatcaagagatccagcgaatgcaaccccctgctgcaagaacccatcgcctcggcccaatttggggctaccgctggcactgagtgtaggaagtctgtaccgtgcgggtgggagcgtgtagtaaagcagcggctattcgggaagactgccggacgctttgacgtctacttcatatctccacagggactcaagtttaggagcaagagtagtctggcaaactatttgcacaaaaatggcgagacgtccctgaagcctgaagactttgacttcaccgtcctcagcaagaggggaatcaagtcccgctataaagattgctcaatggccgcgctgacaagccatttgcagaatcagtccaataattctaactggaacctgcgaacccgctccaaatgtaaaaaagatgtctttatgcctccttcttcctcctccgagctgcaggaatccagaggactttcaaattttacgtcaacccacttgcttcttaaagaggacgagggcgtcgacgacgtgaatttccgaaaggtgaggaaaccaaaggggaaggtcactatcctgaaaggaatccccatcaagaagacaaaaaagggatgccgtaagtcgtgttctgggttcgtccagtcggattccaagagagagagcgtttgcaacaaggcagacgcagagtcggagcctgtggcccagaagtcccagctggataggacggtgtgtatttccgacgcgggtgcatgtggcgagaccctcagcgtgacttccgaggagaactcacttgtgaaaaaaaaagagcggtccctgtcttccggctctaacttttgcagtgaacagaaaacaagtggtatcattaataagttttgtagcgctaaagacagtgagcacaatgaaaaatatgaagataccttcttagagtccgaagagattgggactaaggtcgaggttgtggagaggaaagaacatctgcacaccgacattttaaagcgaggatctgagatggacaataactgttcacccacccgaaaagactttactggcgaaaaaatcttccaggaggacacaattccaaggactcagatcgaacgccgcaagacatctctgtatttctctagcaagtacaacaaggaggctctttcccctccccgtcggaaagcttttaagaaatggacacccccgagatcgccttttaacctagtacaggagacgctgtttcatgacccatggaaactgctcatcgcgaccattttcctcaatcggacctcaggcaagatggccatcccagttctttggaagtttttagagaaatatcctagcgctgaagtcgcgcgcaccgctgattggcgagacgtctctgagctgcttaagcccctcggcttgtatgacctccgcgcgaagactattgtcaagttttcagacgagtacctcactaagcagtggaaataccccatcgagctgcacggcatagggaagtacgggaacgatagttatagaatcttttgcgtaaatgagtggaaacaggtccacccggaagaccacaagctgaataaataccatgattggttgtgggagaatcacgagaagctctcgctctcctag

SEQ ID NO: 24933 - DNA, 789 bp, Artificial Sequence
  Description of Artificial Sequence: Synthetic coding sequence
atgggcaccaccggcctggagagcctgagcctgggcgaccggggcgcagcacctactgtgacctcatctgagaggcttgtacccgacccacctaacgacctgaggaaagaggatgtagctatggagctggaacgggtgggtgaggacgaggagcaaatgatgattaagcgctctagcgagtgtaatcctcttcttcaagagccaattgccagcgcccaattcggcgccaccgccggcacggagtgtcaggatactatacctcggacacagatcgagcgccgcaaaacttcactctattttagcagcaaatataataaggaggcacttagccctcctagacggaaggctttcaaaaaatggacacccccgcgctccccatttaacctagtacaagagaccctcttccacgacccctggaagctgctaatcgcaacgatctttctcaaccgcacttcagggaaaatggccattcccgtgctgtggaagttcctcgagaaataccctagtgctgaggtcgcccggacagccgattggcgggacgttagtgagttgttaaagccactcggtctctacgacttacgggccaaaacaattgtcaaatttagtgacgaatatctgaccaagcaatggaagtatccaatcgaactccatggtatcggcaagtatggcaatgatagctatcgaattttttgcgtcaacgagtggaaacaagttcatcctgaggaccataagctgaacaaatatcacgactggctgtgggaaaatcacgaaaagctttcccttagttag

SEQ ID NO: 24934 - DNA, 1725 bp, Artificial Sequence
  Description of Artificial Sequence: Synthetic coding sequence
atgggcaccaccggcctggagagcctgagcctgggcgaccggggcgctgcccctactgttacctccagtgagagacttgttcccgatccccccaacgacctaaggaaggaagacgtggcaatggagttggaacgtgttggagaggacgaggagcagatgatgatcaaaaggtcttcagagtgcaatccgttgttgcaggaacccattgcctctgcacagttcggcgctactgccggaacggagtgcaggaaatctgtgccttgcgggtgggagcgcgtcgtcaaacagcggctgttcgggaagaccgcggggaggtttgatgtatattttatatcccctcagggactgaaattccgaagcaagagctctttggctaattatttgcataaaaacggtgagacgtcgttgaagcccgaggatttcgactttactgtgttaagtaagcgggggatcaaatcaaggtacaaagactgctccatggccgctttgacctctcacctccaaaaccaaagcaacaactccaactggaatttgcgcacccggtcgaagtgtaaaaaagacgtgttcatgccaccttcctcaagcagcgagctccaggagagccgcggtttgtccaactttaccagtacgcacttgctactcaaagaagatgaaggcgtggacgatgttaactttcgcaaggtgcggaaacccaagggtaaagtcacaatcttgaagggtatccctattaagaagacaaaaaagggatgcaggaagagttgttcggggttcgtgcagtctgactcaaagagggagtctgtgtgtaacaaggccgatgccgaatcggaaccagtggcacagaagagccagttggataggacggtgtgtatatcagacgcaggagcatgtggagaaacactgtctgtaacttccgaggaaaatagtctggtgaagaaaaaagagcggagtctgtcttctggatctaacttctgtagtgagcaaaaaacctccggcatcatcaataaattttgcagtgccaaagatagcgagcacaacgagaaatatgaggacaccttcctcgaatcagaagagataggcacaaaagtggaggtcgtggagcgcaaggaacacctacacacagatatcctgaaacggggaagcgagatggacaacaactgcagcccaacgcgaaaagacttcaccgaagacacgattccaagaacccagattgagagacggaagacctccctgtatttctcatccaaatacaacaaggaagcactgtccccaccacgacgcaaagcattcaaaaaatggactcccccacggtcacctttcaatctggtacaggagactctatttcacgacccttggaagttgcttatcgccacaatttttctgaaccggacttcaggtaagatggctattccagttttgtggaagtttttggaaaagtacccttccgccgaggtagctaggactgccgactggcgcgatgtttcggagttattgaagccactgggtctatacgacctgcgggctaaaacaatcgtcaaatttagcgacgagtacctaacaaagcagtggaagtaccccatcgaattgcacggtataggcaaatacgggaacgactcctaccggatcttctgcgttaacgagtggaaacaagtacatccagaagatcataaactgaacaaataccacgactggctgtgggaaaaccacgaaaaactttcattgtcatag

SEQ ID NO: 24935 - DNA, 93 bp, Artificial Sequence
  Description of Artificial Sequence: Synthetic coding sequence
atggtgaacgaggcccggggcaacagcagcctgaacccctgcctggaaggttccgcttcgagcggctctgagagttccaaagactcgagctag

SEQ ID NO: 24936 - DNA, 2094 bp, Artificial Sequence
  Description of Artificial Sequence: Synthetic coding sequence
atggaccaccggaaggcccgggtgctgcccgccggccactactgcccctcactcggtatttgggccagccaggtgggaagcgtgcgatcaagcgttcccccatctatttctaggaatccagccatggtgaatgaagcccggggaaactcctctttgaacccgtgtttggaaggcagcgctagcagcggctccgagtcttccaaggattcttccaggtgtagcaccccagggttggatccggagcgccacgagagactgcgagaaaaaatgcggcgtcggctcgaatcaggtgataaatggttctctcttgaattttttcctccgagaacggccgaaggggctgtaaatttgatctcacgttttgatcggatggcggccggcggaccactgtacatagacgtaacatggcatcccgcaggcgatcctgggagcgataaggagacgtcatccatgatgatcgcctctaccgccgttaattactgcggattagaaacgatactgcatatgacttgctgccgccagaggttggaggaaatcaccggacacctgcataaggccaaacagctcgggctgaaaaacatcatggccttacggggtgacccaattggtgatcagtgggaggaggaggaaggcggctttaattacgcggtagacctggttaagcatataaggtctgagtttggcgattatttcgatatatgtgtcgcagggtaccctaaaggacaccccgaagctggctcctttgaggctgacctgaaacacttgaaagagaaagtctccgctggggccgacttcattataacgcagctgtttttcgaggccgacactttctttcgatttgtgaaagcctgcactgacatgggcatcacctgcccaatagttcctgggatttttcctattcagggctaccactcactcaggcagttagtgaaactgtcaaaactcgaggtgccgcaagaaatcaaggacgttatcgagccgattaaggacaacgatgccgctattcgcaattatgggattgagctggctgtttctctgtgccaggagctcttagcctctgggcttgtgcccggtctccacttctacactcttaatcgagagatggccaccactgaggtgctcaagcgcttaggtatgtggactgaggaccctcgaagacccttgccttgggcgctgtcagcccaccccaagcggcgggaggaagacgtgagacctatcttttgggccagtagacctaaatcctacatttacaggacccaggagtgggacgagtttcccaacggtaggtggggcaactccagtagccccgcctttggtgagctgaaggactattatcttttctacctcaaatcgaaatcaccgaaagaggagttgctcaagatgtggggtgaagagttgacaagtgaagagagcgtttttgaagtgtttgtgctatatttgagcggcgagccaaatagaaatggacacaaggtgacgtgtctgccgtggaacgatgagcccttggcagctgaaacctccctgttaaaagaggagttgctgcgggtcaatagacaggggatcctgaccatcaattcccaacctaacatcaatggcaaaccgtcttctgatcctatagttggctggggaccttccggcggttacgtgtttcagaaagcttaccttgaattcttcacgtcccgggagacagccgaggcactcctccaggtacttaagaagtatgaattaagagttaattatcacctggtgaacgtgaaaggagaaaatattactaatgctccggagctccaaccaaacgcagttacctggggcatcttcccaggacgggaaatcattcaacccacagttgtcgacccagtgagttttatgttctggaaagacgaggcattcgcactgtggatcgagaggtggggcaagttgtacgaggaggagagcccgtctcggaccataatccagtatatccacgacaattatttcctggtgaatctggtggataacgactttccgctcgacaattgtctctggcaggtggtggaggacactctcgagctgctcaatagacccacccagaacgcacgtgagactgaggcaccgtag

SEQ ID NO: 24937 - DNA, 2094 bp, Artificial Sequence
  Description of Artificial Sequence: Synthetic coding sequence
atggaccaccggaaggcccgggtgctgcccgccggccactactgccccagcctgggcatctgggcatcccaggttggctccgtgcgcagcagtgttccccccagcatctctcggaatccggctatggtcaacgaagcacgcggcaattcttcattgaacccatgtttagaaggtagtgcatcgagtggctccgagagctcgaaagatagctctagatgctctacccctggactcgacccagaaagacacgagagactacgggaaaaaatgcgccggcgactggaatctggcgataagtggttctctctggagttcttccccccacgaactgcagaaggagctgtcaacctcatttcacggttcgatcgcatggctgccggagggccgttatatattgacgtgacctggcaccccgcaggcgatcctggcagcgataaggagacgtcctcaatgatgattgctagcacggctgtaaattactgtggcctcgaaacaatactgcatatgacctgttgtcgccagcggctcgaggagataactgggcatctgcataaggcaaagcagctcggccttaagaacatcatggcactgaggggtgaccctatcggggatcagtgggaggaggaggaggggggatttaattacgccgtggacctggttaaacatattcggtcagagttcggtgattattttgacatttgtgtcgccggctatcccaagggacacccagaggcagggtcttttgaggccgacctgaaacacctgaaggaaaaagtcagcgccggcgctgactttatcatcacccagttgttttttgaagcagataccttttttcgctttgtcaaagcgtgcacggacatggggattacttgtccaatcgtccctggtatctttccaatacagggctatcattcgctccgccagttggtcaaactgtcaaaactggaagtcccccaggagattaaggacgtgatcgagccaataaaagataacgacgcagccataaggaactacggaattgagctggccgtgagtctgtgtcaagaactgttggcctccgggctggtgcccggtttacacttctatactcttaaccgggagatggctaccactgaggtgctgaagaggttgggcatgtggacagaggatcctcggcggccactgccatgggctctgagcgcccacccaaagcggcgcgaagaagacgtcagaccaatcttctgggcaagcagacctaaaagttacatatatcgcacccaggagtgggacgaattccccaatggccgttggggcaattccagcagtcctgccttcggggaattgaaagactactacctattttatctgaaatctaaaagtcctaaggaggagttacttaagatgtggggggaggaattgacctcggaagagagcgtctttgaagtttttgtactgtatctttccggtgagcctaacagaaacggtcacaaagtgacctgcctgccttggaacgacgagcctctcgctgcggagacatccctgctcaaagaagagctgctcagggtgaatcggcagggcatcctgacgattaactctcagccaaatataaatggcaagccatcctcagacccaatcgttggctggggtccctcagggggctacgttttccagaaagcatacttggagtttttcacttctagagagactgccgaagccctccttcaagttctaaagaagtatgaactgagagtaaactaccacctcgtgaatgttaagggtgaaaatataacaaacgctccggagcttcagccaaacgctgtgacttggggcattttccccgggagagagattatccagccaactgtggtagaccctgtctcatttatgttctggaaagatgaggccttcgctctatggatcgagcgatggggtaaactttacgaggaggagagccccagtcgtaccatcatacaatacattcacgacaactacttcctggtcaacctggtggacaacgatttccctctcgataattgcctctggcaggtcgtggaagataccctggaacttttgaaccggcccacgcagaacgctcgggagacagaagccccatag

SEQ ID NO: 24938 - DNA, 1971 bp, Artificial Sequence
  Description of Artificial Sequence: Synthetic coding sequence
atggtgaacgaggcccggggcaacagcagcctgaacccctgcctggaggggtcagccagctccggcagcgaatcaagtaaggattcctctcgttgcagcacgcccggactggacccggaaaggcatgagagactgcgggagaagatgcggagacggcttgagagtggagacaagtggtttagtcttgaattctttccgcctcggacagctgagggcgcagtgaacctcatttccaggtttgacagaatggccgctggcgggccgctgtatatagacgtaacctggcaccccgcgggcgaccccgggtccgacaaggagaccagctcgatgatgatcgcttctaccgccgtcaactactgtgggctggaaacaattctgcacatgacttgttgcagacagcggctcgaagagatcacagggcacctccataaagccaaacaattaggtctgaagaatattatggccctgaggggagacccaatcggtgaccaatgggaggaagaggagggcggatttaactatgccgtagatctggtgaaacatatccgaagtgagttcggagactattttgatatctgcgtcgctggctatccaaagggccacccagaggccggctcgttcgaagctgacttgaagcacctgaaagaaaaggtgtctgctggtgcggattttatcatcacgcagctgttctttgaggctgatacttttttcaggttcgtgaaggcctgcaccgacatgggcattacttgcccaatcgtgcctggcatctttcctatccaagggtatcattcgcttcgacaactcgtcaaactgtccaaactggaagttccccaagaaattaaggacgtcatcgagcccattaaggataacgatgccgccattaggaattacgggatcgaactggccgtgagtctgtgccaggagctgctggcaagtgggttggtcccaggtctgcatttctacaccctgaacagggagatggctacgaccgaagttttaaagcggctgggcatgtggactgaagaccctaggagaccactcccctgggccctgagcgcacatcctaagaggagagaggaggatgtgaggccaatcttctgggcctcccgccctaagtcttatatttaccgaacccaggagtgggacgagtttcctaacggcagatggggcaacagttcttccccagctttcggcgaattgaaagattactatctgttctacttaaaaagtaagtcacccaaagaggagctactgaagatgtggggagaagagcttacctccgaagagtcagtgttcgaggtttttgtgttgtacctttccggcgaaccaaaccgcaacggacacaaagtcacttgcctcccctggaatgacgaaccactggctgccgagactagtctgctgaaagaggaacttctgcgcgttaacaggcagggaattttgaccattaactcgcaaccaaatattaatgggaagccttcatccgaccccatcgttggctggggcccatctggcggttatgtgttccagaaggcatatctggagttttttacttccagggagactgctgaagccctgctgcaggtgttaaagaagtacgagctgcgagtcaattatcatctggtgaatgtaaaaggtgaaaatatcactaacgctcccgaattgcagcccaatgccgtcacttgggggattttccccggacgcgaaatcattcagcctaccgtggttgaccctgtgtccttcatgttctggaaggatgaggctttcgcattatggatagagagatggggaaaactttatgaggaggagtctccctcacggacgatcattcaatacattcatgataactatttccttgtgaacttagttgataatgactttcccttggataactgcctctggcaggtggttgaggatacgctggagctgctgaatagacctacacagaatgctcgggagaccgaagcaccatag

SEQ ID NO: 24939 - DNA, 1971 bp, Artificial Sequence
  Description of Artificial Sequence: Synthetic coding sequence
atggtgaacgaggcccggggcaacagcagcctgaacccctgcctggagggatctgcgtcttcaggaagtgagagctcaaaagatagcagtagatgcagtacaccagggctggaccccgaaaggcacgagaggctgcgtgaaaagatgcgccgcagacttgaatcaggggacaaatggttcagtttggaattcttccctcctagaactgcagaaggagctgtgaacctgatctcaaggttcgataggatggcagctggcggtccactctatattgatgtgacatggcacccagcaggggacccaggcagtgataaagagacatccagtatgatgatagcttctactgctgtaaactactgcggtcttgagacgatcctccacatgacctgctgccgccagcgcctcgaagagatcaccgggcatctgcataaagcgaagcagctaggccttaaaaacataatggctttgagaggggacccaattggggaccagtgggaggaagaagaaggtgggtttaattatgcagtcgacctggtgaaacatattaggtctgaatttggcgattatttcgatatctgcgtggccggctatccaaagggccatccagaggcaggttcctttgaggctgacctgaaacatcttaaggagaaggtaagcgcaggcgcggactttataatcacacagctattcttcgaggcagacacctttttccgcttcgtgaaagcttgcaccgacatgggcatcacctgccctatcgtgcctggtatttttccaatccagggctatcactctttgcgccagcttgtgaaactgtctaaactcgaagtaccacaggaaatcaaggatgtcatcgagcctattaaggataatgatgccgccattcgcaactacggtattgaactggcagtcagtttatgccaggaactgttagccagcggcttggttccaggtctgcacttctacacacttaatcgagagatggcgaccactgaggtcctaaaacgcctaggtatgtggacagaagacccccggagacctcttccttgggccctctcagcccacccaaaacggcgagaggaggatgtcaggccgatcttttgggcatctcggcccaagagttacatataccggacccaagagtgggacgagttcccaaacgggcggtgggggaacagttcgagtccagcctttggagaactgaaggactactatctgttctatctgaagagcaaatcaccgaaagaagaattgcttaaaatgtggggagaagaactgaccagcgaggagtctgtgttcgaagtcttcgtgctgtacctcagcggggaacctaatcgcaacggtcacaaagtgacatgcctcccctggaatgatgagcccttagctgccgagacttctctgcttaaggaggaactgttgagggtgaaccggcagggtatcctcacaatcaactctcagcccaacatcaacggaaagccatccagtgatcccattgtaggctggggcccgtccggcgggtacgtttttcagaaagcgtaccttgagtttttcactagcagagagaccgccgaagccctgctccaggttttgaaaaagtacgaacttcgcgtcaattatcatcttgtcaacgttaagggagagaatattactaatgccccagagctgcaacccaacgctgttacttggggaatcttccctgggagagagatcatccaacctaccgtggtagaccccgtgagctttatgttttggaaagatgaggcttttgccttatggatcgaaagatggggaaaactgtatgaggaagaatcgccgtctcggactattatccagtacattcatgacaactattttcttgtcaatttagtggacaacgacttcccgctggacaattgcctgtggcaggtggtagaggacaccctggaactgctcaaccgccccacacagaatgcgcgggaaaccgaggcaccctag

SEQ ID NO: 24940 - DNA, 93 bp, Artificial Sequence
  Description of Artificial Sequence: Synthetic coding sequence
atggtgaacgaggcccggggcaacagcagcctgaacccctgcctggaaggttcagcgagttccggatccgagtcctcgaaagatagcagctag

SEQ ID NO: 24941 - DNA, 432 bp, Artificial Sequence
  Description of Artificial Sequence: Synthetic coding sequence
atggtgaacgaggcccggggcaacagcagcctgaacccctgcctggaagggtctgccagctctggcagtgaaagtagcaaagacagtagccggtgcagtaccccggggttagaccccgaacgccacgagagattgagagagaagatgagacgacgattggaatccggcgacaagtggttcagcctcgagttcttcccacccaggaccgccgagggcgcggttaaccttatttcaagattcgaccggatggcagcaggggggcccctctacattgatgtcacttggcacccggccggggatccgggatctgacaaggaaacctccagtatgatgatcgcgagcactgccgtgaattattgtggccttgaaactatactacacatgacttgttgccggcagaggctcgaagagatcaccggtcacctgcattag

SEQ ID NO: 24942 - DNA, 162 bp, Artificial Sequence
  Description of Artificial Sequence: Synthetic coding sequence
atgtgccggggctgcggctgcctgccccccgacgccccctgccccactctgtgtagccggaaccctgcaatggtgaatgaggcaaggggcaacagttccctgaacccttgtctagaaggaagtgcctcctccggtagcgagtcttcaaaagatagttcttag

SEQ ID NO: 24943 - DNA, 93 bp, Artificial Sequence
  Description of Artificial Sequence: Synthetic coding sequence
atggtgaacgaggcccggggcaacagcagcctgaacccctgcctggaaggttcggcttctagcggaagtgagtcaagtaaagactcctcttag

SEQ ID NO: 24944 - DNA, 2508 bp, Artificial Sequence
  Description of Artificial Sequence: Synthetic coding sequence
atggccgcccccatcctgaaggacgtggtggcctacgtggaggtgtggagttctaacggcactgagaattactcaaaaacatttaccacacagttggtggatatgggagctaaggtaagcaagacctttaacaaacaggtcacccacgtgatcttcaaggatgggtaccagtccacatgggacaaggcccagaagcgcggggtgaaactcgtttctgtcctgtgggtggagaagtgtagaaccgccggcgctcacattgacgagtccctcttcccggccgcaaacatgaacgagcacctttcatccctgataaaaaagaagaggaaatgcatgcagcccaaggattttaattttaaaacaccggagaatgacaaaaggtttcagaaaaagttcgagaagatggccaaggaactgcagcggcagaaaaccaacctggatgacgacgttcctattctgctctttgagagcaatgggagcctgatttacacacccacaattgagattaattctaggcatcatagtgccatggagaagagactccaagagatgaaggagaagagggaaaatctgagcccgacctctagccagatgatccaacagagtcacgacaatcccagtaattcgctctgcgaggcccccctaaacataagccgggacactttgtgttctgacgagtatttcgctggtggccttcactccagctttgacgatctgtgcggaaatagtgggtgtgggaaccaagagcgtaaattagaaggatcgataaatgacataaaatctgatgtgtgtatatctagcttggtgctcaaagcaaataatattcacagtagcccctcctttacccacttagacaaatcttctccacagaaattcctttcaaaccttagtaaagaggagattaatctgcaacggaacattgccggcaaggtcgtgacccccgatcagaagcaagccgcagggatgagccaagaaaccttcgaggaaaaatatagactcagccctactctaagttccaccaaaggacatctattgattcattcacgcccccgctccagcagcgtgaagagaaagagggtgtcccatggaagtcacagtcctcccaaagagaagtgtaagagaaaacgatcaactaggcgctccatcatgccacgccttcagctctgtagatccgaggacaggctgcagcatgtagccgggcctgctctagaagccctgagctgtggggaaagttcctatgacgactacttttcgccagataatcttaaggaaagatacagcgagaacttgccgcccgagagtcagctgcctagctcgccagcccagttgtcttgtcgcagcctgtctaaaaaggaaagaacgtctattttcgagatgtctgacttcagttgcgtcggcaagaagaccagaacggttgacattactaattttactgccaagactatcagttcaccccgaaagacgggcaacggggaaggccgggccactagctcatgtgtaacgtccgcccccgaagaggccctccgttgttgtcgacaagcggggaaagaggacgcctgtccagagggcaatggtttctcatataccatcgaagatccggcactcccgaaaggccacgatgatgacctgactcccctcgaagggtctctggaggagatgaaggaagccgtcggcctgaagagtacgcaaaacaagggtaccacaagcaagatctccaactcctccgagggtgaggcccagagtgagcatgaaccatgttttatcgttgattgcaacatggagacctcaaccgaagagaaggagaacctaccagggggctactcaggaagcgttaagaaccgacccacacggcacgacgtgctagacgacagctgtgatgggttcaaagatctgatcaagccacacgaagagttaaagaaaagtggaagggggaagaaaccaaccaggacactggtaatgacctccatgcccagcgagaagcagaatgtggttatccaggttgttgacaagctcaaggggttctccatcgcccccgatgtctgtgagacaaccactcatgtccttagcgggaagcccttaaggacactgaacgtcctgctcggcatagctcgtggctgttgggtgctatcttatgactgggtcctatggagcttggagcttggccactggatcagcgaagagcctttcgagctttcccaccattttcctgctgcaccactgtgtaggagcgagtgccatctctccgccggtccttacaggggtactctctttgcagaccagcccgctatgttcgtaagcccagcttctagcccaccagtagcgaagctctgcgaactcgttcacctgtgtggtggaagggtgtcccaggtcccaagacaggcttctatcgttataggtccgtattcaggcaagaagaaggcgaccgtcaagtacctttccgagaagtgggtgctggactccattacacagcataaagtttgtgcacccgagaactacttgctctctcagtag

SEQ ID NO: 24945 - DNA, 1833 bp, Artificial Sequence
  Description of Artificial Sequence: Synthetic coding sequence
atggccgcccccatcctgaaggacgtggtggcctacgtggaggtgtggagttcaaatggaacagagaactacagcaaaacattcaccactcagctggtggacatgggcgcaaaagtgtccaagaccttcaataagcaagtgactcacgtgatcttcaaggacggataccagtctacctgggataaggcccaaaaaagaggagtgaagcttgtgagcgttctgtgggtggaaaagtgtcggacagccggcgctcacatcgacgagtcattgttccccgcagcaaatatgaacgagcatctgagcagtttaattaaaaagaagagaaaatgcatgcagccgaaggattttaattttaaaacgcctgaaaatgacaagcgattccaaaaaaaattcgagaaaatggctaaggaacttcagcggcaaaaaactaacttagacgacgacgtcccgattctccttttcgagtccaacggatcactcatatatactccaactatcgaaatcaactcaagacaccacagcgctatggaaaagcgactgcaggagatgaaggagaagagggaaaacctttctcctacatcatcgcaaatgatccagcagagccacgataatccttcaaacagcctctgcgaggccccgctgaacatttcccgggacaccttatgttcagatgaatattttgccggcggtctgcatagtagctttgatgacctttgcgggaacagcggctgcggcaatcaagagagaaagcttgagggcagtatcaacgatattaagtctgatgtgtgtatctctagtcttgttcttaaggctaacaacatccactcttcaccttcattcacccacctggacaagagctcgccacagaagttccttagcaacctctccaaagaagagatcaacttacaacgcaacattgccggcaaggtggtaacccctgaccagaagcaagcagctgggatgtcacaggagacgttcgaggagaaatatcgcctttcacccactctctcatccacaaaaggccatttgctgatacacagtcgacctaggtcttcatcagtgaagagaaagagagtgtcgcatggctcccactccccgcctaaagaaaagtgcaagcggaaaagatccacaagacggtccataatgccgaggctccagttatgtagatccgaagatcgcctccaacacgttgcaggtccagccctggaagctctgagctgtggcgagtcttcttatgacgactacttttcaccagacaacctgaaagaacgctactctgaaaatctgccacctgaatctcagcttccaagcagcccagcccagctaagctgtagaagtcttagtaagaaggagaggacctctatctttgaaatgtcagacttttcgtgcgtaggaaagaaaaccagaacagtcgatataaccaatttcactgcaaaaaccattagctctcctcgcaagacgggcaatggcgaaggccgcgccactagctcatgtgtgacctctgctccagaagaggcccttaggtgctgccgtcaggcagggaaagaggacgcctgtccagagggaaatggcttttcttataccatcgaagaccctgccctgcctaagggacatgacgatgacctgactccattggaaggaagtcttgaagaaatgaaagaggcagtaggattgaagagcacgcagaacaaggggacaacgtcaaagattagcaattccagtgagggagaagcacagagcgagcatgagccctgcttcattgtagattgcaatatggaaacctcaacagaggaaaaggagaatcttcccgggggttattcaggatctatgtag

SEQ ID NO: 24946 - DNA, 1689 bp, Artificial Sequence
  Description of Artificial Sequence: Synthetic coding sequence
atggccgcccccatcctgaaggacgtggtggcctacgtggaggtgtggagctctaatggcacagaaaactactccaaaacattcaccacgcagctcgtcgatatgggagccaaggtttctaaaacattcaacaagcaggtgacccatgtgatctttaaggacggctaccaatctacttgggacaaggcacagaaaagaggggtgaagctggtgagtgtattgtgggttgagaagtgtcggacagccggggcccatatagacgaaagtctgtttcccgctgctaacatgaatgaacacctgtcctcgctgatcaagaagaagcgaaaatgtatgcagcccaaagatttcaacttcaagacgccagagaatgacaagcggttccagaagaagtttgagaaaatggcaaaagaactgcagcggcagaagaccaatctagcatcccagatgatccagcagagtcacgacaacccatctaactccctgtgtgaagcccctctcaacatctcaagggacactctgtgttccgacgaatacttcgccgggggactgcactcttcctttgacgacctctgtggcaattcaggctgtgggaaccaggaacggaaactggaggggagtattaacgacatcaagtccgatgtctgcatttcatctctggtacttaaagccaataacatacatagctcaccctctttcacgcatctggataaatcctcgccccagaagtttctctctaacctgtctaaggaagaaattaacttgcagcgaaacatcgccggcaaggtggtgacgcccgatcagaagcaggcggccggtatgagccaagagacattcgaagaaaagtacaggctcagtcctaccctttcaagtaccaaaggccacctattgatacatagccgccccaggtcttccagtgtgaaacgcaaacgagtttcacatggcagccactcaccacctaaggagaagtgcaagcgaaaacgttcaaccagacgttccattatgccccgactgcaactatgcagaagcgaagacaggttgcagcacgtcgctggtcctgcccttgaagcgcttagctgcggagagtcctcctacgacgattatttctcacccgataacctgaaagaaagatattcggagaatcttccccccgaaagtcagcttccatcatctcctgcccagctctcttgtcggagtctgagcaaaaaggagcgcacaagtatctttgagatgtctgacttctcatgtgtcggcaagaaaacccggaccgtagatataaccaacttcactgcaaaaaccataagcagcccccggaagaccggaaacggagaaggaagggcaacatcctcatgcgttacctccgcacctgaagaagcactgcggtgttgtcggcaagccggaaaggaggacgcttgtcctgaagggaacggattctcatacaccatcgaggatcccgcactacctaagggtcatgacgatgacctgacacctttagagggaagtctggaagaaatgaaagaggcagtgggcttaaaatcgacccaaaataagggaacaacgtccaagatttcaaattctagcgagggtgaggctcagtcggaacacgaaccatgcttcattgtggactgtaacatggagacctcgaccgaggaaaaagaaaatctgccaggcgggtacagcggaagcatgtag

SEQ ID NO: 24947 - DNA, 234 bp, Artificial Sequence
  Description of Artificial Sequence: Synthetic coding sequence
atgaacgtgctgctgggcagcgtggtgatcttcgccaccttcgtgacgctttgcaatgcatcctgttattttatcccgaatgaaggagtaccgggtgattcgactagaatgtttctgcacctgtgggtaatgacgaagactaccgccaaagagtccagtcgcaggaggaccgctagcattagttggtggcgaaggagaacacagaaaaggcctgtgctaagtgtgaacggttag

SEQ ID NO: 24948 - DNA, 345 bp, Artificial Sequence
  Description of Artificial Sequence: Synthetic coding sequence
atgaacgtgctgctgggcagcgtggtgatcttcgccaccttcgtgactctgtgcaatgcatcatgttatttcatccccaacgaaggggtgcctggcgatagcacgcgcaaatgtatggatctcaagggaaataaacaccccatcaactccgagtggcagaccgataattgcgaaacatgcacgtgctacgagacagaaatctcttgctgcacactcgttagcactccagtcggatacgacaaggacaattgtcagcggatctttaaaaaggaggactgcaaatacatagtcgtggagaagaaggacccgaagaagacgtgctccgtgagcgaatggattatctag

SEQ ID NO: 24949 - DNA, 3813 bp, Artificial Sequence
  Description of Artificial Sequence: Synthetic coding sequence
atgaccgacgacaacagcgacgacaagatcgaggacgagctgcagacattttttacatccgacaaagacggcaatacgcacgcctataatcccaaatcgccccccacacagaattcctcagccagcagtgtaaactggaattcagccaatccggacgacatggtcgtggattatgagacggatcctgccgtggtgaccggtgaaaacatcagcctgagcctccagggagttgaagtatttggacacgagaagtcttcatccgacttcatcagcaaacaagtgctggatatgcataaggacagcatctgccagtgtcccgccctcgtcggcaccgaaaagcctaagtatctgcagcactcttgccactcactcgaagccgtggagggacaatctgtggagccttctctgccatttgtctggaagcctaatgataatctgaactgcgccggttattgtgatgccctcgaattgaatcagacatttgacatgactgtcgataaggtgaactgtacgttcatttctcaccatgcaattggaaaaagccaaagctttcacacagccgggtccctccccccaacaggtagaaggagtggctcgactagcagccttagctattcaacctggacttcatctcactccgacaaaacacacgccagggagaccacctacgatcgtgagtcctttgaaaacccgcaagtcaccccctctgaggcacaagacatgacatataccgccttctccgacgtggtgatgcaatcagaggtgtttgtgtccgatataggaaatcaatgcgcctgtagttccggcaaggtgaccagtgaatacactgacggctctcagcagagactggttggcgaaaaggagacccaagcacttacccccgtgagtgacggcatggaagttcctaatgactcggccctgcaggagtttttctgcctctcacatgatgagtccaattcggaaccccattcgcagtccagctatcggcataaagagatgggacagaatctgagggaaaccgtgtcttactgcctgatcgacgatgagtgccccctgatggtgcccgcatttgataaatctgaggcacaggtgttaaacccagagcacaaagtgactgagactgaggacacccaaatggtgtctaagggcaaagacttgggtacacagaatcacacttccgagcttatactttcatcaccgccaggacagaaagtgggctcctcattcggactcacctgggacgctaacgacatggtgataagcactgacaaaacaatgtgcatgagcactcccgtgctcgaaccgactaaagtaacatttagtgtttctcctatagaggccacagagaagtgcaaaaaggtagagaagggtaaccgcggcctgaaaaacattcccgatagcaaggaggcgccagtcaatctgtgcaagccctcacttgggaaatctacaataaaaacaaacacacccatcggctgtaaagttagaaaaaccgagatcatcagctacccacgtcccaacttcaagaacgtcaaagcaaaggtaatgtcccgtgcggtattgcagcctaaagatgccgcactctccaaagtaacaccaaggcctcaacagacaagcgctagctctcccagctctgtaaactcacgccaacagaccgttctgtcacgcactccaaggtcagacctaaatgcagacaagaaggctgagatcctcataaataagacgcataaacagcagttcaataaactgataacctcccaggcagttcacgtgacaactcattcaaagaatgcctcccacagagtcccacgtaccacatctgccgtgaaatcaaaccaggaagacgtggacaaggcatcttcaagcaattcggcgtgtgagacaggctcagtgtcagccctgttccagaagataaaaggcatactcccagtaaaaatggagtccgccgagtgtctggagatgacatacgttccaaacatcgatagaatcagtcctgaaaagaagggagagaaggaaaacggcacatccatggaaaagcaagaacttaaacaggagatcatgaacgagacattcgaatatggcagcctcttcctaggatccgcttctaagacaactacaacgtctggaagaaatatctcaaagcctgacagttgtggtctgcgacagatagcagcccccaaagcaaaggtaggaccccccgttagttgcctccgtaggaatagtgacaaccgaaatccttctgctgatagagctgtctcacctcaaaggattcggcgggtgagttcttccggaaaacctactagcctgaaaacagcccagtcttcttgggttaatctcccccgccccctgccaaaaagcaaagcctccttaaagtctcccgccctgcggagaacaggttctaccccctctatcgcttcaacacattccgagctctctacatacagtaataattccggcaacgcggctgtgatcaagtacgaagagaagcctcccaaacctgcttttcagaatggctcatccgggtcattttatttaaagccactagtcagtagggcacacgttcacttgatgaaaacaccaccaaaaggtccttctcggaagaacctgtttacggctctgaatgctgtcgagaaaagtcggcagaaaaacccccggtcattatgtatccagccccagaccgcgcccgacgccctgccccccgagaagaccttggaacttacccagtataaaaccaaatgcgaaaatcaatctggtttcattcttcagttaaagcagctgctggcctgcggaaacacaaaattcgaggccctgactgtggtcattcagcatcttctaagtgagagggaggaggccctgaagcagcataagaccctttctcaggaacttgtgaatcttaggggcgagctggttacagctagtaccacatgcgagaagctggaaaaagccagaaatgagctgcagacagtgtacgaggctttcgtgcagcagcatcaggcggagaagaccgagcgcgaaaatagactcaaggaattctacacccgggagtacgagaaattacgggatacatacatcgaggaggcggaaaaatataagatgcaactccaagaacagttcgacaatttgaacgctgcccacgagacatccaaactggagatcgaggcttcgcattcagagaaactggagctgctaaaaaaggcctatgaagcatcattgtcagaaatcaaaaaaggccacgagatcgagaagaagtcacttgaggacctgctgtcagagaagcaggaaagtctggagaaacagattaatgacctcaaaagcgaaaacgacgccctcaatgaaaagctgaaatctgaggaacaaaaacgccgtgcgcgcgagaaagccaatctcaaaaatcctcaaatcatgtatttggaacaagagttggagtcacttaaggccgtgcttgaaatcaaaaatgaaaaactccaccagcaggacattaagctgatgaagatggagaagctagtggacaacaacactgccctcgtggacaagctgaagagatttcagcaggagaatgaggagcttaaagctcgcatggacaaacatatggcaatatcacggcagctttctaccgagcaggccgtgttgcaggagtctctggagaaggaatctaaagtgaataagcggttgagcatggagaacgaggaactgctgtggaagctgcacaacggggacctctgttcccctaaacgctccccaacatctagcgctattcccctgcagagtccaaggaacagtgggagctttccaagccccagcatctctcctaggtag

SEQ ID NO: 24950 - DNA, 1311 bp, Artificial Sequence
  Description of Artificial Sequence: Synthetic coding sequence
atgctgctgagccccaagttcagcctgagcaccatccacatccggcttaccgccaaggggcttctgcgtaatttgcgcttgccctccgggtttcgccgctcgaccgtcgtgtttcacaccgtggagaagtcacgccagaaaaacccccgatccctgtgtattcagcctcagacagctcctgatgccctacctcctgagaaaaccctggaactgacccagtacaaaacaaaatgtgagaatcagtcagggttcatactccagctgaaacagctcctggcctgcggaaatacaaagtttgaggctcttaccgtcgtcatccagcaccttttgtcggagcgtgaggaggctctcaagcagcataaaacactatctcaggagctagttaacctgagaggcgagctggtgacagcatccacgacatgtgagaagctggaaaaggcccgaaacgagctgcagacagtctatgaggccttcgtacagcagcaccaggcagagaaaaccgagagagagaatcggctgaaggagttctacactagagaatacgagaaactgcgggacacctacattgaggaagccgagaagtataagatgcagctacaagagcagtttgacaaccttaatgcagctcatgagacttctaagcttgagattgaagcaagccactcagagaagctggaacttcttaagaaggcatacgaggcatcgctcagcgagatcaaaaaggggcatgagatcgaaaaaaagtctttggaggacttgctctcagaaaaacaggaatctctggaaaagcaaattaatgatctgaaatcggagaatgatgcattgaatgaaaagctcaagagtgaggaacagaaacgccgagcgcgtgagaaggccaatctcaagaacccccagattatgtatctggaacaagaactcgagagcctaaaagccgtcctggaaataaaaaacgagaagcttcaccaacaggacatcaagttgatgaagatggagaaattagtagataacaacactgccctcgtggataagctgaagaggttccaacaggagaatgaagagctgaaggctcgtatggacaagcacatggctatcagcagacagctgtccactgagcaagctgtgctacaggagagcctggaaaaggaaagtaaggtgaataaacgcctctcaatggagaacgaggaattattatggaagctgcacaatggcgatttgtgttcgccgaaacgctctcccacttcctccgctattcccctgcagtcccccaggaacagcggttcgtttccctcaccatcaatctcgccaagatag

SEQ ID NO: 24951 - DNA, 1554 bp, Artificial Sequence
  Description of Artificial Sequence: Synthetic coding sequence
atgaccgtgcccggcggcttccggagctgcaccgagaccgacatctcttctaagattttcattaacagcactctgacgccacccgctggaagcgaaagacactacgacgcaacactcctgacactgttggttgtgggaagttacagcctatgcatcatacctcttttggcgaccttcaccggcaagaaaaccgggaacgccgcggtcattaagtacgaggaaaagccaccaaagcccgcttttcaaaacggcagttccggatcattctatctcaagcccctggtgtcgagagctcacgtgcatctcatgaagacacccccgaaggggccatcccgcaaaaatctattcacggctctcaacgccgtggagaaatcccgccagaagaacccccgttctctgtgcattcagcctcaaaccgcgccagatgccctgccccccgagaaaacccttgagctgactcagtataaaaccaaatgcgaaaaccagtctggctttattctgcagctgaagcagctgctggcgtgtgggaacaccaaattcgaagccctgactgtcgtgatccaacatctcctgtctgagagggaagaggcgctgaaacagcataaaacgctaagtcaggagcttgtcaatctcagaggggaactggtgactgcgtccactacctgcgaaaagctggagaaggctcggaatgagctgcagaccgtttacgaagcatttgtgcagcaacaccaagctgagaagaccgaacgggagaaccggctgaaggagttctatacacgcgaatacgaaaaactgcgagacacatatattgaggaagctgagaagtacaaaatgcagctccaggaacagtttgataatctaaacgcggcccacgagaccagtaagcttgaaattgaggcaagccatagcgaaaaactggagcttctcaagaaggcctatgaagcctcattgtcagagatcaaaaagggtcacgagattgagaagaagagcttggaggatctgttgagcgaaaagcaagagtccctggagaagcagataaatgacctgaaaagtgaaaacgatgcactgaatgagaagctgaaatctgaggaacagaaacgacgggcccgggaaaaagcaaatttgaagaacccccagataatgtatctcgaacaggagcttgagagcctcaaagcggtcctcgaaattaaaaacgaaaagctccatcagcaggacatcaaattgatgaagatggaaaagctggtagataacaacacagccttggtggacaagctcaagaggttccagcaagagaacgaggaactcaaggcccggatggacaagcacatggcaatctctcgccagctgtctaccgaacaggcagtgcttcaagagtctctggagaaggagagcaaagtgaacaaacgactttccatggaaaacgaggagttgctctggaagctgcataatggggatctgtgcagccctaaacggagtcccacaagcagcgcaatccctctgcagtctccccgaaactcaggcagcttcccatcgccttctatttcaccgaggtag

SEQ ID NO: 24952 - DNA, 2313 bp, Artificial Sequence
  Description of Artificial Sequence: Synthetic coding sequence
atgaccgacgacaacagcgacgacaagatcgaggacgagctgcagacatttttcacgagtgacaaggacgggaacactcatgcctataatccaaagtcgcctcctacccaaaattcgtcagcctcatctgtcaactggaactcagccaatcccgatgatatggtggtcgactacgagactgatccagccgtagtcaccggcgaaaatatatctctgtctttgcagggagtcgaggtgttcggacatgaaaaatcatcgagtgatttcatctctaaacaggtccttgacatgcataaggactctatttgccaatgtcccgctctagtggggacggagaagcccaaatatttgcagcattcctgccattcattggaagcagtggagggccaatctgtcgagccatccttaccctttgtctggaagccgaacgataatctgaattgcgccgggtattgtgatgcattggagctgaatcagacatttgacatgaccgtagataaggttaactgtacctttatcagccaccatgccatcggtaagtcacaatcttttcatacagcagggtctcttccccccactgggagacgttcgggttcaacgtccagcttgtcctattcaacctggacgtcttctcactccgataaaactcacgcccgcgagacaacttacgatcgggagtcattcgagaatcctcaagtcacccccagtgaagcccaggatatgacgtacacagccttcagcgacgtggtgatgcagtccgaagtctttgtttcagatataggaaatcagtgtgcttgctcgtccgggaaggtcacaagcgagtatactgacggaagtcagcagcgcctggtgggggagaaagagactcaggcattaactcccgtatcggatggcatggaagttcctaatgattctgcattgcaagaattcttttgtctgtctcacgacgagagtaactccgagcctcactcccaatccagttataggcacaaggaaatgggccagaatctgcgcgagaccgtgagttactgcttgattgacgacgagtgccctcttatggtgccagcgtttgataagtcagaggctcaagtcttgaatccagagcacaaagtgacggagactgaggacactcagatggtttcaaaaggtaaagatctcggcacacaaaaccacacaagtgagcttatcctgagctctccccctggtcagaaggtagggagcagcttcggtcttacctgggatgccaacgatatggtgatcagcacagataagaccatgtgcatgtctacaccagttctggagcctaccaaggtgacattttcagtctcacccatcgaggctacagagaaatgtaagaaggtagagaagggaaatcgggggttgaagaatatccccgattctaaggaagctcccgttaacctctgcaaacctagtctaggcaagtcgaccattaagactaatacaccgatcgggtgcaaggttaggaaaaccgaaataatcagctacccgcgcccgaacttcaagaacgttaaagctaaggtgatgtcccgcgctgtgctgcagccaaaggatgccgccctgtcaaaggtcacaccccgcccccagcaaacctcagcctcatctccgagctctgtgaattcgaggcagcagaccgtgctttcaaggacccctcggtcagacctgaacgctgataagaaagctgagatcttgatcaataaaacgcacaaacagcagtttaacaagttgatcacatcgcaggccgtccacgtgactactcacagtaagaatgcatctcatagggtgcccagaacaacgtcggccgtgaagtcgaaccaggaagacgttgacaaggcatcgagctcaaatagcgcatgtgagactggtagtgtctcggcgctgttccaaaaaataaagggcattctcccggtgaagatggaaagcgcagagtgtctggaaatgacttacgtcccaaatatcgaccggatttcgcccgaaaaaaagggagagaaggagaacggcacaagcatggaaaagcaggagctgaagcaagagattatgaatgaaaccttcgagtatgggagcctgttcttggggagtgcatccaaaacgacaactacctccgggcgcaacatttcaaaacccgacagctgtggactgcggcagatcgctgcccctaaagcaaaagtcgggccaccagtgtcttgtctcaggagaaatagtgataacagaaacccaagcgcggaccgcgcagtgagcccccagagaattcgaagggtgtcttcctccgtactgcccaaagcggctttctcttag

SEQ ID NO: 24953 - DNA, 3651 bp, Artificial Sequence
  Description of Artificial Sequence: Synthetic coding sequence
atgaccgacgacaacagcgacgacaagatcgaggacgagctgcagactttctttacaagcgacaaagatggcaatacccatgcctacaacccaaaaagccctccaactcagaacagcagcgccagctcagtgaattggaacagcgctaatccagacgacatggtagtcgactatgaaaccgatcctgccgtggtgaccggggagaatatttcacttagcctgcaaggagtggaggttttcgggcatgagaaatcctccagtgattttattagtaaacaggtgctggatatgcataaagactccatctgccagtgtcccgctcttgtggggacggagaaaccaaagtatttacagcactcttgtcactcacttgaggcggtggaagggcagtcagtggaacccagcctgccatttgtgtggaaacctaatgacaatttgaattgtgccgggtactgcgatgcattggaactgaatcagacatttgacatgacagtcgacaaggtgaactgcaccttcatcagccaccatgcaattggtaagagtcagtcctttcatacagccgggtccctgccaccaacggggcggcgctccggatctacttcaagcctgtcatacagcacgtggacttcatcgcactctgacaagactcacgcacgagaaacgacttacgacagggaaagcttcgagaaccctcaggtaacccccagtgaagcacaggacatgacttatactgccttttccgacgtcgtaatgcagagcgaggtcttcgtgagtgacattggaaaccagtgtgcatgctcaagcggtaaggtgacatctgagtatacggatggttctcagcaacgcctggtcggcgagaaagagacccaggctttaacacctgtcagcgatggaatggaggtgccaaacgattctgcccttcaggagtttttctgtctgtctcacgacgagagcaactctgagcctcacagccagagtagctaccgtcacaaggaaatgggccagaatctgagagagactgtaagttactgtcttatagatgatgagtgcccacttatggtcccagcattcgataaatctgaagcacaggtcctgaatcctgaacacaaggtgaccgagacagaagacacccaaatggtgtcaaaagggaaagacctcggtacgcagaatcacaccagcgaactaatcctgtccagtcctcctgggcagaaggtgggcagctcgtttgggctgacgtgggatgcgaacgatatggtcatctccacagataagactatgtgcatgtcgacacctgtgctggaacccacgaaggtgaccttctctgtttcgcctatcgaggctactgagaaatgtaagaaggtggagaaaggaaaccgcggcttgaaaaatattcctgacagtaaggaagctccagttaacctatgtaagccttctctggggaagtcgactatcaaaactaacacacctatcggttgcaaagtgaggaaaaccgagattatctcgtatcccagaccaaacttcaaaaatgtgaaagccaaggtgatgagcagggctgtcctgcagcctaaggatgctgctctgagtaaagtcactccacgcccgcagcagacatcagcatccagtccgagctcggtcaatagtcggcaacaaactgtattatcccggacaccccgctccgacttaaatgccgataaaaaagcggaaattctgatcaataagacccacaagcagcaatttaataagttgatcacctcacaggcagtgcatgtgacgacccatagtaagaatgcatcacacagagtacccaggaccaccagtgcggtgaagagcaatcaggaagacgtggacaaggccagctccagtaatagtgcttgcgaaaccggatccgtctccgccctgttccagaagatcaaaggcatactaccagtgaagatggaatccgctgaatgtttagagatgacctacgtccctaatattgaccgaatttctcctgagaagaaaggcgagaaggagaatggcacgtccatggaaaaacaagaacttaagcaggagattatgaatgaaaccttcgagtacggcagtctttttctgggatccgcatcgaagaccaccaccacttcagggagaaatataagcaagcccgacagttgcggcttacggcaaatagctgcaccaaaggcgaaagtcgggccccccgtctcttgtctgcgcaggaattcagacaaccgtaatccaagcgccgatcgcgctgtgtccccgcaaaggatcagaagggtttcttcctccgccggcaacgcagccgtgatcaaatatgaggagaagccgcctaagccagcatttcagaacgggagttctgggagtttctaccttaaacccctggtatccagggctcatgtgcatcttatgaagactccccctaaaggcccctctagaaagaatctcttcaccgcactcaacgcggtggagaagtcacggcagaagaacccacggagtctgtgcattcagccccagactgcccccgacgccttgccccccgaaaaaacattagagctgactcaatacaagacaaaatgcgagaatcagagtgggttcatattgcagttgaaacagctccttgcttgtggtaacacaaaattcgaagccctcaccgttgtaatccagcatctgctctccgagcgagaggaggcgttgaaacaacataaaactctgagtcaggaattggtcaatctgaggggagaactggtgaccgcctctactacctgtgaaaagctggaaaaagcaaggaacgagctgcagactgtatacgaagcttttgtacagcagcaccaggccgaaaaaacagagcgtgaaaaccggctgaaggaattttacacacgggagtatgaaaagctgcgggatacatatatagaagaagctgagaagtacaaaatgcagctccaggagcagttcgacaacctgaacgccgcccacgaaactagtaaactggagatagaagcatctcactctgagaaactggagctcctgaaaaaagcatacgaggctagcctctccgagataaagaaaggacacgagattgagaagaaatctctggaggacctgctatcagagaaacaagaatctctggagaaacagatcaatgacctgaaatccgagaacgatgcgctgaacgagaaactgaagtccgaggaacagaagcgtcgagctagagagaaagccaacctaaaaaatcctcagattatgtatttagaacaggaactggagagtttgaaggcggttttggagatcaaaaacgagaagctgcaccagcaggacattaagttgatgaagatggaaaagctcgtggataataatactgccctggtcgacaaattaaaacggtttcagcaggagaacgaggaactcaaggcacgcatggataagcacatggccatttccagacagcttagcaccgaacaagcagtactccaggaaagtctcgagaaggaatcaaaggttaataaaaggctcagtatggaaaacgaggaactgctctggaagctccacaacggcgatttgtgctcccccaaaagaagtcctacctcatcagccattcccctccagagcccccgcaatagtggctcatttccatcaccaagtatatccccacgctag

SEQ ID NO: 24954 - DNA, 1029 bp, Artificial Sequence
  Description of Artificial Sequence: Synthetic coding sequence
atgggctgccccagcagcaagctgtgcctgtacagcccctgcgccgctactcggcgcgaggaggcactgaaacaacacaagactctcagtcaggagctggttaatttgcggggagaattggtgaccgcttcaaccacttgcgaaaagctggagaaagcacgcaatgagttgcagacagtgtacgaagccttcgtgcagcaacatcaggcagaaaagactgagagggagaatcgcctgaaggagttttatacacgtgagtacgaaaaacttagggacacatacatcgaggaggccgagaagtataaaatgcagctgcaggaacagttcgacaacctcaatgctgcgcacgaaacttctaagctcgagatcgaggcttctcatagcgagaaactggagctccttaagaaggcctatgaggctagcttgtccgagattaaaaaggggcacgagattgaaaaaaaatctctggaagatttgctcagcgagaagcaggaaagtttagagaagcaaatcaacgatttaaaatctgaaaatgatgcactaaatgaaaaactgaaatccgaggaacagaagaggagggcccgagagaaggctaatttaaagaaccctcagatcatgtatctggagcaggaactggagagccttaaggctgttttagaaattaagaacgagaagctgcaccagcaggatattaagctcatgaagatggaaaagttagtggacaacaacactgctttagtggataaactgaagcgctttcagcaggaaaatgaagagctgaaggcccgtatggataagcacatggccatttcccgccagctctccaccgagcaggcagtgctccaagaatctcttgagaaggagtcaaaggtgaataagcgcctttcaatggagaacgaagaactactgtggaaacttcataacggggacctgtgtagtccaaaacgcagcccaacctcatccgctattccactccaatcgcccaggaactctggcagtttcccctctccctccatatcacctaggtag

SEQ ID NO: 24955 - DNA, 3651 bp, Artificial Sequence
  Description of Artificial Sequence: Synthetic coding sequence
atgaccgacgacaacagcgacgacaagatcgaggacgagctgcagacattttttacctccgataaggatgggaatactcacgcctataaccctaaatctccccctacacaaaattcatccgccagctccgttaactggaattcggccaaccccgacgatatggtggtggactatgaaacagaccccgctgtcgttacaggcgagaacatcagcctgtccctacagggggtcgaggtgtttgggcacgaaaaatcatccagtgactttatatccaagcaggttctggacatgcacaaggatagtatttgtcagtgtcctgccctcgtgggcacagagaagcctaaatacctccagcactcttgccattctctggaggcagtggagggtcagagtgtggaaccaagcctgccgttcgtgtggaagcccaatgacaatctaaattgcgcgggctactgcgatgcccttgaactcaaccagacttttgatatgactgtcgacaaggtaaattgcacattcatttcccaccatgctattggcaagagccagtcattccacactgcaggctctttgccacctacgggcaggaggtccgggtccacatcaagcctgtcgtacagtacatggacttctagccacagtgacaagactcacgccagagagaccacatacgaccgtgagtcttttgagaacccacaagtcacaccaagcgaggctcaggatatgacctacaccgccttcagcgatgtggtgatgcagtctgaagtgttcgtcagcgacataggaaaccagtgtgcgtgcagctctggcaaagtgacatctgagtatacagatggttctcagcagcggcttgtgggagagaaagagacccaagcgctaactcctgtttctgatggcatggaagtcccaaatgactcagctctgcaggagttcttttgcttgtcacatgacgagagcaactcagaaccacactcccagtcttcgtatcgccacaaagaaatgggacaaaacctgagggagaccgtgtcttactgcctcattgatgacgagtgcccactgatggtccccgccttcgataaatctgaggcacaagtgctgaaccccgagcacaaagtgactgagacagaagatacccagatggtgtcaaagggtaaggacctgggaacgcagaatcataccagcgaacttatactgagttcccctcccggccagaaagtcggatctagcttcggcctgacctgggatgcaaacgatatggtcatctccacagacaagacaatgtgcatgagcactcccgtcctggagcctacgaaggtcacattcagcgtgagccccatcgaagctactgaaaagtgcaagaaagtcgaaaaagggaaccgggggttaaagaatattcctgacagtaaagaagcaccggtcaacctctgcaaaccgtccctgggcaaatctaccatcaagacaaatacccctattgggtgcaaagtcagaaagactgagatcatctcctaccccaggccaaatttcaagaacgtgaaggccaaggttatgagtcgggcagttttacagcccaaggacgcagccctgagcaaagtaactcctcggccacaacagacctctgccagttctccgtctagtgtaaatagccggcagcaaacagtgttgtctcgaactccaaggtccgatctaaacgccgataagaaagctgagattctgattaacaaaactcataagcagcagttcaacaagttgattacatcccaagcagtgcacgtcactactcacagtaagaatgcctcacaccgggtccctagaaccaccagtgccgtgaagtctaatcaagaagacgtggataaggcctcaagctcgaattccgcttgcgaaaccgggtcggtgtcagcattgtttcagaagatcaaaggcatcctccctgtcaaaatggagagcgctgaatgtttagagatgacgtatgttcccaatattgaccgaataagtcctgagaaaaagggagagaaagaaaacggcacaagcatggagaagcaggaactgaaacaggagatcatgaacgagactttcgagtatgggtcactgtttctgggaagtgcatcaaaaaccacaacaacctcagggaggaatatatcaaagccagacagctgtgggctgcggcagatcgctgctcctaaggcaaaggttgggccacctgtgtcatgtctgcgccggaactccgacaatcggaacccatccgctgacagagccgtgagtcctcagcggataagacgggtcagtagttctgcaggcaatgctgctgttattaagtacgaagagaaacctcctaaacctgcatttcagaatggatcatccggcagcttctatttgaaacctctcgtcagccgggctcacgtgcatttgatgaagacccccccaaaaggcccgtctagaaaaaacctctttacagctctgaatgcggtagaaaaatcacgacagaaaaatccacggtcactgtgcatccagccgcagactgccccagacgcactgcccccggaaaagacccttgagttaacccagtacaaaaccaaatgtgagaaccagagcggttttattctccaacttaaacaactccttgcctgcgggaacacaaagtttgaggcactgaccgttgtaattcaacatctgctgagcgagcgcgaagaggccctaaaacagcataagacactctcccaggagctggtgaaccttcgaggcgaactggtaactgcttcgaccacgtgcgaaaaactcgagaaagcccgaaatgaattgcagaccgtgtatgaggcattcgtacagcagcaccaggcggagaaaacagagcgagaaaaccgtttgaaggagttctacaccagagaatatgaaaagctacgcgacacttacatcgaggaagccgaaaagtacaagatgcaactgcaggaacagtttgataacctcaatgctgcacatgagaccagcaaactggaaattgaggctagccattctgaaaagcttgagctcctgaagaaagcctatgaagcctcactgagcgaaatcaagaaggggcatgaaattgagaagaagtccttagaggaccttttgtccgaaaagcaggaaagcttagagaaacagatcaacgacttgaagtccgagaatgacgccctcaacgagaagctgaaatctgaggaacagaagcgcagggcccgtgaaaaggccaatttgaaaaaccctcaaattatgtacctcgagcaggagctggaaagtctgaaggctgtgttagagataaagaacgagaaactccaccagcaggatatcaaactgatgaagatggagaagctagtggacaataatacggcgttagtcgataagctgaagaggttccagcaggaaaacgaggagcttaaagcaagaatggacaagcacatggctattagccgccaactgagtacggaacaggcagtgctgcaggaatctcttgagaaagagtcaaaagtgaacaagcgtctgagtatggaaaatgaggagctcctgtggaagctacataatggggatctgtgctcccctaaacgttcccctaccagctcagctatccccttacagagtccccggaactctggttcgtttcccagcccatcaatctccccacgctag

SEQ ID NO: 24956 - DNA, 1248 bp, Artificial Sequence
  Description of Artificial Sequence: Synthetic coding sequence
atgaagaccccccccaagggccccagccggaagaacctgttcaccgccttaaacgccgtcgaaaagagccggcaaaagaaccctaggagtctgtgcatacagccacagaccgcccctgatgctctgcccccggagaagacactcgagttgacccagtacaaaactaaatgcgagaaccaaagcggtttcatcttgcagctgaagcagttactggcctgcgggaacacaaaattcgaggctctcactgtggtcatccagcacttgctgtccgagcgggaggaggccttaaaacagcacaagacccttagtcaggagctggtcaaccttaggggggagctggtcactgctagcactacttgcgaaaagctcgagaaggccagaaacgaactgcagaccgtctatgaggcatttgtgcaacagcaccaagccgagaaaacagaaagggagaatcgcctgaaggagttctatacacgagagtatgagaagttaagagacacgtacattgaagaagctgagaagtacaagatgcagttgcaagagcagtttgacaatttgaatgccgcccacgaaacttctaaactggaaatcgaagccagtcactccgaaaaactggaactgctgaagaaggcctatgaagctagtctctctgaaattaaaaaaggacatgagatagagaagaagtccctcgaagacctgctgtcagagaagcaagaatccctggaaaaacagatcaatgatctgaaaagtgagaatgatgcccttaatgaaaaactgaagagcgaggaacagaaacgccgggccagggaaaaggcgaatctgaagaacccccagattatgtacctggaacaagaactggaaagtctcaaagccgtgctggagataaaaaatgagaagctgcatcagcaggacataaaactcatgaaaatggaaaagttggtggataacaacacggcactggtagacaagcttaaaagattccagcaggagaacgaagaactgaaggcccgtatggataagcatatggcaatctctaggcagctgagcaccgaacaggccgtgctgcaggagtccttggagaaagaaagcaaggtgaacaagagactctcgatggagaacgaggagttactgtggaagctgcataacggcgacctgtgttcacccaagcggtctccaacatcatcagccattcccctgcagagtccacggaatagtggtagctttccctccccctcgatatcccctcggtag

SEQ ID NO: 24957 - DNA, 7407 bp, Artificial Sequence
  Description of Artificial Sequence: Synthetic coding sequence
atggccaccgtggtggtggaggccaccgagcccgagcccagcggcagtatagccaatccagctgccagtacaagccccagcctaagtcataggttcctggattctaagttctacctgctggtggtggtgggagaaatcgtcacagaggagcacctacgaagagctattggcaacatcgaactcggaatacgtagttgggatactaatctcatcgagtgtaacctggatcaggagttgaagttattcgtttcgaggcatagtgcaagattctccccagaggtcccaggacagaagatcctgcaccataggtcggacgtacttgagaccgtggtgctgattaatccgtcagacgaggcagtttccaccgaagtgcgcctgatgattaccgacgcagctaggcataaacttttggttctcacagggcaatgcttcgaaaataccggcgagctaattctgcagtctgggagcttcagctttcagaacttcattgagatattcacagatcaggagatcggcgagctgctgagcaccacgcatcccgctaataaagcgtctctcacattattctgtcctgaggagggggattggaaaaactcaaacttggacagacacaatcttcaggattttattaatatcaagctcaactccgccagcatcctccctgaaatggaaggcttgagtgaattcactgaatatttaagcgagtctgtggaggttccatcgcccttcgacattctggagcccccaaccagcggaggcttcttaaagctctcgaagccatgttgttacatttttcccggtggacggggcgattccgccctgttcgccgttaatggatttaacatgctgataaacggaggttctgagcggaaatcatgcttctggaaactgatccgacatctcgaccgggtggactcaattctgctcacccatatcggggatgataatttgcccgggattaactcaatgttgcagcggaaaatcgccgagctggaggaggaacaatctcagggctccaccaccaattcagactggatgaaaaatctgatctcacccgacctgggcgtggtatttttaaatgttcctgaaaatctgaagaacccggagcctaacattaaaatgaaaagaagcattgaagaagcctgcttcaccctccagtacctgaacaaactttccatgaagcccgagccgctgttccgctctgtaggaaatactatcgaccccgtcattctttttcaaaagatgggggtcggcaaactggaaatgtacgtcctcaatccagttaagtcctcgaaggaaatgcaatactttatgcagcagtggacagggacgaacaaggataaagcggaatttattctccctaatgggcaggaggtggatttacccatcagttacttaacaagcgtttcttctctgatcgtgtggcacccagctaaccctgcagaaaaaattatcagagtcctttttccgggcaattcaacccagtacaacatcctggaaggcttggaaaagttgaaacacctagattttctgaagcagcccttggccacccagaaagatctgactggacaggtgcccactccagtggttaagcagactaaactcaaacagagggccgattcccgcgaaagcctgaagccagctgctaagccccttccgtcgaaaagcgtgcggaaagagtctaaggaggagacacctgaagtgacgaaggtgaatcacgtagagaaacctccaaaagtcgaaagtaaggagaaggtaatggtgaagaaggataaacctatcaagaccgaaacgaaacccagtgtgacagagaaggaggtccccagtaaggaagagccttcaccagtgaaggcagaggtggccgaaaagcaggctaccgacgtaaagccaaaagcagccaaggagaaaaccgtgaaaaaagagaccaaggtgaaacccgaagacaaaaaagaagagaaagaaaagccaaagaaagaagttgcgaagaaagaggacaagacccccataaagaaggaagaaaaaccaaagaaggaggaagtcaaaaaagaagtcaaaaaggagatcaaaaaggaggagaagaaggagcccaagaaggaggtcaaaaaggagaccccccctaaagaggttaagaaggaagtgaaaaaggaggaaaaaaaggaagttaagaaagaagaaaaagaacctaagaaggagatcaaaaaactcccgaaagatgcaaagaagtcttctacacccctgtcagaggcaaagaagccggccgcattgaagcctaaagtccctaaaaaggaagagagtgttaaaaaggactccgttgcagctggtaaacccaaggagaaaggcaagatcaaagtgatcaagaaagagggcaaagccgctgaggccgtggccgccgctgtggggaccggcgccacaaccgccgcagttatggcagctgcagggattgccgccatcggccccgcaaaagaactggaggctgagcggtcccttatgagctcacccgaagacctgactaaagatttcgaagagcttaaagccgaagaagtggatgtgaccaaagatatcaaacctcagcttgagctgattgaggacgaagaaaaactcaaagagaccgagccagttgaggcctacgttattcagaaagagcgcgaagtgacaaagggtccagccgagagtcctgacgaagggatcacaactaccgagggggaaggtgaatgcgaacagaccccagaggaactcgagccagttgagaagcagggcgtcgatgatattgagaaattcgaggacgaaggcgccgggttcgaggagtcctcagagacgggggactacgaggaaaaagcggagactgaggaagccgaggaacccgaagaggatggcgaagagcacgtgtgcgtaagtgcctccaaacacagtcccactgaggatgaggaaagcgcgaaagcagaagccgatgcttatattagagaaaaacgcgaatcggtcgcttccggcgacgatcgcgcggaggaagacatggatgaagcaatcgaaaagggcgaagcagagcaatctgaagaagaagcggatgaggaggacaaggcggaggatgcccgtgaagaagagtatgagcctgagaaaatggaagctgaggactacgtcatggcggtagtagataaggccgctgaggccgggggggcagaagaacaatacggattcctaactactccaaccaagcagctcggcgcgcaatctcccggcagagagccggcaagctctattcatgatgaaacccttcctgggggatcagaatcagaagctacagcgagcgatgaggaaaaccgcgaggaccagccggaagaattcacagccaccagcggttatactcagtccacgattgaaatctcctcagagcctactccaatggatgagatgagtacaccacgggatgtgatgtccgatgagacaaataacgaagagactgagagtcctagtcaggaattcgtaaatataactaaatacgagtcctcattgtactcacaagaatattctaagcccgccgacgtcacaccactgaacggcttctcagaaggaagtaagacagatgcaaccgacgggaaggactataatgcttccgcctctaccatcagcccaccatctagcatggaggaggacaagttttcacggtctgccctccgggatgcgtactgcagcgaagttaaggcctccactactctcgacataaaggactctatctcagcggtcagctctgagaaagtgtccccgagcaaaagtccctctctatccccttcgccgcccagcccactagaaaagaccccattgggggaacgtagcgttaacttttctttgaccccgaatgaaataaaggtctccgccgaagctgaagtcgctcccgtgtctcccgaggtgactcaagaggtagtggaggagcattgtgcctcgcccgaagataaaaccctggaagtggtctcgcccagtcaaagtgtcaccggctcagctggccacaccccttattatcagagccctacggatgagaagagctctcacttgcccactgaggtcatcgagaagcctcctgcagtgcctgtgtcctttgagttttcagacgctaaggacgaaaatgaacgggccagcgtatctcccatggacgaaccagttcccgactcagaatccccaatcgagaaggtcctctctcccctacgctctccacccctcatcggtagtgagtccgcatacgagagttttctatcggccgatgacaaagcgagcgggaggggagcagagagtcctttcgaagagaagtctggcaagcaagggagcccagatcaggtgagtcctgtgtctgaaatgacttccacttctttataccaggataaacaggaaggaaagtcaaccgacttcgcccctatcaaagaagacttcggacaggaaaagaagaccgatgacgttgaggctatgtcgtcgcagccagcactagcattggatgagagaaagctgggtgacgtgtcacccacccaaatagacgtcagtcagtttggaagtttcaaggaagatacaaagatgagcatctctgaagggacagttagcgacaagagcgcaactcctgtggatgagggcgtagctgaagacacatactcccacatggaaggggtcgcgtccgtctcgacagcctccgtggcaactagtagctttcctgagcccaccactgacgatgtcagcccaagtctccacgcagaagtcggcagcccccattcgacagaggtggacgactctctttctgtaagcgtggtgcagacacccacaacattccaggagactgagatgtccccatctaaagaggaatgtccccggcccatgtccatcagtcctcccgatttttctcccaaaaccgccaagagtagaacacctgtacaggatcaccgtagtgagcaatctagcatgtcaatcgaatttggccaagaatctcctgagcaaagcctcgccatggatttcagtcgccagagcccggaccaccctacagtgggagctggcgtgttgcacatcacggagaacgggccgacagaggtggactacagcccttctgacatgcaggatagcagcctgagtcacaaaattccgcctatggaggaaccttcctatacccaggataacgacctgtccgagctcatttccgtttctcaagtggaggctagcccctctacctccagcgctcacacaccctctcaaatcgcctcgcccctccaggaagacaccttatcggacgtggccccaccacgggacatgtccctctatgcctccttgacaagcgagaaggttcaatctcttgagggcgagaaactctctcccaaatctgacatctccccgctgactccaagggagtcaagccctctgtattctccaactttctccgactctacttctgccgtgaaagagaaaacggcaacctgtcactctagctctagcccccccatcgatgccgcttcagcagaaccctacgggtttagagctagcgtgctgttcgatactatgcagcaccacctcgcgttaaaccgagatttatccacgcccggcctggagaaggactcaggaggtaagaccccaggagacttttcctatgcctaccagaaacccgaggagaccacacgctcacctgacgaagaggactacgattacgagtcttacgagaagaccacacgcacatcagacgtaggcggctattattacgaaaagatcgaaagaacaacaaagagcccatcagattcaggctattcatatgaaactatcggaaagaccaccaagacgcctgaagatggagactactcatacgagattatcgagaagaccactagaactccagaggagggtgggtactcctacgacatctccgaaaagacaacttccccacccgaggttagcgggtattcatatgagaagacggagcgatctaggaggctgctagatgacatctctaatggatacgacgattcagaggatggcggtcataccctgggcgacccatcatatagttacgagaccaccgaaaagatcaccagctttcccgaatcagaaggatactcctacgaaacatccaccaagaccactaggaccccggataccagcacctactgttatgagactgcagagaagatcactcgcacaccgcaagccagcacatatagttacgagacctctgacctctgctataccgccgagaagaagagcccatccgaggcccgtcaggacgtggatctgtgcctcgtgtcatcctgcgaatacaagcaccccaagacagaacttagccccagttttataaaccctaatcccctggagtggtttgctagtgaagaacccacagaggaaagcgagaaaccattaacccagtctgggggggcgcccccgcctcctgggggaaaacagcagggacgacagtgcgacgagactcctccgacttcagtctctgagtccgcaccatcacagaccgattcagatgtgccgcctgagacagaagagtgtccttccattacagccgatgcaaatattgacagcgaggacgagagcgagacgatccccactgataagactgtgacttataaacatatggaccccccaccagcccccgtgcaggatcgttccccttctcccagacaccccgacgtgagtatggtggatccggaggcattagccatcgaacagaacctgggcaaggccctcaaaaaggatctgaaggagaagaccaaaactaagaagccaggaacaaagacaaagtccagcagccctgttaagaaatctgacggcaagtcgaagcccttagcagcttccccgaaaccagcagggctgaaagagtcttcagacaaagtcagtagggtggcttccccgaagaagaaggaaagcgttgaaaaagccgctaaaccaacgaccaccccagaagtgaaggcagcacgtggtgaggagaaggataaggagacgaagaatgccgccaatgcttctgcttccaaatctgctaaaactgcgacggccgggcctggtacgacaaaaaccacaaagagcagtgctgttcccccaggactgcccgtgtaccttgatctgtgttatatccctaaccattcgaactctaagaacgttgacgtcgaattctttaagagggtccgcagctcctactacgtggtcagcggtaacgacccagccgcagaggaaccaagcagggccgtgctggatgcgctgctcgaaggcaaggcgcagtgggggtcgaatatgcaggtaactcttattcccactcacgatagcgaggtcatgcgagagtggtaccaggagacacatgagaagcagcaggatctgaacataatggtccttgcgagtagctctacagttgtgatgcaggacgagtcttttccagcttgtaaaatcgagttgtag

SEQ ID NO: 24958 - DNA, 432 bp, Artificial Sequence
  Description of Artificial Sequence: Synthetic coding sequence
atgcagcaccggggcttcctgctgctgaccctgctggccctgctggcccttacctcggcggtcgccaaaaagaaggacaaggtgaagaaaggagggccagggtcagagtgcgctgaatgggcttggggcccctgtaccccctctagcaaggactgcggtgtcgggttcagggaaggcacctgcggcgcccagactcagcgaatcaggtgccgggtcccttgcaattggaagaaagaattcggagccgattgcaaatataagtttgaaaactggggagcctgcgacggtggaacaggcactaaggttagacagggcaccctgaagaaagctcgttataacgcgcaatgtcaagagactatcagagtgacaaaaccatgtactccgaagactaaggccaaggccaaagccaagaaaggaaagggaaaagactag

SEQ ID NO: 24959 - DNA, 432 bp, Artificial Sequence
  Description of Artificial Sequence: Synthetic coding sequence
atgcagcaccggggcttcctgctgctgaccctgctggccctgctggctcttaccagtgccgtggctaagaaaaaggacaaagtgaaaaagggcggaccaggctcagagtgtgcggaatgggcttggggcccctgtaccccaagttcaaaggactgcggagtcggctttcgcgaaggcacgtgtggggcccagactcagcggatcagatgcagggtaccctgcaattggaaaaaggagtttggcgctgattgcaagtataaattcgagaactggggagcatgcgatggggggaccgggaccaaagtgagacaggggactttgaagaaagcccgatataacgctcagtgtcaagagacaattcgggtcaccaaaccatgtacccctaaaacgaaagctaaggcgaaggctaagaaggggaagggtaaagactag

SEQ ID NO: 24960 - DNA, 432 bp, Artificial Sequence
  Description of Artificial Sequence: Synthetic coding sequence
atgcagcaccggggcttcctgctgctgaccctgctggccctgctggctctgacatctgccgtggcaaaaaagaaagataaagtaaagaaagggggtcccggcagtgagtgtgccgagtgggcctgggggccgtgcacacctagcagtaaggactgcggcgttgggtttagagaagggacctgtggagctcagactcagagaatccgatgccgtgtgccttgtaactggaaaaaggagttcggcgcagactgtaagtataagtttgagaactggggcgcctgcgatggcggaaccggcacaaaggtgcgccagggtacactcaagaaggccagatataacgctcagtgtcaggagaccatccgagtcaccaaaccttgtacgcccaagacaaaagccaaagccaaggcaaaaaaaggcaagggaaaggattag

SEQ ID NO: 24961 - DNA, 459 bp, Artificial Sequence
  Description of Artificial Sequence: Synthetic coding sequence
atgcagcaccggggcttcctgctgctgaccctgctggccctgctggccttaacatctgccgtggctaagaaaaaggaggagggcgccctgcagtgttcagtgccaggggaccaccctaggcatcaagccttgcacccgcaggatcagtctaaaggccagtcgcaggaaagagagggtaaagggttagacgcaaagcctggatgccagggggcacctggggtgacgtggggcctggcccatgccctccccttaccgggcccaagatgcgaccctcctgtgccttccgtgtgctctctcgcattaattaatcatgctctcccgtgtcccagccactctcctgcacctcccctctcagctcagtcaggtgaaggccaaggaatcctcggctcactttccctgccgcaatctaacgtgagtcctcgtgcccgattctgtagtagccctcagtttcattattag

SEQ ID NO: 24962 - DNA, 432 bp, Artificial Sequence
  Description of Artificial Sequence: Synthetic coding sequence
atgcagcaccggggcttcctgctgctgaccctgctggccctgctggctctgacttctgccgtcgctaagaagaaggacaaagtaaaaaaaggaggcccgggtagcgaatgcgccgagtgggcctggggcccctgtacaccttccagtaaggactgcggagtagggttccgcgaagggacttgcggggctcaaacccaacgcatacgctgtcgggtgccatgtaactggaagaaagagttcggagccgactgcaagtacaagtttgagaactggggggcgtgcgacggagggacaggcacaaaggtcagacaaggtaccttgaagaaagcccggtataatgcacagtgtcaggaaactattcgggtgacgaagccctgcaccccaaagaccaaggccaaggccaaggccaagaagggcaaaggaaaagactag

SEQ ID NO: 24963 - DNA, 432 bp, Artificial Sequence
  Description of Artificial Sequence: Synthetic coding sequence
atgcagcaccggggcttcctgctgctgaccctgctggccctgctggccttgacaagcgccgtggccaagaagaaggacaaagttaaaaaaggtgggccaggctcagagtgcgccgagtgggcttggggcccttgcaccccatcttcaaaggactgtggggtgggatttagggagggcacttgcggcgcccagacccaacgtattagatgtcgtgtgccatgtaactggaagaaggagtttggagccgactgcaagtacaaattcgagaactggggcgcatgcgatggcggcaccggaaccaaggtgcgacaggggacccttaagaaggcacgttacaacgcccagtgtcaagaaacaatccgggtgacaaaaccgtgtacccctaaaacaaaagcgaaggccaaagccaaaaagggaaaaggtaaggactag

SEQ ID NO: 24964 - DNA, 432 bp, Artificial Sequence
  Description of Artificial Sequence: Synthetic coding sequence
atgcagcaccggggcttcctgctgctgaccctgctggccctgctggccctcacttccgctgtggccaaaaaaaaagacaaggtgaaaaaagggggtcccggatctgagtgtgccgagtgggcctggggcccgtgcacaccatccagtaaagactgcggcgtcgggttccgggagggaacatgcggagcacaaacccagcgcattaggtgcagagtgccttgcaattggaaaaaggagttcggtgctgattgcaagtataagtttgaaaattggggcgcctgcgatggggggactggtacaaaagtgcggcagggaaccctgaagaaggcacgttacaacgcccagtgccaggagaccattcgcgtgactaagccctgtacacccaaaacaaaagccaaggccaaggccaaaaaggggaagggaaaggactag

SEQ ID NO: 24965 - DNA, 150 bp, Artificial Sequence
  Description of Artificial Sequence: Synthetic coding sequence
atgcagcaccggggcttcctgctgctgaccctgctggccctgctggcgttgacctcagctgtagccaaaaaaaaagacaaagttaagaagggcggccctggatcagagtgcgccgagtgggcgtggggcccatgcactccgtcctcatag

SEQ ID NO: 24966 - DNA, 396 bp, Artificial Sequence
  Description of Artificial Sequence: Synthetic coding sequence
atgcagcaccggggcttcctgctgctgaccctgctggccctgctggcactcacctctgcggttgctaaaaagaaggacaaggttaaaaaaggcggtcccggatcggaatgtgcggaatgggcgtggggcccttgcacacctagctcaaaggattgcggagttggattccgtgaagggacctgtggtgcccagacccaacgcattcggtgcagggtgccatgtaattggaaaaaagagtttggtgctgactgtaagtacaaatttgagaattggggcgcttgtgatgggggaacgggaaccaaagtccgacaggggactttaaagaaagccagatacaatgcacagtgccaggagacaatccgcgtgacaaaaccttgtactcccaagaccaagtag

SEQ ID NO: 24967 - DNA, 264 bp, Artificial Sequence
  Description of Artificial Sequence: Synthetic coding sequence
atgcagcaccggggcttcctgctgctgaccctgctggccctgctggctctaacaagcgctgttgccaagaagaaggccgattgcaagtataaatttgaaaattggggcgcatgcgatggcggaaccgggacaaaagtgaggcagggcaccctaaaaaaagcgagatataatgcacagtgccaggaaactattcgcgttacaaaaccctgtacccctaagacgaaggcgaaggctaaggctaaaaagggtaagggaaaggattag

SEQ ID NO: 24968 - DNA, 2715 bp, Artificial Sequence
  Description of Artificial Sequence: Synthetic coding sequence
atggccgagagcagcgagagcttcaccatggccagcagccccgcccaacgccgtcgcggcaatgaccctctgaccagtagccctggccggtcaagtaggcggactgatgctctgacttcctcaccgggccgggaccttcccccattcgaagatgaaagtgagggcttgctcggcactgagggtcccctcgaagaggaggaggatggggaagagctgattggggatggcatggaacgcgattacagggctatacccgagctggacgcctatgaggccgaaggattggcattagacgatgaagacgtcgaagaattaacagcttcccaacgcgaagccgccgagcgcgccatgcggcagagggatcgagaagctgggcgaggcctaggccgcatgagaagaggccttctttacgacagcgatgaggaagatgaggagcgccccgctcgtaaacgtcgccaggtcgaacgggctacagaggacggtgaggaggacgaggaaatgatcgagtctatagagaacttggaggacctgaaaggtcactcagtacgggaatgggtgtctatggccggcccgcgactggaaatccaccatcgtttcaagaacttcctgcgaacacacgtggattcacatgggcacaacgtattcaaggaacggatatccgacatgtgtaaggagaacagagagtctctcgtggtaaactacgaagatttggccgctcgcgagcacgttttggcttatttcttgccagaggctcctgccgaattactccagattttcgatgaggcagctctcgaggtggtgctggcaatgtatccaaaatatgacaggattactaaccatatacacgtcaggatttctcacctgcccctagtggaggagctcaggagcttgcgccagctccacctgaatcaactgatccggactagcggcgtggtgacaagctgtaccggagtgttacctcagctctcgatggtcaagtataactgtaacaaatgcaacttcgtgctggggcccttttgtcaaagccagaaccaagaggttaagccagggagctgccccgaatgccagagtgccgggccctttgaagtgaatatggaagagaccatctatcagaattatcaacgaattagaatccaggagtcgcccggcaaggttgctgccgggcgattgcctagatctaaggatgccatccttctggctgatttggtggactcttgcaagccaggggatgaaatcgagctgaccggaatctatcataacaactacgacggttctctgaatacagctaatgggttcccggtgttcgcgaccgtcatcctggccaaccacgtggcaaagaaggataacaaggttgctgtcggtgagctgaccgacgaagacgtgaaaatgatcacatctttgtctaaggaccagcagattggcgagaaaatcttcgccagtatcgctccaagcatttacggccacgaggacatcaaaagagggctcgccctggctttattcgggggagaaccgaagaaccctggtgggaagcataaagtcagaggggacatcaatgtgctgctgtgcggagaccccggcacggctaaatcccagtttctgaaatatatcgagaaggtgtctagtagagctattttcacgaccgggcagggggcctctgctgtgggactaaccgcatatgtccagcgacaccctgtgagcagagagtggactctagaggcaggagccttagtgctggccgatcgcggcgtatgcctcatcgatgagtttgacaaaatgaatgatcaggacaggacatcaattcacgaggccatggaacaacagagtatcagcatatctaaggcaggtatcgtgacctcactgcaggctaggtgcactgtgattgctgcagccaatcctattgggggaagatacgacccctcgctcacctttagtgaaaacgtggatctgactgaacccatcatttctcgttttgacatcttatgtgtggtacgcgacaccgtggaccccgtccaggatgaaatgctcgccaggtttgtcgtcggttcacacgtgcgacaccaccctagtaacaaggaggaggaaggtctggccaacggctccgcagctgagcccgctatgccgaacacctacggagtcgagccactccctcaagaggtcctcaagaaatacattatctatgctaaagagcgggtccatccaaagctaaatcagatggaccaggataaagtggctaaaatgtattccgatctacgcaaggagtccatggctacaggctcaatcccaattacggtacgccatattgaatcgatgatccgcatggctgaagcacacgcaaggatccacctgcgggactatgtgatagaagacgacgtcaatatggcaatccgcgtgatgcttgagtcgttcatagacacacaaaaattctcggttatgagatcgatgcggaagacttttgcacgatacctctcattcagaagggataacaacgaattgctgctgtttatcctcaagcagctggtagcggaacaggtgacatatcaacgtaaccgtttcggcgcacagcaggatactatcgaggtgccagaaaaggacctggtggataaagcacgccagattaatatccataatttgtccgccttttatgactcagaactgtttaggatgaacaagttttcccatgacctcaagcggaaaatgatcctccagcagttctag

SEQ ID NO: 24969 - DNA, 2427 bp, Artificial Sequence
  Description of Artificial Sequence: Synthetic coding sequence
atggccgagagcagcgagagcttcaccatggccagcagccccgcccagagacgcagaggcaatgaccccctgaccagcagccccgggtggggtctcggcaggatgagaagagggctgctctacgacagtgacgaggaagatgaggaaagaccggcacgtaagcgaaggcaggtagagagagccactgaggatggggaggaagacgaggagatgattgaatccatagagaacctggaagacctgaaaggccattcagtgagagaatgggttagcatggccggcccgcggcttgagatccaccatagatttaagaactttttaaggacacacgtcgactcccacggacataacgtttttaaggaaaggatctcagacatgtgtaaggagaaccgggagtctctcgtcgttaactacgaagatctggctgccagggagcacgtactcgcatacttcctacctgaggcgccagccgagcttctgcagatcttcgacgaagccgctctggaggtggtgttggccatgtatccaaaatatgataggataactaatcacatccatgtgaggataagccatctcccactggtggaggagctgaggtcactgcggcagctgcatctgaatcagttaatccgaacctcaggcgtggttaccagttgtacaggagtgcttccccagctgtcaatggtgaagtacaactgtaataagtgtaattttgtgctcggccctttttgtcaatcccagaaccaagaggtgaagcccgggtcgtgcccagaatgccagagtgcagggcctttcgaagtgaacatggaagaaaccatctaccagaattatcagcggatacggatccaggagtctccggggaaggtcgccgccggccgcctcccgagaagcaaagacgctatcctgttagccgatctcgtggattcgtgcaaaccaggcgacgagatagagctgacaggtatatatcacaacaactacgacggctctctaaatactgccaacggattccccgttttcgctacagtgatacttgctaatcacgtggcaaagaaagataataaggttgccgtgggtgagctcacagacgaagacgtcaaaatgatcacaagcctaagtaaagaccagcagataggtgagaaaattttcgcaagcatcgcaccaagtatatacggtcatgaggatatcaagcgaggcctcgcccttgccttgtttggaggggagcccaagaaccccggcggcaagcataaggtcagaggagatatcaatgtccttttatgcggagaccctggaacagccaagtcccagttcctgaagtatattgagaaggtgtcaagcagggcgattttcactaccggtcagggtgcctcagctgtcgggctcacggcatacgtgcaaagacaccctgtctctagggagtggacactggaagccggggccctggttctggcggaccgcggcgtgtgcctgatcgacgagtttgacaaaatgaatgaccaggatagaacatcaatccatgaggcgatggagcagcagagcatttcgataagcaaagcaggaatcgtcacctcccttcaggcacggtgtactgtgatcgcagctgctaatcctatcggtgggcgatacgatccatccctgacctttagcgagaacgtggacctgaccgagcctataatctctagattcgacatactctgtgtggtgagagataccgtggacccggtccaggatgagatgttggcgaggttcgtagtgggtagccacgtccggcaccacccgtccaacaaagaagaggaaggcttggccaacgggtcagccgccgagccagccatgccaaatacctacggagtggaacccttgccgcaggaggttctcaagaagtatatcatctacgcaaaggaaagggtgcatcccaaactgaatcagatggatcaggataaggtcgccaaaatgtactctgatctcagaaaagaatccatggcaacaggcagtatacccatcaccgttaggcatattgagagcatgatacggatggctgaagcgcacgcacgaatccacctccgagactacgtgatcgaagatgatgtgaacatggcaatccgggtgatgttggaaagtttcatcgatacccagaagtttagtgtaatgagatccatgcgcaagacttttgcacggtatctctccttccgccgagacaacaacgagctcctgctgttcattcttaagcaactggttgcagagcaggtgacctaccagagaaatcgctttggcgcccagcaagacacgattgaggtccccgagaaggacttggtagataaggctaggcaaattaatatacataatttgagcgcgttttacgattcagaactgtttcggatgaataaattttctcacgacctcaagcgcaagatgattcttcagcagttctag

SEQ ID NO: 24970 - DNA, 2865 bp, Artificial Sequence
  Description of Artificial Sequence: Synthetic coding sequence
atggccgagagcagcgagagcttcaccatggccagcagccccgcccaaaggaggagggggaatgaccctctaacctcgtcccctgggcgtagttctagacgcacagacgccctaacgtcctcgcccggacgtgacctgcccccatttgaagacgaatctgagggattgttggggaccgaggggcctctcgaggaggaagaagatggcgaggagctgataggagacgggatggagcgagactaccgtgcaatccctgagctcgatgcatacgaagccgaaggactggcgctggatgatgaagacgtggaagagttaactgcgtcccaaagggaggcgggacgggggctcctgtacgattccgacgaagaagacgaggagaggcccgctcgtaagagacgccaagtcgagcgagctaccgaggatggggaggaagacgaagagatgattgaatcgattgaaaacctagaagatctgaagggacacagtgttagagaatgggtgagcatggccgggcctagactggaaatccatcataggtttaagaacttcctccgcacccacgttgactcccatggacataacgtgttcaaggagcggatcagcgacatgtgtaaagagaatagggagtccctcgtggttaattacgaggatctggctgctagagaacacgtactggcctatttcttgcctgaggctccagctgaactgctgcagatctttgacgaagccgccctagaagttgtcctcgccatgtatccaaagtatgatcgtattactaaccacattcacgttcgaataagccacttacccttggttgaggaactccggtcactcaggcagctacacttgaatcaattgatacgcacaagtggagtcgtgaccagctgcactggggtactgccccagctgagcatggtaaagtacaactgcaacaaatgcaacttcgtgctgggacctttctgccaatcccagaaccaggaggttaaacctgggtcttgtccggagtgccaatctgctgggccattcgaggtgaacatggaagagacaatctaccaaaactaccaacgcatcagaatccaggagtctcccggaaaggtggctgctggccgtctccccaggagcaaagatgcaatattattggcagatctggtcgacagctgcaagccgggcgatgagatcgaactcactgggatttaccataacaactatgacggttcactgaacactgccaacggcttccctgtatttgcaaccgttatattggcgaaccacgtcgccaagaaagacaacaaggtagccgtgggagagctcacagatgaggatgtgaagatgataactagtctatcaaaggaccagcagatcggcgagaaggaatcatctaggaatgcatccctggcggaggccggcataggcgcaatcccctcccagctgctggcgattgagccgagcctgagacggagcggcgttccgataggagaggtgggagtcagtcagaggcaggaagcgcgatcattcagcagcgctaatacccactggttcctagaagacctccttggccccagctgtagggacaccatgatctttgccagcattgctcccagtatctatggccatgaagatatcaaaaggggactcgccttggccctgtttggcggcgaacctaagaacccaggcggaaagcacaaggtcaggggagatatcaatgttttgctgtgcggagatcccggaacagccaaatcacaattcctgaagtacattgaaaaggtcagcagccgtgcaatctttactactggccaaggagcctccgccgtcgggctaactgcttacgtgcagcgtcacccagtgtctcgggaatggacattggaagcgggggcactggtgctggcggatcgtggcgtttgtctaatcgatgagttcgataaaatgaacgatcaggacagaacatcaattcacgaggcgatggaacaacagtctatttccatcagcaaagctggtatcgtgacctcccttcaggcccgttgtacagtgatcgctgccgccaaccccatcggcggcagatatgaccctagcctgacgtttagcgagaatgtggacttgaccgaaccgattatcagccggtttgacatactctgcgtggtccgggacacggtggaccctgtccaagatgaaatgctggccaggttcgtggtgggttcccatgtgcggcatcacccaagcaacaaggaggaggaaggcctcgccaacgggagcgctgccgagcccgctatgcctaacacctatggtgtcgaaccactcccacaggaggttctgaaaaagtacattatttatgccaaagagagagtgcaccctaagttaaatcagatggatcaggataaggttgcaaagatgtactcagacctacggaaggagtctatggcaaccggttccatcccaatcaccgtgcgacacatcgagagcatgatcaggatggctgaggctcatgcacgaatccatttgcgggattacgtgatagaggatgatgttaatatggcaatcagagtgatgttggaatcttttatcgacacacagaaattttcagtcatgaggtccatgaggaaaacctttgctcgctacctgtcctttcgcagggacaataatgagctgctccttttcatcttgaagcagctggtcgccgagcaggtgacctaccagcgtaaccgttttggagcccagcaggacaccattgaagttccggagaaggaccttgttgacaaggctcggcaaatcaatatccataatctatctgcattctatgactcagaactgtttcgcatgaacaaattctcccatgacctcaagcgtaagatgattctgcagcaattttag

SEQ ID NO: 24971 - DNA, 753 bp, Artificial Sequence
  Description of Artificial Sequence: Synthetic coding sequence
atggccctgcgggccggcctggtgctgggcttccacaccctgatgactttactgtctccacaggaggccggtgcaaccaaagctgatcatatgggatcctacggccccgctttttatcaatcctacggcgcctcaggacagttcactcacgagttcgatgaggaacagctgttcagtgtggatctaaagaagagcgaggcagtgtggcgattgccggaatttggcgacttcgctcggtttgatccacaaggcgggctggctggcatcgctgctatcaaagcccatcttgacattctcgtagaacgatctaacagaagccgtgcgataaacgttcctcccagagtcacagtgctgcctaagagtcgggtggagctgggccagcccaacatcctcatttgcattgttgataatatcttcccaccagtgattaacataacctggctccggaatggccagaccgtgacggagggcgttgcccaaactagcttctattcgcagccagatcacctgtttaggaagtttcactatctgccttttgtgccctcggctgaggatgtgtatgactgccaggtggagcattggggtctagatgcaccccttctccggcactgggagctgcaagtgcccattcccccaccagacgctatggaaaccttggtgtgtgccctcggcctagctattggcctggtgggatttctcgtgggcaccgtgctcatcatcatgggaacatacgtcagctccgtaccacgctag

SEQ ID NO: 24972 - DNA, 993 bp, Artificial Sequence
  Description of Artificial Sequence: Synthetic coding sequence
atgcaccggtaccgggcccccggcgagcaggacggcgacgccatgccactaggcagcgcagttgatatcttggctactgacgatcctaatttttcccaggaagatcaacaggacacccagatatatgaaaaacacgataaccttctgcacggcacaaagaagaaaaaagaaaagatggtgtctgctgctttcatgaagaaatacattcatgtggctaagattatcaaacccgtgctaacccaagagagtgcaacatatatcgcagaggaatattcccgcctcagaagccaggacagcatgtcttctgatacagcacgaactagcccagtgaccgcccgaactctcgaaacactaatcagactggctacggcccatgctaaagctcgcatgtccaaaacagtcgatttacaggacgccgaggaagccgtggaactagtgcaatacgcttactttaaaaaagttctggaaaaagaaaagaagcggaaaaagcggtcagaagacgagtccgagactgaagacgaggaggaaaagagccaggaggatcaggaacagaagcgcaagcgaaggaaaactaggcagcctgacgccaaggatggggactcctacgacccttacgacttctctgacactgaggaggagatgcctcaggttcacacccctaagaccgcagactctcaagagactaaggaatcacaaaaggtggaactcagcgagagtcgggacggcatcagtccatgttgccccggatggtcctggactcctggcctgaaacagtcgttctacctgtctctcccaaagggatgggactataggcataaaccactgtgccttttcgatctgatattgttcaacgactgtagggtgtcaatggttgagggaatacaggggggacccctggggtgcgtcccaggatcttcctgcgcagtgaacagacatgaaagccctcatcgcatccatcagcccggacagagacgcgccctgctcttctcctag

SEQ ID NO: 24973 - DNA, 2289 bp, Artificial Sequence
  Description of Artificial Sequence: Synthetic coding sequence
atgtggagctgcggccggctgcgggagatcacctggaccagctggaccacacgcctgcttaacaacgccttcgaggaactggtagcctttcagcgcgcactaaaagatttcgttgcatctattgacgcgacatatgcaaagcagtacgaagaattttacgttggcctggaagggtcatttggaagcaagcacgtcagcccgcggacgctcacctcctgctttctaagctgcgttgtgtgcgttgaggggatcgtgaccaagtgcagcctggtacgccccaaggtggtccggtctgtgcattactgtcctgcaacaaagaaaacaattgagcgaagatactccgacctgacaaccctcgttgcttttccttccagcagtgtgtaccccaccaaggatgaggaaaacaacccgctagagaccgagtacggactcagcgtgtataaggatcatcagaccattacaatacaggaaatgccagagaaagctcccgcaggccaactgccacggtcagtggatgtcatcctcgatgacgacttagttgacaaagccaagccgggagaccgtgtgcaggtggttgggacttatagatgtctgccgggcaagaagggtggctataccagcggaactttcagaactgtgctcattgcttgtaatgtgaaacaaatgtccaaagacgctcagccttctttctccgccgaggatatcgccaagattaaaaagttctccaaaacgcggtcaaaggatatcttcgaccaactggctaaatccctcgccccctccatccacgggcatgactacgtcaagaaggctattctctgtttgctcctggggggagtggaacgcgacctagaaaacggtagccacattcggggggacattaacattctcctgatcggcgatcctagcgtggccaagagccagctcttgagatacgtgctgtgtacagccccccgtgccatccccactactgggcggggtagtagcggggtcggattgaccgccgcagtgactactgaccaggaaaccggcgaacgccggttagaggctggagccatggtgctcgccgaccggggagtagtgtgcatcgacgagtttgataaaatgagcgatatggatagaaccgctatccatgaagttatggagcaggggcgggtgactattgccaaagccgggatccacgcacggctcaacgcccgttgttcggtgctggctgccgctaacccggtctacgggcgttacgaccaatataaaacaccaatggaaaatatcggcctgcaggattccctgctcagcagattcgacctgctgttcattatgctggatcagatggacccagagcaggatcgcgaaatctctgaccacgtccttcgcatgcaccgctacagagcaccaggcgagcaggacggcgatgccatgcctttaggatctgccgttgatatccttgcgaccgacgaccccaatttcagccaggaggatcagcaggacactcagatctatgaaaaacatgataatcttcttcatgggacaaaaaagaagaaggaaaagatggtcagcgccgcttttatgaagaagtacatacatgtcgccaaaattatcaaacctgtcctgacccaagagagtgcaacctatattgccgaggagtacagtcgacttcgttctcaagacagcatgagctctgacaccgccagaacaagtccggtgacagccagaaccttagaaacactgatcaggctagcgaccgcccacgctaaagctcggatgtccaaaaccgtggacctccaagacgcggaggaagccgtggagctcgtgcagtatgcctatttcaaaaaggtgctcgagaaggaaaagaaaagaaagaagcggagcgaagatgaatcagagactgaggatgaagaggagaagtcccaggaagatcaggagcagaaacgaaaacgaagaaagacacgccaaccggacgccaaagatggagatagctatgacccgtacgatttttcagatacagaagaagagatgcctcaggtgcatactcctaagaccgcagactctcaggaaaccaaggaatcacagaaggtcgagctttctgaatctaggctgaaagcctttaaagtggcacttcttgatgtatttcgagaggcccacgcccagtcaattgggatgaataggttaaccgagagcattaaccgggatagcgaggaacccttcagctccgttgagatccaggccgccctgagcaaaatgcaggacgataaccaggttatggtctccgagggaatcatatttctgatttag

SEQ ID NO: 24974 - DNA, 987 bp, Artificial Sequence
  Description of Artificial Sequence: Synthetic coding sequence
cggtaccgggcccccggcgagcaggacggcgacgccatgcccctgggttccgctgtcgatattctcgctactgacgatcccaacttctcccaggaggatcagcaggatacccagatatatgagaagcatgacaacctccttcacggtacaaaaaaaaagaaagaaaagatggtgagcgccgcatttatgaagaaatacatccatgtagccaagatcataaaacccgttctgacacaagagagcgcaacatacattgcagaggagtatagcagactccgcagccaggacagcatgtcctcggacaccgcgcgaacctcacccgtcactgcacgtacacttgagaccctaatacggttggccacagctcacgccaaggctagaatgtcaaaaactgtggacctgcaggacgccgaggaggcggtggaactagtccaatacgcctatttcaaaaaggttttggaaaaggaaaagaaaagaaaaaaacgcagcgaggatgagtcggaaacggaggacgaagaggagaagtcacaggaggatcaggagcaaaagagaaagcgccgaaagacacgccaaccagatgccaaggatggcgactcttacgacccctacgatttcagcgacacagaggaggagatgcctcaggtacatacacccaagaccgcggactcgcaagaaaccaaggaatcacagaaggttgaattgtcagagtctcgcgatggcatctctccttgctgccccggttggagttggactcctgggctgaagcagtctttttacctgtcactgcctaaggggtgggactacagacacaaaccgctttgcttatttgatctgattctctttaacgactgtcgcgtgtcgatggttgagggaatccagggagggcctcttggctgcgttcccgggagttcttgcgccgtcaaccggcacgaaagtccacaccggattcatcagcccggacagcgaagagcactgctattctcctag

SEQ ID NO: 24975 - DNA, 2562 bp, Artificial Sequence
  Description of Artificial Sequence: Synthetic coding sequence
atgctgccccggagcccccccctgccccggggcaacctgtggtggagggaggagtttggaagtttcagagctggcgtcgagtcaagttgggagcctcccagagacttcggcggagggagcagcctggctgcggggatggccggaactgtggttttggacgacgttgagttaagagaggcacagagagactatctggatttccttgatgacgaagaagatcaggggatctaccagtccaaagtaagggagttgatttcagataaccagtacaggctcatcgttaacgttaacgacttaagacgcaagaacgaaaagagggcaaacaggctcctaaacaacgccttcgaagagctggtggcttttcaaagagccctgaaagacttcgttgcttccatcgacgcaacatatgcaaagcagtatgaggaattctacgtgggcttggaagggagttttgggtctaaacatgtgtctcccagaactctgacctcgtgcttcttgtcctgtgtggtctgcgtggaggggatcgtcacaaagtgttcccttgtccgtcctaaggtagttcgctctgttcactattgccccgctacaaagaagactattgaaaggcgttattccgatctgacaacccttgtggcatttcccagttcctccgtgtaccctacgaaggacgaagagaacaatccgctcgagacagagtatggattaagcgtgtacaaggaccaccaaactatcacaattcaggagatgcccgagaaagcaccagccgggcagctcccgaggagtgtcgacgtcatcctcgacgacgatcttgtcgataaggcaaaacccggggatagggttcaggtagtgggaacttataggtgtttgcccggtaagaagggaggctacacctccggcacattcaggacggtgttgatagcatgcaacgtcaagcagatgagtaaggacgcccaaccctcctttagcgcggaggatatcgccaaaattaaaaagttctctaaaacacgttctaaggatatctttgaccaactggctaaatccctggctcctagcatacatggacacgactacgtgaagaaagccattctttgcctgctcctgggcggcgtggaacgcgatctggagaatggctcccatatacgtggtgacattaacatcctgctgattggtgatcccagtgtggctaaatctcaacttctgcgctatgtgctgtgcactgccccaagagctatacctaccacaggacgcggtagtagcggggtgggcttaacagctgccgtgactacggatcaggaaaccggtgagagacgcctcgaagccggagcaatggtgttggctgatagaggagtggtttgtatcgatgagtttgataagatgagcgacatggaccggaccgccatacacgaggtgatggagcagggaagagttacaatagccaaagcaggcatccatgcgcgcttaaacgctagatgcagtgtgctggcggccgcaaatcctgtgtatggccgatacgaccagtacaagaccccaatggaaaatatcggcctccaagattcactcctaagtcgttttgatctgctgttcataatgctggaccaaatggatcccgagcaggatcgtgaaatatcggaccatgtgctaaggatgcaccggtacagggcgccaggggaacaggatggggacgcaatgcctcttggatcagccgtggacattctagctaccgatgaccccaacttttctcaagaggaccagcaggacactcagatctacgagaaacacgataacctcctgcacggcacaaagaagaaaaaagagaagatggtgtcggccgcgttcatgaagaagtatattcatgtggctaaaataataaagccggtgttaacacaggaaagcgccacgtacattgcggaggagtactccaggctccggtcccaggattcaatgagtagtgatactgccaggactagtcccgtcactgcacgcaccctggaaactcttatccggctggccactgcacacgcaaaggccaggatgtcaaaaactgtggatctgcaggatgctgaggaggctgtcgagctggtgcagtatgcatacttcaaaaaagttctggagaaagagaagaagcgaaaaaaacgaagcgaggatgaaagcgagaccgaggatgaagaagagaaatctcaggaggaccaagaacaaaaacgaaagcgacgcaagacccggcaaccagatgccaaagatggtgacagctacgacccttatgatttctccgacacagaagaggagatgcctcaggtgcacacacctaaaaccgcagattcccaggagaccaaggagagtcagaaggtggagctgagcgagagccgactgaaagctttcaaagtggccctcctggacgttttccgtgaggctcatgcccagtcaataggcatgaatcgcctcacagaaagtattaatcgcgactctgaggagccattcagcagcgttgaaattcaagctgccctatctaaaatgcaggatgataaccaggtgatggtatcagagggcattatatttctgatttag

SEQ ID NO: 24976 - DNA, 2592 bp, Artificial Sequence
  Description of Artificial Sequence: Synthetic coding sequence
atgagcagccccgccagcacccccagccggcggggcagccggcggggcagggcgacccccgcgcagacaccccggagcgaggacgcacggagtagtcctagccagcgtcgcagaggtgaagattctacctcaactggggagctgcagcctatgccaacctcgccgggagtcgacttgcagagcccagccgcgcaggacgtcttattcagcagtcctccccaaatgcacagttccgccattcccttggattttgacgtcagtagccctctaacgtatgggacaccctctagtcgggtggagggaaccccccggtccggggtgcgcggaacacctgtcagacagcggcctgatcttggaagcgcccagaaaggactgcaagtggatctgcagtcagatggtgcagccgccgaagatatcgtcgcttcagagcagtcactaggccagaagttggtcatctggggaaccgacgtgaatgtggcagcttgcaaggagaacttccagaggttcctgcaaagatttatcgatccactggccaaggaggaggaaaatgtgggcatagatatcacagaacctctttatatgcagcgacttggggagatcaatgtaattggcgagccgtttttgaacgtgaactgtgagcatattaagtcatttgataaaaatctgtatcgccaattgatcagttatcctcaagaggtgatcccgacattcgatatggctgtaaacgagattttttttgatagatatcctgacagcatcctggagcatcagatccaggtgagaccgttcaacgctttaaagactaaaaatatgagaaacctgaatcctgaggacattgaccagctaatcaccatcagcggaatggtgatcaggacaagccagttgattcctgagatgcaggaggccttcttccagtgccaggtgtgtgctcatacaacccgagtggagatggaccgaggcaggattgcagaaccaagtgtttgcggacgttgtcatactacacactcaatggcactgatccacaaccgttctctgttttccgacaagcagatgatcaaacttcaggagtcacccgaagacatgcccgctgggcagactccccatactgtcatacttttcgcccataatgatcttgtagacaaggtgcaaccaggagaccgggtgaatgtgactggcatttacagagccgtgcccatcagggtgaacccccgggtcagcaacgtgaaatcggtctacaagacacacatcgatgtgattcattaccggaagaccgatgcaaagagactgcacggcctggatgaagaggctgaacagaaactgtttagtgagaaaagagtggagctcctgaaagagctgtctaggaaaccagacatatacgaacggctggcttccgccttggctcccagtatctatgagcatgaggacattaagaagggcatactgctgcaattgtttggaggtactaggaaggacttcagtcacacaggacggggaaagttccgcgccgaaattaacattctgctgtgtggggatccaggaactagtaagtcccagctcctgcagtatgtgtataacttagttcccagaggtcagtacacaagtggcaaggggtctagtgcagtgggactcactgcatatgtgatgaaagacccagaaacgagacaactagtgctgcaaaccggagctttggtgctgagcgataacggtatatgctgcattgatgagtttgacaaaatgaacgagtccacccgcagcgtactgcacgaggtaatggagcagcaaacactgagcatcgcaaaagcaggcatcatctgccagttgaatgcccgcacctccgtcttagccgctgccaatcctatcgaatcccaatggaatcctaaaaagacaactattgaaaacatccaacttccacatacactgctaagcaggtttgatctgatttttttacttttggatccacaagacgaagcgtatgatcgccggctcgctcaccatcttgtggctttgtattaccagtccgaggaacaagctgaagaggagttgttggacatggctgtgctgaaagattatatagcatatgcccactctacgatcatgccccggctgtctgaggaggcctcccaggcgctaatcgaggcctatgttgacatgcgaaagatcggctctagccgaggcatggtttcagcatacccaaggcagctggagtcgctgatacgcctggccgaggctcacgccaaagtcaggcttagcaataaagtggaggctattgacgttgaagaggccaagcgattgcaccgtgaagcacttaaacagtcagccactgacccccgcacaggcatagttgatatcagcatccttacgactggcatgtcagctacaagccgaaaacgtaaggaagagttggccgaggcacttaaaaaactgatactgtctaaggggaaaaccccagcccttaaatatcagcagctgttcgaagacatccgtgggcagagtgatatcgccattacaaaggacatgttcgaagaagccctgcgcgctctcgctgacgacgatttcctcacagtgacgggaaaaactgttcgactcctgtag

SEQ ID NO: 24977 - DNA, 2472 bp, Artificial Sequence
  Description of Artificial Sequence: Synthetic coding sequence
atgcccggccacctgcccctgcgggacgtggaggcccggatccccccacctaggggcagttgtagccgatgtcagccccgattggagtggacttgtcgagcgctacttagaagaacctgttgtttccccgccctacccaaatgcattttgcagctgtctttgcttacactgatgctcgagggcacccctcgcagcggcgtccgtggtacccctgtgaggcaaaggcccgatttgggctccgcacagaaaggcttacaggtggacttacaaagtgatggggccgccgcagaagacattgttgctagtgagcagagtctagggcagaagctcgtaatttgggggaccgatgtaaatgtggctgcctgcaaagaaaatttccagcgctttctgcagaggtttatcgacccactggccaaggaggaggaaaatgttggaattgacattacagagcctctttatatgcagagactcggcgaaatcaacgtgattggagaaccgttcctaaacgttaactgtgagcacatcaagtcctttgacaaaaacctgtataggcagctgataagttacccccaagaggtgattcctacgttcgacatggctgtgaacgagatcttctttgatcgctacccagactctattctggagcatcagatccaagtccggccctttaatgccctgaaaacgaagaatatgcggaacctgaatcctgaggatatcgaccagctgatcacgatctcaggaatggtcattcggaccagccaactgataccagagatgcaagaagccttttttcaatgccaagtgtgtgcacataccaccagagtggagatggaccggggtaggatcgcggaacccagcgtgtgtgggcggtgccacacgacacactctatggctctgatacacaatcgaagccttttctccgataaacagatgatcaagcttcaggagtctcctgaggatatgcccgctggccagaccccacacaccgtcatcttatttgctcataatgatctggtagataaagtccagcccggggatcgagtgaacgtgactggtatctatcgtgccgtgcctatccgcgttaatcccagagtgtcaaacgtgaagagcgtatacaagactcatatagatgtcatacactacagaaagaccgacgccaaacgcctgcatggtctcgacgaggaagcagagcagaaactgttcagcgaaaaaagggtcgaactgttgaaagagctgtctcgcaaaccagatatatatgagaggctcgcgtctgccttggccccatctatttacgagcacgaagacattaagaaaggaatcttgctacagctgtttgggggaactagaaaagatttcagccatacaggacgtggaaaattcagagcggagattaacatactgctgtgcggagatcctggtactagtaagagccagctcctccagtacgtctataacctggtgcccagggggcaatacacatcggggaaaggctcatccgccgtcggtttaacagcctacgtgatgaaggatccagagacccgacagcttgtactccagacaggggccttagtgctctctgacaatgggatctgttgcattgacgagttcgacaagatgaacgaaagtacaagatccgtcctgcatgaggtgatggaacaacagactctaagtattgccaaggccggcattatttgccagctcaacgctcgcacgagtgtcttggccgccgcaaaccctatagaatctcagtggaatccgaagaaaaccaccattgagaacattcagctcccccataccctgttgtctcgatttgacctcatattccttctcctggatcctcaagacgaagcgtacgatagaaggttggcccatcacttggtggccctgtattatcagagcgaggagcaggccgaagaagaattactcgatatggcggttttaaaagattacatcgcatacgcccacagtacaattatgcctagactgagcgaggaggcctcgcaggctttgatcgaagcttatgtggacatgaggaagatcggcagctcacgggggatggtctccgcctatccccggcaactcgagtcattgatacgtctggctgaagctcatgccaaggttagactgagcaacaaagttgaagccatcgatgttgaagaagccaaacgcctccatcgagaggccctcaagcaaagtgcaactgatccacgaacaggtatcgtggatatcagcatcctcacgaccggcatgtctgcaacctctcgcaaacgtaaagaggagctagctgaagcacttaagaagttaatcttgtcaaagggaaaaaccccagccctcaagtatcagcagctgtttgaagacatcaggggccagtccgatatcgcgattactaaggacatgttcgaagaagccctaagagccctagccgatgacgatttcctcaccgtgacaggcaaaactgtcaggcttctgtag

SEQ ID NO: 24978 - DNA, 2592 bp, Artificial Sequence
  Description of Artificial Sequence: Synthetic coding sequence
atgagcagccccgccagcacccccagccggcggggcagccggcgggggcgggctacacccgcacagacacctcgctctgaggatgcccgctccagtccttcacagcggaggagaggagaagactcgacctctacaggggaactacagcctatgcccacttctcccggagttgacctgcagagtcctgctgcacaggatgtcctcttttccagccctccgcagatgcactcaagcgccatccctctcgactttgacgtgagctcgccactcacctacggaaccccctcgtcccgagtggaaggcacacctaggtcaggtgtgcggggcacacctgtgcggcagcgtccggatctgggctctgctcaaaaaggcctgcaggtcgatctccagtccgacggggctgccgccgaagacattgttgcctcagagcagtccctgggccagaagctcgtgatctggggcaccgacgtgaatgttgctgcatgcaaggagaacttccaacgttttttgcaacgcttcatcgatcctttggcaaaagaggaggaaaatgtgggaatcgatatcacagaacccctgtacatgcagaggttaggtgaaataaacgtcatcggcgaacctttcctgaatgtcaactgcgagcacattaagtcttttgataaaaatctttaccgccagctgatatcctacccccaagaggttattccaacattcgatatggccgtcaacgagatttttttcgacaggtatcccgattcaattctggagcatcagatacaggtccgccccttcaacgccctgaaaacgaagaatatgcgcaacttgaatccagaagacatagaccaattaattactatcagcggaatggtgatccgtacctcccagttgattcccgagatgcaggaggcgttctttcagtgccaggtttgtgcgcacactacacgggtcgagatggaccgcggccgaattgccgagcccagcgtatgcggcaggtgccatacaacacactcgatggcccttatccataaccgctccttgttttctgacaagcagatgattaaactacaagaatcccccgaagacatgccagctggtcaaactcctcacaccgtgatcctcttcgctcacaatgacttggtagataaagtacagccgggcgatagggttaacgtcaccgggatttatagagcagtccctattcgtgtgaacccccgcgtcagcaacgtcaagtcagtgtacaaaacacacattgatgttattcattacagaaagactgacgcaaagagactccatggactcgacgaagaagctgaacagaaactgttctccgagaaaagagtggagctgcttaaagaactgtcccgcaagcctgacatttacgagaggctggccagcgccctcgcgcccagcatttacgaacacgaagatatcaaaaaggggatccttctgcagctcttcggcggtacaaggaaagactttagtcataccggacgcggaaagttcagagcagagattaatatactcctttgcggtgaccccggcacctctaaaagtcaactgttgcagtatgtctacaatttggtaccacggggccagtacacttcaggtaaggggtctagtgcggttggcctaacagcgtacgttatgaaggatcctgagactcgccagctcgtgctccagactggcgcactcgtgctgtccgacaatggtatctgctgtatcgatgaattcgacaaaatgaacgagtcgacacggtccgttctgcatgaggttatggaacagcaaactctatctattgctaaggcaggaatcatctgccagctgaatgcccgaacgtctgtcctcgcagcggccaatcctatcgagtcccagtggaatcccaagaaaacaacaatcgaaaacattcaactgccccacactttactgtctcgctttgacctgattttcttactgcttgaccctcaggacgaagcatacgatagacgtctggctcaccatctcgttgctctgtactaccaaagtgaggagcaagccgaggaggagctcctggatatggcagtgctgaaagactacatcgcatatgcgcacagcacgatcatgcctagactgtccgaagaggccagtcaggcccttattgaggcctacgtagatatgcgcaagatcgggagcagtagaggcatggttagtgcctatcctagacagctggaatcccttattagactggccgaggcgcacgctaaggtgagattgagcaacaaagttgaggccattgatgtcgaggaagccaagaggctgcaccgggaggcactgaaacagtcagccaccgacccgcgaactgggattgtcgacatcagcattcttactaccggcatgtcagccacctccagaaagaggaaagaggaactcgcagaggcactgaaaaagttaattctgtcaaagggaaagacacctgccctcaaataccagcagttgttcgaagacattagaggacagagtgacattgccatcacaaaagacatgttcgaggaagccttgagggcccttgccgacgacgactttcttaccgtcactggaaagaccgttcgcttgctttag

SEQ ID NO: 24979 - DNA, 855 bp, Artificial Sequence
  Description of Artificial Sequence: Synthetic coding sequence
atggccccccggctgtgcagcatcagcgtgaccgcccggcggctgctggggggacccggaccaagggccggcgatgtcgcctccgccgctgcagcccgattttacagcaaagacaacgaaggctcgtggttcaggagcctcttcgtgcacaaagttgacccaagaaaggatgctcattccacccttctctcgaagaaagagacctccaatttatataaaattcagttccataatgtaaaaccagagtatctggatgcttataattccctgactgaagccgttctgcctaagctgcacctggatgaggattatccttgtagcctcgtggggaattggaatacctggtacggagaacaggaccaggccgtccacctctggcgcttctccggcggctaccccgctctgatggactgtatgaacaagctcaagaataacaaagagtatctagagttccgccgagagaggtcacagatgttactttcacgccggaaccagctgctcctggaattctccttctggaacgagccccaacctcgaatgggccctaatatttacgaacttagaacctataaactcaagcctggaactatgatcgaatggggaaacaattgggccagagccatcaagtaccgccaggaaaaccaggaggccgtcggaggctttttctcacagatcggggagctgtacgttgtccaccacctgtgggcctataaagatctccaatctcgcgaggagacaaggaacgcggcttggagaaaacgcgggtgggatgagaatgtgtactacacagtgcctctggtacgacacatggagtccagaattatgataccactgaaaatctcgccactgcagtag

SEQ ID NO: 24980 - DNA, 2076 bp, Artificial Sequence
  Description of Artificial Sequence: Synthetic coding sequence
atgagcggcttcgacgaccccggcatcttctacagcgacagcttcggcggtgacgcccaggccgatgagggccaagcccgcaaaagccagcttcagagacgatttaaggaatttctgagacaatacagagtgggcactgatcggaccggctttacattcaaataccgagacgagcttaaaagacattataaccttggggagtattggatagaggtggagatggaagatctggctagctttgacgaagacctggctgactatctatataaacaacccgccgaacatctccagctgtccgatatgatgagccatctggtgaaaatacccgggattattatagccgcctctgccgtgcgcgctaaagccaccagaatctcaatccagtgcagatcatgtagaaacaccctgacaaacatcgcgatgcggcccggtcttgaaggatacgcactcccacgtaaatgtaacactgaccaggctgggaggcccaagtgtcctttagacccatacttcatcatgcccgataagtgcaaatgcgtcgattttcagactctgaaattgcaggagctgccagacgcggtgcctcatggcgagatgccccgtcatatgcagttgtactgcgaccggtatctgtgtgacaaggtcgtgccagggaacagggtgacaattatggggatctattctattaaaaaattcggactgacaacctcaaggggcagggaccgcgtcggcgtcggaattaggagctcttacataagggtgctggggattcaggtcgacacagatggatcggggcggtcatttgctggtgctgtgtccccacaggaggaagaagaattccggcggctcgccgcactgccgaacgtctacgaagtaatctcaaagtccatagccccctctatctttggaggaaccgacatgaagaaggccatcgcatgcctgcttttcggcggcagtaggaagagactccccgacggcctaacgagacgcggcgacatcaacctgctgatgctcggtgacccaggtacagcaaaatcacaattactgaaattcgttgaaaagtgtagtcctatcggagtgtataccagtgggaaggggagttcagctgcaggcctgaccgcaagtgtgatgagggatcctagttctaggaattttattatggagggtggagcaatggttcttgctgacggcggagtagtgtgcattgacgaattcgacaagatgcgcgaagacgaccgcgttgcgatacacgaggccatggagcagcagactatttccatcgctaaagcaggcatcacaacgactttgaattcaaggtgctcggttctcgccgcagctaatagcgtgttcggtcgttgggatgagaccaaaggtgaggataacattgattttatgcccaccattctgtcacggttcgacatgattttcattgtgaaggacgaacacaatgaggagagagatgtgatgctcgcaaaacatgtaatcacacttcacgtgagcgcattgactcagacgcaggcagtcgagggtgagatcgatctggcaaagcttaagaagttcattgcttattgccgcgtgaaatgcggccccagactgtctgcggaagctgcagaaaaactgaaaaacagatatattatcatgcggagcggagctaggcaacatgagcgagatagcgaccggaggagctctatcccaatcaccgtgcgacagctggaagcaattgtccggatcgcagaagctctgagtaaaatgaaactccagcccttcgccacagaggctgatgtggaagaggccctgcgcctgtttcaggtgagcaccctcgacgccgccctgtcggggacactctctggggtggagggtttcacatcccaggaggaccaagagatgttgtcgagaatcgagaaacagctgaagagaagattcgccatcggatcccaggttagtgaacacagcatcattaaggacttcacaaagcagaaatatcctgaacatgccatccataaggttctccagcttatgctgagacgcggggaaattcagcacaggatgcagaggaaggtgctgtatcgcctgaaatag

SEQ ID NO: 24981 - DNA, 696 bp, Artificial Sequence
  Description of Artificial Sequence: Synthetic coding sequence
atgagcggcttcgacgaccccggcatcttctacagcgacagcttcgggggcgacgcacaggcagacgaggggcaagctagaaagtcacagcttcaaaggcggttcaaggaattcctgcgccaatatcgcgtaggaacggataggaccgggtttacttttaagtacagcctggcgccctccctgatcgaacacttgctgcctgccaggtactgcagcggctgttgggctgctgcgctgaagctggatctcgcccctgccagtagagacgaactaaaaaggcattacaatcttggtgaatattggatagaggtcgaaatggaggacctggcaagcttcgacgaagatctggctgattacctgtataagcagcctgccgagcacctgcagttactagaggaagcagcgaaagaggtggccgacgaggttacaagaccgcgcccttcaggcgaggaggtgcttcaggacattcaagtgatgctcaaatctgatgctagtccttcctcaattagatccttgaagtcggacatgatgagccacctcgtgaaaatcccaggaattattattgccgcctccgcagttagagcaaaagcaactagaatcagtattcaatgtcgatcatgccggaacactctgactaacatagcaatgcgccccgggctggaaggctatgctcttccccgcaaatgcaacacgtag

SEQ ID NO: 24982 - DNA, 1125 bp, Artificial Sequence
  Description of Artificial Sequence: Synthetic coding sequence
atgaacagcagcggcatcaccacctggggcagcaccggcctgcggtggcgttggagaacaaggccacggccctctggtgaggaagtgttgcaggacatccaggtcatgctcaagtctgatgcatcgccctctagcatacgaagtttaaagagtgacatgatgtcccacctggtcaagattcctgggattatcatcgccgcatctgccgtacgcgccaaagcaacacggataagtattcagtgccgatcctgtcggaatacactcaccaacatcgccatgcgccccggcttagaaggctatgcgctacctcgcaaatgtaacactgaccaagcgggccgcccaaagtgccccctggatccatatttcattatgccagataagtgtaagtgcgttgattttcagactttaaaattgcaagaactgccagacgccgtgccacacggcgaaatgccgaggcacatgcagctgtattgcgataggtacttatgcgacaaagtagtacccggtaaccgtgtgaccattatgggcatttactctattaaaaaatttggtctgacaacctctcgcggccgggatagggtaggtgtagggattcggtcatcatacataagagtgctcggcatacaggtggataccgatggctccggacgcagctttgccggcgccgtgagtccacaagaggaggaggagttccgaaggctggcagcgctgcccaacgtgtatgaggttatcagcaagtcaattgcaccttccattttcggcgggaccgacatgaagaaggccatagcttgcctgctctttggcggctctcgcaagcgcttgcctgatgggctcacaagaagaggggacataaacctgcttatgctgggcgacccaggcacagcaaagagtcaactgctgaagtttgtggagaagtgttcaccaatcggagtgtatacatcggggaaaggctcctcagccgccggcctgacagctagcgtgatgagagatcctagcagccggaacttcattatggagggaggggccatggtccttgccgatgggggagttgtgtgcattgatgaatttgacaagcatagggaggctgctcaagcccctctctgtcactggcttcccggagtttag

SEQ ID NO: 24983 - DNA, 1788 bp, Artificial Sequence
  Description of Artificial Sequence: Synthetic coding sequence
atgttctacttccggggctgcggccggtgggtggccgtgagcttcactaagcagcagttcccactggccaggctgtcctctgacagcgccgctccacgcaccccgcactttgatgtcatcgtgattgggggcgggcacgctggcactgaggccgctactgccgcggccaggtgtgggagcaggacccttctgctgactcaccgggtcgatacaatcggccaaatgagctgcaacccatcctttggcgggattggtaagggccatctgatgagggaggtcgatgcactggacggcctgtgcagtcgaatttgtgatcaaagtggagttcactataaggtgctaaatagaagaaaaggacccgccgtgtgggggcttcgggctcagatagatcgcaagctgtataagcagaatatgcaaaaagaaattctgaatacgccattgctcactgtgcaagagggagcagtggaagatctgatcctcaccgagccagaacccgaacataccgggaaatgtcgtgtgtctggggttgtgctacctgaagatcagctgccatgctatttgacccacactaacccacgcgtcgatgaaattgtgctgaagaatctgcacctcaacagtcacgtgaaagagactaccaggggacctcgctactgtccatccattgaatccaaggtattgcggttcccaaatagacttcaccaggtctggctcgagcccgaaggtatggattcagatttaatttacccacagggactgagtatgacactacccgcggagctccaagagaaaatgatcacatgtatccgcgggttggaaaaggccaaagtgatccagccagggtatggtgtccagtatgattacttagacccacgccagattaccccctcacttgaaacccatctcgtgcagagactgttttttgcagggcagatcaacggaacaaccggatatgaagaggccgcggctcaaggagttattgctggaatcaacgcctctttgcgagtgagcagaaagccaccgttcgtcgtttcacggactgagggctacattggtgtgctgattgacgatctgacaactctgggcacttctgaaccctaccgcatgtttactagcagggtggagtttcgcctgtcattacgtccagataatgccgacagccgcttaacacttcgtggctataaagatgctgggtgtgtgtcgcaacagaggtatgaaagggcctgctggatgaagtcatcattagaagagggtatatcggtcctgaagtctattgaattcttgagcagtaagtggaagaaactcatccctgaggcctccatttcaacttctagaagcctgccagttcgggccctggacgtcctgaaatacgaagaagtagatatggatagtttggccaaggccgtccctgagcccctgaagaaatacactaagtgtagagagctcgctgagaggctgaaaatcgaagcgacctacgaatccgtgctgttccaccaactgcaagaaataaagggggtgcagcaagatgaagcacttcagctgcctaaggatcttgactatttaaccattcgcgacgtatcattgtcacatgaagtccgggagaagctgcatttttcaagaccccagacgattggcgcagcctcccgcatcccaggcgttactcccgctgccattatcaacctgttgcgatttgtgaagacgacacagcggagacaatcagccatgaacgaaagctctaagactgatcagtatctatgtgatgccgatcgtctccaggagagggagctctag

SEQ ID NO: 24984 - DNA, 2154 bp, Artificial Sequence
  Description of Artificial Sequence: Synthetic coding sequence
atgttctacttccggggctgcggccggtgggtggccgtgagcttcacgaaacagcagtttccccttgctcggttaagctctgattctgctgctcccagaacccctcatttcgacgtgatagtgattgggggcgggcacgcaggaaccgaggccgctacagctgccgctaggtgcggatcaagaaccctgctgctgacgcacagagtcgatacaattgggcagatgagctgtaatccgagtttcggggggatcggaaaaggacacctgatgcgggaagtcgacgccttggatggcctttgctcaagaatttgcgaccaaagcggggtgcattataaggttctgaataggagaaaagggcctgctgtatggggtctgcgtgctcagattgaccggaagctctataagcagaatatgcagaaggagattctgaatacgccgctgcttactgtgcaggagggtgcagtggaggacttgattttgacagagccagaacccgagcacactggaaagtgtagggtgtcaggagtggtcctggtggatggatctactgtttatgctgaatcggtgatactcacaaccgggacgtttctcaggggaatgatagtcattgggcttgaaacccaccccgcgggccggctaggggatcagccatctattggtctggcccagactctcgagaagctggggttcgtggttggacgcttaaagactggtactccgccccgaattgcaaaagagtcgatcaactttagtattctgaacaaacacattcccgataatccttcaatccccttttcattcaccaacgagactgtgtggatcaaaccagaagatcagttaccatgttatctgacacatactaaccctcgagtggacgagattgtgttgaagaatctccacctgaacagccatgtcaaggagactacccgaggtccccggtactgccctagcatcgagtcgaaggtcctgcgatttccgaatcgcctccatcaggtgtggctcgagccagagggaatggactcggatctaatatacccacaaggactctcaatgacactgccagccgagcttcaggaaaagatgatcacctgcatcagaggcctggagaaggccaaggtcattcagcctgatggtgtcctactactgctcccccggatggaatgtaacggtgcgatatcggcccaccataacctgcctttacccggttacggggtccaatatgattacctggaccctcgtcagatcaccccttctcttgagactcacttggtgcagagattgttctttgctggacaaatcaacggcacaacaggctatgaagaggctgcggctcagggggtgattgcaggcattaatgcttctctcagggtctcaaggaaacctccctttgtggtgtcccgaactgaagggtatattggcgtgcttatcgacgatctaaccacactgggcacttcagaaccttatagaatgttcacctccagagtcgagttccgccttagcctgcggccagataatgccgacagtaggcttacactgaggggctacaaggatgcgggatgtgtcagtcagcaacgttacgaacgggcctgctggatgaagtcctcgcttgaagagggaattagtgttcttaaaagcattgagtttctctcatctaaatggaagaagctgatccctgaggcatccatctccacctctcgctcgctgccggtacgcgccctcgatgtcctgaaatatgaagaggttgatatggattcgcttgcaaaggctgtgcctgagcccctgaagaagtacaccaagtgtagagagctcgcagaacggttaaagattgaggccacgtatgagtccgtgttatttcatcaactgcaggagatcaagggtgtgcagcaggacgaagccctccaactccctaaggatctggactacctgacaattcgggacgtctccctaagccacgaggttcgggagaagcttcatttctcacgccctcaaaccatcggtgctgcatcccgcatccccggcgtgacgcctgctgcaattattaatctcctccgcttcgtcaagaccacccagcggcgtcagtctgccatgaacgagtcatcaaaaacagaccagtatctatgcgacgcggatcgactgcaagagcgagagctatag

SEQ ID NO: 24985 - DNA, 1932 bp, Artificial Sequence
  Description of Artificial Sequence: Synthetic coding sequence
atgagctgcaaccccagcttcggcggcatcggcaagggccacctgatgcgtgaggtcgacgcactagatggcctatgctccaggatttgtgaccagagcggagtgcattacaaagtccttaataggcggaagggacctgccgtgtggggcctcagggcacagatcgatcgcaaattatacaagcagaatatgcaaaaggagatcctcaacacccctcttctgactgtacaagagggggccgtagaggacctgatcctaacagagccagaacccgagcacaccgggaagtgccgcgtgtccggagtggtcctggtcgacggcagcaccgtctacgccgaatccgtgatcttgactacagggacattcttaagagggatgatcgtgatcggtctggagacacaccctgccggtagattgggagaccagccttccataggtctggctcagaccctcgagaaactgggttttgtcgtggggcgactgaagacgggaacccccccgcgcattgcgaaagagagcataaacttttcaatcttaaacaagcacattcctgacaatccgagcatcccttttagctttaccaatgagacagtgtggatcaagcctgaagaccagttaccttgctatctcacccatacgaatccacgggttgacgagattgttcttaaaaatctccatttgaactctcatgttaaagagacgactcgcggaccacgctattgtccatccattgaatccaaagttctgcgttttccaaaccgattacaccaagtctggttagaacccgagggcatggactccgatctgatctaccctcagggcctctcgatgacattaccggcggaattgcaggagaagatgattacatgcattcggggcctagaaaaagctaaggttattcaaccagacggtgtattgttgttgctgcccaggatggagtgtaatggtgccattagcgcccaccataacttacctttgcccggatatggtgtccagtacgattatctggaccccagacaaatcactccaagtctggagacccatcttgtgcaaaggctcttctttgctggtcaaatcaacggaacgacggggtatgaagaggcagcggctcaaggggtgattgccggaattaatgcctctctccgggtcagcagaaagcccccattcgttgttagcagaaccgaaggatacatcggagtgctgatcgacgatctgaccacactcgggacttctgaaccctatcggatgtttactagccgagtcgagttccggctgtccttgagacccgataacgccgattcacgtttgaccctgcgggggtacaaagatgccgggtgtgtctcccagcaaaggtacgagagagcttgctggatgaaatcatccctcgaggagggtatttccgttttaaaaagcatcgaattcttgagttcaaagtggaagaaactgattcccgaggcatcgatctctacaagccggtctcttccagtgcgagcccttgacgtactgaagtatgaagaggtggacatggatagcctcgccaaggctgtacccgagccactgaagaagtacactaaatgtcgggagctggctgaaaggctcaaaatagaggccacatatgaatcagtactgttccatcaactgcaggagattaagggcgtccagcaggacgaggcactacagctccccaaggacctcgactatctcaccattcgggatgtgtctcttagtcatgaggtgcgggaaaagctgcatttttcaaggcctcaaacaataggggctgcttcccgcattccaggagtaacaccagcagcgattattaatctgctcaggtttgttaaaacaacacaacggagacaatctgcgatgaatgagtccagcaagaccgatcagtatctgtgcgacgccgacaggttgcaggaacgggaactctag

SEQ ID NO: 24986 - DNA, 2199 bp, Artificial Sequence
  Description of Artificial Sequence: Synthetic coding sequence
atgttctacttccggggctgcggccggtgggtggccgtgagcttcactaagcagcaattccccctggcgcgcctttcgagcgactcagcagcccccagaaccccacacttcgacgtcatcgtcattggcgggggccatgccggaacagaagccgccacagccgccgctcgctgtggctctcgtactttgctgctaacacaccgtgtagatacaataggacagatgtcctgtaacccgagctttggtggaattgggaaggggcatcttatgagggaggtagacgcgttagacggcttgtgttctagaatctgcgaccagtcaggtgtgcattataaggtccttaaccgacgcaaagggcctgctgtctgggggctgcgggcccaaattgacaggaagctctataaacagaatatgcagaaggagattcttaatacccctttgttgaccgttcaggagggagccgtcgaggacctaatcttgactgaaccagaaccagagcacaccggaaagtgtcgcgtttccggggtagtgctggtggatggatccaccgtgtacgccgagtccgtcatactgaccacagggactttcctgcgaggcatgatcgtgatcgggttggaaacccaccctgccgggcggttaggagaccagcctagcattggactggcccagacactggagaagctggggttcgtggtcgggcgcctcaagaccggcacccccccacggatcgcgaaggagagcattaacttctccatcctgaacaagcacattccagataatccttcaattccattctccttcactaacgagacagtgtggatcaagcccgaagaccagctcccttgctacctcacccacacgaatccccgagtggatgagatcgtactgaagaatctgcacctgaattctcatgtgaaggaaaccacgagagggccgcgctactgtccatccatcgaatctaaagtgctgaggtttcccaatcgcctccaccaggtatggctggaaccagagggaatggactctgatcttatttaccctcagggattgtcgatgacccttccagccgaacttcaagagaagatgatcacatgcattcgggggctggagaaggccaaggtgattcagcctggatatggggtgcagtacgattatctagatccccgccagatcaccccgtccctcgagacgcacctcgtccagcggctcttcttcgcaggacagattaatggcaccaccggctatgaagaggcagccgctcagaccgagtgctgttcagtggccagactagagtgtagtgacatgatcagtcagttgcaggcaattctgctcccacagccaagcctggtggccggcaccgcggggatgcatcacaacacccagggcgtaatcgccggtatcaacgcctctctgcgtgtgagccggaaaccgccatttgtggtgtcacgcaccgagggatatattggggtgttgattgatgacctaaccacgctcggcacttcagagccctaccggatgtttacttccagagtagagtttagactgtcactccgtccagataatgccgactcacggctcaccctgcgcggttacaaggatgccggctgcgtgtcacagcagcgctacgaacgggcttgctggatgaagagtagcctcgaggagggaataagcgtgctgaaatccatcgagttcctctctagtaagtggaagaagctgattccagaagcgtccattagtacttcaaggtccctgcccgtgcgggcacttgacgtgttgaagtatgaagaggtggatatggattctctagcaaaagcagtccctgagccgctgaagaagtacacaaaatgtagggagttggctgaaagactcaagattgaggcaacctacgaatccgttttgtttcatcagctgcaggagatcaagggtgttcagcaggatgaggccttgcagctccccaaggatctcgattacctgaccatccgggacgtgagcctgagtcacgaggtccgcgagaaactccacttctcgcgcccacagaccataggcgctgcctcccgcattcctggggttacgccagccgcaattattaaccttttgcgcttcgtgaagacgactcaacgccgccagagtgccatgaacgagagcagtaagaccgaccagtacctttgcgacgccgatagattgcaagaaagggaattatag

SEQ ID NO: 24987 - DNA, 2079 bp, Artificial Sequence
  Description of Artificial Sequence: Synthetic coding sequence
atgttctacttccggggctgcggccggtgggtggccgtgagcttcaccaaacaacagtttcccctggcgagattgtcgtcagatagtgccgcgccaaggaccccccacttcgatgtgatcgtcatcggcggaggccatgctgggacagaggccgcgactgcggcagcccggtgtggatccaggacactcctcttaactcatagggttgacacaataggacagatgagctgcaatccttctttcggtggtatcggaaaaggtcacctgatgagagaggtggacgctctggacggtctgtgtagccgcatctgcgaccagagcggtgtgcactataaggtgctgaaccgccggaaaggtccagcagtgtggggcctgagagcccagatcgacaggaaactctataagcagaacatgcagaaggagatcctgaacacccccctcctgactgtgcaggagggcgcggtggaagaccttatactgacggagcctgagcctgagcacaccggaaagtgccgtgttagtggcgttgttctggtggacggctccactgtctacgctgagtcagtcatcctaaccacaggtaccttcttgaggggcatgatcgtgatcgggctggagacacatcctgcaggaagacttggcgatcaacccagcattggcttggctcagacacttgaaaagcttggcttcgtcgtgggacgcttgaaaactgggactcccccaaggattgccaaggagtcgatcaattttagcatcctgaacaaacacatccccgacaatccatccatcccgttctctttcaccaatgaaaccgtttggatcaaacccgaagaccaactgccatgttatctgacgcatacaaatccccgtgtcgacgagatagtgctcaaaaatttacacctgaattcccacgtaaaagagacaacaagagggcccagatactgcccatccatcgaaagcaaggtcctgagatttccaaatcgactgcaccaggtgtggttggagcctgagggcatggattcagacctgatctatccacagggcttgtcgatgactctgccagctgagctgcaggagaagatgatcacgtgtattcgcggcttggaaaaggccaaggtaatccagcccggatacggcgtgcaatatgattacctcgatccacgacagatcacccccagcttagagacgcaccttgtgcaacgcctcttttttgcaggccagattaatggtacgacagggtacgaagaagctgccgctcagggagttattgccggtattaatgcttctctccgcgtctctaggaagccgccttttgtagtgtctagaactgaggggtacatcggggtattaattgatgatctgaccaccttggggacgagcgaaccgtacaggatgtttaccagtagagtagagtttcgcctgagcttgcggcccgacaacgctgacagccgattaaccctgcggggatataaagacgccggctgcgtttcgcagcagcggtacgagcgcgcttgttggatgaagagttctcttgaggaggggattagtgtgttgaaatctatagagttcctctcttcaaagtggaaaaaactgatccctgaggccagtataagtacatcaaggtccctgcctgttcgggcactggacgttctcaagtacgaagaggtggatatggattctttggcaaaagccgtgcctgagcccctcaagaaatataccaagtgtagagaactcgcggagcgcctcaaaatcgaggccacctacgaatcggttctctttcatcagcttcaggaaatcaagggggtgcagcaggatgaagcattgcaactgccaaaagacctcgactatctgacaatccgagatgtgagcctgtcgcacgaggttagagaaaagcttcacttcagtagaccccagacaataggcgcagcttctagaatccccggggtgacccccgccgccatcataaacctgctacgcttcgtcaaaaccacgcaacggagacagagtgcaatgaatgaaagctctaagaccgaccaatacctgtgcgacgcggatcggcttcaggagcgcgaattgtag

SEQ ID NO: 24988 - DNA, 381 bp, Artificial Sequence
  Description of Artificial Sequence: Synthetic coding sequence
atgagcatcggcgtgcccatcaaggtgctgcacgaggccgagggccacatcgtaacgtgcgagaccaatacaggagaggtttatcgggggaaactaatcgaagccgaagataatatgaactgtcagatgagcaatataacagtcacttatagggacggacgcgttgcccagctggaacaggtgtacataagaggtagcaagattcggttcttgattcttccagatatgctgaaaaatgctcctatgctgaagtctatgaagaacaaaaatcagggatccggggcagggcgcgggaaagccgccatcctcaaggcccaggtggctgctagaggccgcggtcggggaatgggtaggggtaacatttttcagaagagacgctag

SEQ ID NO: 24989 - DNA, 1083 bp, Artificial Sequence
  Description of Artificial Sequence: Synthetic coding sequence
atggccgccgccgccgccgccggcgccggccccgagatggtgcggggacaggtgtttgacgtcgggcccagatacacaaatttatcttacatcggggaaggtgcgtacggtatggtctgctcagcatacgataacgtgaacaaggtgagagttgccatcaagaaaatttcccccttcgagcaccagacttattgccaacgcactctcagggaaatcaaaatcctgctcaggttcaggcacgaaaatatcatcggaattaatgatatcatcagggcgccaaccattgagcaaatgaaggatgtgtatattgtacaggatctcatggagacggacctttacaagctgctgaaaacacaacacctctcaaatgatcacatctgctactttctgtatcagatcttacgcggtctcaaatacatccactctgcgaatgtgctgcaccgggatctgaagccctctaatctgctgctaaacacaacttgcgacctaaagatctgtgactttgggcttgcgcgtgtcgccgaccctgatcatgaccacaccggtttcctgaccgaatacgtcgctacaagatggtatcgtgctcctgaaattatgttgaactctaaaggatacacaaagagtatcgatatctggtctgtgggttgcatcttggcggaaatgctctccaacaggccaatatttccgggaaaacattaccttgatcagctcaatcatatcctcgggatcttgggctctccgagccaggaggatctcaactgcatcattaatcttaaggctagaaactacttgctgagccttccacacaaaaacaaggtaccctggaaccgactcttccccaacgctgattccaaggcattggatctgttggacaagatgctgacatttaatcctcacaagcgcatcgaggttgagcaagccttggcccatccatatctggagcagtactacgacccgtcagacgagcccatcgcagaagctcccttcaagtttgatatggagctcgacgatttaccaaaagaaaaactgaaggagctgatttttgaagagaccgcgcgttttcagcccggataccggagctag

SEQ ID NO: 24990 - DNA, 1047 bp, Artificial Sequence
  Description of Artificial Sequence: Synthetic coding sequence
atggtgcggggccaggtgttcgacgtgggcccccggtacaccaacctgtcttacattggggagggggcatacggtatggtatgcagtgcgtacgataacgtaaataaagtaagagtggccattaagaagatatccccctttgagcaccagacgtactgccagcgaaccctacgtgaaataaagattctgctgcgctttcgccacgagaacatcatcggaatcaacgatattatacgggcccccactatcgagcagatgaaagacgtgtatatagtgcaagacctcatggagaccgatctctataagctgttaaaaacacagcacctctctaacgaccacatttgctactttctgtaccaaattcttagggggctgaaatatattcactctgcaaacgtgcttcacagagacctcaaaccgtccaatctgctgctgaatacgacctgtgacctaaagatttgtgacttcggcctggcacgtgtggccgacccggaccatgatcatacagggtttctgacagagtacgttgccacgagatggtaccgtgctcccgagatcatgcttaacagtaaaggctacaccaaatcaatcgatatctggtccgtcgggtgcatcctggccgagatgctgtctaaccgccccatcttcccggggaaacattacctcgaccagcttaatcacatcctcggaatcctgggatcaccttcccaggaagacctcaattgtatcatcaaccttaaagccagaaactacttgctcagtctgccccacaagaataaggtaccttggaatagactatttcctaacgccgattccaaggccctggatttactcgacaagatgctcacttttaatccgcataagaggatcgaggtggagcaggccctagctcacccatatttagagcagtactatgatcccagtgatgaacccattgctgaagccccctttaaattcgatatggaattagatgacctgcccaaggaaaagctaaaggagttgatttttgaagagacagctcgcttccagccaggctacaggagctag

SEQ ID NO: 24991 - DNA, 951 bp, Artificial Sequence
  Description of Artificial Sequence: Synthetic coding sequence
atggccgccgccgccgccgccggcgccggccccgagatggtgcggggacaagtattcgatgtgggccctcgctataccaatctgagttatattggagagggcgcctacggcatggtgtgctccgcttatgacaatgtcaacaaagtacgggtcgccataaagaaaataagtcccttcgagcatcagacctactgccaacgcacactgcgggaaatcaaaattttgcttaggttccggcacgagaacattatcgggatcaatgatattataagagctccaaccatagagcagatgaaagacgtttatatcgtgcaggacttaatggaaacagatctgtataagctcctgaaaactcagcatctctccaacgaccacatttgctactttctgtatcagatcctgagaggcctcaagtatattcactccgcaaatgtcttacatcgagatctgaagccatcaaacctcttgctgaacaccacgtgtgacctcaagatctgcgacttcggcctggcacgcgtggcggaccctgatcatgaccatactgggtttctgaccgaatacgtggccacccgttggtaccgggctccagagattatgcttaacagtaaggggtataccaaatccatagacatctggagcgttggctgtatcctggcagagatgctgtccaacaggccaatctttccgggtaaacattatttggaccagctgaatcatatcttggcactagatctcctggataaaatgctcacttttaacccccacaaaagaatcgaagtcgagcaggccctggcccacccctacctggagcagtactacgatccttccgacgagccaattgccgaggcgccatttaagtttgatatggagctcgacgacctgccaaaagagaaactgaaggaactgatcttcgaggagaccgcccgctttcaacctggatatcggagttag

SEQ ID NO: 24992 - DNA, 1095 bp, Artificial Sequence
  Description of Artificial Sequence: Synthetic coding sequence
atgagcggcccccgggccggcttctaccggcaggagctgaacaagaccgtgtgggaggtgccccaaaggttgcaaggacttaggcccgtagggtctggggcctatgggtccgtctgctcagcctacgatgctcgtctgagacagaaggtggccgtcaagaagttgagcagacctttccagtcccttattcacgcccgaaggacttatcgtgagttaagactccttaagcacttgaagcacgagaatgttatcggcctgctggatgtgtttactcctgctacatctatcgaggatttcagtgaggtctacttagtgactactctcatgggcgccgatctgaacaacattgtgaagtgccaagctctgagtgacgagcacgttcagtttctcgtctaccagctgttgcggggactgaagtacatccactcagctggaataattcacagagacttgaagccctctaatgtggcggtgaacgaggattgtgaacttcggattttggattttggcctggctaggcaggccgatgaggagatgactggatatgtcgccactcgctggtaccgagctccggaaattatgctgaattggatgcactacaatcaaaccgtcgatatctggtccgtgggttgcattatggcagagctgctgcagggcaaggctctgttccccgggagcgattacatcgatcagttaaagcggattatggaagtggtgggaaccccttcccccgaggtactggcaaaaatctcttcagagcacgcacgaacatacatacagtctctgcctcctatgccacagaaggacctttcctctatcttccggggggcaaatccactggcaatagatttgctggggagaatgctcgttctcgactcagatcagagggtgagcgccgcagaggccctcgctcacgcttatttctcccaataccacgacccagaagacgagccagaagcggagccctatgacgagtctgtggaagctaaggagcggacactggaagagtggaaagagttaacctatcaggaagtgctgagctttaaaccccccgagccgccaaaaccccccggaagtctcgaaattgagcagtag

SEQ ID NO: 24993 - DNA, 1095 bp, Artificial Sequence
  Description of Artificial Sequence: Synthetic coding sequence
atgagcggcccccgggccggcttctaccggcaggagctgaacaagacagtgtgggaggtaccccagagactccaggggcttaggccagtgggctccggcgcttacgggtctgtctgttctgcctacgatgcaaggctcaggcagaaggttgcagttaagaaactgtcacggcctttccagtcgctgatccacgcgcgaagaacgtaccgggagctgaggttgctgaagcatctgaaacacgagaatgttattggacttctggatgtgtttacccccgccacttccattgaagacttttcagaggtgtacctggttactacacttatgggtgccgacctcaacaacatagtgaaatgccaggcccttagcgatgagcatgttcagtttctggtataccagttgctcaggggtctgaagtacattcattcagccggcattatccatcgtgacctaaaaccctctaacgtggccgtcaacgaggattgtgagcttcgaatactggacttcggcttggcaagacaagcagacgaggaaatgactggatacgtggccactcggtggtaccgtgcccccgaaattatgcttaattggatgcattataaccaaacagtggacatttggtcagtcgggtgcatcatggccgaactgctccagggcaaggctctatttccagggtctgattacatagatcagttgaagcgcataatggaggtcgtgggtacgccctctccagaagtccttgccaagatttcgagtgagcatgctcgaacttacatccaaagcttgccccccatgccacagaaagatctttccagcatcttccgtggcgctaacccacttgccattgacctcctgggcaggatgctggtgctggactctgatcagagagtgagtgccgcagaagcacttgcccacgcttattttagccagtatcatgatcccgaggatgagccagaggctgaaccctacgatgaatcagtggaagccaaggagagaaccctcgaagaatggaaagagttgacgtaccaggaagtgctgtcttttaagccacccgaacccccaaagccaccaggctcactcgagatcgaacagtag

SEQ ID NO: 24994 - DNA, 642 bp, Artificial Sequence
  Description of Artificial Sequence: Synthetic coding sequence
atgggcgccgacctgaacaacatcgtgaagtgccaggccctgagcgatgagcacgttcagttcctcgtatatcaattactcaggggactgaagtacatccattctgctggcattattcatcgcgacttaaaaccttcaaatgtagcggtcaacgaggattgtgagctcaggatcctggatttcggcctcgctcggcaggccgatgaagaaatgaccggctacgttgccacccggtggtatcgagcccccgagattatgctcaattggatgcactacaaccagaccggcgctgggggccggccatggggtgatgagggacaggggcccagactggctcttgattggctttgtatgccgggcctgcggggccaggcgcggagcccccgcatgtgggatcctcacagcaaagtagccctgcagcgtcctctggagcatgacggctgctggccacctttggcagtgcagctctggactagcccctgtcttggcgggcttgggatggcagaagagggagtctgtccatcatggggcctcgatgtgaccgtcggcctgctggaggagggccgcggagttggaacactcatggaggtgcccagtccctcacactctggataccttgtcagaggactgcatcatggctag

SEQ ID NO: 24995 - DNA, 1149 bp, Artificial Sequence
  Description of Artificial Sequence: Synthetic coding sequence
atggacttcggcctggccctgctgctggccggcctgctgggcctgctgctgggacagagtctacaggtgaaacctttacaagtggagcctcccgaacccgtcgttgccgttgccctgggggcatcacggcaactaacctgtcggttggcctgcgccgatcggggggctagtgttcaatggcgcgggttggatacctcattgggcgccgtgcaaagcgacactgggcgctcagtgttgaccgtcaggaatgcctccctgagcgcagccgggacacgtgtgtgcgtgggcagctgtggcggccgcacgtttcagcacaccgtgcaactcttggtctacgcctttccagatcagcttaccgtctcacctgctgccctggtgcctggtgacccagaagttgcctgtaccgctcacaaggtgacccccgtagaccccaatgcactttcattctcgctgctggtaggcggccaagagctcgagggagcccaagcattagggcctgaagtccaggaggaggaggaggaacctcagggcgatgaagacgtgttgtttagggtcacagagcgctggaggctgccacctctgggaacacccgtgccgccagcattgtactgccaggccactatgcgactgcccggactggaacttagccatcgccaagctatcccggtcctgcacagtccaactagccctgagccgcccgacaccacttcccccgaatcccccgataccacttcgccagaatctccggatacgacaagccaggagcctcccgacacaacttcccctgagcctcctgataagacaagccccgaacccgccccacagcagggctccactcatacccctcgatccccaggcagcacccgcactcgtaggccagaaatttcacaagcaggaccgactcaaggggaggtaatccctacaggatctagcaagccagccggagatcagttgcccgctgccctgtggacctccagtgccgtgctgggtctgttgctgttggctctacccacgtaccatttgtggaagagatgccgccatcttgctgaggatgacacccaccctccagcttccttgcgactactcccccaggtctctgcctgggcgggacttagaggtactggacaggtgggaatctccccatcttag

SEQ ID NO: 24996 - DNA, 1074 bp, Artificial Sequence
  Description of Artificial Sequence: Synthetic coding sequence
atgagcagccccccccccgcccggagcggcttctaccggcaggaggtgactaagacggcctgggaggtgcgggctgtgtacagagatttacaacctgtgggaagtggcgcctatggtgcagtgtgcagcgctgtcgatggcagaacgggagcaaaggtggctataaagaagctgtaccggccgttccagagcgaattgtttgcgaagcgcgcttatcgggaacttcgcttgttaaaacatatgcggcacgagaacgtcatcggactccttgacgtgttcacccccgacgaaaccctcgacgactttaccgacttctaccttgtcatgccattcatgggtacggacctgggcaagctaatgaaacatgaaaagctgggcgaggataggatccagtttctggtataccagatgctgaaaggtttgcgggatctaaagcccggaaaccttgccgtcaatgaggattgcgagctgaaaattcttgatttcggcctcgctcggcaggccgacagtgagatgaccggatatgtcgtgacacggtggtatagggcacctgaagtgatcctgaattggatgagatacacccagaccgtagacatttggtctgttgggtgtatcatggccgaaatgatcacaggcaaaactctgttcaagggcagcgaccacctggaccagctgaaagaaataatgaaagtcacaggaacaccgccggcagagttcgtgcaacgtctgcagtctgatgaggccaaaaactacatgaaaggtctccctgaactggagaaaaaagatttcgcttctatcttaacaaacgcgtctcctttggctgtgaacctgctggagaagatgctagtcctggatgctgaacagagagtgacagctggtgaggccctagcacacccctactttgagtccttgcatgataccgaggacgagccgcaggtgcaaaaatacgacgactcattcgacgatgttgaccgaactttggacgagtggaaaagagtgacctacaaggaagtactgtcctttaaaccaccccgccagctaggcgcccgtgtctctaaggagacgcccctgtag

SEQ ID NO: 24997 - DNA, 837 bp, Artificial Sequence
  Description of Artificial Sequence: Synthetic coding sequence
atggccctgctgcccgtgctgttcctggtgaccgtgctgctgcccagcctcccagctgagggcaaggatcctgcctttaccgcgctgctgaccacacagctccaagttcagagagaaattgttaataagcacaacgaactcagaaaagccgtgtcgccacctgcctcaaatatgttgaaaatggaatggtcgcgggaagtcaccaccaacgcacagaggtgggctaacaagtgtacattgcagcactccgatccagaggacaggaaaacgtctactagatgcggagagaacctctatatgtcatctgaccccacttcttggagctctgccattcaatcatggtacgacgaaatcctcgatttcgtctatggtgtgggacctaaaagccctaatgcagttgttggacattacacacaacttgtgtggtattccacgtatcaggtcggctgcggcatcgcctactgcccaaatcaagatagccttaaatactactacgtgtgccagtactgccccgccatgaaaacctacctgaataagcgcgaagggatcaatgtctggaagtgttttttaagactgaggcacttccagcttctgcgaggagagcagcttcttaccttttccggaaacaatatgaaccggaaaaacacgccctaccagcagggaacgccatgtgccggttgcccggacgattgcgacaaggggctctgtacaaacagctgccaatatcaggacttgctgagtaactgtgacagtctgaagaatacagccggctgtgaacatgagctccttaaggaaaagtgcaaagccacctgtttgtgtgagaacaaaatctactag

SEQ ID NO: 24998 - DNA, 459 bp, Artificial Sequence
  Description of Artificial Sequence: Synthetic coding sequence
atgcagcacgagaacgtgatcggcctgctggacgtgttcacccccgcctctagtttaaggaatttctatgatttctatcttgtcatgcccttcatgcagaccgatctccagaagatcatgggaatggagttttcagaggaaaaaattcaatacctggtctaccagatgcttaaagggttgaagtatattcacagtgctggcgttgtgcatagagacctaaagcccggcaatcttgcggtgaatgaagactgtgagctcaagatactcgatttcgggctggctaggcacgctgatgctgagatgaccggttatgttgtgacacggtggtaccgcgctcctgaagtgatcctgagttggatgcattacaaccagacaggacagatcctgcatccggtacctgccaccgatccacaagaaggttttcactcagctgtgccaaccggacagccccctggctag

SEQ ID NO: 24999 - DNA, 1068 bp, Artificial Sequence
  Description of Artificial Sequence: Synthetic coding sequence
atgagcctgatccggaagaagggcttctacaagcaggacgtgaacaaaaccgcgtgggagttgccgaagacttatgtgagtcctacacacgtgggatccggtgcgtacgggagcgtctgcagcgctatagataagaggtcaggagagaaagtcgccatcaagaagctgtcccggccttttcagtctgaaatcttcgccaagagagcatatcgggagttgctcctgctaaagcatatgcagcacgagaacgtaatcggacttctggacgtctttacacctgcaagcagcctcaggaacttttatgatttttatctagtcatgcccttcatgcaaacggacttgcagaagattatgggaatggaattcagtgaagagaagattcagtatctggtgtaccaaatgctgaagggcctcaaggatctgaaacctggcaacctcgcggtgaacgaggactgtgagctcaagatacttgacttcgggctggcacgtcatgcagatgctgaaatgactggatatgtggttacccgctggtatcgggcccctgaagttattctatcatggatgcactataaccagacggttgatatatggagcgtgggttgcattatggccgagatgttgacaggtaagaccctgttcaaaggcaaagactacttggatcagctcacccagatcctgaaagtaacaggagtgcctgggactgagttcgtacagaaacttaacgataaggccgcaaagagttacatccagagcctgccgcagaccccacggaaagattttacgcagctctttccgagggcttctccccaggccgcagacttgcttgagaaaatgcttgagctggacgtagacaaaaggttaaccgccgcccaggctctcacccatcccttctttgagccctttagggatcctgaggaagagacagaggcgcagcaaccgtttgatgatagcttggaacacgaaaaacttaccgtcgacgagtggaagcagcacatctacaaagaaattgtgaatttttcccctatcgccagaaaggactcacgacgcagatccgggatgaagctgtag

SEQ ID NO: 25000 - DNA, 774 bp, Artificial Sequence
  Description of Artificial Sequence: Synthetic coding sequence
atgagcctgatccggaagaagggcttctacaagcaggacgtgaacaagaccgcatgggagctcccaaaaacatacgtgtcacccactcatgtcgggtctggagcttatgggtccgtgtgcagcgcaatcgacaagaggagcggggaaaaggtcgccatcaagaaactctccaggccctttcaatctgagatctttgccaaaagagcttacagggagctcctgttattaaaacacatgcaacacgaaaatgtcattgggctactggatgtgtttactcctgcaagctctcttcgaaacttttacgacttttatctggtcatgccgttcatgcagaccgacctgcagaagattatgggcatggagttttctgaagagaagatacaatacttggtatatcagatgctcaaaggattgaagtacatccatagtgcaggagtggtccacagagacctgaaacctggcaatttggccgtcaacgaagattgcgaattgaagatactggacttcggcctggcacggcatgctgacgccgagatgaccgggtatgtggtgactcggtggtacagggctcctgaggtaattctgtcgtggatgcactacaaccaaacggggcagatcctgcacccggtgccagcaactgatccccaagaagggtttcacagcgcggtcccaaccggtcagccccccgggtgcggccccgcaggcgaggacgcgggcgctaggaggggacaggcccccgacgggagagccggccctcatccgagtctgttgtag

SEQ ID NO: 25001 - DNA, 933 bp, Artificial Sequence
  Description of Artificial Sequence: Synthetic coding sequence
atgagcctgatccggaagaagggcttctacaagcaggacgtgaacaaaaccgcttgggagctccctaaaacgtatgtgagcccaacccacgtggggtccggcgcttatggaagcgtctgctccgcgattgataagcgttcaggggagaaagtggccattaaaaaactgtcccgcccttttcagtctgaaatctttgcaaaaagggcctaccgcgaacttctgctgctgaagcacatgcagcatgagaatgtgatcggactgctggatgtgttcacaccagcttcttctctgagaaacttttatgatttttaccttgtcatgcccttcatgcagaccgaccttcagaaaataatgggaatggagtttagcgaagagaagatccagtacctggtttaccagatgctgaagggtctgaagtacatccacagtgccggcgtcgtgcaccgcgatctcaaaccaggtaatttagccgttaacgaggactgcgagttgaaaattctcgactttggccttgccagacacgccgacgcagaaatgacagggtacgtcgtgactagatggtacagggccccagaggtaattctgtcgtggatgcactataaccagaccgtggacatttggagtgtaggctgtatcatggccgaaatgctgaccgggaaaacactctttaagggaaaagactacctactagagaagatgctcgagcttgatgttgataagcgcctgaccgccgctcaggctctgacacatcctttttttgaaccctttagggatccagaagaggagaccgaggcccagcagcctttcgacgactctctggagcacgagaaactgacggtagacgaatggaagcagcacatctacaaggaaatcgtgaatttttcccccatcgcccggaaagattcgcggagacgttccggcatgaagctgtag

SEQ ID NO: 25002 - DNA, 1629 bp, Artificial Sequence
  Description of Artificial Sequence: Synthetic coding sequence
atgcccctgcgggacgagaccctgcgggaggtgtgggccagcgactccggccacgaagaagaaagcctatctcctgaggccccccggcggcccaaacagcggcccgcccccgcacagaggctgcgaaagaagagaacagaagccccagagtcaccgtgtccaactggcagcaagccaaggaagccgggtgctggtcggactggaaggccccgcgaagaaccttcaccagatccggctcaggcacgggcgccccagacggtgtatgctcggtttctgcgggaccctgaggccaagaagcgtgaccccagagaaacctttcttgtggccagggccccggatgctgaggacgaagaggaggaagaggaagaagacgaagaagatgaggaggaggaagccgaggaaaaaaaagagaagattttattaccccccaaaaagcctctgcgcgagaagagttccgccgatctaaaagaacggagagccaaggcccaaggaccccgcggcgacctcggtagtcccgacccacctccaaagcctctccgggttcggaacaaggaagccccagctggagagggaactaagatgagaaaaacgaaaaaaaaaggatcgggtgaggctgacaaagatccatctggcagccccgcctctgctcggaaatcacctgccgcaatgtttctggttggggagggctcacccgacaagaaggccctaaaaaagaagggcacgcctaagggggcccggaaagaagaggaggaagaggaggaggccgctacggtgattaaaaagtccaatcagaaaggcaaggccaaaggtaaaggcaaaaagaaggctaaggaagagagggcaccctctccgcctgtcgaagtagacgagcctagagagttcgtcctacggcctgcaccccaggggagaaccgtaaggtgcagattgacccgcgataagaaaggcatggatcgcggaatgtatccatcctacttcctacatttggacactgaaaaaaaagtgtttcttttggcaggccggaaacgtaagaggagcaagaccgccaactatctgatctctatcgaccccacaaatctcagcagaggaggggagaacttcataggaaaactacgatctaatctgctcggcaacaggtttactgtgttcgacaatggccagaacccacagagaggctattctaccaatgtggctagcctccgccaggaactcgcagctgtcatctacgaaaccaatgttctagggtttcgtgggccccggcgtatgaccgtgattatccctggaatgtcagcagagaacgagcgtgtaccaattcgacccagaaacgcctccgatgggctccttgtgcgctggcagaacaagaccctggagtccctcatcgaactacataacaaaccccccgtatggaatgatgacagcggtagttatacccttaatttccaggggcgggtcacacaagcaagtgtcaaaaactttcagattgtgcatgccgatgaccctgactatatcgtgttgcaatttgggcgcgtcgccgaggatgcgtttacgctcgattatcggtatccactgtgtgcgcttcaggccttcgccatcgcattgagttcctttgacggcaaactcgcttgcgaatag

SEQ ID NO: 25003 - DNA, 1083 bp, Artificial Sequence
  Description of Artificial Sequence: Synthetic coding sequence
atgagccaggagcggcccaccttctaccggcaggagctgaacaagaccatatgggaagttccagaacggtaccagaacctttcccctgtcggttctggcgcttacggcagcgtttgtgcagcgttcgacactaagacgggcctgagagttgcagtgaaaaagctgtcccgcccttttcagtccataatccacgccaagaggacttatagagaactgagactattgaaacacatgaagcacgaaaacgttatcgggctgctggacgtgtttaccccagccagatctctggaagagttcaatgatgtgtacctggtgacacacctgatgggcgcagatctcaacaatattgtgaagtgtcagaagctgaccgacgaccatgtacagtttctcatctaccagatcttacgagggttgaagtatatccactccgcagatatcattcacagagatctcaagccttcaaatctggccgtgaatgaagattgcgagctcaaaatcctggattttggcctcgccaggcatacggacgacgaaatgactgggtacgtagccaccaggtggtaccgcgcaccagagatcatgctgaattggatgcactataaccagaccgtggacatctggtctgtaggctgcattatggccgaattactgacggggagaactttattcccaggaaccgaccatattgaccagctcaaactgatcttgagactggtaggtacacccggcgcggaattactgaaaaaaatttcaagcgaaagtgcccggaattacatccagagcctcactcagatgcctaagatgaactttgcaaacgtcttcatcggtgctaatccactagctgtggacctgttggagaaaatgcttgttctagactccgataaacgcatcaccgccgcacaggccctcgcgcatgcttactttgctcaatatcacgacccagatgacgaaccagtggctgacccatatgatcagtccttcgagagccgagatctgctcattgatgagtggaagagcctcacttatgatgaagtcatctcattcgtccctcctccactggatcaggaggagatggagtcgtag

SEQ ID NO: 25004 - DNA, 924 bp, Artificial Sequence
  Description of Artificial Sequence: Synthetic coding sequence
atgagccaggagcggcccaccttctaccggcaggagctgaacaagacgatctgggaggtgcctgagagatatcagaacctttcgccagttggcagcggggcttacgggtcagtctgcgccgcttttgacacaaagaccggcctccgggtggctgtgaaaaagctgagtaggccatttcaatccatcatacacgcgaagcggacctaccgcgaactgcggctgttaaaacacatgaaacacgaaaacgtgattggtctgcttgatgtgtttactcctgcccgaagcctggaagaattcaacgatgtatatctagtcactcatttgatgggggcggacctcaacaatattgtaaaatgccagaagctgactgacgatcatgtacaatttttgatttaccaaatcctgcgggggctcaagtatattcattctgccgatataatccatcgcgatctgaagccctctaatttagccgtgaatgaggactgcgagctaaaaattctagattttggcctcgcccgccacaccgacgacgaaatgactggctacgttgctacacggtggtaccgggctcccgagattatgctgaattggatgcactacaatcagacggttgatatctggtcggttggctgcatcatggctgaattactgacagggagaactctgttccccggtactgatcatattgaccagcttaagctaattctgaggctggttggcaccccaggcgccgaactattgaagaaaatttcttccgagtcactgagtacttgctggcgcaggtgcctgtactggacccagatacgggagctgcagagaccgaagcctttgcacatgccaaccttactgagtacaacgatcctgatgatgaatcagtggcccattcttatgataagccctctgaaggcaggtacaagcctgtag

SEQ ID NO: 25005 - DNA, 852 bp, Artificial Sequence
  Description of Artificial Sequence: Synthetic coding sequence
atgaagcacgagaacgtgatcggcctgctggacgtgttcacccccgctcggtcgctcgaggaatttaacgacgtctacctggtcactcacctcatgggggcagacctgaacaacatcgtgaagtgtcaaaagctgacggacgatcacgttcagttcctgatctaccagattttgagagggctgaagtatatccactctgccgacataatccacagagatttaaaaccttctaatctagcagtaaacgaggactgtgagcttaagatactcgacttcgggttggcccgtcatactgacgatgaaatgactggatacgtggccacacggtggtatagagcgcccgaaatcatgctgaattggatgcactacaatcagactgtcgacatttggtccgtcgggtgtattatggctgagctcctgaccggtcggacactttttcctggaaccgaccatattgatcagctgaagctgattctgcgactcgtcggaacccccggagctgagctcctgaagaagattagctcagaaagcgcacggaattatattcagtcgctcacacagatgcccaaaatgaactttgcaaatgtgtttattggcgccaatccgctagcagtcgacctccttgaaaagatgctggttttggactcagacaaacggattacggctgcacaggccttagcccatgcctacttcgcccagtaccacgaccccgacgatgagcctgtggcagatccttacgaccagagctttgagtctcgggacctgctgatcgatgaatggaagagtctgacttatgatgaagtgatctccttcgtgcctcccccgctcgaccaggaagaaatggagtcctag

SEQ ID NO: 25006 - DNA, 1140 bp, Artificial Sequence
  Description of Artificial Sequence: Synthetic coding sequence
atggccgccgccgccgcccagggcggcggcggcggcgagccccggcggacagagggagtaggtcctggggtgccaggagaagtcgaaatggtgaagggccagccgttcgacgtaggtccgagatacacacagctgcagtacataggagaaggcgcatacggtatggttagttccgcctatgatcacgtgcggaagacccgcgtcgccatcaagaagattagccctttcgagcaccaaacatactgtcagcgcactcttcgggagattcaaatcctcctgaggttcagacacgagaatgtgatcggtatcagggacattctgcgagcgtccacactcgaagccatgagagatgtctatattgtgcaggatttgatggaaactgacctctacaagctgttgaagagccagcagctcagcaacgatcacatctgttatttcctctatcagatccttaggggcttgaaatatatccactccgcaaatgtcctccacagggacctcaagcctagtaacctgctgattaacactacatgtgatctcaagatctgcgacttcggcctggctagaattgccgatcccgaacacgaccacacagggttcctcacagaatacgtggctaccaggtggtatcgagcgcctgagatcatgcttaattcaaagggttataccaagagtattgatatctggagcgtcgggtgcatcctcgccgagatgctgtcaaatcggcctatctttccgggaaaacattatctggatcaacttaaccacatcctggggattcttgggtcccctagccaggaggacctcaactgtatcataaatatgaaggcccgaaattacctgcagtccctgcccagcaaaaccaaggttgcctgggcaaagttattcccaaagtcagattcaaaagcactcgatttactagatagaatgcttactttcaatccaaataagagaataactgttgaggaggccctcgcacacccttatttggagcaatattacgatcctaccgatgagccggtcgccgaagagccctttacctttgcgatggagctcgacgacttgcctaaagaacgcttaaaggagcttatttttcaagagaccgcacggttccaacccggcgttctggaagctccatag

SEQ ID NO: 25007 - DNA, 1008 bp, Artificial Sequence
  Description of Artificial Sequence: Synthetic coding sequence
atggccgccgccgccgcccagggcggcggcggcggcgagccccggaggacggagggagtcgggccaggggtgcctggggaggtggaaatggttaaaggacagccgttcgacgtgggacccagatacacacagttgcagtacattggggagggtgcgtatggcatggtatcctccgcctacgaccacgtgaggaagacacgggttgccatcaaaaagatatctccattcgagcatcagacatactgccagagaactctacgtgagattcagatcttgctgcgattcagacacgagaacgtgatagggatcagggatattttaagggcttctactctagaagctatgagagatgtgtacattgttcaggacctaatggagaccgacctgtataaactgctcaaaagccagcagctttctaatgaccacatatgttatttcctttatcagatcctgcgtggtctcaaatatatacactccgctaacgtgctccaccgagacttaaagccctctaatcttctgattaataccacttgcgacctgaaaatctgtgactttggtctcgctcggattgcagatcccgagcatgaccacaccggatttctcacagagtatgtggcaaccaggtggtacagagcgcctgaaattatgcttaacagcaaaggctacacgaagagcatagatatctggtcagtcggctgtatcctagctgagatgttgtccaaccgaccgattttcccgggtaagcattatttggaccagttgaatcacatccttgccttggacctgctggatcgcatgctaaccttcaatccaaataaacgtattacagtggaggaagcactggctcacccttatctcgagcaatactacgacccaaccgatgagcccgtggccgaagagcccttcactttcgctatggagctggacgatctacccaaagagaggctaaaggaattgatttttcaagagaccgctagattccagcctggggtcctcgaagctccatag

SEQ ID NO: 25008 - DNA, 936 bp, Artificial Sequence
  Description of Artificial Sequence: Synthetic coding sequence
atggtgaagggccagcccttcgacgtgggcccccggtacacccagctgcagtatatcggggaaggggcttatggcatggtgtcttctgcgtatgatcatgtgcgcaaaaccagggtggccattaagaaaataagtccttttgagcaccagacgtattgccagcgcacactgcgagaaattcagatactgcttaggttcagacacgaaaacgtgatcggcatcagggacatcctgcgagcctcaaccttagaagccatgcgagacgtgtatattgtgcaggacctgatggaaacagacctgtacaagctactaaaatcccaacagctctcaaacgaccatatttgctattttttataccagatcctccgcgggctgaagtatatacactctgctaacgttctacacagagacctgaaaccttcaaacctgctgatcaacacgacctgtgacctaaaggggtacaccaaatcgatcgatatctggagcgtcggttgtatcctggccgaaatgctgtctaatcgtcccatcttccctggaaagcactacctggatcagctcaaccatattctgggcattttgggctcacctagtcaagaggatctcaattgtataatcaatatgaaggctaggaattaccttcagagtttgcctagcaaaactaaggtcgcgtgggccaaactcttcccaaagagcgattccaaggcactggaccttctggacaggatgttgacctttaatcccaacaagcggattactgtggaagaggccttagcgcacccgtaccttgagcagtattacgatcccaccgacgaaccagtagccgaagaacctttcactttcgccatggaactggacgacctcccaaaggagcgactgaaagagctcatattccaggagaccgctaggtttcagccgggcgttctcgaagctccttag

SEQ ID NO: 25009 - DNA, 1008 bp, Artificial Sequence
  Description of Artificial Sequence: Synthetic coding sequence
atggccgccgccgccgcccagggcggcggcggcggcgagccccggcgcacagagggcgtgggcccaggcgtcccaggggaagtagaaatggtgaaaggccagcccttcgatgtgggcccaaggtacacacagctgcagtacatcggggagggtgcctatggaatggtgtctagtgcatacgatcatgtgcgcaagactagagtcgctattaagaagatcagtccatttgagcatcagacctactgccaacggacactgcgggagattcagatcttactgcgcttcaggcatgagaacgttataggtatcagggatatcttacgtgcgtccacgttagaagctatgagggatgtgtacatcgtgcaggatctcatggaaacagatctgtacaaactgctgaagagccagcaattgtccaatgaccatatctgttactttctataccagatactgcgaggcctgaagtatattcattctgccaatgtgctgcacagggacttaaaaccttccaacttgctcatcaacacaacttgcgacctgaagatctgcgatttcggcctggctaggattgccgatcccgaacatgaccacactggatttttgactgagtatgtcgccacccggtggtatcgcgccccggaaattatgctgaactccaagggctataccaaatctatcgacatatggtcggttggctgtatcctggctgagatgctgtcaaataggcccatctttcccgggaaacactacctggaccagctaaaccacatcttggccctggatctccttgacagaatgctgacgtttaaccccaataaaagaataactgtggaagaggcactcgctcacccctacctcgagcagtattacgatcccacggacgagcccgtggcagaggaacctttcacattcgccatggaactggatgatctgcctaaggaacgcctgaaagagctgatcttccaggagacagccaggttccagcctggcgtgttagaggccccctag

SEQ ID NO: 25010 - DNA, 1074 bp, Artificial Sequence
  Description of Artificial Sequence: Synthetic coding sequence
atggccgccgccgccgcccagggcggcggcggcggcgagccccggcgtacagagggcgtgggccctggggtgccgggggaggtcgaaatggttaagggccagccgttcgacgtgggacctcgatacacccaacttcagtatattggcgagggagcatacgggatggttagttctgcttacgatcacgtcaggaaaacacgagtcgccattaagaagatctctccctttgagcaccagacctattgtcaacgaacactgcgggaaatccagatcctcctgcggttccgccacgagaacgtcatagggattcgggatattctccgagcaagcaccttggaagccatgagggatgtttatattgtgcaagatctcatggagacagatctctataaactgctgaaaagtcaacagctgtccaatgatcatatatgctatttcttatatcaaattcttaggggactgaaatacatccattcagctaacgtgctacaccgggacttaaagccgtcaaatctgctgattaacactacctgcgacctcaaaatttgtgatttcggcctcgcccgtatcgctgatcccgagcatgatcacacaggattccttaccgagtacgtcgctaccaggtggtaccgggcccccgagataatgctgaacagcaagggttacacaaagagtatagacatatggagcgtaggatgcattctagccgagatgctcagtaatcgacctatctttccggggaaacactatctggatcagcttaatcacatccttggcatcctcggaagcccgtcacaggaggacttaaattgcatcataaacatgaaggctaggaattatctgcaatcactcccctcaaaaactaaagtggcctgggccaagctgttccccaaatcggacagcaaggcgctcgacctgctcgatcgcatgctcacctttaatccaaacaaaagaatcacagttgaggaggcccttgcccacccatacctagagcaatactacgaccccaccgacgaagttggacagtctcccgccgccgtcggcctgggagcgggcgaacaggggggaacctag

SEQ ID NO: 25011 - DNA, 798 bp, Artificial Sequence
  Description of Artificial Sequence: Synthetic coding sequence
atgcgggacgtgtacatcgtgcaggacctgatggagaccgacctgtacaaactgttgaagtcccagcagctgtccaatgaccacatttgctatttcctgtaccagatcctgaggggactaaagtacattcattcggccaatgtgcttcatagggatttgaagccatcgaatctgttgatcaataccacctgtgatctgaaaatctgtgatttcgggctggcgcgtatcgcagaccctgagcacgatcacacaggtttcttgactgaatacgtggccacaaggtggtacagagccccggaaatcatgctgaacagcaaaggttacaccaaatccatcgacatttggtcagtgggctgcatattagcagaaatgctttcaaatcggccgatttttcctggcaaacattacctggaccaacttaaccatattctaggcatcctgggctcacccagccaggaggatttaaactgcattattaatatgaaagcacgcaactatctccaaagtctgccaagcaagaccaaggttgcctgggccaagctttttccaaagtcggatagcaaggccctcgacctgctagaccgaatgctcactttcaaccctaataagaggattactgtggaggaggctcttgcacacccttacctggaacagtactacgatccgactgacgaaccagtggcagaggaaccttttactttcgctatggaactggacgacttgcccaaggaacgtctgaaagaactgatatttcaggagaccgcaagattccagccgggagttcttgaagccccttag

SEQ ID NO: 25012 - DNA, 1284 bp, Artificial Sequence
  Description of Artificial Sequence: Synthetic coding sequence
atgagccggagcaagcgggacaacaacttctacagcgtggagatcggtgactcaacctttaccgttctcaaacgctatcaaaacctgaagcccatcggttccggcgcccaaggcattgtttgtgctgcatacgacgccatcctggaacgcaacgtggccatcaaaaaactgtctcgacccttccaaaatcagacccatgccaaaagggcatacagagaacttgttttaatgaagtgcgtgaatcacaaaaacattatcggcttgctcaatgtgttcacccctcagaagtccctggaagagtttcaggacgtgtacattgttatggagctcatggatgctaatctgtgtcaggtaattcaaatggaactcgatcacgagcgaatgtcgtatctcctgtaccagatgctttgcgggatcaaacatctccacagcgcgggaatcatccacagagacctgaagcctagcaatattgtcgtaaaatctgattgcacccttaagatacttgattttgggctggctcgcacagcaggaacttccttcatgatgactccttatgttgtaacccggtactatagagcaccagaagtcattcttgggatggggtataaagagaacgttgatctctggtcagtcgggtgcattatgggagagatggtgtgtcacaaaatcctgttccccggcagagattacatagaccaatggaacaaagtgatcgagcagctcgggacgccgtgtcccgaatttatgaagaagcttcagccgactgtccggacatatgtggagaaccgacccaagtatgccggctactcatttgaaaaactgtttcccgatgtgctcttccctgcagacagcgaacataataagttgaaggcgtctcaggccagagacctattatcaaagatgctggtgatcgacgctagtaagcggatatccgttgatgaagccctacagcatccatacattaacgtgtggtatgacccttctgaagcagaagctcccccacccaagatccccgataagcagctggacgaaagggaacacactattgaggagtggaaagagctgatctataaagaagttatggatctggaggaaaggactaaaaacggcgtgattcgcggacagccgtcacccttgggggctgccgtcatcaatggaagtcagcatccttcgagctcctcgtcagtcaacgacgtgtctagcatgtctaccgaccccaccttagcttcagataccgattcctcgctggaggcagcggccggccctttaggatgctgtcgatag

SEQ ID NO: 25013 - DNA, 657 bp, Artificial Sequence
  Description of Artificial Sequence: Synthetic coding sequence
atgagccggagcaagcgggacaacaacttctacagcgtggagatcggggattccacatttaccgtgctcaaacggtatcagaatctcaagcctataggtagcggcgcccagggtattgtatgtgcagcatacgatgccattcttgaacggaacgtcgcaattaaaaaattaagccgacccttccagaatcagacgcatgcaaagcgtgcttatagagaattggtcctgatgaaatgcgttaaccacaagaatattatcgggttgcttaacgtgttcacacctcagaaatcactagaagaattccaagatgtgtatattgtcatggaactcatggacgccaacctgtgtcaggtaatacagatggagctggatcatgaaagaatgtcatacctattgtaccaaatgttgtgtggcattaagcacctgcattccgcaggtatcatccacagggatctcaaaccatctaatattgtagtgaagtccgattgtactctgaaaattctggacttcgggctggcccggacagcgggcactagttttatgatgaccccttacgtagtcacacgctactatagagcacccgaagtgattctcggcatgggatataaggagaacggcgggcgcatgggaaaaggaatctttacccgattacagtag

SEQ ID NO: 25014 - DNA, 1284 bp, Artificial Sequence
  Description of Artificial Sequence: Synthetic coding sequence
atgagccggagcaagcgggacaacaacttctacagcgtggagatcggagatagcacattcacggtactgaagcggtatcagaacctgaagccaatcggcagcggcgcccaggggattgtgtgcgctgcttatgacgccatcctggagagaaacgtcgctatcaagaagttgtcacgaccattccaaaatcagactcacgcaaaacgggcctaccgagaactggtgttgatgaaatgcgttaaccacaaaaacataattggccttctgaacgtgtttaccccgcaaaaaagtttagaagaattccaggatgtgtatattgtgatggagttgatggacgcgaacctgtgccaagtgatccagatggagcttgatcatgaaagaatgagctatctgctttaccagatgctgtgcggaataaaacatctgcacagtgcaggaattatccatcgcgacctgaaacccagtaatatcgtagtcaaatctgactgcaccctgaaaatcttggactttgggctggcacggactgctggaacaagtttcatgatgacgccttacgtggtgactcgttactaccgtgcccccgaggtcatcttaggaatgggctataaggagaacgtggatatctggtcagttggatgcatcatgggtgagatgataaagggtggggtgctgtttcctggaactgatcatatagaccagtggaacaaggtaatcgaacagttgggaacgccgtgtccggaatttatgaaaaaactacaaccaacggttcgcacttatgtcgaaaatagacccaagtacgctggatacagtttcgaaaagctgttcccagatgttctatttcccgcagacagtgaacacaataaactgaaggcatcccaggcacgcgatctgctctctaaaatgctggtgattgatgctagtaagcgtatttctgtggacgaagcgctgcaacacccctatatcaatgtgtggtacgaccccagcgaggctgaggctcctcctcctaaaatcccagataagcagctcgatgaaagagagcacactattgaggagtggaaagagttgatctacaaggaagtgatggatctcgaagaacgtaccaagaatggcgttatcaggggccagccttctccactcggggcagccgttattaacggctcccagcacccatcaagcagctcctccgtcaatgacgtgagcagtatgtctaccgatcccaccctggcaagcgatactgactcatctcttgaggccgccgctggtcccctgggatgttgtcggtag

SEQ ID NO: 25015 - DNA, 1155 bp, Artificial Sequence
  Description of Artificial Sequence: Synthetic coding sequence
atgagccggagcaagcgggacaacaacttctacagcgtggagatcggcgacagtaccttcacagtcctgaaacgttaccagaatcttaagcctatcggtagcggcgcccagggaatcgtttgtgccgcgtatgacgccatcctggagcgtaacgtggctatcaagaagctttctcgcccattccagaatcagacacacgccaagagagcctatcgtgaactcgtcctgatgaagtgtgttaaccataagaacattatcggacttctgaacgtgtttacgccccagaagagcctggaagagttccaggacgtatacatagtgatggagctcatggacgctaacctgtgccaggtcattcagatggaattggaccatgaacggatgtcatacctcctgtatcagatgctatgcggcatcaagcacttacacagcgctgggatcatccacagagacctgaaacctagtaatattgtcgttaaatccgattgtaccttgaaaatactggattttgggctggcgaggaccgccggcacctctttcatgatgaccccttacgtggtgactcgctactaccgagcacccgaagtaattctaggcatgggatataaagagaacgtggatatctggtctgttggatgcatcatgggagaaatgattaaagggggcgtgctgttccctggtactgatcatatcgaccagtggaataaggtcatagagcaactcggaaccccatgccctgagtttatgaagaaactgcagcccactgtccgtacatacgtggaaaatcggcctaaatacgctggctactcctttgagaaactctttccggacgtcttattccctgcagactctgaacacaacaaacttaaggcgtctcaggctagggatctgctgtcgaaaatgttagtaatcgatgcatcgaaaagaatttcagtcgacgaagccctgcagcacccttacattaacgtttggtacgatcctagcgaggccgaagcaccgcccccaaagatccccgacaaacagctggacgagcgtgaacacactattgaagaatggaaggagctcatctacaaagaagtgatggatcttgaagagaggactaagaacggcgttattaggggtcagccctcacctttagctcaagtgcaacagtag

SEQ ID NO: 25016 - DNA, 1155 bp, Artificial Sequence
  Description of Artificial Sequence: Synthetic coding sequence
atgagccggagcaagcgggacaacaacttctacagcgtggagatcggagatagtacatttaccgtgctgaagcgatatcagaatctgaaacccatcggctcaggggcccaggggatcgtgtgcgcagcctacgacgctattctggaacggaatgtggccatcaaaaagctctcccgcccatttcagaatcagactcatgcaaagcgcgcctacagggagctagttctgatgaaatgcgtcaaccacaagaatataatcggtctgttaaacgtgtttacaccccagaagtctcttgaagagttccaggacgtgtatatcgttatggagctgatggatgccaatctctgccaggttatccagatggagctcgaccacgagagaatgtcgtacctgttataccaaatgttatgcggtattaaacacctgcacagcgccggtatcatccatagagaccttaaaccatcaaacatcgttgtgaagagtgactgcacactgaagatactggacttcgggctggcccgtacggccggcacgtcgttcatgatgactccgtatgtcgtcacccggtattatcgtgcacccgaggtcattctagggatgggttataaggaaaacgttgatctgtggtcagtgggctgcatcatgggggagatggtttgccacaagattctgttcccgggtagagattatattgaccagtggaacaaagtgattgaacagttaggcaccccttgtcctgaatttatgaagaagctacagcctactgtgcgcacatacgtggagaaccgtccaaaatatgcaggttattcgtttgagaaactctttccagacgtactgttccctgccgactctgaacataacaagctgaaagcatctcaggcccgagatctgttatccaagatgttagtgatcgacgcatcaaagcgaatatctgtggatgaagctttgcagcatccttatatcaatgtgtggtatgatccttctgaagcggaagctccccctccaaagataccggataagcagctggatgagagggaacatacaatcgaagaatggaaagaactcatctacaaggaggtcatggatctggaagaaaggacgaagaacggggtgattcgcggccaaccaagtcccctggcccaggtacagcagtag

SEQ ID NO: 25017 - DNA, 1284 bp, Artificial Sequence
  Description of Artificial Sequence: Synthetic coding sequence
atgagccggagcaagcgggacaacaacttctacagcgtggagatcggagattccacattcaccgtgctgaaacggtatcagaacctgaagcccatcggatcgggcgctcagggtatagtctgtgctgcttacgatgctattctagaacgaaatgttgcaataaaaaagctgtcccggccatttcaaaatcagacacacgcaaagcgcgcataccgcgagctggtgttgatgaaatgtgtaaaccacaagaatataattgggttactgaatgtgtttacaccccagaagtccctggaggagttccaagacgtttatatagtcatggaactcatggacgccaatttatgccaggtgatccagatggagttagatcacgaacggatgtcgtatctgctttaccagatgctgtgcgggatcaagcacctgcactcggccggcatcatccacagagatctcaaaccgtccaacattgtggtgaaaagtgattgtacgctcaaaattctcgacttcggtctcgcaaggactgccggcacttcttttatgatgactccctacgtggtgacgcgttattatagagctcctgaggtgattcttggaatgggatacaaagagaatgtcgacctgtggtccgtggggtgtattatgggcgaaatggtgtgccacaagattctatttccaggacgggactacatcgatcagtggaataaggtcattgaacaacttggtaccccctgccccgagttcatgaaaaaacttcagcctacggtgaggacatatgtggaaaatagacccaaatacgcggggtatagctttgagaaactctttccggacgtactgtttcccgctgacagtgagcacaataagctaaaagctagccaggcccgcgaccttctatccaagatgctcgtgatcgatgcctccaagcgcatctcagtcgatgaagcactacaacacccctatatcaacgtgtggtacgatccatctgaggccgaggcccctccccctaaaatccctgataaacagcttgacgaaagggaacacactatcgaagagtggaaagaactcatttataaggaggttatggacctagaggagcgaacgaagaacggagtgatacggggacagccttctccactgggggctgctgtcatcaacggatcccagcaccctagtagcagctcctctgtgaacgacgtatcctccatgtctaccgaccctaccctcgcctccgataccgacagctcccttgaagcagcggccggcccattgggatgctgcagatag

SEQ ID NO: 25018 - DNA, 927 bp, Artificial Sequence
  Description of Artificial Sequence: Synthetic coding sequence
atgagccggagcaagcgggacaacaacttctacagcgtggagatcggtgattctacgttcacagtgctgaaaagataccagaatctgaagcctataggaagcggcgcccaagggatcgtgtgtgccgcttatgacgccatcctggaaagaaatgtcgccatcaagaagctttcacggccatttcagaaccagacgcacgctaagcgagcctatagggagctcgtcctgatgaagtgtgttaatcacaagaatatcattggcttattgaacgtcttcaccccccagaaaagcctggaagagttccaggacgtctacattgtcatggagctgatggacgccaacctctgtcaggtgatccagatggagctagatcacgagcgtatgagttatctgctgtatcagatgttgtgtggcataaagcacctacactccgctggcatcattcaccgggacctgaagccaagcaatattgtcgtcaaaagcgattgtacactgaaaattctggacttcggcctcgctagaaccgctggtacaagcttcatgatgacaccatacgtggtcacacgctactaccgggcacctgaggtgatcctgggtatgggatacaaggagaatgccgattctgagcacaacaagctgaaggctagtcaggctcgcgacctgttgtccaagatgctggtcatcgacgctagcaaacgaatatccgtcgatgaagcgctgcagcatccttacatcaatgtgtggtatgacccatctgaggctgaagccccacctcctaaaatacccgataagcaattggacgagcgggaacacacaatagaggaatggaaggaattaatttataaagaggtgatggatttagaggagcgcaccaagaatggcgtcatccgggggcaaccttctcctttggcacaagtacagcagtag

SEQ ID NO: 25019 - DNA, 429 bp, Artificial Sequence
  Description of Artificial Sequence: Synthetic coding sequence
atgagccggagcaagcgggacaacaacttctacagcgtggagatcggtgactccacttttactgtattaaagcggtatcagaatctcaaaccgatcggcagcggcgctcaagggatcgtatgcgcagcctatgatgccatacttgagcggaacgtcgccattaagaagctgtctagaccctttcagaatcagacacacgcaaagagggcttaccgagagctcgtcctgatgaaatgtgtcaatcacaaaaatattatagggctcctcaatgtgttcactccccagaagtccctggaggaattccaggatgtctacatcgtcatggagctgatggacgctaacctctgccaggtgatccaaatggagttggaccatgagcggatgagttatctactgtaccagatgctgtgtgggataaagcatctctag

SEQ ID NO: 25020 - DNA, 294 bp, Artificial Sequence
  Description of Artificial Sequence: Synthetic coding sequence
atgatcatcggcctgctgaacgtgttcaccccccagaagagcctggaagagtttcaggacgtctacattgtcatggagcttatggacgccaacttgtgccaggtaattcaaatggaactggaccacgaacgtatgtcatacctcctctatcaaatgctctgcggaataaagcacctacactcagccggcatcatacatcgagatctaaaacctagcaacatcgtggtcaagtccgattgcactctgaaaatcctggattttggactggccaggacagcggggacctctttttag

SEQ ID NO: 25021 - DNA, 429 bp, Artificial Sequence
  Description of Artificial Sequence: Synthetic coding sequence
atgagccggagcaagcgggacaacaacttctacagcgtggagatcggagactcaacttttacagtgctgaaacgataccagaacctgaagccaatcggaagtggtgcccagggaatcgtgtgtgcagcctatgatgccatccttgagcgtaacgtcgccattaagaagctctctcgtccgttccaaaatcagactcatgccaagagagcatacagggagctggtcctgatgaagtgtgtgaatcacaaaaatattattggcctgctaaatgtgttcacccctcaaaagtctttggaggagttccaagacgtttacatagtaatggagctgatggacgccaacctttgtcaggtcattcagatggagctggatcatgagcggatgagctatctgctttatcagatgctgtgtggcatcaagcacctctag

SEQ ID NO: 25022 - DNA, 1182 bp, Artificial Sequence
  Description of Artificial Sequence: Synthetic coding sequence
atgcccaagaagaagcccacccccatccagctgaaccccgcccccgatgggtccgcagttaacggtaccagcagtgcggagacaaacctcgaagcgctccagaaaaagttagaggagttagagctggatgagcagcagaggaaaaggctggaggcattccttactcagaagcagaaagtcggcgagttaaaagatgacgacttcgagaaaatttctgaactcggtgctggaaatggcggggtggttttcaaagtaagccataagccgagtggtctcgtgatggctcgtaaactgatacatttggagatcaaacctgcaattcgaaatcaaatcatccgggaactccaggttctgcacgagtgcaatagcccgtatatcgtgggattctatggggcgttctactcagatggagagatctcaatctgcatggaacatatggacggcggaagtttagatcaggtattgaaaaaagcagggcgtatccctgagcagatcttaggaaaggtgtctattgcagtcattaagggtcttacatatttgcgcgagaagcacaaaattatgcatcgcgacgtaaagccctctaacatcttagtgaattccaggggagaaataaaactctgcgattttggtgtgtcagggcagttgattgacagcatggctaacagttttgtgggcaccagatcttacatgtcccccgaaagactgcagggaacacactattcggtccagtcggacatatggagcatgggtctctccctagtcgaaatggccgtggggagatacccaataccgccccccgatgcgaaggaactcgagctgatgtttggttgccaggttgaaggagacgccgctgaaactcccccacgaccgcgaactcccggaagaccattgagctcctatggcatggattcccggccacctatggccatattcgagctcctggattacatcgtgaatgagcccccaccgaaactaccatccggcgtcttttctcttgaatttcaagatttcgtgaataaatgtctgatcaaaaaccccgccgagagggcagatttgaaacagctgatggtccacgccttcatcaaaaggtccgacgcagaggaagtcgacttcgccgggtggctctgtagcaccattggacttaaccagccctccacccctactcacgctgccggagtttag

SEQ ID NO: 25023 - DNA, 1203 bp, Artificial Sequence
  Description of Artificial Sequence: Synthetic coding sequence
atgctggcccggcggaagcccgtgctgcccgccctgaccatcaaccctacaatcgctgagggcccctctcctacctcggaaggggccagtgaggccaatttggttgatctgcagaaaaaactggaggagcttgagctcgatgagcagcaaaagaaaagattagaagcattcttgactcagaaagcaaaggttggcgaacttaaggacgatgactttgaacgcattagtgagctaggtgcaggaaacggaggggtggtaaccaaggtccagcacaggccttcgggcctcatcatggcccggaagcttatccacctcgaaattaagcccgctatacgtaatcaaattattcgggagctgcaggttctacacgaatgcaattcaccctacatcgtgggtttttacggtgctttctattcggacggagagattagtatctgtatggagcacatggacggtggaagtctggatcaagtgcttaaagaggcaaaaagaattcctgaagaaatcttagggaaagtcagtattgctgtcctgaggggcctcgcttacttgcgcgaaaagcaccaaatcatgcaccgagacgtcaaacccagtaatatcctggtgaactccagaggtgaaatcaaactatgtgattttggtgtctcgggacagctgatcgactctatggctaactctttcgtcgggacacggagttacatggctcctgagcgactgcagggcacccattacagtgtccagagcgatatttggagcatgggtctatccctggtggaactagccgtggggcgctaccccatccctcccccagacgccaaagagctcgaagcgatctttgggcgccctgtggtggatggtgaggagggagaaccccatagcatcagtcctcgcccgagacctcctggaagacctgtgtctggacatgggatggattccaggcctgcaatggcgatcttcgaacttctggactacatcgttaatgaaccaccgcctaagctgccaaacggagtatttacccccgattttcaagagtttgtgaacaagtgcctcattaagaatccagccgaacgtgccgacctgaagatgctgacgaaccatacgtttatcaagcgctctgaagtcgaagaggtggacttcgcaggttggctgtgcaaaacactgcgtctgaaccagcccggcacccctacccgtactgccgtctag

SEQ ID NO: 25024 - DNA, 1056 bp, Artificial Sequence
  Description of Artificial Sequence: Synthetic coding sequence
atgggcgtgcagggcaccctgatgagccgggaccagaccccccacctcctgagtattctcggcaagagcaagagaaagaaggacctgcgcataagctgcatgtccaaaccccccgctccaaacccaacaccaccacgaaatttagactcaagaactttcatcacaattggggatcgtaatttcgaagtcgaggcggacgacctggtgacgattagtgagttgggccgaggtgcctacggcgtagtcgaaaaggttaggcacgcccagtcaggcactatcatggcagtcaaaaggatccgggccactgtgaactcgcaggaacagaaaagactgttgatggacctggatatcaacatgaggaccgtcgattgtttttataccgtgacattttatggggccttatttcgagagggggacgtgtggatatgcatggagctgatggacacctccctcgacaagttctatagaaaagtgctcgacaagaacatgactattccagaagatatactgggtgagatcgccgtttctatcgtccgcgcactcgagcatttacactcaaagctgtcagtgatccaccgagatgtcaagccatccaacgtgctgattaacaaagaaggtcacgtgaaaatgtgtgactttggcattagcggctacttagtggactcagttgccaagacaatggacgctggctgtaagccttatatggccccggaacggatcaatcccgaactgaaccaaaaaggctataacgtcaagtcagatgtgtggtctttgggtattaccatgattgagatggcaattcttcgattcccctacgagtcttggggtacccccttccagcaactcaagcaagttgtggaggagcccagcccccagctgcccgcggacagattcagtcccgagttcgttgacttcaccgcgcagtgtctgcgtaagaacccagccgaaagaatgagctatcttgagctaatggagcacccatttttcaccctgcataagaccaaaaagacagacatagccgcttttgtaaaagaaatccttggcgaagattcttag

SEQ ID NO: 25025 - DNA, 1044 bp, Artificial Sequence
  Description of Artificial Sequence: Synthetic coding sequence
atggagagccccgccagcagccagcccgccagcatgccccagagcaagggtaagtccaagcgcaagaaagacctgagaataagttgcatgtctaagccccccgccccaaaccccaccccaccacgtaatctagacagtaggacatttattactataggagataggaacttcgaggttgaggccgatgacttggtgacaatctctgagctgggcagaggggcctacggcgtggtcgaaaaggtcagacacgcgcaaagcggcactataatggccgttaagaggattagagcaacagtaaactcccaggagcagaagcggctgctgatggacctcgatattaatatgcggacagtcgattgcttttacaccgtgactttctatggggccctcttcagagagggagacgtgtggatatgcatggagctgatggacacatccctggataagttctatcggaaggtattagacaaaaacatgactattcctgaggacattctgggagaaatagcggtgtcaatcgttcgcgccctggaacacctgcatagtaagctgagtgttatccacagagacgtgaagccctccaacgtccttattaacaaggagggacatgttaagatgtgtgacttcggaatcagcggatatctcgtggattctgttgccaagacaatggatgcaggctgtaagccttacatggcccctgagcgaatcaatccagagctgaaccaaaagggatacaacgtgaaatccgacgtgtggtccctaggaatcaccatgatcgagatggccatcctgcggtttccatacgagtcgtggggaaccccattccagcagctgaaacaggttgtagaggagccctctcctcagctgccagccgaccgcttttctccagagttcgtcgactttacagcgcagtgccttcgtaaaaatcctgcggaaagaatgtcatacttggagttaatggaacatcctttcttcaccttgcacaaaactaagaagactgatattgccgccttcgtgaaggaaatcctaggggaagattcttag

SEQ ID NO: 25026 - DNA, 957 bp, Artificial Sequence
  Description of Artificial Sequence: Synthetic coding sequence
atgagcaagccccccgcccccaaccccacccccccccggaacctggacagccggactttcatcacaataggcgaccggaattttgaggtggaggccgatgacttggtgaccataagcgagctgggccgcggtgcttacggggtggtcgagaaagtgaggcatgctcagagtggtacaattatggcagtaaagaggatacgggccaccgtgaacagccaagaacagaagagactactcatggatctggatatcaacatgcgcaccgtggattgtttctatacagtaaccttctacggtgctctgttcagggagggggacgtttggatttgcatggaattgatggacactagcctggacaagttctaccgcaaggtgttggataaaaacatgaccatccctgaagatattttgggagagattgctgtaagtattgttagggccctggagcatttgcactccaagctgagcgtcattcaccgtgatgtaaagccaagcaatgtcctgattaataaggaaggacacgttaagatgtgcgacttcggaatttcaggctatctagtggacagcgtggccaaaaccatggacgccggatgcaagccttacatggccccagagaggataaatcccgaactcaatcaaaaggggtacaacgtaaagtccgacgtctggtctctggggatcacaatgatagagatggctatcctgcggtttccatacgaaagctggggaaccccctttcagcagctgaaacaggtggttgaggaaccatccccccagttgcccgcagacaggttttctcctgaattcgtggacttcacggcacagtgtctgagaaaaaatcccgccgaacgcatgagctacctggaactgatggagcatcccttctttactctgcataagaccaaaaagaccgacattgccgcgtttgtcaaggaaatccttggtgaggatagctag

SEQ ID NO: 25027 - DNA, 1113 bp, Artificial Sequence
  Description of Artificial Sequence: Synthetic coding sequence
atgctgagcaacagccagggccagagcccccccgtgcccttccccgcgccggccccaccgcctcagccccccacaccagcactgccacacccacctgctcagccccctcctccaccaccccagcagttcccccagttccacgtgaaaagtggcctccagatcaagaaaaatgctatcatcgatgattacaaagtcacatcacaggtgctcggactaggaatcaatggtaaggtgttgcagattttcaataagaggacgcaggagaagttcgcactgaagatgttacaagactgtcctaaggcccgcagagaggtggagttacactggcgcgcttctcaatgccctcacatcgttcggatcgttgacgtttatgaaaacttatacgcagggcgcaagtgcctgctgatagtgatggagtgcctcgacggaggtgaattattctcaagaatacaagatcgcggcgatcaggcattcaccgaaagggaggccagtgagatcatgaagtcaattggtgaggccatccagtatctccactcaattaacatcgctcaccgggacgtgaaaccagagaacttgttgtatacatcgaagcggccaaacgcaatactgaagctcaccgatttcggttttgccaaagagaccacaagtcataacagtttaacaacaccatgctacacgccttattacgtcgcgccggaagtattaggacccgagaagtatgacaagtcttgtgatatgtggagtctcggcgttatcatgtacatccttctgtgcggctatccacccttttacagtaaccatggcctcgcaatttcacccgggatgaagacacggattcgcatgggccagtacgaatttccaaatcccgaatggtctgaagtcagtgaggaggtcaaaatgctaatcagaaatctccttaaaacggagccaactcagagaatgacaatcacggagttcatgaatcacccctggataatgcagagtactaaggttccccagactccacttcacacatcccgcgttttgaaagaggataaggaacgatgggaggatgtgaaaggctgcctacatgacaagaattcagatcaggccacctggctgacaaggctgtag

SEQ ID NO: 25028 - DNA, 1203 bp, Artificial Sequence
  Description of Artificial Sequence: Synthetic coding sequence
atgctgagcaacagccagggccagagcccccccgtgcccttccccgccccagcaccccccccacagccgcccaccccagccctgccccacccccctgcccagcctcctccgcctccaccgcagcaatttccacagttccacgttaagtccggattacaaattaagaaaaacgcaatcatagacgattacaaagtgacatcccaggtactggggttgggaataaatggaaaggtgttgcagattttcaacaagcgcacacaagagaaatttgcactcaagatgctgcaagactgcccaaaggccagacgtgaggttgaactgcactggcgtgcgagtcaatgcccacatatcgtgcggattgtcgatgtctatgaaaacctctacgctggaagaaagtgtcttctgatagtcatggagtgtctggacgggggcgagcttttttcacgaatacaagatagaggcgaccaggctttcacagaacgcgaagcttcagaaattatgaagagcattggtgaggctatccaatacctgcactccatcaatatcgctcatagagacgtgaagccagagaacctgctgtacacttctaagcggccaaatgcaattctgaaactaaccgatttcggctttgctaaggagacgacctcccataactccctgaccactccatgttacacaccctactacgtggcccccgaagtcctggggcccgagaaatatgacaaaagctgcgacatgtggtcattgggggtgatcatgtatatccttttatgcgggtacccccctttctacagtaatcatggactggccatatccccggggatgaagacaagaattcgcatgggacaatatgagtttccaaacccagagtggagcgaagtgtctgaagaggtaaagatgctgataagaaacctcctaaaaacagagcctactcagaggatgacaatcactgagtttatgaaccacccatggattatgcaaagtacgaaggttccccaaaccccccttcatactagcagggtgctcaaagaagataaggagcgttgggaagacgtcaaggaagagatgacaagcgccttagccaccatgcgcgtggactatgaacaaatcaaaatcaagaagatcgaggacgcctcaaatccacttctgctcaagcgaaggaaaaaggccagggccctggaggctgctgcccttgctcactag

SEQ ID NO: 25029 - DNA, 1149 bp, Artificial Sequence
  Description of Artificial Sequence: Synthetic coding sequence
atggacggcgagaccgccgaggagcagggcggccccgtgcccccccccgtggccccaggtggtcctggactaggaggggccccaggcggccggagagagccaaagaaatacgcggtcactgacgactatcagctgagtaagcaggtgctggggctcggcgtaaacggcaaggttctcgaatgtttccaccgaaggacagggcagaaatgtgccctgaagttactgtacgattctcccaaggctcgacaggaagtggatcatcactggcaggcttcgggtggacctcacatcgtgtgtattctagatgtgtatgaaaacatgcatcatgggaagcgctgtctgctgatcataatggagtgtatggaaggtggggagcttttctctcgcattcaggagcggggagatcaggccttcaccgagagggaggcggcagagatcatgcgcgatatcgggaccgctatccaattcctgcactcacacaacatcgcacatcgggatgtcaagcctgagaacctcctgtataccagcaaggagaaggacgcagtactgaaactaacggacttcgggtttgccaaggagactacccaaaacgccctgcagactccctgttataccccttattatgtcgcccccgaggttcttggacctgaaaaatacgataaaagctgcgatatgtggagcctgggtgtgatcatgtacattctactatgcggttttccaccgttctattccaataccgggcaggccatcagcccagggatgaaaaggcgcatccgcttggggcagtacggtttcccgaacccagagtggagtgaggtgagcgaagacgctaagcagctgattcgactcctgctgaaaacagacccaactgagcgtctgactattacccaattcatgaaccacccgtggataaaccagtccatggtagttccccagactccgctgcacaccgcccgcgtcctgcaggaggataaagatcattgggatgaagtcaaagaggagatgaccagtgctctggccaccatgcgcgttgactacgaccaggtcaaaataaaagacctcaagacatctaacaacaggctgctcaacaagcgcagaaagaaacaggcgggctcctcaagcgcctcacagggatgcaataaccagtag

SEQ ID NO: 25030 - DNA, 999 bp, Artificial Sequence
  Description of Artificial Sequence: Synthetic coding sequence
atggacggcgagaccgccgaggagcagggcggccccgtgccccccccagtggctcccggggggccaggtcttggcggcgcaccgggtggccgccgggagccaaagaagtacgctgtaaccgacgattaccagctgtccaagcaggtgctggggctcggagttaatggaaaagtgctagagtgcttccaccgccggactggtcaaaagtgcgccttgaagttgctgtacgactctccaaaagccagacaggaggttgaccaccactggcaggcctctggggggccacacatagtgtgtattctggatgtgtacgagaacatgcatcatggcaaacgctgcctgctgatcattatggagtgcatggagggaggcgagctgttcagcagaatacaggaacgaggcgatcaagcttttactgaaagagaggctgcggagattatgagggacatcggcaccgcaatccagttcttacactctcacaatatcgctcacagggatgtgaagcctgagaacctgctgtatacttctaaagagaaggacgctgtactgaagctgaccgactttgggttcgctaaagaaaccacacagaacgccctgcagaccccctgttataccccctactacgtcgcccccgaagtgcttgggccagagaagtatgataaaagctgcgatatgtggtcccttggtgtgattatgtatatcctcctgtgcgggtttcccccattctactctaacacgggccaagcaatcagccctggcatgaaaagaagaatccggctcgggcagtacgggttcccaaatccagaatggtccgaggtaagcgaggacgcaaaacagctcattagactactgctgaagactgatccaactgaacgcctgaccatcacacagttcatgaatcacccttggatcaaccaatctatggtagtgccacagactccgctgcatactgcccgagttctccaggaagacaaagatcattgggatgaagtaaagtag

SEQ ID NO: 25031 - DNA, 1149 bp, Artificial Sequence
  Description of Artificial Sequence: Synthetic coding sequence
atggacggcgagaccgccgaggagcagggcggccccgtgcccccccctgtggctccaggtgggccaggcctgggcggggctcccgggggtaggcgcgagccgaaaaagtacgccgttaccgacgactaccagttgagtaaacaagttcttggccttggagtcaacggaaaggtactggagtgctttcaccggaggacaggccagaaatgtgctttgaagctactgtacgactctcctaaagccagacaggaggtggaccaccactggcaagcgagcggcggcccccatattgtgtgcatcctggacgtatatgagaatatgcatcacgggaaaaggtgtctcttaatcattatggaatgcatggagggaggtgagctcttttctcgcatccaagagcgtggtgaccaggccttcactgagagggaagcagcagagatcatgagggacattggaaccgctattcagttcctccattctcataatatcgctcaccgtgacgtaaagcctgaaaacttactctacacctccaaagagaaggacgccgtcctgaaattaaccgatttcggattcgcaaaagaaacgacccagaacgcactccagactccatgctacactccatattacgtggcccccgaggtgttgggccctgaaaagtatgacaagtcctgcgatatgtggagcttaggagttatcatgtacatcctcctgtgcggattccctcccttctactctaacacaggccaggccatttctccaggtatgaagaggcggattcgtctgggccagtatgggttccccaaccccgagtggtccgaggtcagcgaagatgcaaaacaactgattcgactcctgcttaaaacagatccaactgagcggctgaccattacccagtttatgaatcacccatggataaaccagtccatggttgtgccacaaacaccactccacacggctcgcgtcctacaggaggataaagaccattgggacgaagtcaaagaggaaatgacgagcgccctcgccacaatgcgagttgactacgaccaggttaagataaaggatttgaagacaagcaataatagattgctgaataaaaggcgcaagaagcaggccggttctagttccgcttcacaaggatgtaacaatcagtag

SEQ ID NO: 25032 - DNA, 360 bp, Artificial Sequence
  Description of Artificial Sequence: Synthetic coding sequence
atggacggcgagaccgccgaggagcagggcggccccgtgccccccccagtagcaccagggggtcctggcctcgggggcgcccccggagggaggcgagagccaaaaaagtatgcagtcaccgacgactatcagctgtcaaagcaggtcttgggactaggagtgaacggcaaagtcctagagtgctttcataggcgaacagggcagaagtgcgccctaaaactcctgtatgacagcccaaaggccagacaagaagtcgatcaccactggcaagcgagcggcgggcctcacatcgtatgcatcctcgacgtgtatgagaatatgcatcatggaaaaagatgtttgttgatcatcatggaatag

SEQ ID NO: 25033 - DNA, 1422 bp, Artificial Sequence
  Description of Artificial Sequence: Synthetic coding sequence
atgagcgaggagagcgacatggacaaggccatcaaggagaccagcattctggaagagtatagtatcaattggacacagaaacttggtgcaggcatctccggcccagtgagagtttgcgttaagaaatccacacaggagcgcttcgccctgaagatattgttggataggccaaaagcccgaaacgaggttcgcctacatatgatgtgtgctactcacccaaatatcgtccagattatcgaggtgtttgctaattcggtgcagtttccccacgaaagcagccctagagcccgcctgctcattgtcatggagatgatggagggaggggagttgttccacagaatttctcaacatagacactttaccgaaaaacaggcttctcaggttaccaagcagatcgctctcgcactccggcactgtcacctgctgaatatcgcccatagagacttgaaaccagaaaacctcctttttaaagataatagcctggacgcccccgtgaagttgtgcgacttcggatttgcgaagattgaccaaggtgacttgatgacacctcagttcacaccatactacgtggcgccacaggtactggaagcccagcgaaggcaccagaaagagaaatcaggaataattccaacctctcccactccatatacatacaataaatcttgcgatctctggtccctgggggtcataatctatgtcatgctttgcgggtacccgcccttttacagtaaacatcattctagaacaattcctaaagacatgcgccggaagattatgaccgggtcattcgaatttcccgaggaagaatggtcccaaatctcagaaatggctaaggacgtggtgaggaagctgttaaaggttaagcccgaggaaagactaactatcgaaggagtgctggatcatccatggcttaactctaccgaggcccttgacaatgttctaccaagcgcacagctgatgatggacaaagctgtcgtggctggcatccagcaggctcacgcggagcagttggctaatatgcggatccaggacctcaaagtaagcttgaagccgctccactccgtgaacaaccccatcttacggaagaggaagctgctggggacgaagcctaaagattcagtctatatccacgaccatgagaatggagccgaggattcaaacgtggccttagaaaagttaagggacgttattgcacaatgcattctcccacaggctggcaaaggggagaacgaagacgagaagttgaacgaggttatgcaggaggcttggaagtataatcgcgaatgtaaattactccgagacacattgcaatctttctcatggaatggaagggggttcaccgacaaagtagatcgcttgaagctggcggagattgtgaagcaggtgatcgaagaacaaaccacttcccacgagtcgcaatag

SEQ ID NO: 25034 - DNA, 1416 bp, Artificial Sequence
  Description of Artificial Sequence: Synthetic coding sequence
atgagcgaggagagcgacatggacaaggccatcaaggagaccagcatactggaggagtactctatcaattggactcagaaactcggcgccggaattagtgggcccgtccgggtgtgtgtgaagaagtctacccaagaaaggttcgcgttgaaaatcttgctggatcgccctaaagctagaaacgaggtacgcctgcacatgatgtgcgccacacaccccaatattgtgcagatcatcgaagtgtttgctaatagtgtgcagttcccgcacgagtccagcccacgcgctcggttactgattgtcatggaaatgatggagggaggtgaactgttccaccggatcagtcaacaccgccattttacggagaagcaagcatctcaggttaccaaacagatagctctggcactcaggcactgtcacctcctaaacatcgcgcaccgtgacttgaaaccagaaaacctactgttcaaagacaactcattggatgcacctgtgaagctctgcgacttcgggttcgccaagatcgaccagggagatctcatgacaccgcagttcactccttactacgtagcaccgcaggttctggaagcgcaacggagacaccagaaagaaaaaagcgggataattcctacatcgccaacgccttacacatataataagtcatgcgacctctggagccttggagtgatcatctacgtgatgctatgcgggtacccgccattttacagtaagcaccactctcggacaattccaaaagatatgcgccggaaaatcatgactggatcgtttgaattccctgaggaggagtggagccaaataagcgagatggcaaaggatgtcgtccgtaaactgctgaaggttaagcctgaggaacgactaaccattgagggagtcctcgaccatccgtggttaaatagcaccgaggccctggacaatgtgttacccagcgcccagcttatgatggataaagccgtggtcgcaggcatccagcaggcacacgcggagcagctggccaatatgcgaatccaggacctgaaggtgagcttaaagcctctgcatagtgtaaacaaccccattttacgaaaaagaaaactacttggcacgaagccaaaagacagcgtgtatattcatgatcacgaaaatggcgccgaggactcaaatgttgccctcgagaagctgcgtgatgtcattgcccaatgtatcctcccccaggccggtgaaaatgaagacgagaaactcaatgaggtcatgcaggaagcatggaaatataatcgggagtgtaagctactccgggacacattgcaatcctttagctggaacgggagaggattcaccgacaaagtagacaggctcaaactcgcagaaattgtcaaacaggtgatagaggagcagaccacatcccacgaaagtcagtag

SEQ ID NO: 25035 - DNA, 1416 bp, Artificial Sequence
  Description of Artificial Sequence: Synthetic coding sequence
atgagcgaggagagcgacatggacaaggccatcaaggagaccagcatcctagaggaatacagtattaattggacccagaagctgggcgccggaataagcgggcctgttcgagtttgtgtgaagaaaagtacccaggagagattcgctctaaagatactgcttgacaggcctaaggcaaggaacgaagtcagactgcatatgatgtgtgcaactcaccccaacattgtgcagatcatagaagtgtttgccaattcagtgcagtttcctcatgagagttcccctcgggcgagactgttaattgtcatggagatgatggaggggggcgagctcttccaccggatttcacaacacagacatttcactgaaaaacaggcaagtcaggtgaccaagcaggcgacactcgcattgaggcattgccatctcctcaacatcgcccaccgagaccttaaaccagaaaatttgctatttaaagacaacagcttagacgctcctgtcaaattatgcgattttggctttgctaagattgatcagggtgacctgatgactccccagttcactccatactatgtggctccccaagtgctggaagcccaacgtaggcaccagaaagagaaatccggcatcattcccacatcccccacaccgtacacatataataaatcctgtgatctatggtccctcggcgtcatcatctacgtgatgctttgcgggtaccctcccttttattctaaacaccattcaagaaccatacctaaggacatgcgcagaaaaataatgacgggatcatttgaatttccggaagaagaatggagtcaaatttcagagatggctaaggatgtggttaggaaactcctcaaggtaaaacccgaagaacggctgacaatagagggggtgctagaccacccatggctgaattcgacagaagccttggacaacgtactgccttccgcgcagttgatgatggacaaagctgtagtcgctggcattcagcaagcccatgccgaacagctggctaacatgagaattcaagatctgaaggtcagtctgaaacccctgcatagcgttaataatcctatacttaggaagcgcaaactcctggggacaaagcccaaggactcagtgtacattcacgaccacgagaatggggcagaagactccaatgttgccttagagaaactgcgggatgtaattgcccagtgtatcctgccgcaagcgggggaaaatgaggacgaaaaattaaacgaggtgatgcaagaggcatggaagtataatagggagtgcaagctgctgagagacactttgcagagtttttcttggaatgggcgcggtttcaccgacaaagtggataggttgaagctggcggaaatcgtgaaacaagtcattgaggagcagaccacttcccacgagagccagtag

SEQ ID NO: 25036 - DNA, 1422 bp, Artificial Sequence
  Description of Artificial Sequence: Synthetic coding sequence
atgagcgaggagagcgacatggacaaggccatcaaggagaccagcatcttggaggaatattctataaattggactcagaaactcggtgccgggatctctggcccagtgcgagtgtgcgtgaaaaaatctacgcaggagagatttgcacttaaaattttgcttgatagaccaaaggctcgaaacgaagtcagactgcacatgatgtgtgccacccaccctaacattgtgcaaatcattgaagttttcgccaattccgtacagtttcctcacgagtccagccctcgggcccggcttttgatcgtgatggagatgatggagggcggtgagctcttccaccggattagtcagcaccgccattttacggagaagcaggcaagccaggtcactaagcaggcaactctggctctgaggcactgccacctgctcaatattgcacacagagacctcaaacctgagaacttactctttaaggataactcactcgacgccccggttaagctgtgcgacttcggatttgccaagattgaccaaggcgacctgatgacaccacagtttacaccctattacgtggccccacaagtgctcgaagcacagcgcagacatcagaaagaaaagagcggcattatcccgacgagccctaccccttatacctataacaagtcttgtgacctgtggtctttaggggtcatcatctatgtgatgctttgcgggtaccctccattttactccaaacaccactcacggaccatcccaaaggacatgaggagaaaaattatgacagggagctttgaattccccgaagaagagtggagccagataagcgaaatggccaaggacgtggtgcgcaagttactcaaggtcaagccagaagagaggcttaccatcgaaggagtgctggatcatccttggctgaactccaccgaggctctagacaatgtcttacccagtgcccaactcatgatggataaagcggtagtcgcgggcattcaacaggcacacgcagagcagcttgctaatatgcgtattcaggacctgaaggtatctttaaaacctctgcactccgtgaacaaccccattttgcggaaacgaaaacttcttggtactaaacctaaagattctgtatacatacatgatcacgagaatggggctgaagacagcaacgtcgctctcgagaaacttcgcgatgtcattgcccagtgtatcttaccgcaggccggcaaaggcgagaacgaggacgaaaagctgaatgaagtaatgcaagaagcctggaagtataatcgggagtgtaaactcctgagggacactctacaatccttcagttggaacggccgggggttcactgataaggtggaccgactgaaacttgcagagattgtaaagcaggtgatcgaagaacagaccacgtctcacgagtctcagtag

SEQ ID NO: 25037 - DNA, 2799 bp, Artificial Sequence
  Description of Artificial Sequence: Synthetic coding sequence
atggccgccgccgccgccgtggaggccgccgcccccatgggcgccctgtggggactcgttcacgatttcgtcgtggggcagcaggaagggcccgcagaccaggtcgctgccgatgtgaagtcaggaaattacacagtactgcaggtggtggaagcactaggcagctcgctggagaaccctgagcctcgtacccgggcaagagccatccaacttctgtcccaggtgctcctgcattgccacactctgttgctcgagaaggaagtagtccacttaatcctgttctacgagaacagactcaaggaccatcatcttgttattccgagtgtgctccagggactgaaagccctgtccctgtgcgtggccttaccaccgggattagcagtatctgtgctgaaagccatctttcaagaagtgcatgtacagtctctgcctcaggtggacaggcacacagtgtataacatcatcactaactttatgcgcacacgggaggaagagctaaagagcctgggtgccgactttacattcggctttattcaggtaatggacggcgagaaggatccccgtaatctgcttgtcgccttccgaatcgtgcacgacctgatcagtagggactactctctgggccccttcgtggaagagctttttgaagttaccagctgctactttccgatcgacttcacccctcccccgaatgacccccacggcatccaaagagaagatttgatcctctcgcttcgcgctgtcttggcttctacaccaagattcgccgaatttctgttgccactgctcattgagaaggtggatagtgaagtgctgagtgcaaagctggactctctgcagacactcaatgcctgttgcgccgtctatggtcagaaggagctgaaggacttcctgccgtctctgtgggccagtatacgccgggagagcagccagcgaaggaccatcctggaaatgttattagggttcctcaagcttcagcaaaaatggtcttatgaagacaaggatcagagacctctgaacgggttcaaagatcaactgtgcagcctagtcttcatggcactcaccgacccttcgactcagctgcaactggttggaattagaacactgacagtcctcggagcccaacccgatttgcttagttacgaagacctcgagcttgcagtgggtcacctctatagactgtcttttctgaaggaagattcacagtcatgtcgggtagcagcattggaagctagcggcactctggccgccctgtacccagtggctttttcaagccacctggtccccaaactagcagaagaactgagggtgggggagtccaatttgacaaacggtgatgagcccacccagtgttctaggcacttgtgttgcctgcaggccctctccgccgtgtccacacatccctccatagtgaaagaaacacttccgctgctactgcagcacttgtggcaggtgaacagaggcaacatggttgctcaatcttcagacgttatagcagtgtgtcaatccttgagacagatggccgagaagtgccagcaggatccagagtcgtgttggtattttcatcagactgcaatcccatgcctgctagcgttggccgtgcaggcttcaatgccagagaaggagccatctgtcttgcgtaaggtactacttgaagatgaagtcctggcagctatggtaagtgtcatcggtactgcaaccactcacttatctcccgagctggccgcccagtcagtcacacacattgtgccattatttttggatggaaacgtcagcttcctgccagaaaatagcttcccctccagattccagcctttccaggatggcagtagtgggcagcggagacttatcgctctgctgatggcatttgtttgtagcctgccacggaacgtcgagatcccgcagcttaaccagcttatgagggagttactcgagctctcttgctgtcactcttgccctttttcctccactgccgccgcgaaatgttttgccggtttgttgaataagcaccctgctggtcaacagctggatgaattcttgcaactggctgtggacaaggtggaggcaggcttgggcagtgggccctgtcgtagccaggccttcactctcctactgtgggtaactaaggccctagtcctgcgatatcaccccctaagttcctgtctcacagctcgactgatgggcttgctctctgaccccgaactgggccctgcagccgcagacggattctcccttttgatgagcgattgcaccgacgtgttgacaagggccggccatgccgaggtacgcattatgtttagacagaggttctttaccgacaacgtccctgcgctcgtacagggatttcacgcagccccacaggacgtaaaaccaaattacctaaaaggactgagtcatgttctgaaccggctgcccaagccggtgctcctgcctgagctccctacattgctatctcttctgctggaggcgctgagctgccccgattgcgttgtccagttatctacactgtcatgcctgcagcccctccttctagaggcaccccaggtgatgtctcttcacgtcgacactctcgtgaccaaattcctaaatctgtcatctagtccttccatggctgtacgcatcgccgctcttcagtgtatgcacgccttgaccagactgcccaccccagtgctgcttccctataaaccccaggtcatccgcgcactagctaagcctctggatgataagaagcgactcgtgaggaaggaggccgtcagcgctaggggagagtggttcctgttgggctcaccaggttcctag

SEQ ID NO: 25038 - DNA, 1092 bp, Artificial Sequence
  Description of Artificial Sequence: Synthetic coding sequence
atgctgctgggcttcctgaagctgcagcagaagtggagctacgaggacaaggatcagcgccctctcaatgggtttaaggaccagttgtgttctctcgtgtttatggcactgactgacccaagcacccagttgcagctcgtaggcattcggacccttacagtcctcggcgcgcagcctgacctgctatcatacgaggacctggaactggctgtgggccatctgtatcggctctcatttttgaaggaagatagccagagctgtagggtggccgccttagaggcttctggcactctggctgccctttatcctgtggcattctcgagccatctggtgcccaagctcgcggaggagctgcgtgtgggtgaatctaacctgactaatggcgatgaaccaacgcagtgtagtaggcatctgtgttgtctgcaggcactatcagcagttagcactcacccaagcattgtgaaagaaacactgcctctactgctgcaacacttatggcaggttaatcggggaaatatggtcgcacaaagtagcgatgtgatcgcggtgtgtcagtccctgagacagatggcggagaaatgtcagcaggaccctgagtcctgctggtatttccaccagaccgctatcccttgcctgctcgctctcgccgttcaagcttcaatgccagagaaagagccctctgtgctaaggaaggtcttgttagaggacgaggtactggcagcaatggtttcagtaattggcacagccactacacacctctcaccagagctggccgctcagtctgtgacacacattgtccctttgtttctggacgggaacgtgagctttttgccagaaaacagttttccttcaaggtttcagccttttcaagatggatcctccggacagagacgtttgattgcactcttaatggcctttgtctgctccctacccagaaatgtggaaattccccagttaaatcagctgatgagggagctcctggaactgtcttgcaccgccgcgccttttttaccacctctcctcccctccgccttgcaggactcttctacttccacactgcagggaagctcctggatgaatagctattcctag

SEQ ID NO: 25039 - DNA, 1128 bp, Artificial Sequence
  Description of Artificial Sequence: Synthetic coding sequence
atgaagctggtgtggcccagcgccaagctgctgcaggccgccgccggggcgagcgctagggcgtgtgattcagtgaccagcaatgtgctacccttgctgctggaacagttccataagcattcccagtccagccaacgcagaaccatcctagagatgctgttggggtttttgaaactacagcagaaatggagctacgaagataaagaccagcgcccgctcaatgggttcaaggaccagttatgcagtctcgtcttcatggcactgacagatccctcaacacagctgcagctggtggggatcaggacattgaccgtgctcggagctcagccagatctgttgtcctatgaggaccttgagctggcagtgggccacctctacagactgtcttttttaaaagaagactcccaatcgtgcagagttgccgctttggaggcttcggggactcttgcagctctttatcctgtggccttctcttctcatttggtgcctaaactggcagaagagttacgggtgggtgaatctaacttgactaacggcgacgagccaactcagtgctccagacacctgtgctgcctccaggctctatccgctgtttccacgcaccccagcattgttaaagaaactctcccgctactgctccagcatctgtggcaggtgaaccgcggcaatatggtggctcaatcctccgacgtcatcgccgtatgtcagagtctgaggcagatggccgagaagtgccagcaggaccccgagtcttgctggtattttcaccagactgccatcccatgcctccttgcactcgcagtacaggcttcgatgcccgaaaaggaaccatctgtgcttagaaaggtgctgcttgaagacgaggttttagctgccatggtatccgtgatagggaccgctaccacacacctctctcccgagctggccgcccagtctgtcacacacattgtgcccttattcttggatggtaatgtgtccttcctccctgagaattccttcccttctcgctttcaacctttccaggtgacagacggctctagtggtcagaggaggttgattgctcttctcatggctttcgtatgcagccttcccagaaacggctcgagttggatgaactcgtacagctag

SEQ ID NO: 25040 - DNA, 1128 bp, Artificial Sequence
  Description of Artificial Sequence: Synthetic coding sequence
atgaagctggtgtggcccagcgccaagctgctgcaggccgccgccggcgccagtgccagagcctgtgatagcgtgacgtctaacgtgctgcccttactcctggaacagttccacaagcactcccagtcctctcagagaagaaccatcttagaaatgctgctgggctttttgaagctgcagcagaagtggtcctacgaagataaagatcagcggcccctcaacggattcaaggaccaactgtgctccctggtgttcatggccttgacggacccttccacacagttgcagcttgtgggtattcgaacgttaaccgtactgggggctcagccagacttgctttcctatgaagatttggagctggcagttggacacctgtatcgactgagctttctgaaagaagactctcagagctgtagggttgcagccttagaagcaagcggaacactggcagccctgtatccagtggcattctcaagccatctggttccaaaactagccgaagagcttcgggtcggcgaaagtaacctgacaaatggggacgaaccgacacaatgttccaggcatctgtgctgcctacaagccctatccgcagtctctactcacccttcgatcgtcaaggaaaccctgccattactgctgcagcacttatggcaggttaacagggggaacatggtggcacagtcatccgacgtcatcgccgtttgtcagtcgttgcgccaaatggccgagaaatgtcagcaggatcctgaatcgtgctggtattttcatcaaactgccatcccctgcctccttgctttagccgtgcaggcatcaatgccagagaaagaacccagtgtccttcgcaaggtactgttagaggacgaagtgctcgctgcaatggtgagcgtcatcggcaccgccaccacacacctttcacccgaattggccgcgcagtccgtgacccacattgtcccattattcttggacggcaacgtcagttttttacctgaaaactccttccccagtcgattccaaccatttcaagtgacggatggtagcagtgggcaacggaggctcatagcattgctcatggctttcgtctgttcactgcccaggaacgggagctcctggatgaattcttactcctag

SEQ ID NO: 25041 - DNA, 2964 bp, Artificial Sequence
  Description of Artificial Sequence: Synthetic coding sequence
atggccgccgccgccgccgtggaggccgccgcccccatgggcgccttatggggactcgttcacgatttcgtcgttggacagcaggaaggcccagccgaccaggtagcggctgacgtgaaatctgggaactataccgtgcttcaggttgtggaggccctggggagttccctcgaaaatcctgagcctcgcacacgagctcgcgccatccaattgttaagccaagtccttctccactgccacacacttctccttgaaaaagaggttgtccacctgatcctgttttatgaaaatcgtctaaaagatcatcatctggtaatccccagcgttctacagggacttaaggcgctgagcctgtgcgttgccctgcctcccggcctagcagtgagcgtcctcaaggccatctttcaggaagtgcacgtgcaaagtctcccacaagtcgatcgccatactgtctacaatatcatcaccaatttcatgagaaccagggaggagggcccattcgtcgaggaactgttcgaagttactagctgttattttccaatcgacttcactccgccacctaatgaccctcacggcattcagagggaggatctgattctttcactgcgggccgtgttggctagtacaccaagattcgcagaattcctgctgccccttctgattgagaaggtggacagtgaagtactgagcgccaaacttgactccttgcagactctgaatgcctgctgtgccgtttacggtcaaaaggagctgaaggactttcttccctccctctgggcttccatacgtagagaggttttccagactgcttccgaacgggtcgaagccgaaggcctagccgctctccatagcctgaccgcatgtctgtcaagaagtgttcttagggctgacgcggaggacttgttggactcattccttagcaatatactccaggactgcaggcatcacttgtgtgaaccagatatgaagcttgtctggccttctgccaaactgttgcaggctgctgccggggcctccgccagggcctgcgacagcgtgacctcaaatgttcttccactcctgctcgagcagttccacaaacactcacagtcttcccagagacggacaattctggagatgcttctgggttttctcaaacttcagcagaagtggagctacgaggataaagatcagcggccgcttaatggatttaaagatcagttatgtagcctggtctttatggccttgactgaccccagcacccagttgcaactggtcgggattagaaccctgaccgtgttgggggcgcagcctgatctgctgtcgtatgaggacttggagctggccgttggtcatctctaccgcctctcctttctgaaggaagacagccagtcgtgcagggttgcagcgctcgaggcttccggtactctggctgcactttatccagtggcttttagctcgcatcttgtaccgaaactggcagaggaactgcgtgttggcgaatctaacttgacgaacggcgacgagcctacacaatgtagtaggcatttgtgctgcctgcaagcactcagtgccgtgtctacccacccctcaattgtgaaagagactctgccactccttctacagcacctatggcaggtaaacagaggaaatatggtagcacaatctagtgatgtgattgcagtgtgccagagtctacggcagatggctgaaaagtgccagcaagacccagagagctgttggtattttcatcaaaccgcgattccctgcctcctggcactagcggttcaggcgtccatgccagagaaggagccctcggtcctacggaaagtgctgctcgaggacgaagtgctggctgcaatggtgtccgtaatcggaacggccacgacccatctgtcccctgagctcgcggcccagagcgtcacccacatcgttccattgttcctcgacggaaatgtgagcttcctcccggagaactcctttccttcaaggttccagccttttcaggacggatccagcgggcagagacgattgattgctttactgatggcctttgtttgcagtctcccacggaatgtggaaatcccacagctgaaccagttgatgagagagctgttagaactatcttgttgtcacagctgtccctttagctctactgctgccgccaagtgctttgccgggctcctgaataagcatccagccgggcagcagttggacgagttcctgcaactggccgtcgataaagtcgaggcggggttggggagtgggccctgtcgtagtcaggcttttaccttactcctttgggtaacgaaggcactggttctgagatatcaccccttgagctcatgcctaaccgctagactgatggggcttcttagcgacccagagttggggcccgctgctgctgacggtttctcactgctgatgagcgactgtactgacgtcctcacgcgggctgggcatgccgaggtgcgaatcatgtttagacagcggttcttcacggacaatgtcccggctttggtgcaggggttccatgcagccccacaggatgtcaaaccaaactatctcaagggtctcagtcacgtgctcaacagactccccaaacccgtgcttctacccgagttgccaacgctgctgtctctgctcctggaagctctctcgtgcccagactgtgtggttcaactgtccaccctgtcctgcctgcagccgttgttgctggaggctccccaggtgatgtcactccatgttgacactttagttactaaatttctcaatctgtcatcctcccctagcatggcagtgagaattgccgcactgcagtgcatgcacgctcttacacgcctgccaacgccagtcctcttaccttacaaaccacaggtgatcagagctctcgccaagcctctcgacgataaaaagcgcttggtgcgcaaagaggctgtgagcgcccgtggggagtggtttctcctgggcagccccggaagctag

SEQ ID NO: 25042 - DNA, 3093 bp, Artificial Sequence
  Description of Artificial Sequence: Synthetic coding sequence
atggccgccgccgccgccgtggaggccgccgcccccatgggcgccctgtgggggctggtccatgattttgttgtcgggcaacaagaggggcccgcggatcaggtggccgcggatgtcaagagcggaaattatactgttctacaggttgtggaagctcttggctcttctctcgagaatccagagccaagaacgagagctcgcgccattcagcttttgagccaggtgctgctccactgccacactctgctgttagagaaagaggtggtgcatctgatcttgttctacgagaaccggctcaaggaccaccatctcgtgataccttcagttcttcaggggcttaaggcccttagtttatgcgtggctcttccacctggcttggccgttagcgtgctcaaggctatcttccaggaagtgcacgttcagtctctgcctcaagtggatcggcacactgtctataatattattacaaactttatgcgcactagagaggaagaactcaaatctctgggcgccgattttacctttgggtttattcaggtaatggacggtgagaaggaccccagaaatttgctggttgcctttcgaatcgtacacgatcttatctctagagactatagtcttggcccattcgtggaggaactgtttgaggtgacatcatgttacttccccattgactttactcctcctccaaacgatccccacggtattcaacgcgaagatttgatcctgtccttgcgggccgtactcgccagcacccctcggttcgctgagttcctactgccactgttgatcgagaaagtagatagtgaagtcctgtcagcgaagcttgactcgctgcaaaccctgaacgcgtgctgcgctgtctatggacagaaggaacttaaggatttcctccccagtctatgggctagcataaggcgggaggtgtttcagacggcatcggagcgcgtcgaggctgaaggcctggccgccctacattctctgaccgcctgtctttctcggagcgtgctgagggcggacgcagaagatttattggacagcttcctgtcgaatattctacaagactgtaggcaccatctgtgcgagcccgatatgaaacttgtctggcccagcgcaaaattgctgcaggctgcagccggcgcaagtgcccgtgcctgtgactccgttacctccaatgtgctgcccctgcttttagagcagttccacaagcatagtcaatccagtcaaagaagaacaattctcgaaatgctgctcggttttcttaaactgcagcagaagtggagctacgaggataaagaccagcggccgttaaatgggttcaaagatcagctctgtagccttgtctttatggctctcactgatcccagcacccaacttcagctggtggggattagaaccctcacagtgctgggcgctcagcccgatctcttatcatatgaggacctggagctggcagttggacacttgtaccgtctgtccttcttaaaggaggatagccagtcctgtcgcgtggccgcgctagaagccagcggaaccctcgctgccttatatcctgtggctttcagctcgcatttggtcccaaagctggccgaagagctgagagtcggtgaatccaatcttactaacggggacgaaccaacgcagtgctcacggcacctatgttgcctgcaggccctgagtgccgtgtctacacatccttcaattgtgaaagaaaccttgcctttgctcttacagcacctgtggcaggtcaaccgcggcaacatggtggctcagtccagtgacgttatcgcagtatgccagagcttaaggcagatggccgagaagtgccaacaggatcctgagtcctgctggtactttcatcaaactgcgatcccttgtcttctggcgcttgctgtccaggcatctatgcctgagaaagaacccagtgtacttaggaaggttctcctggaggatgaggtactggcagccatggtttcggtgatagggacagctacaacacatctgagtccagagctagctgcccagagcgtgacacatatcgtccctctctttctggacggaaacgtgagttttttacccgaaaatagcttccccagtagatttcagccgtttcaggacgggtcaagcgggcagcgtcggctaattgccttactcatggctttcgtgtgttctttgcctagaaatgtcgaaatcccacagttaaatcaactcatgcgggagctccttgagttgagctgctgccattcctgtcccttctcatccactgccgccgccaagtgtttcgccggtctcctgaataagcatccagctgggcagcagcttgacgagtttttgcagctggctgtggataaggtggaggcaggacttgggtcgggaccctgccggtctcaggctttcacgcttctcttgtgggtgacaaaagcgctggtcctacggtaccacccgctgagcagctgtctgaccgcccggctgatgggcttactgtccgacccggagctgggccctgctgcggcagacggcttctcgcttctgatgagtgattgtacagacgtgttaacacgggccggacacgccgaggttcggatcatgttcaggcagaggtttttcacagacaatgttcccgctctggtccagggctttcacgctgctccccaggacgttaagcccaattatttaaaaggccttagccacgtcctcaacaggctccctaagcccgtgttgttgcccgagcttccaactctgctgtccctgctactggaggccctgagctgccccgattgcgtcgtacagttgtccacgctatcgtgcctccaacctttactgctggaagctccacaagtgatgagcctgcacgtcgataccctagttactaaatttctcaatctcagttcttctcctagtatggcggtgcgtatcgctgctctccaatgcatgcatgctctcacgaggctgcccacccccgttcttttaccctataagccccaggtgataagggcactggcgaaaccactggatgataaaaaacgcctggtcagaaaagaagctgtgtccgccaggggcgaatggttccttctgggctcccctgggagctag

SEQ ID NO: 25043 - DNA, 3030 bp, Artificial Sequence
  Description of Artificial Sequence: Synthetic coding sequence
atggccgccgccgccgccgtggaggccgccgcccccatgggcgccctgtgggggttagtgcacgactttgttgtgggccagcaggagggccctgccgaccaggttgctgccagttccctcgagaatccggagcctcgaaccagggctagagccatccagctgctgtcccaggtgctgctgcactgtcacactctgctcctcgagaaagaggtggtgcaccttatccttttctatgaaaaccgcttgaaggatcaccacctcgtaatcccaagtgtgctgcaaggcctcaaagcattatcactctgtgttgcgctgccccctggtctcgccgtcagcgttctgaaggccatcttccaggaagtccacgttcaagtggatcgccacacggtgtataatatcatcactaactttatgcgcacaagagaagaagagttgaagagcctgggggcggactttacattcggcttcattcaagttatggatggggaaaaggatcctaggaaccttcttgtggcatttaggatcgtgcatgacctgatctcacgcgattactccctgggtcctttcgttgaggaactgttcgaagtaacctcatgttactttcccatcgattttacaccccctcccaatgaccctcacggtattcaacgagaagacctgatccttagccttcgtgcggtgctcgccagcacccctcgttttgcagaatttttgctgcccctgctaatcgaaaaagtggattctgaggtcctatctgcaaagctggactcactgcagaccttgaatgcctgctgcgcggtgtatggccagaaagagcttaaagattttttgccttctctctgggcatcaataaggagagaggtgtttcaaactgccagtgaaagggtcgaagcagaaggtctggcagctctgcacagtttaaccgcatgtctcagccggagcgtccttcgggcggatgctgaggacctgctggattcatttctttcaaacattcttcaggactgccggcatcacctgtgcgagcctgatatgaagttggtgtggccttccgcgaagctgctgcaggctgcagctggcgccagcgccagggcttgcgattctgttacctcaaacgttttgcctttacttctcgaacagtttcacaagcattctcagtcaagccagcggagaacgattctagagatgcttttggggttcctgaaactccagcagaaatggtcctacgaggataaggatcagcggcctctgaacgggtttaaggatcaattatgtagcttagtcttcatggccttgacagaccccagtacgcagctccagctagtaggaattaggacattaactgtgctcggcgctcagcccgatttgctcagctacgaggacttagagctggccgtcggacacctgtatcggctgtcttttctcaaagaagactctcagtcctgccgggttgccgccctggaggcatcaggcacccttgccgcactctatcccgtggctttctcctctcacctcgtcccgaagctggccgaggaacttcgcgtcggggagtccaacttgacaaacggggatgaacccactcagtgttctagacacctctgttgtctgcaggcgctgtctgctgtatctacacatcccagtatcgttaaggagactctcccactgttgttacaacatctttggcaggtaaataggggcaacatggtcgcacagagctccgacgtcatcgccgtttgtcagagcttgcgccagatggcagaaaaatgtcagcaggaccccgaatcttgctggtactttcaccagactgctataccctgcctgctagcgctagcagtccaggctagcatgcccgagaaagaaccatctgtgctgaggaaggttcttcttgaggatgaggttctggctgctatggtcagcgtgattggcactgcgaccacccacctctctcccgagcttgccgcccagtcagttacccacattgtgcccttgtttttagatggaaacgtgtctttccttcccgaaaatagctttcccagccgtttccaacctttccaggacgggtcctctggccagaggagactgatcgccctgctaatggcttttgtgtgctcgctgcctagaaacgtggagatcccacaactgaaccagttgatgagggaactcttggaactctcttgttgtcacagctgccctttcagcagtaccgctgccgctaaatgttttgccggtctgcttaacaagcaccccgctggacaacagctggacgaatttctgcaactggcggtggataaggtagaggccggtttaggctcaggcccctgcaggtcccaagctttcaccctgctgttgtgggtgaccaaggcactggtgctgagataccatccactcagctcatgcctcaccgctcggttgatggggctgttgtcagacccggaactgggacccgctgccgccgacgggttcagcctgctgatgtccgattgcactgacgtcctcacgagagccggtcacgccgaggtgcgtataatgttcagacagcggttctttacagacaatgtgccagccttggtgcagggcttccacgccgctccacaggacgttaagcctaattacctgaaggggcttagtcacgttctcaacaggctgcccaaacctgttcttctgccagagctgccaaccctgctttccctgttgctcgaggctctaagctgtcccgattgtgtagtccaattgtcgactctttcctgcctccagcctttgctcctcgaggccccacaggtcatgtcactgcacgtggacactctcgtgaccaaattccttaatctgagctcttcaccaagtatggcagtcagaatagccgctctgcagtgcatgcacgcccttactaggttgcctactccagttctgctgccttacaaaccccaggtcattcgggctttggccaagcctctggatgacaagaagcgcctggtaagaaaagaggcagtatccgcaaggggagagtggttcttgttagggagccctggcagctag

SEQ ID NO: 25044 - DNA, 3093 bp, Artificial Sequence
  Description of Artificial Sequence: Synthetic coding sequence
atggccgccgccgccgccgtggaggccgccgcccccatgggcgccctgtggggcttggttcacgattttgtggtcggccaacaggagggacctgcggatcaggtggctgccgacgtcaaaagcggtaactacactgtgctgcaggtggtggaagcgctcggctcttccctggagaaccctgaacctcgaaccagggccagggccatccagttgctgtcccaggtgttactgcactgtcacaccctgctattagagaaagaggttgtacacctcatactcttctacgagaaccggctgaaagatcatcaccttgtcattccctctgttttgcaagggctcaaagcactgtccctctgtgtcgctctgccccccggtctggctgtatcagtactcaaggcaatattccaggaagtacacgttcagagtcttcctcaggttgacagacacacggtgtacaacattattacaaactttatgagaacacgcgaagaggagctcaagtctctaggcgcagattttaccttcggcttcattcaagtcatggacggcgagaaggacccacgcaatctgctggtagctttccgaatagtgcacgatctaatcagcagagactactcactggggccgttcgtggaggaacttttcgaggtaacctcgtgctatttccccatcgatttcacccctccgccaaacgatccccatgggatacagcgggaagacctgatcctaagcttgagggctgtactggcctctacccctaggttcgcagagtttctgctgccattactgatcgaaaaggtggactctgaggtgctgtccgccaaactcgactctttgcagaccctaaacgcctgttgcgctgtgtatggccagaaagagttgaaggacttcctgcctagcctgtgggcatctattcgtagggaagtcttccaaacagcaagcgaacgcgtcgaggccgagggcctcgctgccttgcatagcctcactgcctgtttgtcaaggtcagttctgagggccgacgccgaggacttgctggactcttttctgagcaacattctgcaagactgccggcaccacctgtgcgagcctgatatgaagctggtgtggccaagcgccaagctgctgcaggccgccgccggtgcgtccgctagggcttgcgattctgttacctccaacgtgcttccactgctcttagagcaatttcataagcattctcaatctagccaacgacgcaccatactagagatgttactgggtttcctcaaactgcagcagaaatggtcttacgaagacaaggaccagagacccctgaacggattcaaggatcagttatgctcccttgtgtttatggccctcaccgacccatcaacccaactgcagctcgtgggaataagaaccctgaccgtgctcggcgctcagcctgatctgctcagctatgaggatttggaattggccgtgggccacttgtacagacttagtttcttaaaggaagattcacagtcgtgtagagtggcagcccttgaagccagcgggaccctggctgccctgtatcccgtcgcgttctcctctcacctggtccccaaattagcagaggagctacgggtgggtgagagcaatctgaccaatggcgacgagcccacacagtgttcgagacacctgtgctgcttacaggcgctgtcggccgtcagcacacacccttcaattgtcaaagaaacactgccgcttctcctgcagcatttgtggcaggttaaccggggaaatatggttgcgcagtcgtccgacgtcatcgctgtgtgtcagagcctgcggcagatggccgaaaaatgccagcaggaccctgagagttgctggtattttcatcagaccgctatcccatgccttctcgctctcgcagtccaggctagcatgcccgagaaggaaccatccgtgctgcgtaaggtcttgctcgaagacgaggtcttggcggccatggtttccgtgatcggcacagcaaccacccacctgagtcctgaattggcagcgcagagcgtgactcatatcgttcccctatttctcgatgggaacgtaagttttctgccagagaattctttcccaagtagatttcagccttttcaggacggttcaagtggacagcgccgcctcattgccttgctgatggccttcgtgtgcagtctgcctcgcaacgtcgagatccctcagctgaaccagctgatgagggagctcctcgaactcagctgctgtcattcatgtccattttcttccaccgctgccgcgaagtgtttcgctggacttctgaacaaacatcccgctggacagcagttggacgaattcctgcagctcgccgtggataaagtcgaagccggtctcgggagcggcccgtgtcgaagtcaagctttcactcttctgctgtgggtcacaaaagccctggtgctccggtaccatcctctttcctcctgtttgaccgctaggttaatgggcttacttagtgaccccgagctcggcccagccgccgcagacgggttctcactgcttatgtccgattgcacagacgtgctcactagggcaggacatgcagaagtgcgcattatgtttcgtcagcggtttttcaccgataatgtgcctgccctcgtgcagggcttccacgcagctccccaggacgttaaaccgaactacctaaaaggactgagccatgtcttgaacaggctccccaagcctgtcctgctccctgaactgccaacactgctgagtttactcctggaggcactcagctgtcccgattgcgtggtccagctgtcgacactgtcctgtctccaaccacttctgctggaggctccacaagttatgtcactgcacgtggacacactggttactaagtttctaaacctgtcgagcagcccgtcaatggccgttcgtatagccgccctgcagtgcatgcatgccctcacaagactccccacccccgtgctgcttccctacaagcctcaggtgattcgtgcgttggcaaagcctctagacgataagaagcgccttgttcggaaagaggccgtctcggctcgcggcgagtggttcctgctgggaagtccaggaagctag

SEQ ID NO: 25045 - DNA, 1734 bp, Artificial Sequence
  Description of Artificial Sequence: Synthetic coding sequence
atgcccaagaccatcagcgtgcgggtgaccaccatggacgccgagctggagtttgccattcaacctaatacaactggcaagcagctatttgaccaggtggtgaaaacaattgggttacgagaagtatggttcttcggccttcagtaccaggacaccaaggggttcagtacatggcttaagctaaacaagaaagttaccgctcaggacgtgaggaaggagtcaccactgttgttcaagttccgcgctaaattctatcccgaagatgtgagcgaagagttgatccaagacattactcagcgtctgttcttcctccaggtcaaggagggtattctcaacgatgatatatactgtccgccggagactgccgtgttgctagcttcctacgctgttcagagcaagtatggcgattttaataaagaagtccataaaagtgggtatcttgctggggataaactattacctcagagagttctggagcagcacaaactgaataaagatcaatgggaggaacggatccaagtgtggcatgaggagcacaggggaatgctgagagaagacgccgtgctggaataccttaaaatcgcccaggatttggaaatgtacggagtgaattacttctcaattaaaaacaaaaaaggctctgaattatggctgggcgtggatgccttgggactgaacatctacgagcaaaatgatagactcaccccaaaaatcggcttcccctggtctgagatccgcaatatctcattcaatgacaaaaaattcgtcataaagcccattgataaaaaagctccagatttcgttttctacgcaccccgtctgcggatcaacaagcggatcctcgccctgtgtatgggaaatcatgagctgtacatgcgcaggagaaagcccgacacgatagaagtgcagcaaatgaaggcccaagctagagaggaaaaacaccagaaacagatggaacgcgccatgctggagaatgagaagaagaaacgcgagatggcagaaaaagagaaagagaaaattgaacgagagaaagaggaactaatggaaagactgaaacaaatcgaggagcaaacaaaaaaagcacagcaggaattagaggaacagaccaggcgggccctggaattggagcaggagcgcaagcgggctcagtccgaggccgaaaagctggcaaaggaacgacaagaagccgaagaagccaaagaggccctgctccaggcaagccgggatcagaagaagacgcaggaacaattggcccttgaaatggcagaactgaccgcgaggatttcacagctggagatggcaagacagaaaaaggagagcgaagccgtcgaatggcagcaaaaggcccagatggtccaagaagatctggaaaagacacgggcagagctgaaaacggcgatgtccacaccccatgtcgctgaacctgccgagaatgaacaggacgaacaggacgagaatggggctgaggctagcgcagatctcagagccgacgccatggccaaggaccggagcgaagaagagcgaacgacggaggccgagaagaatgaacgtgtccaaaagcatttaaaggctctaacctccgagctggcaaacgcacgagatgagtctaagaaaactgccaacgacatgatacacgccgagaacatgcggcttggccgggataagtacaaaacactgcggcaaatcagacagggcaacaccaagcagaggattgacgagttcgagtctatgtag

SEQ ID NO: 25046 - DNA, 717 bp, Artificial Sequence
  Description of Artificial Sequence: Synthetic coding sequence
atgcggttcaagaaccggttccagcggttcatgaaccaccgggcccccgcaaatggtcgatacaaaccaacttgctacgagcacgctgctaactgctatactcatgcctttctcatagtgcccgccattgtgggtagtgcattgttgcaccgcctaagcgatgattgttgggaaaagatcactgcctggatctacgggatgggactctgcgccttgtttatcgtttccacagtgtttcatattgtaagttggaaaaaaagccacctgcgtaccgtggagcattgcttccatatgtgtgatcgcatggtgatctatttttttatagcagccagttatgccccatggctcaacctgagggaactcggacccctggcatctcacatgagatggttcatctggttgatggctgcgggcggtacaatatacgttttcttgtatcacgaaaagtacaaggttgttgagctgttcttttaccttactatgggattctctcccgctctcgtggttacatcaatgaacaatacagatgggctccaagagctggcatgtggggggctcatctattgtttgggcgtggtctttttcaagagcgacggcattattccttttgcgcacgccatttggcacctgttcgttgcaaccgcagcggccgtgcattattacgccatttggaagtacttgtaccgatcacctaccgatttcatgcggcatttgtag

SEQ ID NO: 25047 - DNA, 2127 bp, Artificial Sequence
  Description of Artificial Sequence: Synthetic coding sequence
atgagcaccgccgacgccctggacgacgagaacaccttcaagatcctggtggctactgatattcacctcggctttatggagaaggatgcagtgaggggcaacgacaccttcgtcacattggacgagattctccgactggcccaggaaaacgaggtggattttatacttctgggtggggatttgttccacgaaaataaaccctcccggaaaacactgcacacctgcctggaacttcttcgcaaatattgcatgggggacaggcccgtacagtttgaaatcctgtctgatcaatcagtaaattttgggttctccaagtttccgtgggtcaactaccaagatggcaatctgaacatcagtattcctgtgttttctatccatgggaaccacgatgaccccacaggcgccgatgcactttgtgctctcgatatcttgagctgtgcaggtttcgtgaaccatttcgggagatcaatgagcgtggagaaaatagacatcagtccagtcctgctacaaaaggggtctacaaaaatagccctctatggcctcgggtcaatcccagatgaacgactataccggatgttcgtgaacaagaaagtcaccatgttacggccaaaagaagacgaaaactcctggtttaatctgtttgtgatccatcaaaatcgctcaaagcacgggtccaccaatttcattccagaacagtttcttgatgactttatagacctcgtgatttggggtcatgaacacgagtgtaaaatagccccgaccaagaatgaacagcaacttttctatatctcccaaccaggaagcagcgtcgtgacatctttatcaccaggggaggcggtgaagaagcacgttgggctgttgagaattaaaggccgcaaaatgaacatgcacaagattcctctgcatacagtccggcaattttttatggaggatatcgtcctggctaatcaccccgatatatttaatcctgacaacccaaaggtaacacaagcaatccaaagtttctgtctggagaaaatcgaggagatgctggagaatgccgagagggagaggctgggaaacagccaccagcccgagaaaccgcttgtccggttgagggtggactactccgggggattcgaacccttcagcgtgctgcgattctcacaaaaattcgtggatcgtgtcgcgaatcccaaagatattattcacttcttcaggcacagggagcaaaaggagaagacaggcgaggagatcaacttcggtaaactaatcacaaaaccctccgaaggcaccactctgagagtggaagacttggtaaagcagtattttcagacggccgagaaaaatgtgcagctgtcacttctcactgagagagggatgggggaggcagtgcaggagtttgtagacaaagaagaaaaggatgccatcgaggaactggttaagtaccagctggaaaaaactcagaggttcctcaaagagcgccacattgacgcactggaggataaaattgatgaagaagttaggaggttccgggaaactaggcagaaaaataccaatgaagaagacgatgaggtaagagaagcaatgacacgagccagagccctccgatcccagtcagaggagtctgcctccgccttctctgccgacgacctgatgagcatcgacctggctgagcagatggcaaacgactccgatgatagtatttcagcagcgacaaacaagggtcggggcagaggaagaggccggcggggcggcagagggcagaacagcgcctcaagaggaggtagccagcgaggtcgcgctgatacgggactggaaacatcaacccgcagccggaactccaagaccgcggtcagtgcttcaaggaatatgtccatcatcgatgcatttaagtcgactcgccagcaacccagccggaacgtgactacaaaaaactattcggaagtcatcgaggtagatgaaagtgatgtggaagaagatatattcccgacgacatccaagaccgaccaaaggtggagttccacaagtagtagtaagatcatgagccagtcccaggtttcaaaaggtgtagacttcgaatcctccgaggacgatgatgacgacccatttatgaatacttccagcctccgtagaaataggagatag

SEQ ID NO: 25048 - DNA, 2043 bp, Artificial Sequence
  Description of Artificial Sequence: Synthetic coding sequence
atgagcaccgccgacgccctggacgacgagaacaccttcaagatcctggtggccaccgacatccatctgggtttcatggaaaaggacgccgtgcgggggaatgacacctttgtcaccctggacgagatcctcagactcgcccaggagaatgaagtggactttatattgttgggcggggacctgtttcatgagaataagccaagtcgcaagaccttacacacatgcctggagctgttgcggaaatattgcatgggcgacagaccggtgcagttcgagatcctgtccgatcagtctgtcaatttcggcttcagcaagtttccatgggtcaattatcaagacggcaacctgaatattagtatcccggtatttagtattcacggaaaccacgacgatccaacaggggccgacgctctttgtgcactggatattctttcttgcgcaggcttcgttaaccacttcggtagaagcatgtcagtagagaaaattgacatttccccggtgctgctgcagaaaggcagtactaaaattgcactctacggcctgggaagcatcccagatgagcggttatatcgcatgttcgtcaataagaaggttaccatgcttagacccaaggaagatgaaaactcttggtttaacctgttcgtgatccatcaaaataggagcaagcacgggagcaccaactttatccctgagcagttcctggatgactttatcgatctggttatttggggacacgaacatgaatgtaaaatcgctcctaccaaaaatgagcaacaactgttttacatttcacagccagggagtagcgtagttactagtctgagtccaggcgaagccgtgaagaaacacgtcggcttgttgcggatcaaagggcggaaaatgaatatgcataaaatccctcttcacacagtgcggcagttcttcatggaggacattgtgctggctaaccacccagacatctttaacccagacaatccaaaggtcactcaggcgatccagtcgttttgtttagagaagatcgaggaaatgctggaaaacgctgaaagggagcgactgggaaacagtcaccaacccgaaaaacccctggtgcgcttgagagtggactatagtggaggattcgaaccattctcagtactgcggttcagccaaaagtttgtcgatcgggtggcaaaccccaaggacatcatccattttttccgccaccgtgagcagaaagagaagacaggagaagagatcaattttgggaagctaatcacaaaaccatcggaaggcaccaccctgcgcgttgaggacctggtcaaacagtatttccaaaccgcagaaaaaaatgtgcagctgtccctcttaaccgagcgcggcatgggggaggccgtccaggaatttgtcgataaagaagaaaaggatgcaattgaggagctggtgaagtaccagttagagaagactcagcgcttcctgaaagaacgacacattgatgcactggaagataagatcgatgaggaggttcgaaggtttcgggagacgagacagaagaatacgaacgaggaagatgatgaagtccgcgaggccatgaccagagcacgtgccctcaggtctcagtccgaagagagcgcaagcgctttcagcgctgacgatcttatgagtatcgacctggccgagcagatggccaatgactccgatgactcgatcagtgccgctactaacaaggggcgaggcaggggaagagggagacgaggaggccgcgggcagaactctgcatccaggggaggttctcagagaggccgcgcattcaaaagcaccagacaacaaccttcccgaaacgtgaccactaaaaactactccgaggtgatcgaagtggacgagagcgacgtcgaggaagacattttccctacgacttccaaaacagaccagcgttggagctccacctctagttccaaaatcatgtctcagtctcaggtgtctaaaggcgtggactttgaatcatccgaagacgacgacgacgatccttttatgaatacgtcctctctgaggcgtaatcgacgctag

SEQ ID NO: 25049 - DNA, 2124 bp, Artificial Sequence
  Description of Artificial Sequence: Synthetic coding sequence
atgagcaccgccgacgccctggacgacgagaacaccttcaagatcctggtcgctaccgatatccacctcggtttcatggagaaggacgccgtccgggggaacgatacgtttgtcaccttagacgagatcctgagactggcgcaggagaatgaggttgattttattctactgggcggtgacctgttccatgagaacaagcccagcagaaagacacttcacacgtgcctggaactgttaagaaaatattgcatgggagaccgccctgtgcaattcgagatcttaagtgaccaatcggtgaattttggattctctaagtttccttgggtaaattaccaggacggcaatctgaacatttcaatacctgttttctcaatacatggaaatcacgatgacccaacaggagcagatgcactgtgcgcactcgatatcttgagctgcgctggcttcgtcaaccattttggcagatccatgtctgttgaaaagatcgatattagccccgtattgctgcaaaagggttcaacaaagatcgctctgtatggcctcggctccattccagacgagcgcctgtacaggatgttcgtgaataaaaaagtgaccatgctgcggccaaaggaagatgagaattcctggtttaatctcttcgtaatccaccagaacagatcaaaacacggcagtaccaactttattcccgaacaattcctggatgatttcatcgacctcgttatttggggacacgagcacgaatgtaaaatcgcccctactaaaaacgaacagcagctgttttacatttcccagccaggctcttccgtggtcacctctctatcacctggcgaggccgtcaagaaacacgtgggtctgttgaggattaaggggcgaaagatgaatatgcacaaaattcccctgcatactgtgcgccagtttttcatggaagatatcgtgctcgccaaccacccggatatttttaatcccgataaccctaaggtgacccaggccattcagagcttctgcttggagaagattgaggagatgctcgaaaatgcagaaagggagagactcggaaacagccaccagccagagaaaccgctcgtgaggcttcgcgtggactattcaggagggtttgagccattttctgtgttacgcttttcacagaagttcgtggaccgcgtggctaatcctaaggatatcattcatttctttcggcaccgagaacaaaaagagaagacaggtgaagagattaatttcgggaagctcattactaaaccaagcgagggcaccactctcagggtggaggacttggttaaacaatacttccagaccgccgagaagaatgttcagctgagcctgcttaccgaacggggcatgggcgaggccgtccaggaattcgtcgataaagaagagaaggacgctatcgaagagctcgttaagtatcagttggaaaaaacacaacggtttctgaaggagcgacacatagatgctcttgaagacaaaattgatgaagaagtgcgccggttccgggagaccaggcagaaaaacactaatgaagaagatgatgaggtcagagaagccatgactcgagccagggccttaagatctcagtccgaggaatccgccagtgcattctctgcggatgaccttatgtctatagatctcgctgagcaaatggctaacgattccgatgatagtatcagcgctgccactaacaaggggcgtggacgaggccgcggacgccgcgggggcaggggacaaaattcggcctccagggggggctcccagagagggcgcgacaccggactagagacatccactagatctcgcaattctaaaactgctgttagcgcctcccggaatatgtctatcatagatgcatttaagagtactcggcaacagccctccagaaatgtgactaccaagaactactccgaggttattgaagtggatgaatccgatgtggaagaggacattttccccaccacatcaaaaaccgatcagagatggtctagcactagttcctcaaagattatgagtcagtctcaggtgtcaaagggcgtagatttcgagagcagtgaagatgatgacgacgatcccttcatgaatacatccagcttgagaagaaatcggcgttag

SEQ ID NO: 25050 - DNA, 2136 bp, Artificial Sequence
  Description of Artificial Sequence: Synthetic coding sequence
atgaaccggaacatcagccaccagaagggcgacgacgagaacaccttcaaaatactagtggctaccgatatccacctcgggttcatggagaaggatgccgtcaggggcaacgatacattcgtgacactagatgaaattctgcgcctggctcaggagaatgaggtggactttatcctgctgggaggggatctctttcatgagaacaagcctagtagaaagaccttgcacacttgtctcgagctgctgcgcaaatactgcatgggagatcggccagtacagtttgagattctgtccgaccagagcgttaattttggattctctaaatttccttgggtcaactaccaggatgggaacctgaatatttctatacctgttttttcaatccacggaaaccacgatgaccccaccggcgcggatgctttgtgtgcactggacattctctcttgtgccggatttgtgaaccacttcggccgcagcatgtctgtggagaagatcgatatctcccctgtgcttttacagaagggcagcacaaagattgccctgtacggtctgggaagcatacctgacgaacgtctctatcgcatgttcgtgaataagaaagtcacaatgctgcgccctaaggaggacgaaaatagctggttcaatctttttgtgatccaccaaaatcgctcaaagcatggatcaaccaactttatccccgagcagttcctggatgatttcatcgatctggttatatggggccatgagcatgagtgcaaaattgctcccactaaaaacgagcagcagctgttttatatcagccagcctggctcatccgtggtgactagcttaagccccggcgaagccgtgaagaaacacgtcggtctgctcagaatcaaaggccggaaaatgaacatgcataaaatccccttgcatacggtcaggcagtttttcatggaggatattgtattggcaaaccacccagacatattcaacccagacaatccaaaagtcacccaggcaatccagtctttttgcctagagaagatcgaggagatgctcgagaacgccgaacgcgagagactgggaaactcacaccagcctgaaaagcctctcgtgagactgcgggtggattatagcggcggatttgagcctttttcagttttaaggttttcacagaagtttgtggatcgggtagctaatccaaaagatatcattcacttttttaggcatagggaacaaaaagaaaagactggagaggagatcaacttcggaaagctgattacaaaaccgagcgaaggcacgactctacgggtagaagatctggtgaaacagtatttccagactgccgaaaaaaatgtacagctctctctgctgacagagcgcggcatgggagaggctgtgcaagagttcgtcgacaaggaggaaaaagatgccatagaggaattggtgaagtaccagttggaaaagacccagaggttcctgaaagaacgccatatcgacgctctggaagacaagattgacgaggaagtccgaaggtttagagagaccagacagaaaaatacaaatgaggaggacgatgaagtgcgagaggccatgacacgcgcacgggctttacgcagtcagtccgaagagtcagcatcagcctttagcgccgacgacttaatgtcaatcgatctggcagagcagatggctaacgattccgatgactcgatttccgccgcgacgaacaagggtcgcggtagaggccgaggccggaggggcggcaggggccagaactcggccagccggggtggaagccagcgtggacgcgcagatactggcctggagacgagcactaggtctcgcaacagcaagactgcagtttctgcaagccgaaacatgtccatcatcgacgcctttaaatctacccgacagcagcctagccgtaacgtcacaaccaagaactactccgaggtaatagaagtcgatgaatctgacgtggaggaggacatcttccctacaacatccaaaacagaccaaagatggagctccacgtcttcctccaaaattatgtcccaatctcaggtgtctaaaggcgtcgacttcgagagttccgaagacgacgacgatgatccgtttatgaacacctcaagtctccggcgcaacaggcggtag

SEQ ID NO: 25051 - DNA, 384 bp, Artificial Sequence
  Description of Artificial Sequence: Synthetic coding sequence
atgagcaccgccgacgccctggacgacgagaacaccttcaagatccttgtcgcgactgacatccaccttggattcatggagaaggatgccgtgcgcggcaacgatactttcgttactctcgacgaaattctccgactggcacaggaaaatgaggtcgattttatacttttgggaggagacctcttccacgaaaataaacctagccgcaaaaccctccacacatgcttggaactgttacggaagtactgcatgggagaccgaccggtgcagttcgagatcttgagcgaccagtccgtcaactttggcttctcaaagtttccttgggtgaactaccaggatggcaatctgaacatcagcatcccagtcttctcgatccacggctag

SEQ ID NO: 25052 - DNA, 336 bp, Artificial Sequence
  Description of Artificial Sequence: Synthetic coding sequence
atgagcaccgccgacgccctggacgacgagaacaccttcaagatcctcgtagcaactgatattcatcttggctttatggaaaaggatgccgtgcgggggaatgacacattcgtcacccttgacgaaatcctccgcctggcccaagagaatgaggtagattttattctgctgggaggagatctgttccacgaaaacaaaccttcccggaaaaccctgcacacttgtttagaattattgcgaaagtattgtatgggtgatcggcccgttcagttcgagatactcagcgatcagtctgttaattttgggttctccaaattcccctgggtgaactattag

SEQ ID NO: 25053 - DNA, 666 bp, Artificial Sequence
  Description of Artificial Sequence: Synthetic coding sequence
atgagcaccgccgacgccctggacgacgagaacaccttcaagatcctggtcgcaacggatatccacctcggcttcatggagaaagacgcagtgcgcgggaacgataccttcgttacactggacgaaattttgcggttggcccaggaaaatgaggttgacttcatactgcttggcggggatctattccacgagaataagccgtcacgtaagaccctgcatacatgccttgaactgctaagaaagtactgtatgggagataggcccgtgcaatttgaaattctctcggatcagtccgtgaactttggcttttcaaaatttccatgggtaaattaccaggacggcaatctcaatatctccatcccagtgttcagtattcatggcaatcacgatgaccccaccggcgcagatgccctgtgtgcccttgacatcctttcctgcgccggttttgtgaatcattttggcaggtctatgagcgtggagaagatagacataagcccagtgcttcttcagaagggaagcacgaaaatcgctctttacggtctgggctccataccggatgagcgtctatatcggatgtttgtgaacaagaaagttactatgctgcgcccgaaagaagacgagaattcctggttcaaccttttcgttatccatcagaatagggtctag

SEQ ID NO: 25054 - DNA, 822 bp, Artificial Sequence
  Description of Artificial Sequence: Synthetic coding sequence
atgacccccggcacccagagccccttcttcctgctgctgctgctgacggttctaactgtcgtgaccggaagtgggcacgccagctctaccccagggggcgagaaggagacttcggctactcagagatctagtgtgccatcctccaccgaaaagaatgccctgtccaccggcgttagcttcttttttctcagtttccatatatctaacctgcagtttaattcgtccctggaagacccctctaccgactattaccaggaactgcagcgggatatctccgagatgttcctgcaaatttataagcagggggggttcctgggactgtctaacataaaatttcggcccgggagcgttgttgtgcagttgacactcgccttccgtgaggggacgatcaatgtgcacgacgtggaaacccagttcaatcagtacaaaactgaggccgcctcaagatacaatcttacgattagtgatgtgtcagtttcagatgtcccctttcctttctcggcgcagtctggtgctggagtccccgggtggggcattgccctcctggtgctggtgtgcgtcctggtggcactcgcaatagtttatcttatcgcgctagccgtttgccagtgccgaagaaaaaattacggtcagcttgacatttttcccgcaagagatacatatcatcctatgagcgaatatccgacctaccatacacacggaagatacgtgccccctagctccaccgacaggtcaccgtacgaaaaggtttcggcgggcaacgggggcagctcactcagttacaccaatccggccgtagctgcgaccagcgcaaatctatag

SEQ ID NO: 25055 - DNA, 675 bp, Artificial Sequence
  Description of Artificial Sequence: Synthetic coding sequence
atgacccccggcacccagagccccttcttcctgctgctgctgctgaccgtgctgaccgccaccaccgccccgaaacccgctacagtggtgaccggctccgggcatgccagctccacccctgggggcgagaaagaaacaagtgccacacagcgctcttccgttccaagttctaccgaaaagaacgccttccgccctggaagcgtggtagtgcaattgactctggcgtttagggaggggaccattaatgtgcacgatgttgagacccagttcaatcagtataagacggaagccgcttctaggtacaacttgacaatatccgacgtatccgtgtctgatgtgccctttcctttcagtgcccagagtggtgccggggtcccgggctggggaatcgccttgctggtgctagtctgcgtgttggtggcactggcaatagtctatctgattgccttggctgtctgtcaatgtcggcggaagaattatggccagctggatatattcccagccagagacacatatcatccgatgtccgagtaccctacataccacacacatggccgctacgtgccccctagctccacggatcgtagtccttatgaaaaggtgtcggctggaaacggcggcagctctctgagctacacaaaccctgccgtggccgccacaagtgcaaatctttag

SEQ ID NO: 25056 - DNA, 501 bp, Artificial Sequence
  Description of Artificial Sequence: Synthetic coding sequence
atgacccccggcacccagagccccttcttcctgctgctgctgctgaccgttctaacagcaaccacagcccccaaacctgccacggtcgtgaccggctccggtcacgctagtagcactcccggcggcgagaaggaaactagcgccactcagcggtcttcggtgccaagcagcactgagaagaacgcttccggggcgggagtgcccggttggggaatcgccctgttggtgctagtgtgtgtccttgtcgctttggccattgtgtacctgatcgcactcgcggtgtgccaatgtaggagaaaaaactacggccagctggatatcttccctgcgagagacacctatcatcctatgtcggagtacccaacctaccacactcacgggagatatgttcctccttcctcgaccgatcggtctccttacgaaaaggtctcagccggaaacggcgggtcctcccttagctataccaatcccgccgttgcagccacaagcgccaatttatag

SEQ ID NO: 25057 - DNA, 612 bp, Artificial Sequence
  Description of Artificial Sequence: Synthetic coding sequence
atgacccccggcacccagagccccttcttcctgctgctgctgctgacagtgctgactgtagtcaccggctcaggacacgcttcctctacacccggcggcgaaaaagagacctccgctacccagcggtcctccgtgccgagctccactgaaaagaacgccattccagcccccacaacaaccaagtcttgccgcgaaacttttcttaaatgcttctgcaggtttattaacaagggcgtattttgggctagtccaatcctgtcttcagtcagtgacgtaccttttcctttcagcgctcaatccggcgccggtgtaccagggtggggtatcgcactgctcgtgctggtttgcgtactggtcgccctcgcaatcgtgtacttgatagcactggctgtctgccaatgtaggagaaagaactatggccaacttgatatcttccccgcacgggacacctaccatcctatgtcggaatatcctacctaccacacacacggccggtatgtgccaccatcatctacagatcgctctccctatgagaaagtgagtgcaggaaacggtggctcttcattgagctacacaaacccggcggtcgcagctacatctgcaaacttatag

SEQ ID NO: 25058 - DNA, 507 bp, Artificial Sequence
  Description of Artificial Sequence: Synthetic coding sequence
atgacccccggcacccagagccccttcttcctgctgctgctgctgacagtgctcactgtcgtgactggcagcggacatgcgagttcaactcctggaggcgaaaaggagacaagcgctacacagagatcctctgtccctagcagtacagagaaaaatgcactgagtacaggagtgtcttttttttttttgtctttccacatcagtaaccttcagttcaatagcagcctcgaagatccatctacagactactatcaagaactgcagagggatatctccgaaatggccgtgtgtcaatgcaggaggaagaactatggccagctggacatattcccagctagggacacctatcaccccatgtccgaatatcctacttaccatacccacggaaggtatgtaccaccatcaagtacagaccgttctccttacgagaaggttagcgccgggaacggagggtcatcactctcatacaccaaccctgcagtagcagcaaccagcgccaatctctag

SEQ ID NO: 25059 - DNA, 768 bp, Artificial Sequence
  Description of Artificial Sequence: Synthetic coding sequence
atgacccccggcacccagagccccttcttcctgctgctgctgctgacagtactgaccgtagtgactgggtcggggcatgcatcaagtacccccgggggagaaaaggaaacgagtgccactcagcggtcatccgtgccaagctctaccgagaagaatgcctttaacagcagcctggaggacccatccactgattattatcaagaattacagagggacatctccgagatgtttctccaaatatacaagcagggcggtttcctcggactgtcaaatattaaattccgtcctgggtctgtcgtggtgcagttgactcttgccttccgagaagggacgattaatgtgcacgatgtggaaacccaattcaaccaatataaaactgaggccgcttctagatataatctcactatctccgatgtgtctgtgagtgatgtgcccttccctttctcagcacagtcgggcgctggagtcccaggatgggggattgccctgctcgtgctggtgtgcgtgttggtcgccctggctattgtgtacctcatcgccttagccgtatgccagtgtcgtcggaagaactacggacagctggatatttttccagctagagatacataccacccgatgagtgaatatcctacctaccatacccacggtcggtatgttccacccagctcaactgatcggtctccttacgaaaaggtgtcagcgggaaacgggggaagttctctgagctacaccaatcctgctgtagcggccacaagcgctaacttgtag

SEQ ID NO: 25060 - DNA, 795 bp, Artificial Sequence
  Description of Artificial Sequence: Synthetic coding sequence
atgacccccggcacccagagccccttcttcctgctgctgctgctgaccgtgctgactgcaaccactgcgcctaaacctgcgactgtggtgacaggaagtgggcacgcctccagtactccaggaggggaaaaggaaaccagcgccacccaaagatcctcagttccatcgagtactgagaaaaatgctttcaattccagcctagaagacccttccactgattattaccaggagctgcagagagacatcagcgaaatgttcctccagatttataagcagggcggctttctaggcctctcaaatataaagtttaggcctggtagcgttgtggtgcagttgacgcttgcctttagagagggtactatcaatgtgcatgacgtggagacacagtttaaccaatacaagactgaagccgcctctcgctataacctgactatcagtgatgtgtcggtttccgatgtgcctttccctttcagtgctcagagtggggcgggggtaccaggctggggcatcgccctgctcgttctcgtctgcgttctcgttgcacttgcaatagtgtatctgatagcactggccgtttgccagtgccgaaggaagaattatggacagctggatatattccctgctcgcgacacgtaccacccgatgtccgagtatcccacatatcacacccatggccgatacgtgcccccgagctcaactgatagatccccctacgagaaagtatctgccgggaacggcggctcgtcactgtcctacactaatcccgccgtggcggcgactagtgcgaacctgtag

SEQ ID NO: 25061 - DNA, 597 bp, Artificial Sequence
  Description of Artificial Sequence: Synthetic coding sequence
atgacccccggcacccagagccccttcttcctgctgctgctgctgactgtcctgactgtagtcactgggagtggccacgccagctccacacctggcggagagaaagaaacgtcagcaacacaaagaagctccgtgcccagctcaaccgagaagaacgcactgtcaactggagtgtcattttttttcctctcttttcacatcagcaatctgcagtttaattcttccttggaagatcccagtactgactactaccaggaattgcagagggatatctctgagatgttccttcagatctacaaacagggcggctttcttggactgtcaaatataaagttcaggcctggctccgttgtggtccagctcactcttgcatttagagaagggactatcaacgtgcatgacgtcgagacacagtttaaccagtacaaaactgaagcagccagtagatataacctaacaatcagcgacgtgagtggctgtttgagcgtccctccaaaggaactgcgagccgctgggcacctcagttcaccaggctatctcccatcctatgagagggtcccgcacctgccacacccctgggccctatgtgccccttag

SEQ ID NO: 25062 - DNA, 1428 bp, Artificial Sequence
  Description of Artificial Sequence: Synthetic coding sequence
atgacccccggcacccagagccccttcttcctgctgctgctgctgactgttttgacggtggttacgggttctgggcacgcctcttctacgcccggaggtgagaaggaaacgtccgccacccaaagatcctccgttccctcgtccactgagaagaatgcagtgagcatgacaagttccgtgctctcgtctcactctcccgggagtggcagtagtaccactcaaggacaggatgtcacgctcgcacccgccaccgagccagccagcggtagtgccgccacctggggccaggatgttacctctgtgcccgttacacggccagccctcgggagcacgacacctcccgcccatgacgtcacgtccgcccccgacaataagcctgcgccgggctcaacagcccctcccgcacacggagtgaccagtgctcccgataccaggcctgcgcctggttctacagccccgccagcccacggagtaacgagcgcgcctgataaccgtcccgccctcggatctaccgccccccccgttcataacgttacatcggcgagcggtagcgcctctggcagcgcctctacccttgtgcacaacgggacatccgcccgcgccaccaccacacctgcgagcaaatcgaccccgttctctattcctagccatcattccgacacaccgaccacactggctagccattccactaaaacagacgcctcttcgactcatcattccacagttcctccgctgacctctagtaaccacagtacctccccgcagctatccacaggggtttctttctttttcctcagttttcatatcagtaatctgcagtttaactcgtctctggaggatcctagtacagattattatcaagaactccagcgtgatatctctgagatgttcctacagatatataagcaaggcgggtttcttggcctgtccaacattaagtttcgtccgggctctgtcgttgttcagctgacccttgccttcagggaggggaccattaatgttcatgatgtcgaaacccagttcaatcagtataagaccgaagccgctagccggtataacctgacaatctctgatgtgtcagtgagcgatgtccctttccctttttcagcccagagtggtgcgggggtgccaggatggggtatcgccctcctggtcctagtttgtgtgctagtggccctggcgatcgtctacctgattgccctagctgtttgtcagtgccgccgtaagaattacgggcagctggatatctttccagcgcgtgatacctaccacccgatgagcgagtatccaacatatcatacccatggccgctatgttccccccagtagcacagataggtccccatatgaaaaagtgagtgcgggcaacggagggagtagcctgagctataccaatccagcagtggctgctacttctgcgaacctatag

SEQ ID NO: 25063 - DNA, 480 bp, Artificial Sequence
  Description of Artificial Sequence: Synthetic coding sequence
atgacccccggcacccagagccccttcttcctgctgctgctgctgacagtgctgacagctaccaccgccccaaagcctgctactgtcgtcacaggctccgggcacgcctcatctacccctggcggagaaaaggaaacaagcgctactcaacggagctctgtgccatcttcaacagaaaaaaatgcattcaactctagcttagaggatccttccacggattactaccaggagctccagcgcgacatcagcgagatggccgtttgtcagtgtaggcgtaagaattacgggcagctcgatatcttcccagccagggacacctaccacccgatgtcagaatatcccacttaccatacccacggccgctatgtaccccccagcagcaccgatcgctccccctatgagaaagtgagtgctggcaacggcggatcatcccttagctacacaaatcctgcggtcgccgccactagtgccaacctgtag

SEQ ID NO: 25064 - DNA, 693 bp, Artificial Sequence
  Description of Artificial Sequence: Synthetic coding sequence
atgacccccggcacccagagccccttcttcctgctgctgctgctgactgtgttaacggtcgtgaccggatcaggacacgcttcatctacccccggaggagaaaaagaaacctctgccacgcagcgcagtagcgtgccttcctcaaccgagaaaaatgcaattcccgctcctactactaccaaatcttgtcgtgagacattcctaaagtggccgggctccgtcgtagtgcaactgacactcgcattccgggaaggcaccattaatgtacacgatgtcgaaacccagttcaaccaatataaaaccgaggctgcctctcgttacaacctcacaatctcggacgtttctgtatcagatgtgccattcccgttctctgcccagtctggagctggtgtgcccgggtggggaatcgctctgttggtcctagtgtgcgtactggttgcgctcgccattgtctacctgatcgccctagccgtctgccagtgtagaaggaagaactatggccaactggatatttttcccgctcgagacacgtatcacccaatgagcgagtacccaacataccacacgcacggtaggtacgtgcctcccagtagcaccgatcgatcgccctacgagaaggtgagcgccgggaacggcggctcatccctatcttacacaaatcctgcagtggccgcaacgtcagctaacctatag

SEQ ID NO: 25065 - DNA, 1686 bp, Artificial Sequence
  Description of Artificial Sequence: Synthetic coding sequence
atgacccccggcacccagagccccttcttcctgctgctgctgctgacagtgctgaccgtggtgacgggcagtggtcacgcctctagcacccccggtggcgagaaagaaacctccgcaacacagcggtctagtgtgccttcctctaccgaaaagaacgccgtaagtatgacaagctccgtccttagctctcactcaccaggcagtggctcgtcaacgactcaaggccaggatgtgacactggccccggccacagaaccagcgtctggaagcgcggccacatgggggcaagatgtaacctccgtcccagttacccgaccagctttaggatcaaccactccccccgcacatgacgttacatcagctccagatacacggccggcacctggctctacagcgccgccggctcatggcgtgacctcggctcccgataccaggcccgcccccgggagcacagccccacccgcccacggagtaacatcagcccccgatacgaggccagcacccggctctacggcgccccccgctcatggagtcacgtcagcccccgacaccagaccagccccgggatccacagctccccctgcccacggggtgacttccgcgcccgacacaaggagagcacccgggagtacccctgcgccaggttccacagcgcctcccgcccacggagtgacctcggctcctgacacccggcccgcccctggctcaaccgcacctcctgctcacggcgtcaccagcgccccagacaatcgtcctgcgttgggcagtacagctcctcccgtgcataacgttacatcagcctcaggtagcgcttcaggatccgctagtaccctggtacacaacgggacatcagcccgcgcgactaccacacccgcatctaagtctaccccattttctattccctcccatcactcggacacaccaaccactctggccagccactcgacaaagaccgatgctagcagtacacaccactccaccgtcccaccactgacaagctcaaatcattccacctccccacagttgagcactggagtttcattcttttttctgagtttccacatcagcaatctgcagttcaacagtagtctggaagaccccagtaccgactactatcaagaacttcagcgggatatctctgagatgtttctgcagatttacaaacagggaggttttcttgggctgagcaacatcaaatttagacctggaagcgttgtggtgcaactgacattagcatttcgcgaggggactatcaatgtgcatgacgtcgagacgcagtttaaccagtataaaaccgaggctgccagcaggtacaatctgaccatctcagatgtttccgtatccgatgtgccttttccgttttccgcccagagtggcgccggcgttccagggtgggggatcgccctgctggtcctggtatgtgtcttggtcgccttagcaattgtatacttaatcgcgctggccgtctgtcagtgccgtcggaagaactatggacagctggacatctttccagcccgcgatacatatcatcccatgagtgaatacccgacctatcacacccacggaaggtacgtgccaccctcctccaccgatcgctctccctatgaaaaggtgagcgcaggtaacggggggtcttcactgtcatatactaatcccgccgtggccgcaacttctgccaacctgtag

SEQ ID NO: 25066 - DNA, 690 bp, Artificial Sequence
  Description of Artificial Sequence: Synthetic coding sequence
atgacccccggcacccagagccccttcttcctgctgctgctgctgaccgttctgacggtcgttaccggatctggccacgcctcttcaactcctggcggggagaaggagacttcagccacccagcggagctctgtaccaagttctacggagaaaaatgccatttataaacaaggagggttcttggggttatccaacattaagtttcgaccgggctctgtcgtggttcagttgactctggctttccgggagggaacaataaacgtgcatgacgtcgagacccagtttaatcaatataaaaccgaagccgcctctaggtacaatctgacaatctcggacgtgtcggttagcgacgtcccgtttccattctctgctcagtctggggctggagtgccagggtggggcatcgcactgctcgtccttgtgtgtgtgcttgtggccttggccatagtctatttaatcgccctagcagtgtgccaatgcaggcgaaagaactacgggcagctcgacatctttcccgcacgagatacataccacccaatgagcgaataccccacgtaccatacacacggaaggtatgtgcccccgtctagtactgatcggagtccttacgagaaggtgagtgcggggaacggtgggtcatcactctcctacacaaaccccgccgtggctgcgacatccgctaatctgtag

SEQ ID NO: 25067 - DNA, 780 bp, Artificial Sequence
  Description of Artificial Sequence: Synthetic coding sequence
atgacccccggcacccagagccccttcttcctgctgctgctgctgaccgtcctcactgctaccaccgctcccaaacccgctaccgtcgtcacgggaagtggccacgcttcctctacgcctgggggagagaaagaaacaagcgccacccagagatccagtgtaccaagctctactgagaagaacgcttttaacagctccctcgaggatccgtctacagactactaccaggagctgcagagagacatcagcgagatgtttttacaaatctacaaacagggggggttccttggacttagtaatattaagttcaggcccggctccgtagtcgtacagcttacccttgccttccgcgaaggcacaattaatgtacacgacgttgagacccagtttaatcaatataaaacagaagcagccagtaggtacaatctcacaatcagcgacgtcagtgtgtcggacgtcccattcccgttttcagcgcagagcggcgcaggtgtgcctgggtggggcatcgctctgcttgtccttgtctgtgtgcttgttgctcttgcaattgtgtaccttatcgccctagccgtctgtcagtgtagaaggaagaattacgggcagctggacatttttccagctcgcgatacgtatcaccccatgtcagagtaccccacttaccatactcacggtaggtatgtgcccccgtcctctactgacagatccccctacgaaaagcgccagaatggttggtctactatgcctcggggcgccctccccgaagagagccagggctag

SEQ ID NO: 25068 - DNA, 1833 bp, Artificial Sequence
  Description of Artificial Sequence: Synthetic coding sequence
atgggcctgaaggccgcccagaagaccctgttccccctgcggagcattgacgatgtggttaggttgttcgctgcagagcttgggagagaggagccagacctggtattactgtctcttgtgttaggatttgtggagcactttctggccgtgaatagggtgatccccactaatgttccagaactcacatttcagccctcgcccgcccctgatcctcccggcggacttacttatttcccggtcgcagacttgtctataatagcagcactctacgcaagattcaccgcccagatccggggagcagttgacttaagtctgtatcctagggagggtggcgtgtcaagccgggaactggtgaagaaagtcagtgacgtcatttggaattctctgagtcggagttactttaaggatagagcccacattcaaagcctgttctcattcatcacaggcacaaaattggatagcagcggggtggcattcgcggtggtaggcgcctgtcaagcgctcggtttacgggacgtgcacctcgctttaagcgaggaccatgcttgggtggtgttcggaccaaacggcgagcagactgcagaagtgacatggcacggtaaaggaaacgaggaccgccgaggtcagactgttaacgccggtgtggccgagcgctcatggttatatttgaagggctcctacatgcgctgcgaccggaaaatggaggtggccttcatggtttgtgccattaatccctctatcgacttgcatactgactcgctcgagctactgcagttacagcagaaactgttgtggttactttacgatctaggccacctggaacgatatccgatggccctgggaaacctggccgacctagaagagcttgagcccactccaggccgaccagaccccctaacgctttatcacaaagggatcgcctccgctaagacgtattatagagacgaacacatctatccatacatgtacctggccggttatcactgccggaaccgtaatgttagggaagcactacaggcctgggccgacaccgcaacagttatccaggactataattattgtcgagaggatgaagaaatctacaaagagtttttcgaggtggccaatgacgtaatccctaatctgctgaaagaagccgccagcttacttgaggcgggagaggagagacctggcgagcaatctcagggcacacagtcccaaggaagcgctttgcaggatccagagtgctttgcccatctgcttcgcttttacgatggcatttgtaagtgggaggaaggcagccctactcctgtacttcacgttggctgggccaccttcctggtgcaaagtctcggacggttcgaggggcaagtccgtcaaaaggttcgaattgtctctcgggaggccgaagcagcagaggctgaagaaccatggggggaagaggcccgcgagggtcgcagacgcggcccccggcgagagagcaagcctgaagaaccaccaccgcctaaaaaaccagcactcgacaagggcctggggacaggtcagggggcagtcagtggaccccctcgaaaaccgccaggaaccgtggccggaacagcgcgaggacctgaggggggctccacagcacaggttcctgccccaacagctagcccccctccggaggggcccgtattgacgttccagtcggaaaaaatgaagggaatgaaagaactcctcgtcgcgaccaaaattaactccagcgctataaagctccagttaacagctcagtctcaggtgcagatgaaaaaacagaaagtaagcactccgagcgactacacattgagcttcttaaaaaggcagcgaaaaggactttag

SEQ ID NO: 25069 - DNA, 1833 bp, Artificial Sequence
  Description of Artificial Sequence: Synthetic coding sequence
atgggcctgaaggccgcccagaagaccctgttccccctgcggagcatcgatgatgtagtgaggttgttcgccgcggaactcggtcgtgaggagccagatctcgttctcctgagtcttgtattaggcttcgttgaacactttctggccgtcaatcgagtaattcctacgaatgttcccgagctgacctttcagccgtccccagcacctgatccccccggcggcctcacctattttcctgtcgcggatctgtccatcattgctgctctatatgcgcggttcactgcccagatccgcggcgctgtggacctgtcactgtacccgagggaggggggcgttagttctcgggagctagtgaagaaggtgtcagacgtgatttggaatagcctgagccgatcatacttcaaagatcgagctcacatccagtcattgttcagcttcatcactggcactaaattagactcttcgggtgtggcattcgccgtcgtaggggcctgccaggccctgggtcttcgcgatgtccatctcgctctctcagaggatcacgcatgggtcgtcttcggaccaaacggggaacaaactgctgaagtcacatggcacggcaaaggtaacgaagaccgcaggggtcaaaccgttaacgccggagtggctgaaagatcttggctgtatctgaagggatcttatatgcggtgtgaccgtaaaatggaagtggcttttatggtgtgtgctatcaacccttccatcgacttacatacagatagtctggaattattgcagctgcaacaaaagttattgtggctcctgtacgacttaggtcatctcgagcgctatcccatggcattgggtaaccttgcggatcttgaagagctcgaacctacaccgggccgacccgatccgctgacattgtaccataaaggcatcgcttcggcaaagacctattacagagacgagcacatctacccctatatgtatctcgcgggctaccattgtagaaaccgaaatgtcagagaggctctccaggcgtgggctgatacagcaactgtgatccaggattataactactgccgagaggatgaagaaatctacaaggaatttttcgaggtggctaacgacgttattcccaacctgctcaaggaagcagcctcacttctcgaagccggggaggaacgcccaggagagcagtcccagggcacgcagtcccagggtagcgcactccaggacccagaatgcttcgcccatctgctacggttctacgatgggatatgtaaatgggaagagggcagtcccacgcctgtgctgcacgttgggtgggccacatttcttgtgcagagtcttggcagatttgagggacaagtgagacagaaggtgcgtattgtcagtagagaggccgaggccgccgaggctgaggaaccatggggcgaagaagcaagggaggggcgtcgcaggggccccagacgtgagtccaagcccgaggaaccgccaccgcctaaaaaaccagccctggacaagggccttggaaccggccagggggcggtttccggtccaccccgcaagcctccaggcactgtggcaggtaccgccaggggcccagagggaggaagtactgcgcaggtgccggctcctactgccagccctcctcctgaagggccggtgctgactttccagtcagaaaaaatgaagggaatgaaagagctgctagtcgccaccaagattaatagttccgcaatcaaactgcagcttaccgcgcaatctcaggtgcagatgaagaagcagaaggtctcaacccccagtgattacacactgagcttcctcaagcggcagcgcaaggggctttag

SEQ ID NO: 25070 - DNA, 1848 bp, Artificial Sequence
  Description of Artificial Sequence: Synthetic coding sequence
atgggcctgaaggccgcccagaagaccctgttccccctgcggagcattgacgacgtcgtccgcctgttcgccgccgaattgggaagggaggaaccagacctggtgctgctgtctttggtgctcggatttgttgagcactttctcgcagtaaacagagttatcccaaccaatgtccccgagctgacgttccaaccatcaccagccccagatcctcctggagggttaacttacttccctgtcgctgacctgtctataatagccgccctctacgctagattcacagcgcagatcaggggagcagttgatctgagtttgtaccctcgagaaggtggagtatcatctcgggaattagtgaagaaggttagcgatgtgatctggaacagcttgtcgcggtcctatttcaaggaccgagcgcatatccagtcacttttcagtttcatcacaggctggtctcccgtcggcaccaagttggatagctctggagtagccttcgcagtagtcggtgcatgtcaggctttaggtctcagagatgtacatctagcgctttcagaagatcatgcctgggtcgtgtttggccctaacggagaacagaccgctgaagtaacctggcatggcaagggtaatgaagaccgacgtggccaaaccgtgaacgccggggtcgcagaaagaagctggctctatctaaaggggagttatatgcggtgtgaccgcaagatggaggtggcttttatggtctgcgccatcaaccctagtattgatctgcatacagactcccttgaactgttgcaactccagcaaaaactcctttggcttctgtatgatctgggacacctcgaacggtatcccatggcccttggaaacctggccgacctggaggaactggaaccaacccctggccggccggaccctcttactctctatcataaagggatagcttccgcaaaaacgtattatcgcgacgaacatatctacccatacatgtacctcgctggttaccactgtcgcaataggaacgtgagagaggctcttcaggcctgggccgacacagctaccgttatccaggactataactattgtcgtgaggatgaggagatttacaaagagttctttgaagttgccaatgatgtcattccaaatctccttaaggaggccgcctccctactggaggccggtgaagaacgacccggagaacagtcgcagggcactcagtcacaaggctctgcacttcaagaccccgagtgctttgcccacctgctgagattctacgacgggatatgcaaatgggaggaggggtcgccaactcctgtactgcatgtgggttgggcaaccttcctagtgcagtcacttgggcgctttgagggacaagtccgccagaaggtccgtattgtctcacgggaagcagaagcagccgaggctgaggaaccatggggcgaggaggctagagagggaagaaggcgaggccctcggcgggaatcgaaacccgaagagcccccgccccccaagaagcctgctcttgataagggtctagggaccgggcagggcgccgtgtctgggccccctcgcaagcctccaggcaccgttgccggcaccgccagaggtcctgaaggaggatctactgcacaagttcctgccccgacagcctctcctcctcctgagggtcccgtgcttacattccagagcgagaagatgaagggcatgaaagaactactggtggccacaaaaatcaacagttccgccattaagctgcagctgacggcccagtcccaggtgcagatgaaaaaacaaaaagtgagtaccccctcggattatactctgtccttcctcaagcggcagagaaaagggctttag

SEQ ID NO: 25071 - DNA, 1848 bp, Artificial Sequence
  Description of Artificial Sequence: Synthetic coding sequence
atgggcctgaaggccgcccagaagaccctgttccccctgcggagcatcgacgatgtcgtgaggttattcgctgcagaactcggccgggaagaaccggatttagtgctgctctccctcgtgctcggcttcgttgaacatttcctagctgtaaaccgcgtcattccaacaaatgtgccagaactaaccttccagccctctcctgccccggatccgcctggaggtctgacctattttccggtggctgatttgtccataatagcggcactttatgctcggtttacggcccagatccgcggagccgtggacctgtctttatatccgcgggaaggaggggtatcatcaagggagcttgttaagaaggtgagcgacgttatatggaattccttgtccagaagttacttcaaagatcgggcccacatccagagtctgtttagctttattactggatggtcaccggttggaacaaaactggactcttcgggtgtggctttcgccgtagtgggggcatgtcaggctcttggcctccgggatgtgcacctcgcactctcagaggaccacgcgtgggtggtattcggacccaacggggagcagactgcagaggtgacctggcacgggaagggcaatgaagatcggcggggccaaaccgttaatgccggcgtagcggaacgtagctggctttatctcaaagggagttatatgagatgtgacaggaaaatggaggtggctttcatggtctgcgcaatcaaccccagtatcgacctgcacaccgatagcctcgaactgttgcagctacagcagaagctgctctggttgctgtacgacctagggcatctcgaacggtaccctatggcccttggaaatctggccgacctagaagaactagaacctacacctggccgtccggaccccctcaccctctatcataagggcatcgcctcagcgaagacatactatcgagatgagcacatttacccttatatgtatcttgcaggataccattgtagaaaccggaacgtccgcgaggctctgcaggcgtgggccgacactgctacagttattcaggactacaattattgcagagaggacgaggaaatttacaaggaattctttgaggtagccaacgatgtcatcccgaacctgctgaaggaggcagctagcctgctggaagccggggaggagcggcccggcgaacagtctcagggaacacagtcccaggggtccgccctacaagaccctgagtgctttgcccatctgctgcgattctacgatggcatctgtaagtgggaggaagggagcccaacccctgtcctgcacgtcggctgggccactttcttggttcagtctctagggcgtttcgagggacaggttcgacagaaggtcaggattgtctcccgggaagcggaggctgctgaagctgaggagccctggggcgaggaggctcgggagggacgccgaagaggcccgaggagagagagcaagccagaggaaccccctcctccaaagaagcctgcgctagacaaagggttgggcaccggccagggcgccgtctctggcccacccagaaaacctcctgggacagtcgcagggactgctcgagggccagaaggggggtccaccgcacaggtccctgcccctacagccagccctcctcccgagggccctgtgctgactttccagtcagagaaaatgaagggcatgaaagagcttctggtggccacaaagattaacagttcagctataaagctccagctcacagctcagtctcaggtgcaaatgaagaagcagaaggtaagtaccccgtctgattacacactttcctttttgaagcgtcagagaaaaggactgtag

SEQ ID NO: 25072 - DNA, 1668 bp, Artificial Sequence
  Description of Artificial Sequence: Synthetic coding sequence
atgggcctgaaggccgcccagaagaccctgttccccctgcggagcattgacgacgtggtgcggttatttgctgcagagttgggtcgggaagaacccgacctggtgctattgtctctcgtgctgggctttgtcgaacactttcttgccgtgaatagagtcatacccacaaatgtgcctgagcttacctttcaaccaagtccagctcccgacccccctggtgggctgacatatttcccagtcgctgacctgtctataatcgcagccctctatgcgcgcttcaccgctcagattaggggagccgtggatctaagcctctatcctagagagggcggcgtatcctcccgcgagctggttaagaaggtgtctgacgtgatctggaatagtctgagtaggtcttactttaaggaccgagctcatattcagagtctattttctttcatcaccggtacgaaactcgatagctcaggggtggcattcgccgtagtgggcgcctgccaggccctgggattgagagacgtccatctggctctctctgaggaccatgcttgggtagtgtttgggccaaatggtgagcagactgctgaggtgacatggcacggtaagggaaacgaagatcggcgcggacagactgtgaacgccggggtggcggagcgctcctggctgtacttgaagggctcttacatgaggtgcgaccgcaaaatggaagtggcttttatggtgtgtgctatcaacccatctattgacctgcacacggactctctcgagctccttcaacttcaacaaaagctcctctggctgttgtacgatctgggccatctggaaaggtacccgatggctttgggcaacctggccgacctggaggagctcgagccaacacctggccggccggatccccttactttgtaccacaaagggatcgcctccgctaaaacttattacagggacgagcacatctatccgtacatgtacctggctggctaccactgcaggaacaggaacgtgcgggaggctctgcaggcttgggccgatacagccacagttattcaggattataactattgccgtgaggatgaggagatctataaagagttcttcgaggtggcaaatgacgtcatccctaacctgctcaaagaggccgcatcgctgttggaggctggcgaagagcgacctggcgagcagagccaggttcgtcagaaagtgagaatcgtaagtagagaggccgaagcggcggaggcagaggagccgtggggcgaagaggccagagagggcaggcggcgaggaccaagacgtgaatccaagcctgaggagccgccacctcctaagaagcctgccctcgataaagggctaggtacaggccaaggggccgtgtcggggcccccacgcaagccccccgggaccgtcgccggaacggcccggggtcctgaaggcggctcaacagcacaagttcccgcccccaccgcctccccgcctcccgaagggcctgtcttgacttttcagagcgaaaagatgaagggcatgaaagaactgcttgtggcaactaaaattaactcttctgctattaagctccagctgacggcacagtctcaggtacagatgaagaagcagaaggtgtccactccgagcgactacactctttctttcctgaaacgacagcgaaagggtctgtag

SEQ ID NO: 25073 - DNA, 1728 bp, Artificial Sequence
  Description of Artificial Sequence: Synthetic coding sequence
atgggcctgaaggccgcccagaagaccctgttccccctgcggagcatcgacgacgtagttagactgttcgctgccgaattaggacgcgaagaacccgacctggtgttgttgtccctggtgcttggatttgtggagcattttctcgcagtgaacagagtcatccccacaaacgtgccagaactcacttttcagccatctcccgccccagacccacccgggggcctcacatacttccctgtggctgacctaagtattattgcagctctctacgctcgcttcacggcccagattagaggggccgtcgacttaagtctttatccaagagaggggggcgtaagctcgagagaactggtgaaaaaagtttccgatgtgatatggaacagcctgtctcggtcttattttaaagacagagcacatatacagtcactcttttccttcattacaggcaccaagcttgattcttccggcgtggcgtttgcagtggtcggggcttgtcaggccttggggttacgagatgtccatctcgccttgagcgaagatcatgcatggagctggctctacctgaaaggttcctatatgaggtgtgatagaaagatggaggtggcctttatggtctgtgccatcaatccttcaattgatttgcatactgattctctggagctgcttcagctgcagcagaagcttctgtggctgttatatgacttgggccacctcgaacggtaccccatggccctggggaatttggccgatttggaggagttggaacccaccccaggacgcccagaccctctgaccctgtaccataaagggatcgcctccgctaagacttactacagggacgagcacatttatccctatatgtacctggccgggtatcactgtagaaaccgaaacgtgcgcgaagctttgcaagcatgggcagacacagctacggtgattcaggattacaattactgccgggaggatgaagagatctacaaagagttcttcgaggtcgctaatgacgtcattcctaacctgctgaaagaggcagccagcttgctggaggcaggagaggaacgacccggagaacagagccagggtacccagagccagggtagcgccctccaggatccagaatgtttcgcccaccttctcaggttctatgacggaatttgtaaatgggaggagggtagccctaccccggtgttgcacgtcgggtgggctacctttctggtgcagtctctggggcggtttgagggacaggtcaggcagaaggtgcggatcgtctcgcgcgaggccgaggccgcggaggccgaggagccttggggggaagaagcaagggaaggcaggaggcgcggtccgcggagagagagtaagccagaagagcctccaccaccaaaaaaaccagcgttggataaaggactgggtactggtcaaggagctgtgagcgggccaccccgaaagccccccggcaccgtggcagggacagcgagggggcccgagggcggctcaactgctcaggtacctgcccccacagcatcaccacccccagagggacctgtgctcacctttcaatctgaaaagatgaaaggaatgaaggagttgcttgtcgccacaaagattaatagtagtgcaatcaagctgcaattgactgcacagtcacaggtgcagatgaagaaacagaaagttagcacccctagtgattatactttgagcttccttaaacgtcagcgcaaagggctttag

SEQ ID NO: 25074 - DNA, 1833 bp, Artificial Sequence
  Description of Artificial Sequence: Synthetic coding sequence
atgggcctgaaggccgcccagaagaccctgttccccctgcggagcatagatgacgtcgtacggctcttcgctgcagaactcggcagagaagaaccagaccttgtacttttaagcttggtgctagggttcgttgagcattttctggcagttaatagagttattcccacaaacgttcctgaactgaccttccagccatctccagctcccgatccccctgggggactgacctacttcccggtagctgacctgtccatcatcgctgcattgtacgcacgctttaccgcccagatacgcggggccgtggatttgagcctctaccctagggaagggggtgtgtccagtagagaactggtgaaaaaagtgtccgacgtcatctggaactcactgtcgcgctcatatttcaaggatagggctcacatccagtctctgtttagctttattactggtaccaagttggattccagcggcgttgcgtttgccgtcgtgggcgcctgtcaggccctgggtcttcgcgatgtccacctggcactgtccgaggaccacgcatgggtagtattcggaccgaacggggagcagactgctgaggtaacatggcacggtaaaggaaacgaagatcggcggggtcaaaccgtgaatgccggggttgcagaaaggagttggctgtacttgaaaggatcttacatgcgttgtgatcgtaaaatggaggtggcttttatggtgtgcgccatcaatccttccattgacttgcacactgattccctggaactccttcaactgcagcagaaactgctctggcttctgtacgacttaggacacctcgagagatatccgatggccctgggcaatttagcagaccttgaagaactcgaaccaacacccggtagaccagaccccttgacgctgtaccataagggcatcgcaagcgccaaaacttactaccgagacgagcatatctacccgtacatgtatctggcaggatatcactgccgaaaccgaaacgtgcgggaggcccttcaggcctgggctgacacggcaacagttattcaggattataactactgtagagaggatgaggagatctacaaggagttctttgaggtggccaatgatgttattcccaatctgctgaaggaggcggcctcattactggaagcaggggaggagaggcccggcgagcagagccaaggaacccagtcccagggcagtgcgctccaagacccggaatgtttcgcccacctgctgaggttctatgatggcatctgtaaatgggaggaaggttctccaacgccggttttgcacgtgggttgggctacattccttgtacagtctttaggacgttttgagggacaggtgcggcagaaggtgaggatagtgagcagagaagcagaggccgctgaagcagaggaaccctggggcgaagaggcaagagaaggccggagaaggggacctagacgcgagtccaaacccgaggagcctcctcccccgaagaaaccagctttggacaaaggactgggaaccggccagggcgccgtttccggccctcctaggaaacccccaggcaccgtggcaggcactgccaggggccccgaaggcggcagtacagcccaagtgccagccccaaccgctagccctccccccgaaggccctgtgcttactttccagtctgaaaagatgaagggaatgaaagaattactggtggccactaagataaactccagcgcaataaaactgcagctcacagctcagtcacaggtccagatgaaaaaacagaaagtctctactcccagtgattacacgctgagtttcctcaagcgtcagcgcaaaggtttgtag

SEQ ID NO: 25075 - DNA, 1848 bp, Artificial Sequence
  Description of Artificial Sequence: Synthetic coding sequence
atgggcctgaaggccgcccagaagaccctgttccccctgcggagcattgacgacgttgttaggctgtttgctgctgagctgggtagggaggagcccgacctggtcttgctttccttagttttgggtttcgtcgaacatttccttgctgtgaacagagtgatccccacgaatgtgcctgagctcacatttcagcccagtcctgcaccagacccccctgggggcctcacctatttccctgtggctgatctctccatcatagctgcactatacgcacgatttaccgctcaaattagaggcgccgttgacctgtcactctatcccagggaaggtggggtgtcatcccgcgaactggtaaagaaagtgagcgacgtgatatggaatagtctctcaaggtcctacttcaaagaccgcgcacatatacagtcactgtttagtttcattaccgggtggtcacctgtgggtactaagttggactcatctggcgtggcctttgccgtcgtcggggcctgccaggccctgggtctgcgggatgtgcacctcgccctctctgaggatcatgcatgggtggtgttcggcccaaatggagaacagacagctgaagtgacctggcatggaaaagggaacgaagaccggaggggacagaccgtaaacgccggcgtagcagagaggagctggttatatctgaaaggctcttatatgcgctgtgataggaagatggaagtggctttcatggtgtgtgccatcaacccttccatcgacttacacaccgactctcttgagttgctccagttacaacagaagctcctgtggctcttgtatgatttgggccacctggagaggtatccaatggccctgggcaatctggccgatctcgaggaattggaacctacccctggacgtcccgaccctctcactctgtaccataaaggcatagctagcgccaaaacttattaccgagatgaacatatttacccttacatgtacttagcaggatatcattgccgcaacagaaatgtgcgcgaagcactacaggcatgggctgataccgcgacagtcatacaagattacaattactgcagagaggacgaggagatctataaggagttttttgaggtggccaatgatgtgatcccaaacctgctcaaagaagccgcttccctgctggaggcgggagaggagagaccgggcgagcaatcacaaggtacacagtcacaaggaagcgccctgcaggatcctgaatgcttcgcacatcttcttcgcttttacgacggcatttgcaagtgggaagaaggctcccccacccccgtattacatgtcggatgggccacctttctggtgcagagtctcgggcgcttcgaggggcaagttagacagaaagtgagaatcgtttctagagaggccgaggcagccgaagccgaggagccttggggtgaggaagcccgcgaaggaaggaggaggggcccacgcagggaatctaaaccagaagaacctccacctccaaaaaaacctgccctggataagggcctgggtacaggccagggagcagtgtcagggcctccacggaagccgcctggcaccgttgccgggacggctaggggcccagagggcgggtcaactgcacaggttccagctcccaccgcctctcctccaccagaaggcccggttttgacatttcaaagtgagaagatgaagggaatgaaagagctgctggttgctacaaagatcaattcaagcgccatcaagcttcagctcacggcccaatcgcaggtccagatgaaaaagcagaaggtctcaactccaagtgattacaccctcagcttcctgaaacgtcagcggaagggattatag

SEQ ID NO: 25076 - DNA, 1848 bp, Artificial Sequence
  Description of Artificial Sequence: Synthetic coding sequence
atgggcctgaaggccgcccagaagaccctgttccccctgcggagcatcgacgacgttgtccggctgttcgctgccgaactgggccgcgaggagcccgatctggtgttattaagcttagtcctgggcttcgtagagcactttttggccgtgaatagggtgattccaaccaacgtgccggagctcaccttccagccctccccagcccccgatcctcccggaggattgacctattttcctgtggccgatctgtcgatcatcgccgcactctacgcccgattcacagcccagattcggggcgccgtcgacctcagtctatatccaagagaagggggtgtcagctcgcgcgagctggtgaagaaggtttccgatgtcatttggaattcattgtcaaggtcctatttcaaggatcgcgcacacatacaatctctttttagctttattacaggatggtcccccgttggaaccaaattggacagctctggggttgcgtttgctgtcgtgggcgcctgccaggcgctgggcctgagggatgttcatttggctctaagtgaagatcacgcatgggtcgtgtttggacctaacggcgaacaaacggcggaagtgacctggcacgggaaagggaatgaagacaggagaggccagactgtgaacgctggtgtggcagagcgtagctggctgtatctcaaaggaagctacatgcggtgcgaccgcaaaatggaagttgcctttatggtgtgtgcgatcaatccttctatcgatctgcataccgactccctggaacttctacaattgcagcagaagctactgtggctgctgtacgacttgggtcacctggaacgctaccccatggctctcggcaatctggctgacctggaagagctagagccgacacctggtaggccagacccgctgactttgtatcataaagggatagccagcgcaaaaacttattacagagacgagcacatttatccctatatgtatttggcgggctaccactgtagaaatcgtaacgttcgggaggcattgcaggcctgggcggacaccgccaccgtgatacaggattataattactgtcgcgaggacgaggaaatttataaggagttctttgaagtggccaacgatgtaattccgaacctgctgaaagaagccgccagtttgctggaggctggagaagagaggcccggggagcaatcacagggtacacagtcccagggaagtgccctgcaggaccctgagtgttttgcccacttgctacgcttttatgacggtatttgcaaatgggaggaaggctcacctacccccgtgctgcacgtgggctgggcaacatttctagtccagtctctggggcgcttcgagggacaggtgcgtcagaaggttcggattgttagccgggaggctgaagcagcagaggctgaagaaccctggggcgaagaagctagagagggacgccggcgaggccccagaagagaatctaaacctgaagagccccctccgccgaagaagcctgcactcgataaggggctgggaactgggcaaggagctgtcagtgggcccccaagaaagcctcctggtacggtggccggaactgctagagggccggaaggaggaagcactgcgcaggttcccgcccctactgcctcaccccctcccgagggaccagttctcacctttcagtcagagaagatgaagggcatgaaggaactgttagtggccaccaaaatcaatagctccgcaataaaacttcagctgaccgcccagagccaggtccagatgaagaagcagaaagtctctactccctctgattataccctgtcatttctgaaacgccagagaaagggcttgtag

SEQ ID NO: 25077 - DNA, 786 bp, Artificial Sequence
  Description of Artificial Sequence: Synthetic coding sequence
atgggcctgaaggccgcccagaagaccctgttccccctgcggagcattgacgatgtagtcaggctctttgcagcagagctcggtcgggaagaacctgatctggttcttttgtcactagtgctcggcttcgttgaacacttcctggctgtcaatagggtgattcccaccaacgtgccagaactgacctttcaaccatcacctgcacccgaccctcccggaggacttacctactttcctgttgcagatctgtctataatcgcggccctgtatgcgcgctttaccgcccagattagaggcgccgttgatctgtcactatatccacgagagggcggggtgtccagtagagagctcgttaaaaaggtgtcggacgtcatctggaactccctgtcccggtcttacttcaaggaccgtgcacatatccaaagtcttttttccttcattaccggtaccaaattggactcaagcggggtcgccttcgccgttgtcggtgcctgccaggctctgggcctaagagacgtgcatctcgctttaagtgaagatcacgcctgggtggtgtttgggcccaacggcgaacagacagctgaggttacctggcatggcaagggcaatgaagaccggcgtggacaaaccgtaaatgccggcgttgcagaacggtcttggctttaccttaaaggctcttatatgcgctgtgacaggaagatggaggtggccttcatggtctgcgccataaacccgagcattgacttgcatacagattctctcgaattactccagctccagcaatag

SEQ ID NO: 25078 - DNA, 441 bp, Artificial Sequence
  Description of Artificial Sequence: Synthetic coding sequence
atgggcctgaaggccgcccagaagaccctgttccccctgcggagcatcgacgatgttgtcaggttattcgcagccgagctcggacgcgaggaacctgatcttgtgctgctgtctctggtgctgggatttgttgaacacttcctggcagtgaacagagtgattccgaccaacgtcccagaactgacctttcagccctcacctgcgccggatcctcccggtggactgacctatttccccgttgccgacttgtcaattatcgctgcactctacgcccgcttcactgcgcaaatccgaggtgcagtcgacctttctttatacccgcgcgagggaggtgtgagctccagagagctggtgaagaaagtaagcgacgtgatctggaactcactttcccgctcctatttcaaagatagagctcacatccagagtctgtttagtttctag

SEQ ID NO: 25079 - DNA, 441 bp, Artificial Sequence
  Description of Artificial Sequence: Synthetic coding sequence
atgggcctgaaggccgcccagaagaccctgttccccctgcggagcattgatgacgtggttaggctgttcgccgccgagttgggcagagaggagcctgatctagtgcttctgagtcttgtgcttggatttgtggagcactttctagccgttaatagagtaattccaactaacgttcccgaattgacttttcaaccaagcccagccccagatccaccaggcggcctgacatactttccagtggcagatctgtcaattattgccgctctgtatgccagatttactgctcagattcgcggagccgtggacctgagtctatacccgagagaaggcggcgtgagttctcgtgaactggtgaaaaaagttagtgatgtgatttggaacagtctgtctcgctcctattttaaagatagagctcacattcaatcactgttctctttctag

SEQ ID NO: 25080 - DNA, 1041 bp, Artificial Sequence
  Description of Artificial Sequence: Synthetic coding sequence
atgggcctgaaggccgcccagaagaccctgttccccctgcggagcattgacgatgttgtgcgtctgttcgctgccgagctgggccgcgaagagcccgatttggtgctcctctcacttgtgttgggctttgtcgagcatttcctggccgtcaatagagtcattcccacaaacgtgccagaactgactttccaaccatcgcctgcccctgatccacccggtggtctcacctattttcccgtcgccgacttgtccattatagcagcactatatgcacgctttaccgcccagatccgaggggcagtcgatctgtccttgtatccgcgagaagggggagtgtcttcccgcgagttggttaagaaggtgtcagacgtgatttggaacagtctgagcaggagctactttaaggatcgggcacacatccaatccctattctcattcatcacgggtacaaaactggatagctcaggcgtggctttcgccgttgtgggagcttgccaggcattaggtttgcgcgacgtgcatttggcgctatcagaagatcacgcctgggtcgtatttggaccaaacggagagcagaccgccgaggtgacgtggcatggcaaagggaatgaggacagacgcggccagactgtgaatgccggggtggcagagcgcagctggctgtatctcaagggttcgtatatgcggtgtgataggaaaatggaggtggcatttatggtatgcgctatcaacccatcaatcgacctccacacggattcccttgaactgctgcagcttcaacaaaagctgctgtggctcctgtacgatctcggtcaccttgagagatacccaatggccctgggaaacctggccgatctggaagagctggaaccaacccccgggcgacctgaccctcttacgctctatcacaagggaattgcctcagcgaagacctattatagagatgagcacatttatccctatatgtatttagctgggtatcattgtcgaaatcggaacgtgagggaggctttacaggcctgggccgacaccgcaacctag

SEQ ID NO: 25081 - DNA, 1848 bp, Artificial Sequence
  Description of Artificial Sequence: Synthetic coding sequence
atgggcctgaaggccgcccagaagaccctgttccccctgcggagcattgatgacgtggtgcgtttgttcgcagctgaattagggagagaagaacccgatctggtgctcctatccctggtgcttggcttcgtggagcacttccttgctgtcaatagagttatcccaacaaatgttcctgagctgacattccagccaagtccagccccagaccccccagggggtctaacgtactttccagtggccgacctatccattattgctgccctgtatgctaggtttacggcccagattagaggggccgtcgatctctccctgtacccgcgggagggaggcgttagcagcagagaactggttaaaaaggtgtctgacgtcatatggaattctttgtcccggtcttactttaaagatagggcccatatccaaagtctgttttcattcataacaggctggagtccagttgggacaaagctcgattcaagcggtgtggccttcgccgtggtgggtgcatgtcaagctttaggactccgtgacgtgcatctggctctgtccgaagaccacgcttgggttgtcttcggacccaatggggagcagacggccgaagtgacgtggcacgggaaagggaacgaggatcgacgtggtcaaactgtaaatgcaggtgtcgctgaacggtcttggctatacctgaaagggtcctacatgaggtgcgatcggaaaatggaggtggccttcatggtctgcgccattaacccctccatcgacctgcatactgactctcttgaactcctacaactgcaacaaaagctgctctggcttctgtacgacctgggtcacctggagcggtacccgatggccctcggaaacctggcggacctggaggagctggaaccaacaccggggcggcctgaccctctgactctttatcataaggggatagcatcagccaaaacctactatcgagacgagcacatctatccatatatgtacctggccggctaccactgcaggaaccgtaatgttagagaagcgcttcaggcctgggctgacaccgctaccgtgatacaggactacaattactgccgcgaagacgaggagatctataaagagttcttcgaagtcgcaaatgacgtcatcccaaacctgctaaaagaggctgcctctttactggaggccggagaagaacggcctggagagcagtcgcaaggaacccagtcacaggggagcgcactgcaggacccggagtgctttgcccatttgttgcgcttctacgatgggatttgcaaatgggaagagggtagccccactccggtgttgcacgtggggtgggccacatttctcgtccaatccctgggccggttcgagggccaagtgaggcagaaggtcagaatcgtaagtcgcgaggcggaggccgctgaggccgaagaaccgtggggcgaggaagccagagagggccgacggcgcgggccccgccgcgaaagcaagcccgaagagccaccaccgcccaaaaaacctgctctggataaaggcctcgggaccgggcagggtgccgtgtctggccctccacgtaagccccctggaacagtagctggcactgctcgggggcccgaggggggttctacagcacaggtcccggctccaactgcctcgcctcctccggagggtccagtgctgacgttccagtccgaaaagatgaaggggatgaaggagctgctggtagcaactaaaatcaacagttcggcaattaagctgcagctgacggctcagtctcaagtccagatgaaaaagcagaaggtgtcaacaccgtctgattatactctcagcttcctgaagcggcagcggaagggcttgtag

SEQ ID NO: 25082 - DNA, 846 bp, Artificial Sequence
  Description of Artificial Sequence: Synthetic coding sequence
atgggcctgaaggccgcccagaagaccctgttccccctgcggagcattgatgatgtggttcgcttgttcgctgctgaactcggacgcgaagagcctgaccttgtcctgctgagcctggtcctcggcttcgttgagcacttcttagccgtgaatcgagtgattcctacaaacgtcccagagctgacctttcagccatctcccgctccggaccccccaggcggattgacctacttcccggtggccgacctgtcaatcattgctgccctctatgcaaggtttaccgcgcagatccgcggagcagtggacctgtccctgtatccaagagagggcggcgtcagcagcagagagttagtcaagaaggtcagcgatgttatttggaactccttgtcaaggtcatacttcaaagatcgggcacacatacaatctctgttttcatttatcactggtaccaagctcgatagctctggggttgcctttgctgtggtaggtgcctgccaagctcttggcctgagagatgtgcatctggccctgtctgaggatcatgcctgggtcgtgttcggaccaaatggagagcagaccgccgaggtcacttggcatgggaaggggaacgaggaccgacgggggcagaccgtgaatgccggcgtcgcagaacggagttggctgtaccttaaggggagctacatgcggtgtgataggaagatggaggtagctttcatggtctgtgccatcaatccttcaatagatttacatactgactctctcgaactgctgcagttgcagcaaaagctgctgtggctcctctacgatctgggacatttggagaggtatcccatggccctaggatag

SEQ ID NO: 25083 - DNA, 1656 bp, Artificial Sequence
  Description of Artificial Sequence: Synthetic coding sequence
atggccgcccccgtgcggctgggccggaagcggcccctgcccgcctgcccaaatcctttgttcgtccgatggctgacggaatggagggatgaggcaacgcggtcccgacgaaggaccaggttcgtcttccagaaggccctgcggtccctcaggcgctacccccttcctcttaggagcgggaaagaagctaaaatcctgcagcacttcggggatggactttgtcgcatgttggatgagcgcttgcaaaggcaccgcaccagcgggggtgaccacgcacccgattcgccctctggagaaaactctcctgcgccccaaggacggctggccgaagtgcaggacagttccatgccggtgcctgcacagccaaaagccggcggaagcggctcttactggcccgctcgccattccggagccagagttatcctgttggttctatatcgcgagcatctaaatccaaacggtcaccactttctcacaaaggaggaactgttgcagcggtgcgcacagaaatctcctagggtcgcacccggcagcgcccgtccatggcctgcactacgttctctgctgcataggaacctcgtcctgagaactcatcaacccgccagatatagcctaacgcccgagggtttggagctggctcaaaagctggccgagtcagagggcttatccttattgaacgtgggtatcggacctaaggaaccccccggagaggaaacagctgtccccggggctgctagcgcggaactggcgagcgaggcaggcgtgcagcaacagcccctggagttacgacccggcgagtacagagtactgctgtgtgttgatataggagaaacaaggggcggcgggcaccgccctgaactcctgagagaactgcagcgtctccatgtcacacacactgtgcggaagctgcacgttggggattttgtctgggttgcacaggaaacaaatcccagagacccagctaatcccggagaattggtattagaccacatcgtcgagcggaagcgcctcgacgatctgtgcagctccatcatcgatggccggtttcgagaacagaagttccggcttaaacgatgcgggctagaacggagagtgtacttggtagaagaacacggttcagtccataacctgtctctgcccgaaagcaccctgctccaggccgtgacaaatacgcaggtaatcgacggcttttttgttaagaggaccgcagacatcaaggagtccgcggcctacctggcgctcctgactaggggcctgcagcgcctgtaccaaggacacactctgcgcagccgcccgtggggaacaccagggaatccagaatctggtgccatgacatcacctaatccactctgttccctgctaactttcagcgactttaatgctggcgccatcaagaacaaggcccagtcagtgcgggaggtgttcgcacggcaactcatgcaggtgaggggggtgagcggcgagaaagctgcagctttggtggaccgatattctacaccggcatccctccttgccgcttatgacgcctgtgccactcccaaggagcaggaaaccttgctctctaccattaagtgtggccggttgcagcggaacctgggtccggctctgtctagaacgctcagtcaactgtactgttcttatggaccactgacttag

SEQ ID NO: 25084 - DNA, 1656 bp, Artificial Sequence
  Description of Artificial Sequence: Synthetic coding sequence
atggccgcccccgtgcggctgggccggaagcggcccctgcccgcctgcccaaatccattatttgtgcgatggctcaccgagtggagggacgaggctactcggtctaggaggaggacccgcttcgtatttcagaaagccttgagatcgctgcgccgataccccctgcccttgcgatcaggaaaggaagcaaagatccttcaacatttcggcgatggtctttgtagaatgctggatgaaagacttcagcgacacaggacgtccggcggggatcatgctcccgattctccttcgggggaaaattctccggcgccgcagggaagactggccgaggtgcaggattcctcgatgcctgtccctgctcaacccaaagccggtggcagtggttcttactggcctgctcggcactctggggctcgcgtaattctgcttgtgttataccgcgaacatctgaacccaaacggacaccattttttgacaaaagaggaacttctccaacggtgcgctcagaaaagcccgcgcgttgccccaggctcagccaggccctggcccgcattgagatctctgctccatcggaaccttgtgctgaggacccaccaacctgcccgctatagcctgactccagagggcctggagctggctcagaagctggcggagtctgaaggactgtccctgttaaatgttgggattgggccaaaggagccacccggcgaagagaccgccgtgcctggagccgccagcgccgaactggcatctgaggccggcgtgcagcagcagccgcttgagttgcgacccggggaatatagggttttgctgtgtgtggacattggcgagaccaggggaggtggtcacaggcccgagttattgagggaattgcagcgactccatgtgacgcatactgttaggaagctgcatgtcggggacttcgtttgggtggcgcaggagacaaacccccgtgacccggccaatccaggagagctggtcctcgaccacattgtggagagaaagcgactcgacgacctgtgctctagtatcattgatggtcggtttagggaacagaagtttcgcttaaaacggtgcggcctcgagagacgcgtgtatcttgtggaggaacacggttctgtccacaatctgtcactgcctgagtccaccttactgcaggctgtaacaaatacccaggtcatcgacgggttctttgtgaagcgaactgcggacatcaaggaatccgccgcgtatcttgcccttttaactaggggactgcagagactttaccaaggtcacacccttcgctcacgaccttggggaaccccaggaaatccggagagtggcgctatgacttcacctaatcccctgtgttctctcctcaccttctctgatttcaacgctggggccattaagaacaaagctcagtcagtgagggaagtattcgccagacagcttatgcaggtgcgtggggtcagtggtgagaaagccgcggcactggtggacaggtactccacgcctgcctctctgttggcggcgtatgatgcgtgcgcaaccccaaaggagcaagagaccttgctgtccacgattaagtgcggacggcttcagcggaacctcggacccgccctctcaagaacattgtctcaactgtactgtagttacggccctctcacatag

SEQ ID NO: 25085 - DNA, 2490 bp, Artificial Sequence
  Description of Artificial Sequence: Synthetic coding sequence
atgaacagcggcgtggccatgaagtacggcaacgacagcagcgccgagctcagcgagttgcactccgccgcgctcgcatcgttgaagggtgacatcgtggagctgaataagcggctgcagcagactgaaagagagagggatctgttggaaaagaagctcgcgaaggctcagtgcgaacaatctcatctgatgcgggaacacgaagacgtccaagagaggactacgctgaggtacgaagaacgaatcacagaactgcatagtgttatcgcagagctgaataaaaagatcgataggctgcaaggaaccaccattcgcgaagaggacgagtattcagagctgcgctcggagctatcacagtcccagcacgaggtcaatgaagacagtagaagcatggatcaggatcagactagtgtttctattccagaaaaccagtccacaatggtaaccgccgatatggacaactgctctgatcttaactctgagctgcagcgcgtcctgacgggactagagaatgtcgtgtgtggccggaaaaaatcatcatgtagtctgtccgtcgccgaagtggataaacatattgagcagctgaccacagctagtgaacactgcgatctggcaattaagactgtggaagaaattgaaggggtgctgggccgggatctataccctaacttggcagaagagagatcccgctgggagaaagaacttgctggtctccgtgaggaaaatgagtccctaacagcaatgttgtgcagcaaggaagaggaactgaaccggactaaggctaccatgaacgcgatccgagaggagagggatcggctgcgccgtagagtgcgcgagttgcagacaaggctccaaagcgtgcaggcgaccggaccaagtagtcccggccgcttgacgagtacaaaccggcctatcaatccatccacaggcgaactctccacttcctcctctagtaacgacattccaatcgccaaaatagctgaacgcgtcaaactgtctaagactaggagtgaatcctcctcaagtgatcggccggtcctgggctctgagatatcgagcatcggcgtgagctcttctgtggccgagcacctggcccacagcctgcaggattgtagtaatattcaggagatttttcagacattgtattcccatggatccgcgatcagcgaatccaaaatacgcgaatttgaagttgaaactgaaagattgaattctaggatcgaacatttgaagagccagaacgatctgctgacaattactctcgaggagtgcaaatccaacgccgagagaatgtcaatgctggtgggaaaatatgaatctaacgcgacggccctgcgcctcgccctacagtactcagaacagtgtattgaagcctacgaactgttgctcgcactggccgaatccgaacagagcctaattttgggacagttccgagcagccggtgtaggatcgtcccccggcgaccagagcggggatgagaatattacccagatgttaaagagagctcacgactgtcgaaagaccgctgagaacgctgcgaaggcacttcttatgaaattagatggctcttgtggcggcgcctttgcggtggccgggtgcagcgtacagccctgggaaagtctatcttccaattcacacacaagcacaacgtcttccactgcctcttcctgcgacaccgaatttactaaggaggacgaacaacggctgaaagattatattcagcagctcaaaaatgatcgagcggccgtcaaactgacaatgcttgaactggagagtatccacattgatcccctgagttacgacgtgaagccaaggggggactcacagagactggatctagagaacgctgttctgatgcaggaactgatggccatgaaggaggagatggccgaactgaaggcgcagctgtacctgcttgaaaaggaaaaaaaggcactggaactcaaactctctacgcgcgaggcacaggagcaggcttatctggttcacattgagcatttgaagtcggaagtggaagaacagaaagagcagcggatgcgttctctgtctagtacgagctcaggctccaaagacaagcccggcaaagaatgcgccgatgccgcctctcccgccttgtctctggctgaattgaggactacatgttccgaaaatgagctcgccgctgagtttacaaatgcgatacgcagagaaaagaagctgaaagccagggtccaagagttggtaagtgcactggaaaggttgactaagtctagtgagatacggcatcagcagtctgctgagttcgtcaacgaccttaagcgagcgaattccaacctcgtcgccgcatatgagaaggctaaaaagaaacaccagaataagctgaagaaactcgaatcgcagatgatggccatggtcgagagacatgaaacccaggtccggatgcttaaacagcggatcgcactgctggaggaggaaaatagccgcccccatacaaacgaaacatccttgtag

SEQ ID NO: 25086 - DNA, 2133 bp, Artificial Sequence
  Description of Artificial Sequence: Synthetic coding sequence
atgaagctggtgttcctggtgctgctgttcctgggcgccctgggcttgtgcctggccggacgccggcgcagtgttcagtggtgcgccgtatcccagccggaggcgacaaagtgttttcaatggcagcgaaatatgcgaaaagtgaggggtccccccgtgagctgcatcaaacgcgactctcccatccagtgcatccaagccatcgctgagaatagagccgatgccgtgactctggacggcggatttatttatgaagcgggccttgcaccttataagctacgacctgtcgcggcggaggtctacggaaccgaaaggcagccaaggacacactattacgccgttgctgttgtcaagaaaggcggctcctttcagcttaacgagttgcagggcctgaagtcttgtcataccgggcttaggcggactgccgggtggaatgtcccaattggcactctgcgtccattcttgaactggactggtccccccgagcccattgaggctgcagtggctaggttcttctctgcctcctgtgtgcctggtgcggacaaagggcagttcccgaatctgtgcaggctctgcgccggtactggagagaacaagtgcgccttttccagccaggaaccttacttttcttactctggtgcctttaagtgcttgcgggacggtgcgggggacgtggctttcataagggagtccactgttttcgaagaccttagcgacgaggccgagagggacgagtacgaactcctttgccctgataatacccgaaaacctgtcgataagtttaaagactgccacctggcaagggtaccctcacacgctgttgttgcgaggtcagtgaatggaaaagaagatgccatttggaacctgttgaggcaggctcaggagaaatttggtaaggacaaaagtcctaagttccagctcttcgggtcaccttcagggcagaaggatctgctgtttaaagacagcgccatcggcttctctagagtgccccctagaatcgattccgggttatacctgggtagcggctacttcacagcgatacagaacttgcggaagtccgaggaagaagtggccgctagacgagctagagtggtatggtgtgcagtgggcgaacaggaactgcggaagtgcaatcaatggagcggtctctctgaggggtcagtcacatgttcaagtgcatccacaactgaagattgcatcgcccttgtcctgaaaggggaggcagacgcaatgtccttggatggcggttatgtttacacagccggaaaatgcggcctcgtacccgtcttggccgagaactataaatcccagcaatcaagcgatccagaccccaattgtgtggaccgtcccgtggaaggctatctggcggtcgcagtcgtgagacggtccgacacctctttaacatggaacagtgtaaaaggcaagaaaagttgtcacaccgccgtggatcgcaccgccggctggaacatccccatgggcctgctctttaaccagactggatcatgtaagttcgacgagtactttagccagagttgtgctccaggctctgacccaaggagcaacttatgtgccctgtgtatcggggacgaacagggggagaacaaatgcgttcctaactcaaacgaaaggtactacgggtacactggcgccttcaggtgcctcgctgaaaatgccggcgatgtagcttttgtcaaagacgtcaccgtcctccagaatactgacggtaacaataatgaggcctgggcaaaggacttgaagctcgccgactttgcactcctctgcctcgatgggaagcgaaagcccgtgacagaggctcgcagctgtcacctcgccatggcgcccaatcacgcggtagtctcaaggatggataaagtggagcggctgaagcaggtgcttcttcaccaacaagccaagttcggcagaaacggatctgactgtcctgacaagttctgcctttttcagtccgaaactaagaacctcctgtttaacgacaataccgaatgcctcgcgcggcttcacggcaaaaccacatatgagaagtacctgggtccccagtatgtggcggggattaccaacctgaagaagtgctcaacgagccccctgctggaggcatgcgaatttctgcgaaaatag

SEQ ID NO: 25087 - DNA, 1656 bp, Artificial Sequence
  Description of Artificial Sequence: Synthetic coding sequence
aagcccctgctgaaccacgtgctggccatcaagggcccccggagcaggtggcgaactttctataatatcgcaacccgccgaaaggctttgaaaaatcctagtgaagagtacgggaaaattctcgaggtcgttggacgctatagtgtccacaacgctggcatcagcttctctgttaagaaacagggagagacagtggcggatgtgaggactctgccgaatgcgagcaccgtcgacaacataaggtccatttttggcaatgccgtatcacgggagctcattgagatcgggtgcgaggacaagaccttggcgttcaaaatgaatggctatattagcaacgccaattactccgtcaaaaagtgtatttttttgctgttcattaatcaccgattagtcgaatccaccagtctccgaaaagccatcgagaccgtttatgctgcttacctacccaagaatacccacccgttcctctacttgagccttgagatctccccacaaaacgttgacgtgaacgttcacccaaccaagcacgaagtgcatttcctgcatgaagaatctatcctcgagcgggtacaacagcacatcgaaagtaagctgttgggcagtaactcaagtcgaatgtattttacacagaccctgctccctggccttgccggtcctagtggcgagatggttaagtccacaacatccctgacgagctcctcaacctccggcagtagcgacaaggtctatgctcaccaaatggtacgtacagatagccgagaacagaagttggatgcttttctccaacctctgtccaagcccctctccagccagccccaagcaatcgtgactgaagacaaaacagacatttcctccgggcgggcgagacaacaggacgaagagatgctggagttgccggccccagcagaggtggccgccaaaaaccaatccctggagggggacaccaccaagggcacttccgaaatgtcagaaaagcggggccctacttcttccaatcccaggaaacgacatcgggaagactcggatgtggagatggttgaagacgacagccggaaagaaatgaccgccgcctgtacaccgaggcgtcgtataattaacctgacttccgtgctctccctccaggaggaaataaatgagcagggccatgaagtactgcgcgagatgctccacaaccacagtttcgtcggctgcgtgaacccacagtgggctttagcacagcaccagactaaattgtatcttctgaataccacaaagctgagtgaggagctcttctaccagatactgatttacgatttcgctaattttggtgtactccgactgtctgagcccgccccactattcgatctagcgatgctggctctggactctccagaatctggatggactgaagaggacggcccaaaagagggactagccgagtacatcgtagagtttctgaagaaaaaggctgaaatgcttgccgactatttctctcttgagatcgacgagagcgaggtacctggaagtatcccgaacagttggaagtggaccgtggaacacatcgtctataaagctctccgatcccacatcctgcccccaaagcactttaccgaggacggaaatattttgcagcttgctaatctgccagatttgtacaaagtgttcgaacgttgttag

SEQ ID NO: 25088 - DNA, 351 bp, Artificial Sequence
  Description of Artificial Sequence: Synthetic coding sequence
atgagcgagaagcggggccccaccagcagcaacccccggaagcggcaccgagaggacagcgacgtggagatggttgaggacgattccaggaaggagatgactgcagcctgcaccccgagacgcagaatcataaatctgacaagcgtcctctccctccaggaagagatcaatgaacagggccacgaggttcttcgggagatgcttcacaaccattcattcgtaggctgcgtcaaccctcaatgggctcttgcccagcaccagactaagttgtatctgctgaacactaccaagcttcgggtcaaatgcctggcccctttccagacaccagggtcaggtttgtggaacacgtag

SEQ ID NO: 25089 - DNA, 525 bp, Artificial Sequence
  Description of Artificial Sequence: Synthetic coding sequence
atgagcgagaagcggggccccaccagcagcaacccccggaagcggcacagagaggactctgatgtggagatggttgaagatgatagcaggaaggagatgacagccgcctgcaccccaagacggcgcattatcaacctgacatctgtactctccctgcaggaggagataaatgagcaaggccacgaggtgctacgagaaatgttacacaaccactcattcgttggctgtgtaaatcctcagccttggcattcaatcaaaccgagctacaccttctccacccctccttctttttccgaagaattgttctaccagatcctgatatacgactttgccaactttggggtacttcgactcagttccgaagtaccagggtcaatccctaactcctggaagtggaccgtggagcatattgtatataaagctctgaggagtcacattctccctcccaaacatttcacagaagatggcaacatcctgcagctagcgaatctgccagacctgtacaaagtgttcgaaaggtgttag

SEQ ID NO: 25090 - DNA, 1977 bp, Artificial Sequence
  Description of Artificial Sequence: Synthetic coding sequence
atggccttcgaggccctggccagcatcagccacgtggcccacgtgaccatcactactaagacggccgatggaaagtgtgcctaccgggctagctactctgatgggaaactgaaggcacctccaaaaccctgcgcgggtaatcaaggaacccagattactgtagaagacctgttttataatatagcgacccgcaggaaggctctgaaaaaccctagtgaggaatacggcaagattctcgaagtggtaggcaggtactccgtgcacaacgcaggaatatcatttagcgtgaaaaaacaaggtgagacagtggcggatgtgaggaccttgcccaatgcttctactgtcgataatatccggtcaatctttggcaacgctgtgagccgggaactgatcgagatcgggtgcgaagacaagactcttgccttcaagatgaatggctatataagcaatgcgaactattccgtgaaaaagtgtatctttctcctgtttattaatcacaggttggtggagtctacatctctccgcaaggccattgagacagtttacgctgcctacctgcctaagaacacccatccatttctatatttgtcactggagatcagtccccagaatgtggatgtcaacgtgcatcccaccaaacacgaggttcatttccttcacgaggaaagcatacttgagagggtacagcagcatatcgaaagtaagctgttggggagtaactcgagccggatgtacttcacccagaccctcttacctggcttagctgggccaagtggagagatggtgaagagcacaacttctctcacctcttcttctacaagcgggtcaagtgataaggtttatgcacaccagatggtaagaacagactcgcgggagcagaaactggatgctttcttgcagcctctgtcaaaacccctaagctctcagcctcaggctatcgtcactgaagacaagacggacatctcctctggacgggcccgccaacaagatgaagaaatgctggagctccctgctcccgctgaggttgcagccaaaaaccaaagcctcgagggcgatacgactaagggcacttccgaaatgtccgagaagcgtggtccaaccagctctaatccccgcaagcgccacagagaagattctgatgtcgaaatggtcgaggatgactccaggaaagaaatgaccgccgcctgcactccaaggcgaaggattatcaatctgacttctgtactctcattacaggaggaaattaatgagcaggggcacgaagttctgcgcgagatgctccataaccacagctttgtgggatgcgtgaaccctcaatgggctctggcccagcatcaaaccaagctgtacctgctgaacacgacaaagctgagtgaagagcttttttaccagatccttatttacgacttcgccaattttggcgtgctgagactcagtgagccagccccgctgttcgacttagctatgctcgcactcgattcgccagagtctggctggacggaagaggatggacccaaggagggcctggccgaatacattgtagaatttttaaagaagaaggccgagatgcttgctgattactttagcctcgagatagacgaagaaggcaacttgattggactccccctcctgatagacaattacgttcctccactcgaggggttgcctattttcatcctcagacttgccaccgaggtgaattgggatgaggagaaagagtgtttcgagtcattgagcaaggagtgcgcgatgttctattcaatccggaagcaatacatctcagaggaatcaaccctcagcggacagcagagcgaggttccgggcagcatcccgaatagttggaagtggacagttgaacatatcgtatacaaagcactgcggtcccacatcctccctccaaagcacttcaccgaagatggcaacatattacagctcgccaatctgcctgacctttacaaggtcttcgaacgctgctag

SEQ ID NO: 25091 - DNA, 960 bp, Artificial Sequence
  Description of Artificial Sequence: Synthetic coding sequence
atgatcgagaactgcctggacgccaagagcaccagcatccaggtgatcgttaaggagggtggcctgaaattgatccagatccaggacaatgggacggggattcgtaaggaggaccttgacatcgtgtgtgagcgatttacaacctccaagctgcagagttttgaggatctggcatcaatttctacctatgggttccggggcgaggcactggccagtataagtcacgtggcacacgtgacgatcacaacaaaaacagcagatggtaagtgtgcctacagggcctcttatagcgatggcaaacttaaggctccccctaagccatgcgcaggaaaccagggcacgcagatcactgttgaagatctgttctacaacatcgctaccagacgaaaagcactgaaaaatccgtccgaggagtacggtaagatcctcgaggttgtcgggcgctatagcgtgcataacgcaggcatctcattcagtgtgaaaaaacagggggaaacggttgccgatgtccggacccttccaaatgcctcaaccgtggataacatacggtctatctttggtaacgccgtgtctcgcgaactgatcgaaattggttgtgaggacaagaccctcgcttttaaaatgaacggatacataagtaacgcaaattactctgtcaagaagtgtatctttctactgtttataaatcacaggctcgtggagagtacctctttgcgaaaagccatagagacagtgtatgccgcctatctccccaaaaacacccacccgttcctttacctttccctggaaatctccccccaaaacgtcgacgtgaatgtacatcccactaaacatgaggtgcactttctgcatgaggagtcaatactggaaagggtgcaacagcacattgagtccaagttgttaggtagcaattcatctcgcatgtattttacacaaaaggagacaagcggacggttttag

SEQ ID NO: 25092 - DNA, 1548 bp, Artificial Sequence
  Description of Artificial Sequence: Synthetic coding sequence
atgaacggctacatcagcaacgccaactacagcgtgaagaagtgcattttcttgttatttatcaatcaccgattagtggaatctacttccttgcgcaaagctatagagactgtgtacgccgcttatcttccaaagaacacccatcccttcctgtacctgtctctggagatctctcctcaaaacgtggacgtcaatgtacatcctacaaagcacgaggtccattttttacatgaggaatctattttagaaagggtgcaacagcacatcgaaagtaagcttttggggtccaactcatcccggatgtattttacgcagaccctgctccccggattagcaggaccaagcggcgagatggtgaagtctacaacctccctcacctcctcgtccacctctggttctagcgacaaggtatacgcgcaccagatggtgaggacagatagccgagaacagaagctggacgcctttcttcagccactcagtaaaccactgagctctcagccacaagcaatcgtgaccgaggacaagacagatatatcatccggaagagcaaggcagcaggacgaggaaatgcttgagctgcccgctcctgctgaggtcgctgctaagaaccaatcgttggagggcgataccaccaaagggacaagcgagatgtctgagaagaggggacccacaagttctaacccaagaaagcgacatcgggaagactcagacgtcgaaatggttgaagatgacagtaggaaggagatgaccgccgcgtgcaccccaaggcgacgcatcatcaatcttacttcagtcctctctctgcaggaagaaatcaacgagcaggggcacgaggtgctccgagagatgctgcacaatcactcttttgtgggttgtgttaacccccagtgggccctggctcagcatcagacgaaattgtacctgctcaatacgacaaagctatccgaggaactcttttaccagatcctcatttatgatttcgccaattttggggtgctgaggttaagcgaaccggctcccttgttcgatctggctatgcttgctctggactcgcctgagtcagggtggaccgaagaggatggcccgaaggaaggtctggccgaatatattgttgaatttctgaaaaagaaggccgaaatgctggcagactacttctctttagaaattgatgaagaaggaaacctcatcgggctcccactgctgattgacaattacgtaccccccttggaaggtctccctatattcatcctgcgcctggccaccgaagtcaactgggacgaggagaaagagtgctttgagagcctctcaaaggaatgtgccatgttctactccatacgtaagcagtacatctcggaagagagtacactctccggacaacagagtgaggtcccgggttccatacctaatagctggaaatggaccgtcgagcacatcgtctataaggccctgagaagtcacatcctgcctccaaaacatttcactgaggatggaaatatcctccagctggcaaatcttccagacctatataaggtattcgaacggtgctag

SEQ ID NO: 25093 - DNA, 2040 bp, Artificial Sequence
  Description of Artificial Sequence: Synthetic coding sequence
tgacggctggacgagaccgtggtgaaccggatcgccgccggcgaggtcatccagagacccgcaaacgccatcaaggagatgatcgaaaattgcttggatgcaaaatccacatccattcaggtgatcgtgaaggaaggcggtttaaagttaattcagattcaagacaacggcactggtatacggaaagaggatctcgacatcgtttgcgagcgctttaccacttctaaactccagtcttttgaggacctggccagcatatcgacctacggtttcagaggcgaggccctggcctctatttcccacgtggcccacgtgacaatcacaaccaagacagccgacggtaagtgcgcatatagagccagctactctgacggcaagctgaaagctcctccgaagccttgcgccggtaatcagggcactcagatcacagtcgaagatctgttctataacatcgcaaccaggagaaaggcgctgaaaaatcccagcgaggagtatgggaaaatcctggaagtggttggtcggtactccgttcacaacgcaggtatctcatttagtgtgaagaagcaaggcgagaccgtcgccgatgtgagaaccctgcctaatgcatccaccgtggataatattagaagcatcttcggcaatgccgtatctcgcgaattgatcgagatcgggtgtgaagataagacattagccttcaaaatgaacggatatattagcaacgccaattactccgttaagaaatgcatttttctgcttttcattaatcaccggcttgtggaaagtacatctctgagaaaggctatcgagacagtttacgctgcctacctgcccaagaatacccatcccttcctctacctgtcattggaaatttccccacagaatgtggatgtgaatgtccacccgaccaaacacgaggtccactttctccacgaagagtcgatcctcgaaagagttcagcagcacatcgaaagtaagctactgggcagcaacagttcccggatgtacttcacacaaactctgctgccagggctggctggaccatccggcgagatggtcaaatcaactacatccttgactagttcctctacatcagggtcatccgataaagtctacgcccaccagatggtgcggaccgatagccgcgaacagaagctggatgcctttttacaaccgctgagtaaacctctgtccagccaacctcaagcaattgtgactgaggataagactgacattagttctggaagagccagacagcaggacgaggaaatgttggaactgcccgcacccgctgaggtggccgctaaaaatcagtctctcgagggggataccacgaaaggcacttcagagatgagcgagaaacggggcccaacctcttctaaccctagaaaacgacacagggaagattcagatgtggagatggttgaggatgattctcggaaagagatgactgccgcatgtacacctaggcggcgaatcattaatcttacatccgttctgtcactgcaggaggaaatcaatgaacaggggcatgaggtgttgcgcgaaatgctccacaatcacagcttcgtgggctgtgtaaaccctcagtgggcgcttgctcaacaccagacgaagctctacttgttaaataccactaagctgtctgaggagctgttttaccagattctgatctatgattttgcaaattttggcgttttgagattgagtgaacccgccccgctctttgatcttgcaatgctggcactggattccccagaaagcgggtggaccgaggaagatgggcccaaagaagggctggcggaatatattgtggagttcctcaagaagaaggctgagatgttagctgactatttcagcctagagatcgatgagagcgaagtgcctggatctatccctaactcctggaagtggactgtcgaacacatcgtttataaggctctgagaagccacatactgcctcctaagcattttacagaagatggaaatattctgcagctggctaacctccctgatctgtataaggtttttgagcgctgctag

SEQ ID NO: 25094 - DNA, 1548 bp, Artificial Sequence
  Description of Artificial Sequence: Synthetic coding sequence
atgaacggctacatcagcaacgccaactacagcgtgaagaagtgcatttttctgctgtttatcaatcacaggctcgttgagagcacatccctcagaaaagccatcgagactgtgtacgcagcttacctccccaaaaatacccacccttttctgtacctgagcctcgaaatctccccccaaaacgttgatgttaatgtgcatcctacaaaacatgaagtgcacttcctacacgaggaaagcatcctagagagggtgcaacaacatatcgagagcaaactcctggggtctaatagcagtagaatgtattttacacagacactcttgccagggctggcagggcctagcggagagatggtcaaatctaccacatcactgacctcctcctccacttcagggagctctgacaaggtatacgcccaccagatggtgagaactgactctcgcgaacaaaaacttgacgcttttcttcagccactatctaagccgctttccagtcagccccaggcaatcgtgacagaagacaagaccgatatatccagcgggcgcgcacggcagcaagatgaagagatgcttgaactgcccgctcccgctgaggtagccgctaaaaaccaaagcctcgagggggacaccaccaaaggtaccagcgagatgagcgagaaacggggaccaacttccagcaacccccggaagcgtcacagggaagatagcgacgttgagatggtggaggatgactcccggaaggaaatgacagcggcctgcaccccgcggagaaggattatcaacctcacttcggtgctgtccctgcaggaggagattaatgagcagggccatgaagtcctgcgtgagatgctgcacaaccacagtttcgtgggctgcgttaacccacagtgggctctcgctcagcaccagactaagttgtacctgctgaatacgactaaacttagcgaagagctgttttaccaaattctaatttacgacttcgctaactttggcgttctgcgcctgtccgagccggcccccttattcgacctagcgatgctagctcttgactccccagagtcggggtggaccgaagaagacggccccaaggaaggcctggccgaatacattgtggaattcttgaaaaaaaaagctgagatgttggcagactatttcagcctagagatcgacgaggaggggaacttgattggtctcccactacttattgataactatgtaccccccctggaggggctcccgatatttatcctgcgtctggccacagaggtgaattgggatgaggagaaggagtgttttgagagtcttagtaaggagtgcgctatgttctatagtatcagaaaacagtatataagcgaggaaagtaccctctcagggcaacagtccgaagtgccaggtagcatccctaactcctggaaatggactgtggaacatattgtttataaggctcttaggtcccatattcttccacccaagcattttaccgaggatggtaacattctccagctggccaaccttccagacttatacaaagtattcgaacgatgctag

SEQ ID NO: 25095 - DNA, 1383 bp, Artificial Sequence
  Description of Artificial Sequence: Synthetic coding sequence
atgaacggctacatcagcaacgccaactacagcgtgaagaagtgcatattcctcctgtttatcaatcaccggctcgtggagtctacgtcgctgcggaaggctattgagaccgtttacgccgcttacctaccaaaaaatacccatccgttcctctacctttcactggaaatctccccccaaaacgtggatgtcaatgtgcatccaacaaaacatgaggtccactttctgcacgaggaaagtattctggagagagtgcaacaacatatagagtccaagttgctcggtagtaactcttcacggatgtactttacgcagacgttgctgccaggcctggccggacccagtggtgagatggtcaaatccactacctcactcacctccagcagcacaagcggtagctccgataaggtgtatgcccaccagatggttcgtactgatagcagggaacaaaagctggatgcatttctgcagccattgtccaagcctctctcgagccagccacaggctatcgtgactgaggacaagaccgatatctccagcggcagggccagacaacaggacgaggaaatgctcgaactgcctgcccccgccgaagtggcggccaaaaaccagtctttggaaggggacactactaagggtaccagcgaaatgagtgagaagcgaggcccaacatcctctaacccgagaaagagacatcgggaagactccgatgtggagatggtggaagacgattcccggaaagagatgaccgccgcctgcacgcctcgaaggagaattataaacttaacatcggtcctaagcctccaggaggagatcaatgagcagggccacgaagttttacgcgagatgctccacaaccattcttttgttggctgtgtcaaccctcagtgggccctcgcgcagcaccagaccaaactgtatctcctgaataccacaaaactcagcgaggagctgttttaccagatccttatatatgatttcgccaactttggcgttttgaggctatctgaacccgctccactttttgacctggccatgctagcccttgactctcctgagagcggctggaccgaggaagatgggcccaaagaaggcctggccgagtacatcgtggagtttttaaagaaaaaggctgaaatgcttgctgattatttctctctggaaatcgatgaggagggaaaccttataggactccccctgcttattgataactatgtccctccactggaaggcctgccaatattcatcctgcgcctggcaacagaggtcaactgggacgaagaaaaagagtgcttcgaaagccttagcaaggaatgcgctatgttctattctattaggaagcagtacatttcagaggagtcaactctgagcgggcagcagtag

SEQ ID NO: 25096 - DNA, 843 bp, Artificial Sequence
  Description of Artificial Sequence: Synthetic coding sequence
atgatcgagaactgcctggacgccaagagcaccagcatccaggtgatcgttaaggagggtgggttgaaactcattcagatccaggacaatggcaccggcattcgtaaggaggatttggatatcgtctgtgagcggtttactacctctaaattgcagtccttcgaggatctggcgagtatttctacttacgggttcaggggcgaggctctcgcctcgatcagtcacgttgcgcatgtgacgataactaccaaaacagccgatggtaagtgtgcttacagggcttcctactccgatggcaagctcaaagctcccccaaagccttgtgctgggaaccaggggactcagatcacagtcgaggatctcttttacaacatcgcaacccgccgtaaagctctgaaaaatcccagcgaggaatacggcaagatacttgaagtggttggaaggtatagtgtacataatgcaggtattagctttagcgttaagaaacagggagagaccgttgcagacgtcagaactctgcctaacgcctctactgttgacaacattcggagtatcttcgggaatgctgttagtagggagcttatcgagatcggttgcgaagacaagaccttggcttttaagatgaatggttatatcagcaacgccaattattcagtgaagaaatgtatattcttattgttcattaaccatcgcctggttgaaagtacctcacttcgcaaggccattgagacagtttatgccgcctacttaccaaaaaatacacacccctttctctaccttagactctgttatcaggacctgctggcccccttggggcgctggctcaaccctcaacaggtgtag

SEQ ID NO: 25097 - DNA, 1548 bp, Artificial Sequence
  Description of Artificial Sequence: Synthetic coding sequence
atgaacggctacatcagcaacgccaactacagcgtgaagaagtgcatcttcctcctgttcatcaaccatcgcttggtcgagtctaccagtctgcggaaggcgattgagacagtttatgccgcttacctgcccaaaaatactcatccatttttgtacctcagtctggagatatccccccagaacgtggacgtgaatgtgcacccaaccaagcacgaagttcacttccttcatgaggagagcatcctggagcgcgtccagcagcatattgaatctaaactcctcggatccaatagctcccgcatgtatttcacacagaccttattgcccggccttgcggggcccagtggggaaatggtgaagtctaccactagtctaacctcttccagcacgtctggatctagcgacaaggtctatgcgcaccagatggtgcgaacagactcacgggagcagaaactggacgcatttctccagcccttgagtaaaccgctaagcagtcagccacaggcaatagtgaccgaagataaaacagacataagttctgggagggccaggcagcaggacgaagagatgctagaattgcccgctccggcggaagtagcagccaagaatcagtcacttgagggcgacacaactaaaggaacttctgagatgtctgaaaagagagggccgacatcttctaatcctagaaagcgccatcgcgaggactcggacgtggaaatggtagaggatgattctcggaaggagatgacggcggcctgtactccacgcagacgcatcatcaatctgacttccgtgctgtctctccaagaggagattaacgagcaagggcatgaagtccttagggaaatgcttcacaaccattcttttgtgggatgtgttaatcctcagtgggcgctcgcccagcatcaaacaaagctgtatcttttaaacacgaccaaacttagtgaagagttgttttaccagatcttgatctacgactttgctaacttcggagtgctaaggttgtctgagccagcacccttattcgatttagctatgctggctcttgatagcccagaaagtggatggacagaagaagacggccctaaagaggggcttgccgagtacattgtcgagtttctgaaaaaaaaggcagagatgctggccgactactttagtctagaaattgacgaggaggggaatctgataggactgcccctgctgatcgacaactacgtcccaccactggaaggactacccattttcatcctcagactggccacggaggttaactgggacgaggagaaggaatgctttgagtccttatctaaggagtgcgctatgttctacagcatccgtaagcaatatatctcagaagagtcaactctgtctggtcaacaatccgaagttccaggtagcatcccaaactcatggaaatggaccgtcgaacatatcgtctacaaggctcttagaagtcatatactccctcccaagcatttcacagaggacgggaatatcctgcagctcgctaacctgcccgacctgtacaaggtcttcgagcgctgctag

SEQ ID NO: 25098 - DNA, 4290 bp, Artificial Sequence
  Description of Artificial Sequence: Synthetic coding sequence
atgatcaagtgcctgagcgtggaggtgcaggccaagctgcggagcggcttggctatatcctctcttggacaatgtgtcgaggaactggctttgaatagcattgatgctgaggctaaatgcgtagcggtcagagtgaacatggagacattccaggtccaggtgatcgacaacggatttggcatgggcagcgacgatgtggaaaaggtcggtaacaggtactttacctcgaaatgtcacagcgtccaggaccttgaaaatccgcgattttacggctttcgaggggaggctctggctaatattgctgatatggcgtcagccgtggagattagcagcaagaagaaccgcactatgaaaacttttgtcaaactgttccaaagcgggaaagcattaaaagcttgcgaggcagacgtgactcgagcctctgcggggacaaccgtcaccgtgtacaaccttttttatcagctacctgtgcgccgaaaatgtatggaccctcgcctagaatttgagaaggtgcgccagcgcatcgaggccctctctctcatgcatccctcaatttccttctctctaagaaacgacgtttccggctctatggtccttcagttgcccaaaaccaaagacgtgtgctcccggttctgtcagatttatggtctgggaaagtcacaaaaattacgcgagattagtttcaaatacaaggaattcgagttgtcaggatacatttctagtgaggcacattataacaaaaacatgcagttcctgtttgttaataagaggttggttctccgcactaagctgcacaagctgatagattttcttcttaggaaggagtcaattatttgtaagcccaagaatggtccaacctcaagacaaatgaattcttcactgaggcatcggtctactcctgaactctacggtatatacgtgattaacgtgcagtgtcagttttgcgaatacgacgtgtgcatggaacccgccaaaactctaatcgaatttcagaactgggatacactgctgttctgcatccaggaaggcgtgaagatgttcctgaagcaggaaaaactattcgttgaactctctggagaagacatcaaagagttcagcgaggacaatgggttctcgctctttgacgccaccctgcagaaacgtgtgacttcagacgaaagatccaactttcaagaggcctgcaacaatattcttgattcctacgaaatgtttaacttacagagcaaggccgtgaaacggaagaccactgccgaaaatgtgaacactcagtccagccgcgatagcgaagcaacgagaaaaaacacgaatgacgcctttctgtacatttacgagagtggcggcccagggcatagcaagatgacagaaccatctctgcagaacaaggattcctcatgctcggagagcaagatgctggagcaggagactatcgtcgcgtctgaagccggcgagaatgagaagcacaagaagtcctttctggaacactcatctctggaaaacccctgcggaacatccctggaaatgtttctcagccctttccaaacgccgtgtcacttcgaggaatccgggcaagatcttgaaatttggaaggagtccacaacagtgaacggcatggctgccaacatcctgaagaacaacagaattcaaaatcagccgaagcggttcaaggacgccaccgaagtgggctgtcaacctctgcccttcgccaccactctgtggggggttcacagcgcacaaacggagaaggaaaaaaagaaggaatccagcaactgcgggagacggaacgtgttcagctacggacgggtgaaactgtgctcaactggcttcattacgcatgtggttcagaacgaaaaaactaagtcaaccgaaacagaacattccttcaagaactatgtaagacccggtccaacccgcgcacaggagacgttcggtaacaggacacgtcattccgtggagaccccagatattaaggacttggcatcaaccctttcaaaggaaagtggacaactgcccaataaaaagaattgccgaactaacatctcgtatgggctcgagaacgaaccgacggctacatacacaatgttctccgcctttcaagagggatcaaagaagtctcagacagattgcatcttgtctgacacctccccctcatttccatggtatcgacacgttagcaatgacagtcggaagacagacaagctcatcggtttttctaagccaattgtccgcaaaaagttgagcctgagctctcagctggggtctctcgaaaagtttaaacgccagtatggtaaagtcgagaacccacttgataccgaagtggaagaaagtaacggagtgaccaccaatctttctctccaggtggagcccgacatcctgctgaaggacaaaaaccgacttgagaattccgatgtctgcaaaatcaccacaatggagcattctgacagtgactcctcatgccagcctgctagccatatcttaaattcagaaaaatttccgtttagtaaggatgaagactgtctggagcaacaaatgccaagtctccgggaatccccgatgacgcttaaagagctgtctttgttcaatagaaagcccctggatctggagaagtccagtgaaagcctcgcctctaaactttctagactgaagggaagcgaacgcgagacccagaccatggggatgatgtcacgcttcaacgaactgccaaatagtgacagcagtcgcaaagacagcaaactctgttcggtccttacccaagacttctgcatgctttttaataacaagcatgaaaagacagagaatggcgtgattccgacgtccgattccgctactcaagataactcatttaacaagaattctaagactcactctaatagcaataccaccgagaattgtgtgatcagcgagacaccgcttgtacttccctacaacaactcaaaagtcaccggcaaggactctgacgtacttatacgcgctagcgaacagcagatcggctctctggactctcctagtggaatgttgatgaatcccgttgaagacgcaacaggcgatcagaacggcatctgtttccaatcagaggagtctaaggcaagagcttgcagcgagacagaggaaagtaatacttgttgctctgattggcagcgacatttcgacgtggcactggggcgcatggtgtacgtaaacaaaatgaccggactgtcaacatttatcgcaccgacagaagacattcaggcggcctgcaccaaggatctcactacagtcgccgtcgatgtggtgctggagaacggatctcaatataggtgccagccgttccgtagcgatctggtcttgccgtttctccctagggctcgcgcagagaggactgttatgcgccaggacaacagggacactgtggatgacaccgtgtcaagcgaatccttgcagtctcttttctccgagtgggacaatcctgtcttcgcccggtatccagaagttgctgtggacgtaagttccgggcaggccgaaagccttgccgtcaagatccataatatactgtacccctatagatttaccaagggcatgatccattctatgcaggtgctgcagcaggttgataacaagttcatagcatgtcttatgagcacaaaaactgaagagaatggagaggctgattcctacgaaaagcagcaggctcagggctccggtcggaagaaactcctgtcttctacgctcatccctcctctggaaattacagtgacagaagaacagaggagactcttatggtgttatcataaaaacctggaggatctgggtcttgagtttgtatttcctgacaccagtgacagccttgtattggttgggaaagtgcccctgtgcttcgtggagcgggaagcaaatgagcttaggagaggcaggtcaactgtcactaagtccatagtggaagagtttattcgggagcagttagaactgttgcagactacaggcggcatccagggtacactgccgctcactgtgcaaaaggttctcgcctcccaggcttgccacggggcgattaaattcaatgatgggctgtcgctccaggaatcgtgccgccttatagaggcactatcctcctgccagcttccgtttcagtgcgcccacggcagacccagcatgttgcctcttgctgatatcgaccatctggagcaagagaagcagattaaaccaaatttgacaaagctgagaaaaatggcgcaggcttggcgattatttggtaaagccgaatgcgacacacgccaatctctgcagcaatcaatgcccccatgtgaaccgccatag

SEQ ID NO: 25099 - DNA, 4362 bp, Artificial Sequence
  Description of Artificial Sequence: Synthetic coding sequence
atgatcaagtgcctgagcgtggaggtgcaggccaagctgcggagcgggcttgctatttcctccttaggtcaatgtgtcgaggagctcgcgctgaatagcattgacgctgaagccaagtgcgttgccgtgagagtgaacatggagacgtttcaggtgcaggtcatcgacaatggtttcggcatgggaagcgatgatgtagaaaaggtcgggaatcgatatttcaccagtaagtgtcattcagtccaagatctggagaatcctaggttttacgggttcagaggggaagctctggctaatattgcagacatggcttcagccgtggaaatctcgagcaagaaaaacagaacaatgaagacctttgtgaagctgttccagtcgggcaaggccctgaaagcgtgcgaggccgatgtcactcgcgcctccgccgggacaaccgtcactgtttataacctgttctaccaactgcctgtgcgccgaaagtgcatggacccccgtttggagttcgagaaggttcgtcagcgtattgaggccctgtcactgatgcatccatcgatctccttcagcttgaggaatgatgtgtctggatctatggtgctccagctgccaaagaccaaggacgtctgcagtagattctgtcagatctatggcctgggaaaatcacagaaactcagggagatttcgtttaagtataaggagttcgagctgtcgggctatataagcagcgaagcacattacaacaaaaacatgcagtttttatttgtgaacaagagattagtcttgaggaccaagctgcataaactgatcgactttcttctgaggaaagagtccataatatgcaagcctaaaaacgggcccaccagccggcagatgaactcatccttaaggcatcgctcaaccccagaactatacggaatatacgtcataaatgtgcagtgccaattttgcgaatatgatgtgtgtatggagcctgccaagacactcatcgaattccagaactgggacacattactgttctgcattcaggagggcgtaaagatgttcctcaaacaggaaaaactttttgtggagctcagtggggaagacattaaggaattttctgaggataatggttttagtctgttcgatgccaccctgcagaaacgggtcacgtcagatgagagatcaaacttccaggaggcctgtaataacatactggactcatatgaaatgttcaatctgcagagcaaggccgttaagagaaaaactactgcagagaacgtgaatacccagagctccagggactcagaagcgacacgcaaaaacaccaacgacgcatttctgtatatttacgaatccggagggcccggtcactctaaaatgacagagcccagtctacagaataaagactcatcttgttccgaatccaagatgctggagcaggagactatcgtggccagcgaggctggagagaatgagaagcataagaagtcatttcttgaacacagttccttggagaatccttgcgggacatctttggaaatgtttctgagcccatttcagacgccttgtcattttgaagaatccgggcaggacctcgagatctggaaagagtctacgaccgtcaacggtatggccgcgaatatcctaaaaaacaataggatacaaaaccaacccaagagattcaaggatgcgactgaggtaggctgccagccccttccctttgcaaccactttatggggcgtgcatagtgctcagaccgaaaaggagaagaagaaggagtcctccaattgcggcaggcgtaatgtcttctcttacggcagagtgaaactttgcagcactggattcattactcacgtagttcagaacgagaaaactaagtctacggagacagagcattcctttaagaactatgtccggcctggccctactcgggcccaggaaaccttcggaaaccgtactcgccactccgttgaaaccccggatataaaggatctggcaagcacactgtctaaagagtcagggcagttgccaaataaaaagaattgccgtacaaacatctcttacggcctcgaaaacgaacctacagcaacttatacaatgttttccgcattccaggaaggttccaaaaagagtcagaccgattgtattctgagcgatacaagtccttctttcccttggtacaggcacgtatctaatgattctcgcaaaaccgataagctgataggtttcagcaagccgatcgtgaggaagaagctgtctctgagctcccaattagggagcctggagaaattcaaacggcagtatggcaaggtagaaaatccccttgacacggaagtagaggaaagcaatggtgtgacaactaatctgagcttacaagtggagccagatatactgctgaaggacaaaaataggctggagaattccgatgtgtgtaaaatcactaccatggagcacagcgactctgacagttcgtgccagcctgcatctcatattctgaatagcgaaaagttccctttctcaaaggacgaagactgtttagaacagcagatgcctagcctccgggagagtcctatgacactcaaggaactgagtctgtttaatcgcaaaccactggacttggaaaagagcagcgaatcactcgcaagcaaactgtcgagacttaaagggagtgagagagaaacccaaacgatgggcatgatgagtcggtttaacgagctgccgaatagcgattcctccagaaaggatagcaaactgtgcagtgttttaacacaagatttttgcatgctgtttaacaataaacacgagaaaacagagaacggggtaatacctaccagtgacagcgccacgcaggacaattcatttaacaagaattctaaaacgcactcaaactctaatacaaccgaaaattgtgtgatctccgaaacaccgctagtgctgccctacaacaactccaaggtcactggaaaagactcagacgtgcttattcgcgcctcagaacagcaaattgggagcctcgattctccatccggaatgctcatgaatccagtggaggatgcgaccggtgatcagaatggcatctgcttccagtctgaagaatccaaggccagagcatgctcagaaactgaggagagcaacacatgttgtagcgactggcaaaggcacttcgacgtggccctgggaaggatggtgtatgtgaataagatgaccggacttagtacatttattgctcctaccgaagacatccaggccgcctgcacgaaagacctgaccacagtggccgtcgatgttgtgctcgagaacggctcacaataccggtgccagcccttcaggagcgatctggtgcttcctttcctgcctagggcgcgggccgaaagaaccgttatgaggcaggacaacagggacacggttgacgacacggtatcttccgagtccctccaatcactcttctcagagtgggacaacccagtattcgctcggtatccagaagtggccgtggacgtgagcagcgggcaggctgaatcccttgctgtgaagatccataatattctctacccgtatcggtttactaagggaatgatccacagtatgcaagtgttgcaacaggtggataataagttcatcgcatgccttatgtccactaaaacggaagagaatggagaggccgggggaaatctgctggtgctcgtggatcaacacgccgcgcacgagagaatccgcttagagcagttaataattgacagctatgagaaacagcaggcccagggatctggccgtaagaagctcctttcaagcacccttattcctcctctggagatcactgttaccgaagagcagaggcgcctgctgtggtgctaccataaaaacttagaagacctgggcctggagttcgttttcccagacacatccgattctttagtcctggtggggaaggttccattgtgtttcgttgagcgtgaagcaaacgagctgaggagaggtcgaagtacagttacaaaaagcatcgtggaagaatttattcgggaacagctcgagctcctgcagacaaccggcggtattcagggcactctcccactgaccgtacagaaagtgcttgctagtcaagcgtgtcacggtgctataaagttcaacgatggcctgagcttacaggagagctgcaggctgatcgaggcacttagctcctgtcaactcccctttcagtgcgcccacggacggcccagtatgctgccgctcgccgacatcgaccatctcgagcaggaaaagcagatcaaacctaatctcaccaagctcaggaaaatggctcaagcctggaggctctttggcaaagcagaatgtgacacacgccagtctctgcagcagtcaatgcctccctgtgaaccaccttag

SEQ ID NO: 25100 - DNA, 1176 bp, Artificial Sequence
  Description of Artificial Sequence: Synthetic coding sequence
atggtgtacgtgaacaagatgaccggcctgagcaccttcatcgccccaactgaggatattcaggcagcctgtactaaagacttgacaacagtggccgtcgacgtcgttctggagaacggatcacagtaccgatgccagccttttaggtccgaccttgtgctgccattcctgccccgcgcccgtgccgagcgaactgttatgaggcaggacaaccgagataccgtcgacgacaccgtatcttccgaatccctgcagtccctcttttctgagtgggataaccccgtgttcgcaagatatcctgaggtagccgtagacgtgagtagcggccaggctgagtcactggctgttaaaatccacaatatcctgtacccttacagatttacaaaaggtatgatccatagtatgcaggtattgcagcaagtggataataaattcatagcctgcctcatgagtacaaaaacagaagaaaacggcgaagcaggcggcaacttgctggtgctggtcgatcagcacgccgctcacgagcgaattcgcctagagcaactgatcattgactcatatgaaaaacagcaggcacagggttccggtcggaagaagttactcagcagcacactgatccctcctctggagatcacagtcacggaagagcagcgcaggctcctctggtgttatcataaaaacttagaagatcttggcctggaatttgtctttcccgacacctctgacagcttggttcttgtgggaaaggtgccgctgtgttttgtggaacgtgaggccaacgagctccgcaggggacgcagcactgtaaccaaaagcattgttgaacttttgcagacgaccggtgggatccaaggaacactgccacttacggtccagaaggtcctggcgagtcaggcttgccacggtgcaatcaaattcaatgacggtctttcgttgcaggaatcgtgccgcttgattgaggccctttcatcttgtcagctccctttccagtgcgctcatggacgccccagtatgttgcctctggctgatattgatcatctagagcaggagaaacagatcaaaccaaacctgactaaactccgtaaaatggcacaagcctggaggctgttcggcaaagcagagtgcgatacgcggcaatcactgcaacagagcatgccgccctgcgagcccccctag

SEQ ID NO: 25101 - DNA, 597 bp, Artificial Sequence
  Description of Artificial Sequence: Synthetic coding sequence
atgaaccccgtggaggacgccaccggcgaccagaacggcatctgcttccagtccgaagaaagcaaagctagagcgtgttctgagactgaggagagcaatacatgctgctccgattggcagcgacattttgatgttgccttaggaagaatggtttatgtaaacaaaatgacaggtttgtctaccttcatcgcgccgaccgaggacatccaagcggcttgcactaaagatttgaccactgtcgcggtggatgtggtcctggagaacggctctcagtaccgctgtcaaccctttagatcggaccttgtccttccattcttacccagagcccgggccgaacgaaccgtgatgcgtcaagataatcgcgacacggtcgacgatactgtcagctcagagtcactacaatctttgttttctgaatgggataaccccgtatttgccagataccctgaagtgttgcagcaggtggacaacaagttcatcgcctgcttgatgtcgactaaaaccgaggagaacggcgaggccgctgagttgatgatgctccaagatccttgctgtaggcaatcccgcgaggacgaaaatcacgagtttagcctttag

SEQ ID NO: 25102 - DNA, 489 bp, Artificial Sequence
  Description of Artificial Sequence: Synthetic coding sequence
atgatcaagtgcctgagcgtggaggtgcaggccaagctgcggagcggcctggcaatctcgagcttggggcagtgcgtggaagagctagccttgaattctatcgatgccgaggccaagtgcgtggcagtacgcgtgaatatggaaactttccaagtacaggttatcgacaacggcttcggtatgggtagcgatgacgttgagaaagtggggaatagatattttacaagtaagtgtcactccgtgcaagacctggagaaccccaggttctacggttttagaggcgaggccctcgcaaatatcgccgacatggcaagcgctgtcgagatctcttctaagaaaaatcggacaatgaaaacttttgtgaaactgttccagtctggtaaagcattgaaggcatgtgaggcggacgtgacaagagccagtgctgggacaacagttactgtatataaccttttctatcagctccctgttaggcggaaatgcatgtag

SEQ ID NO: 25103 - DNA, 4362 bp, Artificial Sequence
  Description of Artificial Sequence: Synthetic coding sequence
atgatcaagtgcctgagcgtggaggtgcaggccaagctgcggagcggcctggctatcagtagcctaggccagtgcgtggaagagttggctttaaatagtatagacgccgaggccaagtgtgtggcagtgcgcgtcaatatggaaacgttccaagtccaggtcatagacaatggctttggcatgggttccgatgatgtggaaaaggttgggaatcgatactttacatccaagtgtcatagcgtacaggacttggagaaccctcgcttttatggtttcaggggggaggccctcgctaacattgccgacatggctagcgccgttgaaatttccagcaagaaaaaccgaacaatgaaaaccttcgtcaaactgttccaaagtggaaaagccctgaaggcatgcgaggctgacgtgacccgagcatcggcaggcaccaccgtaaccgtgtacaatctattctatcagcttccagttcgacgcaagtgtatggatccacgcctggaattcgagaaggtgcggcagcggatcgaagccctgagtctgatgcatccctccatttctttctccctccgtaatgatgtttctggatctatggtactccaactccctaaaacaaaggatgtttgtagccgattctgccaaatctacggcctgggcaagtcccaaaagcttagagagatcagttttaagtacaaggagttcgaactctctggctacatttcatctgaagcccactataacaagaatatgcaatttctgtttgtaaataaaagacttgtgctgcggacgaagttgcataagcttatcgacttcttacttcgaaaggaatcaatcatctgtaaacccaaaaatggccccacttcgagacagatgaactcatccctccgccacagaagtacccccgaactgtacggcatctacgtcattaacgtgcaatgtcaattttgcgaatatgacgtttgcatggaacccgcaaagacgttgatcgagtttcagaactgggataccctcctcttttgtatccaagaaggtgtgaagatgttcttgaaacaggaaaaactgtttgtagagctgtcaggggaggatatcaaggaattttctgaagacaacgggttcagtctgttcgacgcaaccttgcagaagcgcgtgacctctgatgagcgctccaactttcaggaggcttgcaataatattctggacagctacgagatgttcaacctccaaagcaaggcggttaagaggaagactacagccgagaatgtcaacacacagagcagccgcgacagcgaggcaacccgcaagaataccaacgatgccttcttatatatttacgagagcggggggcctggccactctaagatgacagaaccctccttacaaaacaaggatagttcttgcagcgagtcaaagatgctggagcaggaaacaatcgtggctagtgaggctggagagaatgaaaagcacaagaagagcttcctggaacacagcagtctggaaaacccctgtggcacttctctcgaaatgttcctcagcccctttcagacaccatgccatttcgaggagtctggacaggatttagagatctggaaagaaagtaccaccgtgaacggcatggccgccaacattctgaagaataatcggattcagaaccagcccaaaagatttaaggacgcaaccgaggtgggatgccagcccctccctttcgccactacactctggggcgtccatagcgctcaaacagagaaagagaagaagaaggagagttccaactgtggtcgtcggaatgtcttcagctacggaagggtgaaactgtgcagtactggcttcataactcatgtggttcagaacgaaaagacaaagagcacagaaactgagcactcgtttaagaattacgtaaggccaggcccaactagggcccaggagacgttcggtaatcggacccgacatagtgttgagaccccggatatcaaagacctggcaagtactctctccaaagaaagtggccagctgcccaataaaaaaaactgtaggacaaacataagttatgggctggaaaacgagccgacagccacttataccatgtttagtgccttccaggaaggctccaaaaaaagccaaaccgattgcatccttagcgatacctctccatcattcccatggtacaggcatgtcagcaacgacagccgaaaaactgacaaactgatcggctttagtaaacctatcgtaagaaagaaactcagcctttcctcacagctgggtagcctggagaagttcaagaggcagtacggaaaggtcgagaaccccctcgatacggaggtggaggagtccaatggcgtgacgaccaacctctcgttacaagtggaaccagatatactcctgaaagataaaaacaggttggaaaattccgacgtctgtaagataaccacgatggagcactctgattcggactcttcgtgccaacctgccagccacatcttaaactccgagaagttccccttttcaaaggacgaagactgcctggaacagcagatgccctctttaagagaatctccgatgactctgaaagaactttccctcttcaaccgaaagcccctcgatctggaaaagtcttcagaatcgctggcgtccaaattgtctcgcctgaaaggttccgaacgcgagacccagactatgggcatgatgtctcgcttcaatgagctgcctaactccgactctagcaggaaggactctaaactgtgcagcgtgttgacccaagacttctgcatgctcttcaacaacaaacacgaaaagacggagaatggtgtaatccctaccagcgattcggccacgcaagacaactcattcaataagaattcaaaaacacactccaatagcaacacgacagaaaactgtgttatcagcgagacccctctagtacttccatacaataacagcaaagtcaccggaaaggactccgacgtgctgatccgcgcttcagagcagcagatcgggagcttggattctccatccggaatgctgatgaatccagtggaggatgcgactggcgatcagaatggcatttgtttccaaagcgaggagagcaaagcaagagcttgcagtgaaactgaagaatccaacacgtgttgcagtgattggcaacggcacttcgatgtcgctttgggacgtatggtgtatgttaacaagatgaccgggctatctacatttatcgcaccaactgaagatatccaagcagcgtgcacaaaggacttgacaacagtggcagtggacgtggtgctggagaatggcagtcaataccgctgtcagccctttcgatctgacttggtgctaccctttctgccgcgagccagagcggagagaacggtgatgagacaggataaccgggataccgtcgatgatactgtttcctccgagtctctgcaaagtttattctctgaatgggacaatcccgtgtttgctcgatatcctgaagtggcagttgatgtgagctccgggcaggctgaatcccttgccgtcaaaatacacaacattttgtatccgtaccggttcacaaaaggaatgattcattcgatgcaggtgttacagcaggtggataataaatttattgcctgtctgatgtccacaaagacagaagagaatggagaggcagggggcaatctactggtcctggtggatcaacacgccgcccacgagaggattcggctggagcagctcattattgacagttacgaaaagcagcaagcacagggttcaggtcgtaaaaagcttttgagtagcactctcatccccccccttgagattaccgttacagaggagcaaaggagactgctgtggtgttatcataaaaatcttgaagacctcggcctggagttcgtcttccctgacacaagcgatagtttggtgctggtgggcaaggttcctctgtgctttgtggagcgcgaagctaacgagctcaggcgtgggagatcaacggttacaaaaagcattgtggaggaattcatccgggaacaactggagctgctccaaaccactggtggcatacagggaaccctacccctcactgtgcaaaaggtgttggcctcccaggcctgtcacggtgccattaaatttaacgacggcctgtccctccaggaatcctgtaggctgatcgaggctctcagctcatgtcagctgcctttccaatgcgcccacggtcggccctctatgctgcccctcgccgatatcgatcacctggagcaggagaagcagataaagcctaacctgactaagctgcgtaaaatggcccaggcttggaggctcttcggcaaagcagagtgcgatactcgacagtccctgcaacagagtatgccaccgtgtgagcccccatag

SEQ ID NO: 25104 - DNA, 321 bp, Artificial Sequence
  Description of Artificial Sequence: Synthetic coding sequence
atgatcaagtgcctgagcgtggaggtgcaggccaagctgcggagcggactggccatcagttcactgggacagtgcgtggaagagctggcacttaactccattgatgcagaagcaaagtgtgtggccgtccgtgtcaacatggaaacctttcaggttcaggtgattgataacggattcggcatgggctctgatgatgtcgagaaggtcggcaacagatattttacaagcaagtgccactctgtccaggacctcgagaatccacgcttttacggctttaggggagaagcactcgccaacatcgctgatatggcatcggcctag

SEQ ID NO: 25105 - DNA, 135 bp, Artificial Sequence
  Description of Artificial Sequence: Synthetic coding sequence
atggccgacaagcccgacatgggcgagatcgccagcttcgacaaggccaagttaaagaagaccgaaacacaggagaagaatacgcttcctaccaaggagactattgagcaagagaagcggtccgagatcagctag

SEQ ID NO: 25106 - DNA, 1026 bp, Artificial Sequence
  Description of Artificial Sequence: Synthetic coding sequence
atggccgtgcagcccaaggagaccctgcagctggagagcgccgccgaggtgggatttgtccgcttctttcagggcatgccggaaaaaccgacaaccactgtaagactgtttgatagaggagatttttacaccgcacatggggaggatgccctgctggccgcaagggaggtgttcaagactcagggggtcatcaagtacatgggacctgcaggcgcaaagaacctgcaaagtgtggtgttgagcaaaatgaatttcgagtcctttgtgaaagatcttctcctggtgcgtcagtacagagtggaggtttataaaaacagagccgggaacaaggcgtccaaggaaaacgattggtacttggcttataaggcctcgcctggcaacctgtctcagttcgaagacattctgtttggaaataatgacatgagcgcctctattggagtggtaggagtgaaaatgtcggcggtggatggtcagaggcaggtgggggtcggatatgtggatagcattcagcggaaactgggcctttgtgagtttcccgataacgatcagttcagtaacctggaagccctactcatacagattggccctaaggagtgcgtattgccaggaggtgagacagctggggatatgggcaagctacgtcagataattcagcggggtggaatactaattaccgagcggaaaaaagctgacttcagtaccaaagatatctaccaagacctgaaccgtcttctgaagggcaagaagggtgaacaaatgaattccgctgtgctccccgagatggagaatcaggttgctgtaagtagtctgagtgccgttatcaagttcttggaactcctgagtgatgacagtaactttggtcagttcgagcttaccacatttgatttctcccaatatatgaagctggacattgctgcagtcagagctttgaatctctttcagggctcagtggaggatacaacaggatctcagtcgctggctgcgctacttaataaatgtaagaccccacaggggcaaacttgttag

SEQ ID NO: 25107 - DNA, 2766 bp, Artificial Sequence
  Description of Artificial Sequence: Synthetic coding sequence
atggccgtgcagcccaaggagaccctgcagctggagagcgccgccgaggttggcttcgtgagatttttccagggaatgcccgagaagccaaccactaccgtccgtctattcgaccggggagacttttatactgctcatggtgaggatgctctgctggctgcacgcgaagtgttcaagactcagggagtgataaaatacatgggtcccgccggcgccaaaaatttacaaagcgttgttctgtcgaagatgaacttcgaatcttttgtgaaagatctgctgctggtaaggcagtatagggtggaggtttataagaatcgggccggtaacaaagcctcaaaggaaaacgattggtatctcgcgtacaaagcaagtcccggaaacctcagtcagttcgaagacatccttttcggaaacaacgacatgtccgccagtattggtgtggtcggcgtcaaaatgtccgcagtagacgggcagcggcaggtgggggtaggatatgttgattccattcagcggaagctgggtttatgtgagtttcctgataatgaccagtttagtaatctggaagctttactgatccaaataggtcctaaggaatgcgtcttacccgggggagagacagccggcgacatgggaaaacttcgccaaattattcagagaggaggtatccttattacagaaagaaagaaggcggatttcagcactaaagacatttaccaagacctgaatagactcctgaaggggaaaaaaggagaacaaatgaactccgccgttctgcctgagatggagaatcaggtcgctgtcagttctctttccgccgtcattaaattcctggaacttctctccgatgacagtaatttcggtcagttcgagctgacgacctttgacttttctcagtatatgaaactcgacatagcagccgttcgagcactgaacctgtttcaggggtcggtggaggacacgacaggtagccaaagcctggcagctttactgaacaagtgcaaaaccccacaggggcagaggttggtgaaccagtggatcaaacaaccactaatggacaagaatagaatagaggagcgactgaacctcgtcgaagcattcgttgaggacgctgagctgcgccagaccttacaggaggacctgctgagacggtttcctgatctgaatagacttgcgaaaaagttccagagacaggcagcaaatctgcaggactgctacaggctgtatcaaggaatcaatcagctgcccaacgtgattcaagctttggaaaaacacgaaggcaaacaccagaagctcctgttggctgtatttgtcacacccctcacagacctccggagcgacttcagcaagtttcaggagatgatagagaccacactggacatggatcaagtggaaaatcacgaattcctcgtaaaaccctccttcgacccgaacttgtccgagctacgagagattatgaatgaccttgagaagaagatgcaatctacattaatcagcgccgcacgcgatttgggacttgaccccgggaagcagatcaaactcgattccagtgctcagttcggatactactttcgggtcacctgcaaggaagagaaagtcctgaggaataacaaaaatttttcaactgtggacattcagaagaacggcgtcaagttcactaacagtaagctgactagcctgaatgaggaatacaccaagaacaagactgaatacgaggaggcccaggacgctatcgtaaaagaaattgtcaacatctcatctggatacgtggaaccaatgcagactctgaatgatgtattggcccagctggatgctgttgtgtcatttgctcacgtgtccaatggagccccggtgccctacgtgagacctgcaatactggagaaagggcagggtcgtatcattcttaaggcaagccgacatgcatgtgtggaggttcaggatgagattgccttcatacccaacgacgtttacttcgaaaaggataagcaaatgttccatattattaccggcccaaacatggggggcaaaagcacctacattcgacagaccggggtgatcgtgttaatggcgcagattggctgcttcgtgccttgcgagagtgccgaagtgagtatcgtggattgcatactggcccgcgtgggagcaggggactcccaacttaaaggggtgtccacctttatggctgagatgctcgaaaccgcttctatcctcaggtcagcgactaaggactcacttatcataatcgacgaactcgggcgcggcacttccacctatgatgggtttggactagcatgggccatttctgaatatatcgccactaagatcggagcattttgtatgttcgccacccactttcacgaactgacggctctggcaaatcagataccaaccgtcaacaatctgcacgttactgctcttaccaccgaggagaccctgactatgctataccaggtgaaaaagggtgtgtgcgatcagagtttcggaattcatgttgctgagctggccaatttccccaagcacgtgatcgagtgtgctaaacaaaaagccctcgagctggaggagttccaatacattggcgagtcacaagggtatgacatcatggagcccgcagccaagaaatgttatctggaaagagagaatctgcgggtcacagaacccaaggaccagtgccttatactgctgacctggaagcgcaaactgcgtggcggcaaacgaagcgcttgctcccggcccgaaagacagaaccagggatccggggagctgtcatag

SEQ ID NO: 25108 - DNA, 2163 bp, Artificial Sequence
  Description of Artificial Sequence: Synthetic coding sequence
atgatcggcatctggcacatccggctgctgctggccatcagcctgtctttaaaaacttttagcctcgtgacgatgatatgccagttacctcttgtcttgtgggttcttaagtgccctcaactaatggcaagagacatgggtaagcttaggcagattatacagcggggcggtattcttattactgagagaaagaaagcagatttcagtacaaaggacatatatcaggatttgaataggctcttgaaggggaagaagggcgagcaaatgaactcagcagtactgcctgagatggagaatcaggggtctgttgaagacaccaccggtagtcaatcgttggcggcactcctgaacaagtgcaaaaccccacagggccagagactcgttaaccagtggatcaaacagccactgatggataagaatcggattgaggagcgattaaacctagtggaggccttcgtcgaggacgccgaacttaggcagacactgcaagaggaccttcttaggaggttccccgatctgaaccgccttgctaaaaaatttcagcgacaagcagccaaccttcaggattgctataggctctaccaggggattaaccaactcccgaacgtgatacaggccctggaaaaacatgaaggaaagcatcagaaactcttgctggccgtcttcgtgactcctctcactgacctgcgcagcgacttttcgaaattccaggaaatgatagagaccaccctagatatggatcaagtggaaaatcacgagtttctggttaagcccagcttcgatcccaatttgtccgagttgagagaaattatgaatgatctcgagaaaaaaatgcagagcaccctaatctccgccgcccgggatctagggctcgacccgggaaagcagatcaaattagatagtagtgctcagttcggttactatttcagagtgacctgtaaggaagaaaaggtgctgcgaaacaataaaaattttagcacggtggatatccaaaaaaatggggtaaagtttactaatagcaagctgaccagcctgaatgaagaatacactaagaacaagacagagtacgaggaggctcaggacgctatcgtgaaagagattgtgaacatctccagcggctacgtcgaacccatgcagaccctaaatgacgtgttggcacagctggacgcggttgtgagtttcgcacacgttagtaacggtgcaccagtcccatacgtgcgtcctgcaatactggagaagggacagggcaggattattctcaaggcctctcgccacgcgtgcgtcgaagtccaggatgagatcgcctttattccaaatgatgtgtacttcgagaaagataaacagatgtttcatattatcacgggaccaaacatgggagggaagtctacttacatccgtcagacaggggtgatagtgcttatggcacagatcggttgttttgtgccttgcgaatccgccgaagtttctattgtagactgcatcttagctcgcgttggggctggggactctcagcttaagggtgtgtctactttcatggctgagatgctggagacggcatcaatcctgcggtccgccactaaggattccctgattattatagacgagcttggaagaggaacttctacttatgacggatttggtctggcttgggctattagcgagtatatcgccacaaaaataggagctttctgtatgtttgcaacccactttcacgagttgaccgccctcgcgaaccagattcccacggtgaataatctgcacgtcaccgccttaacaacagaggagacactcaccatgctgtatcaggtgaagaagggggtttgcgatcagtcatttggaatccacgtggcagagcttgccaactttcccaagcacgtgatcgagtgcgccaaacaaaaagccctggagcttgaggagttccagtatatcggtgagagtcaaggatacgatatcatggagcccgctgctaagaaatgttatctggaacgagaacagggagagaagattatacaggaatttttgtcaaaagttaaacagatgccgttcactgagatgagtgaagaaaacataactatcaagttaaaacagttgaaagccgaagtgattgctaagaataattctttcgtgaacgagattattagtcggatcaaagtgacaacttag

SEQ ID NO: 25109 - DNA, 2433 bp, Artificial Sequence
  Description of Artificial Sequence: Synthetic coding sequence
atggccgtgcagcccaaggagaccctgcagctggagagcgccgccgaagttggattcgtgagattctttcaggggatgcccgaaaagccaactacaactgtccgattgttcgaccgcggggacttctatacagctcacggtgaagatgctttgttggctgcaagagaggtgtttaaaacccagggggtgatcaaatacatgggacccgctggcgccaaaaatctgcagagcgtcgttctgagcaagatgaacttcgaaagctttgtgaaagaccttctcctggtgcggcagtacagggtggaagtctacaagaacagagctggaaataaggctagcaaggaaaacgactggtacttggcatacaaggctagccctggcaatctcagtcagtttgaggacatactgtttggcaataatgatatgtccgcctccataggagtggtcggcgtgaagatgtcagctgtcgacggtcagcgacaggttggtgtcggctacgtggactctattcagcgaaagttgggcctttgcgaattccctgataatgatcagttctcaaatctggaagcactcctgattcagattgggcctaaagagtgtgtcctgcccgggggggaaaccgccggcgacatgggcaagctccggcagattatccagagaggcggcattctgatcaccgaaaggaagaaggccgacttctcgacaaaggatatctatcaggacctcaacagactcttaaagggcaagaaaggggagcagatgaactctgccgttttaccagagatggaaaatcaagtggcagtctcaagcctgtctgccgtaattaaattccttgagctgctgtctgacgatagcaatttcggtcagtttgagctcactacctttgatttcagtcaatatatgaaacttgatattgccgccgtccgcgcgctgaacctgttccaggggagcgttgaggacacgacaggctcccaaagtcttgctgcactgctcaacaagtgcaaaaccccacagggccagaggttggtgaaccagtggattaagcaacccttgatggacaaaaatcgcattgaggaacgcctgaacctggtggaagcctttgtggaggatgctgaattgcgccagacactgcaggaggatctgctgagaaggtttcctgacctcaataggttggctaaaaaatttcagcggcaggctgccaatcttcaagattgttaccggctgtaccagggtattaatcaattacccaatgtgatccaggctttggaaaaacatgaaggcaagcaccaaaagttactgctcgccgtttttgtcaccccacttactgatctccggagcgactttagtaagtttcaggagatgattgagacaaccctggatatggatcaagtcgaaaaccatgaattcctggtaaagccctcctttgaccctaatctcagcgaacttcgcgagatcatgaacgacctggagaagaaaatgcagtctacgctcattagtgctgctcgcgatctgggcttagacccagggaagcaaattaagctggacagctccgctcagttcgggtactatttccgcgtcacgtgcaaagaggagaaggtcctgaggaacaataaaaatttttccaccgtggacattcagaaaaatggcgttaaattcaccaacagtaaattgacctcattgaatgaggagtatactaaaaacaagacggaatacgaagaagcccaggatgccattgtaaaagagatcgtgaatatttcttcaggttacgtggaaccgatgcagacacttaatgacgtacttgcacagctagatgccgttgtttccttcgctcacgtttcaaacggggcaccagttccttatgtcagacctgctatcctcgagaagggacagggcaggattatcctgaaagcatctagacacgcttgcgtcgaagtgcaggacgaaatagctttcataccaaatgacgtttatttcgagaaggataagcagatgttccatataatcacaggacctaacatgggggggaaaagcacgtatatccgccagaccggggttatcgttctgatggcccaaataggctgtttcgtgccctgtgaaagcgcggaagtcagcatcgttgactgtatcctggcccgagtcggagccggtgacagccaattgaagggtgtttccactttcatggcagaaatgcttgagaccgcaagtatactacgttctgccacaaaggattctcttattattatcgatgaacttggtagaggaacttctacgtacgatggatttggcctcgcctgggctattagtgaatatatcgctactaaaattggtgcattctgcatgttcgcgacaattttcatgaacttactgccgtggcctattcgctaccagcttctcatcatctatatgtcccagcattcccccctcaagaggccatag

SEQ ID NO: 25110 - DNA, 507 bp, Artificial Sequence
  Description of Artificial Sequence: Synthetic coding sequence
atggacaagaaccggatcgaggagcggctgaacctggtggaggccttcgttgaggatgctgagctcaggcagactctccaggaggaccttcttcgcagattccccgatctgaaccggctagccaagaagtttcagcgtcaggcagctaacttgcaggactgttaccggctgtaccagggcattaaccagctgcctaacgtgattcaagccttagagaagcacgagggtaagcatcaaaaactcctattggctgttttcgtgactccactgaccgatctccgttccgattttagtaagttccaggagatgatcgagaccaccctcgacatggaccaggtggagaaccacgagtttctcgtcaagccctcctttgaccctaacctgtctgagttaagagagatcatgaacgacctcgaaaagaagatgcagagcactttgatttctgccgcaagggatctggggggatctctgcagcctagaagctctaggcttgcctgcgcaacctag

SEQ ID NO: 25111 - DNA, 1602 bp, Artificial Sequence
  Description of Artificial Sequence: Synthetic coding sequence
atggccgtgcagcccaaggagaccctgcagctggagagcgccgccgaggttgggtttgtgcggttcttccagggtatgcctgaaaagccaactactactgtgcgtctgtttgaccgcggagatttttatactgcccatggtgaggatgcccttctggcagctagggaagtgtttaaaactcagggagtcataaaatacatggggcctgctggtgctaaaaatttacagtctgtagttttgagtaagatgaattttgagtccttcgttaaagatctcctgctggtccgccagtacagagtggaggtctacaaaaatcgggctggcaacaaagcttccaaagagaatgattggtacctggcatataaagcctcacctggcaatctctctcagtttgaggacatcctgttcggaaacaatgacatgtctgcatctatcggagtggtgggagtgaaaatgtctgccgttgatgggcagaggcaagtgggtgtagggtacgtcgactcaatccaaaggaagctgggactgtgtgaattcccagacaacgaccaattcagcaacttagaagccctcttaatccagattggccccaaagaatgcgtcctgcctggcggcgagactgccggcgacatgggtaagttacgacagatcattcagaggggggggattttaattaccgagcgcaaaaaggccgatttttccactaaagatatctatcaggatctgaaccgacttctgaaagggaagaaaggcgaacagatgaactccgccgtacttcctgagatggaaaatcaagtcgcggtctcttctctgagcgccgtaatcaaattcttagagctcctttctgatgattcaaactttggtcaatttgagctcactacgtttgatttttcccagtatatgaaacttgacattgcagctgtaagggcccttaacttgttccaaggatccgtagaagacaccaccgggtcgcagagcttggcagccctgctgaacaagtgcaagactccccaagggcaacggctggttaatcaatggattaaacaacctctgatggataagaatcggatcgaggaacgcctcaatcttgtcgaggcctttgttgaagacgcagaactgaggcagactcttcaggaggacctgctgcgcagattccccgatctcaacaggttagcgaaaaagtttcaacggcaggctgcaaacctgcaagactgctacagattgtatcaagggatcaaccaactgccaaacgtgatccaagcactagaaaaacacgaaggcaagcatcagaaacttctgctggctgtcttcgtgacacccctgactgatctgagatctgatttctccaagtttcaggagatgatcgaaacaaccctcgatatggatcaagtggagaatcatgagttcctcgtaaagcccagctttgatcccaacctgtccgagttgagagagattatgaacgacctggagaaaaagatgcagtccaccttaatttccgcagcacgcgacctcggtttggaccctggcaagcagatcaaattggatagttcagcccagtttgggtattactttcgggtgacatgtaaggagaaaagtccttcctag

SEQ ID NO: 25112 - DNA, 1233 bp, Artificial Sequence
  Description of Artificial Sequence: Synthetic coding sequence
atggccgtgcagcccaaggagaccctgcagctggagagcgccgccgaggtgggatttgttaggttcttccaggggatgcctgagaagccaactaccactgtgaggctgtttgacaggggggacttttatactgctcatggagaagacgctcttctagctgctcgggaagtctttaagacacagggagtcataaaatatatgggtcctgccggggccaagaatttgcagagcgtggtattgtccaagatgaactttgagagctttgtcaaagatctgttgctcgtccgccagtaccgcgtagaggtgtataaaaaccgcgcaggcaataaggccagcaaagagaacgactggtaccttgcctacaaagcatctcccggcaacctgtcccagtttgaagatatcctattcggtaataacgatatgtctgcttccataggagtggtgggggtaaagatgagcgctgtggatggacagagacaggtgggcgttgggtacgtcgattcaatccaacgaaagctcggcttatgtgagttcccagacaatgaccagttttccaatctggaggctttgctaatccagatcggcccaaaggaatgcgttctcccgggcggagagacggcgggtgatatgggcaaactgcgccagatcattcaaagaggcggcattttgattaccgagcgaaaaaaagctgatttttcgaccaaagatatttatcaggacctgaacaggcttttaaaaggaaagaaaggagaacagatgaactctgccgtattaccagaaatggaaaaccaggtagcagtttcatccctatcagccgtgattaagtttctcgaactcctttccgatgactctaatttcggccaatttgaacttaccacgttcgatttcagccagtatatgaaactcgacatcgccgctgtacgtgctctaaacctgttccaggggtctgttgaagacactacaggaagtcagtccctggccgctcttctcaataagtgtaaaactccccaaggacagaggttagtcaaccagtggatcaagcagcccctgatggacaagaatcgtatcgaggaaaggctgaacttagtggaggcttttgtagaggatgctgaactcagacaaaccctgcaagaagactacttcgtcgactctcagatcctgaccgaccttccccgcagcttcaaggacaagcagcagacctataaaattgtaaccgatagcataagggtgtag

SEQ ID NO: 25113 - DNA, 1458 bp, Artificial Sequence
  Description of Artificial Sequence: Synthetic coding sequence
atggccgtgcagcccaaggagaccctgcagctggagagcgccgccgaagtcggcttcgttcggttcttccagggaatgcccgaaaaaccaacaactacagtccgattattcgatcgaggagatttttataccgctcatggagaagacgctctgcttgccgcccgggaggtgtttaagactcagggtgtgattaaatatatgggaccagcaggagccaagaatttgcagagcgttgttctcagtaaaatgaattttgagtctttcgttaaagaccttttactcgttcgtcaataccgagtagaagtgtataagaaccgggcgggcaacaaagccagcaaggagaatgactggtatttggcctataaagcttcccccggcaatctttctcagttcgaggatatcctattcggtaacaatgatatgagtgcaagtatcggcgtagttggagtcaaaatgtccgctgtggacggccagcgtcaggtgggcgtcggctatgtcgacagcattcaacggaagctgggactctgcgagtttccagacaatgatcagttttcgaacctggaggctcttctgattcaaattggccccaaagagtgcgtgctgcctggtggtgagacggctggtgatatgggtaagctgaggcagataatacagcgcggtggaatcttaataactgagcggaagaaggccgacttctccacgaaagacatttatcaggatctgaatagactgctgaagggcaagaaaggcgaacagatgaacagtgctgtgctgcccgagatggaaaaccaagtcgcggtcagttccttaagtgctgttattaaattcctggagttactatctgacgattctaattttggccagtttgaactcactacattcgactttagtcagtacatgaaactggatattgcagcagtgagagccctgaatctctttcagggctcagtggaagataccacagggagccaatcactggcagcgctgctgaacaaatgcaaaaccccccagggccagcggctggtgaatcagtggatcaaacagccgttaatggacaagaatcgcattgaggagcggttaaacctggtggaagcatttgtggaagatgccgagctgcggcaaacactgcaggaagacctcctgagaagattccccgatcttaatcggttggccaagaagtttcagcgccaggcggccaacctacaggactgttaccgtctgtaccagggcataaaccagctaccaaatgtgatccaagcgctggagaagcacgagggcaaacaccagaagctactcctggcggtattcgtgactcctctgaccgatctccgaagcgacttcagcaaatttcaagaaatgatcgagacaacgttggacatggaccaggtggagaaccatgagttcctggtgaagcctagtttcgaccccaatctgtcggaactgcggaacaacgaatag

SEQ ID NO: 25114 - DNA, 2607 bp, Artificial Sequence
  Description of Artificial Sequence: Synthetic coding sequence
atgggccccgccggcgccaagaacctgcagagcgtggtgctgagcaaaatgaatttcgaatccttcgtgaaggacctgcttctagtgcgccagtatcgcgtcgaggtgtacaagaatagagccggcaacaaggcctcaaaggaaaacgactggtaccttgcgtacaaagcctctcccggcaatttgtcacagttcgaagacatcctgttcggcaataacgacatgtccgcatctataggagtggtgggggtgaagatgtcagcagtagacggtcagcgtcaggtcggcgtggggtatgtggattctattcagcgaaagttagggctgtgcgaatttcccgataacgatcagttttctaacctagaagctctgctgatccagattggaccaaaagaatgtgtgctgccaggaggcgaaacagctggggatatgggtaagcttagacagataatacagaggggtgggatcctgatcacggagcgtaagaaagccgacttttccactaaggatatctaccaggacctgaatcgcctgcttaaggggaaaaagggagagcaaatgaatagtgcggtattgccggagatggagaaccaggtggccgtctctagtttgtctgcagtcattaagttcctggagctgctgtccgatgactccaacttcgggcagtttgaactgacgactttcgacttctcgcaatacatgaagctcgatatcgctgccgttagggcattgaacctatttcagggctctgtggaggacactactggcagtcagagcctcgcggccttattgaataaatgcaaaaccccccagggacagcggctggtcaaccagtggatcaagcagccattaatggataagaatcggatagaggaacggctgaacctggtggaggcattcgtggaggacgccgaactgcgtcagaccttgcaggaggatcttctaaggcgattccctgatttgaaccggctcgcaaagaagtttcagcggcaggccgcaaaccttcaagactgctataggctttatcaagggattaatcaactgcccaatgtgattcaagcccttgaaaagcacgaaggcaagcatcagaagctgctcctggccgtctttgtgactccactcacagacctcagaagcgacttcagcaagtttcaggaaatgatcgagacaaccttggacatggatcaagtcgaaaaccatgaattcctggtcaagccctctttcgacccaaacctgtctgagctgcgcgagattatgaatgatctggaaaagaagatgcagagtacattgataagtgcagcccgcgacttggggcttgatcctgggaaacagataaagctagattcgagcgcacagtttggatattatttccgtgtcacgtgcaaggaagaaaaagttctgagaaacaacaaaaacttctccaccgtggacatccagaaaaacggggtgaaattcactaactcgaagttgacctccctgaacgaagagtatacaaagaacaagaccgagtacgaggaagcccaggatgccatagttaaagaaatcgtaaacatcagttctggatatgtagagccgatgcagaccctgaacgatgtactggcccagctcgatgccgtagtatcctttgcccacgtgagcaacggggcacctgtgccatatgtgagaccagctatcctggagaagggacagggaagaatcattctcaaagctagccgccacgcctgcgtggaggtccaggacgaaattgcgtttattccaaacgacgtgtactttgagaaagacaagcagatgttccacatcattaccgggcctaatatgggaggcaagtcaacctatattagacagacaggcgtgatcgtgttgatggctcagattggctgcttcgtcccatgcgaaagcgctgaggtgtcgattgtagattgtatcctggcaagagtgggggcaggcgactcccagttgaaaggggtgtccacctttatggcagagatgttggagacagcaagcatcctgcgttctgccactaaggacagtctcattattattgacgaactgggccggggaacatccacctacgacggttttggtttggcctgggcaataagcgagtacattgccacgaaaattggcgctttttgcatgtttgccacacattttcacgagctaactgcacttgcaaaccagattccaaccgtgaacaacctccacgtcacagctttgaccacagaggaaactctgaccatgctgtatcaggtgaagaagggggtgtgtgatcagagcttcgggattcacgtggcagagctggcaaattttccaaaacacgtgatcgagtgtgccaagcagaaggctctggaacttgaagaatttcagtacattggcgaatcacaggggtacgatatcatggaacctgccgctaagaagtgttacctggagagggaacagggcgagaaaattatacaggagttcctgtccaaggtaaaacagatgccttttaccgagatgtcggaggaaaatattaccataaagttgaaacagctcaaggccgaggtaattgccaaaaacaattcttttgtgaacgagatcatttctaggatcaaagtcacgacgtag

SEQ ID NO: 25115 - DNA, 3414 bp, Artificial Sequence
  Description of Artificial Sequence: Synthetic coding sequence
atgagccggcggaagcccgccagcggcggcctggccgccagcagcagtgctcccgccaggcaggccgtcctatcaaggttctttcagtccacaggaagtctaaagtccacttccagctccactggcgccgccgatcaggtggacccaggagctgcagccgctgccgccgctgccgcggcagccgccccacctgcaccccccgcacccgctttcccaccccaactccccccccacattgctaccgagattgataggcgcaagaaacgacccctcgagaacgacgggcctgtgaagaagaaggtcaagaaagtgcagcagaaagagggaggtagcgaccttggtatgagcggaaattcagaacccaagaaatgcttaaggaccaggaatgtaagcaaaagtctagaaaagctaaaggagttctgctgcgacagcgcactgccgcagtcccgggttcagacagaatccctgcaggagcgcttcgccgtgctgcctaaatgcacagactttgacgacatctctctgttacacgctaagaatgccgtttcctccgaagactccaagcgccagattaaccagaaggacacgaccctgtttgacctttcccaattcggttcttctaatacgagccatgagaatctccaaaaaaccgcgagcaaaagcgcaaataaaaggtctaagtctatctatactcccctggagctccagtacatcgagatgaagcagcaacacaaggatgcagttctctgcgtcgaatgcggttacaagtaccgctttttcggtgaggacgccgagatcgccgctcgagagttgaacatatactgtcacctggaccacaatttcatgactgcctcaattcccacccaccgacttttcgtgcatgttagaagacttgtagcaaaaggatacaaggtgggggtagttaaacaaacagaaactgctgctctgaaggccataggagataatcggagctcactcttctcacggaaactgacagctctctatacaaagtccacgctgatcggagaagacgtgaatccacttatcaaactggacgacgctgtgaacgtggatgaaatcatgactgacacgtccacatcctatctgctctgcatcagcgagaacaaggaaaatgtgcgcgacaagaaaaaagggaacatctttataggaattgttggcgtccagccagccactggcgaggtcgtctttgactcatttcaggattctgcctctcggagcgagcttgaaacccggatgagctcactccagcctgtcgaattacttcttccgtccgccctgtcagaacagacggaagcactcattcacagagctactagcgtgtccgtacaggacgacaggatacgcgtggaaaggatggacaatatttactttgagtatagtcacgctttccaggctgtcactgaattttacgctaaagatactgtagacataaaggggtcccaaatcatcagtgggattgtaaatcttgagaaacctgtaatatgttcgctggctgctatcattaagtatctgaaagagttcaatctggagaaaatgttgtcgaagcccgaaaacttcaagcagttatcttcgaaaatggagtttatgaccataaacggaaccacactccgaaatcttgaaatcttgcagaatcaaacagatatgaaaaccaaaggatctctcctctgggtgctggatcatacgaagacatctttcggacgcagaaagctaaagaagtgggtaacccagccgcttctaaaactgagagagatcaacgcgcgcctagatgccgtttcagaagtccttcattctgagagttccgtttttggccagatcgaaaaccacctccgaaagctccctgatatcgagcggggcctctgctcaatctatcataagaagtgtagcactcaggagttttttctaattgtgaagacactttaccacctgaaaagtgaattccaggctatcataccagcggtgaatagccatatccagtcggacctgctgaggaccgttattctggagatccctgaactgttgagtcctgtagagcactatctcaaaattcttaacgagcaagctgctaaagtgggcgacaagacggagctgtttaaagacctcagtgatttccccttgatcaaaaagcgaaaggatgagattcagggcgtgattgacgaaatacggatgcacttgcaagagatccggaagattctgaagaatccgtccgctcagtacgtgactgtgtctggtcaagagtttatgattgagataaagaacagtgcagtctcctgcattccgacggactgggtgaaagtcggcagcaccaaggctgtgtccagatttcattctccgtttattgtcgaaaactaccggcacctgaaccagttgcgggaacagctagttctggattgtagcgctgagtggctggatttccttgaaaaattctctgaacactaccactcactgtgtaaagcagtccaccatctagccacagtggactgcatcttcagccttgcgaaagtggcaaagcaaggggattattgccggcccaccgtccaggaagagcgcaagatcgtcatcaagaacggacgccatcccgtcatagacgtgctgttaggggagcaggaccagtacgtccccaacaacacagatttgtcagaggattcagagagggttatgattattactggacctaacatgggcgggaaatcctcttacataaaacaggttgcgctcataactatcatggcccagataggaagctacgtcccggctgaggaagctactatcgggatagtcgacggcattttcactcggatgggcgccgccgataacatctataagggccagagcacttttatggaagagcttactgatacggctgagatcatccgcaaagccacatcccaatccttggtgatcttggacgaactggggcgggggacaagcacacatgatggcattgccattgcctatgctaccctggaatacttcatcagagatgtgaaatctctcacattgtttgtcacacactaccctcccgtatgtgagcttgagaaaaattatagccaccaggtgggcaactaccacatgggttttttagtcagtgaagatgagtctaaattggacccaggggcggccgagcaggtccctgactttgttaccttcttataccagattacccgtggcatcgctgcgcggagttatggtctgaatgttgctaagttagctgacgttcccggcgagatactgaaaaaggcggctcataagtccaaggaattagaaggtctgattaacacaaagaggaaaaggctgaaatacttcgcgaagctctggaccatgcacaacgcgcaagacttacagaaatggacagaagagtttaatatggaggagacccagacctccctcctgcattag

SEQ ID NO: 25116 - DNA, 3387 bp, Artificial Sequence
  Description of Artificial Sequence: Synthetic coding sequence
atgagccggcggaagcccgccagcggcggcctggccgccagcagcagcgcacccgcccgtcaagcggtgctctcccgcttctttcagtccacggggtcacttaagtccactagcagttccaccggcgctgccgaccaggtggaccctggtgcagccgccgccgcagctccgccagcgcccgcttttcctccccagctccccccccatattgcaaccgagatagatcggaggaaaaaacgacctctggagaatgatggcccagtcaagaagaaagtcaagaaggttcagcagaaagaggggggttcagaccttgggatgtcaggcaatagtgagcccaagaaatgcctgcggacaaggaatgtgtcaaagtccctggaaaagttgaaggaattctgttgtgattcagctctccctcagtctagggttcaaaccgaatcactgcaagagagatttgcagtgttacccaaatgtaccgattttgatgacatcagcctcctgcatgcaaagaatgccgtgtcgtccgaagactctaagcggcagatcaatcaaaaagatactactctgttcgacctgagtcaattcggtagctcaaataccagtcacgagaatcttcagaaaaccgcctctaagtccgctaacaaaaggagcaaatctatttatactccccttgaactgcagtatatcgaaatgaagcagcaacataaggatgccgttctgtgtgtcgaatgtggctacaaatatagattctttggcgaggatgcagagattgctgcccgcgagttgaatatatactgccatctcgatcacaatttcatgaccgcaagtattccaacacacaggctattcgtccatgtgaggcggcttgtcgcgaagggctacaaagtgggtgtcgtgaagcaaacagaaaccgctgcactgaaggccattggagataacagaagttccctattttctaggaagctcacagcgttgtacacaaaatctacacttattggagaagatgtgaatccgttgatcaagctggacgatgccgtgaacgtggacgaaattatgacagatacgagcacatcatacttgctgtgtatcagcgagaacaaagagaacgtccgggacaaaaaaaaggggaatatatttatcggaattgtgggtgtccagccggccaccggggaagtggtgtttgactcatttcaagacagcgccagccgttcagaattggaaacacgcatgtcatccctccagccggtcgagctgttgcttccttctgctctatctgagcagacagaggccctcatccacagggccacaagtgttagcgtccaggacgacagaattcgcgtagaaaggatggataatatttatttcgagtattcccatgcgtttcaggctgtcaccgagttttacgccaaggataccgtggacattaaaggttcgcagataatatctgggatcgttaacctagagaagcccgtgatctgcagcctggccgctattataaaatacctgaaggaattcaacctggaaaagatgctgtccaagccggagaattttaaacagctatcatcaaagatggaattcatgactattaacggcaccacgctcaggaacctagagatcctgcagaatcagaccgacatgaagactaagggatctctcctgtgggtcttagaccatactaagacttcttttggtaggcgcaagttgaaaaaatgggtgacccagccattgttaaaactgagagaaataaacgctagattagacgcagtgagcgaggtgttacattccgaatcttcagtgttcggacagatcgagaatcacttgcgcaagctgcccgacattgagcgcggcctgtgtagcatctaccataaaaaatgctccacgcaagagttctttctgatcgtgaagacgttgtaccacctgaaaagtgagtttcaagctataatacctgccgtgaacagtcatatccagtctgacctgctgcgaacagtcattcttgagattccagaactcttgagtcctgttgagcattacctgaaaattctcaacgaacaggccgccaaggtaggggataagaccgagctgtttaaagacctctctgattttccactcattaagaagcgaaaagacgagattcagggcgtcattgatgaaatccggatgcacttgcaggaaatcaggaaaattctcaagaatccctctgctcagtacgtcacagtgagtggccaagagttcatgatcgagataaagaacagcgctgtgtcttgcattccaacggattgggttaaagtgggctcaacaaaggccgtttctaggtttcactccccttttatcgttgaaaattaccgccacctgaaccagctgagggaacagcttgtcttggactgctcggccgagtggctcgattttctcgagaaattctccgaacactatcatagcttgtgtaaggccgtccaccacctcgccaccgtggattgtatctttagtttggccaaggtcgctaaacaaggggactactgccggcctacagtccaggaggagcgaaagatcgtgatcaagaatggaaggcaccccgtaatcgacgtcctgctcggagagcaagatcagtatgtgccgaacaacacagatctctcggaagatagtgagcgtgtgatgataattaccggcccaaatatgggcggcaagtcaagctatattaagcaggtggccctgatcacaattatggcccagatcggctcttacgtgcccgcagaggaggcaaccatcgggatcgtggatgggattttcacaagaatgggagccgccgataacatctacaaggggcagtcaacttttatggaagaactgactgataccgccgaaatcattcgcaaggcgacttcccagagcctcgtgattttggacgagctggggcgcggtacatccacccatgacggaatcgcaatcgcctatgccaccctggaatactttattagagacgtgaagtccttgactttatttgtcacacattatcccccagtttgcgagctcgaaaaaaactattcccaccaggtgggaaactaccacatgggtttccttgtgagtgaagacgaatctaagctcgatcccggcgctgctgaacaagttcctgatttcgtaacctttctctatcagatcaccagaggcatcgccgctcgatcctacgggctgaacgtggctaagctcgccgacgtaccaggggagatcctgaagaaggccgctcataaatctaaagagctggaaggactgataaatactaaacgtaagcgcctgaaatattttgcgaagctttggaccatgcataacgctcaagacctccaaaagtggaccgaggaatttaatatggaggaaacacagacatcactactgcattag

SEQ ID NO: 25117 - DNA, 2811 bp, Artificial Sequence
  Description of Artificial Sequence: Synthetic coding sequence
atgctgcggcccgagatcagcagcaccagccccagcgcccccgccgtatcaccaagtagtggcgaaactagatcccctcagggccccagatacaatttcgggctgcaggagacaccacaatcccgaccttcggtgcaggttgtgtccgcgtccacctgccccggcacctctggggcggccggggatcgctctagtagtagctctagtctgccatgtcccgcccccaattccaggcccgcgcagggatcatacttcggaaataagagagcttatgcagagaatacagtcgccagtaacttcacattcggggctagctctagctcagctcgagatacaaactacccacagacgctgaaaactcccctgagcaccggcaacccccagagaagcggttacaaatcttggacaccccaggtagggtatagcgcttcctcaagctccgccatatctgcccatagcccctcggtgattgtggcagttgtcgaagggcgaggattggctcgaggcgaaataggtatggcctctatagatcttaaaaacccacaaataattctgtctcaatttgccgataatactacatatgctaaggtgatcacaaagctgaaaattctcagtcccttagaaattatcatgagcaacaccgcttgtgctgtgggtaattccacgaagctgtttactctcattactgagaactttaagaatgttaacttcaccacaatccagaggaagtatttcaatgaaacaaaaggtctggagtacatcgagcagttgtgcattgcagaattttctacagtgctgatggaggtgcagtctaagtattattgcctggccgccgtagcagccttgctgaagtacgtagagtttatacagaacagtgtgtatgcacctaaatcactgaagatttgttttcaggggagcgagcagacagccatgatcgacagttctagcgcccagaatctggagttgctcatcaacaaccaggattatcggaataaccatacgctgttcggagtattaaattacactaagacacccggaggctctcggagattacgatctaacatcctcgagccactcgttgatattgaaaccatcaacatgcgactcgattgcgtccaggaacttttgcaggacgaagagctgttttttggcctacaaagcgtgataagccgcttcctggacaccgagcaactgctatcagtgttagtgcagataccaaagcaggacactgtgaacgccgccgagagcaagattactaatctgatttatctgaaacatacattagagctcgtagaccccctgaaaatcgcgatgaagaattgtaacacccctctgcttagagcctactatggttccctggaagataagagatttggtataatcctcgagaaaattaagacagtgatcaatgacgacgcacgatatatgaaaggctgcctgaacatgaggacccaaaagtgctacgcagtgaggtcaaatatcaatgagtttctggatatcgcaagacggacgtacaccgaaattgttgacgatatagccggtatgatttctcaactgggggagaaatactccctgccgcttcgaacctccttctcatccgcccgcggcttttttatccagatgacaaccgattgcattgcactgccttcggaccagctgcccagtgaattcatcaagatctctaaagtcaagaattcctacagcttcacaagtgctgacctcatcaagatgaacgagcggtgccaagaaagcctgcgcgagatttaccacatgacgtacatgatcgtttgtaagctcctgtcagagatctatgagcacattcactgtctctataaactcagcgataccgtcagcatgctggacatgctgctcagctttgctcacgcctgtacactgtcagattacgtgcgacctgagttcacagatactttagcaattaagcaaggatggcacccaattctggagaagatttcagctgagaagcctatcgccaataacacatatgttaccgagggaagcaactttctgatcatcacgggaccaaatatgtctggtaagagcacctatctgaagcaaattgccctgtgccaaatcatggcccaaatcggatcatacgtcccagccgagtacagtagctttagaattgccaagcagatctttaccaggattagcaccgacgacgacatcgaaactaatagctcaaccttcatgaaagaaatgaaagaaattgcatatatactgcacaacgctaacgataagagcctcattctcatcgatgaactagggcgtggaacgaatactgaggaaggcatcggaatttgttatgctgtttgtgaatatctgctctctctgaaagcctttactctgttcgctacacactttctcgagctttgccatatcgatgctctttatccaaacgtagaaaacatgcatttcgaagtacagcacgtcaagaacaccagtagaaataaggaagcaattttatacacctacaagctgtcaaaggggttgaccgaggagaagaactatgggctgaaggccgcagaagtgtcttcactgcctccctccatagttctggatgcgaaggaaattaccactcagattacacggcaaattcttcaaaatcaaagatcaactcctgagatggagcgacagcgtgccgtgtaccacctcgcaacacgcctggtgcaaaccgctagaaattctcagctggaccccgattctctgagaatttacctgagcaatttaaagaagaaatacaaagaggatttcccaaggacagagcaggttcccgagaagaccgaagaatag

SEQ ID NO: 25118 - DNA, 813 bp, Artificial Sequence
  Description of Artificial Sequence: Synthetic coding sequence
atggccagcctgggcgccaacccccggcggaccccccagggcccccgcccaggggcggcaagttcaggctttccatctccagcccccgtgccggggcctcgcgaggcggaagaggaggaagttgaggaggaagaagaactggcggagatacatctctgtgttctgtggaactccggctaccttggcatcgcttactatgacaccagtgacagcacaatacacttcatgccagacgcgccggaccatgagagcctgaagctcctgcagagggtgctcgatgagatcaatccacagtccgtggttacctctgccaagcaagacgagaatatgacacgcttcctcggaaagctggcttctcaggagcacagggagcccaaaagaccggagatcatctttttacctagcgtcgacttcggattagagatcagcaagcaaaggctactgtctggtaattactctttcattccggatgctatgaccgcgaccgaaaaaatccttttcctcagttcaatcattccatttgactgcctgctgaccgtgcgagctctggggggcctgttgaagttcctcggtcggcgccgaattggggtagagctcgaagactacaatgtgtccgttcccatactaggattcaagaagttcatgctgacacaccttgtgaatattgaccaggacacatacagcgtcctgcagatattcaaatcagaaagccatccatcggtgtataaggtggcatccggccttaaggagggactgtccctctttgggattctcaataggtgccattgcaaatggggggaaaaactcctgtag

SEQ ID NO: 25119 - DNA, 813 bp, Artificial Sequence
  Description of Artificial Sequence: Synthetic coding sequence
atggccagcctgggcgccaacccccggcggaccccccagggccccaggcccggagccgctagctccggcttcccgagccccgcccctgtacctggtcccagggaggccgaggaggaagaggtggaggaagaagaggaattggctgagatccacttatgtgtgctgtggaactccggttacttagggatagcctattacgacacgtctgactcaaccattcactttatgccagacgcccctgatcacgagtccctaaagttactccagcgagtcctggatgaaataaatccccaatctgtggttaccagcgcaaagcaggacgaaaacatgaccagatttctgggtaaacttgctagccaggaacaccgcgagccaaaaaggccagagataatcttccttccttccgtggatttcggattagaaatctcaaaacaacggctgctctccgggaactattccttcatacccgacgccatgacagcgaccgaaaaaatcctgtttttgagttctattattccatttgattgcctcctgactgttagagcccttggaggactgctgaaattcctggggcggcgtcggatcggagtagaactcgaggactacaatgtgtctgtgccgatcttaggattcaagaaatttatgctgacacacctcgtgaatatcgaccaagacacatacagcgtgctgcagatcttcaagtctgagtcccacccaagcgtgtacaaggtagcatcagggcttaaggagggactatcactgtttggcatactgaatagatgccattgtaagtggggggagaaattgctgtag

SEQ ID NO: 25120 - DNA, 585 bp, Artificial Sequence
  Description of Artificial Sequence: Synthetic coding sequence
atggccagcctgggcgccaacccccggcggaccccccagggcccccggcccggagccgcttcctcaggcttccctagccccgcccctgttcctggtccccgcgaagctgaggaagaggaggtcgaggaggaagaggagctcgccgagattcacctgtgcgtcctctggaatagtggatacttaggaatagcgtactacgacacgtctgattccacaatacattttatgcctgacgcccccgatcatgaatcgctgaagctattgcagcgggttttggacgaaataaatcctcagagcgttgtcacgtctgcaaagcaagatgagaacatgacacgcttccttgggaaactggccagccaggaacaccgagaaccaaagagaccggagatcatcttcctgccttctgtggacttcgggctcgaaataagtaaacaacggctcttaagcggcaattacagctttatccctgacgctatgacagccaccgagaaaatactcttcctgagctcaatcatcccctttgattgtcttttgactgtgcgggccttggggggcctgctgaaatttctgggtaggcggcggtag

SEQ ID NO: 25121 - DNA, 813 bp, Artificial Sequence
  Description of Artificial Sequence: Synthetic coding sequence
atggccagcctgggcgccaacccccggcggaccccccagggccccaggcccggcgctgcatccagtggatttccatctcctgcacctgtcccaggaccacgggaagcggaggaggaggaggtggaggaggaggaggagctggcagaaattcatctgtgcgtactgtggaattcaggttacctgggaatagcgtattacgatacaagcgatagcacaattcacttcatgccagacgccccagaccatgagagtctaaagctcctgcaaagagtgttagacgagattaacccacaatcagtggtaacctccgctaaacaagatgagaatatgacgcgcttcctgggcaagctggcttcacaagagcatagggaaccaaagagacctgagataatttttctgccctccgtggatttcggacttgaaatatctaagcagcggctcctgagcggcaattacagtttcatccccgacgctatgaccgctactgaaaaaatactattcctatcctccatcattccctttgattgtcttctgaccgttagggcattgggcgggctgctgaagttcttgggccggagacggatcggtgtggaactggaggattacaatgtatctgtacccatcctgggttttaagaagttcatgttaacccaccttgtaaatattgatcaggacacttattctgtgctgcagatttttaagagtgaatcacacccaagcgtatacaaagtggcctcaggactgaaggagggcctgtctctgttcggtatcctgaatcgatgtcattgtaaatggggcgagaagctcttgtag

SEQ ID NO: 25122 - DNA, 864 bp, Artificial Sequence
  Description of Artificial Sequence: Synthetic coding sequence
atggccagcctgggcgccaacccccggcggaccccccagggcccccgccccggcgctgcatcgagtgggtttccatctcctgctcccgtgcccggacctcgagaggctgaggaagaagaagtggaagaggaggaggagttggcagagatccatttatgcgtgctgtggaactccggatacctgggcatcgcttattatgataccagcgatagcacgattcacttcatgcctgatgctccagatcacgaatcgctcaaacttctgcagcgtgtcctggatgagattaatcctcaatcagtggtaacaagcgcaaaacaagatgagaatatgacccggttcctggggaagttggcaagccaggaacatagagaaccgaagagacctgaaatcatattcctcccttcagtcgatttcggactggagatttccaagcagcgtctgttaagcggaaattacagttttatcccagacgctatgacagcaacagagaagatcctgtttctgtcatccataattccatttgactgtctcttgacgccgccgggcgacctccggttcaccccgatccccttgctgataccctctcaggtgagagcgctgggggggttattgaaattcctgggccgacgccgcattggggtcgagctggaggactataacgtcagtgtgccaatattgggcttcaagaagttcatgttgactcatctggtaaatatcgatcaggatacctattcagtgttgcaaatattcaaaagtgagtcccacccttccgtgtacaaggtggcttccggattgaaggagggattaagcctattcggcatccttaaccggtgccactgcaaatggggagagaagcttctgtag

SEQ ID NO: 25123 - DNA, 324 bp, Artificial Sequence
  Description of Artificial Sequence: Synthetic coding sequence
aagatcctgttcctgagcagcatcatccccttcgactgcctgctgacggtgagggctttaggcggactgctcaaattcctgggaagacgcaggattggggtcgagctggaggattacaacgtttccgtccccatcctaggctttaagaagtttatgcttacacacttggtaaatattgatcaggatacatattcagtcctgcagatttttaagagcgagtcacatccttcggtgtacaaagttgcatccggactgaaggagggattatcacttttcgggattttgaaccgatgccattgtaaatggggggagaagttgctctag

SEQ ID NO: 25124 - DNA, 765 bp, Artificial Sequence
  Description of Artificial Sequence: Synthetic coding sequence
atggccagcctgggcgccaacccccggcggaccccccagggcccccggcctggtgccgcaagttctggtttcccctcgcccgctccggtgccagggccaagagaggccgaggaagaggaggtggaagaggaagaagaacttgcagaaattcacctatgtgtgctgtggaactctgggtacctgggtatcgcttactacgacaccagtgattctacaatccatttcatgcccgatgctcccgatcatgagtccctgaaactgttgcagcgcgtcctggacgaaatcaacccccagagcgtggtgacatcggctaagcaggacgagaatatgactagatttcttggcaaactcgcctcacaggagcaccgggagcccaaaagacctgagatcatttttctgccctccgtggacttcggactggagatatccaaacagcgattattgtcagggaactactcttttatcccagatgcaatgaccgccacagagaaaatcttgttcctgtcatcgatcatcccgtttgactgtctattaacggtgagggccttgggcggcctcttgaagtttttgggccgccgcaggattggcgtcgaactggaagattataacgttagtgtgcccatcctcggttttaaaaaatttatgttaacccatctcgtgaacattgaccaggatacttacaggctagagtgtaatggcgctataagcgcccagtgcaacttatgtctgctgggcagttctgattcacccgctagcgccagctag

SEQ ID NO: 25125 - DNA, 1542 bp, Artificial Sequence
  Description of Artificial Sequence: Synthetic coding sequence
atggccatggagatcgacagccggcccggcggcctgcccggcagcagctgcaatctcggtgcagcacgggagcatatgcaggctgttactcggaattatattacacatccccgagtgacctatcgcacagtgtgctccgtcaatgggcccctcgtagtgctggatcgcgttaaattcgctcagtacgcggagatcgtccatttcaccctccccgacggcacgcaacggtcaggacaggtcctggaagtggccggcactaaagctatagtgcaagtattcgagggaacctccggcatcgatgctcgcaagacaacttgcgaatttaccggagatatcctaagaacacccgtgagcgaggacatgctcggccgggtatttaacggctctggtaaacccattgataagggccccgtcgtgatggctgaggatttcctggatataaatggacagccaataaacccccattctcgcatatatccagaggagatgattcagaccggcatatcaccgattgatgtaatgaacagcatcgctaggggacagaaaatccccatattcagcgcggccgggctgcctcataacgagattgccgctcagatatgccggcaggcagggctagtgaaaaagtcaaaggctgttctggattaccacgatgataattttgctatcgtgttcgccgccatgggcgtgaacatggaaacagcaagattttttaagtctgacttcgagcagaatgggactatgggcaacgtgtgtctgtttcttaacctggctaacgaccctacaattgaacggattataacacccaggttggccctcacgaccgcagaatttctcgcctaccagtgcgaaaagcatgtactggttatattgacagacatgagcagttatgccgaggctctccgagaggtctccgctgcccgcgaagaggtgcccggacgtcgcggttttcctggctatatgtatacggatctcgccacgatctacgaaagagccggcagagtagagggtcgcggagggtctatcactcagatccctatccttacaatgccgaacgatgacattacacatccaatcccggacttgacgggtttcatcactgaaggtcagatttatgtggaccgccagctgcataatcggcagatttaccctccaataaatgtgcttccaagtctatccagattgatgaaaagtgcgataggagagggaatgacccgcaaagaccacggcgacgttagcaaccagctgtatgcctgttacgctatcggcaaggacgtgcaggccatgaaagccgtcgttggggaagaggcattaacgagcgaagatctgctgtatctggaattcctccagaaatttgaaaagaattttatcaaccagggtccctatgagaatcgtagcgtcttcgaatctctggacttgggctggaaactcctgagaatcttcccaaaggagatgctgaagaggatcccacaggctgtcatcgatgagttttactctcgggaaggcgctctgcaggaccttgccccagacacagcgctctag

SEQ ID NO: 25126 - DNA, 759 bp, Artificial Sequence
  Description of Artificial Sequence: Synthetic coding sequence
atgagccggcagagcaccctgtacagcttcttccccaagagccccgccttatctgatgccaataaggcctctgccagagcatcacgagaaggtggtagggccgcagcagcacctggggcctctccttctcctggaggagatgccgcctggtccgaggccggacctggacctcgtccactggctagaagcgcgagcccacccaaagcgaaaaacctaaacggaggtcttcgtcgctccgtcgcccccgccgcgcccacatcctgcgatttttcccccggcgacctggtgtgggctaagatggaaggttacccatggtggccctgcctggtgtacaaccatccatttgacggtactttcattcgggagaaaggaaagagtgttagagtccatgtacagttcttcgatgacagcccaactaggggctgggttagtaagcgcctattaaagccctatactggcagcaagagcaaagaggctcagaaaggtgggcacttctattccgcgaaaccggagatcctgagagctatgcaacgggccgatgaggcattgaataaggataagattaaacgcctggagctggccgtttgcgatgaacccagcgagcccgaggaggaagaggaaatggaggtgggtacaacctacgtgaccgacaagagcgaggaggataatgagatagagtccgaagaggaggttcagcctaagacccagggatctcgcagatcttctcgccagataaagaagcggcgaaagaaaagatag

SEQ ID NO: 25127 - DNA, 3177 bp, Artificial Sequence
  Description of Artificial Sequence: Synthetic coding sequence
atggtgaccggcaacggcagcctgaagcggaagagcagccggaaggagacaccctccgccaccaagcaagcgacctccatctcttcagagacaaagaacaccctgcgggcattcagcgcaccacagaacagtgagtcacaggcgcacgtatccggaggtggagacgactcgagtaggcccactgtgtggtaccacgagacgctcgagtggttgaaagaagaaaaaaggcgcgatgaacaccggcgacgccccgatcaccctgatttcgatgcctcaactctttatgtgccagaagactttctgaactcatgtacaccagggatgcgtaaatggtggcaaatcaagtcacaaaactttgacttggtgatttgttataaggtgggcaaattttatgagctgtaccacatggatgcactgatcggggtgtccgaattgggcctcgtcttcatgaaaggaaactgggcccacagcggatttcccgaaatagcattcggtagatactccgacagcctggtgcagaaggggtataaagtggcgcgcgtagaacaaacagagacccctgaaatgatggaagctcgatgtcgcaaaatggcccacatctcaaagtacgatagggtggtacgtcgggagatttgccggattattacaaaaggtacacaaacatactccgtcctggaaggcgatccaagcgaaaattacagtaagtatctcctgtctctcaaggagaaggaagaagactcttccggacatacccgcgcgtatggagtttgctttgtagatacttctctcggtaaattcttcatcggccagttctctgatgaccggcactgctcccggtttaggaccttggttgcccactatcctccagtgcaggtgctgttcgagaagggaaacctcagcaaggagacgaaaaccattctcaagagctccttaagttgctccctgcaggaaggcctgatcccgggtagtcagttctgggacgccagcaaaacactccggactctgttggaagaagaatactttcgtgagaaactctccgacggtattggtgtaatgttgccgcaggtcctgaagggaatgacaagcgaatcagactctataggtctcactccgggagagaaatccgagctggcactgtctgctctgggcggttgtgttttttatctgaagaagtgtttaatcgatcaggagctattaagcatggccaactttgaagagtacattccgttggacagtgataccgtgtccacgacccggagcggcgctattttcacaaaggcttaccagcgtatggtgctggatgctgtgactctgaataatctggagatctttctgaacgggaccaatggatctactgaaggtacgttgctggaaagagtggacacttgtcatacacctttcgggaagaggttattgaaacagtggctttgcgccccactgtgtaatcattacgccatcaacgaccggctcgacgccatcgaggacctcatggtcgtccctgacaaaatttcagaggtggtcgagttactgaaaaaacttcccgaccttgaacgcctcttgtcaaagatccataatgtgggatctcctctgaaatcacaaaaccaccctgatagtcgagctatcatgtacgaagagactacttattccaagaagaaaataattgatttcctcagtgccctcgaggggtttaaagtgatgtgcaaaataatcgggattatggaagaagtagccgacggctttaaatctaagattctgaagcaggtaatttccctgcagactaaaaatcctgaaggacggttcccagatctgaccgttgaacttaatagatgggacactgcctttgatcacgaaaaagcccggaaaacaggactgatcacgcccaaggcgggctttgatagcgactatgaccaggcacttgctgatattcgcgaaaatgagcagtccctgctggagtatctggagaagcagcgcaatagaattggatgcagaaccattgtatattggggcatagggagaaatcgctatcagctcgagatcccagagaattttacaacccgcaatctgcctgaggaatatgaactcaaatccactaaaaaaggttgtaagagatactggacaaagaccattgaaaagaaactcgcgaacctcatcaacgcagaagagagaagggacgtgagcctgaaggattgcatgagaaggctcttttacaattttgacaagaattacaaagactggcagagtgctgtggagtgcatcgcagtgcttgatgtgttgctgtgcctcgctaactattcccggggcggagacgggcctatgtgcagacccgtgattcttctgcccgaagatacaccccctttcttagaactaaaggggagtcgccatccttgcattacgaagacctttttcggtgatgatttcattcccaatgatatactgatcggctgtgaggaggaggagcaggaaaacggaaaggcatattgcgttctagtgaccggccctaacatgggaggtaagagtactctcatgcgtcaggcgggactgctcgctgtgatggcccagatgggctgctacgtgccagccgaagtatgtcgactgacccccatcgaccgggttttcacccgcttgggggctagtgaccggatcatgagcggtgagagcacgttcttcgtggaacttagcgaaactgccagtatcctgatgcatgctactgcccattccttggtgctagtagacgaactcggcaggggaaccgccaccttcgatggaaccgccatcgctaacgctgtcgttaaggagcttgcggagacaattaagtgtcgcacgttattttccacgcactatcattccctggtagaggactatagccaaaacgttgcggttcggctcgggcacatggcttgcatggtcgagaatgagtgtgaagacccttcacaagagaccatcacttttttgtataaatttattaaaggtgcttgcccaaaatcttacggcttcaacgccgcaagactcgccaatctgccagaggaggtgatccagaaagggcatagaaaggctcgtgagttcgaaaaaatgaaccagagtctcaggctctttcgggaggtgtgcctcgcatcggagagatcaactgtggacgctgaggccgttcataaattgctcactctgatcaaagagctgtag

SEQ ID NO: 25128 - DNA, 3693 bp, Artificial Sequence
  Description of Artificial Sequence: Synthetic coding sequence
atgagccggcagagcaccctgtacagcttcttccccaagagccccgccctaagcgatgccaataaagcaagtgctcgggcgagtagggagggcggccgggctgcagccgcgccgggtgcctcaccttccccgggcggcgatgcggcctggtctgaagccggacccggtcctaggccgctggcccgcagcgcgtccccacctaaggccaaaaacctcaatgggggtcttcgtcggagtgtgggcacaacgtatgtgactgacaagagcgaagaggataacgagatcgagtctgaagaggaggtgcagccaaaaacgcaaggctctcgtcggagttccaggcagattaaaaaacggcgggttattagcgattctgagagcgacattggaggctcagatgtcgagtttaaacccgatactaaagaagaaggcagtagcgatgagattagctccggcgtgggggactctgagtctgagggcctgaattccccagtcaaagtcgcgaggaaaagaaagaggatggtgactggaaatggctctctcaagcggaagtcaagcaggaaggagacgcccagtgcgaccaagcaggccacgtctatctcaagtgaaaccaaaaatacacttcgcgccttttctgccccacaaaatagtgagtcacaggcacacgtgagcggcgggggggacgattcatctcgtcccacagtttggtatcatgaaacactggagtggctgaaggaagagaagcgccgcgatgaacatcgacgccgtcccgaccatccagatttcgacgcctccactttatatgtacctgaggactttctgaactcatgcactcctggaatgaggaagtggtggcagatcaaaagtcagaatttcgatctcgtcatctgctacaaggtcggaaaattttacgagctgtaccatatggacgcccttatcggcgtctctgagctgggtctggtgttcatgaaggggaactgggcccattctggatttcccgaaattgcttttggtaggtactccgactctcttgtccagaagggatacaaggtggccagggtggagcagacagagaccccagaaatgatggaggcccggtgccgcaagatggcgcacatctcgaaatatgaccgagttgtgcgacgcgaaatctgtcgcattatcaccaagggcacacagacctacagcgtcctcgaaggcgacccgtcagaaaattatagcaagtatttactcagtctgaaggagaaagaagaggactcttccggccacacgagagcgtacggtgtttgcttcgtcgacaccagtctggggaagtttttcattggtcaattttcagacgaccgtcactgttctaggttcagaaccttagtggctcattaccctcctgtccaggtcctcttcgagaaaggcaacttatctaaggaaaccaaaacaatcctgaagtctagcctcagctgcagtctgcaggaggggctgattcctggcagtcagttttgggacgctagtaagacactgcggacgcttctcgaagaagaatacttccgtgaaaagttatctgacgggattggagttatgctgcctcaagtactcaaaggtatgacgtctgaatccgacagtatcggcctcactcccggcgagaaaagtgagctcgcactgagcgctttaggaggctgcgtgttttatctgaaaaaatgtcttattgatcaagaactgctgtccatggccaattttgaagagtacatcccgctggatagcgataccgttagcaccaccagatccggagccatatttaccaaggcctaccaacgcatggtgctggacgccgtgacattaaataatcttgaaatctttctgaacggaaccaatgggagtaccgagggtacactgctagagcgggtagatacatgccacactccattcgggaagcgcctcttaaaacagtggttgtgtgcacccttgtgtaaccactatgctatcaatgatcgactggacgcgatcgaagacctgatggtcgtgccagacaagatctccgaagtagttgaactactgaaaaaactccccgaccttgaaagactgctgtcaaaaatacacaacgtcggctcccctctaaaatcacagaaccacccagattctagagccattatgtatgaagagactacatactccaaaaaaaagattatagactttctctccgccctcgaaggctttaaagtcatgtgtaagatcattggcataatggaggaggtagcagacgggtttaaatcaaagattctaaagcaggttatttctctccagactaagaatccagaaggtcgattccctgatttaacagtcgaactgaatagatgggatacagcttttgatcatgagaaagccagaaaaaccggcctgattactcctaaagccgggttcgatagcgattacgatcaggccctggctgatataagagaaaacgagcagtctctactcgaatacctcgaaaagcagcgcaaccggataggctgtaggacgatcgtatactggggaatcggcaggaaccggtatcagcttgaaattcccgagaattttacgactagaaacttacccgaggagtacgagctcaaatcaaccaaaaagggctgtaagcggtactggaccaagaccatcgaaaaaaagttggccaatctcatcaacgcggaggagaggagggatgtttccctcaaagattgtatgcgccggttgttttacaactttgacaagaactacaaagactggcagtccgcagtggaatgtatcgccgtgcttgatgtgctgctgtgtctggccaattactcaagagggggagatggaccaatgtgtaggccagttatcctcctgccggaagacacacctccttttcttgaactgaaaggcagcagacatccgtgcattactaaaaccttttttggggatgactttatccccaatgatatccttattggctgtgaggaggaggagcaggagaatggtaaggcctactgtgtgctagttaccgggccaaatatgggaggaaagtcaaccttaatgagacaggcaggcctgctggccgtgatggcccagatgggttgctacgtgcctgctgaggtgtgtcggctcacacctatcgatagggttttcacgagacttggcgcctccgaccggattatgtctggcgaaagtacattctttgtggagctgagtgaaacagcatctatcttaatgcatgccaccgctcactccctggtgctggtggacgagttaggcagagggacggccacgttcgatggcaccgcaatcgcaaacgccgtggtaaaagagttggccgaaacgattaaatgccggacccttttctctacccattaccattcgctggttgaagattactcccaaaatgtggcggtccgcctggggcatatggcgtgtatggttgaaaatgagtgtgaagacccttcacaggagacgataacgttcttgtataaatttataaagggagcgtgccccaaatcttacggattcaatgccgcgcggctggcgaatcttcctgaggaagttattcagaaaggtcacaggaaagctcgagaatttgaaaaaatgaatcagtccctgcgcctctttagggaagtgtgtcttgcatctgagcgcagcacggtcgatgccgaggcagtacacaagttgctaactctcatcaaggaattatag

SEQ ID NO: 25129 - DNA, 975 bp, Artificial Sequence
  Description of Artificial Sequence: Synthetic coding sequence
atgcggcggctgttctacaacttcgacaagaactacaaggactggcagagtgctgttgaatgtatcgctgtgctggacgtcctcctgtgtcttgccaattattcaagagggggagatggacctatgtgtagaccagttattctgctacctgaagacactcctccattcctggagttaaagggttctcggcatccttgcatcactaaaactttttttggcgatgactttattccgaacgatattcttataggctgcgaggaggaggagcaggagaacggcaagatagtgtgcctgctgttagatcagatttggggcgcctcgctacgcatgaggcaggcgggcttactcgcagtgatggcccagatggggtgctatgtgccagcagaggtttgcagactcaccccgatagatagagtgtttactaggctgggggcgagcgacagaatcatgtctggggagtcaacatttttcgtggagctttcagaaacagcatccatcttgatgcatgctactgcccacagcctcgttctggttgatgaactgggcagaggcacagcaacatttgatggcacagctatcgccaacgcggtggtgaaagagttggcagaaactatcaaatgtcgtactttgttttccacacactaccacatatcccggcggttgttcagcaagtgttgctgtttagggcatatggcttgcatggtggaaaacgaatgtgaagatccttctcaggagactataacatttctatataaatttatcaagggtgcctgccctaagtcctacgggtttaatgcagctcggctggcaaatcttccagaagaggttatacagaaaggccatcggaaggctcgcgagtttgagaaaatgaatcagtcattgagactgtttagggaagtctgtctcgcctccgaacggagcaccgtcgatgccgaggccgtgcacaagctcctgacccttatcaaggagctgtag

SEQ ID NO: 25130 - DNA, 3201 bp, Artificial Sequence
  Description of Artificial Sequence: Synthetic coding sequence
atgagccggcagagcaccctgtacagcttcttccccaagagccccgcgttgtctgacgctaataaggcctctgcaagagctagccgagaaggcgggagggccgcttgccctagaggtctgagcttcccaaggagaggatgcgggcttgagagaggctgggcgtggaggccactcgcaaggtcagccagccctcccaaagccaagaacctgaatggggggctccgaagatctgtggcccctgccgcaccaactagttgtgacttctcccctggggatcttgtctgggctaaaatggaaggatacccctggtggccctgccttgtgtataatcaccccttcgatggtacattcattagggaaaagggtaagagcgtgagggtccacgttcaattcttcgatgactccccaacacgtggctgggtatcgaaaaggttgctcaaaccgtacacgggatccaagtcaaaggaggctcagaagggcggccatttttacagcgctaagccagagatactgagagcaatgcagcgggccgatgaagctttaaataaggataagattaaaaggttggaactggcagtatgtgacgaaccgagcgaacccgaggaagaggaggaaatggaggtgggtacaacttacgtaaccgacaaaagtgaagaagacaatgaaatcgaaagcgaggaggaggttcagccaaaaacgcagggcagccgccgaagctctcggcagatcaagaagagaagagttattagcgattccgagagtgacattggtggctccgacgtggaattcaagcctgataccaaagaagagggaagcagcgacgagatttcttcaggagtgggtgactccgaaagcgaagggttgaatagccccgtcaaagtggccagaaagagaaaacgtatggtgacaggaaacgggtctttgaagcggaagtccagcagaaaggagactccctctgccacaaagcaggccacatccataagttccgaaactaaaaacaccctgagagccttttcagctccccagaactctgaatcacaggcccatgtctctggcggcggcgatgattcttcccgccctaccgtatggtatcacgagaccttagagtggctcaaagaggaaaaaagaagagacgagcatcggcgccggccagaccacccagactttgatgcatccacactgtatgtacctgaggacttcctaaactcatgcacaccggggatgcgaaagtggtggcagataaagtcccagaattttgacctggtgatctgctacaaagtgggaaagttttacgagctgtaccacatggacgctctgatcggcgtaagcgaacttggactggtttttatgaaaggcaactgggcgcatagcgggtttccagagatcgcgttcggcaggtattcagatagccttgttcagaaaggttataaagtagctcgagtcgaacagacggaaactcccgaaatgatggaagcgcggtgtcgcaaaatggctcacatctccaaatacgatcgggtcgtgcggcgcgagatctgccggattattactaagggcacccagacttacagtgttctggaaggggacccctccgaaaattacagcaagtacctgctgagcctgaaagagaaggaggaggacagcagtggtcacacgagggcttacggggtctgctttgttgacacatcacttggcaagttcttcattgggcaattctcagacgacagacattgctctagattcagaaccctagtcgcacactatccacccgtccaggtactgttcgagaagggcaatctctcaaaagagacaaaaaccatcctgaaatcttctctgagttgctcacttcaggaaggcctaataccagggagccagttctgggatgcctccaaaaccctcagaacgttgctggaggaggaatactttagagaaaagcttagtgacgggattggagtaatgcttccgcaggtgctgaagggcatgacaagcgaatctgacagcattggtctgactcccggagagaagagcgaactggcactgtcagccttggggggttgcgtattctaccttaaaaaatgtctgattgaccaggagctgttgtccatggcgaatttcgaggaatacataccactggattcggacaccgtgtccactacccgctccggggcgatttttaccaaggcctatcaaaggatggttcttgacgctgtgacactcaacaacctggagatctttctgaatggaactaatgggagcacagagggaacactgctggaacgcgtggatacctgccatacaccctttgggaaacggctgctgaagcagtggctttgtgctccactctgtaatcactatgctattaacgatagactcgatgcaattgaagacctaatggtcgtgccggacaagatttcagaggtcgtggagctgttgaagaagctgccagatctggagcgtctgctgtccaagattcacaatgtcggatccccactaaagtcccaaaaccatcctgatagtcgagccattatgtatgaagaaacaacctacagtaaaaagaagatcatcgactttctatcagctttggagggcttcaaggtgatgtgcaagatcatcggcatcatggaagaagtggccgatggctttaaaagcaagattctcaagcaggtcatttcccttcagacaaagaatccggaagggcggttccccgatctaactgtcgagctgaacaggtgggataccgcctttgatcacgagaaagcccggaaaaccggcctgattacccccaaggccggcttcgactcagattacgaccaggcactcgcagacatacgtgagaatgagcaatcacttcttgagtatctggagaaacagcgaaatcgcatcggctgtaggactatagtctactggggaatcggcaggaacagataccagcttgagatccccgagaactttacaacccggaacctgcctgaggaatacgaactaaagtctacaaagaaaggttgcaaacgctactggaccaagaccattgagaaaaaattggcaaatctaattaacgctgaggaacgcagagatgtatccctcaaggattgcatgcgtcgccttttctacaacttcgacaagaactataaagattggcagtccgccgtggaatgcattgcagtccttggtaaaaccttgaacaaattggtcttgcggctgtag

SEQ ID NO: 25131 - DNA, 1569 bp, Artificial Sequence
  Description of Artificial Sequence: Synthetic coding sequence
atgcggaagccccgggccgccgtgggcagcggccaccggaagcaggctgcctcgcaagaaggaagacagaagcacgcaaaaaacaattcgcaggcaaaaccgtccgcctgtgatgcaggtctcgctcgccaacctgaggaggttgtacttcaggcctccgtgagctcttatcatctgtttcgtgacgtggcggaagtcacagcttttcggggatcactgctgagctggtatgaccaggagaaacgggatctcccttggaggagacgagccgaggatgaaatggatttggacagaagggcttacgccgtctgggtttcagaagtgatgctgcagcagactcaggtcgctactgtgatcaattactatactggatggatgcagaagtggccgaccctacaggatttggcatccgcgtctctggaggaagttaaccagctttgggcagggctgggctactattctaggggcaggaggctgcaagagggtgctcgaaaggtagtcgaagagctggggggccacatgcctcgaaccgcggaaaccctgcaacagcttctacccggggtgggaaggtacaccgccggggccattgcaagcattgcctttggacaagctaccggtgtagtggatggcaatgtggctcgtgttttatgtagagtgagagcgattggagcagaccctagtagtacccttgtcagtcaacagctttggggcctcgcacagcaacttgtggatccagccaggcccggtgacttcaaccaagccgccatggaacttggcgctaccgtatgtaccccccaacgacccctgtgctcccaatgcccggttgaaagtctctgtagggctcggcaacgcgtcgaacaggagcagttgctggccagcggctccctgtccggcagccccgacgtagaagaatgtgcgcctaacaccggacaatgtcacctgtgtttgccaccttctgaaccttgggatcagacattaggagtggtgaacttccccagaaaagcctctagaaaacctccccgggaggagtcctctgctacttgcgtgctcgaacagccaggagcactgggtgcccagatactactcgtgcaacggcccaactctggtcttctggccggtctatgggagtttcctagcgttacttgggagccttccgaacagttgcaacggaaagccttgttgcaggagctgcaacgctgggctggacccctaccagcaacccatctgaggcacctcggtgaggttgtgcatactttctcccacattaaacttacatatcaggtgtatgggctggctctggaaggtcagaccccggtgaccacggttccccccggagctaggtggctgacacaagaggaattccacaccgcggccgtcagtactgccatgaaaaaggtgttcagagtctatcaggggcagcagcccggcacttgcatgggaagcaaacgtagtcaggtatcctcgccctgtagtcggaagaagccgaggatgggccaacaggtcttggataactttttcaggagccacatcagtaccgacgcccactcgttgaacagcgccgcacaatag

SEQ ID NO: 25132 - DNA, 1566 bp, Artificial Sequence
  Description of Artificial Sequence: Synthetic coding sequence
atgcggaagccccgggccgccgtgggcagcggccaccggaagcaggccgcgagccaggaagggaggcaaaaacatgcaaagaacaattcccaagcgaagcctagtgcctgcgacggtctcgccagacaacccgaggaagtggtgctccaggcctctgtgtcatcttaccatctctttcgggatgtggccgaagtgactgccttccgggggtccttgctcagctggtacgaccaggaaaagcgagatctcccatggcgccggagggcagaggatgaaatggatctggatcgtagagcctatgccgtgtgggtcagtgaggtgatgctccagcagacgcaggtggccaccgtgattaactactataccggatggatgcaaaagtggccaactctgcaggacctcgcatctgcctctcttgaggaagtgaaccagctttgggccggactcggatactacagccgaggaagacgcctacaggagggggccagaaaagtggtcgaggagctggggggtcacatgcctcgaacagccgagacgctgcaacagctgctgcctggggtgggcagatacactgccggggccattgcctctatagcctttggtcaggccacaggggtggtcgacggcaacgtggctagggtgctctgcagggtcagagccatcggtgcagatccgagctcaacactcgtgtcccagcaactttggggactcgcgcaacaattggtcgaccccgcccggcccggcgattttaatcaagcagcgatggagctgggagctacggtgtgcacgccacaacgacccctgtgctcacagtgccccgtagaatccttgtgtagggctagacagcgtgtcgagcaggagcagctgctggccagcggtagcttgtctggatcccctgatgtcgaagagtgtgccccaaacaccggacagtgtcacctctgtcttccaccatctgagccctgggaccaaactctaggggttgtcaactttccccgtaaggccagccggaaacccccccgcgaggaatccagtgctacttgcgtcctggagcagccaggtgctctcggtgctcaaatcttactagtgcagcgtcctaacagtggactcctggccggattgtgggagtttccctccgtcacttgggagcccagcgagcagctgcagagaaaagccttgctgcaggagttacagcgatgggccgggccactacccgccacacatctcaggcatctaggagaggttgtacatacgtttagtcacataaaacttacatatcaggtttacggtctggctcttgagggacagacaccagttaccactgtcccgcccggagcccgatggctgacccaagaagagttccacacagccgcagtctcgacagcaatgaagaaagtcttcagagtgtaccaggggcagcagccaggcacatgcatggggtcgaaaaggtcccaagtctcttctccctgttctcgcaaaaagcctcggatgggccaacaggtcctggataacttcttccgatcccatatttctacagatgcgcattcactgaatagtgcagcccagtag

SEQ ID NO: 25133 - DNA, 1641 bp, Artificial Sequence
  Description of Artificial Sequence: Synthetic coding sequence
atgacccccctggtgagccggctgagccggctgtgggccatcatgagaaaacccagagctgctgtgggctccggccaccgtaagcaggctgcatcacaggaggggaggcagaaacacgccaaaaacaacagtcaggctaagccttcagcctgtgatggcatgattgctgaatgccccggcgccccagccgggctggcccgtcagccagaagaggtagtattacaagccagtgtgagctcttaccacctcttccgggacgtggcggaggtgactgccttcaggggcagcctgctctcctggtacgaccaggaaaagagagacctgccttggagaagacgagctgaggacgagatggaccttgatcgcagggcttatgctgtctgggtatcggaagtcatgctgcaacaaactcaggtggcaaccgtgattaactactacacgggttggatgcagaagtggccaactctgcaagaccttgccagcgcgtctctggaggaggtgaaccagctctgggctgggttgggatattactctagaggtcgacggctacaggaaggagccaggaaggtggttgaggaactgggcggacacatgccccggaccgctgagaccttgcagcaacttttgcctggagtgggacgctacacagcgggtgcaatcgccagtatcgcttttggccaggcgacaggggttgttgacggcaacgtggcccgggtgctatgccgtgtcagggcgatcggggccgatccaagctccactctcgtcagccaacagttatggggcctggctcaacagctggttgacccagccaggccaggggattttaaccaagcagccatggagttgggcgccacggtctgcaccccgcagaggcccttgtgttcacagtgccctgtggagagtctgtgtcgtgcccggcagcgggtggagcaggaacagctcctcgctagcggaagcttgtccggctctccagacgtggaagagtgcgcgcccaacaccggacagtgccacctgtgtttaccaccttccgaaccttgggaccagactttgggcgtggtaaatttcccacgcaaagcttcaaggaagcccccgcgggaagagagttctgccacgtgtgtgttggagcagccgggggccctcggtgcacagatacttctggtacaacggccaaatagtggcctgctggctggcctctgggaatttccaagcgtaacctgggaacctagcgagcagctgcagcggaaagctctgttgcaggagctgcagcgctgggcaggccctctgccagccacccacttacggcacttgggggaggtggttcatactttcagccatatcaagttaacctaccaggtttatgggctcgcactggaaggccaaacacccgtcacaactgtccccccaggagctcggtggctgactcaggaggagtttcataccgccgctgtgtcgactgcgatgaagaaggtgtttagggtttaccaagggcagcagcccggcacttgcatgggctctaaaagatcccaggtgagctcaccttgcagtcgaaagaaacctagaatgggacaacaagtgttggacaacttcttccgcagccacataagcactgacgcgcatagcctcaactctgccgcacagtag

SEQ ID NO: 25134 - DNA, 1599 bp, Artificial Sequence
  Description of Artificial Sequence: Synthetic coding sequence
atgcggaagccccgggccgccgtgggcagcggccaccggaagcaggccgcttcacaagaaggccgacaaaagcatgcgaagaacaatagccaggccaagccatccgcatgcgatggcatgattgccgagtgccccggcgcgcccgccggccttgccagacagccagaagaagtggtgctccaggcaagcgtctctagttaccaccttttccgtgacgtcgctgaggtcacggcattccgcggctcactcctcagctggtatgatcaggagaagagagacctgccttggaggagaagagctgaggacgaaatggatttagatcgtagggcctatgccgtgtgggtgagtgaagtcatgctgcagcagacccaggtggcaacagtgataaattattacacagggtggatgcagaagtggcccactttgcaggacctggcctctgcatctttggaggaagttaaccagctgtgggcgggactggggtactactcaagagggagacgcctgcaggagggcgcccggaaggtggtagaggagcttggaggacacatgcctcgcacagccgagacgctgcaacaactgctcccaggggtgggcaggtacactgctggagccattgcctcgatagcattcggccaggcgacgggagtagtggatgggaacgtggccagggtactgtgcagggttcgggccattggcgccgacccgagctccacacttgtgagccaacagttgtggggcctggctcagcaactcgtagaccccgcacgtccaggtgatttcaatcaggctgctatggagttgggggctactgtatgtaccccccagaggcccctctgcagccagtgccctgtagaaagtctctgtagggccaggcagcgtgttgaacaggaacaactgctcgcctctggaagcctctcaggcagcccagacgtcgaagagtgcgctcccaacacagggcaatgccatctctgcctgccgccctctgagccatgggaccagacattgggcgtcgttaatttcccacggaaggcatctcgcaaaccacctagggaagaaagctctgccacctgtgtgctggagcagcccggagccctcggagctcaaatcctcctcgtgcagcgcccaaatagcggcttgctggcaggcctctgggaattcccttcggttacatgggagccgagtgaacagcttcagaggaaagctctgctccaggagctgcagaggtgggcaggccccctccccgcgacccatctccgccatctcggagaggttgtgcatacctttagccacataaaattgacatatcaggtgtacggcttagccctggagggacaaacacctgtcaccaccgtccccccaggagcacggtggctgactcaggaggaattccatacagcagccgtgtccacagccatgaaaaaggtgttccgtgtgtatcagggccagcagcccggaacttgcatgggatccaaaagatcccaagtgagcagcccctgtagcagaaagaaaccgagaatgggccagcaggtgctcgataactttttccggtctcacatctcaacagacgcccatagcctgaacagcgccgctcaatag

SEQ ID NO: 25135 - DNA, 1566 bp, Artificial Sequence
  Description of Artificial Sequence: Synthetic coding sequence
atgcggaagccccgggccgccgtgggcagcggccaccggaagcaggctgcttcccaggaaggaagacagaaacacgcaaaaaataattctcaagctaagccgagcgcttgcgacggtcttgctcggcagcctgaggaggttgtgctgcaggcttctgtttcttcataccacctcttcagggacgtggccgaggtgacagcattcaggggctccctgttgtcctggtatgaccaggagaagcgcgacttgccatggagaagacgggccgaagacgaaatggacttggaccgccgcgcttacgcggtgtgggtttctgaagtgatgttacaacagacacaagtggccaccgtcattaattattatacaggctggatgcagaagtggcccaccctgcaggatctggccagtgcatcactcgaggaggtcaatcagctttgggccggactgggatattactctcgagggcgtaggcttcaagagggtgccagaaaggtggtcgaggagctgggaggccacatgcccagaacagccgaaaccttacagcagctgctgccgggtgtcgggcgctacaccgcaggcgcaatcgcgtccatcgctttcggtcaagcaactggcgtggtggacggcaacgtggccagggtcctctgtagggttagagccattggagccgatcctagttcaacccttgtctctcaacaactgtgggggctcgcccagcagttggtagatcctgccaggccaggggatttcaaccaagccgctatggagttgggagcaacagtttgtacccctcagcgacccctgtgctcacagtgtccagtagagtcactgtgtagggccagacagagagtggagcaagagcaactattggccagcggctctctttcagggtcacctgacgtcgaggagtgcgcccctaacacaggacagtgccacctctgtctgccaccatctgaaccatgggatcagacattgggtgtcgtcaacttcccaaggaaagcaagtcgcaagccaccccgcgaggagtcctcggcaacctgcgtgctcgaacagcccggcgccctgggagctcagatcctcttggtgcaaaggcccaattctggcctacttgccgggttatgggaatttccctcagttacttgggaaccctccgagcagttgcaaagaaaggcattactgcaggaattacaacggtgggccgggcccttgccggctacccatcttaggcatttaggagaggtagtgcacaccttttctcatatcaaattgacctaccaggtctacgggcttgctctcgagggacagaccccagtgactacagtgccccccggggcaaggtggcttacccaagaggagttccacacagccgctgtgtcaacagccatgaagaaggtattccgcgtgtatcaggggcagcagccagggacctgcatgggaagcaagcggagccaggtctctagcccctgtagcaggaagaagcctcgtatgggtcagcaggtgctcgataactttttccgaagccatatatccacagacgcacactccctcaactcagcagcacaatag

SEQ ID NO: 25136 - DNA, 1611 bp, Artificial Sequence
  Description of Artificial Sequence: Synthetic coding sequence
atgacccccctggtgagccggctgagccggctgtgggccatcatgcgcaaaccacgggccgcagttggctccgggcatagaaagcaagccgcatctcaggagggccgccagaagcatgccaaaaataatagccaggccaaacctagcgcctgcgatgcaggtctggcccggcagcctgaagaggtcgtgctgcaggccagtgtgtcatcataccacctattcagggatgtagctgaggtcaccgcatttcggggttccctgcttagctggtatgaccaggagaagcgcgacttgccgtggcgccggcgcgccgaggacgaaatggatcttgatagaagagcctatgccgtctgggtatctgaggtaatgctacagcagacccaagtagcgaccgtcattaactattacaccggctggatgcagaagtggcctacgttgcaggaccttgccagcgccagcttggaggaggtaaatcagctgtgggccggcctcgggtactattctcggggcaggagattacaggagggcgcgcgcaaggtggtggaagagttaggcggtcatatgcctcgaacagccgaaacgctccagcagctcttgccaggcgtggggagatacacagctggcgccatcgcctctatcgcttttggtcaggcaacaggagtcgtggacggcaacgttgcacgggtgctctgtcgggtgagagcaatcggcgctgaccccagtagcacattggtgtcccaacaattatggggcctcgcgcaacagctggtggatccagcccgaccaggtgacttcaaccaggccgccatggagctgggggctaccgtgtgcacaccccagcgcccactatgcagtcagtgtcctgtggagagtctctgccgcgcacgtcaacgcgttgagcaggaacagctgcttgcttccggcagcttgtctggatcgccagatgtggaagaatgcgcccctaatacagggcagtgccatttatgcctgcctccgtccgaaccttgggatcagactctgggggttgtgaactttcctagaaaggccagcagaaagcccccgagggaggaatccagcgcaacttgtgttctcgagcagcctggcgctctcggggctcagattctgcttgttcagcgaccgaattcagggctactggccggtctctgggagttccccagtgttacctgggaacctagcgaacagcttcaaaggaaagctctcctgcaggagctacaacgatgggccggacccctccctgcaacgcatctcagacacttaggcgaagtggtgcatacattctctcacatcaagctcacataccaagtgtatggtctggccctagaaggacagaccccagtcacaacggtgccccccggagcccggtggctgactcaggaggaattccatactgcagccgtctccaccgctatgaaaaaagtgttccgggtgtaccaaggccagcagcccggaacatgcatgggctccaagaggtctcaggtttcttcgccttgctcgaggaaaaaacctcgcatgggtcaacaggtgctcgacaacttcttccgaagccacatctcgaccgacgcccactccctgaattccgccgctcagtag

SEQ ID NO: 25137 - DNA, 1608 bp, Artificial Sequence
  Description of Artificial Sequence: Synthetic coding sequence
atgacccccctggtgagccggctgagccggctgtgggccatcatgaggaagccacgcgccgctgttggaagcggccatcgcaaacaggccgcttcccaggaggggaggcagaaacacgcgaagaacaactcacaggccaaaccaagcgcatgcgacggacttgcccgccagccggaggaagtggtattacaggcttccgtttcaagctatcacttgttccgcgatgtagccgaggtgacggcctttagaggttcgctgctgtcttggtatgatcaagagaagagagatttgccttggaggaggcgagcggaggacgaaatggacttggatcgacgggcttacgccgtctgggttagcgaagtcatgctacagcaaacacaggtggcaactgtcataaactactacaccggttggatgcagaaatggccgactttacaggatcttgcttcagcctcacttgaggaggtgaatcagctctgggccgggctaggttattattctcgaggccgtaggctacaagagggtgcgcggaaagttgtcgaggagttggggggacatatgccaagaacagccgagacactgcagcagctgttgccaggagtgggaaggtatacagccggcgctattgcatcaatagccttcggtcaggccacaggcgttgtggatggcaacgtggcccgagtgttgtgccgggttcgggccataggcgcagatcccagttctaccctggtgtcccagcagctgtgggggctagcacagcaactggtggatcctgcccgtccaggtgatttcaatcaggccgcaatggaactgggagccacggtttgcaccccacaacggcccttgtgttctcagtgccccgttgagagtttgtgccgcgctaggcagagggtggagcaggaacagctcctggcctcaggtagcctgagtggctcccccgatgtagaggaatgtgcccccaatacgggccaatgtcatctgtgcctgcccccttccgagccatgggatcaaactctgggcgtggtgaacttcccccggaaagccagcaggaaacccccaagggaagagtcttccgccacatgtgtgctcgagcagcccggcgctctcggggcccagatcttgctcgttcaacgacctaatagcggcctactggccggtctctgggaattcccctctgtaacctgggaacccagcgagcagctgcagcgcaaggccctcctgcaggaacttcagcgttgggccggccctctgccggccacccacctgcggcatctcggagaggtggtgcacacttttagccatatcaaactgacctaccaggtgtacgggttggctttggagggccagaccccggtaacaactgttcctcctggcgcgaggtggctcacccaggaagaattccacaccgcggccgtctcaaccgccatgaagaaggtgttccgggtctaccaggggcagcagcccggcacatgcatgggatcgaagagaagtcaagtcagcagtccatgctctcgaaaaaagcctcgcatgggtcagcaggtgttggacaatttctttagatcacacataagcacagacgcgcacagtttgaatagcgcggcccagtag

SEQ ID NO: 25138 - DNA, 876 bp, Artificial Sequence
  Description of Artificial Sequence: Synthetic coding sequence
atgcggaagccccgggccgccgtgggcagcggccaccggaagcaggccgcgtcgcaggagggtcggcagaaacacgccaagaataatagtcaagcaaaaccttctgcttgtgacggcatgattgccgagtgtcccggcgccccagccggactagccaggcaacctgaggaggtagtgctgcaggcttctgtgtcaagctaccatctatttcgggatgttgcagaggtgacggcttttcgcggcagtttactttcctggtacgatcaagaaaagagagatctgccctggaggcgtcgcgcggaggatgaaatggatctggatcgacgcgcatatgccgtgtgggtgagcgaggtcatgctgcagcagacacaggttgccaccgtcataaattattatactgggtggatgcagaagtggcctacgttacaggatctggcgtccgccagccttgaggaggtcaaccaactgtgggcaggtttaggttactactctcgcgggagacgcctgcaggagggggcccgaaaagtagttgaggagttggggggacacatgccaagaactgcagagacactgcagcaattgctgcctggcgtggggcggtacactgctggggccatagcatccattgcttttggccaagccacaggcgtggtcgacggcaatgtggcgagagtgctctgtcgcgtaagagcaatcggagccgatccttctagcaccttggtaagccaacaactatggggactggcccagcagctcgtggatcccgctcgacccggggacttcaatcaggctgctatggagctgggcgcaaccgtgtgtacaccacagcgccccctgtgctcccaatgtccagtggagtcattatgccgagcctag

SEQ ID NO: 25139 - DNA, 1599 bp, Artificial Sequence
  Description of Artificial Sequence: Synthetic coding sequence
atgcggaagccccgggccgccgtgggcagcggccaccggaagcaggcagcctcccaggagggaagacaaaagcatgccaagaacaacagtcaggctaagcctagtgcctgtgatggaatgattgccgagtgtccaggggctccagctggtctggcaaggcagccggaggaagtggtcctgcaggctagtgtaagttcataccacttattccgcgacgttgcagaagtcactgcttttagaggcagcctgctcagctggtacgaccaggagaaacgggaccttccctggaggcggcgggccgaagatgaaatggatcttgacaggagggcttacgcagtctgggtgtccgaagttatgctgcaacagactcaggtcgcaacggtaattaattactatacaggatggatgcaaaagtggcctactctgcaggatctggcatctgcatctcttgaggaagtgaaccagctgtgggctggtctgggctactattctaggggcagaaggctgcaggagggcgcaaggaaggtcgtggaagaactcggaggccatatgccaagaacagccgagacactgcaacagttgctgccaggcgtggggaggtacactgcgggagcaatcgcgagtatagccttcggacaagccacaggcgttgtggatggcaacgttgctagggtgctttgtagggtccgggcaattggcgcggacccctcctcaacactggtgagtcagcaactgtggggactggcccagcagttggtggacccagccaggcctggagatttcaaccaggctgccatggagctcggcgcaacagtctgcactcctcagcgtccactgtgttctcagtgcccagtggagagcctgtgcagagcgaggcagagggtcgaacaggagcagttactggccagtggaagtctatccggcagccccgacgtggaggagtgtgctcctaacactgggcaatgccacctatgtcttcctccatctgagccctgggatcagacgctgggggttgtgaatttcccacgcaaggcttctcggaagcctcccagagaagagtcctccgccacctgtgttctggaacaacccggcgcactgggggcgcagattctgctggtgcagcgaccgaattccggcctgttagctggcctgtgggaatttccgtctgtaacctgggagccaagtgagcagctgcagcggaaagcgctactgcaggaactgcagagatgggctggtcctctccctgccacacacctgaggcacctgggggaggtcgttcacactttcagccacataaagctcacttaccaagtgtacggcctggccctggaaggccagacccctgtgaccacagtaccccccggagccaggtggctgacacaagaggagtttcacaccgctgctgtgagtacagccatgaagaaagtcttccgggtctatcagggacagcagcctggaacttgtatgggaagtaaaaggagtcaggtgagcagcccctgcagcagaaaaaagcctagaatggggcagcaggtgctagataacttcttcaggtcacatattagcactgacgcacattcccttaatagtgctgcgcagtag

SEQ ID NO: 25140 - DNA, 1650 bp, Artificial Sequence
  Description of Artificial Sequence: Synthetic coding sequence
atgacccccctggtgagccggctgagccggctgtgggccatcatgaggaagccccgggcagccgtgggctcaggtcaccgaaagcaggcagcctcacaagagggacggcagaagcacgccaaaaataacagccaagccaaaccctccgcctgcgacgcctgtgccggaatgatcgctgagtgtcccggagcccctgctggccttgcccgacagcccgaggaagtagttctccaggctagcgtgtcctcttaccacttgtttagagacgtcgccgaggtcactgcattccgaggcagtctactcagttggtacgaccaggaaaaaagagatcttccatggcgcaggagagccgaggacgagatggacctagaccgtcgtgcctatgcagtatgggttagtgaagtgatgttacaacagactcaagtggcaaccgtaattaactattacaccggctggatgcagaaatggcctaccctgcaggacctcgccagcgctagccttgaggaagtcaaccagctttgggctgggttgggctactactcacgaggaagacgcctacaggagggagccagaaaggtggttgaagagttagggggtcacatgccacggaccgccgaaactctccaacagctgctgcccggtgtgggcagatataccgctggcgccatagcatcaatcgcatttggtcaggccaccggcgtggtggacggcaacgtggcaagggtgctgtgtcgtgtccgggccattggtgccgacccttcaagcacgctcgtaagtcagcagttgtggggcctagctcagcagctagtggaccctgcgcgaccaggtgactttaaccaggctgctatggagctgggtgccacagtgtgcacaccacaacgacctctgtgcagccagtgtcctgtcgagtcgctgtgtcgcgctagacagcgggtggaacaagagcagctgcttgcaagcgggagcctgtctggaagccctgatgtggaggagtgcgcaccaaataccgggcagtgccatttgtgccttccaccttctgagccttgggatcagactctgggcgtcgtgaacttcccgaggaaggctagtcggaaacccccaagagaagaatcaagcgcgacttgcgtgctcgagcaacccggcgcactgggagctcaaattctgctggtccagcgacctaactctggcctcttggcaggcctatgggagttccccagcgtgacatgggagccgagcgaacagctgcagcgcaaagcgctactgcaggaactgcagcgatgggccgggcccctgccggcaacccacctgagacacctcggagaggtcgtccacacttttagccacataaagcttacctaccaggtgtacggactggccctggaaggccagacacccgtgaccactgttccacccggagcccgctggttgacccaggaagagttccacactgcagctgtatctaccgcaatgaaaaaggtgtttcgggtatatcaaggacaacaacccggaacctgtatgggatccaagcggtcccaggtctcatctccttgttctaggaagaaacccagaatggggcagcaggtgttagacaacttcttccggagtcatatttccaccgatgcccacagcctgaactccgcggcccagtag

SEQ ID NO: 25141 - DNA, 1566 bp, Artificial Sequence
  Description of Artificial Sequence: Synthetic coding sequence
atgcggaagccccgggccgccgtgggcagcggccaccggaagcaggcagcctcccaggaaggccgacagaagcacgccaaaaataacagccaggccaaaccctccgcttgtgatggcctagctaggcaacctgaggaagttgtcctacaggcgtccgtgtcttcctaccacttgtttagggatgtagcagaagtgaccgccttcaggggcagtctactcagctggtatgaccaagagaagagggatctgccctggcggaggcgggccgaagacgagatggatctggacagacgcgcttacgccgtctgggtgagcgaggtgatgctacagcaaacccaggttgcaaccgtcatcaactattacaccggctggatgcagaagtggcctaccctgcaggatctagcttccgccagcctcgaagaggtgaatcaactctgggcggggctcggttactacagccgcgggagacggcttcaggagggcgcaagaaaggtggtggaggagctaggggggcacatgccaaggaccgccgaaaccctgcaacagctactgcctggagtcggtcgatacaccgctggcgcaattgccagcattgccttcgggcaggctacaggagtagtcgatggtaacgtcgcacgggtactgtgcagagtccgggccatcggagcggatcctagctctacactggtaagccagcagctgtggggcctggcacaacagcttgtggatcccgcccggccaggcgacttcaatcaggccgccatggagttgggagccaccgtgtgtaccccacagaggcccctctgcagccagtgccccgttgagtctttatgccgcgctcgccagagagtcgagcaagaacagctccttgcctccggttcgctttctggcagccccgatgtggaggagtgtgcaccgaataccgggcaatgccacctgtgtctccctccatccgagccctgggatcaaaccctgggcgtggtgaatttcccacgcaaggcttccagaaagccaccccgcgaggaatcaagcgctacttgcgtgcttgagcagccaggagccctgggcgctcagatcctacttgtccagcgcccaaactctggccttctggctggcctttgggagttcccaagcgtgacttgggagccatctgagcagctgcagagaaaggctctactgcaggagctgcagcgctgggctgggccgctgcccgctactcatctacggcacctgggagaggttgtccataccttttctcacataaagctgacatatcaagtgtacggtcttgctctcgagggccagacacccgtgactactgtcccgcccggggccaggtggcttactcaggaggaattccacaccgcagctgtgagtaccgccatgaagaaagtgtttcgcgtttatcaggggcagcagccaggaacatgcatgggcagcaagcggagtcaagtttctagcccctgttcacggaagaagccccgcatgggccaacaggtgctggacaactttttccgctcccacatttctaccgatgctcactcactgaattctgcagcccagtag

SEQ ID NO: 25142 - DNA, 648 bp, Artificial Sequence
  Description of Artificial Sequence: Synthetic coding sequence
atgacccccctggtgagccggctgagccggctgtgggaggtgaaccaactctgggccggactgggatattacagcagagggagaagactgcaggaaggggcccgcaaagtggtggaggagttaggagggcatatgcctcggacggccgagaccctccagcagctgctgcccggagtcggtaggtatacggccggagccattgctagtatcgcattcgggcaggctaccggagtggtggatgggaacgtcgctcgagtgttatgccgagtccgcgctatcggtgcagacccatcatcaactctggtctcgcagcagctttggggactcgctcagcagctcgttgaccccgctcgccccggcgactttaaccaagcagccatggaattgggggccacagtgtgcaccccacagagacctctgtgctcccagtgtcctgtagaaagcctctgtagagcccgccagcgcgtggagcaagaacagctgctggccagcggctcactgagcgggtcccccgatgtggaagagtgtgccccaaacaccggacagtgccatctctgtttgcccccaagcgagccctgggaccagactctcggcgtggtgaattttccccggaaggctagcagaaagcctcctcgagaggagtcgtag

SEQ ID NO: 25143 - DNA, 693 bp, Artificial Sequence
  Description of Artificial Sequence: Synthetic coding sequence
atgacccccctggtgagccggctgagccggctgtgggccatcatgaggaaaccacgcgccgccgtgggctccgggcatcgcaagcaggccgccagccaggaaggaaggcagaagcatgcgaagaataacagccaggcgaagccatcggcctgcgacgggggggaaagcacgctgggttggcctggactgctctttagctggcccgcggccgccggaggaagtagcgaaggactcttggccggcctctgggaattccctagcgtgacgtgggaaccgtccgagcagcttcagcgcaaagccctgttgcaagaattgcagcgttgggcagggccgttacctgcgacccacttgcgccatttaggagaggttgtccataccttttctcatattaagctcacatatcaggtgtacgggttagccctggaaggccaaactcccgttactaccgtcccccctggggctcgttggctaacacaggaagagttccacacggctgccgtgtccacggctatgaagaaggtctttagggtgtatcaaggccagcagcccgggacttgtatgggctccaaaagaagccaagttagtagtccgtgtagccgtaagaaacccaggatgggccagcaagttctggataacttcttccggtctcatatttccaccgacgcccattccctgaacagcgccgcacagtag

SEQ ID NO: 25144 - DNA, 291 bp, Artificial Sequence
  Description of Artificial Sequence: Synthetic coding sequence
atgagcgacaacgacgacatcgaggtggagagcgacgaggagcagccacggttccaatccgcagccgacaaacgcgcacatcacaacgcccttgaacggaaaaggagggaccacatcaaagactcctttcatagccttcgcgactctgtcccctctcttcaaggcgagaaactgtatttcctgttttggaagctctgcacgcctgtccttcacagacagtccctcatgcagaaatgccacacgttcatctccagctatcaggttcacaagaagaaggagtgtaaaatctag

SEQ ID NO: 25145 - DNA, 405 bp, Artificial Sequence
  Description of Artificial Sequence: Synthetic coding sequence
atgagcgacaacgacgacatcgaggtggagagcgacgaggagcagccacggtttcagagcgcagctgataaaagagctcatcataacgccttggagcgcaaacgacgtgatcatatcaaggattcgttccacagcctaagagacagcgtgccttcgctacagggggagaaggcttcacgggctcagatcctggataaggctaccgagtatattcagtacatgcggagaaagaatcacacacaccagcaagacattgatgacttaaagcggcagaacgcgctcctggaacagcagggggagcacccatcctcctggggatcctggccctgttgtgccccagccagatcagggtttggcacctgggcgtgcagggtgcgcgcctcccacggagtctgtgcacagtag

SEQ ID NO: 25146 - DNA, 252 bp, Artificial Sequence
  Description of Artificial Sequence: Synthetic coding sequence
atgagcgacaacgacgacatcgaggtggagagcgacgaggagcagccccgattccagtctgccgctgataaacgcgcacaccacaatgccctggaacgcaaaaggcgggaccacattaaggactcgttccactctcttcgcgactcagtgccttcgctccaaggcgagaagggtacaaagatgaagctcactctaccacctgtctttccatacgaacacttacctttccctacggtgttttgtcatggctag

SEQ ID NO: 25147 - DNA, 456 bp, Artificial Sequence
  Description of Artificial Sequence: Synthetic coding sequence
atgagcgacaacgacgacatcgaggtggagagcgacgccgacaagcgagcccatcataacgctctggagagaaagagacgcgaccatataaaagactccttccactctcttcgggattcagttcccagcctgcaaggcgaaaaggcgtctagagctcagattctcgataaggccacagagtatattcaatatatgagaagaaaaaaccatactcaccagcaggatattgacgatttaaagagacaaaacgcgctcctggaacaacaagtcagggccctcgaaaaagctcgttcctccgcgcagctccagactaattacccctcctctgacaatagtttgtacactaacgctaaggggagcacaatctcagccttcgacggcggctctgacagcagcagcgaaagcgaaccggaggagccgcaatcaagaaagaaactgcgcatggaagcctcctag

SEQ ID NO: 25148 - DNA, 483 bp, Artificial Sequence
  Description of Artificial Sequence: Synthetic coding sequence
atgagcgacaacgacgacatcgaggtggagagcgacgaggagcagccccgattccaaagcgctgccgacaagagggcccaccataacgccctcgagaggaaaagacgggatcatataaaagactctttccacagcttacgggattcggttccttcattacagggggaaaaggcatcgcgggcccaaatattggacaaagctacagaatatattcagtatatgaggcgaaagaaccacactcatcaacaagacattgatgatctcaaacgccagaacgccctgctcgagcagcaagtacgggctctggagaaagcccggagctccgctcagttgcagactaactatcccagctccgacaatagcctgtacactaacgctaaaggaagtaccatcagcgcctttgatggcggatccgattcttcctccgagagcgagccggaggagcctcagagtcggaagaagctcagaatggaggcatcctag

SEQ ID NO: 25149 - DNA, 426 bp, Artificial Sequence
  Description of Artificial Sequence: Synthetic coding sequence
atgctgagcgtgaagatcaccagcatcttcagcatcttcttcttcctcctcttccaggaagagcagccaagattccagtcagcagctgataagagggctcatcataacgcgctcgaacgtaaacgacgcgaccacattaaggacagcttccatagcctgcgggactctgtcccctcactgcagggagaaaaggcctccagagcccagatcctggacaaggccactgaatatatccagtatatgagacgcaagaaccatactcaccagcaagatatcgacgatctaaagcgtcaaaacgccctgctggagcagcagggggagcacccaagtagctggggctcatggccttgttgtgccccagctaggtcagggttcggcacctgggcttgccgtgtgcgagcttcacacggggtatgcgcccagtag

SEQ ID NO: 25150 - DNA, 312 bp, Artificial Sequence
  Description of Artificial Sequence: Synthetic coding sequence
atgagcgacaacgacgacatcgaggtggagagcgacgaggagcagccccggtttcagagcgccgctgacaagcgagcccaccacaacgcattggagcgaaaacgccgcgatcatatcaaggatagctttcactccctgagagactccgtcccgtccctgcagggtgaaaaggcgtcaagggcacagattttagataaagcaactgaatacattcagtatatgcgccgaaagaaccacacccaccagcaggacatagacgaccttaagcgacaaaacgcccttctcgagcaacagggggaatctgaatcatag

SEQ ID NO: 25151 - DNA, 312 bp, Artificial Sequence
  Description of Artificial Sequence: Synthetic coding sequence
atgagcgacaacgacgacatcgaggtggagagcgacgaggagcagcccaggtttcagtccgctgctgataaaagagctcatcacaacgccctggagcgcaaacgccgagaccacataaaggactccttccacagcctgcgagactctgtccccagcctgcaaggggaaaaagcatcccgggcacaaattttagacaaggctaccgagtatatacaatacatgagaaggaagaatcacacacaccagcaagacatcgacgatttgaaacggcaaaacgcactgctggaacaacagggagagtctgagagctag

SEQ ID NO: 25152 - DNA, 13923 bp, Artificial Sequence
  Description of Artificial Sequence: Synthetic coding sequence
atgcccgtgcccgacggcagcgtggccgccgccggcctgggcctggggttgcctgcagccgacagccggggacactatcaactgctcctttccggacgcgcgctggcagatcggtaccggcgtatatatacagctgccctgaatgacagggaccagggcggtggctcagcggggcatcccgccagccgcaacaaaaaaatcctgaataaaaagaagttgaagagaaaacagaagtcaaaaagtaaggtgaagacacggtcgaagagtgagaatcttgagaacacagtaataatccctgacatcaagttacactcaaacccatctgccttcaatatttactgtaatgtaagacattgcgtccttgagtggcagaagaaggaaatcagcctggcggccgcatctaagaactcagtgcaaagcggcgagtccgacagtgacgaagaagaggaatccaaagaacccccaattaagctccctaaaatcattgaagttggcctgtgcgaggtatttgagctcattaaggagacacgcttctcccatccatcgttgtgccttagatccttacaagcgctgttgaatgttctacagggccaacagcccgagggactgcaaagcgagccaccggaggtgttagaatcattattccagttactattggaaattactgtgaggtccacaggcatgaacgactcgaccggacagagccttacagcccttagctgcgcctgtttattctccttagtggcgtcctggggagagaccggtcggaccctgcaggccataagcgccattctgaccaacaatggcagccacgcttgccaaaccatccaggtccccacaattctgaactcacttcagaggagcgtccaggccgtcctggttggcaaaatccagatccaagattggttctcaaacggtattaaaaaggctgcacttatgcataaatggccgctcaaagagatcagtgtagacgaagatgaccagtgtctcctgcagaatgacggcttttttttgtacctgctgtgcaaggatggcctttacaaaataggatccggctactcagggacagttcggggtcatatctacaacagtacctcacggattcgtaatcgcaaggaaaagaaatcctggctcggttacgcacaaggttatttgctgtaccgtgatgtgaacaatcactcaatgaccgctattcggatctccccggagacgctagagcaggacggtactgtaatgctacctgattgccataccgaaggacagaacatactgttcaccgacggggagtacattaaccagattgccgcttctcgcgacgacggctttgtcgttcggatcttcgccacttctaccgaacctgtgctccagcaggagttgcagctcaaactggcaagaaaatgcctccacgcttgtggcatttcactctttgacctggagaaagatctgcacattatcagtactggattcgacgaggagagcgcaatactcggcgctgggagggagtttgctctgatgaagacagccaacggtaagatttattacacaggcaaatatcagagcctgggcatcaaacagggtggcccctcagctggaaagtgggtagagctgccaataaccaaatcccctaagatcgtccacttcagcgtcggtcacgatggcagccatgccttgctggtcgctgaagacggcagtattttctttaccggtagtgcatctaagggagaggacggcgagtccactaaatcgcgccgtcagtctaaaccctacaaacccaaaaagattattaagatggagggcaaaattgtggtgtataccgcctgtaacaacggcagttcatccgttatatctaaggacggcgaactttacatgtttggtaaggacgcgatttacagtgacagttcatctctagtcactgacctcaagggtcactttgtaactcaggtggcaatggggaaagcccacacctgcgtccttatgaagaacggagaggtatggaccttcggggttaataataagggccagtgcgggcgagatactggagccatgaaccagggcgggaaggggtttggagtagaaaatatggcgaccgccatggatgaggatcttgaggaagaattggatgagaaggacgagaagtcaatgatgtgtcctcctggaatgcacaagtggaagctggaacagtgtatggtatgcacagtttgtggggattgtaccgggtatggggcttcatgcgtgtcctcaggcaggcccgacagagtccctggagggatctgtggctgtgggagtggtgaatcaggctgcgccgtgtgtggatgctgcaaggcctgcgcccgcgagttggatggccaagaggcacgacagagaggcatcctcgacgcagttaaggagatgattcccttggatctgcttctggccgttccagtgcctggcgtgaacatagaggagcatctccagctccggcaagaggagaaacggcagcgtgtgataaggcgccaccggttggaggaagggagaggccctttagtattcgctggacccatctttatgaaccatcgagagcaggcgctagcccgcttgcggagccaccccgcccaactcaaacataagcgggataagcacaaagacggatccggtgaacgtggggagaaggacgcttccaaaatcacgacttatcccccagggtcagtgcggttcgactgcgagctgcgtgcagtgcaggtaagttgtggctttcaccactctgtagtgctaatggaaaacggggatgtatatacatttggctatggtcagcatggtcagcttggccacggcgacgtgaacagcagaggttgtccaacgttggtgcaagccctccctggaccctctacacaggtcacggcaggatctaatcacaccgccgtgctgctgatggacggccaggtgtttacttttgggtcattctctaaaggacaattgggccggccaatactcgatgtcccctattggaatgctaagcccgcccccatgcccaacataggcagtaaatatggcagaaaagctacctggattggcgcgtcgggcgaccagaccttcctgaggattgacgaggcgcttattaattcccacgtgctcgccaccagcgaaatcttcgcgtcaaagcatatcattgggctggtgccggcttccatttctgagcccccaccattcaaatgtttgctcattaataaggtggacggctcctgtaagaccttcaacgatagcgagcaggaggacctccaaggctttggcgtctgcttggaccccgtctatgatgtcatctggagatttcgacctaacaccagggaattatggtgctacaatgctgtggtcgcggacgcacgtttgcccagcgcagctgacatgcagtctcgatgtagtatcctgtcaccggagctggcactgcccaccgggtcaagagcactgaccacgcgcagccacgccgccctgcatattctcgggtgcctcgatacattagcggcgatgcaggacctcaagatgggagtggcctctaccgaggaggagacacaggccgtgatgaaagtgtactctaaggaggactactccgtggtgaatcgattcgagagccatggcggtggatggggatattcagcacatagtgtcgaggctattcggttttccgccgacacggacatcctgttgggtggacttggcctgttcggtggccgcggggaatacaccgcgaaaattaaactgtttgaattgggtccagacggcggagaccacgaaacagacggagatctcctggccgaaacagacgtgcttgcatatgactgtgctgccagggagaaatacgcaatgatgtttgatgaacccgtgctgctgcaggcgggctggtggtatgtcgcttgggctcgcgtgtcggggccctcgtctgattgcgggtctcatggccaagcctcaattactactgatgacggggtcgtctttcagttcaagagttcaaaaaaatccaacaacggcactgatgtcaatgcgggtcagattcctcagttgctctatcggctcccaacatctgatggatccgcatctaaaggcaaacagcaaacctccgagccagtgcacattctgaaaagatcctttgctagaaccgtcagcgtggagtgctttgagagccttctgagtattcttcactggagttggaccaccctagtcctaggcgtagaagagctccggggcctgaaggggtttcagtttaccgcaaccctcctggacctggagcgcctgagatttgtaggtacgtgttgtcttcgcctgcttcgagtctatacgtgcgaaatttatcccgtgtccgcaactggaaaggctgtcgtggaagaaacctctaagctggctgagtgtattggcaagacacggacactgctgcgcaaaatattgtccgagggggtcgaccactgtatggtcaagttagacaacgatcctcagggctatctttcgcagccactgtccctgcttgaggctgtgttgcaggaatgtcataacacctttactgcttgcttccactccttttaccctactccagcgttacagtgggcctgcctctgcgatctcttgaattgccttgatcaggatatccaggaagccaacttcaagaccagttcctcccggctgttagcagctgtgatgtcagccctctgtcataccagtgtgaagctgaccagcattttccctattgcatatgatggggaggtgttactgcggtccattgttaagcaggtgtccaccgaaaatgactctaccctggtgcacaggttccctttgctggtggctcacatggagaaattatctcaaagtgaagagaatatttcgggaatgacatcctttcgagaagtcctggagaaaatgctcgttatcgtggtgctccccgtgcggaacagtctgcgacgagaaaacgagctgttttcttcgcatctcgtgagtaacacttgtggattgttagcttctatagtctctgagctcacagcgtctgcgctggggagtgaggtcgacggactgaacagcttacattcggtgaaagccagtgccaacagattcacaaagacctctcaggggcggtcttggaacactggtaatgggagtccagacgccatttgcttctcagttgacaaacccgggattgtggtcgtcgggttttctgtgtatggcggcggtggcatccacgagtacgagcttgaagtgcttgttgatgactccgaacatgcaggagatagcacccactcacatcgatggacgtcattggagttagttaagggtacttatactactgatgatagtcctagcgacatcgctgaaattcggctggataaagtcgtgccactgaaagagaatgtaaaatatgcagtgaggctccggaactacggttcccgcaccgctaatggagacggcggaatgacaactgttcagtgcccggatggggtgacatttacatttagcacctgttcactgtcttctaacggaacaaatcagacccgaggacaaatcccccagattctatactatcggagcgaatttgacggcgacctacagtcccagttgctctctaaggctaatgaagaagacaagaattgtagcagagcattgagcgtcgtgtccactgtggtgcgtgcctcaaaggacttactgcatcgtgcccttgctgtagatgccgatgacatccctgaactgctgagtagctcctccctgttcagcatgctgctccctctaatcattgcatacattggacccgttgccgcagcaattccaaaggtcgccgtggaggtgttcgggctcgtccagcagctactgccctctgtcgctattttaaatcagaagtacgcacccccagcttttaaccccaaccagtctaccgatagcactaccggcaatcagcctgagcagggtctaagcgcctgcacaacaagttctcactatgcggtaatcgaaagtgagcatccatataaacctgcctgcgtgatgcattataaggtgaccttccccgagtgtgttcgctggatgacaatagaattcgacccacaatgtggcaccgcacagagtgaagatgtgctcaggttgttgatccctgtcaggacagtccagaatagtgggtatggccctaagctcactagcgtccacgagaatttgaatagttggatagagctaaagaagttttctggctctagcggctggccaaccatggtcctcgtgctccccggtaatgaggccttattttcacttgaaacagcaagtgactacgttaaggacgataaggctagcttctatggctttaagtgttttgctattggctatgaattttcacctggtccggacgagggggtcatccagctcgagaaagaactcgctaacctaggaggagtgtgcgctgctgcactgatgaagaaagatcttgcacttcccattggcaatgaattagaggaagacctcgagattctagaagaagcagctttacaggtgtgtaagactcactcgggaatattgggcaaggggctagccctctctcacagccctacaattctcgaagccctggaggggaatctacctttgcagatacagtcaaatgaacagagcttcctggatgatttcattgcttgcgttcctggcagctctggcggacgactggcgcgctggctccagcccgactcctatgcagacccacagaagaccagtttaattctgaataaggacgacattcgatgtggctggcccacaactattaccgtgcaaacgaaagatcagtatggcgatgtggtgcatgttcctaatatgaaggtggaggtgaaggccgttcctgtgtcccagaagaagatgtctttacagcaggatcaagccaagaagccgcagcggattcctgggtccccagcagttacagcggctagttcgaacacagatatgacgtacggtgggctcgctagccctaaacttgacgtttcctacgaacctatgatagtcaaagaagccagatacattgccatcacaatgatgaaagtctacgaaaattatagctttgaagagctgcggtttgcgtcgcctacccccaaacgaccatctgagaatatgctgatcagagtgaataatgacgggacctattgtgctaactggacaccaggagcaatcggcctgtatactctgcacgtaacaattgacggcatcgagatcgatgccggacttgaggtaaaggtgaaggatccacccaaaggcatgatacctcctggaacacagcttgtgaaaccaaagtccgaacctcagccaaataaggtgcggaagtttgttgcaaaagattccgccggtcttaggatccgatctcaccctagtctgcagtcagagcagattggtatcgtgaaggtgaatggaaccatcacatttatcgatgagattcacaacgacgatggtgtatggttgcgattgaacgatgagaccattaaaaaatacgtccccaacatgaatggctacaccgaagcgtggtgtttaagttttaaccagcacctgggaaagtcactacttgtacctgtggacgagtccaagacaaataccgacgacttctttaaggacatcaacagttgctgcccccaggaagccaccatgcaggagcaggacatgccattcttacgaggcggacccggtatgtataaagtcgtcaaaaccggaccctctggacacaacattcgatcatgccctaatctgaggggcataccaattggcatgcttgtgttgggcaataaagtgaaggccgttggcgaggtgactaacagcgagggcacttgggtccaactagaccagaacagtatggttgaattctgtgagtcagatgaaggcgaggcctggtctctggcacgggataggggaggcaaccaatacctacgccatgaagacgagcaggctctgctcgaccagaactcccaaacaccaccaccttctccgttctcggtgcaagctttcaacaaaggggcttcttgtagcgcacagggttttgattatgggttgggtaactccaaaggggatagaggaaacataagtacctcaagcaaaccagctagcacctccggaaaatccgagctgtctagtaagcacagtaggtctctgaaaccggacggcaggatgagccggaccacagctgatcaaaagaagcctaggggaactgagagcctgtcagcgtctgagtctcttatcctcaagagcgacgccgctaagctgagaagcgacagccatagccggtcccttagcccaaatcacaatacccttcaaacactgaaaagcgatggtaggatgccatccagcagccgcgccgagtcccccggtcccggctctaggctttcctcaccaaaacctaaaactttgccagccaatcgatcgtccccgtccggggccagcagtccaagaagttcctcgccacatgacaagaatttacctcaaaaaagcaccgcccctgtgaagacaaaactggatccgcctcgcgaacgtagtaaatccgattcttatacacttgaccccgatactcttcggaaaaagaaaatgcccctgacggagcccctcagaggacgaagcacatctccaaagccaaagtctgtccctaaagatagtacagactcccctggcagtgagaatagggcccctagtccccacgtagtgcaggagaacctgcactcggaggttgtggaggtttgtacatcctctactttgaaaacgaattcgctgaccgacagcacgtgtgatgatagttcagagtttaagtcagtagatgaggggagcaacaaagtgcacttctcaatcggaaaagctccccttaaggacgaacaggaaatgagagcatctcccaaaatatcccgtaaatgtgccaataggcacacgagaccaaaaaaggaaaagtctagcttcctatttaaaggtgacggtagtaagcctcttgagcccgccaagcaggccatgagccccagcgtggcggagtgtgctcgtgcagtgttcgcgtcctttctgtggcacgaaggcattgtgcacgacgccatggcctgctcatcttttttaaagtttcaccccgagctctccaaagaacacgcaccaatccgatctagcctgaattcacagcaacccaccgaagagaaagaaaccaagcttaagaaccgccattctctggagataagctctgccctgaacatgttcaacatcgccccccatggcccagatattagcaagatgggctccattaataagaacaaagtcctgtccatgttaaaagaacctcccctgcatgaaaagtgcgaggacggtaaaacagagactacatttgagatgtcaatgcataacaccatgaaatctaagtctcccttaccacttaccctgcagcacctagtggccttctgggaggacatcagcctggccaccattaaggcagcttcacagaacatgattttcccatctcccggctcttgcgcagttctgaagaaaaaggagtgcgagaaagagaacaagaagagtaaaaaggaaaagaaaaagaaagagaaggcagaagttcgtccccgagggaacttatttggggaaatggcccagctggctgtcggcggtcctgagaaggataccatttgtgagctgtgcggtgagagccacccgtatccagtcacctatcacatgcggcaggcccaccccggttgtggaaggtatgctggcggccaaggctacaatagcatcggccatttctgcggaggctgggccggtaactgcggggacggcggtattggcggaagcacctggtacctggtttgtgatcgctgccgggagaagtacctgcgagagaaacaggccgctgcacgtgaaaaagtgaagcaatctcgtcggaagcccatgcaggtgaaaactccgcgcgcccttccaacaatggaagctcaccaggtcattaaggctaacgcactgtttctgcttagcctgagctccgccgctgaaccaagcatcctttgctatcacccagccaagccattccagtcccagttgccatctgtaaaggaaggcatctctgaagatctgcctgtaaagatgccctgtttgtatttgcagacgttggctcgtcatcaccatgagaactttgttggataccaagatgataatctgttccaggacgagatgaggtacttgcggagcacaagtgtacccgcgccctacatttcagtcactccggacgcctctcccaacgtatttgaggaacccgaaagcaacatgaagagcatgcccccgtcactggaaacctcacccatcaccgatactgatcttgcaaagcggacagtattccaaagatcctattccgtggtagcgtcggaatacgacaaacagcactccattctcccagcaagagtaaaagcaatacctcggcggcgcgtgaattccggtgacacagaagtcggaagttccttattgagacaccctagtccagagctgtctagattaatttcagcacatagctcactctctaaaggtgagagaaacttccagtggcccgtactagcatttgtgattcagcatcacgaccttgaaggtctggagattgccatgaagcaggcgctgcgcaaatcggcgtgcagagtctttgctatggaagcatttaattggcttctctgtaatgtaattcaaaccacatctttacacgatattctatggcactttgtcgctagcctgacgccagctccagtggagcctgaggaagaggaagatgaggaaaataagacaagtaaggagaacagcgaacaggagaaggatacacgggtatgtgagcatcccttatcagatattgtcattgcaggtgaggccgcgcaccctttaccacatacattccaccggctgctacaaaccattagtgacctgatgatgtccctcccttccggatcctctttacagcagatggcacttcggtgctggagcctgaagtttaagcagtcagatcaccaattcctgcaccagagcaatgttttccatcacataaacaacatactaagcaaatcggatgatggagattcagaagagtcatttagtatcagtatccagagcggctttgaggcgatgtcccaggagttatgcatagtaatgtgtctgaaagacctcacctccattgtggacatcaagaccagcagtaggcccgcaatgatcgggtccttgacagatggatctacggagacattttgggagtccggggacgaagataaaaataagacaaagaacattactatcaactgcgtgaagggaatcaacgcgaggtacgtgtcagtccacgtggataattctcgggatctgggtaacaaagtgacaagcatgaccttcctgaccgggaaagcagtggaggatctgtgtagaataaagcaagtggacttggactctcgccatatcggatgggtgacatctgaactcccaggtggagacaaccacatcatcaagattgagctgaaggggcctgaaaatacattacgtgtgaggcaggtgaaagtgctgggatggaaagacggtgaaagtacaaaaatcgcagggcaaatttcagcctctgtagctcaacagcgcaactgtgaggcagaaacactcagagtgtttcgattaatcacaagccaagtgtttggtaaactcatttctggagacgccgagcccactcccgagcaagaggaaaaagccttgttgtctagtcccgaaggcgaggagaaggtttataacgctacgtcggacgcggacctgaaggagcatatggtcgggatcatttttagtcgctcaaaactgaccaatctccaaaaacaggtgtgcgcccatatcgtgcaggcaattagaatggaggccactcgggtgcgcgaagaatgggagcacgcaatctcatcgaaagagaacgctaactcacagccaaatgatgaggatgcgagtagcgatgcttattgcttcgaactgctgtcaatggtattggctctttcaggtagtaacgtcgggagacagtacctcgcccagcaactcacactgctgcaggatctgttctcgctgctgcacaccgcctccccaagagttcagcgacaggttacctccctgttgagacgggtgctcccagaagtaaccccatcgcgcctggcttctataatcggggtcaaatccctgccacctgcagacatttccgacatcatccatagcacggagaagggagattggaacaaactgggaattctagacatgttcttgggctgcattgcgaaagccctcacagtgcagctgaaagcaaagggcacgaccataactgggactgctggcacgacggtcggaaaaggggtcactaccgtcacgctgccaatgatctttaactcatcatatctgagacgtggcgagtcacattggtggatgaagggatcaactcccacccagatcagtgagattatcattaagctgattaaagatatggctgctggccacttgtcagaagcctggtcccgtgtcactaaaaatgcgattgccgagactatcattgcactcacaaagatggaggaagaatttcggagcccagtgagatgcatcgccactaccagactatggttagctctggccagcctgtgcgtattggaccaggaccacgtggaccgactgagttcgggtcggtggatgggtaaggacggacagcagaagcagatgccaatgtgtgacaaccacgatgatggagagaccgctgccattattctctgcaacgtatgtggcaatctctgtaccgattgcgatcggttcctccatcttcacagaaggacaaagacacatcagaggcaggtgtttaaagaggaggaagaggcgatcaaagtggatttgcatgagggatgcggtaggacaaaactcttctggttgatggcattggccgattccaagactatgaaagctatggttgaatttcgcgaacacactggaaagcctacaaccagttctagcgaagcttgccgattctgcggatcccgcagcggtaccgaattgtcagccgtcggctctgtgtgtagtgatgccgactgtcaggaatacgctaaaatagcctgtagtaagacccacccctgtggccatccctgcgggggcgtcaagaatgaagagcactgcttaccttgtctgcacgggtgtgataagtctgccacaagcctgaaacaagacgccgatgacatgtgcatgatctgcttcaccgaggccctgtcagcagcccccgcgatccagcttgattgctcacatatttttcatttacagtgttgcagacgcgttttggagaatagatggctgggccccagaataactttcggttttatttcctgcccgatttgcaagaacaagattaaccacatcgtgttgaaggatcttctcgatccaattaaggagctgtatgaagatgtaagaagaaaagccttgatgcgactcgagtacgagggccttcataaaagtgaggctatcacaaccccaggggtgcgcttctacaacgatcccgctggctacgccatgaatcgttatgcttattacgtgtgctataagtgtagaaaagcatacttcgggggagaggctagatgcgacgccgaggcaggccgtggagacgactatgacccgagggagctcatctgtggcgcatgcagcgatgtgagcagggcacagatgtgtccaaaacacgggacggatttcttggaatacaagtgtcgttactgttgttccgttgcagtcttcttttgctttgggacaacccacttttgcaacgcgtgccatgacgactttcagaggatgacatcaatccctaaagaggaactgccccactgtcctgcgggccccaaaggcaagcagctcgaagggacagaatgcccattacacgtggtgcacccaccaaccggggaggaatttgcactcggctgtggtgtttgccgcaacgcccacactttttag

SEQ ID NO: 25153 - DNA, 1542 bp, Artificial Sequence
  Description of Artificial Sequence: Synthetic coding sequence
atgcaggagcaggacatgcccttcctgcggggcggccccggcatgtataaggttgtgaaaacaggcccgtctggccacaatatcagatcctgtcctaacctcagaggcatccctatcggaatgctggtgctcggcaacaaggtgaaggccgtaggagaggtcactaattcagaggggacttgggtgcagctggatcagaactctatggtggagttttgcgagagtgacgagggagaggcttggagccttgccagagacaggggcggtaaccagtatctgcgccatgaagatgagcaggcactgctggaccaaaacagccagacaccacctccctctcctttttcagtccaggctttcaataagggggctagttgctcagcccagggcttcgactacggtctggggaactctaaggttctgacagttctgcccactgcaggtgaccagctcagcgcaattctgaacagcatccaaagtcgccctaacctgcccgcaccaagcattttcgaccaagccgcaaaaccaccaagttccttggttcactctcctttcgttttcggccagcctctcagtttccagcaaccacagctgcaatctgacagaggtaacatcagcacgagctcaaagcctgcctctacctctggcaaatccgagctgtcaagcaagcacagcagaagtcttaagccagacggcagaatgtcacgaaccactgctgaccagaagaaaccgcgcggcacagagtcactaagcgcgtctgagtctctgatactgaagagcgacgctgcaaaactgcggtcagactcgcactcccgatcgttgagccccaaccacaataccctccaaacgctgaagtctgacgggagaatgccctcctcaagccgggcagaatctccaggcccgggaagcagattgagcagtcctaagccgaagaccctgcctgctaataggtcatctccaagtggcgccagcagccccagatccagcagccctcatgataagaatctccctcagaaaagcaccgcccccgtgaagacaaaactggacccgcctcgcgaaaggtccaagtctgatagctacacactcgaccccgacactctgcgcaaaaagaagatgcccttaaccgagccactgcgggggagatctacatcaccaaagccaaagagcgtgcctaaagacagcaccgattcccccggcagtgagaatagggcaccaagcccgcacgttgtccaggagaatctccattctgaagtggtggaggtttgcacaagcagcacactgaaaaccaacagtctgaccgatagtacgtgtgatgacagctctgaattcaaatcagttgacgagggcagcaacaaagtccatttttccatcggaaaggccccccttaaggacgagcaggaaatgagggcaagccctaaaattagtcggaaatgtgctaacagacatactagaccaaaacgcaagatagagttttccttccagagaaggtggatccaagcctttcgcgccagccaggcctcgcacgtgtccttttgtgggaggtag

SEQ ID NO: 25154 - DNA, 14037 bp, Artificial Sequence
  Description of Artificial Sequence: Synthetic coding sequence
atgatgatgtgcgccgccaccgccagccccgccgccgccagcagcgggcttgggggcgatggcttctacccagccgctacattttccagtagtcctgcacctggcgccttgtttatgcccgtgccagatggcagcgttgccgcagctggtctcggacttggtttgccagccgcagactcaagggggcactatcagctgctgttgtcgggacgcgccctggcagacaggtataggcggatttatactgcagctctcaatgatcgcgaccagggagggggttcagccggccaccccgcgagccggaacaagaagattttaaataagaaaaagttaaaacggaaacagaagagtaagtcaaaggtgaaaacacgatcaaagagcgagaatctggaaaatacagtgataatccctgatatcaaactgcacagcaacccttccgcattcaacatttactgcaacgtgagacactgtgtattagagtggcagaagaaggaaatttccctggctgccgccagcaaaaatagtgtgcagagcggagaatcagacagtgatgaagaggaagagtcaaaagagccaccgattaagttacccaaaatcatagaagtgggactctgcgaagtcttcgagcttatcaaggagactagattctcacatccttctctgtgcctaaggagtcttcaagcactcctcaatgtgctccagggtcaacagcctgagggcctccagagtgagcctcctgaagtcctcgagtctctgtttcagctgctgctcgagataacagtcaggagtacggggatgaatgattccactggccaatctctgactgcgctttcctgcgcttgcctgttctccctcgtcgcttcatggggcgaaacaggacgaacacttcaggcaataagtgccatcctgactaacaatggctcacatgcatgtcagaccatacaggtgcctactatattgaattccttgcagaggtccgtgcaggcggttcttgtgggcaaaatccaaatccaagattggttttcaaacggcatcaagaaggctgccctgatgcacaagtggccattaaaagaaatctccgttgacgaagacgatcagtgcctgctccagaatgatggcttttttctttatttgctgtgtaaagacgggctctacaagatcggctctggctatagtgggactgtaagaggccacatctataatagtacaagcagaatcaggaaccggaaggaaaaaaaatcatggctcgggtatgcccaagggtatctgctttatcgagacgtcaacaatcattctatgacagccatccggatatcaccagagactcttgagcaagatggcacggtcatgttgccagactgtcacaccgaagggcagaacatcttgttcacagacggggagtacattaatcagatcgcggcaagccgggatgatggattcgtggtccgtatattcgcaacctccactgaacccgtgctgcagcaggagcttcagttgaagctggcgaggaaatgtttgcatgcctgcgggatttctctgtttgaccttgaaaaggacctacatattatctccactggattcgatgaggagtccgccatcctgggcgccgggagggaattcgccttgatgaagaccgctaacggtaagatttattatacagggaaataccagtccctaggaatcaaacaggggggtccgtccgctggcaagtgggtggaattacctattaccaagagccctaaaatcgttcacttttctgttggtcatgacgggagccatgcacttctcgtggctgaggacggaagcatttttttcacaggctctgcctctaagggtgaagatggggaatcaactaagagccgccgacagagtaagccctataaacccaagaagatcattaagatggagggcaaaattgtggtatacacggcctgtaacaatggatcatcctccgtaatttccaaggacggcgagctttatatgttcggtaaagacgctatttacagtgactcctcctctttggtgaccgatctcaagggtcactttgtgacccaagtcgcaatgggcaaggctcatacatgcgtattaatgaagaacggcgaagtatggacttttggcgttaacaacaaaggacagtgcggacgggacaccggggctatgaaccagggtggaaaaggcttcggagtagagaatatggccaccgcaatggacgaagacctggaggaggagttagacgaaaaagacgagaagtcaatgatgtgtcctccaggaatgcacaagtggaaattggaacagtgtatggtttgtaccgtgtgtggggactgtacaggttacggcgcttcatgcgtaagcagcggcaggccagatcgtgtaccgggtggcatttgcggatgcggctccggggagtccgggtgtgcggtttgcgggtgctgtaaggcttgcgcccgggagcttgacggtcaggaagctaggcagcgcgggatcctggacgcagtaaaggagatgatccctctggacctcttgcttgctgtgccggtacctggtgtcaatatcgaagagcatctgcaactgcggcaggaggaaaagcggcaacgagttatccgaaggcacaggttagaggagggcagaggcccactcgtctttgccggtcctatttttatgaaccaccgtgaacaggccttagcccgccttaggtcccaccctgcacaactgaagcacaaacgcgataagcacaaggatgggagcggtgagcggggggaaaaggatgcttccaagattacgacctatcctcctggctcagtgagattcgattgcgaactcagggccgtccaggttagctgtgggtttcaccattccgtggtgttgatggaaaacggggacgtctacacattcgggtacggacagcacggccagttgggccatggcgacgtcaactccagaggctgccccacgctggtgcaggctttgccaggaccgtccacacaggttactgctggcagcaaccataccgccgtgcttttgatggacggacaggtcttcacattcggctccttctctaaagggcagcttggccgacccatcctggacgtaccatactggaacgccaagcccgctccgatgcccaacattggatcaaagtacggcaggaaggcaacctggataggagcctccggggaccaaacatttctgaggatagatgaagcactcataaactctcacgtgcttgctacaagcgaaatattcgcaagcaagcatatcattggcctggttcccgcctccatatcagagccaccgcccttcaaatgtctgctgattaataaggtggatggaagctgcaaaaccttcaatgactcagaacaggaggacttgcagggctttggcgtctgcctagacccagtttacgatgttatatggaggttccgtcccaatactcgggaactctggtgttacaatgctgtagtggccgacgcacggcttccatccgctgcggatatgcagagtagatgtagtatcctaagccctgagctggcactgcctactggaagtcgcgccctgaccactcggtcacatgcagccctacacattctaggatgcctcgatacattggcggcaatgcaggacctgaaaatgggggtggcctcaactgaggaagaaacgcaggccgtaatgaaggtgtacagcaaggaagactacagtgtggttaaccgattcgagtcacatggcggcggatggggctattccgcccactccgtggaggcaattcggttcagtgcagatacagacattttgctggggggactcggtctgtttgggggcagaggggaatacactgcaaagattaagctgttcgagctgggcccggatggtggggaccacgagaccgacggagatctcctcgcggagacagacgtcctggcttacgattgcgctgcccgggagaagtatgcaatgatgtttgacgagcccgtcctactgcaggcaggctggtggtatgtagcctgggctcgggtcagtggacctagcagcgattgtggaagtcacggtcaggcgtctatcaccacagacgatggcgtcgtatttcagtttaagtcatctaagaagtctaacaatggcaccgatgtaaacgccggccagatcccacagctactctacagactgcctacaagcgacggatcagcttccaaggggaagcagcagactagcgaacccgtccacattttaaagagatcgtttgcccggactgtgagcgtcgagtgttttgagagcctcctttccattttacactggtcatggaccaccctcgtgctcggagtggaagagttacgggggctcaagggatttcagttcacagctaccttgctggatttagagaggttgcgattcgtgggcacgtgctgcctgcggctgttgcgagtctacacttgtgaaatctacccggttagcgcaaccggtaaggctgtggtagaagaaacctccaagctggcggagtgtatcgggaaaaccagaaccctgctgagaaagattctgagtgagggagtggaccactgtatggttaagctcgacaatgacccccaggggtacctaagtcagccgctctctttgttagaggccgtgctgcaggagtgccacaacaccttcactgcatgttttcactccttctatccaactcctgctctgcaatgggcatgcctgtgcgatttgctgaattgcctggaccaggacatccaggaagccaactttaaaacatcgtcatcaaggctacttgcggcagtaatgtctgctctgtgtcacacgtccgtcaagctgacgtcaatttttcccattgcttatgacggtgaagttctgctgcgtagtattgtgaaacaagtcagcactgaaaatgacagtacactggtgcatcggttcccgctcctggtcgcacatatggaaaaactaagccaatccgaggagaacataagcggtatgacttcattcagggaagtgctggaaaaaatgctggtgattgtggttctcccagtgagaaatagtctgcgccgggagaatgagcttttcagctcacacctcgttagcaacacatgcggattgcttgcaagcatagtatctgaactgacagcgtcagccttaggatcagaggtggatggccttaatagtttacattccgttaaggcgtcagccaaccggttcaccaaaacctcgcaagggaggtcatggaacacagggaacggatccccagatgcaatttgcttttcagtggataaacctggtatcgtcgtggtaggttttagtgtctacggcggaggtggaattcacgaatacgagctggaagttcttgtcgacgacagcgaacacgccggggattccactcattctcaccgctggacaagcctggaactcgtgaaaggtacatacacaactgatgacagcccttccgatattgcagaaatccggttagataaggttgttcctttgaaggaaaatgtgaagtatgcggtgcgattgcggaattacggttcccgcacagcaaatggagacggcggcatgactacagtccaatgcccagatggagtaacctttacttttagcacatgttccctgtcctcgaatggcaccaatcagacgagaggacaaatcccacagatactgtactaccgctctgaattcgatggggatcttcagtcgcagctgctgtccaaagccaacgaagaggataagaattgttctcgggccctgtctgttgtcagcaccgtggtccgtgcttctaaagacctcttgcaccgggcccttgctgtggacgcggacgatatccctgagctactgagctcttcctcactcttctcgatgctgctgcctctcataattgcttatattgggccagtagctgctgcaatccccaaggtggccgtggaggtgtttggtctcgtgcagcaactcttaccttctgttgccattcttaaccagaagtatgcccctccagctttcaatcccaaccaaagcaccgattccacaacaggcaatcagcctgaacagggattgtctgcgtgcaccacttccagccattacgccgtgatcgaaagcgagcacccgtacaaacctgcctgtgtgatgcattataaggttacattcccagaatgcgtcaggtggatgacaatcgagttcgacccccagtgcggcactgcccaatcagaagacgtgctacggctgctgattcctgtcaggaccgtccagaactccgggtacggccccaaactcacatccgttcacgaaaatctgaatagttggatcgaactgaagaagttttcaggttcttctggatggccaaccatggtgttagttctgcctggcaatgaggctcttttttccttggagacagcctctgattatgtaaaggacgataaggcatccttttacggattcaagtgtttcgccatcggctatgagtttagtcccgggccggacgagggagtgattcaattggaaaaagagcttgccaacctgggaggggtttgcgctgctgctctcatgaaaaaagatctagcgctgcccatcggaaatgaactcgaggaggatctggagatcttggaggaagcagcactccaggtctgcaagacgcattctggaatcctgggaaaaggcctggcactatcacattccccaactattctggaagccctcgaaggtaatctgccactgcaaatacagagcaacgagcagtctttcctggatgattttatcgcatgtgttcctgggtcctccggtggtaggcttgctaggtggctgcagcctgactcatatgcagatccccagaaaacaagcctgatccttaataaggatgacatcaggtgtggttggcctacaacgattacagtccagactaaggatcaatacggtgatgtggtccacgtgcccaatatgaaagtcgaggtgaaggccgtgcctgtgagtcaaaagaagatgtcactacagcaggatcaggccaagaaacctcagcggattccagggagccccgcggttactgctgcttcctctaatactgatatgacatacggaggactggcttcgcctaaactggatgtgagttatgaacccatgatagttaaagaggccaggtacatcgccatcaccatgatgaaagtctatgaaaattacagttttgaggagctcagatttgccagccctactccaaaaaggccatcagagaacatgctgatcagagttaataacgatggcacgtattgtgctaattggacccccggagcaattgggctgtacacacttcatgtgacaatcgacgggatagagatcgacgccgggctggaggtcaaggttaaggacccaccaaaaggaatgatcccaccggggacacagctcgtcaagcctaaaagcgaacctcagcctaacaaagtccggaagttcgtggcaaaggattctgcaggacttcggatcagatcccacccctctctacagtccgagcagatcgggatagtcaaggtgaacggcacaattactttcatcgatgagatccataacgatgacggcgtttggctgagacttaacgacgaaactatcaagaagtacgtgcctaatatgaacggttatacagaggcctggtgtctcagtttcaaccaacatctggggaaatccctcttagttccagtggacgaatctaagacaaatacagatgatttttttaaggacattaacagctgctgtccgcaggaagcaacaatgcaagagcaggacatgcccttcctgcgaggtgggcccggaatgtacaaggtggtgaaaacgggcccctcagggcacaatatccgttcctgccccaacctgagaggtatccctattggcatgctggtcctgggaaacaaagtgaaagccgttggcgaagtgaccaatagcgaagggacttgggtacagctggaccaaaattcgatggtcgagttctgtgaaagtgacgagggggaggcatggtctttggcccgcgatcgaggtggtaaccagtaccttaggcacgaagatgaacaggccctgttggatcagaattcacagacgccccccccctcacctttttctgtgcaggctttcaacaagggcgcttcctgctccgcccaggggtttgactacggactgggaaattcaaagggagaccggggaaatattagcacaagcagcaaaccggcctcaactagcgggaaatcagaattaagctccaagcattcacggtcacttaaacccgacggccggatgtctcggaccactgccgaccaaaaaaaaccccgtggcactgagtcactttcagcttcagaaagcttaatcttgaaaagcgacgctgcgaagctgcggagtgatagccacagccgaagcctttctcccaatcataatactctgcagacactgaagtcagacggcagaatgccatcatccagccgcgcagagtctcctggccccgggtcccgcctctcatctcccaagcccaagacattgcctgccaacagatcatccccctcgggcgcgtcttctcctcgctcctccagcccccacgataagaacctgcctcagaaatcgacagccccagtgaagaccaagctggatccccctcgcgagagaagcaagtccgatagctatactctcgatcccgacactctgcgcaagaaaaaaatgcctctcaccgaacctttacgcggccgtagtaccagcccaaaacctaaatccgtgcccaaagattctactgacagcccaggtagcgagaacagggcaccctctccacatgttgttcaggaaaatctacattccgaagttgtcgaggtgtgcactagctcaactctgaagaccaacagcctcacagactccacttgcgatgatagctctgaattcaagtccgtagatgaagggtcaaacaaggttcacttctcgattggaaaagctcctctgaaagatgagcaggagatgagagccagcccgaaaatctctaggaaatgtgccaatagacacacccgcccaaaaaaggagaagtcatcttttttgtttaagggtgatggatctaaaccccttgagcctgccaagcaggctatgagtccttctgttgccgaatgtgcacgagcagtttttgccagcttcctctggcacgaaggaattgtgcatgatgcaatggcctgcagctcattcctgaaatttcacccagagttgagcaaggagcacgcccccattcgctccagtctcaactctcagcagcctaccgaagagaaggaaacaaagttgaagaacaggcatagcttagaaatttcatcagccctgaacatgttcaacattgccccgcacggccccgatatcagcaaaatgggatcaattaataagaacaaggtactttctatgctaaaggaacccccactgcatgagaagtgcgaggatggaaaaacagaaactacgttcgagatgagcatgcacaacaccatgaaaagcaagtctccgctgcctctgaccctgcagcatctcgtcgccttctgggaggatatctccctggctactatcaaggccgctagccaaaatatgattttcccctctcctggctcttgcgccgtgctaaaaaagaaagagtgcgagaaagagaataaaaagtccaaaaaggaaaagaaaaagaaggagaaagccgaggttaggccacgcggaaatctcttcggtgaaatggcacagctcgctgtcggaggccccgagaaagataccatctgcgaactttgtggagagtctcatccatacccagtgacctatcacatgcgccaggctcatcctggatgcgggcgatatgcaggggggcagggatataattccatagggcacttttgcgggggctgggccgggaattgcggggatggcggcattggcggctcaacctggtacctggtgtgtgatcgatgcagagagaaatatttacgcgaaaagcaggcggcggcgcgcgagaaggtcaagcagtcgcgcaggaaacctatgcaggtgaagacaccacgtgcactcccaaccatggaagctcatcaagttataaaggctaatgccctctttctgctgtctctaagtagtgcagccgagcccagcatattgtgctatcaccccgctaaaccttttcagtctcagttgccgtccgtcaaggaagggatttctgaggaccttccggttaagatgccttgcctgtacctccagaccctggcccgccatcatcatgagaatttcgtgggatatcaggacgataacctgtttcaggatgagatgcggtacctcaggtcaaccagcgtgccagcaccttacatatccgtgaccccagacgcttctcccaatgtgttcgaggaacccgaaagcaacatgaagtcaatgccgccctccttagaaacaagtccaatcaccgatactgatttggctaagaggacagtcttccagagatcgtacagcgtagtggcctcagaatacgataaacagcattctatcctgcctgccagagtaaaggcaatcccacgccgccgagtgaacagcggggacacggaagtggggagttcattgctgcgacacccatctcctgaacttagtagactgatttcagcccatagtagtttgtctaaaggagagcgcaatttccagtggcccgtattggcttttgtgatccagcaccacgacttggaagggctggagatcgcgatgaaacaggccctccggaagagtgcttgtagagtattcgccatggaagcattcaactggctgttgtgcaatgtgatacagacaacttctctccacgacatcctgtggcactttgtggcgtcacttactccggctccagtcgagcccgaagaagaagaagatgaggagaataagacatctaaggaaaactccgagcaggaaaaggacacgcgagtgtgtgagcatccgctcagtgacatcgtaatcgcaggggaagctgctcacccccttccacatacctttcacagactgctccagactatcagcgaccttatgatgtccctgcctagtggaagctctctccagcagatggctctgcgatgctggtcactgaaatttaaacagtcggatcaccagttcctgcatcaaagtaacgtgttccatcacatcaacaatatccttagtaaatctgatgatggcgactctgaggaaagtttttcaatctctatccagtctggatttgaagcaatgtcacaggagctgtgcatagtgatgtgcctgaaggatctgacctccatagtggacatcaagaccagcagccggcctgctatgatcggaagtctaacagacggtagcactgagacattctgggagtccggagacgaggacaaaaacaaaacaaagaatattactataaactgtgtaaaggggattaacgctaggtatgtgtctgttcacgtcgacaatagcagggatcttggcaataaggtgaccagcatgactttcctgacaggaaaggccgtggaggacctatgtaggatcaaacaggtggacttggattcgcggcatattggatgggtaacgtctgaactaccggggggagacaaccacattattaaaatagaactgaaggggccagagaatacactgcgcgtgcgacaggtgaaagtcctgggttggaaagacggcgagagtaccaaaatcgctggccagatcagtgcctcagtcgcacaacagaggaactgcgaagcagaaactctgcgggtcttccgtttaattacctcccaggtgtttggaaaattgatttctggggatgcggaaccgacccctgagcaggaggagaaagcccttttgtcttctccagagggcgaggaaaaagtatataatgcaacctccgacgctgacttaaaggaacacatggtgggtatcatcttttcccgatctaagctgacgaacctgcagaagcaggtgtgtgcacatatagtgcaagctatccgcatggaagccacgcgggttagagaagaatgggaacatgccatctcatccaaagagaatgcgaactcacagcccaatgatgaagatgcctcatcagacgcgtattgctttgagctcctatcgatggtgttagctttgtctggaagcaatgtgggccgacagtacctagcccagcaactgactctgctgcaagatctgtttagcttattgcacacagcttctccacgtgtgcagagacaggtgacttcactcctgcgccgcgtgctgcctgaagtcactccgtctaggttagcatctatcatcggtgtaaagtcactgccgcctgctgacatcagcgacatcatccatagcactgaaaagggggattggaataagctaggtattctcgacatgtttctaggctgtatcgccaaagccctcactgtccaactcaaggctaaggggacaactataaccggcactgcaggcaccacggtgggcaagggggtcacgacagtgactttacccatgatcttcaattccagctacttacgccgtggcgagtctcactggtggatgaaggggagtactcctacccaaatcagcgagatcattattaaacttatcaaagatatggccgctggccacttaagtgaggcctggtccagagtaaccaaaaatgcgatcgcggagaccatcatcgccctgacaaagatggaagaagaatttagaagccccgttcgctgcatagccactactagactgtggttggcactggcttccctgtgtgtactggaccaggaccatgtggataggctgagcagcggaagatggatgggcaaagatggacagcaaaagcagatgcctatgtgcgacaatcatgatgatggcgagacagccgccatcatcctgtgtaacgtgtgcggtaatctttgtactgactgtgaccgcttcctgcatttacatcggcgtaccaagactcaccagcggcaggttttcaaggaagaagaagaggccatcaaggtcgatctgcatgagggctgtggccggaccaaactcttctggctaatggccctggccgacagcaagaccatgaaagcaatggttgaatttcgcgagcataccggaaagccaacaacgtctagtagcgaggcttgcaggttttgcggcagtcggagtggcacagagctatcggccgtgggttccgtttgttccgacgctgactgtcaagagtacgcaaaaatcgcttgtagcaagacacacccctgcggccacccttgtggaggggtgaagaacgaagaacactgtctgccttgtctgcatggttgcgataagagtgcgacctctctcaagcaagacgccgatgacatgtgcatgatttgtttcacggaagccctgagtgctgctccagctatacagttggattgctcacatatcttccacctccagtgctgcaggcgggtactggaaaaccgctggctgggtccacgcataacattcggcttcatatcttgccccatatgtaagaacaagatcaaccacatcgtgctgaaagacctgctcgatccgatcaaggagttgtacgaggatgtacgacgtaaggccctgatgaggctggaatatgaaggattgcataagagcgaggcgatcactacccccggggtccggttttataatgaccctgcagggtacgccatgaatcgctatgcctattacgtgtgttataaatgtagaaaggcatacttcggcggggaggccagatgcgacgcagaagccggccgtggagacgattatgacccccgggagctcatctgcggggcttgttctgatgttagcagagcacaaatgtgcccgaagcacggcaccgactttctggagtataaatgccgatactgttgtagtgtggcggtctttttctgcttcggcacgacacacttctgtaatgcttgccacgacgatttccaacgaatgacatcgattcccaaggaagaattgccacactgtcccgccggaccaaagggcaagcaacttgagggcactgaatgcccattgcatgtagtgcatcccccaaccggagaggagtttgcccttgggtgcggagtctgtagaaacgcacacaccttttag

SEQ ID NO: 25155 - DNA, 13923 bp, Artificial Sequence
  Description of Artificial Sequence: Synthetic coding sequence
atgcccgtgcccgacggcagcgtggccgccgccggcctgggcctgggcctcccagctgctgacagtagaggacattatcagctgttgctcagcggccgtgctctcgccgacagatataggcgtatttacactgcagcattgaatgatagagatcaaggtgggggctccgcagggcacccggcctcccgcaacaaaaagatcttaaataagaagaagttgaaaaggaagcagaagtccaagagcaaggtcaaaaccagatccaagtcggagaatctggagaataccgtaatcatcccggatataaagctgcattctaatcccagcgcgtttaacatttattgtaatgtgcgacattgcgtgcttgagtggcagaagaaggaaatctcactggccgccgcgagcaagaacagcgttcaaagtggtgaaagtgacagcgacgaggaggaggaatctaaggagcctccgatcaaattaccgaagatcatcgaggttggactgtgcgaggtgttcgagctcatcaaggaaacacggttttctcacccaagcctttgcttacgcagcctgcaggcattactgaatgtccttcagggccagcagccggaagggctgcagagcgagccccccgaggtgcttgagagcctgtttcagctcctgctggaaatcactgtccggtcgacgggcatgaatgattcaactggtcaatcccttacagctcttagttgcgcctgcctcttttccctcgtggccagttggggcgagacggggcgtaccctgcaggcaatcagcgctatcttgaccaacaatggctcccacgcgtgtcagacaatccaggttccaacaattctcaacagtttacagagatccgttcaagctgtcctagtgggaaagatccaaattcaggattggttctccaacgggattaagaaagccgcacttatgcacaagtggcctctgaaggagatcagtgtggacgaagatgaccaatgcctccttcagaacgacgggttttttctgtatttactgtgtaaggatggactctataaaatagggagcggttattccgggacggtccggggtcatatctataatagcacatctagaattcgaaacagaaaggagaagaaatcctggctgggctacgctcaaggctatctcctgtaccgggacgtaaacaatcacagcatgactgccatccggatcagccctgaaaccttagaacaggacggtactgtgatgttgcctgattgccacaccgaaggacagaacattctgttcacagatggggaatatattaatcagatcgccgcgtcccgtgacgacggattcgtagtgcgcatatttgccacatctacggaacccgtgcttcaacaggagctccagctgaagctcgcaagaaagtgcctccacgcctgtggtatatcactatttgacctagagaaggaccttcatatcatcagcactgggtttgatgaagaatccgcgatacttggggctggccgggaatttgccctcatgaaaacagccaacggaaagatctactacactggcaagtatcaatcccttggcatcaaacagggaggcccttctgccgggaaatgggtggagctgcccattactaagtccccaaagatagtacacttctctgtaggacacgacggcagtcacgcacttctggtggccgaagatggcagcatttttttcaccggttctgccagcaaaggcgaggatggtgagtccaccaaaagccggaggcagtccaagccctacaaacctaaaaagattataaaaatggaggggaagatcgtggtatacactgcgtgtaataacggcagctcaagtgtaattagcaaagacggagaactgtatatgttcggtaaagacgccatttactcagacagctcttctctggttaccgatctgaagggacactttgtaacccaggtggccatgggcaaagcgcacacctgtgtgctgatgaagaatggcgaagtttggactttcggcgtcaataataaaggacaatgcggtagggatactggcgccatgaaccaggggggcaaggggtttggagtggagaacatggcaaccgccatggatgaagaccttgaagaagaactggatgaaaaagatgagaagtctatgatgtgccctcccggtatgcataagtggaaacttgagcagtgcatggtgtgtactgtttgtggagattgtaccggctacggcgcatcctgtgtttctagcggcaggcctgaccgtgtgcccggtggcatttgcggatgtggatccggtgaatctggatgtgccgtttgcgggtgctgcaaggcctgtgcacgcgaactggacgggcaagaggcccggcaacgggggatcctggacgccgtgaaagagatgatccccctggatctgctcctggccgtgccagtacccggagtaaatatcgaagaacatttgcagctgagacaggaggagaagaggcagcgggtaattaggaggcatcgccttgaggaaggaagagggcctctagtcttcgccggtcctattttcatgaatcatagagagcaagccttagccagactgaggtcccatccagctcagctgaaacataaacgggataagcacaaagacgggtcaggcgagagaggcgaaaaggacgcctccaagatcaccacataccccccaggctccgtccgatttgattgtgagctgcgggcagtccaagtctcgtgcggatttcatcactctgtggtgcttatggaaaacggcgacgtgtacacctttggttacggacagcacggccaactgggccacggcgatgttaactccagagggtgccccactcttgtacaagctttacccggcccatcaacacaggtaactgctggatccaatcacaccgctgttctactgatggatggtcaagtattcacctttggatctttctccaagggccagctgggccgtccaatactggacgtcccttactggaatgccaaacccgcccctatgcctaacattgggagcaaatatggcagaaaagccacctggatcggggcatcaggcgatcaaacattcctccgaattgatgaagccctaattaactcacacgtgctggccactagtgagattttcgcctcaaaacatattattggcctggttccagcatccatctccgagcctcctccttttaagtgtttgctcattaataaggtggatgggagctgtaagacattcaatgattcagaacaggaagacctgcagggattcggtgtgtgcctggaccccgtctacgacgtgatctggcgctttcgcccaaatacacgcgagctctggtgttacaatgcggttgtcgcggacgcccggctcccatctgccgcggacatgcaaagtcgatgctctattttgtctcccgagctagccctgcccacaggctctcgcgccctcacaacacgttctcatgcagcccttcacatactggggtgcctagacaccctggctgctatgcaggatttgaaaatgggagtggccagtaccgaggaagagacacaagccgttatgaaggtatattccaaggaagactactcggtggtcaacagatttgagtcccatggaggcggctggggttattccgcacactctgttgaagccattcggtttagcgccgataccgatattctcttgggagggttgggtctgtttggtgggcggggagaatatacagccaagattaagctatttgagctgggacccgacggcggcgaccacgagactgacggggatctattggccgagaccgatgtgttggcctacgattgcgctgctcgcgagaagtatgcgatgatgttcgacgaacctgtgctcctccaagctggttggtggtatgttgcttgggcacgcgtgagcggaccgagcagtgactgcgggtcacacggacaagcttcgatcaccactgacgacggagtcgtcttccagtttaaatctagtaaaaaaagtaacaatgggactgacgttaacgctggccagatcccccagctcctctaccggctccctacgtccgacggcagcgcttcaaaaggcaaacagcagacctccgaaccagtccatattctgaagcgcagtttcgccagaactgtaagcgtcgagtgctttgagagtctgctttccattctgcactggtcttggactacgctggtgttgggcgtcgaggagttaagggggctgaaggggtttcagtttacagccactttgctagacctcgaacggctgcgattcgtcggaacttgctgtctgagactactgagagtgtacacttgcgaaatttaccccgtgtcagcaaccggaaaggctgtcgtggaggagacaagcaaactagccgagtgcattggcaaaacacggaccctactgcggaagattctgtcagagggagtagatcactgtatggtcaaactggacaatgaccctcaaggatatctgtctcaaccgctgagcctattggaggccgtcctgcaggaatgtcacaataccttcacggcctgtttccactctttttatccaacgccggccctgcagtgggcctgcctttgtgatctcctgaattgcctcgaccaggacatccaggaggcaaacttcaaaacctcatcgtcccgtttgctcgccgcagtgatgtccgcactctgtcacacgagcgtgaagctgacctcgatcttccccatagcatacgacggagaagtattgctgaggtcaatcgtgaaacaggtctcaacagagaatgactctacattggtgcaccgctttcccctcttggtggcacacatggaaaagctcagtcagtcggaggagaatatatccggcatgacatctttcagggaagtgcttgaaaaaatgctcgtcatcgtcgttctacctgtgcgcaacagtctgcggagggagaatgagctattcagttctcatttggtcagcaacacctgcggtctgctggcgagcatcgtttctgagctgacagcgtccgccttaggatctgaagtggatggactgaactctttacatagcgtcaaggcaagtgcaaaccggttcaccaaaacctctcaggggcgatcatggaatactggcaacggttcaccggatgccatttgtttttccgtggacaagccaggtatcgtggtggtgggattctcagtgtacggcggtggcggcatccatgagtatgagctggaagtattggttgacgacagcgaacatgcaggagattctacccactctcaccggtggacctcactagaactcgtgaagggcacgtacactacagacgacagccccagcgatatcgcagaaatcagactggacaaagtggtacctctgaaggaaaacgttaagtacgcagtgcgcctgagaaactatggtagcagaacagccaacggcgatggaggaatgacaactgttcaatgtccggatggcgtgactttcaccttctctacatgctcactgagctccaatggaactaatcagacgagagggcaaatcccgcaaatactttactaccgctctgagttcgacggcgacctccaatcacagctcctgagcaaggcaaatgaggaggataagaactgtagccgcgccctatcagtcgtgtcaaccgtggtcagggcttccaaagatctcctgcacagagccttggccgttgacgctgacgacatccccgaacttctgagttcatcatccctgttctccatgttattaccactcatcattgcttacatcggacccgtcgccgccgcaatccctaaagtggccgtggaggtgttcggactggtccagcaacttttgccctccgtcgccatcctgaaccaaaaatatgcccccccagccttcaatccaaatcagtctaccgactcaaccacgggcaatcaacccgaacaggggctatccgcctgcacaacctcgtcacactacgctgtcatcgaatctgaacatccctataaaccagcctgtgttatgcattacaaagtgacctttccagagtgcgtcaggtggatgacaatcgagtttgatccgcagtgcggcactgctcagtcagaagacgtgttacgcttgcttattcctgtgcggacagttcaaaactcgggttacggtcctaaactaacaagcgtgcacgagaatctaaacagttggatagagcttaaaaagttcagcggttcttctgggtggccaaccatggtgctggtcctcccaggaaatgaggctctcttttcactcgaaaccgcaagcgactatgtaaaggatgacaaggccagcttttacggctttaagtgcttcgctatcggctatgagttttccccaggacctgatgaaggcgtgatacaattagaaaaagaattggcaaacctggggggcgtgtgcgctgctgctttaatgaaaaaagatctcgccctccctataggaaacgagctcgaagaagacctggagatcttagaggaagcagctctgcaggtatgtaagacccatagtggtatcctgggtaaggggttggcactctctcacagtccaacaatccttgaggccctggaagggaaccttccgcttcagatccagtctaatgagcagtcctttcttgacgactttatagcatgcgtgcccgggagctctggagggagactggcaagatggttacagccagattcgtacgccgacccacaaaaaacctctctaatcctgaacaaagatgacatccggtgtggctggcctaccaccataaccgttcagacaaaagatcagtacggggatgtcgttcatgtgccgaatatgaaggtggaagtgaaggccgtcccggtttctcagaaaaagatgagcttgcagcaagatcaggccaaaaaaccccagaggattccaggttctccagcagtgactgcagcgagctctaacacagacatgacctatggaggattggcatcccccaagttagacgtttcctacgagcctatgattgttaaagaggcccgctatatagccatcaccatgatgaaggtatatgaaaactacagttttgaggaactgaggtttgcctctccaactcctaaaagaccttcagaaaatatgttgatcagagtgaacaacgacggaacatattgtgccaactggaccccaggagcaatcggcctttacaccctgcacgtaacaattgatggcatcgagatcgatgctggcctggaggtgaaagttaaggatccgcctaaggggatgatccccccaggcacccagttggtcaagcccaaatccgagccgcagcccaataaggtgcggaaattcgtggcgaaggactcagccgggctgaggatccgcagtcatcccagcttgcaaagcgagcaaataggcatagtgaaggtcaacggcaccatcaccttcatagacgagattcacaatgacgatggcgtgtggttgaggcttaatgacgagactattaaaaaatacgtccctaacatgaatggctacaccgaagcttggtgcctcagttttaatcagcaccttggaaagtccctcctcgtccccgtagatgagtccaaaaccaacaccgatgatttttttaaagacattaattcctgctgtccacaggaggcaactatgcaagagcaagacatgcccttcttgcgcggcgggccgggcatgtacaaagtggtgaagaccggcccatccggccacaacattaggtcctgccctaacttgagagggataccaatcgggatgttggtgctcggcaacaaggtaaaagcagtgggcgaggtaaccaacagcgagggaacatgggtccagttagaccagaactctatggtggagttctgtgaatctgacgaaggagaggcctggagtttggcccgcgataggggagggaatcaataccttcggcacgaggatgagcaggccttactggatcagaattcacagaccccaccaccttcaccgttctctgtccaagcgtttaataagggcgcatcctgtagcgcacaggggttcgactatggacttggcaactctaagggggatagaggcaatatatctacgtctagcaagcctgcgtccaccagcggtaaaagtgagctcagcagcaaacacagcagaagtctgaagccagacggccgaatgagcaggactacagcagatcagaagaagccgcgggggacggagagtctcagcgccagcgagtctctgatacttaaatctgacgccgcaaaacttaggtctgactcgcattcccgaagcttatctccaaaccacaataccttgcaaaccctaaaatcagacggccggatgccctccagttcacgtgcagaatcacctgggccaggttcacgtttgtccagcccaaaaccaaaaaccctcccagctaaccggtcctccccatccggtgctagtagcccacgttcctcaagcccccacgacaagaatttgccccaaaagtctacggcaccggtgaagaccaagttggatccgccgagagagagatccaagagtgattcttatactttggaccctgacactttaaggaagaagaagatgcctctgaccgaacccctgcggggacggtccaccagtcctaaacccaaaagcgtcccaaaggactcaactgacagcccgggcagcgagaaccgagcaccaagtcctcatgtggtccaggagaacctccatagtgaggtggtggaagtttgtacctcctctacactgaagaccaactcactcacagatagtacctgtgatgacagctctgagtttaaatcggtagatgaaggctctaacaaagtccattttagtatcggaaaggcacctttgaaggacgaacaagagatgagggcaagtcctaaaatttcccgcaagtgtgctaaccgtcacacaagacccaagaaggagaagagcagcttcctcttcaaaggggacggaagcaagccactggagcccgcgaaacaggccatgtctcccagcgtcgcggaatgcgcccgcgctgttttcgccagctttctgtggcacgaaggaatagtccatgatgccatggcgtgttccagctttctcaaatttcatcccgagttgtcaaaggaacacgcgcccattagatcgtcgctaaattcccagcagcccaccgaggagaaagaaactaagctgaagaatagacattcgctggaaatcagctctgccctgaatatgtttaacatagctccccacgggcccgatatctctaagatggggtccatcaataagaacaaagtcctgagcatgctcaaagagccacccctgcatgaaaagtgcgaagacggcaaaactgagacaactttcgaaatgagtatgcacaatactatgaaatctaagtccccattgccgcttacactacaacacctggtagctttttgggaggatatttccctggccacgattaaagctgccagccagaatatgatcttcccctccccaggcagctgtgccgtgctcaaaaaaaaggagtgcgagaaggaaaataaaaaatcgaaaaaggaaaaaaaaaagaaagagaaggctgaagtgaggcctaggggaaacctcttcggagaaatggcgcagctggccgtcgggggcccagagaaggatacgatttgtgaactatgtggggaatctcacccatacccagtaacttaccacatgcggcaagcccacccaggctgtggaaggtacgctggaggccaggggtacaatagcattggccatttttgtggaggatgggcaggcaattgcggggacgggggtattggcggttccacctggtatctagtgtgcgaccggtgtcgggagaaatatctaagagagaagcaagcggccgctcgcgagaaggtaaagcagagccggagaaaacctatgcaagtgaagacccctagagcgttaccgacgatggaggctcatcaggtcattaaagctaacgcactgtttcttcttagtttgagctccgctgctgagccctccattttatgttaccatcctgctaagccgtttcagtcacagctccctagtgtgaaggaaggcatttctgaggatctcccggtcaagatgccctgcctgtaccttcagacactggcccgtcaccaccatgagaacttcgtggggtatcaggacgataatctgttccaggatgagatgcgatacttgagatcaacctccgtgcccgccccttatatctctgtcacacctgatgcttcccctaatgtgtttgaagagcctgaatccaatatgaagtccatgcctccatcgcttgaaactagccctatcactgatactgatctggctaaaagaacagtatttcagagatcttacagcgtggtggcatctgaatatgataagcagcattccatactgccagcaagggtgaaagcgattcccagacgcagagtcaactccggagacacagaagtcggttcctcacttctccgccaccctagccctgaactgagtcgtctgataagcgcacatagttcattgtctaagggagaacgtaatttccagtggcccgtgttggcttttgtgatccagcaccatgacctggaagggttggagatcgccatgaaacaagccctgagaaagtctgcatgtcgtgtgtttgccatggaagcttttaattggctcctttgtaacgtcatacaaacaacatcccttcatgacattttatggcattttgtagctagcctcacgccagcacctgtcgagcccgaagaagaggaagatgaagagaacaaaacatcaaaggaaaattctgagcaggagaaagatacacgagtgtgtgaacatccactgagtgacattgtgatcgccggcgaggccgcacacccattgccccatacctttcatcggctcttgcagaccatctccgacttaatgatgtccctccccagcggttctagcctgcaacagatggctcttcggtgctggagcctgaagtttaagcagagcgatcaccagtttctgcatcagtcaaacgtgttccaccatataaacaacattttatccaagagcgacgatggggattccgaggagagttttagcatttcgatccagtcaggttttgaagcaatgtcccaggagctttgcattgttatgtgcttaaaggatctaacctcaatcgtggacataaagacatcaagcagacccgcaatgatcgggtctttgactgatgggtcaactgaaaccttctgggagtcaggcgacgaagataagaataagaccaagaacatcacgatcaattgtgtgaagggcatcaacgcacggtacgtgagcgtacacgtggataattctcgcgacctgggaaataaagtgacatctatgacgttccttacgggaaaggccgtggaggacctttgcaggatcaaacaggtggatctcgatagtaggcatatcggatgggtgacaagtgaacttcctggaggggacaaccacattatcaaaattgaactgaagggcccagaaaacacattgcgggtgcgacaggtgaaagttcttggatggaaggacggagagtcaaccaagattgcagggcagatcagcgcatccgtagcacagcaaaggaactgtgaggctgagaccctgcgggttttcagactgattactagtcaggtctttggtaaactgatcagcggcgacgccgaacccacgccagagcaggaagagaaggctcttctgtcgtctcccgaaggcgaggagaaggtttacaatgctacatccgacgccgatcttaaggagcacatggtgggaattattttctcaagaagcaaattgactaacctgcagaaacaagtttgcgctcatattgtacaggcaatcagaatggaggcgaccagggtccgggaggaatgggagcacgcgattagcagcaaagagaacgctaattcccagccgaacgacgaggacgcatcatcagatgcgtactgttttgaactactgtccatggtgctggcgctgtctgggagcaatgtcggaaggcagtacctcgcccagcagttgactcttttgcaggacctttttagcctcctgcatacggccagcccacgcgtccagaggcaggtcacttccctgctaaggcgggtgttacccgaggtgaccccgtcgagactggcttcaatcatcggagtgaaaagcctgcccccagccgatatttcagacatcattcattccaccgaaaaaggagactggaataagcttggaatactggatatgttcttgggctgtattgctaaggccctgaccgtccagctaaaagctaaaggaacgacaatcaccggcacagccgggacgactgtggggaaaggagtcaccaccgtcacacttcctatgatctttaacagttcatacctccggcggggcgaaagtcattggtggatgaaaggatctactcctacgcaaatcagtgagatcataattaaactgattaaggatatggcagccggccatctcagcgaagcctggagccgagtgacgaagaacgcaattgccgaaactataatcgcattaacaaaaatggaggaggagttcaggagtcctgtcagatgtattgccaccaccaggctgtggcttgccctcgcgtcgctgtgtgtgctggatcaagatcacgtggaccggctgtcaagcggccgttggatgggtaaggacggacagcagaaacaaatgccaatgtgtgacaaccacgatgacggggagaccgctgccatcatcctgtgcaatgtgtgtggcaacctctgtactgactgtgaccgtttcttacacctccatagaaggactaaaacccaccaaaggcaggtattcaaggaggaggaagaagccatcaaggttgatctgcacgagggctgtgggaggactaaactcttttggttaatggcgctagcagactctaagacaatgaaggcgatggtagaatttcgggagcacactgggaagcctactacatcctcatcagaggcctgccgcttctgcggtagtcggtcaggaacagaattatccgcggtaggatctgtctgttcggacgctgattgccaggaatacgccaaaatcgcctgctcaaaaacccacccttgcgggcatccttgtggaggcgtcaagaacgaggaacattgtcttccatgcctacatggttgcgataagagtgcaacaagcttaaaacaggatgcggacgatatgtgtatgatatgcttcaccgaagccctcagtgctgcgcccgccatacagttggattgcagtcacatctttcacctgcagtgttgccggagagtgttagagaacaggtggctcggacctcggattacatttggctttataagttgtcccatctgtaaaaacaagatcaatcacatcgttctcaaggatctcttggatcctatcaaagagctatacgaggatgtaaggagaaaggcactcatgcgactcgaatatgagggactgcataaatcagaagctatcactacacccggagtaagattctacaacgaccccgccgggtacgctatgaatcgctatgcctactacgtgtgctataaatgtcgcaaggcctactttgggggggaggctcggtgtgatgcagaggcaggccggggggacgactacgacccacgggagctcatatgcggcgcctgctcagacgtgtcgagggcacagatgtgtcctaaacacggaaccgatttcctcgagtataagtgtcgctactgttgttccgtcgccgtcttcttctgctttggcactacacacttttgcaacgcctgtcatgatgatttccagagaatgacatcgatcccaaaggaagaattaccccattgcccggcaggccccaagggcaaacagcttgagggcacagaatgccctcttcacgtagtgcatcctcccactggcgaggagttcgcactcggatgtggcgtttgcaggaacgctcacactttctag

SEQ ID NO: 25156 - DNA, 930 bp, Artificial Sequence
  Description of Artificial Sequence: Synthetic coding sequence
atgcggcccgaccgggccgaggcccccggcccccccgccatggccgctgggggtccaggcgccggatccgccgccccggttagcagcactagctccctgcctctcgcagctctaaatatgcgagtgcggaggagactgtccctgttcctcaacgtgcgcacacaggtggctgcagactggacggccctggcagaagagatggacttcgagtatttagagatacgccaactagagacacaggccgaccccaccggtaggctgctcgatgcatggcaaggccggcctggcgcatccgtcgggcggctactcgagttgctgacaaagctgggaagggatgacgtgctgctggaactgggacctagcatagaggaagattgtcagaaatatatcttgaagcagcaacaggaagaggccgagaagccactgcaagtcgctgctgttgattcgtccgtgcctagaacagcggaattggccggtataaccaccctggacgatccattgggccatatgcccgagcggtttgacgcattcatttgctactgcccatctgatattcaattcgtgcaggaaatgatccggcaactggaacaaactaactataggttgaagttgtgcgtgtctgaccgtgacgtccttcccggaacttgtgtgtggtcaatcgcttctgagttaattgaaaagcggtgtcgaaggatggttgtggtagtgtcggatgactatctgcagagcaaggagtgtgacttccagaccaaattcgccctgagcctctctccaggggcccaccagaagaggctaattccgataaagtacaaggccatgaaaaaggagttcccttcaattctgcgtttcattaccgtgtgtgattatactaacccctgtaccaaaagctggttctggacaagattggcaaaggctctgagtttgccttag

SEQ ID NO: 25157 - DNA, 858 bp, Artificial Sequence
  Description of Artificial Sequence: Synthetic coding sequence
atggccgccggcggccccggcgccggcagcgccgcccccgtgagctctaccagcagtttgcctctggctgccctcaacatgcgtgtgcgacggcggcttagcttgttcctgaacgttcgtactcaggttgcagcagactggactgccctggcagaagagatggatttcgagtatcttgagatccgccagctagagacacaggctgacccaactggcgctagcgtcggtaggctattggagctgctaaccaaactggggcgagatgacgtcctcctcgagttaggacccagcatcgaggaagattgccagaaatatatcctgaaacagcagcaggaggaggccgagaaacctctgcaggttgcagcagtcgattcgtctgtcccgcggaccgccgagctggcaggtattactactctggatgatccgctcgggcatatgcccgaaagattcgacgccttcatatgctattgcccctctgacatccaattcgtgcaggagatgataagacagttggagcagaccaattacaggttaaagctttgtgtgtctgatagagatgtgctgcctggcacttgtgtgtggtccatagcctccgagttgatcgaaaagagatgcaggcgtatggttgtagttgtctccgacgattatttgcagagtaaagaatgtgatttccagactaaattcgccctgtctctcagccccggggcacaccagaagcggttaatccctataaaatataaggctatgaaaaaagaatttccatcaattttgcgatttatcaccgtgtgtgactacaccaacccgtgcacaaaaagctggttctggactcggctagccaaagccctgagcttgccttag

SEQ ID NO: 25158 - DNA, 954 bp, Artificial Sequence
  Description of Artificial Sequence: Synthetic coding sequence
atgcggcccgaccgggccgaggcccccggcccccccgccatggccgccggagggcccggagccggatcagcagctcctgtgagcagcacgtcctcactacccctggccgcgctgaacatgagggtccgcagaagactgagtttgttcctgaatgtacgcacccaggtggctgccgattggactgctttagccgaggaaatggactttgagtacctggagattcgtcagctagaaacccaagccgatccgactgggaggttgttagatgcttggcagggaagaccaggcgcaagcgtggggaggctcctcgagcttctgacaaagctgggtagagacgatgtgttgttagagctagggccatctatcgaagaggattgtcagaagtacatcctaaagcaacagcaggaggaggcagagaagcctctacaggtggccgcagttgattcttccgtgcccaggactgcagaacttgccggaatcaccacacttgacgaccccctgggtcacatgcccgagcgcttcgacgctttcatttgttactgcccctctgacatacagttcgtgcaggagatgatccgccagctggagcagacaaattaccgactcaagctatgcgtgtccgacagggacgtcttaccagggacttgcgtatggtctattgcatctgagttgattgaaaaaagactggccaggaggcctaggggcggctgccgaaggatggtggtcgtggtgtcagacgattatttacagagtaaagaatgcgacttccagaccaagttcgctctctcacttagtcctggcgcccatcagaagcgcctgatcccaatcaaatataaggccatgaaaaaggaattcccttccattctccgttttatcacagtatgtgactacaccaacccatgtactaaatcatggttttggactcggctggctaaagccttgagtctcccttag

SEQ ID NO: 25159 - DNA, 510 bp, Artificial Sequence
  Description of Artificial Sequence: Synthetic coding sequence
atggccgccggcggccccggcgccggcagcgccgcccccgtgagctccacttcgagcctccccttggccgccctcaatatgagggttaggaggcggctgtccctctttctgaatgtcaggacacaggtcgcagctgactggaccgccctcgctgaagagatggatttcgagtacctggaaatccgccagctggagacccaggctgaccccaccggccggctattggatgcgtggcagggccggccaggcgctagcgtcggtaggctacttgagctgctgaccaaacttggacgggacgatgtgctgctcgaactaggcccaagcatagaggaagactgtcagaaatatattctgaaacagcagcaggaggaggccgaaaaacctcttcaggttgctgccgtcgactcgagtgtccctccccacttaatgactccgtggggaatctgcttgtcagtgagcatgcctagcagtgccatcgcacctgcaacgtcctctctttgcagaagatag

SEQ ID NO: 25160 - DNA, 963 bp, Artificial Sequence
  Description of Artificial Sequence: Synthetic coding sequence
atggagctgctgagcccccccctgcgggacgtggacctgaccgccccggatgggagcctctgttcgtttgcgaccaccgacgatttctacgatgacccttgcttcgactcacctgacttgagattcttcgaagatcttgacccgagactcatgcatgtcggagcgctgcttaagcctgaggaacatagtcatttccccgctgctgtccaccctgcccccggggcaagagaggacgaacatgttcgtgctccgtccggtcaccatcaagccggccggtgcctgctgtgggcttgtaaggcctgtaagagaaaaaccaccaacgccgatcgcagaaaggctgccaccatgcgtgaaagaaggcgcttgtccaaggttaatgaggcatttgaaactttaaagcggtgtacttcttccaaccccaatcaacgactgccaaaagttgaaatcctcaggaatgcaattcgatatattgaggggctgcaggcactactgagagatcaagacgcagctcctccgggcgctgccgccgctttctacgcacctggaccactgcctcctggccgagggggggagcactatagcggggactcagacgcatcctcaccccgttcaaattgttcggacggtatgatggattacagcggaccgccctctggagctcgccggcggaactgctatgaaggggcgtactacaacgaagccccctccgaaccgcgccccgggaagtcggcagctgtgagctctttggactgtttgtcctctatagttgaaaggatctctaccgagtctccggcagccccggctttgttgctcgccgacgttcctagtgagagtccaccgcggcgtcaagaggctgcggcgcccagcgaaggagaatctagtggagacccaactcagtcacccgacgctgccccgcagtgcccagccggggcgaaccccaatcccatataccaagttctgtag

SEQ ID NO: 25161 - DNA, 5538 bp, Artificial Sequence
  Description of Artificial Sequence: Synthetic coding sequence
atgggcgacgtgaagctggtggccagcagccacatcagcaagaccagtctgtcagtcgacccgtctagggttgactcaatgcccctcactgaagcccctgcctttatactccctccacggaacctgtgcattaaggagggggctactgcaaagttcgagggacgcgttaggggctacccggaaccacaggtcacttggcaccggaacggacagcctataacatctgggggacgcttccttctggattgtggaatccgcggaacgttcagtctggtcatacatgctgtccatgaagaagatcgcggcaagtacacctgcgaagcaactaatggctctggcgcaagacaggtgacagtcgaattgactgttgagggctcctttgccaaacagcttggccaacctgttgtctccaaaactctcggggatcgtttctcagccccggccgtggagaccagaccgagcatctggggcgagtgccctcccaagtttgcaactaaactcggccgcgtggtggtgaaagagggacagatgggacggtttagttgcaaaattacgggccgccctcagcctcaagttacctggctgaagggtaatgtgccattacagcctagcgcccgggtgagtgttagcgagaagaatggcatgcaagtgctcgagatccacggagtgaaccaggacgacgtaggggtctacacttgtctggtggtgaatggctctggcaaggcgagcatgtctgcagagcttagcattcaagggctagacagcgcaaataggtcgttcgtgcgagagacaaaggccaccaactcagatgtgcgcaaagaagtgacgaatgtgatctctaaggagtccaagctcgatagcttggaagcggcagcaaagtccaaaaactgcagctccccacaaagggggggatcccctccatgggccgccaacagccagccgcaaccgccccgcgagtccaagctcgagtcatgtaaggatagccctcgaacagcccctcagacgccagtgctgcagaagaccagctcttcgatcactttacaggcggctagagtgcagcctgagccaagggcccctggacttggagtactgtctccgtcaggagaagaacgtaaacgccccgcgccaccccgacctgcaacatttcccactcgacaacccgggttaggttcccaggatgtggtcagtaaggccgctaacagacgaattcctatggaagggcagcgagattctgcttttcccaagtttgaaagcaagcctcagtctcaggaagtcaaggagaaccagaccgtaaagttcaggtgcgagggactcgccgtgatggaggtcgcccctagtttctcgtctgttttgaaggattgcgctgtgatcgaggggcaggactttgtgctgcagtgtagcgtcaggggcaccccagttccgcggataacctggctcctgaatgggcaaccaatccagtacgcccgctcaacatgcgaagctggcgtagctgagcttcatattcaagacgcactgcctgaggatcatggtacatacacctgccttgctgagaacgccctaggccaagtttcctgttcggcttgggtgactgtgcacgagaaaaagtccagtcgcaagagcgagtatcttctgcccgtcgctcctagtaagcctaccgctcccatttttttacaggggctttctgatttgaaagtaatggacgggagccaagtcaccatgacagtccaggttagtggtaaccccccacctgaggtaatctggttgcataacgggaatgagattcaggaatctgaggatttccacttcgaacagagaggtactcagcatagtctttgtattcaggaagtctttccggaggataccggaacttatacttgtgaggcttggaacagcgcaggcgaagttagaacccaggccgttctgacagtccaggagcctcatgacggcacacagccgtggttcattagtaagccccgtagtgtaaccgcatctctggggcaatctgtgctgattagttgtgcaattgccggtgacccctttccaaccgtccactggttgagggacgggaaagccctgtgcaaagatacagggcatttcgaggtgctgcaaaacgaagatgtattcaccctggtgctgaagaaagtgcagccttggcatgcgggacagtacgaaattcttctcaagaacagagtgggagaatgtagctgtcaagtgtcactgatgttgcagaactcgagcgctagagcactccctcgaggacgagagcctgctagttgcgaggatctttgtggtggaggggtgggagcagatggcggaggaagtgataggtatggaagcctgcgccccgggtggcctgctcggggacaagggtggctggaagaagaggacggcgaggatgttagaggggtcttgaagcgcagggttgagaccaggcagcataccgaggaagccattcgacaacaagaggtagagcagttggatttccgcgacctgctgggaaagaaggtgagcacaaaaactcttagcgaggatgacttaaaggagatcccagccgagcaaatggatttccgggcaaacttacagagacaagtgaagccaaagaccgtgagtgaggaggaaaggaaagttcattcaccgcagcaggtggacttcaggtccgtgctggccaagaagggaacttccaagacaccagtccccgagaaagtccctccacctaaaccagcgactcctgatttccgatccgtgctgggtggaaagaagaagctgcccgcggaaaatggctcttctagtgccgagacactcaacgctaaagcagttgagagcagtaaaccgctgagcaatgctcaaccttcaggacctctgaagcccgtgggcaacgcgaaacccgccgaaaccctgaaaccaatgggcaacgccaagcccgcagagacactcaagccaatgggtaatgctaagccagatgagaatctcaagtcagcctctaaggaagagctgaagaaggacgtgaagaatgacgtgaattgcaagaggggacacgctggtacaactgacaatgagaagcggtctgagtcccaggggacagccccagccttcaagcagaagttgcaggatgttcatgtggccgaggggaaaaaactgctattacagtgtcaggtgagttcggaccctcccgctaccattatctggaccctaaatggtaaaaccctaaagacaacgaagttcatcatattgtcccaggagggttccctttgtagcgtgagtatcgagaaggcactgcctgaagacagaggcttgtataaatgcgttgctaagaacgacgccgggcaggccgaatgcagctgtcaagtcactgtcgacgatgccccagcatctgaaaataccaaggccccagagatgaagtccagacgacctaagtcttccttgcctccagtgctcggcacagaatccgacgccaccgtgaagaagaaacctgctcccaagacaccccctaaagcagctatgcctcctcaaataatccagttccctgaggatcagaaagtgagggccggggaatcagtggaactgttcggcaaagtgaccggaacacaacccattacttgtacctggatgaagttccggaaacagatccaggagtccgagcacatgaaagttgagaactcagagaacggaagtaaactcacaatcctggctgcccggcaggaacactgtgggtgctatactctgctggtggaaaacaaattaggctccagacaggcacaagttaacctgactgtcgtcgataaaccagatcctcctgctggcactccgtgcgcatccgacatcagaagttccagtctcaccctctcatggtacgggagtagctacgacggaggttccgccgtgcaaagttacagcattgaaatctgggactccgccaacaagacatggaaggagctcgcaacatgtaggtccacctcctttaatgttcaggacctactgcccgatcatgagtacaagttccgggtgcgggcaataaacgtatacggcacgtccgagcccagccaggaatccgagttaacgactgtgggcgaaaagccagaagagcccaaggacgaggttgaggtgagtgacgacgacgagaaagagcccgaagtcgattaccgcacagttaccattaatactgaacagaaggtgtcggacttttacgatattgaggagcgcctggggtccggaaagttcggtcaggtgtttagactggtggagaagaaaactagaaaggtctgggccggcaagttctttaaggcctactcagcaaaggagaaggaaaacattcgccaggaaatctccattatgaattgtctgcatcatcccaaactggtgcagtgcgtggatgcgttcgaggaaaaagcaaacatcgtgatggtcctcgaaatagtgagtggaggtgaactgtttgaaaggatcattgacgaggactttgagttaactgaacgggagtgcattaagtacatgaggcaaatttcagaaggagtggaatatatccataagcagggaatcgtgcacttggatcttaagccagaaaacattatgtgcgtgaacaagactggcacgagaatcaaactgatcgatttcgggttggctcgccgtcttgaaaacgcaggctcgttaaaggtactgtttggcacccccgaattcgtcgcccctgaagtgatcaattatgaacccatcggctacgctaccgacatgtggagtattggcgttatatgttacatcttggtgagcggcctaagccccttcatgggggataatgataacgagaccttagccaatgttacctctgctacttgggatttcgacgacgaagcctttgacgaaatctctgatgatgccaaggatttcatttctaatctgctgaagaaagacatgaaaaatcgcctggactgcacacaatgccttcagcacccttggctcatgaaggataccaaaaacatggaggccaaaaagctcagcaaggaccggatgaagaagtacatggcccggcgaaagtggcagaagacaggcaacgctgttcgagcaattgggagactctcaagcatggctatgataagcggtctttcaggcaggaaatcgagcacaggttccccaacatctcccctgaatgctgagaagttggaaagtgaggaggatgtctctcaagccttcctcgaagccgtggcagaggagaagccacacgtgaaaccctatttcagcaagacaatccgcgaccttgaagtggtggaaggttccgccgcgaggttcgattgcaagatcgaagggtatcccgatcccgaggtcgtttggtttaaagatgaccaatctattagggagagccgccacttccagattgattacgatgaagatggaaactgctccctgattataagcgacgtatgcggagatgatgacgccaagtacacttgtaaagccgtgaactctctgggcgaggctacctgcaccgcggagttaatcgtcgagactatggaggagggcgagggcgagggggaggaggaggaagagtag

SEQ ID NO: 25162 - DNA, 2145 bp, Artificial Sequence
  Description of Artificial Sequence: Synthetic coding sequence
atgaagagccggcggcccaagagcagcctgccccccgtgctgggcacagagagcgatgccaccgtgaagaagaagccagcccctaagacccctccaaaggcggctatgccgccacaaattatccagtttccggaagaccagaaggttagggccggcgagtcagtagaactgtttgggaaggtaaccggaactcagcctatcacttgtacttggatgaagttccgcaagcaaatccaggagagcgaacatatgaaagtcgagaactcagaaaatggttccaagttaacgatccttgcagcccggcaggagcattgtggctgctacaccctgctggtggagaacaaactgggatcgaggcaagcccaggtcaatctgacagtagtggataaacctgatcctcctgcaggcacaccttgtgcctccgatatcagaagcagttcgctcaccctgtcatggtacgggtccagttatgacgggggtagcgctgtacagtcttattccattgaaatttgggactcggcgaacaagacttggaaagagcttgccacctgcagatctacgagttttaatgttcaggacctactgcctgatcacgaatacaagtttagggtacgagccatcaacgtgtatgggacaagcgagccttcccaagagtctgagctaaccaccgtgggcgaaaaaccagaggagcctaaagatgaagtggaagttagcgatgacgacgagaaagaacccgaagttgactatcgtaccgtcacaataaacaccgaacagaaagtctccgatttttatgatatagaggaaagattgggatctggaaaattcggccaggtgttcaggttggttgaaaagaagactaggaaggtttgggccggcaaattctttaaggcatacagcgccaaagaaaaggagaatattcgacaggagatatctatcatgaactgcttacaccatcccaaactggttcagtgtgttgacgccttcgaggagaaagccaacattgtgatggtactggaaatagtgagcggtggagagctatttgagagaattatagacgaggactttgagctcacagagagagagtgcatcaagtatatgagacagatttcagaaggggtcgaatatattcataagcaaggcatcgtacatctcgacctcaaacccgaaaacatcatgtgtgttaacaaaaccggcactagaataaagctgattgacttcggactggcccgtcggctggagaacgcaggaagcctgaaggtcctgttcggaacccctgaattcgtcgccccagaggttattaattatgaacccatcggatatgctacggacatgtggtccattggcgtgatatgttacatcttagtgtcggggctgtccccgttcatgggagataacgacaacgaaacacttgccaacgtgacgtctgcgacttgggatttcgacgacgaagccttcgacgagatcagtgatgacgctaaggacttcattagcaatcttctgaagaaagatatgaagaaccgacttgactgtacacagtgcctccaacatccctggttgatgaaagatacgaaaaatatggaagccaaaaagttgtccaaagatcgcatgaagaagtatatggcccgtcggaagtggcagaagacgggcaatgctgtccgcgccattgggaggctgtcatctatggcaatgatttccggcctgtcaggaaggaaaagttctacagggagcccaaccagccctttaaatgctgaaaagctggaatcagaggaggacgtgtcacaggcctttttggaagctgtggcagaggagaaaccccatgtgaaaccatacttttctaaaacaatcagagatctggaggtcgtcgaaggcagcgctgcccgcttcgactgtaagatagagggttacccagatcctgaagttgtgtggtttaaggatgaccaaagtatccgggagtccaggcattttcagattgactacgatgaagacggaaattgttctttaattatctctgatgtgtgcggggacgacgatgccaaatatacttgcaaggccgtcaattcattaggcgaggctacttgcactgccgaactaattgtggaaaccatggaagaaggtgaaggcgagggcgaagaggaggaggaatag

SEQ ID NO: 25163 - DNA, 5592 bp, Artificial Sequence
  Description of Artificial Sequence: Synthetic coding sequence
atgggcgacgtgaagctggtggccagcagccacatcagcaagacctctctttccgtcgacccctcaagggtggacagcatgccactcaccgaagccccggcgtttatcctgccacctcggaatctgtgtatcaaagaaggtgctacggcaaagtttgagggccgtgtgcgagggtacccagagccacaggtcacatggcaccgaaacggacagcctataacctctggaggcagattcctgcttgactgtggcataaggggcacgttcagcctggtgatccacgcagtgcacgaggaagaccgcggtaaatacacatgcgaggctactaacggtagcggagctcggcaggttaccgtcgagctcaccgtggaggggtccttcgccaaacagttaggtcagcctgtggtgtccaagacactaggcgataggttctctgctccggcagtggagacccgcccctccatttggggggagtgtccaccaaagttcgctactaagctcgggcgcgtcgtggtcaaggaaggacagatggggagattctcctgtaaaatcactggccgaccacaaccccaagtaacgtggctgaagggcaacgtgccactgcagccaagtgcacgtgtgagcgtgtccgaaaaaaacggtatgcaggtgcttgaaatacatggtgttaaccaagacgacgtaggggtctatacatgtctagtcgtcaacgggagcgggaaagcaagcatgtctgctgaactctccatccagggcctcgattcagccaatagaagtttcgttagagaaacaaaggctacaaactccgatgtgcggaaggaggtaaccaacgtgattagtaaagaatcaaagctcgactccctcgaggccgcggcaaagagtaaaaattgctctagcccacagagaggtgggtcacctccttgggccgccaattcccagccccaaccaccaagggagagcaaactcgaaagctgcaaggattcaccacggacggccccccagacaccggtactacagaagacttcctcttcaatcaccctgcaggctgcaagggtccaacccgaaccaagggcccccggcttaggggtcttgtctccatccggtgaggagcgcaagcggccggccccaccaaggcccgccacctttcctactaggcagcctggactcggaagccaggacgtggtctccaaggccgccaacagacggattccgatggagggacaaagagactccgctttcccaaaattcgaatcaaagccccagtcccaggaagtaaaagaaaaccaaactgttaaattccgctgtgaggtgagtggaatacccaaacctgaggtcgcttggttcttagaagggactcccgtgagacggcaggagggctcaattgaggtgtacgaagacgctgggagccactacttgtgtttgctgaaggcccgcacacgcgattctggaacatacagttgcactgcgtcgaatgcccaagggcagttatcctgctcatggaccttgcaggtggagcgccttgcagtgatggaagtggcgccttccttttcatcagttctaaaggactgcgctgtcatcgaagggcaggatttcgtgctccagtgcagcgtgcgagggacccccgttccaaggattacatggctactgaacggtcagccaatccagtacgctaggtccacctgcgaagcaggggtggccgagctccacattcaggacgccctgcctgaggatcacgggacctatacctgtctcgccgagaacgcactcgggcaggtgagctgctctgcttgggtcactgtgcacgagaagaagagttcacgaaagagcgagtacctgctgcctgtggcaccctcaaagcccaccgcaccaattttcctacaggggctgtcagatcttaaggtgatggacggctcgcaggtaactatgacagtccaggtctcaggaaaccctccgcctgaagtaatttggctgcacaacggcaatgaaatccaagagtccgaagacttccactttgagcagcgtggtacacagcattccctttgcatccaggaggtgtttcccgaggacactgggacctatacctgcgaggcatggaattccgccggagaggttaggacgcaggctgtgttgaccgtccaagagccccatgatggtacccagccgtggttcattagcaaacctagatccgtcacagcttcgcttggccagtctgtgctcatctcctgcgccatcgctggtgatccattcccaaccgtgcattggttgagagatggtaaagccctgtgtaaagacacaggtcacttcgaggtactacagaacgaggacgtcttcacccttgtcttgaagaaggtacaaccttggcatgcaggacagtatgagatactcctgaagaacagggtcggagaatgtagctgtcaggtttcactcatgcttcagaacagcagtgcccgggctctccctcgaggcagagagcccgcgtcctgcgaagatctatgtggcggaggcgtgggagctgatggtgggggtagcgatcggtacggatccttgcgccctggatggcccgcgcggggacagggatggctcgaggaggaagatggggaagacgttcgaggagtgctgaaaagacgggtggagacccggcagcacactgaggaggctatccggcaacaggaggtcgagcagttggattttcgggatctcttgggaaagaaagtgtccacaaaaacattgtctgaggacgatctcaaagaaatccccgctgaacagatggattttcgcgccaatctgcagagacaggtcaagccaaaaacagtatccgaggaagaacggaaagtgcacagtcctcaacaggtcgattttagaagcgtgctggcaaaaaaaggaacatcgaaaactcccgtgcctgagaaagtgcctcccccaaaaccagccactcccgatttccggtctgtccttggaggaaaaaagaaactgcctgcagagaatggctctagcagcgccgaaacactgaatgcgaaggccgtagaatcgagtaaaccattgagcaatgcccaaccttctgggcccttaaagccagtcggaaacgctaaacccgctgagacactcaagcccatgggtaatgccaaaccagccgagacactcaagcctatgggcaatgccaaaccagacgagaacctgaaaagtgccagtaaggaagagctcaaaaaggatgtgaaaaacgatgtcaactgtaaacggggccacgccggaaccactgataatgaaaagagatcagagtcgcagggaacggctcccgccttcaaacagaagctccaagacgtgcatgtggcagagggcaagaaattactgctgcagtgtcaggtttcttccgacccaccagcaaccatcatctggactttgaatggaaaaaccctaaaaaccacgaagttcataatactgtcacaggaggggtccctgtgcagcgtgtctatagaaaaagctctgccggaagaccgtggtctgtacaagtgtgttgccaagaatgacgccggccaggctgaatgtagctgtcaggtaaccgtggatgacgcccccgctagcgaaaacaccaaagcgcccgaaatgaaatctcgcaggccaaagtctagcctgccccccgtgctcggcacggagtccgatgctactgtcaaaaagaaacccgctccaaaaacaccacccaaagcggccatgccgccacagattattcagttccccgaggaccaaaaagtgagggcgggagaatccgttgaattgttcggtaaggttacagggacacagccaatcacttgcacttggatgaaatttcgaaaacagatccaggaatccgagcacatgaaagtcgagaattcagaaaatggtagtaagctcacaattcttgccgctcgacaagagcactgtggttgttatacattactggtggagaataagcttggatctagacaggcccaggttaatctgacagttgttgataagcccgaccccccggccgggacaccatgcgcgtctgatattcgcagctcatccctcacactctcttggtacgggagcagctacgacgggggctctgcggtacaatcatactcgatagaaatatgggactcagcgaacaaaacatggaaagaacttgcaacatgcaggagcaccagcttcaatgttcaggacctcctgcccgatcacgaatacaaattcagagtcagggccattaatgtctacgggacctcagaaccttcacaggagagcgagcttaccactgtcggtgaaaaacccgaggagcctaaagacgaagttgaggttagcgatgacgatgaaaaggagccagaggtcgattacaggacggtgaccatcaatacagaacagaaagttagcgacttttacgacatcgaagagcggctcggctctgggaaatttggtcaggtctttaggctggttgaaaaaaagacacggaaagtgtgggcagggaaattctttaaggcctactcagcgaaagagaaggaaaacatccgccaagagatctcaatcatgaactgccttcatcatccaaagctcgtccagtgcgttgacgcattcgaggagaaggcgaacattgtgatggtcttagagatagttagcggcggcgagctgtttgaaagaatcattgacgaagatttcgagctgaccgagcgagaatgtatcaaatacatgcggcagatctctgagggcgtggagtacattcataaacagggaattgtgcatctagatcttaaacctgagaacataatgtgtgtcaacaaaactgggactcgcatcaagcttatcgatttcggcctggctaggaggctagaaaatgcaggcagtctgaaggttttgtttggcaccccggagtttgtggccccggaggtcatcaattacgagccaatcggctacgcgacggatatgtggtcaatcggggtaatttgctacatactgaatcggctggactgcacacaatgcttacagcatccgtggctcatgaaagataccaagaatatggaggctaagaagctatccaaagacagaatgaagaaatacatggcaagaagaaagtggcagaaaaccggcaacgctgtccgggccattgggcgactttctagtatggctatgatcagtgggctaagtggccggaagtcctccaccggctctcctacctcccccctgaacgctgagaagcttgaatcagaggaggacgtttcccaggcatttctcgaggctgtggccgaggaaaagccccacgttaaaccctactttagtaaaacaataagggatcttgaagtagtcgagggaagtgctgctagatttgactgtaaaatcgagggttaccccgaccccgaagtggtgtggtttaaagacgatcagtccattagagagagcagacactttcagattgactacgacgaagacgggaattgcagcttaattataagtgacgtatgcggtgatgatgacgcgaaatacacttgcaaagcggttaacagccttggagaagctacctgcacagccgaactaatagtggagacgatggaggaaggggaaggcgagggagaggaggaggaggaatag

SEQ ID NO: 25164 - DNA, 5745 bp, Artificial Sequence
  Description of Artificial Sequence: Synthetic coding sequence
atgggcgacgtgaagctggtggccagcagccacatcagcaagaccagcctgagcgttgacccttccagagtggactccatgccactgactgaggcgcctgcctttattctccccccccgaaatctgtgtatcaaagaaggtgccaccgcaaaatttgaggggcgcgtcagagggtatcccgaaccccaggtaacatggcaccgcaacggacagccgataacgtctggaggcagatttctgctcgattgcggaattcggggaacattttctctggtgatccatgccgttcacgaagaggacagaggtaagtacacatgtgaggctaccaatgggagcggtgctcgacaggtcaccgtagaactgacagttgagggctcatttgctaaacaactcggccaacctgtggtcagcaaaacactaggcgatagattcagcgcccctgccgtagaaaccaggccctcaatttggggggagtgtccgcccaaatttgctactaagctgggaagggtggtcgtgaaggagggccagatgggccgctttagttgtaaaattactggacgcccgcagcctcaggttacttggctcaaaggaaacgtacctctacagccatcagcacgggtgagcgtcagtgagaaaaacgggatgcaggtgctcgagattcatggcgtgaaccaggatgacgttggcgtctatacctgtttggtggtaaatggctctgggaaggcctcgatgtcagcagagctctcaattcaaggcttggatagcgcaaatcgctcgtttgttagggaaacgaaggccaccaacagtgatgtgcgtaaggaggtaaccaacgttatttctaaggaaagcaaactcgattcccttgaggcggccgctaaatccaagaattgttcttccccccagcgaggcgggagtcctccatgggctgctaactctcagccacagcccccaagggagtcaaagctggaatcttgcaaagattcccctagaactgcgccccaaacccctgttctgcagaagacttcctcaagtattactttgcaagctgctagagttcagcctgaacccagggcgcctgggctcggcgtactttccccaagcggagaggaacggaaacgcccagctccccccaggcctgctacctttcccacacgtcagcctggacttggaagtcaggacgtcgtgtcaaaagccgctaaccgccggattccaatggaaggccagagggacagcgcttttcctaagttcgagtccaagccccagtcccaggaggtcaaggaaaaccaaacggtgaaattccgctgtgaggtgtccggcatccctaagccagaggtcgcttggttcttggagggcacacctgtccgtcggcaagaaggctcgattgaggtgtacgaggacgctgggagccactatttgtgtctccttaaggctaggacaagggatagtggtacttatagctgcacagcttccaatgcacagggccaactatcatgtagctggacactacaggtggagcgcttggccgttatggaagtggccccctctttctcttcagtgctgaaagattgtgccgtcattgagggccaggatttcgtcttacagtgttccgtgcgtgggacgccagtgccccgtatcacctggttgcttaatggccaacccatacagtatgccaggtcaacatgtgaagccggagtggccgagttgcatatccaggacgcactacctgaggaccatggtacctacacctgtctggccgagaatgcccttggccaggtcagctgcagcgcttgggttaccgtgcacgaaaagaagtccagtaggaaaagtgagtacctcctccccgtggcgcccagtaaaccgacagcccccatattcctgcagggcctttccgatctaaaggtaatggatggctcccaggtgactatgacggtccaggtatctggtaatccccctcctgaggtgatatggctacataacggcaacgagatccaggagtctgaggactttcactttgaacagagaggcactcagcatagtctgtgcatacaagaagtgtttccggaggataccggcacatacacctgtgaagcttggaactcagcaggagaggtcagaacacaggctgtcctcaccgtgcaggagccgcacgacggaacacaaccgtggtttatctccaagcctagatccgtgaccgcttccctgggccaatctgttctcatctcgtgtgcaatcgccggggatccttttccgactgtacactggttaagggatgggaaggcactgtgcaaagatacgggacattttgaggtgctgcagaacgaggacgtgttcacactggttttgaagaaggtccaaccctggcatgcggggcagtatgagattctgctaaagaaccgtgtcggtgagtgtagctgccaggtgtccttaatgctgcagaactcctcagctcgagcactaccccggggcagggagcctgccagctgcgaggatctgtgtgggggcggggttggagctgacggcggcggatcggacagatatgggagcctgaggccaggttggcctgctagggggcaggggtggctggaagaagaagacggggaggatgttcgaggggtgctcaaaaggagagtggagactaggcagcatacagaggaggcaataagacagcaggaagtggagcaactggattttcgggatctgctgggaaagaaggtttctacaaagactctgtcagaggacgacctgaaagagattccagccgaacagatggacttcagagccaatctgcagagacaggtaaagcccaaaactgtgtccgaggaggaaagaaaggtgcattccccccaacaggtcgattttaggagtgttcttgcaaaaaaaggtacaagcaagacaccagttcccgaaaaggtgccaccacctaagcctgccaccccagactttcgctccgtactgggggggaaaaagaagcttccagccgagaatggcagcagcagcgccgagaccctgaatgccaaggctgtcgagagctctaagcctctaagcaatgcccagcctagtgggcctttgaaacctgttggaaatgcgaagcccgcggaaactttgaagcccatgggtaatgcaaagccagccgagactcttaaaccaatgggtaacgccaagccagacgaaaatcttaagagtgcgtctaaggaggaactcaaaaaggacgtgaagaacgatgtcaactgtaagcgagggcatgctggaacaaccgataacgagaaaagatcagagtcgcagggcacagctcctgcgtttaagcagaaacttcaggacgtccatgtggctgagggcaagaagctactgttgcaatgccaggtaagcagcgacccgcccgctactatcatatggactttgaatggcaaaacactgaaaaccacaaagtttatcatcctcagtcaggagggcagcctgtgttcggtgtccatagagaaagctctccctgaggatcgaggcctgtacaagtgcgttgctaagaacgatgccggacaggctgagtgttcttgccaggtcaccgtggatgacgcaccagcttctgagaataccaaggcaccagaaatgaagtcccgccggccaaaatctagcttgccccccgtgctgggaaccgagtccgatgcaaccgtgaagaagaaaccggcacctaagacacctcccaaggcggcaatgcctccccagattatccagtttccggaagatcaaaaagtacgagccggcgaaagcgtggagctgttcggaaaggtcaccggaacacaaccaataacctgtacctggatgaagtttcggaaacaaattcaggagagtgaacacatgaaagtggagaatagtgagaacggctcaaagctcacaatcttggcagccaggcaggagcattgtggatgctacactcttcttgtggaaaacaagctaggatctcgtcaggcccaggtgaatctcacggtggtcgacaagccagatcccccggccgggacaccgtgcgcgtctgacatccgttcctctagcctgaccctgtcttggtacgggtcatcatacgatggcggctctgcagtccagagctactctatcgaaatctgggattctgcaaataaaacatggaaggaactggccacatgcagatctactagctttaatgtacaggacctgttgcccgaccacgagtataagtttagggtgcgggccatcaatgtgtatgggacgagcgaacctagtcaagagtctgaacttacaaccgttggtgagaaacccgaggagcctaaagacgaggtggaggtgtccgacgatgatgagaaagagccagaggtagattatagaactgtcacaattaatacagagcagaaggtctccgatttttacgacattgaggagcgcttgggctctggtaaattcggtcaagtatttaggctagtcgagaaaaaaactaggaaagtgtgggccggcaagttctttaaggcttactctgccaaggaaaaggaaaatattaggcaagagattagtataatgaattgtctacaccatcccaagctggttcagtgtgttgatgccttcgaggaaaaggcgaacattgtgatggttctggagatcgtgagcggcggggagctctttgagaggatcattgatgaagatttcgagctcacagaaagggaatgcattaaatacatgcggcagataagtgaaggtgtcgaatacatacacaagcagggcattgtgcacctggatctgaaacccgaaaatataatgtgtgttaacaagacgggcacacggattaagctgatcgacttcggcttggcccgaaggctcgaaaatgcagggagtctgaaggtcttgttcgggacccccgaatttgtcgctcccgaggtcattaactacgaacccatcggctacgccacagacatgtggtctattggggtaatctgttatatcttggtgagtggcctgagcccatttatgggggataatgacaacgaaaccttggccaatgttacctcagccacctgggacttcgatgacgaagccttcgacgagatctccgacgatgcgaaggatttcatatcaaatctcctgaagaaggacatgaagaatcgtctcgattgcacccaatgtctgcaacacccctggctgatgaaggatactaaaaatatggaggcaaagaaactgtcaaaagatagaatgaagaagtacatggcaagaagaaagtggcaaaagaccggcaatgcagtgagggctatcggacgcctgagctccatggccatgatctcaggcttgtccgggcgcaaatcctccacaggcagtcccacctcccctctaaatgctgaaaagctggaaagcgaggaggatgtgagccaggcctttctggaagcggttgccgaagagaaacctcacgtgaaaccttacttctctaaaacaattagggatctggaggtcgtggaagggtctgcagcgcggtttgactgtaagatagaagggtacccggatcctgaggtagtgtggtttaaggacgatcagtccatccgggagtcaagacacttccagatcgactacgacgaggacggtaattgctcactgatcattagtgatgtgtgcggcgatgatgatgctaaatacacctgcaaggctgttaatagcctgggagaagccacttgcactgccgaactgatcgtagagacaatggaagaaggtgaaggggagggggaggaggaagaagaatag

SEQ ID NO: 25165 - DNA, 231 bp, Artificial Sequence
  Description of Artificial Sequence: Synthetic coding sequence
atgggcgacgtgaagctggtggccagcagccacatcagcaagacctcactcagcgtcgatccctcccgagtggactcaatgcctctcactgaggcgcccgctttcattctgcctccaaggaacctgtgtatcaaagagggagcaaccgctaagttcgagggccgggtaaggggctaccccgagccgcaggtcacctggcaccggaacgggcagcccattacgtccgggtag

SEQ ID NO: 25166 - DNA, 5592 bp, Artificial Sequence
  Description of Artificial Sequence: Synthetic coding sequence
atgggcgacgtgaagctggtggccagcagccacatcagcaagaccagtctgagcgtggacccctctcgcgtggactctatgcccctgaccgaggccccagctttcatcctaccccctaggaatttatgtattaaggaaggtgcgacagcaaagtttgagggccgtgttcgcgggtatcctgagccccaagtcacctggcatcggaatggtcagccaatcacaagcggcggaagattcctgctggattgcggtattcggggcaccttcagcctggttatccatgctgttcacgaggaggaccgggggaagtacacttgcgaagcaacaaatggcagcggagctcgccaggtaacagttgaactcacagtcgagggctcattcgccaagcagttaggccagcctgtggtgtccaagacactgggggatcgattctctgccccagctgtcgagacccgaccaagcatttggggcgagtgcccgcctaagtttgcaacgaagttaggaagagtagtggttaaagagggtcagatgggccggttttcttgcaaaatcaccggcagacctcagccgcaggtgacttggcttaagggaaacgtgcccttgcagccctccgctagggtgagcgtaagcgaaaaaaatgggatgcaggtgcttgagatccacggcgtaaatcaagacgatgtgggcgtctacacctgccttgttgtgaatggatccggcaaggcatctatgtccgccgagttgtctattcaagggctggattcagccaaccgaagcttcgtgcgggagacaaaagcaacaaatagcgacgtccggaaagaggtcaccaatgtaatttctaaggaatcaaagcttgacagcctggaagcagctgctaagagcaagaactgctcctccccacagagaggcggatcccccccttgggctgctaatagtcaaccacagccccctagagaatccaaattggagtcctgtaaagatagcccacggaccgctcctcagacgcccgtgctgcagaagacctcctcctcaatcacactccaggcagctcgggtacagcctgagccaagagcccccggcctcggcgtgttaagcccctccggagaagagcggaagcggccagccccacctcggccagccacctttcctacgcggcagccaggcctgggttctcaggatgtggtctcaaaggccgcgaataggaggattcccatggagggccagcgagattccgcttttcctaagttcgagagcaagccccaatctcaggaggtgaaggaaaaccaaacggtaaaattccgatgtgaagtgagtggtatccctaagcccgaggtagcctggttcctggaaggaactcccgtgcgccgacaagaggggtccattgaggtctatgaggatgccgggtcacattacctgtgtctgctgaaagctcggacacgggactctggcacatatagctgtaccgcatccaatgcccagggccaactctcttgtagttggacacttcaggtcgaaaggctcgccgtgatggaagtggctccaagcttttccagtgtgctgaaggactgcgctgtgattgagggccaggactttgtcttgcagtgcagcgtgagaggtactcccgtgccacggattacctggctgctgaatggccagcctatccagtatgcccgttccacctgtgaagcaggcgtcgcagagcttcatatacaggacgcgttgcctgaggaccatggaacctatacgtgtctcgcagaaaacgcacttgggcaggtttcgtgcagcgcctgggttacagtacatgagaaaaagtcctctcgaaaatccgaatacctgctcccagttgcccccagtaagccaacagcaccgatcttcctccagggcctctctgacctaaaggtgatggatggatctcaagtaactatgacagtccaggtctccggaaacccgccgcctgaggtcatctggctccacaatggcaatgaaattcaggaatctgaggacttccacttcgagcagagggggacccagcacagcctctgcatccaggaggtgttccccgaagacacaggaacctacacctgtgaagcatggaacagcgcgggtgaagttagaactcaggctgtgctcacagtgcaagaacctcacgacggcacacagccctggttcatttccaaaccacgctctgttaccgcatctctcggccaaagcgtgctcatctcctgcgctattgccggcgatcctttccctactgtccattggctaagagacgggaaggccttgtgcaaggacaccgggcatttcgaagtgttacagaatgaagacgtcttcactctggtactcaagaaagtccaaccatggcacgccgggcagtacgaaatcctcctgaagaatagagtcggggaatgctcttgccaggtgagtctgatgctgcaaaactctagtgcgcgcgcgctccccagagggagggagcctgcctcttgcgaagatttgtgcggtggaggagttggggccgacggtggaggctcagatagatacggcagcctgaggcccggatggcctgctagagggcaaggctggctggaagaggaggatggggaggacgtgaggggcgtgttgaagaggagagtggagacccgacaacatacagaagaggcaatccggcaacaggaggtggagcagctagattttagagaccttctggggaagaaagtctcaaccaaaacactatccgaggatgacttaaaggaaattccggcagagcagatggatttccgggccaatttacagaggcaagtgaagccaaagactgtgagcgaggaggagcgtaaggtgcacagcccacaacaggtggactttaggtctgtcctagctaaaaaaggaacgagcaaaactccggtgcccgagaaagttccaccaccaaagcctgcaacacccgactttcgttccgttctcggagggaaaaaaaaactaccggccgaaaacggcagctcttctgccgaaactctgaatgccaaggctgtggagtcctctaaaccactatctaacgcccaaccctctggacccttaaaacccgtcggcaatgcgaagcctgccgaaacactgaaacctatggggaatgcaaagcctgccgaaactctgaagcctatgggcaacgcaaagcctgatgagaacctcaagtccgcctccaaagaggagttgaagaaagatgtgaagaacgatgtgaactgtaagcgaggacatgcaggcaccaccgataatgagaagcggagcgagagtcagggcacagcccctgcttttaagcagaaactacaggacgtgcacgtggcagagggcaaaaaactccttctgcaatgtcaggtgtcttctgatccaccagcaaccatcatttggactttgaatggcaagacacttaaaaccacaaaattcatcatcctgtcccaagagggcagcctgtgcagcgtgagcattgaaaaagcgttgccagaggaccgaggcctgtataaatgtgtcgctaagaatgacgctggccaagctgaatgctcctgtcaggtgacagtggatgacgctcccgcctcagaaaatacaaaggcacctgagatgaagtcaagacgtcccaagtcttcactgcctcccgtccttggaaccgagagcgacgcaaccgtgaaaaagaagccagcacccaagaccccgccaaaggctgccatgccccctcagatcatccaattccccgaggaccagaaagtgcgggccggcgagagcgtggaactgttcggcaaagttactggtactcaacctattacatgtacttggatgaagttccggaagcaaattcaggaaagtgaacacatgaaagtcgaaaactccgaaaacggcagcaagctaaccatactggccgctcgtcaagagcactgcgggtgctacactttgcttgtcgaaaataagttggggagtaggcaggcccaagtcaatcttactgttgtggataaacctgacccccctgcgggaaccccatgtgcttccgacatccgctcaagctctttaaccctctcgtggtacggttcctcctatgatggaggtagtgccgtgcagtcttacagtatcgagatttgggatagtgctaacaaaacatggaaggaactggccacatgccggagcacgagctttaatgtccaggaccttctacccgatcacgagtacaaatttagggtgcgggcaattaacgtgtatggtacctcggaacccagtcaggaatccgagttgacgaccgtgggcgaaaaacctgaagagcctaaggatgaggttgaggtgtcagatgatgacgagaaagagccagaggtggactatcggacggtcactattaatacagagcagaaggtgtctgatttttatgatattgaggagcgtctgggcagtgggaagtttggccaagtgtttaggctcgtggagaagaagactcggaaggtttgggcaggaaagttctttaaggcctactccgccaaggaaaaggaaaacattcggcaagaaatcagtattatgaactgcctgcaccaccccaagctggtccagtgcgttgacgctttcgaggaaaaggccaacatcgtgatggtcctggagattgtatccggaggagagctttttgaaaggattatcgatgaggattttgagctgactgaacgagagtgtattaagtatatgaggcaaatcagcgaaggcgtggagtatattcacaagcaagggattgtccacctggatctaaagcctgaaaacatcatgtgtgtaaacaagactgggactagaataaagcttattgatttcggtctagccaggcgactcgagaatgccgggtccctgaaagtgttgtttgggacacctgagttcgttgcccccgaggttatcaactatgagcctatcggctacgctacagatatgtggtctattggcgtgatatgttacatcctgaaccgacttgactgtacgcagtgcctgcagcatccatggctgatgaaggatacaaaaaatatggaggccaagaagctctccaaggatcggatgaagaaatacatggccagaaggaagtggcagaaaaccggtaatgcagttcgtgcaatcggccggctatcctcaatggctatgatctccggactgtccggccgcaagtcatcaacaggttctcctacatccccactgaatgccgagaagcttgagtctgaggaagacgtttctcaggcttttctggaggccgtcgccgaggagaagcctcacgtgaagccctacttcagtaaaaccatacgggatctggaggtggttgaagggtctgcagctcgctttgactgtaaaatagagggataccctgaccctgaagtcgtatggttcaaagacgatcagtccattcgcgagagcagacattttcagatcgattatgacgaggacggaaattgttccctgattattagcgacgtgtgtggggacgatgacgccaagtacacttgcaaagccgttaactccttgggcgaggccacctgcacagccgagttgattgtagagaccatggaggaaggcgaaggtgaaggggaggaggaagaggagtag

SEQ ID NO: 25167 - DNA, 465 bp, Artificial Sequence
  Description of Artificial Sequence: Synthetic coding sequence
atggccatgatcagcggcctgagcggccggaagagcagcaccggctctccgacctctccgctcaacgccgagaaactggagtccgaggaagatgtgtcccaggcctttctggaagctgtggctgaggaaaagccacacgtgaagccatacttctcaaaaactatcagagaccttgaagtagtcgagggcagcgcggcgcggtttgattgtaaaattgaagggtatcccgatccagaggtcgtctggtttaaagatgaccaatccatccgggagagtcgccacttccagattgattacgacgaggatggcaactgcagcctcatcatctccgatgtgtgcggcgatgacgacgccaagtacacgtgcaaggccgtgaactccttaggagaggcaacatgcaccgcagagttgatcgtagaaactatggaggagggagagggcgagggagaggaagaggaggaatag

SEQ ID NO: 25168 - DNA, 5745 bp, Artificial Sequence
  Description of Artificial Sequence: Synthetic coding sequence
atgggcgacgtgaagctggtggccagcagccacatcagcaagacctcactgagtgtggacccaagtcgagtggatagcatgccgctaactgaggcccccgcattcatcttgcctccccggaatttatgtattaaggagggggctaccgccaaatttgaaggaagggtgagaggttaccctgagccccaggtcacctggcatagaaacgggcagcctattacctccgggggtcgcttcttgctcgactgcggcataagggggaccttttctttagtcatacacgccgtgcacgaagaggatagagggaaatatacctgcgaagcaacgaatggctccggggcacgccaggtgactgtagagctcacagtggagggttctttcgctaagcagcttggacagcctgtcgttagcaagactctgggcgaccggtttagcgctccagccgtggaaacccggcccagcatctggggggagtgtccacccaagtttgctaccaagctgggccgggtcgttgtgaaggagggccaaatgggcaggttttcatgcaaaatcacgggtaggccccagcctcaggtgacttggctaaaaggtaatgtgccgttacaacccagtgcgagggtcagcgtctcagagaagaatggaatgcaagtgctggagatccacggcgttaatcaggatgatgtgggggtttatacttgcctagtggttaatggttccggcaaggccagcatgagcgctgaattgagcatccaggggctggacagtgccaatcgatcatttgtacgggaaacaaaggccactaacagcgacgtgaggaaggaggtcacaaatgttatttccaaggagtcaaagctggactctttagaagccgccgccaagagtaagaactgttcttcaccacagcgcggagggagtccaccatgggccgccaattctcaaccacagcctccaagagaaagcaaactggagtcctgcaaagacagtccaagaaccgctccccagacaccagtgctgcagaagacaagctccagcattactttgcaggccgcgcgggtgcagcccgagccacgggccccagggctcggagtgttgtcgcctagcggcgaagagcggaagagacccgctccgccacggcctgccacgtttcccaccagacagccagggctggggtcccaggacgtcgtatcaaaggctgcaaataggaggatccctatggagggccagcgagacagcgcctttcctaaattcgagagtaagccccagagtcaggaggtgaaagagaaccagactgtgaaattcagatgtgaggtgtccggtattcctaagcccgaggtagcctggtttttggaaggcacacccgttaggaggcaggagggttcaatcgaggtatacgaagatgcgggcagtcactacctctgtctgctgaaagcgcggacacgtgacagtggcacctatagttgcacggcgtcaaatgcccagggtcaactgtcttgcagctggacacttcaagtggagcgtctagccgtcatggaggtggctccatcattttcatccgtattaaaagactgcgccgtgattgaaggccaggattttgttctgcagtgcagcgtccggggcaccccggtgccgaggattacctggctcctgaacgggcagcccattcaatatgcgcggagcacctgtgaggcgggtgtggccgaacttcatatccaggatgcactgcctgaagaccacggcacatacacttgtcttgcggagaatgcattgggacaggtgagttgttctgcctgggttacagtgcacgaaaagaaatcctcacggaaaagcgagtatcttctgccggtagcaccttccaagcccaccgctccaattttcctgcagggattgtcagacctgaaggtgatggatgggagtcaggtgacaatgacggtccaggtttccggtaacccccctcctgaagtaatatggctccataacggtaatgaaattcaagagtccgaagatttccacttcgaacagaggggcacccagcattcgctctgcatccaggaggtgtttccagaggacaccgggacctatacatgtgaggcatggaattcggcaggcgaagtccggacccaagccgtcctcactgtccaggaacctcacgatggcacccagccttggttcatttccaagcctagatctgtcaccgcaagcttgggccagtcagtccttatctcttgtgccatcgctggagatccatttccaaccgtccattggctgcgggacggaaaggcgctatgcaaggataccgggcactttgaagtgcttcagaatgaggacgtgtttaccctcgtattgaagaaggtccagccatggcacgccgggcagtatgagattctgttaaagaatagagttggagagtgcagctgtcaggtgtcactaatgctccaaaactccagcgcgagggccctgccccgcggcagagagccggcaagttgtgaagacctttgtggcggaggcgtgggggccgacgggggcggctctgatagatacggcagtttaagaccaggttggcccgccaggggacagggatggctagaagaggaagatggtgaggacgtgagaggggtgctgaaacgccgcgtggagaccagacagcacaccgaagaagcaatccgccaacaggaggtggagcagttagatttccgagatctgctgggaaagaaggtctccactaaaacactcagcgaagacgatctgaaagagattcctgccgaacaaatggatttccgcgctaatctgcagaggcaggtaaagccgaaaaccgtgtccgaagaagagcggaaagtgcattcgcctcaacaggttgacttcagaagtgtgctggccaagaagggcacaagcaaaactccagtgcctgaaaaagtgccaccgcctaaaccagcaactcccgactttcgctccgttctgggcggaaaaaagaagctgcctgctgagaatggcagctcaagcgccgagacactgaacgccaaggcagtggagtcgagcaaaccactgagtaatgctcagccttcagggcctttgaagccagttggcaatgcgaagcccgcagagacacttaaacctatgggtaatgccaagcctgccgaaacgttaaagcctatgggaaacgctaagcccgatgagaacttgaaaagcgccagtaaggaagaactaaaaaaagatgtgaaaaacgatgtcaattgtaagaggggccacgcaggaacgactgataacgaaaaaaggtctgagtcccagggaactgcacccgcctttaagcaaaaattgcaggatgtgcacgttgccgagggaaagaagctgctgctgcaatgtcaggtgtcttctgaccccccggccactataatttggacccttaatgggaagacactcaaaaccacaaaattcattatcctatcccaagagggatccctttgttctgtgtccatcgaaaaagcccttcccgaagatcgcggtctgtacaagtgcgttgctaagaatgatgcaggacaggctgagtgctcatgccaagtcacagtggatgatgccccagcttctgagaataccaaagcccctgagatgaaatcacgacgaccaaagagcagtctccctcccgttttgggcacggaatctgatgctacagtgaagaagaaacccgccccgaaaacccctcccaaggccgccatgccaccacaaattatacaattcccagaggaccagaaggtccgtgcaggagaaagtgtggaactttttggaaaggtgactggcacccagcccatcacatgtacctggatgaagttccggaaacagatccaggagtccgaacacatgaaggttgagaattcagaaaacgggtctaagctcaccattcttgctgcaaggcaggaacactgcgggtgttatacattactggttgaaaacaaattaggcagccgccaagctcaagtcaacctcactgtggtggacaagcctgatcctcccgcaggcacaccctgcgcttctgatattaggtcctcatctcttactctgtcctggtacggttcaagctacgatggaggtagcgctgtacaatcatattctatcgagatctgggacagcgcgaacaaaacgtggaaggaactcgctacctgtcgtagcacatcctttaatgtgcaggatctactcccggatcatgagtacaagttccgcgttcgcgccattaatgtctacggaacaagcgagccctctcaagagtctgaactcaccaccgtgggcgagaagccggaagaacccaaggatgaggtcgaggtaagcgacgacgacgaaaaagagccagaggttgactatcgaacggtgaccatcaacactgaacagaaggtttctgatttctatgatatcgaagaacggttgggtagtggtaagttcgggcaggtatttcgtctggtggagaagaagacacggaaagtgtgggccgggaagtttttcaaggcctacagcgcaaaggaaaaagagaatatcagacaggagatatccataatgaactgtctgcaccatccgaaattggtacagtgcgtcgatgctttcgaggaaaaagctaatatcgtgatggtcctcgagattgtaagtggcggggagttattcgaacggataattgacgaagacttcgagcttaccgagagagagtgcatcaagtatatgcggcaaattagcgaaggcgttgaatatatccataagcagggcatcgtccacctggaccttaaaccagaaaacatcatgtgtgtaaacaagactgggactcgtattaagctgatcgacttcgggctcgctaggcgcctggagaacgctggctcactaaaagtgcttttcgggacgcctgagtttgtggctcctgaggtcatcaactatgagcccattggatatgccactgacatgtggagtataggcgtgatctgttacatcctggtcagcggcctgagccccttcatgggcgacaatgacaatgagactctcgccaacgtgacctccgcaacatgggacttcgatgatgaggccttcgacgagatcagtgacgatgccaaagatttcatttccaacttattaaagaaagatatgaagaaccgcctcgactgcacccagtgcttgcaacatccgtggctgatgaaggacaccaaaaacatggaagccaaaaagctgtccaaggaccgaatgaaaaagtacatggccaggaggaaatggcagaagactgggaacgccgtgcgtgctataggtcgactgtcttcaatggcaatgatctctggtctatcaggtcgaaagagttccactggaagccctacctcacctctcaacgctgagaagttagaaagcgaagaagatgtaagccaagcattcttggaagcggtggctgaagagaagcctcacgttaaaccatactttagcaagacaatccgagacctcgaggttgtagaaggatcggctgcacggtttgactgtaagattgagggataccctgacccggaggtcgtttggtttaaggatgaccagtcaatccgggagagccgtcacttccagatcgactacgatgaagacggcaattgcagcctgattatcagcgacgtgtgcggagacgatgacgcgaaatacacatgcaaggctgttaatagcctgggcgaggcaacctgcaccgcagagctgatcgttgagacaatggaggagggagagggcgagggtgaagaggaagaagagtag

SEQ ID NO: 25169 - DNA, 5931 bp, Artificial Sequence
  Description of Artificial Sequence: Synthetic coding sequence
atggcccagcggaccggcctggaggaccccgagcggtacctgttcgtagatagagccgtcatctataatcctgctacacaggccgactggactgccaaaaaacttgtctggatcccttccgagcgccacggcttcgaggccgcatccatcaaagaagagcgaggtgacgaggttatggtagagctcgctgagaacggcaagaaggccatggtgaataaggatgacattcagaagatgaaccccccaaaattcagcaaggttgaggacatggccgagctgacctgtttgaacgaggctagtgtactgcataacctgaaggaccgatactatagtggactaatttacacttatagcggtttattttgcgtggttataaatccttacaagaaccttcccatctacagcgaaaacattatcgagatgtatcggggaaaaaagcgccacgagatgccccctcatatttatgctatctccgaatcagcttatcggtgtatgctacaagatagagaggatcaatccattctgtgtacaggggagtcaggcgccgggaagactgagaataccaaaaaggttattcagtacctcgctcatgtggcttcatcacataaaggtagaaaagaccacaatattccaggggagctggaacgccagctgctgcaggcaaatccgatcctagaatcgttcggcaacgctaaaactgtgaaaaatgacaattcgagtagatttggcaagttcattcggatcaacttcgacgtcactgggtacattgttggggccaacatagaaacctatctgctcgagaagtccagggctgtccggcaggccaaggatgagcgaacattccatattttctatcagctactctcaggggcgggggagcacctgaagtcagacctgttgctggagggattcaataactaccgattcctgtctaacgggtacattcccatcccaggtcaacaggacaaggataactttcaggagacgatggaggctatgcatataatgggcttctctcacgaggaaatactctccatgctcaaggtggtcagtagcgtgttacagttcggcaatatcagcttcaagaaggaacgaaacaccgatcaagctagtatgccagagaataccgtggcacaaaagctgtgtcacctgctcgggatgaacgtcatggagtttacacgcgcaatcttaacaccacgcatcaaggtcggacgggactacgtgcagaaggcccagactaaggaacaggctgacttcgccgtggaggctctggctaaggcaacgtacgaaaggctgttcaggtggctggtgcatagaatcaataaagcgctcgacagaacaaagcggcagggagcatcgtttatcggcattctggatatagcaggtttcgaaatcttcgagctgaattctttcgagcagctatgtatcaattatacgaatgaaaagttgcagcaactcttcaaccacaccatgttcatcttagaacaggaagagtaccaaagagaagggatagaatggaatttcatcgactttggcttagatcttcagccttgcattgatctgatagagaggccagctaatcctccaggggtgctcgctctcctcgatgaagagtgttggtttcctaaagccactgataagacgttcgtggagaaacttgtgcaggaacagggctcccatagtaaattccagaagcctcgccagctcaaggacaaagcggacttctgcatcattcattacgccggaaaggtggactataaagcagacgagtggctgatgaaaaacatggacccattaaatgataatgtggccacgttgctccaccagtcaagtgatcggttcgttgccgagttatggaaggatgtggatcgcatagtaggtttggatcaggtaacaggcatgactgaaactgccttcggcagcgcttacaagactaagaagggcatgttccgcacggttggacagctgtataaagagtccctcaccaagttaatggcaacattacgtaacacaaatccgaactttgtgcggtgcatcatccccaatcatgaaaagcgtgctggtaaactggatcctcacttagtcttggaccagcttagatgtaacggggtgctcgagggtatccggatttgccgacagggctttcctaaccgcatcgtgttccaagaatttaggcagcgctacgaaattctcactccaaacgctatccccaaaggcttcatggatggcaagcaggcttgcgagcgaatgattcgagccctcgagctggaccccaacctgtaccgcattgggcagtctaagattttcttcagggccggagttttagctcacctggaggaggagcgcgacctgaagatcacagatatcattatcttcttccaggcagtatgccgcggttacctggcccgcaaagcgtttgctaaaaaacagcagcagttgagcgctttaaaagtgctacaacggaattgtgccgcctatttgaagcttagacattggcaatggtggagagtatttaccaaagttaaaccactcctgcaggtgacacggcaggaggaggagcttcaggctaaggatgaagagctgctcaaggtgaaggagaagcaaaccaaggtggaaggagaactcgaggaaatggagcggaagcatcagcagctgctggaggagaaaaacatcctggctgagcagttgcaggccgagacagaactatttgccgaggccgaagagatgcgggcccggctagccgcgaagaaacaggaactcgaggagatcttgcacgacctagagtccagggtagaggaagaggaagaacgcaaccagattctacagaacgagaaaaagaagatgcaggcccatatccaagatctcgaggagcaattagacgaagaagaaggagctaggcagaagttgcaactggaaaaagttactgctgaagccaagattaagaaaatggaagaagagatcctgctactggaggatcaaaatagcaagttcattaaagagaaaaaacttatggaagaccgcatagcagagtgctcctcccaactggcagaagaagaggagaaagctaaaaacctggctaagataagaaataagcaggaagtgatgatctccgatcttgaagagcggctaaagaaggaagagaagacaagacaagagctggagaaggctaagcgcaaattggatggcgaaacaacagacctgcaggaccagattgcagagctgcaggcccagatcgacgagttgaaattacagctcgccaagaaagaagaagaacttcagggcgctctggccagaggggacgacgagactcttcataagaataatgccctgaaagttgtccgggaactgcaggcacaaattgccgaactacaggaggatttcgagtcggaaaaggcatcacgaaacaaggccgaaaaacagaagagggacttatctgaggagctagaggctctcaagactgagctggaagacacgctggacacaactgccgctcagcaggagctccgcaccaagcgcgagcaggaggtggcggaacttaaaaaggccttggaagaggagaccaaaaatcacgaagcacagatccaggatatgagacagcgccacgccaccgcactggaagagctcagtgaacagcttgaacaggctaagcgattcaaggccaacctcgagaagaataagcaagggcttgagacggataataaagagctggcctgtgaagtcaaagtccttcaacaggttaaggcagagagcgaacacaaaagaaaaaagcttgacgctcaggtgcaggagttacacgctaaagtcagtgagggcgatcgtcttcgcgtcgaactagcagaaaaggcttcaaagttgcaaaatgagctagacaatgtaagtactctgctggaagaggccgagaaaaagggcattaaattcgccaaggatgccgcctctctggaaagtcagttgcaagatacacaggagctgctgcaggaagaaaccagacaaaaactgaacctttcaagcagaattcgacagcttgaagaggagaagaacagcctccaggagcagcaagaggaggaagaggaggcccggaagaacctggaaaaacaggtgcttgctctccagtcacagcttgccgatactaagaagaaagtggacgatgatctgggtacaatcgagtctctggaggaggcaaagaagaaactgctgaaggacgccgaggctctatcacagcggctggaagaaaaagccctggcatacgataaactcgagaagaccaaaaatcgcctacaacaggagttggatgacttaactgtcgaccttgatcatcaaaggcaagttgcaagcaacttggagaagaaacagaagaagttcgaccagctgttagctgaggaaaagtccatcagcgctaggtatgcagaagaacgtgacagggccgaggccgaagccagggagaaggagaccaaagcactgtcactggcccgcgcacttgaggaagccctcgaggccaaggaagagtttgagaggcagaataagcagcttcgtgccgacatggaggacctgatgtctagcaaggacgacgtggggaaaaatgtgcacgaactcgaaaagtcaaagcgtgcactggaacagcaggtcgaggaaatgcgtacacagctcgaggagctggaagacgagctccaagccaccgaggatgccaaactgagattagaggtgaatatgcaggccatgaaggcccaattcgagagggatctgcaaactcgggacgagcagaacgaagaaaagaagcggctgctgataaagcaggttcgggagctggaagccgagctcgaggatgagaggaaacagcgagccttggccgtggcatccaaaaagaagatggaaatcgatctcaaagatttagaggcccagatagaagccgcgaacaaggcgagagacgaagtgattaagcagctgaggaagctccaggcgcagatgaaagattaccagagggagctcgaggaagcgagagcttcccgggatgaaatatttgcacagtctaaggaatccgaaaagaagttgaagtcactagaagcggagatactccagttgcaagaggagctggcatcaagcgagagggcacgcagacatgcggaacaggagcgggacgagcttgctgacgagatcaccaacagtgcctctggaaaatcagcgttactcgacgagaagcgtaggctcgaggcacgaatagcacagttggaggaggagctcgaggaggagcaaagtaatatggagcttctaaatgacagatttaggaagactaccctgcaggtggataccctgaatgccgaattggccgccgagcgttctgcagctcagaaaagtgataacgcccgacaacagttggagagacagaataaggaactgaaggccaaattacaggagctggaaggagctgttaagtccaagttcaaggcaactataagcgctcttgaggccaagattggtcagttggaggagcaactcgagcaggaagctaaggagagagctgcggccaacaagttggtgcgcagaaccgaaaagaaattaaaagaaatttttatgcaagtggaagacgagaggcggcacgccgatcaatataaagaacagatggagaaggctaatgccagaatgaaacagcttaagcgccagctcgaagaggcagaagaggaagctacccgagccaatgcttccaggagaaaactgcaaagagaactggacgacgctacagaggctaatgaaggactttcacgagaggttagtaccctgaaaaatcgcttgcgcagaggaggcccaatttctttcagctctagccgctctggtaggcgtcagcttcatctggagggagcctctctcgaactgtctgacgacgatactgagagcaaaacaagcgatgttaacgagactcagcctcctcaaagtgaatag

SEQ ID NO: 25170 - DNA, 6024 bp, Artificial Sequence
  Description of Artificial Sequence: Synthetic coding sequence
atggcccagcggaccggcctggaggaccccgagcggtacctgttcgtcgatcgcgccgtcatttataaccctgccactcaggcggattggacagccaagaagcttgtttggattcccagtgagagacacggttttgaggccgcaagcattaaagaagaaagaggtgatgaggtgatggttgaactcgctgaaaatgggaaaaaagctatggtcaacaaagacgatatccagaaaatgaatcccccaaagttttccaaggtggaggacatggcggagttaacttgcttgaatgaagccagcgtgttacataatttgaaggatagatattactctggcctgatctatacctatagtgggctgttttgtgtggtgattaacccctataagaacctgcccatttactccgagaatattatagaaatgtaccgcggaaaaaaaagacacgaaatgccccctcatatttatgcgatttcagagtcagcctatcgctgtatgttgcaggatcgggaggatcagtcaatcctgtgcactggcgaatcaggtgcaggtaaaaccgagaataccaaaaaggtgatccaatacttagcacatgtagcatccagtcacaaagggaggaaggaccataacattcctcaggagagtcctaagcctgtgaaacatcagggtgagctggaacgccagctgctccaggctaaccccatactagaatcattcggcaacgctaaaacagtgaagaatgacaactcaagtcgcttcgggaaatttatccggataaatttcgacgtcactgggtatatcgttggcgcaaatatcgagacgtacttgctagagaaatcacgggctgtgcgtcaggccaaagatgagagaacattccacatcttctaccagctcctgtctggagcgggagagcatttgaaaagtgacctgctgttggagggcttcaataactaccgcttcctgtccaacggatatattccaattcccgggcaacaagacaaagacaattttcaggaaacgatggaggccatgcatattatggggttttcccacgaggagatcttaagcatgcttaaagtggtatccagcgtactgcaatttggcaacatctcttttaaaaaggagagaaatacagaccaggccagcatgcctgaaaacaccgtggctcaaaaactgtgccatttacttgggatgaacgtcatggaatttacaagagctatcctgaccccaagaattaaggtcggaagggactacgtccaaaaagctcagaccaaggaacaggctgacttcgccgtggaggccctggcaaaagctacatacgagcgactcttccggtggctggtgcatcgcattaacaaagcgctggataggaccaagcggcagggagcttcgttcattggtattttggatatcgctgggttcgaaatcttcgagctgaactctttcgaacagctctgcattaactataccaacgaaaagttacagcaacttttcaaccacactatgttcatactggagcaggaagagtatcagcgagagggcattgaatggaatttcatcgacttcggacttgatctgcagccgtgtattgacttgattgagaggcccgcaaacccacccggagtcctggcccttttggacgaggagtgttggtttccaaaagctacagataaaaccttcgtggaaaaactggttcaggagcaagggtcacatagcaaattccagaagcctaggcaactgaaggacaaagcggacttttgtatcatccattatgccggcaaagtggattacaaagcagacgaatggctcatgaagaacatggaccctctaaatgacaatgtggctactctgctccatcagagtagtgacagattcgtggccgagctgtggaaagacgaaatacagaacattcagcgggcctcattctacgactccgtcagtggactccacgagccccccgtggatagaattgttgggctcgatcaagtgaccggtatgacagaaactgcctttggctctgcctataagaccaagaaggggatgtttaggacagttgggcaattatacaaggaatctctcacaaaactcatggcaacactccggaataccaaccccaattttgtaaggtgtataataccaaatcatgaaaagcgtgctgggaaactggacccccacctcgtccttgaccagcttaggtgtaatggggttctggaaggtatacgaatttgccgtcaaggattccctaaccgaatcgtttttcaagagtttagacagaggtacgagatactaacgcccaacgcaatccccaaagggttcatggacggcaagcaggcatgcgagcggatgatcagggctttggagctcgacccaaatctttaccgtattggtcagtcaaagattttttttcgcgccggagtgctagctcatctggaagaagaaagagacctgaagattaccgacattatcatttttttccaggccgtgtgtaggggatacctcgccaggaaggccttcgctaaaaaacagcaacaattgtcagctcttaaagttctccagagaaattgtgccgcttacctcaaactgaggcactggcagtggtggcgggtgttcacaaaggtcaagccgttgctccaggtgaccaggcaggaagaggagcttcaggccaaagatgaggaactgttgaaagtgaaggagaagcagaccaaagtggagggtgagctggaggagatggagaggaagcaccagcaactgctagaggaaaagaatattctcgctgagcagttgcaggcagagacagagctgtttgccgaagccgaagagatgcgagccagattggctgcaaaaaagcaggaactggaagaaattctgcacgatttggaaagccgcgtggaggaggaggaggagagaaatcaaatcctccaaaatgagaagaagaagatgcaggcacatattcaggatcttgaagagcagttagacgaagaagaaggcgccaggcaaaagttacaactcgagaaagttactgccgaagctaaaataaagaaaatggaagaggagatcctgctgctggaagatcaaaacagcaagtttattaaggaaaaaaaactcatggaggaccggattgctgagtgttcctctcaactggctgaggaggaagagaaggccaagaatctggccaagattagaaataaacaggaagtcatgatttctgatcttgaggagcgccttaagaaagaagagaaaacccgccaagaacttgagaaagctaagcggaagctcgacggagaaacaacagatctccaggatcagatcgccgagctccaggcccaaattgacgagctcaagctccagctggccaaaaaagaggaggagttgcagggcgccctggcccggggtgacgatgaaacgctgcacaagaacaacgctcttaaagttgtgagagagctacaggcacagattgcagagcttcaagaggactttgaatcggaaaaggctagcagaaataaagccgagaagcagaaacgagatctctccgaggaactggaggccctgaaaaccgagctagaagacactctggacacgacagcagcccaacaggagctgcgaacgaagagggaacaggaagtggccgagttgaagaaagctcttgaggaagaaactaaaaatcacgaagcacagatacaagatatgaggcagcgccacgccacggccctcgaggagctttcagagcagctggaacaggccaagcgattcaaggctaacctggagaagaacaagcaaggactggaaacagacaacaaggagttagcttgcgaggtcaaggtattgcagcaggtaaaagccgaatctgaacacaagaggaagaagctggatgcccaagtacaggagctgcatgcaaaggtgtccgagggggatcgtttgagggtcgagctggcagagaaggccagcaagctgcagaatgaactagacaacgtctcaaccctattggaggaggctgagaaaaagggcatcaaatttgccaaagatgctgcctctctagagagtcagctccaggatacccaagagctgctgcaggaggaaacccggcagaaattgaacctgtcctcccgcataaggcagctggaggaagagaagaacagcttgcaagaacagcaggaagaggaggaggaggcaaggaagaatttggaaaagcaggtgctcgctctgcagagtcagctggccgataccaaaaaaaaagtcgatgatgatctggggacaatcgagtctctggaagaagccaaaaagaagttgctgaaagatgcagaggccttgtcgcagaggttagaggagaaagccctagcatatgacaaattggagaagaccaagaatcggctgcagcaggagctggacgatctgactgtggatctggaccaccagcgacaagtggccagcaacctggaaaagaaacaaaaaaaatttgatcagctcctggccgaggagaaaagcatatcggctaggtacgcagaggagagggatagggccgaggcggaagctcgggagaaagaaacaaaggcgctgagcctcgccagagccctcgaggaggctctagaagctaaggaagagtttgaaagacagaacaaacagctgcgggcggacatggaagatctcatgtcttcaaaggacgacgtgggcaagaacgtgcatgaactggaaaagtcgaagagagctctggagcagcaggtggaagaaatgcgaactcagctggaggaactcgaggatgaactgcaagctactgaggatgcaaaactaagactagaggttaatatgcaggctatgaaggcacagttcgagagagatctgcagaccagggacgagcaaaacgaggaaaagaaaaggctgctgattaaacaggtaagggagctggaagccgagttggaagacgaacgcaagcagagagcactggccgtcgcaagcaagaagaagatggagatcgacctaaaggatttggaggcacagattgaagctgcaaataaggcacgtgacgaagtgatcaaacagttgcgcaaactgcaggcacagatgaaggactatcagagggagcttgaagaagcacgggcttcgcgagatgaaattttcgctcagagtaaagaatctgaaaaaaagctcaagtctctagaagccgagatcctgcagctacaggaggagcttgcatccagcgagcgcgccagaaggcatgccgaacaggaacgcgacgagctggcagacgaaattactaacagcgcatccggtaaatcagccctgttagacgagaagcgtcgacttgaggctagaatagctcagctcgaggaggaattagaggaagagcaatctaacatggagttgctgaacgacaggttcagaaagaccactctgcaggtcgacaccctgaatgccgagttggccgctgagcggagcgctgctcagaagagtgacaacgcacggcagcaacttgaaaggcaaaataaagaactcaaggcaaagctgcaggagctagagggggcagtgaaatccaagttcaaggcaactatctccgcattggaagccaaaatcggacagctggaagaacaattagagcaggaagccaaggaacgtgccgccgcaaacaaactggtgcgcaggacagaaaaaaaacttaaagagatatttatgcaggtcgaagacgagcgccgccacgcggaccagtacaaggagcagatggagaaggccaacgctaggatgaagcagctcaagaggcaactggaagaggcagaagaagaagcgacccgggctaacgcttcccgacgcaagctccaacgagaattggacgacgcaacagaagctaacgaggggttgtcacgcgaagtctcaacgctgaagaatcgcctcaggagaggaggcccaataagcttctcaagctctcgctccgggcgcagacagctgcatctggagggcgcgagtctggagctatccgatgacgatactgagtccaagaccagcgacgtcaacgagacacaacccccacagagtgagtag

SEQ ID NO: 25171 - DNA, 5979 bp, Artificial Sequence
  Description of Artificial Sequence: Synthetic coding sequence
atggcccagcggaccggcctggaggaccccgagcggtacctgttcgttgatagagccgtgatttataatccagcaacgcaggcagattggaccgcaaaaaaactggtctggatcccctcggagcgccacggattcgaagcagcttcaattaaagaagagcggggggacgaagtaatggttgagctcgccgagaacggaaagaaggccatggtcaacaaggatgatattcagaagatgaaccctccaaagttctccaaggtggaagacatggcagaacttacatgtctcaatgaagcttccgtactgcacaatctcaaagacaggtactatagcggcttgatttatacttatagtggactgttttgtgtagtcataaatccttataaaaatctacccatctacagtgaaaatattatcgaaatgtaccgcggaaagaaaagacacgagatgccaccacacatatacgcgatcagcgaatctgcatacagatgcatgcttcaagacagagaggatcaaagcatcctttgcactggcgagtccggagccggtaagaccgagaatacaaaaaaggtcattcagtatttggctcatgtggcatcttcccacaaggggcgaaaggatcataatattccccaagaaagccccaagccggtgaagcaccaggcctcagcgttattatacggagaactggaacggcaactgctacaggcaaaccccattttggagagctttggaaatgccaaaaccgttaagaatgacaacagttcccgcttcgggaagttcattcgaatcaatttcgatgtcacaggttatatcgtgggtgcaaacattgagacctatctgctggagaaatcacgagccgtacggcaagccaaagacgaacgaacgttccacattttttaccagctgctgtccggggcaggagaacaccttaaatcagatctattgctggaggggtttaataactacaggtttctctctaacgggtatattccgatcccaggtcagcaggataaagacaactttcaggagaccatggaagctatgcatatcatgggcttttcccatgaagagatcctaagtatgttaaaagttgtgtctagcgtgctacagtttggaaatatctcctttaagaaagaaaggaacaccgaccaggccagcatgccggagaacacagtcgcgcagaaattatgccatctgctcggcatgaatgtgatggaatttacgcgtgcaatccttacgccgcgtatcaaggtgggacgggattacgtgcaaaaagcccaaacgaaggaacaggcagacttcgctgtcgaggccttggccaaggctacttacgagagattgttcagatggttagtgcaccggatcaacaaggcccttgatcgtacaaaaagacagggcgctagcttcatcgggatattggatatcgccggctttgaaatattcgaattgaactcgttcgagcaactctgtatcaattacacaaatgaaaagctgcaacaactttttaaccatacgatgttcattctggaacaggaagagtaccagagggagggtattgaatggaattttattgattttggacttgatctgcaaccatgtatcgatctcattgagaggcctgccaatccccctggagtgctggccttgctggatgaagaatgctggtttcctaaggctactgataagacattcgtggagaaactggtgcaggagcagggatcccactctaagtttcagaaaccgcgccagctcaaggacaaggccgatttttgtattatacactacgccgggaaagtcgattacaaggccgacgaatggctgatgaaaaatatggaccccctgaacgacaacgtagccacactgctgcaccaaagctccgatagattcgtggccgagctgtggaaagacgtggataggatcgtggggttggaccaagtgaccggcatgaccgagacggcattcggatccgcctacaagactaaaaaaggcatgtttagaacagtgggacagctctataaagagtccctcacaaagttaatggccacattgcgaaataccaaccctaactttgtgcgctgtattataccaaatcacgagaaacgagcggggaagttggaccctcatctggtgttggaccagcttcggtgtaatggggtgctcgagggcatcagaatttgcagacagggattcccaaatcgcattgtatttcaagagttcaggcagagatatgagattctgacgccgaacgcaatccccaagggattcatggacggtaaacaggcctgtgaacgaatgatcagggccctggagctcgatcccaatctttaccggattggtcagagcaaaatattctttcgtgctggtgtgcttgcccatttggaggaagagagggaccttaagataacagatatcataatattctttcaggcggtgtgcagggggtacttggctcggaaagcctttgcaaagaaacagcaacaactgtcagccctgaaagttctgcagcggaactgcgcagcttatctgaaattgcgccattggcagtggtggcgcgtgtttacaaaggtgaaaccactgctgcaggtaacaagacaggaagaggaacttcaggcgaaggacgaagagttgctgaaggtgaaggagaaacagaccaaagtggaaggtgagttggaagagatggaaaggaaacaccaacagctgcttgaagagaagaacattcttgctgagcagctccaggcagagacggagctgttcgctgaggctgaagagatgcgtgcaagactcgctgccaaaaagcaggagttggaagaaatcttgcacgatctcgaaagccgtgttgaggaggaagaggagaggaaccaaattcttcagaacgaaaagaagaaaatgcaagcccacattcaggacctggaggagcagctcgacgaagaagagggcgccagacaaaagcttcagctggagaaagtgacagctgaagccaagataaagaagatggaggaagagattttgctgttggaggaccagaactcaaagtttatcaaggagaagaaactaatggaagaccgcatcgccgagtgttccagtcagctggctgaggaggaggagaaggccaagaacctggcaaaaatccgcaacaagcaagaggtcatgatcagcgacttggaggaacggctcaagaaggaggaaaagacaaggcaggaactggaaaaagctaagcggaaattggatggagagacaacggacttacaggatcagatagcggagctccaggcccaaattgacgagctgaagctgcagctggcaaaaaaggaggaagagctgcagggtgctctcgcaagaggcgatgatgaaactctgcacaagaataatgctctcaaagtggtgagagagctccaggcccagatcgccgaactgcaggaggatttcgagtcggagaaagccagccggaacaaagctgaaaagcagaagcgtgacctctctgaagagcttgaggccttgaagacagagctggaagacacccttgataccacggcggcacagcaagagctccgcaccaagagggaacaggaagtggcagaacttaaaaaggccctggaggaggagaccaagaatcacgaggcgcaaattcaggacatgaggcagcggcatgcaactgcactggaagagctcagtgagcagctggaacaggccaaacgcttcaaagctaatctcgagaaaaataagcagggtcttgagaccgacaataaagaactcgcttgtgaggtaaaggtgctgcagcaagtgaaagctgagagcgagcacaagcgcaaaaagctcgatgcgcaggtgcaggaacttcacgccaaagtgtcagaaggcgaccggctgcgcgttgagctcgctgaaaaagcttccaagctccaaaatgagctggacaatgtctctacactgctggaagaagcagagaaaaaggggatcaaatttgctaaagatgccgcgagcctggagtcccagctacaggacacacaggagctcttgcaggaagagacccggcagaaattgaacttatccagcaggatcagacaactggaggaggaaaagaatagcctgcaggagcaacaagaggaagaggaagaggctagaaaaaaccttgagaagcaggtgctggcactccagagccaactggctgataccaagaaaaaggtcgacgacgacctgggtaccattgaaagtctcgaggaggctaagaaaaagctcctgaaggacgctgaagccctgagccagcgcctggaagagaaagccctggcatacgataagctggagaaaacaaagaatcggctgcaacaagagttagacgacttaactgttgatttagaccaccagcggcaggtagcaagtaatcttgaaaaaaagcaaaagaaatttgatcagctgttggcagaagagaagagtatatctgcgcgatacgccgaggagcgtgatagagccgaagcagaagcgagggagaaggagactaaagccctatcactcgccagggccctggaggaggcgttggaagctaaagaggagtttgaaaggcagaataaacagctccgggctgatatggaagatctcatgtctagcaaggatgacgtcgggaaaaatgtacacgagcttgaaaagagcaagcgcgccctcgagcagcaagtggaagagatgcggacccagttggaagagctggaggacgagttacaggccacggaagacgctaagctcagactcgaagtgaacatgcaagccatgaaggcacagtttgaaagagacttgcagactcgcgatgagcagaatgaggagaaaaagcgcctgctcatcaaacaggtgcgggagctagaagctgagctcgaggatgagcggaaacagcgtgcgcttgcagtggcaagcaaaaagaagatggaaattgatctgaaggatctcgaggcccaaattgaggctgcaaataaagcacgcgatgaggtaattaagcagctgagaaagttgcaggcacagatgaaagactaccaaagggagctggaggaagctcgggcaagccgcgatgaaatctttgcccagtcaaaagaaagtgagaaaaaactgaagtctcttgaggctgaaatcttacagctgcaggaggagctcgcgtccagtgaacgggctaggcggcacgcagagcaagagagggatgagctggcggacgaaatcactaacagcgcttccggaaaatctgcattactggacgagaagcgaagactggaggctaggattgcccaactggaggaggagctggaggaggagcagtccaacatggagctgctgaatgatcggtttcggaaaaccacgctacaggtggacaccctcaatgccgaactggctgcagagaggagcgcagcccagaaaagcgataacgcccggcaacagctcgagcgacaaaacaaagaactgaaagcgaagctccaggaattagagggggccgtgaaaagtaagtttaaggcgacaataagcgctctagaggcgaaaattggccaactggaagagcagctggaacaggaggcaaaagaacgggctgccgctaacaagctggtccgtcggacggagaagaaattgaaggagatttttatgcaggttgaagacgaaagacgccacgcggaccagtataaggagcagatggagaaggccaacgcgcgaatgaaacagcttaagcgacaacttgaggaggcagaagaggaagcgactagagctaatgcttcccggaggaagttgcagagggaactcgatgatgccaccgaggcaaacgaggggctatctcgcgaagtctccacccttaaaaacagactgcgcagaggcggtccaatctctttcagctccagtcgtagtggcaggcgccaattgcacctggagggagcatctctggagctgtctgacgacgatacggaatctaaaacctctgatgtcaacgaaacacagccgcctcagagtgaatag

SEQ ID NO: 25172 - DNA, 5994 bp, Artificial Sequence
  Description of Artificial Sequence: Synthetic coding sequence
atggcccagcggaccggcctggaggaccccgagcggtacctgttcgtggaccgcgctgttatttacaaccccgcgacccaagccgactggaccgctaaaaaactggtttggatcccatcggaacggcacggatttgaggccgcctccataaaggaggaaagaggagatgaagtgatggttgagctcgcagaaaatgggaaaaaggccatggttaacaaggacgacatccagaaaatgaatcctcctaagttctccaaggttgaggacatggccgaactgacatgtctcaatgaggcctccgttctgcacaaccttaaagaccgctactactcagggctgatttatacgtatagcggattgttttgcgtagtaatcaacccgtataaaaatctgccgatttatagcgaaaatattatcgaaatgtacagaggcaagaaacggcatgaaatgccgcctcatatttatgccatttctgagtctgcgtacagatgtatgttgcaggacagagaagaccaatcaatactgtgcactggggagtcaggcgccggcaagactgagaacactaaaaaggtcattcagtacttggcacacgtggcctcttcccataaaggtagaaaagaccacaatatcccaggagaattagagagacagctgcttcaggcaaacccaattctcgaatcattcggcaacgcaaagactgtcaaaaatgataacagttcccgcttcggtaagttcataagaatcaattttgacgtgacaggatacattgtgggcgctaatatagagacctaccttctagagaaaagtagggccgtaaggcaggctaaggatgaacgtacctttcacatcttctaccagcttctatccggcgcaggggaacacctgaagtccgatctgctgttagaaggatttaataattataggttcctctccaacgggtacatccccattcctggacagcaagacaaggataatttccaggaaacaatggaagccatgcatatcatggggttttcacacgaggaaatcttgtctatgttaaaggtcgtcagtagcgtattgcagtttggcaacattagctttaagaaagagagaaacactgatcaggccagtatgccagagaacaccgtagcccagaagctgtgccatcttcttggaatgaacgtgatggaattcacccgagccattctgacacccaggatcaaagtgggcagggactatgttcagaaggctcaaacaaaagaacaggccgatttcgcagtggaagcactggccaaagcgacatacgaacgcctgttccgatggttggttcatagaattaacaaggcccttgatcggaccaaacgacaaggggccagcttcattggaatcctcgacattgccggcttcgagatcttcgagctgaacagctttgagcagctgtgtatcaactatactaatgagaaactgcagcaactgtttaaccacacaatgtttatacttgagcaagaggagtatcaacgcgagggcatcgaatggaattttatcgattttggcttggacttgcaaccctgcattgatcttattgaacggcccgctaacccaccgggagtgctcgccctgctcgatgaagaatgttggttcccgaaggcaacagacaagactttcgtggagaagctcgtccaggaacagggctcacacagcaaattccagaagcctagacagctcaaggataaagcagacttttgtatcatccactacgccgggaaggtcgattataaggcggatgagtggctgatgaagaatatggatcccctgaacgataatgtcgccacattgctgcatcagtccagtgataggttcgtagccgaactgtggaaggacgaaattcagaatatccagcgcgctagcttctatgacagcgtttcaggattgcatgagccgccagtcgatcgtatcgtaggtctggaccaagtgactggaatgacagagactgcctttggcagtgcttataaaacaaaaaaaggtatgttccgtacggtgggtcagttgtataaagagagtttaacaaagctcatggccacattacgcaacaccaatccaaacttcgtgcggtgcatcattccaaaccacgagaagagagctggaaaacttgacccacacctcgtgctcgaccaactgagatgcaacggcgtgctggaaggaataagaatttgcaggcaaggatttcccaaccgcatagtgtttcaagagttccggcagagatatgaaatcctcaccccaaatgctattccgaaaggctttatggatggcaagcaggcatgcgagagaatgatccgggcacttgagctggatcctaacctttacagaatcggacagtctaagatcttcttcagggctggcgtactggcacacttggaggaggaaagggacttaaaaattacagatattattatcttcttccaagccgtctgccggggatacctcgcccggaaagcgtttgctaagaaacagcagcagcttagcgctttgaaagtgctccagcgcaactgtgcagcctacctgaagctgcggcattggcagtggtggcgggtgtttacaaaagtgaagccgctccttcaggttactcgtcaggaagaagaattacaagctaaagatgaggaactacttaaagtgaaggagaaacagactaaagtcgaaggagagctggaagagatggagcgaaaacatcagcagctgctggaggaaaagaacatactagccgaacagctgcaagcggagacagagttattcgccgaagctgaagaaatgagggcgaggttagctgcaaagaagcaggaactggaggagattctacacgaccttgagtcacgtgtggaggaagaggaagaacggaaccagattttacagaacgagaaaaagaagatgcaggcccacatacaggatctggaggagcagttagacgaggaggagggtgcaaggcaaaagctccagctggaaaaggtcacagccgaagcaaaaattaaaaagatggaagaagagatcttgcttttggaggaccagaatagcaagttcatcaaagagaaaaagttaatggaagatcggatcgccgagtgcagttcccagctggccgaagaggaggagaaggccaagaatctggccaaaattaggaacaaacaagaagtgatgatcagtgacctggaggagaggctgaaaaaggaagagaaaacacgccaggaactggagaaagctaagcgaaagctggatggggaaactaccgacttacaggatcagatcgccgaactgcaggcacagatcgacgaattgaagctccagctggcaaaaaaggaagaggagctgcagggggctttggcccggggggacgacgagacgctgcacaaaaacaatgccttgaaagtcgtaagagaacttcaagcacaaatcgcggagctccaggaagattttgaaagcgagaaggcaagcagaaataaggccgagaagcagaaacgggatttgtccgaagagctcgaagctctaaagaccgagctggaggacacgcttgatactactgccgcccagcaagagcttcggacgaagcgggagcaagaggtggcagaacttaagaaggccctggaagaagaaaccaaaaaccacgaggcgcagattcaggatatgcgccagcgacacgccactgccctggaagaactctccgagcagctcgagcaggcaaaacggtttaaagcaaatttggaaaagaataagcagggactagagacagacaacaaggaactggcctgtgaggtgaaggtcctacagcaggtgaaagcggagtcagagcataagcggaagaagttagatgctcaggtgcaggaactgcacgcaaaagttagcgagggggatcggttgcgagtggaactcgccgaaaaagcgagtaagctgcagaatgaactggataatgtatctaccctgttggaggaggcagagaaaaagggaattaagtttgcaaaggatgccgccagcctcgaatcgcagctgcaggatacacaggagctgctacaggaggaaacccggcagaaactcaatctcagctcccggattagacagttagaggaagagaagaacagcctgcaggagcagcaagaggaagaggaagaggccaggaagaatcttgaaaaacaggtcctggctctccagtcccagctggccgataccaaaaaaaaggtggatgatgatctcggcactattgaatcattggaggaggccaagaaaaaacttctgaaggatgccgaagccttgtcccaacgcttggaagagaaagctttggcttatgacaagttggagaagacaaaaaaccgcctccaacaggagctggacgatttaacagtcgatctcgaccatcaaagacaggttgcctcgaatctcgagaagaagcagaaaaaatttgatcagttgctcgccgaggagaagtccattagcgctaggtacgcagaggagcgcgatcgggctgaggcagaggctcgagaaaaagagactaaggccctcagcttagccagggccttggaggaagcccttgaggccaaagaggaatttgagagacagaacaagcaactgagggcagacatggaagacttaatgtcaagcaaagacgacgtgggcaaaaacgtgcatgagctggaaaagagtaaaagagccttggaacagcaggtggaggagatgcgcactcaacttgaggagctggaagacgagctccaggctaccgaggacgctaaactgagactggaggttaatatgcaggccatgaaggctcagttcgaacgtgacctacagactcgcgatgagcagaatgaagaaaaaaagcggttattaattaaacaggtgagagagctcgaggctgagctcgaagatgagcgcaagcaacgcgctcttgcggtagcctccaagaaaaagatggagattgacttgaaagacctggaagcacaaatagaggcagccaataaggctagggatgaggtgatcaaacagctgcgcaagctgcaggcccagatgaaggactaccaacgcgaactggaagaagcgagagcatcaagagatgaaatcttcgcccagagcaaggaaagcgaaaaaaagcttaaatctctggaggctgagatccttcagttgcaggaagaactggcgagctctgagagagccagacgacacgccgagcaggaacgagacgaactcgccgacgagattactaatagtgcatcaggaaagagcgcattactagatgagaaacgtcggcttgaggcacggatcgcacagcttgaagaggaactcgaggaggagcagagtaatatggaactactcaatgacaggtttcggaaaaccacccttcaggtggacacactgaatgctgaactggcggcagagcgatctgcggctcaaaaaagcgataacgcccgacagcagctagagcgccagaacaaagaactgaaagccaaattgcaggagctcgagggagcagttaagtctaagtttaaagccacaatctcagcactggaggcaaagatcggacagctcgaagagcaacttgagcaggaggctaaggaacgagctgctgctaataagttggtccgacgcaccgagaaaaaactcaaagaaatcttcatgcaggttgaagacgaacggaggcatgctgaccagtataaggaacagatggagaaagccaacgctcggatgaaacaactgaagcgtcagctagaagaggccgaggaggaggccacaagggcgaatgccagccgccgcaagcttcagcgggaattagacgacgctactgaggccaatgagggcctgtctcgagaggtctcaaccctgaagaaccgtctgaggagaggcggtccaatttcattttcatctagtcgaagcgggcgcaggcagttacacctggagggcgcaagtttagaactctctgatgacgacacagagtccaaaacttcagatgtcaacgagacgcagccaccacagagcgaatag

SEQ ID NO: 25173 - DNA, 567 bp, Artificial Sequence
  Description of Artificial Sequence: Synthetic coding sequence
atggcccagcggaccggcctggaggaccccgagcggtacctgttcgtcgaccgcgccgtaatttacaaccccgctacccaggcagactggaccgcgaaaaaactggtttggatccccagtgagaggcacggctttgaggctgccagcattaaagaagagaggggggatgaagtaatggttgaactggcagagaacggtaaaaaggcgatggtaaataaggacgacatccagaagatgaaccccccgaagttctctaaagtagaggatatggcagaactcacctgtctgaatgaggctagtgtgctgcataacctgaaggatcggtactattctgggctaatttatacctattccgggctgttttgtgtggtcatcaacccttacaaaaatctgcccatctactctgagaacatcatcgaaatgtatcggggtaaaaagcgacacgagatgcccccccacatttacgccatcagtgagtctgcatatagatgtatgctgcaggaccgggaagatcagagcatcctgtgtacgggcgagtctggtgcaggtaagaccgaaaatacttag

SEQ ID NO: 25174 - DNA, 1446 bp, Artificial Sequence
  Description of Artificial Sequence: Synthetic coding sequence
atgtacgacgccgagcggggctggagcctgagcttcgccggctgcgggttcttgggcttctaccatgtgggagcaacccgatgtttatcggagcacgcgccccacctactacgggatgcgcggatgcttttcggggcctccgccggagccctgcactgcgttggcgtgttaagtggcataccgctcgagcaaaccctgcaagttctttcggatttggtacggaaagcgcgaagccggaacatagggatattccatccaagctttaacctgtcgaaattccttagacagggcctgtgtaaatgcttaccagcaaatgtgcaccagctaatttcaggtaagatcggaatttccctgacaagagttagtgacggtgagaacgtgcttgttagcgactttcggagcaaggatgaagtggtcgacgccctcgtgtgttcttgcttcatccccttctactccggcctaatccctcccagctttcggggagtcagatacgttgatggtggggtgtcagataacgtgccgttcattgatgcaaaaaccaccattactgtgtcacccttctatggcgaatacgacatctgccctaaggttaaatccacaaatttccttcacgttgacattacaaaactgtccctcaggctctgtactggcaacctttatctcctctcaagggcctttgtacctccagatttaaaggtgctgggcgaaatctgcctgcgcgggtatttggatgccttccggttcctggaggaaaagggaatttgcaataggcctcagcccggtcttaagtctagctccgagggaatggatccggaggttgcaatgccgagttgggcaaacatgtctctcgatagctctcctgagagtgccgccctagccgtgagactggaaggagacgagcttttagatcatctcaggctctctattttgccatgggacgagtctatcctcgacacccttagtccacggctcgccaccgcactcagtgaagagatgaaggacaaggggggatatatgagcaaaatttgcaatctgctacccatcaggattatgtcctacgtgatgctcccatgtacactacccgtagagagtgccatcgccatcgtgcagagactagtcacttggctgcctgacatgccagacgatgtgttgtggctgcaatgggttacaagccaagtgtttacgagagttctgatgtgcctgctgccagcatccagatctcagatgcctgttagtagccagcaggcttccccttgcactcctgaacaggactggccctgttggactccttgcagccccaagggttgtcccgcagaaactaaggcagaagcgactccacgatcaattctgagatcctctctgaatttttttctcgggaataaggtgccagctggcgcagaaggtctcagtacatttccttctttcagtctggaaaagtccctttag

SEQ ID NO: 25175 - DNA, 4149 bp, Artificial Sequence
  Description of Artificial Sequence: Synthetic coding sequence
atgtacaagggcaagaagcggcacgagatgcccccccacatctacgccatcaccgatacggcttatcgcagtatgatgcaggatagggaagaccagagtatcctgtgcaccggggagagtggggccgggaagaccgagaataccaaaaaggtgatccagtatttggcttatgtcgcctcaagccacaagtctaagaaagatcagggcgaacttgagcgacagctgttacaagctaaccccatactcgaggcatttgggaatgccaagacagtgaaaaacgacaattcatctcgttttgggaagttcatcaggataaatttcgatgtgaatgggtacatagtgggagctaacatcgagacatacctcctggagaagtcacgcgctatcaggcaagccaaggaagaacgcaccttccatatcttttactacctgctgagcggcgctggagaacatttgaaaaccgacttattgctcgaaccctataataaatatcgctttctgtccaacggacacgttactattcctggccagcaagacaaggatatgtttcaagagaccatggaggccatgagaataatggggataccagaagaagaacaaatgggactgcttcgcgtgatctcaggagtgcttcagttgggcaacattgtgtttaaaaaagaacgcaacacagaccaggctagtatgccggacaacactgccgctcagaaggtctcacacctgctgggaatcaacgtgacagacttcacaagaggcattctgacgccacgcatcaaagtgggtcgcgactatgtacagaaggctcagacaaaagaacaggccgattttgctatcgaagcacttgccaaggccacctatgagcggatgtttcggtggctggtcctgagaatcaataaagccttagacaagactaagagacagggcgcctctttcattgggatacttgatatcgctgggtttgagatcttcgatctcaattccttcgagcaactctgtattaattatacgaatgagaagctgcagcagttgttcaatcatactatgtttattctagaacaggaagagtaccagagggagggcatcgagtggaatttcatcgactttggccttgacctccagccttgcatagacctcatcgaaaagcctgcgggccctcccggaatcctggcactcctggacgaagaatgttggttccctaaggcaacggataagagtttcgtcgaaaaagtaatgcaggagcaaggcacccacccgaaattccagaagcctaaacagctgaaggataaagccgacttctgcatcatccactacgcggggaaagtggattataaggccgacgaatggctcatgaaaaacatggaccccctgaatgataatatcgctacattactgcaccaatcgtctgataaattcgtgagcgagttgtggaaagacgtggaccgtataatcggtttggaccaagtcgctggcatgagcgagaccgcccttcccggagctttcaagacacgcaaggggatgtttagaacagttggccagctgtacaaggagcaactggccaagcttatggcaacccttcggaacactaaccccaacttcgtcagatgtattatccctaaccatgaaaaaaaggctggaaagctcgatccccaccttgtgttggaccagctacggtgcaatggagtgttagaagggatcaggatctgtcgccagggctttcccaatcgggttgtgttccaggagtttaggcagagatatgaaatcttgactccaaatagtattcctaagggttttatggacggcaaacaggcttgtgtcctaatgatcaaagctctggaactcgactcaaacctttataggattgggcagtcaaaagtcttctttagagcaggcgtgttagctcatctggaggaggagagagacctgaaaataaccgacgtcatcataggctttcaggcttgctgtcgcggctacctggccagaaaggcctttgctaaacgtcaacaacagttgaccgccatgaaggtgctccaacggaactgtgccgcctaccttaagcttaggaactggcagtggtggagactgtttaccaaagtgaagcctctcctccaggtctcccgccaggaggaggagatgatggcaaaagaggaagaactggtcaaggtccgcgagaagcagctggccgccgaaaacagactcacagaaatggaaacactgcagtcacagctgatggcagagaagttgcagttacaggaacaactgcaggcagaaacagagttgtgtgctgaggccgaagaactacgtgcgaggcttaccgccaagaagcaggagctggaagaaatttgtcacgacctggaagccagagtggaggaagaggaggaacgctgtcagcacctccaggccgaaaagaaaaagatgcagcagaacattcaggagcttgaagaacaactagaagaggaggagtcagcacggcagaaactgcagcttgaaaaggttacaacagaagcaaaactcaagaaactggaagaagaattggacgatctcttggtggatctggaccatcagcgacaatccgcatgtaatctggaaaagaaacaaaagaagtttgatcagctgctggccgaggagaagaccattagtgctaagtacgccgaggaaagagaccgggctgaggccgaagcgagggaaaaggaaacaaaagctcttagcttggcccgggccctggaagaggccatggaacaaaaggctgaactggagcgtctgaacaagcaattcagaaccgagatggaagacctcatgagtagtaaggacgatgtgggcaaaagcgtgcatgagcttgagaagtcaaaaagggccctggagcagcaggtcgaggagatgaaaacacagttggaagaactagaggacgaactgcaggccacggaagacgctaagctgcggctggaggtgaatcttcaggccatgaaggctcaattcgagcgggacttgcaggggagagacgaacaaagcgaagaaaagaagaagcagctggtcagacaagtcagggagatggaagccgaattggaggacgagcgaaaacaacggagcatggccgtggctgctaggaagaagctcgagatggatctgaaggatcttgaagctcatattgactccgccaataaaaaccgcgacgaagccattaagcagttacggaagctacaggcacagatgaaggactgcatgagagaactcgatgatacccgggcctcccgcgaagagattttggctcaggccaaggagaatgagaagaagctgaaatccatggaagccgagatgatccagctccaggaggagttggccgccgctgaaagggcaaagcggcaagcacagcaagagcgggatgaactggctgacgagattgccaactccagcggtaagggagccctggccctggaggaaaagcgaagactggaagccagaatcgcccaacttgaggaagaactagaggaggaacaggggaacacagaactgatcaacgatcgccttaagaaggcaaacttgcaaatcgatcagattaacacggatctgaatttagaacggtcccacgcacaaaagaacgagaacgcgaggcagcagctggagaggcaaaataaggaacttaaggtgaagctgcaggaaatggaagggaccgtaaaatccaaatataaagcatcaattaccgccctggaggctaaaatcgcccagctcgaagagcagctcgacaatgaaacaaaggaaaggcaggccgcgtgtaagcaagtccggaggaccgaaaaaaagctcaaagatgtgctactgcaggttgacgacgaacgaagaaacgctgagcagtataaggaccaggcggataaggcttctaccagattgaagcagctgaaacgccagttggaggaggctgaagaggaggcccagcgggctaacgcctcaaggcgtaagcttcagcgagagctggaggatgcaaccgagactgcggatgcaatgaaccgcgaagtgtcctcactcaaaaacaaactccgccgtggagatttaccgtttgtggtgcctaggagaatggctaggaaaggcgccggtgacggcagtgatgaagaggtggacggaaaggctgatggcgcagaagcaaaacccgcagaatag

SEQ ID NO: 25176 - DNA, 1689 bp, Artificial Sequence
  Description of Artificial Sequence: Synthetic coding sequence
gccagcggcacccggcggcggtggccccccaccaccagctggcggcggccacggcgtggctgttcacgatcctggacaacttgctggtggacatggacaaccagtgctcgggcaagggccacttggagaaggagtagaaggagtctgacgagctcctggagaagaagacgtccttctcttccctctatgcaacggagtgccactgggctcaggcgccggcctgagaggcggagaccccgcctctgtcggtggcctgggcccgaggaggccatggagcagaaggccgaactagagagactgaataaacagtttcgaactgaaatggaggacctgatgagctccaaggatgatgtgggcaagagcgttcatgagctggagaaaagcaagagggcgctggagcaacaggttgaggagatgaaaactcagctggaagagttagaggacgagttgcaggcaacagaggatgctaaactccgacttgaagtgaacctgcaggcaatgaaagcacagtttgaacgggacttacagggccgggacgagcaatctgaggagaagaaaaagcagctggttcggcaagtacgcgagatggaggctgaactggaagacgaacggaagcagcggtctatggctgtagccgcccgcaagaagttggaaatggatctgaaagacctcgaggcgcatatagactctgctaacaagaatagagacgaggccatcaagcaactgaggaaactccaggcccagatgaaggactgtatgagagagctggatgacactagggcctctcgcgaagaaatactggcccaggcaaaagaaaatgagaaaaaactgaagtccatggaagctgaaatgatccagctacaggaggaactggccgccgccgagcgagctaaaagacaggcccaacaggaacgagacgagctcgcagatgaaatcgccaattcaagtggaaaaggcgcactcgcgctggaggagaagcgtaggctagaggcacgtattgcccagctggaagaggagctggaggaggaacagggcaatactgaactcataaatgaccgacttaaaaaagcaaacttgcagatcgaccaaattaataccgacttgaacctcgaacgtagccacgcacaaaagaacgagaacgcacggcaacagctcgagaggcagaacaaagaactgaaggtgaaattgcaggaaatggaggggactgtcaaatctaagtataaagctagcattaccgccctggaagcaaagatcgcacagctcgaagaacaattggacaacgagactaaggaacgccaagccgcctgcaaacaggtcagaaggaccgagaagaagcttaaggacgtgttgctgcaggtcgacgacgaaagaaggaacgccgagcagtacaaagatcaggctgacaaagcctccacccggctgaagcaattgaagcgacaactggaggaggctgaggaggaggctcaacgcgcaaatgccagtcgtcgtaaactgcagagggagttggaagacgcaactgagaccgcagatgccatgaaccgtgaggtgagcagcctcaaaaacaagcttcgccgcggagatctgcccttcgtagtgcccaggagaatggcgaggaagggggctggcgatggtagcgacgaagaggtggacgggaaggctgatggggccgaagcgaagcccgcggagtag

SEQ ID NO: 25177 - DNA, 657 bp, Artificial Sequence
  Description of Artificial Sequence: Synthetic coding sequence
atggcccagcaggccgccgacaagtacctgtacgtggacaagaactttattaacaacccacttgctcaggctgactgggccgccaagaaactggtatgggtccccagtgacaagtccggattcgaacccgcgtcactaaaggaggaggtaggagaagaagccattgtggagctggtggaaaacggcaagaaggtcaaggtgaataaagatgatatacaaaagatgaatcctcctaaatttagcaaggtagaagatatggccgagctcacctgcctcaatgaagcctcggtgttacataacctgaaggagcgctactatagtgggctgatttacacatactctgggctgttttgtgtggtgattaatccatacaagaaccttcctatctactccgaggaaattgtggagatgtacaagggcaagaagcggcatgagatgccacctcatatatacgcaattaccgacactgcataccgaagcatgatgcaggatcgggaagaccagagcattttatgtacaggagagtccggagcgggaaagacagaaaatacaaaaaaagtgatccaatatctggcttacgtcgcgtcaagccataagagcaagaaggaccaagaagcttacttcaaaaacagagctgttagactgggcgttctctag

SEQ ID NO: 25178 - DNA, 312 bp, Artificial Sequence
  Description of Artificial Sequence: Synthetic coding sequence
atggcccagcaggccgccgacaagtacctgtacgtggacaagaacttcatcaacaatcccttagcacaggcggactgggccgcaaagaaattggtgtgggtaccctctgataagtccggctttgagccggcctctctcaaggaggaagtaggggaggaggcaattgtggaactggttgaaaacggcaagaaggtgaaggtgaacaaggacgatatccagaaaatgaaccctcccaagttttcgaaagtggaggatatggcggagctgacctgcctgaacgaggccagcgtactccataatctgaaggagtag

SEQ ID NO: 25179 - DNA, 519 bp, Artificial Sequence
  Description of Artificial Sequence: Synthetic coding sequence
atgagcagcaagcgggccaaggccaagaccaccaagaagcggccccaaagggccaccagcaacgtgtttgcgatgttcgaccagtcgcagattcaggagttcaaggaagctttcaacatgatcgatcagaatcgcgatggcttcattgataaagaagacctgcacgatatgctcgcttccctggggaaaaatccgaccgacgaatacctcgagggcatgatgtctgaggcgcctggaccgatcaacttcactatgttcctaaccatgttcggggaaaagctaaacggaactgatccagaggacgtaatcaggaatgcttttgcttgcttcgatgaggaggcctctggatttattcacgaagaccacttgcgtgagctgcttactacgatgggcgatcgctttacagatgaagaggtagacgagatgtatagggaagctcccatagacaagaaaggcaacttcaactacgtggaatttaccagaatcctgaagcacggtgccaaggataaagacgactag

SEQ ID NO: 25180 - DNA, 357 bp, Artificial Sequence
  Description of Artificial Sequence: Synthetic coding sequence
atgagcagcaagcgggccaaggccaagaccaccaagaagcggccccaacgagctacgagcaacgtgtttgctatgtttgatcagtcccagatccaggaatttaaagaagccttcaacatgattgatcaaaatcgcgacggattcattgacaaggaagatctccacgacatgctggccagcttgggatttatccacgaagaccatctgagagagctactcacaaccatgggcgacagatttaccgacgaggaagttgatgaaatgtatagagaagcccccatcgacaaaaaaggaaattttaactacgttgaatttacgcgaatcctcaagcacggggccaaggacaaggatgactag

SEQ ID NO: 25181 - DNA, 927 bp, Artificial Sequence
  Description of Artificial Sequence: Synthetic coding sequence
atgcaggagctgaccctgagccccggccccgccaagctgacccccactcttgatcccacgcaccgcatggagctcatactgtcgactagccctgctgagctgaccctcgatcctgcctgtcaacctaaacttccgctcgatagcacttgtcaaccggaaatgactttcaaccccggacctaccgagctaactctggaccctgaacatcagccagaggaaacccccgcacccagtctggccgaactgacgttggagccagtccatcgtaggcctgagctgttggatgcatgcgcggacctgattaatgaccagtggccgcggagccggacatcccggttgcactccttgggccagtcatcggacgccttccctctttgtctgatgctgctttcaccccaccccaccctcgaggctgcacctgtggtcgtcgggcatgcacgtctcagtcgcgttttgaatcagccgcagtccctgttggtcgagaccgtcgtggtagctcgtgctttacgaggtaggggctttggccgaagattgatggaggggttagaagtatttgctagggctagggggttcagaaaattacatctgactactcacgatcaggttcatttctacacccacctcggatatcagctgggagaacctgtacaggggctagtcttcacgagccgcagactgccagcaacgcttttgaacgccttccccaccgccccatcccccaggccaccaaggaaggcaccaaaccttacggctcaggccgcccctcgaggccccaaaggacccccactccctccacccccgccgctacccgaatgcttaaccatctcccccccagtaccctccggcccacctagcaagtccttacttgagacccagtaccagaatgtgagggggcggccgatattttggatggagaaagatatttag

SEQ ID NO: 25182 - DNA, 861 bp, Artificial Sequence
  Description of Artificial Sequence: Synthetic coding sequence
atggagctgatcctgagcaccagccccgccgagctgaccctggacccggcgtgccaacccaagttacctttagatagtacatgtcagcctgagatgacattcaacccaggcccaacagaactgacactggatcccgagcaccagcctgaggagactccagccccgtcgctcgcagaactgaccctcgaacccgtgcaccgccgccctgagctcctggacgcgtgtgccgatctgattaatgaccagtggcctcgctctcggacctccagactgcactcgctgggccagagtagcgatgccttcccactgtgcctgatgctgctgagcccgcatcctactctggaggcagcacccgtcgtagtcgggcacgctaggctgagccgcgttctgaaccaaccacagtctctgcttgtcgagacagttgtcgtggcgcgcgctctgcgcgggagaggatttggtcgtcgattgatggaaggactggaagtctttgctcgagcccgcggattcaggaagcttcacctgaccactcatgaccaagtccacttttacacacacttgggctaccagctgggtgagccagtacagggtcttgtattcacatcccgccgccttccagccaccctgctaaacgcctttccgaccgcccccagccccaggcctcccaggaaggcccccaatctgactgctcaggccgcccctcgaggccccaagggacccccacttcccccccctccacccttgcctgagtgcctgacaattagtccccctgtgcccagcgggccgccatctaagtccctcttagaaactcagtatcaaaacgtaagggggcgcccaatcttttggatggagaaagatatctag

SEQ ID NO: 25183 - DNA, 174 bp, Artificial Sequence
  Description of Artificial Sequence: Synthetic coding sequence
atggagctgatcctgagcaccagccccgccgagctgaccctggacccagcttgccagcccaagctgcctctggactccacctgtcagcctgagatgacttttaatcctggtcccactgaacttacattggacccagagcatcagccagaggagacgcctgcaccttctctgtag

SEQ ID NO: 25184 - DNA, 861 bp, Artificial Sequence
  Description of Artificial Sequence: Synthetic coding sequence
atggagctgatcctgagcaccagccccgccgagctgaccctggaccctgcatgccagcccaagctcccactggacagtacctgccagcccgaaatgaccttcaacccagggcctactgagttaacccttgaccccgagcaccagccagaagaaaccccagccccgtcactagccgaactaaccttggagcccgtgcatcgccgaccagagcttctcgacgcctgtgctgatctcatcaacgatcaatggccaagatcaaggactagccggttgcattccctgggccaatcatcagacgccttccccctgtgcttgatgctcctatctccacatcctacacttgaggccgccccagttgtcgtcggacatgccagattgagtcgggtgcttaatcaaccccaatccttgctggtggagacggtggttgtggcccgtgctctgcggggacgtggcttcgggcgtaggctgatggaggggctggaggtgtttgcccgggcccgggggttcaggaaacttcacttgactacacatgaccaggttcatttttatactcacctgggctaccagttaggggagcctgtgcaagggcttgtatttacatcaaggcgcctccctgccacgctgctgaatgctttccccaccgccccgagtccgcggccgcccagaaaggcccccaatctgacagcccaggcagcacctaggggccctaaaggtccacccctgccacctccgcctcccctacccgagtgtctaaccattagtccccctgtgcctagcggcccgccaagcaagtccctccttgaaacacagtatcagaacgtgcggggccgacccatattttggatggagaaagatatctag

SEQ ID NO: 25185 - DNA, 861 bp, Artificial Sequence
  Description of Artificial Sequence: Synthetic coding sequence
atggagctgatcctgagcaccagccccgccgagctgaccctggaccctgcgtgccaaccgaaattgcccctagactctacctgtcagccagaaatgacttttaaccctgggcctacggagctaacactggaccctgaacaccagcccgaagaaacgccagcgccaagcctcgccgagttaaccttggaacctgtccatcgccggcctgagctgcttgacgcctgtgccgatttgataaatgatcagtggccgagaagcagaacatcgcggctccactccctcggtcagagcagcgatgcttttcccctgtgcctgatgctcctgtcccctcaccctaccctggaggcagcccccgtcgtggtcgggcacgctcgcctgtcccgggtgctgaaccagccgcagagcttgctggtcgagactgtcgtggtagcccgcgccctccggggccgcggatttggtcggagattaatggaagggttggaagtctttgctcgcgcccgggggtttaggaaattacacctaaccactcacgatcaagtccacttttacacccatcttggctatcagctcggggagcccgtgcagggcctggtgttcacatctcgccgcttgcccgctaccttgctaaacgccttcccaaccgccccctctccacgtccccctcggaaagcccctaacctaaccgcccaagccgctcccaggggtccgaaagggccgcctctgccacctccacccccattgcctgagtgtcttactattagcccacctgtaccttccggccccccgagcaaaagtcttttggagacacaatatcaaaacgtccgcggaagacccatattttggatggagaaagatatatag

SEQ ID NO: 25186 - DNA, 261 bp, Artificial Sequence
  Description of Artificial Sequence: Synthetic coding sequence
atggagctgatcctgagcaccagccccgccgagctgaccctggacccagcctgtcaacctaaattgcctttggactctacttgtcagcctgagatgacctttaacccaggaccaacagagctgaccttggatccagagcatcagcctgaagaaacacccgctccttccttagccgagttgaccctggaacccgtgcaccgacgccccgaattgttagacgcttgcgctgacctgatcaatgatcagtggccacgcagttag

SEQ ID NO: 25187 - DNA, 30 bp, Artificial Sequence; identical to SEQ ID NO: 11723
  Description of Artificial Sequence: Synthetic coding sequence

SEQ ID NO: 25188 - DNA, 987 bp, Artificial Sequence
  Description of Artificial Sequence: Synthetic coding sequence
atggccgagctgcaggaggtgcagatcaccgaggagaagcccctgctgcccggacagactccagaagctgctaaaactcacagcgttgagaccccttacggaagcgtgacttttacggtgtatgggaccccaaaacccaagcgaccggccatcctaacatatcacgacgtgggcctcaattataagtcttgcttccagcctttgtttcagtttgaggacatgcaggagatcattcaaaactttgtgagggtccacgttgacgcccccggcatggaagagggtgcccctgttttccccctcggttatcagtatccctcccttgatcagctggctgacatgatcccttgcgtcctgcaatatctcaattttagcacaatcattggtgtgggggtgggagctggagcctacatcctggccagatacgcactcactggtcttacctccagcatccctgagatgatactaggccatctgttcagccaggaagaactgtcaggcaatagtgagctaatccaaaagtatcgtaacatcataactcacgctcccaatctggacaacattgaattgtactggaattcctataataatcgcagggacctcaacttcgaacgtggtggcgacatcactctccggtgcccagtgatgctagtcgtcggtgatcaagccccacatgaggacgcagtcgtggaatgcaactccaagctggaccctacccaaacatctttcttaaagatggctgacagtgggggacagccccagctgacacagcccgggaagttgactgaagcgtttaaatatttccttcagggaatgggatacatggccagttcttgtatgacgaggctgtctagaagcaggactgcaagtttgactagtgcagcctccgtcgatggtaaccggagtcgatcgcgcacgctctcccagagcagcgagtccggcaccctgagttccggtcctcccggccacactatggaggtttcctgttag

SEQ ID NO: 25189 - DNA, 1116 bp, Artificial Sequence
  Description of Artificial Sequence: Synthetic coding sequence
atggccgagctgcaggaggtgcagatcaccgaggagaagcccctgctgcctggtcagacaccggaggctgccaaggaagcggaattggccgcgcggattctgctcgatcaaggtcaaactcacagtgtcgaaaccccctatggttcagtaacttttaccgtgtatggaaccccaaaacctaaaagacccgccatcctgacttaccatgacgtggggttgaactataagagctgcttccagcccctgtttcaatttgaagacatgcaagaaatcattcagaattttgtgcgggttcacgtggatgctcccgggatggaagagggagcccccgtgttcccattgggctatcagtatccctccctcgatcagctggcagacatgatcccgtgcgtactccagtacctgaacttcagcaccatcattggcgtaggtgtcggagcgggggcctatatcctcgctcgctacgctctgaatcaccccgacacagtcgagggacttgtgttaatcaacattgatccaaatgccaagggatggatggactgggccgcccataagctgacgggcctgacgagttccattccggagatgatattgggacatctcttcagtcaggaggagctgagcgggaattccgaactcatccagaaatatagaaacatcataacgcacgcacctaacctggacaacattgagttatactggaattcttacaacaaccgtagggacctgaattttgagcggggtggggatattaccctccgatgccctgttatgttagtagtcggagatcaggctcctcacgaagatgcagtggtggagtgtaacagtaaactagacccaacacagaccagctttttgaaaatggcggacagtggggggcagccccagctcacccagcctggcaaattgaccgaagccttcaaatacttccttcaagggatggggtacatggccagcagttgtatgacaagactctccagaagtcgaacagcttctctgacatccgctgcgtcggttgatggcaatcgctctaggtcgcgcactctgagccaatcctctgaatccggcactctaagttccggtcctcccggacacaccatggaagtatcctgttag

SEQ ID NO: 25190 - DNA, 1074 bp, Artificial Sequence
  Description of Artificial Sequence: Synthetic coding sequence
atggccgagctgcaggaggtgcagatcaccgaggagaagcccctgctccccggccagactcccgaggccgcaaaaacacattcggtggagaccccctacgggagtgtcactttcacagtctacggtacgccaaagcctaaaaggccagctatcctcacctaccacgatgttggcctgaactataaaagttgctttcagccactttttcagtttgaggacatgcaggaaatcattcagaactttgtgagagttcatgtcgatgctcctggaatggaagagggcgctcctgtgttccccctcggatatcagtacccctcgctcgatcagcttgcagacatgataccctgcgtcctgcagtacttgaacttttctaccattatcggggtgggtgtcggtgctggcgcctacattcttgccaggtatgctctgaatcaccctgataccgtggagggacttgtgctcatcaacatcgaccccaatgcaaaaggctggatggattgggcagcacataagctgaccggtttaacctcctctattcctgaaatgattctgggccatctgttcagccaggaggagctgtctggaaactccgaactgatccagaaatacaggaacattataacccacgctcccaacctcgacaacatcgagctatactggaactcctataacaatcgccgcgacctgaattttgagaggggaggcgacatcacccttaggtgtccagtgatgctggtggtcggagaccaagcccctcacgaagatgctgttgtcgagtgtaactccaagttggatccaacacaaactagcttccttaaaatggccgattccggcggacaaccccagcttacccagcctgggaagctcaccgaggccttcaagtattttttacagggcatgggctatatggcctcttcctgtatgacacgtctttcccgtagccgcacggcgtctctgacctccgccgcctccgttgatgggaacaggagtcggagtcggacacttagccaatccagcgagtccggtacccttagttccggtccacctgggcatactatggaggtctcctgttag

SEQ ID NO: 25191 - DNA, 1074 bp, Artificial Sequence
  Description of Artificial Sequence: Synthetic coding sequence
atggccgagctgcaggaggtgcagatcaccgaggagaagcccctgctccctggtcagactcccgaagcagctaagacacactctgttgaaacgccttacggtagtgtgacttttaccgtatacggcactcccaaaccaaaacgacccgcaattctaacttaccacgatgttggcctcaactataaatcctgcttccaacctctcttccagtttgaagacatgcaggagataatccagaacttcgtgagggtccatgtcgatgcaccaggcatggaagaaggcgcgcccgtgtttcctctgggataccagtatccttccctggaccagttggccgacatgattccctgcgtgcttcagtacctgaatttcagcacaatcataggcgtgggagtaggggcaggggcttatatattggctcgctatgccctgaaccaccccgataccgtcgaggggctcgtgcttatcaatattgaccctaacgccaaaggctggatggactgggctgcacacaaactcacaggcctcacgagttcaatccctgagatgatcttaggacacttattttcccaggaagagctatccggtaacagcgagctgattcagaagtaccggaacatcattacacatgccccgaaccttgataatattgaattgtattggaacagctataacaatagacgggatctgaacttcgagcgggggggcgatatcacactccggtgcccagtgatgctggtcgtaggcgatcaggcaccacatgaggatgctgttgtcgaatgtaactcaaaactggaccccacgcagacctcttttcttaaaatggccgactctggggggcagccacaactgactcagcctgggaagttgacagaagcctttaagtatttcctgcagggcatgggttatatggcctcctcctgcatgactaggttatccaggtctagaacagcttccctgacctcggctgctagcgtcgacggcaacaggtcaagaagtcggaccctttctcaatcttccgaatctgggacattatcatcagggcctccgggacacaccatggaagtgtcttgctag

SEQ ID NO: 25192 - DNA, 1026 bp, Artificial Sequence
  Description of Artificial Sequence: Synthetic coding sequence
atggccgagctgcaggaggtgcagatcaccgaggagaagcccctgttaccagggcagacacctgaggccgccaagacacatagcgtcgaaacgccttacgggtctgtgacattcaccgtgtacgggacacctaagcccaaaagacccgctatcctgacctaccacgacgttgggctgaattataagagttgctttcagcccctgttccaattcgaagacatgcaggagattatccaaaacttcgtaagggtgcacgtggatgccccagggatggaggaaggggctcccgtgttcccactcggatatcagtacccgtccctcgatcagctggccgatatgataccttgtgtgttgcagtatttgaacttctctaccatcatcggggtgggcgttggcgcaggggcctacatattagctaggtatgccttgaatcatcctgacactgtcgaaggtctcgttctcattaacatcgaccctaatgctaagggctggatggattgggccgcacacaaattgacaggtctgactagcagcatcccagagatgatcttaggacacttatttagccaggaggagctctccgggaattccgagcttatccagaagtacagaaatattatcacacacgcccctaatctggataatattgagttgtactggaattcatacaataatcgacgcgacctgaactttgaaagaggcggggacatcacactaaggtgcccagttatgctggtggtgggggaccaggcccctcacgaggatgctgtcatggctgatagcggggggcagccccagctgacccagcccggcaagctgacggaggcctttaagtattttctgcagggcatgggttatatggcatcatcatgcatgacccgcctaagtcggtcaagaacagccagcttgacctcagcagcctccgtcgatggcaaccggagtcgttcccgtacactgagccagagcagtgagagcgggactctgagcagcggtcccccaggccatacaatggaggtgagttgttag

SEQ ID NO: 25193 - DNA, 1083 bp, Artificial Sequence
  Description of Artificial Sequence: Synthetic coding sequence
atggccgagctgcaggaggtgcagatcaccgaggagaagcccctgcttcccgggcaaacacccgaggccgcgaaggaagccgagctagccgcccgcatcctgttggatcaaggccagactcactccgtagagacaccttatggcagcgtgacttttactgtgtacggaacgcctaaaccgaaaagaccagcaatactaacgtaccacgatgtcggactaaactacaagtcatgtttccagccgttgttccagtttgaagatatgcaggaaatcatccagaacttcgtgagggtgcatgtcgacgcccccggcatggaggaaggagctcccgtgttccctctcgggtatcagtatcccagcctggatcagctcgcagacatgatcccctgcgtcctgcagtatctgaacttttcaactatcattggcgtgggggtgggagctggggcctacatactggcacgttacgccctgaatcatcctgataccgtggaaggcctggtccttatcaacatcgatcccaacgcgaaggggtggatggactgggcagcgcacaaactgacaggactgacttcctccattcctgagatgattttgggacacctgttctcacaggaggagctctcaggtaatagtgaactaattcagaagtacaggaatatcataacccacgcccccaacttagacaatattgaactgtactggaatagctacaacaacaggagagaccttaacttcgaacgcggaggcgatattaccctgcgatgccctgtgatgctggtggtcgaatgcaattccaagctcgaccccacccaaactagcttcctgaaaatggctgactccggcggtcagccccaactcactcagcctggaaaattgacagaagcctttaagtattttctgcagggcatggggtatatggcatcaagctgcatgaccaggctgtcaagaagtcggacggccagcctaacctcagcggcgagcgtggacggtaacagaagtcgaagcagaacgctttctcaatcttcagaatcgggtacactatcctccgggccccccgggcacactatggaggtcagctgctag

SEQ ID NO: 25194 - DNA, 1116 bp, Artificial Sequence
  Description of Artificial Sequence: Synthetic coding sequence
atggccgagctgcaggaggtgcagatcaccgaggagaagcccctgctgcctggacagacccctgaggccgctaaggaagccgagcttgcagcgcggattctgctggaccagggccagacccattcagtggaaaccccatatggtagcgtgacattcacagtgtacgggacaccaaagccaaaacgcccggctattttgacctatcatgacgtgggcttgaactataagagctgttttcagcctctgtttcagtttgaagatatgcaggagatcatccagaattttgtccgggtgcacgtcgacgctcccggaatggaagaaggcgctccggtgtttcccttaggttaccaatacccctccctggatcagctagctgatatgatcccgtgtgtccttcagtaccttaacttttctacgattattggagttggtgtcggggcaggcgcttacatcctggcccgctatgcactcaaccaccctgacaccgttgaggggctggtcttgattaatattgaccccaatgccaaggggtggatggactgggccgctcataagctgaccgggctcacatcctccatccctgagatgatactgggacatctcttctcccaggaggagttgtcaggaaattctgaactgatccaaaaataccggaacatcatcacacacgctcccaatctcgataacattgagctgtactggaattcatataataataggcgagatcttaactttgagagaggtggggatatcaccctcaggtgccctgtgatgctggtggttggtgatcaggccccccatgaggatgcagtagtagagtgtaacagcaaactggatcctacccagacctccttcctgaagatggctgactcaggagggcaaccgcagcttacccagccgggtaagctaacagaagcattcaaatacttcctgcaaggtatggggtacatggcctcttcatgcatgaccaggctgagccgcagccggacggcttctctgacatcagcagcctcagtggatggaaatcgctcacgcagtcgcacactttcacaaagttctgaaagcggaaccctatcaagtgggccacccggacacactatggaagtctcttgttag

SEQ ID NO: 25195 - DNA, 1116 bp, Artificial Sequence
  Description of Artificial Sequence: Synthetic coding sequence
atggccgagctgcaggaggtgcagatcaccgaggagaagcccctgttgccaggtcaaacccccgaagccgccaaggaagctgagctggccgcacgaatactgctcgatcaggggcagacacatagcgtcgagaccccgtacggcagcgtcaccttcacggtgtatggcaccccaaagccgaagcgcccagccatattaacatatcacgacgttgggctgaactacaagagttgctttcagccgctttttcagtttgaggatatgcaagagataattcagaatttcgtgcgggtgcatgtcgatgcgcctgggatggaggaaggagcacctgtgtttcccctgggctatcagtatccctccttggatcagctggccgacatgatcccctgcgtgttgcagtatctgaacttttccaccatcattggcgtgggagtgggggccggggcctacattctggctcgctacgcactcaaccaccctgacacagtggaaggtctggtgttaatcaatatcgacccaaacgcgaagggctggatggattgggctgcccataaattgacgggactgacctcatcaattccagagatgattttaggccacctcttctcccaagaagaactgtccggcaacagcgagctgatccaaaagtaccggaatatcatcacgcacgctccaaacctcgataacatagaactctattggaactcttataacaataggagggatctgaacttcgaaaggggcggagatattactctgcgttgcccagtcatgctagttgtaggagaccaggcaccacatgaggatgccgtggttgagtgcaattcaaagctagatccaacccagacctcttttctcaaaatggctgatagcggcggacagccccagcttacccagccaggtaaactcacggaggctttcaagtattttttgcagggcatgggctatatggctagtagttgcatgacccgattgtcacgttctcgaacagctagtttgacatccgcagccagtgtagatggcaatcgcagtaggagccggaccctttcccagtcatcggagtcaggaactctgtcttcagggccccccgggcacaccatggaagtgagctgctag

SEQ ID NO: 25196 - DNA, 987 bp, Artificial Sequence
  Description of Artificial Sequence: Synthetic coding sequence
atggccgagctgcaggaggtgcagatcaccgaggagaagcccctgctcccaggccagacacccgaggccgccaaaacccacagcgtcgagactccctatggatcagtgacttttaccgtgtacggcacgcccaagcctaagcggccagcgatactcacctaccatgatgtcggtcttaactataagagctgctttcagcccttattccagttcgaagatatgcaggagatcatacaaaacttcgtgcgggtacacgtggacgccccgggcatggaagagggtgcacccgtctttcctttgggataccaatatccttctctggatcaactcgctgacatgattccatgcgttctccagtacttaaacttttccacgatcatcggtgttggcgtcggcgctggtgcctacatcctggcacgctatgctctgaccggcttgacatccagcattcccgaaatgattctcgggcatctatttagtcaagaggaactttcgggcaacagcgagttgattcagaagtacaggaacattatcacccatgccccaaacttggacaatatagaactgtactggaacagctataataatcggcgagatctgaactttgagcgggggggtgatatcactctaagatgtccggtgatgcttgtggtgggtgaccaggccccccacgaggatgccgtggttgagtgtaactctaagctggaccctactcaaacttcgtttctcaagatggccgatagcggtggtcagcctcagctgacacaacctggaaagttgactgaggctttcaagtattttctgcagggcatgggctacatggctagttcctgcatgacacggctgtctcgttcccggacagcttcacttacctccgcggcctctgttgatggcaaccgctcccgatcccggacgctcagccaatccagcgaatcaggaacactgtctagcggaccaccggggcacacaatggaagttagttgctag

SEQ ID NO: 25197 - DNA, 1026 bp, Artificial Sequence
  Description of Artificial Sequence: Synthetic coding sequence
atggccgagctgcaggaggtgcagatcaccgaggagaagcccctgcttccgggccaaacccctgaggctgccaaaacgcactccgtggaaacaccctacgggagcgttacgttcactgtatacggaaccccaaaaccaaaacgccccgccatcttaacctaccacgatgtaggcctgaattataaaagttgctttcaacctctctttcagtttgaagacatgcaggaaattatccagaactttgttcgcgtgcacgttgacgcccccggaatggaggagggcgcccccgttttcccgctcgggtatcagtacccttcgctggatcagttggcagacatgattccatgtgttttacaatacttgaatttttctaccatcatcggtgtgggagtgggcgccggtgcttacattcttgctagatatgctctgaaccacccggatacagttgaagggttagtgcttattaacattgacccaaatgctaaggggtggatggattgggctgctcacaaattaaccggacttacctcatcgattccagagatgattctcgggcacctattttctcaagaggaattgagcggtaacagtgagcttattcaaaaatacaggaacattataactcatgcccctaacctggataatatcgagttgtactggaattcctataataacagacgtgaccttaacttcgaacgagggggggatatcacactgcggtgcccagttatgcttgtggtaggtgaccaagcacctcacgaggatgccgtgatggccgattctggcgggcaaccgcagctgactcagcctggtaaattgaccgaggcctttaagtacttcctgcagggtatggggtatatggcctcctcttgcatgacccgtctcagtagatcccgcactgccagtcttacttctgccgctagcgtcgatgggaatagaagccgctctcgcaccctgagtcagtccagcgagtcgggaaccctgagctcaggccccccaggacacacaatggaagtgagttgttag

SEQ ID NO: 25198 - DNA, 1116 bp, Artificial Sequence
  Description of Artificial Sequence: Synthetic coding sequence
atggccgagctgcaggaggtgcagatcaccgaggagaagcccctgctgccggggcagacacccgaagccgccaaggaggcagaattggcagcccggatcttgctcgatcagggtcagacacattccgtggagacaccctatggaagcgtgacctttacggtatacggtacaccaaagcccaagaggcctgccatcctcacctaccatgatgtggggcttaactacaaaagttgctttcaacccctgttccagtttgaggacatgcaggaaattatacagaattttgttcgagttcacgtggacgcccctggcatggaagagggggccccagtttttccattggggtatcagtacccaagcctggaccaactggccgatatgatcccttgcgtgttgcagtatctgaatttctccacaatcattggggtcggtgtgggggccggcgcctacattctcgcccgctatgctctgaatcatcccgacaccgtagagggactcgtgctcataaatatcgaccctaacgctaagggctggatggattgggccgctcacaaactgacaggactgacaagttccattccggaaatgatcttaggacatctgttctcccaggaagaactctcaggcaactccgaactaattcagaagtaccggaacatcatcactcacgcacccaatttggataacattgagctgtactggaattcctacaacaaccggcgcgatttaaatttcgagaggggaggagacatcacactgaggtgccccgttatgctcgtcgtgggtgaccaagcaccccacgaggacgcagtggtggaatgtaattcaaagttggaccctacgcagacatcctttttaaaaatggctgactccggaggccagccgcagctgacacaacccgggaagctaaccgaggcgttcaagtatttcctccaaggcatgggttatatggcttctagctgcatgacaagactgtctcgcagtcggaccgcgagcttgacatcagccgcctctgttgatggcaacaggagccggagcagaaccctttcacaaagttccgaatctgggacactatcctccggaccccccgggcatacaatggaagttagctgctag

SEQ ID NO: 25199 - DNA, 1104 bp, Artificial Sequence
  Description of Artificial Sequence: Synthetic coding sequence
atggagaacggcggcagcatgcaggccaccatggccgagctgcaggaggtgcagattactgaagagaaaccacttctgcctggccagacccctgaggctgctaaaacccactccgtggaaaccccatacggatctgttacgttcacggtctacgggacccctaaacctaagcggccagccatcctgacataccacgatgtcgggctaaattacaagagctgcttccagccactgtttcagtttgaagacatgcaagagataattcagaattttgtgagggtgcacgtagatgccccaggcatggaggagggtgcacctgtgttccccttgggatatcaatatccaagtctggatcagctggccgacatgatcccctgcgtgcttcagtacctcaatttttccaccattattggagtcggagtgggtgctggagcctacatccttgcacgatatgctctcaaccaccccgacacagtagaaggattggtgcttataaacatagaccctaatgcgaagggctggatggactgggccgcccataagttaacaggcctgacaagtagtatccctgagatgattttaggccacctgttcagtcaggaggagctctctggcaacagcgagctcatccagaaataccgaaacatcataactcacgctcctaacctcgataatattgagctgtattggaactcctacaataacagaagggacctcaattttgagcggggtggagatatcacattgagatgtcccgtgatgctggtggtgggcgatcaggcgcctcacgaggacgcagtggttgagtgtaactccaaactggatcccactcagactagctttctgaagatggcagactccggaggtcagccccaactgacacagccgggcaaactgaccgaggcgtttaaatactttctgcaggggatggggtatatggcctccagctgcatgacccgcctgagcagatccagaaccgcaagcctcacgtccgccgcatcggtggacgggaaccggagtcggtccaggaccctgtctcagagctccgagtccggcactttatcatcgggacccccgggccatacgatggaagtgagctgctag

SEQ ID NO: 25200 - DNA, 504 bp, Artificial Sequence
  Description of Artificial Sequence: Synthetic coding sequence
atggccgagctgcaggaggtgcagatcaccgaggagaagcccctgctcccaggccagacgccagaggctgccaaaactcactctgtggaaacgccttacggctctgtgaccttcaccgtatacggaactccaaaaccgaagcggccggccatccttacctaccacgacgtgggcctgaactacaagagctgttttcagccccttttccagtttgaagatatgcaggaaatcatccagaattttgtacgtgtccacgtggacgcccctggtatggaggagggagcccccgtcttcccacttggctaccagtacccgtccttagatcaactggctgacatgatcccctgtgtgctgcaatacttgaatttctccactattattggagttggagttggtgcaggagcctatatactggcacggtacgcgttaaatcaccccgatacagtggagggtctggtgctcatcaatatagaccctaatgctaagggatggatggactggtag

SEQ ID NO: 25201 - DNA, 1074 bp, Artificial Sequence
  Description of Artificial Sequence: Synthetic coding sequence
atggccgagctgcaggaggtgcagatcaccgaggagaagcccctgctgccagggcagacaccagaggcggctaagactcactccgtagagaccccttacggatctgtgacttttacggtgtatggcacgcccaaacctaagcgaccagctatccttacgtatcatgacgtgggattgaattataaaagttgcttccaacccttgtttcagtttgaagatatgcaggaaatcatccagaattttgttcgtgtacacgtggatgcccctgggatggaggagggcgccccagtcttccctttaggctaccagtaccctagcctagaccaactcgcggatatgattccgtgcgtgctgcagtatttgaattttagtaccattatcggagtcggggtgggagcaggcgcgtatatactggcccgctacgctcttaatcatcccgacacagtcgagggcttagtcttaattaacattgatccaaacgcaaagggctggatggactgggccgcccacaagctgactggccttacttcctctattcctgaaatgattttggggcacttattttcacaagaagagttgagcggaaactccgaactaatacaaaagtatcgaaatataattacccacgctcccaacctggataatattgagctctattggaattcctataataatcgccgagacctgaatttcgagcgcggcggcgatatcaccctgcgttgcccagtcatgctggtcgtcggggaccaggcgccgcatgaggatgctgtggtagagtgcaactctaagttagacccaacacaaaccagttttctgaagatggcagattcagggggccagccccaacttacccagcctggcaaactgaccgaggcgttcaagtatttccttcaggggatgggttacatggccagctcctgcatgacccgactcagtcggtcccggacagcatcgcttacttctgcagccagcgtggacgggaatcggagcaggagccggacactaagtcagtcctcagaatctggtaccctctcaagtggaccacctgggcatactatggaagtcagttgttag

SEQ ID NO: 25202 - DNA, 522 bp, Artificial Sequence
  Description of Artificial Sequence: Synthetic coding sequence
atggccgagctgcaggaggtgcagatcaccgaggagaagcccctgctgccaggacaaactccagaggccgcaaaggaagccgagcttgctgcccggatcctccttgatcagggtcagactcatagcgtggagactccatatggatcagtcacttttaccgtttacgggaccccgaagccaaaacgccccgcaattctcacctaccacgacgtcggcctcaactacaaatcatgctttcaaccgctgttccagttcgaggatatgcaggagattattcaaaactttgtcagagtccatgttgatgcccctggcatggaagagggtgctccagtcttccctcttggctatcagtacccgtccttggaccagctcgctgatatgatcccttgtgtgctccagtacctcaatttttctaccatcattggggtgggagttggtgcgggggcatacatactggctcggtatgctctgaatcaccctgacaccgtagaaggactcgtcctgatcaatatcgacccgtag

SEQ ID NO: 25203 - DNA, 759 bp, Artificial Sequence
  Description of Artificial Sequence: Synthetic coding sequence
atggccgagctgcaggaggtgcagatcaccgaggagaagcccctgctgccaggacaaacaccagaggctgctaaagaagctgagttagcggcgagaattctcctcgaccagggacagacacactcagttgagaccccttatggatccgtgaccttcaccgtgtatggtactccaaaacctaagaggccagcaatactcacctaccatgacgtaggtctcaattataaatcttgctttcaacctttgtttcagtttgaggatatgcaggagatcatccagaatttcgtgcgcgtccacgtcgatgcccccggaatggaggaaggagcccccgtgttcccactagggtaccaatacccttccctcgaccagctcgccgatatgattccttgcgtcctacagtatctgaatttcagtacaataataggcgtcggggtgggcgccggcgcttacatcctggcccgatacgccctcaaccacccggacacagtagagggactagtgctgattaacatcgacccaaacgcaaagggctggatggactgggcggcccacaagctgacgggactgacatcctccatacccgaaatgattctcggtcatctattttcacaagaggagctgagtggaaactctgagctgatccagaagtacagaaatatcatcactcatgcgcctaacctcgacaacatcgaactttactggaacagctacaacaaccgtagagacttgaacttcgaacgggggggagacatcacatag

SEQ ID NO: 25204 - DNA, 525 bp, Artificial Sequence
  Description of Artificial Sequence: Synthetic coding sequence
atggccgagctgcaggaggtgcagatcaccgaggagaagcccctgttgcctggccagaccccggaagccgcaaaaacacacagtgtagagaccccttatggaagtgtcacatttaccgtgtacggaacgcccaagcctaaacgcccggccattttgacataccatgacgtggggctgaactacaaaagctgcttccagcctttatttcaattcgaggacatgcaggaaattattcagaacttcgtgcgtgtgcatgtcgacgcgcctggaatggaagagggcgcccctgtgtttcccctgggataccagtacccatctcttgatcagctggccgatatgattccttgcgtcctgcagtacctgaatttttccacgatcatcggcgtaggagtaggcgctggtgcctatatcctggccaggtatgctctcaaccaccctgatacggtggaagggctcgtgctcatcaacatagatcccaacgcaaaggggtggatggactgggccgcccacaaacttacaggctag

SEQ ID NO: 25205 - DNA, 1074 bp, Artificial Sequence
  Description of Artificial Sequence: Synthetic coding sequence
atggccgagctgcaggaggtgcagatcaccgaggagaagcccctgcttccgggacagacacccgaagcggcaaagacccattcagtggaaactccctatggcagcgtgacctttacagtttatgggacacccaagccaaagaggcccgccatcctgacctatcatgatgtggggctgaactacaaaagttgcttccagcctctgttccagtttgaagacatgcaggagatcatccagaactttgttcgggtgcacgtcgacgcccctggaatggaggagggagcaccagtttttccattaggataccaatatccgagcctagaccagttggccgatatgataccttgtgtactgcaatatctaaatttctcaactatcattggcgtcggagttggggccggcgcatatatcctggctaggtatgcccttaatcatcccgatacggtggagggattggtgcttatcaatatcgatcccaatgccaaaggttggatggactgggctgcccacaagctgactggcctcacaagcagtatccctgagatgattttgggccatctcttcagccaagaggaattaagcggcaactcagagcttatacagaaatatcgcaacatcatcactcatgcgcccaatctggataacattgagctgtactggaactcctataataatagaagagacctgaacttcgagcggggtggggacattactctccggtgccctgtaatgttggtggtgggtgaccaagcaccacacgaagacgccgtggtcgagtgcaactcaaagctggatccaacacaaactagtttcttgaaaatggctgattccggggggcagcctcaactgacgcagcccggtaaactgaccgaagcattcaagtattttttacagggtatgggctacatggcctcgtcatgtatgacaagactctcccgctcgaggactgcctccctgacatccgcagcctcggttgacggcaaccgctccagatccagaaccttgtctcagagttctgaatctggcacccttagctccgggccccccggacacacaatggaagtctcctgttag

SEQ ID NO: 25206 - DNA, 450 bp, Artificial Sequence
  Description of Artificial Sequence: Synthetic coding sequence
atggccgagctgcaggaggtgcagatcaccgaggagaagcccctgcttccgggccagacccccgaagccgcaaaggaggccgaactagctgcgcggatcctcctggaccaggggcagacacattcagtcgagactccgtacggtagcgtgacctttacagtgtatggcacccctaagccgaaacggcctgcaatcctcacctatcacgacgttgggttgaactacaagtcctgttttcagcctttgtttcagttcgaagacatgcaggagatcatacagaactttgtgcgggtccatgttgacgcccccggaatggaggaaggcgctcctgtctttcctctcggataccagtacccgtctctggaccagctggccgatatgatcccgtgtgtgttgcagtatttgaatttctccaccatcattggcgtgggtgtgggagccggtgcctag

SEQ ID NO: 25207 - DNA, 261 bp, Artificial Sequence
  Description of Artificial Sequence: Synthetic coding sequence
atggccgagctgcaggaggtgcagatcaccgaggagaagcccctgcttcctgggcaaacaccggaagccgcgaaggaagctgagctggccgcgcgtatcctgcttgatcaaggacaaactcactcagtggagaccccttacgggagcgtcaccttcaccgtttacggaactccaaagccgaagcgacctgctattctgacctatcatgacgtcggactgaactacaaatcctgtttccagcccttgtttcaatttgaatag

SEQ ID NO: 25208 - DNA, 390 bp, Artificial Sequence
  Description of Artificial Sequence: Synthetic coding sequence
atggccgagctgcaggaggtgcagatcaccgaggagaagcccctgttgcctggacagactccagaggccgcaaaagaagcagaactagccgccaggatcctgctggatcagggacaaacgcattctgtggaaaccccctacggatctgttactttcaccgtatatggaacccctaagcccaagagacctgccatactgacatatcacgacgtgggactgaactataagtcctgttttcagcctcttttccagttcgaggacatgcaggagataatccagaactttgtcagggtgcacgtggacgcacctggaatggaagagggggcaccagtcttccccctcgggtatcagtacccctccctagaccagctcgccgacatgatcccgtag

SEQ ID NO: 25209 - DNA, 447 bp, Artificial Sequence
  Description of Artificial Sequence: Synthetic coding sequence
atggccgagctgcaggaggtgcagatcaccgaggagaagcccctgctacctggacagacacccgaggccgctaaggaggcagaactcgccgctcggattttgcttgatcaggggcagacccactctgtcgaaactccatatgggagcgtcacatttaccgtctacgggacccccaagcccaagcggcctgcaattcttacataccatgacgtcgggcttaattataagagttgcttccagcctctgttccagttcgaggatatgcaggagattatccaaaacttcgttcgcgtccacgtggacgccccaggaatggaggagggggcacctgtgtttccactgggataccagtatcccagcctcgaccagctggcagacatgattccttgtgtgctacaatacttgaatttcagtactattatcggcgtcggggttggagccggctag

SEQ ID NO: 25210 - DNA, 405 bp, Artificial Sequence
  Description of Artificial Sequence: Synthetic coding sequence
atggccgagctgcaggaggtgcagatcaccgaggagaagcccctgctgccagggcagacccctgaggctgcaaagactcacagcgtggagacaccttatggctcagtaaccttcaccgtttacggaactcctaaaccaaaaagaccggcaatcttgacctatcatgacgttggcttaaattacaagagttgcttccagcccctgttccagtttgaggacatgcaagagattatccagaatttcgttagagttcatgttgacgctccgggcatggaggaaggggcgccagtgttccctctgggttaccagtacccatccctggatcagcttgctgatatgataccctgcgtgctccagtatctgaacttttccactatcattggagttggggttggggcagggtag

SEQ ID NO: 25211 - DNA, 327 bp, Artificial Sequence
  Description of Artificial Sequence: Synthetic coding sequence
atggccgagctgcaggaggtgcagatcaccgaggagaagcccctgctccccggacagacaccagaagcggcaaaaacccattctgtggagactccatacggcagtgttacctttacggtgtacggtacacctaagcccaagcgtcctgccatcctgacttatcacgacgtagggcttaactataagtcctgcttccaacctctttttcagttcgaagatatgcaagaaatcatacagaactttgtgagagtgcatgtcgacgccccaggcatggaggagggcgctcccgtctttcctctcggatatcagtaccccagcctggactag

SEQ ID NO: 25212 - DNA, 363 bp, Artificial Sequence
  Description of Artificial Sequence: Synthetic coding sequence
atggccgagctgcaggaggtgcagatcaccgaggagaagcccctgctgcccggacagacccctgaggctgctaagacgcattccgtggagaccccctacggttccgtgacatttaccgtgtacggcacccccaagcccaaacggcccgcaatcctgacttaccatgacgtggggctgaactacaagtcttgttttcagcctctcttccaattcgaggacatgcaagaaattattcagaatttcgtaagggttcatgtggacgcccctgggatggaggagggggctcctgtgtttccactcggctaccagtatcccagcttggatcagttggctgatatgattccctgtgtgctccagtattag

SEQ ID NO: 25213 - DNA, 300 bp, Artificial Sequence
  Description of Artificial Sequence: Synthetic coding sequence
atggccgagctgcaggaggtgcagatcaccgaggagaagcccctgctgccaggccaaacccccgaagccgccaaggaagccgagctcgctgccaggattctgctggaccaaggccagactcatagcgtggagaccccctatggcagcgtaacctttacagtgtatgggactcctaagcctaaacggcctgcaatcttgacataccatgatgtcggactgaactataaatcatgctttcagccacttttccagtttgaagatatgcaagaaattatacaaaatttcgtgagggttcattag

SEQ ID NO: 25214 - DNA, 279 bp, Artificial Sequence
  Description of Artificial Sequence: Synthetic coding sequence
atggccgagctgcaggaggtgcagatcaccgaggagaagcccctgctgcccgggcagacacccgaagccgctaaaacacactctgtggaaacaccttacggtagtgtgaccttcaccgtttatggcactccaaagccgaaaaggcccgccatcctgacctatcacgatgtggggcttaattacaaatcttgtttccagcccctgttccaattcgaggatatgcaggagattattcagaattttgtgcgcgtgcatgttgatgcgccagggatggagtag

SEQ ID NO: 25215 - DNA, 462 bp, Artificial Sequence
  Description of Artificial Sequence: Synthetic coding sequence
atggccgagctgcaggaggtgcagatcaccgaggagaagcccctgcttcccggccagacccctgaggccgccaagacccatagtgtcgagacaccctatggctccgtgacattcacagtgtacggcacccctaaaccaaagagacccgctatcctgacgtatcatgatgtcggtttgaactacaagtcctgcttccaacctctctttcagtttgaggatatgcaagagatcatacagaattttgtgagagtacatgtcgacgccccaggcatggaggaaggcgctcctgtttttcccctggggtatcagtacccgagcttggaccagctggccgacatgattccctgtgttctgcagtatttgaatttttccaccataataggcgtgggtgtgggtgccggagcgtatatcctggcccgctatgctctgaatcacccggacactgttgagggtcttgtgtag

SEQ ID NO: 25216 - DNA, 1074 bp, Artificial Sequence
  Description of Artificial Sequence: Synthetic coding sequence
atggccgagctgcaggaggtgcagatcaccgaggagaagcccctgctgcctggtcagacgccagaggcagcaaagacacattccgttgaaactccttacggctctgtgacctttactgtctacgggacccccaagcccaagcggcctgccattctgacttatcatgacgttgggctgaactataagtcatgtttccaaccattgtttcaattcgaggacatgcaggagatcatacagaattttgtgcgcgtccacgtggacgcccctggtatggaagaaggcgcaccagtgtttcctttgggctaccagtacccatctctcgatcagctggccgacatgataccatgtgtactccagtacctgaacttttccacgataattggcgtcggtgttggcgctggggcatacatcctggctaggtatgcccttaatcatcctgataccgtggaaggcctggtgctgatcaacattgacccgaacgccaaaggctggatggactgggccgcacacaaactcacaggcctcaccagctcgatacctgagatgatcctggggcatctgttctcacaagaagagctgtctggtaatagtgaactgattcagaagtatagaaatattattacacatgcaccaaatctggacaatattgagctatattggaattcctacaataatcggagagatctgaattttgagcgcggtggagacataactctgcggtgccccgtgatgctggtagtgggagaccaggctccacacgaggacgccgtggtggaatgtaactctaaactcgatcccacacaaacaagttttctgaagatggcagacagcgggggccagccccaacttacgcagccaggtaaactgacggaggcatttaaatattttctgcagggcatgggttacatggctagctcctgtatgacaagactcagccgttcaagaaccgcctccctcactagtgccgccagcgtggatggcaaccgatcccggtcaaggaccttatctcagtcaagcgagtcgggcactctctcctctggccctccgggccatactatggaggtgtcttgctag

SEQ ID NO: 25217 - DNA, 585 bp, Artificial Sequence
  Description of Artificial Sequence: Synthetic coding sequence
atggccgagctgcaggaggtgcagatcaccgaggagaagcccctgctcccaggacagactcccgaggccgcaaaggaagcagaactcgctgcacgaattttgctcgatcagggacagacacattccgtagaaactccgtatggatcagtgaccttcacggtatatggcacacctaagcctaagaggcccgccatccttacctatcacgacgtcggactgaattataaaagctgctttcaacctctcttccaattcgaggatatgcaggagatcatccagaatttcgtccgcgtacatgtagacgcccctggtatggaagaaggcgcgccagtgttccccctgggttatcagtacccatctttagatcagttagccgatatgattccctgcgtactgcaatacttaaatttctccacaatcattggcgtgggagtgggggcgggtgcgtatatcctggctaggtacgcactgaaccaccccgacactgttgagggtctggttcttattaacatagaccccaacgcaaaagggtggatggactgggccgctcataaactgactggccttacttcgagcattccatag

SEQ ID NO: 25218 - DNA, 387 bp, Artificial Sequence
  Description of Artificial Sequence: Synthetic coding sequence
atggccgagctgcaggaggtgcagatcaccgaggagaagcccctgttgcctggacagaccccagaggccgctaaaacacactctgtggagaccccatatggtagcgtgacatttactgtgtacgggacaccaaaacctaagaggcccgctattctcacttaccacgatgtcggattaaattacaaatcttgtttccagccgctgttccagttcgaagatatgcaagagatcattcaaaattttgtccgcgtccatgtggatgcgccaggcatggaagaaggagctccggtgttcccgttgggataccaatacccaagtctggaccaactcgccgacatgatcccatgcgtgttacagtacctcaacttcagcactattattggctag

SEQ ID NO: 25219 - DNA, 660 bp, Artificial Sequence
  Description of Artificial Sequence: Synthetic coding sequence
atggccgagctgcaggaggtgcagatcaccgaggagaagcccctgttgcctggtcagacacctgaagccgccaaggaagctgagctcgcggctcgcattttgctcgatcagggccagacacactcggtcgagactccctatggttccgtaactttcaccgtttatggaacgcctaaacctaagagaccagccattctcacataccatgatgtcggcctaaactacaaatcatgctttcaacccctctttcagttcgaagatatgcaggaaattatccagaatttcgtgcgggtccacgtggacgcgcctgggatggaggagggcgctcccgtgtttcctctcggctatcagtacccttccctggatcagctcgccgacatgattccttgcgtgctgcagtatctgaatttttctactattataggtgtgggtgtgggcgcaggtgcttacatcttagcacgctacgcccttaatcaccccgacacagtagaaggattggtcctaataaatattgatcctaatgccaaaggctggatggattgggcagctcacaaacttactgggttgacctctagcatacccgaaatgatactcggccatctgttcagtcaggaggagctatctggcaattctgagctaattcagaaatatagaaactag

SEQ ID NO: 25220 - DNA, 666 bp, Artificial Sequence
  Description of Artificial Sequence: Synthetic coding sequence
atggccgagctgcaggaggtgcagatcaccgaggagaagcccctgctccctgggcagacacccgaggctgctaagacccacagtgtcgagaccccgtatggatcagtgactttcacagtttatggaacacctaagcccaagcgcccagccatattaacttaccacgacgtgggtctcaactacaagtcctgctttcagcctctcttccagtttgaagatatgcaggaaattatccagaattttgttagagttcacgtggacgctccagggatggaagagggcgcccccgtcttcccattgggctaccagtacccaagcctggaccagctggccgatatgatcccatgcgtgctgcagtacctgaacttctccacgatcatcggggtgggcgtaggagcaggcgcatatatattggcccggtacgctcttaatcatccagataccgtcgaaggactggtgttgattaacattgatcccaacgccaagggttggatggattgggcagctcataagttaacaggtctgacatcaagcatcccggagatgatactgggtcacctgtttagccaagaggaactatcaggaaactccgagctcattcagaagtacaggaatatcataactcacgcacctaatttagacaatatagagctgtactggaactag

SEQ ID NO: 25221 - DNA, 1116 bp, Artificial Sequence
  Description of Artificial Sequence: Synthetic coding sequence
atggccgagctgcaggaggtgcagatcaccgaggagaagcccctgctaccaggccagacccctgaagctgccaaagaggccgagctggccgcccgaattttgctggaccagggacagacacacagcgtcgagacaccatatggaagcgtgacattcactgtttacggcactcctaagcctaagcgccccgctatcttgacttaccatgatgtgggactcaattacaagagttgcttccagcccctgttccagttcgaagacatgcaggaaattatccagaactttgttagggtgcacgtcgatgctcctggtatggaggagggtgcaccagtgtttccactgggttaccaatacccttcactcgaccagctggccgacatgatcccctgcgtcttacagtatctcaattttagcaccatcattggtgtgggcgttggcgcaggcgcatacattctggcgcgctacgcactgaatcaccccgacaccgtggagggactggtcctgattaatattgatccgaacgcaaaggggtggatggattgggccgcgcacaagttgaccggactgacatcaagcatcccagaaatgatcctgggccatctctttagccaggaggagctgagcggcaactcagaactgatccaaaagtacaggaatattataacccacgccccaaatctggataatattgaactttattggaattcctataacaatcggcgcgacttgaactttgagaggggaggagacatcaccctacggtgtccagtgatgctggtggtgggggaccaagcccctcacgaagatgctgttgtcgagtgcaacagcaaactcgaccccacacaaacctccttcctaaagatggccgatagcggagggcagccacagctcacccagccgggcaaactcacagaagccttcaagtacttcttacagggcatggggtacatggcatctagctgtatgactcgcctttcgagatctcgtacagccagccttaccagcgcagcctctgtagatgggaatcggtcacggagtcggaccctgtctcagtccagtgagagcggaacactaagctccggtcctcctggccacacaatggaagtttcctgttag

SEQ ID NO: 25222 - DNA, 432 bp, Artificial Sequence
  Description of Artificial Sequence: Synthetic coding sequence
atggccgagctgcaggaggtgcagatcaccgaggagaagcccctgctgccaggccaaacacccgaagcggcgaagactcactccgtggagactccatacggctccgtaacttttacggtatacggaaccccaaagccaaaacgtccagccattcttacctatcatgacgtgggcctgaactacaagtcctgtttccagcccctgtttcaattcgaggatatgcaggagattattcagaattttgtgcgggtacacgtggatgctcctggtatggaagaaggagccccagtgtttcctctgggatatcagtaccccagcttggaccaacttgccgatatgatcccttgcgtgttgcagtacctcaactttagcaccattattggtgtgggggtgggcgccggggcttatatactcgcacgatacgctctttag

SEQ ID NO: 25223 - DNA, 483 bp, Artificial Sequence
  Description of Artificial Sequence: Synthetic coding sequence
atggccgagctgcaggaggtgcagatcaccgaggagaagcccctgctacccggccaaacccctgaagctgccaaaacccactctgtcgagaccccctatggcagcgtgaccttcactgtgtatgggacacccaagcctaagcggcccgccattctgacttaccacgacgtcgggttgaactataaatcatgttttcagccattgtttcagtttgaagatatgcaggagatcattcagaatttcgtgcgcgtccacgttgacgcccccggtatggaggagggagcccccgtatttcctctgggataccaatatccctcccttgaccagttagctgacatgattccgtgtgtgctccaatacctcaacttcagcaccatcattggggtcggcgtgggcgcaggcgcctacattttggctagatatgcattaaaccatcccgatactgtggaagggctcgtgctaatcaacattgaccccaactag

SEQ ID NO: 25224 - DNA, 426 bp, Artificial Sequence
  Description of Artificial Sequence: Synthetic coding sequence
atggccgagctgcaggaggtgcagatcaccgaggagaagcccctgctgcctggccagacccctgaggcagcaaaggaggccgaactggctgcacggatactgctggaccagggacaaacccacagtgttgagacaccttatgggagcgtaacatttaccgtgtacgggactccgaagcccaagcgtccagctatactgacttaccatgatgtcgggctaaactacaagtcctgttttcaaccattatttcagtttgaagacatgcaggagatcatccagaatttcgtcagagtgcatgtggacgctcccggaatggaagagggagccccagtcttccccctcgggtaccagtacccatctctggaccagctggctgacatgataccttgcgtcctacagtatcttaatttctctaccataatctag

SEQ ID NO: 25225 - DNA, 357 bp, Artificial Sequence
  Description of Artificial Sequence: Synthetic coding sequence
atggccgagctgcaggaggtgcagatcaccgaggagaagcccctgctgcccggccagacacctgaggcagctaaggaggcagaacttgccgcgcgcattctcctcgaccagggccagacacatagcgttgagactccctacggatctgtgacgttcacagtctatggtacccccaagcccaaacgcccagctatcctgacttaccacgacgtcgggctgaactataaatcctgcttccagcccttatttcagttcgaagacatgcaggaaattattcagaacttcgttagggtgcatgtcgacgcccctggaatggaagagggggctcctgtcttcccactcgggtaccaatactag

SEQ ID NO: 25226 - DNA, 423 bp, Artificial Sequence
  Description of Artificial Sequence: Synthetic coding sequence
atggccgagctgcaggaggtgcagatcaccgaggagaagcccctgctgccaggacagacccctgaggctgctaaagaggccgaacttgccgcaaggattcttctagatcagggacagacacactctgttgagacaccttatggttctgtcacgtttaccgtgtacggaactcccaagccaaagcggcctgcaatcttgacttaccacgacgtggggctcaactataagtcctgcttccagcctctgtttcagtttgaagacatgcaggagattatacaaaatttcgttagagtgcatgttgacgcccccggtatggaggaaggcgctcctgtgtttccccttggataccaatacccatcacttgatcagctggccgacatgataccctgcgttctacagtaccttaatttttctaccatatag

SEQ ID NO: 25227 - DNA, 435 bp, Artificial Sequence
  Description of Artificial Sequence: Synthetic coding sequence
atggccgagctgcaggaggtgcagatcaccgaggagaagcccctgctgcctgggcagaccccagaggccgctaaaacacactccgtagagacaccttacggatccgtgacctttacagtatatggaacaccgaaaccaaagcggcctgccattcttacttatcatgacgtggggttaaactataagtcatgctttcagcctttgtttcagtttgaggacatgcaggagatcattcaaaactttgtgagagtgcacgttgatgccccaggcatggaagaaggagcccctgtcttccccctcggctaccaatacccttctttggaccaactcgccgatatgatcccttgtgtgctccagtacttaaactttagtactatcatcggagtgggtgtaggagccggcgcttacattctagcccgatatgccctcaactag

SEQ ID NO: 25228 - DNA, 462 bp, Artificial Sequence
  Description of Artificial Sequence: Synthetic coding sequence
atggccgagctgcaggaggtgcagatcaccgaggagaagcccctgctcccggggcagactcctgaggccgcaaaaacacattccgtggagaccccttatggctctgttactttcacagtgtatggtactcctaagcccaaaaggccagctattctcacttaccacgatgtaggcttgaactataaatcctgcttccagcccctgttccagtttgaggatatgcaggagattatccagaatttcgtgagggtgcacgtggacgcccccggaatggaggaaggtgctcctgtcttccccctggggtaccagtatccatctctggaccagctggccgacatgattccctgcgtactgcagtacctcaatttttccactattattggtgtcggagtgggggccggggcctacattttagccaggtatgcactcaatcaccccgatacagttgagggactcgtatag

SEQ ID NO: 25229 - DNA, 675 bp, Artificial Sequence
  Description of Artificial Sequence: Synthetic coding sequence
atggccgagctgcaggaggtgcagatcaccgaggagaagcccctgctccccggccagacccctgaggcagcaaaaacccactcagtggaaactccatacggcagcgttaccttcacagtttatgggactcccaaaccaaagaggccagccatccttacctaccacgatgtcggtctgaattacaaatcatgctttcagccccttttccagtttgaggacatgcaagagattatccagaactttgtcagagtgcacgttgacgcccccggcatggaggagggggcgccagtgttccccttggggtatcaatatccctctctggatcagttggccgacatgatcccttgcgtcctgcagtatttgaacttcagtacaataattggcgttggggtcggagccggcgcctacatcctggctcggtatgctcttaaccaccccgacaccgtggaaggtctcgtcctgattaacattgaccctaacgcaaaggggtggatggactgggcagcccataagctcacaggactcaccagctcaatccccgaaatgattctggggcatctgttttcacaagaagaactttccgggaactctgaactgatacagaaatacagaaacatcattacacatgctcctaatctggataatattgagctgtactggaatagttataactag

SEQ ID NO: 25230 - DNA, 453 bp, Artificial Sequence
  Description of Artificial Sequence: Synthetic coding sequence
atggccgagctgcaggaggtgcagatcaccgaggagaagcccctgctgcctggacaaacgcctgaggccgcaaagacgcactctgtagaaaccccctacggctccgtcactttcaccgtatacggtacgcccaaaccgaaaagacccgcaattctaacttaccatgatgtcggtctgaactacaagagctgtttccagcccttgttccaatttgaagacatgcaggagatcattcagaacttcgtccgggtccacgtggatgcccccggcatggaagaaggcgcccccgtctttccattggggtatcagtacccatcactggaccagttggctgacatgataccttgtgtgctccagtatctgaatttcagcacaattattggggtgggtgtcggggctggcgcttacattctggcccggtacgctctgaaccacccggatactgtggaatag

SEQ ID NO: 25231 - DNA, 384 bp, Artificial Sequence
  Description of Artificial Sequence: Synthetic coding sequence
atggccgagctgcaggaggtgcagatcaccgaggagaagcccctgctccctggccaaactccagaggcagcaaaaactcacagtgtggagactccttacggatctgtgacatttaccgtgtacggtacccccaaaccaaagaggcctgcaattctcacctatcatgacgtaggcctgaactacaaatcttgcttccagcccctttttcaattcgaggatatgcaagaaataatccagaatttcgttagagttcacgtggacgcgccgggcatggaggagggcgccccagtgttccctctggggtaccagtatccgtccttggatcagcttgccgacatgattccctgtgtgctgcagtacttgaatttctccacaattatctag

SEQ ID NO: 25232 - DNA, 450 bp, Artificial Sequence
  Description of Artificial Sequence: Synthetic coding sequence
atggccgagctgcaggaggtgcagatcaccgaggagaagcccctgctgccgggccagacacctgaggctgcgaagactcacagtgtggagaccccgtatggctccgtgaccttcaccgtgtatggcactccaaagcccaaacgccctgcaatcctcacatatcatgatgtcggtctgaactataaatcatgttttcagcctctcttccaatttgaggatatgcaagagatcatccaaaactttgtgcgcgtccacgtggatgccccaggcatggaagagggagctcccgtgttcccacttggctaccagtacccctcgctcgaccagctggcagatatgattccttgtgttctccagtatttgaacttctctactattataggtgtgggtgtgggagctggtgcttacatcctcgcgcgctacgcactgaatcacccggacacagtttag

SEQ ID NO: 25233 - DNA, 1128 bp, Artificial Sequence
  Description of Artificial Sequence: Synthetic coding sequence
atggacgagctgcaggacgtgcagctgaccgagatcaagcccctgcttaacgataaaaacgggactcgcaacttccaggactttgattgccaggagcacgacatcgaaactacccatggggtggtacatgttaccatccgtggtttgcctaagggcaatcgtcccgttatcctgacctatcatgatataggtctcaatcacaagtcatgttttaatgcattcttcaattttgaagacatgcaggagataactcaacacttcgccgtgtgccacgtggatgcacctggccaacaggaaggggctccaagcttccccacagggtaccagtatcccacaatggacgagttggccgagatgctacctccagttttgacacaccttagtttgaagagcatcatcggaatcggagttggtgctggggcctatattctgtctcgctttgctctaaatcatcctgagctcgtggaaggactcgttctgatcaatgttgatccttgtgccaagggctggatagattgggctgcaagtaagttatcaggcctaacaacaaacgtggttgacattatcttggcccaccatttcggccaggaggaacttcaggccaacctggatctcatacagacttaccgcatgcacatcgcacaggatattaatcaagacaatcttcagctatttttgaactcatacaacggccggcgggatctggaaattgagcgacccattttggggcagaacgacaacaagtccaaaacattgaagtgtagcaccctgcttgtggttggcgacaactcaccagctgtggaggctgtggtggagtgtaattctaggctgaacccaattaacaccacactcttgaagatggcagactgtggcgggctaccacaagtcgttcaacccggcaaactcaccgaagcctttaagtacttcctccaggggatgggctatattccttctgcatctatgaccaggcttgcccggtccaggactcactccaccagctcaagtctgggctcgggcgaatcccctttcagccgaagtgtcaccagcaaccaatcagatgggacccaggagtcttgtgaatctcccgatgtgctggacaggcatcagacgatggaagtatcctgttag

SEQ ID NO: 25234 - DNA, 1092 bp, Artificial Sequence
  Description of Artificial Sequence: Synthetic coding sequence
atggacgagctgcaggacgtgcagctgaccgagatcaagcccctgctaaacgataaggagcacgatatcgaaaccacacatggtgttgtgcacgttacaatcagaggactgcctaaggggaatcgcccagtgatcctgacctatcatgatatcggccttaatcacaagtcgtgctttaacgccttctttaacttcgaagacatgcaggagatcactcaacattttgctgtgtgccacgtggacgccccggggcagcaggagggcgctcccagcttcccgaccggctaccagtaccccacaatggacgaattggcagaaatgctcccacctgtgttgacacatctctctctcaagtctataatcggcataggtgtaggtgccggagcgtacatcctgtcccggtttgcacttaaccatccagagctcgtggaaggcctggtgctgatcaatgttgatccatgcgccaaaggatggattgattgggcagcctctaaactgtccggtctgaccaccaacgtggtggacatcatcctggcccatcacttcgggcaagaggagctgcaagcgaatctggatttaattcagacttaccgcatgcacatcgcccaggatataaaccaggacaatctgcagctgtttctcaactcctataacggcaggcgggacctagaaatcgagcgacccatactgggccagaatgataacaagtccaaaactctcaagtgctcaacgctgctggtggtaggagataactctcccgcagtggaggccgtcgtggagtgcaactccaggctgaatccaatcaacacgaccttgctaaaaatggccgattgtggcggtctgcctcaagtggtccaaccagggaaattaaccgaagccttcaagtattttctgcaggggatgggctacattccgagcgcttccatgacccgactcgcgcgttcccgtacgcacagtacttccagttcactggggtccggggagtctcctttttcaagatctgtcacctcaaatcagagcgatggcacacaagagagttgcgagagccctgacgtcctagataggcaccaaaccatggaggttagctgctag

SEQ ID NO: 25235 - DNA, 843 bp, Artificial Sequence
  Description of Artificial Sequence: Synthetic coding sequence
atggtgcaggagaccagccggaccctgaccgtgcggtaccagtacccaactatggacgaacttgctgaaatgcttccccccgtgctaactcacctgagcttgaaaagcataataggcattggtgtgggggcaggagcctatatcctgagcaggtttgccctgaatcaccctgaactggttgagggtctggttttgatcaacgtggacccttgcgcaaaaggttggatagattgggcagcgagcaaactgagtggcctgaccacgaatgtcgtggacataatcctcgcccatcatttcggacaggaggagctccaggctaacctggacttgatccagacctatcggatgcacatcgcccaggatataaatcaggataatctccaactgttcctgaacagttacaacggccgaagagacctagaaatcgagagaccgattctgggccagaatgacaataagtccaagactctcaaatgctcgacactgctcgtggtgggcgacaactctcctgcagtggaggcagtcgtggaatgtaactctaggctgaatcccattaacacaacgctcctgaaaatggccgattgcggaggactcccacaggtggtacaaccaggcaaactcacagaagccttcaaatattttctccagggcatgggttatatccccagcgcgagcatgactcggctcgcccgctcaaggactcactctacttcctcctcgctgggctctggcgagagtccattctcacgcagcgttacttccaatcagtctgacggcacacaggagagctgtgaatctcctgatgttctggacagacatcagaccatggaagtgtcgtgttag

SEQ ID NO: 25236 - DNA, 816 bp, Artificial Sequence
  Description of Artificial Sequence: Synthetic coding sequence
atgatccggtaccagtaccccaccatggacgagctggccgagatgctgccacccgtcttaacgcatctgtccctgaagtctattatcgggatcggcgttggagcaggagcctatattcttagcagattcgctctgaatcacccagagctggttgaggggctcgttctgatcaatgtcgacccctgcgcgaaggggtggatcgactgggccgccagtaaactctcaggacttaccacaaacgtggtggacatcattctagctcaccatttcggccaggaagagttacaggccaacctagacttgattcagacataccggatgcatattgcacaggatattaatcaggacaacttacagctttttttgaactcttacaatgggcggcgggatctagaaatcgagcgccccattctaggacaaaacgataataaaagtaaaacactcaagtgttctaccttactagtggtcggggataactcccctgcagtagaggcggtagtagaatgtaactcccgcctgaacccaatcaatacgactttgctgaaaatggctgactgcggcgggctgcctcaggtggtccagccgggaaagctaaccgaggcattcaagtatttcctgcagggaatggggtacataccgagcgccagtatgaccagactcgccaggtccaggactcacagcactagcagcagcctgggctctggggaaagccccttcagtagaagcgttacttcgaatcagagtgacggaactcaagagagctgtgagagtccagacgtacttgacagacaccagactatggaggtgagctgctag

SEQ ID NO: 25237 - DNA, 420 bp, Artificial Sequence
  Description of Artificial Sequence: Synthetic coding sequence
atgcccgagggccccgagctgcacctggccagccagttcgtgaacgaagcttgtagagcccttgtttttggtggatgtgtcgagaaaagtagcgtgagccgcaatcctgaagttcccttcgagtcaagtgcctaccgtatttctgcctctgcccgagggaaggagctgcgccttattttgtcaccgctgccgggagcacagccccagcaggagccccgtgctccaaggggagccgcgaccccttgtccccccgctctgcttcacgggcctgcctggccacccgcgaggcccatgtttaggggtcacccacccgttcggccactaggaccctggggcaaggtggccgcaggacctagggccctttgcctggctggcgtccccgccgtgcagggtgagtgtgcgacaaagccgtccggatag

SEQ ID NO: 25238 - DNA, 1173 bp, Artificial Sequence
  Description of Artificial Sequence: Synthetic coding sequence
atgcccgagggccccgagctgcacctggccagccagttcgtgaacgaggcatgccgtgcccttgtcttcggggggtgcgttgaaaaaagctcagtttctcgtaacccagaggtgcccttcgaaagtagtgcctaccggatttctgcttcagctagggggaaagaacttcgcctgatcctgagtcctctgccgggggcccagccacagcaggagcccctggccttagtgtttaggtttggaatgagcgggtcgttccagctggtcccgcgagaggaactgccacgacacgcacacttgcgattttacacagctccccctggaccccggctagctctatgctttgtcgatatcaggcggttcggtaggtgggatctgggtgggaagtggcaacctggaaggggaccttgcgtgttgcaagaataccagcagtttagagagaacgttcttcgcaatctcgctgataaggcttttgaccggccaatttgtgaggccctgctggatcagcgcttcttcaacggtatcggaaattacctgcgcgccgaaattctgtacagactcaaaattccacccttcgaaaaggctaggtccgtgctggaggcactgcagcagcataggccctcaccagagctgaccctgtcacaaaaaattaggacgaaactgcagaaccctgacttactggaactttgccactccgtaccaaaggaggtggtgcagctgggcggcaaaggttatggaagtgaatccggagaggaggattttgccgccttcagggcctggctcagatgctacggtatgccaggcatgtccagcttacaagataggcacggacggacaatttggttccagggcgatcccggacctctcgccccaaaaggaagaaaaagccgtaaaaagaagagcaaagcaactcagcttagcccagaagaccgggtggaagatgccctacctccctctaaagcccccagcaggaccagaagagctaagagggatctgccgaagagaacagcaacccagcgaccagagggcaccagcctgcaacaggaccccgaggctcctaccgtgcctaaaaagggcaggaggaaagggaggcaagccgcctccggccactgtcgaccacgcaaggtcaaggccgacataccatctttggaaccagaaggcacctctgcctcttag

SEQ ID NO: 25239 - DNA, 1173 bp, Artificial Sequence
  Description of Artificial Sequence: Synthetic coding sequence
atgcccgagggccccgagctgcacctggccagccagttcgtgaacgaggcgtgcagagcattggtcttcggaggatgcgtggaaaagtccagcgtaagccgtaaccccgaagtcccttttgaatcctccgcttatcgaatcagtgcaagcgcgcggggaaaagagctgaggctgattctatctcctctacctggtgcccagccacagcaggagcccctcgcactggtgtttcgattcgggatgagtggatcatttcagctcgtgcctagagaagaacttccccgtcatgcacacctacggttctatactgccccaccaggccctcgactcgccttatgcttcgtggacatccggaggtttggccgctgggacctgggtggcaaatggcagccagggaggggcccctgtgtgcttcaggagtatcaacagttccgcgagaacgtcctgcgcaacttggccgataaggcgttcgaccgccctatttgtgaagccctcctggaccagcgcttttttaatggtatcgggaactatctgagggccgagattctctataggctgaagatcccacctttcgaaaaggccaggagtgtgttagaggctctgcaacaacaccgcccttctcccgaactgactctctctcagaagatcaggaccaagctacagaatcccgatctgttagagctgtgccatagcgtaccgaaagaagtggtacagctcggcgggaaaggttatggttcggaatcaggcgaggaggatttcgccgccttcagggcttggctaagatgttatggaatgcccggaatgagcagtctgcaggaccggcatgggagaacaatttggtttcagggggacccggggcccttggcccccaaaggacgcaaatcacgtaagaagaaatccaaggccacacagctgtcgcctgaagaccgggtggaagatgcccttcctccctccaaggcaccaagtcgcacacggcgtgcaaaaagggaccttcctaaacgcacagccacccagagacctgagggaacatcactgcagcaagaccctgaggcacctactgtgcccaaaaaggggcggcgaaaaggcagacaagcagccagcgggcattgccggccgaggaaagtcaaggccgatatcccttcactcgaacccgaaggcactagcgcaagctag

SEQ ID NO: 25240 - DNA, 999 bp, Artificial Sequence
  Description of Artificial Sequence: Synthetic coding sequence
atgcccgagggccccctggtgcggaagttccaccacctggtgagcccctttgtgggtcagcaggtcgtgaaaacaggaggcagctccaaaaagctgcagcctgcttctttgcaatcgttatggctgcaagatacccaagttcatggtaaaaaactgttcctgcgctttgatctcgacgaggagatgggccccccagggtctagccccaccccagagccaccccagaaggaggttcaaaaagaaggcgcggccgacccaaaacaagtaggtgaaccgtcaggtcaaaagaccctagatgggagttctaggtcagcagaactggtgcctcagggtgaagatgattctgaatacctggaacgcgatgctcctgcaggtgatgccggccggtggttacgggtgtccttcggcctgttcggatccgtgtgggtaaatgacttcagccgggctaaaaaagctaataaacggggagattggagggacccttctcccagactggttctacacttcggcggcggtggattcctggcattctacaattgccagctctcatggtcttcgtccccagtggtcacccccacctgtgacatcctctcagaaaaatttcatcggggacaggctcttgaagccctcggtcaggcgcaaccagtgtgttacactctcctggatcagcggtacttcagcgggctgggtaacatcattaaaaatgaggccctgtaccgagcgggaatccaccccctgagcctgggctctgtcttgtccgcttcgcgaagggaagtcctcgtcgaccatgtggtcgaatttagcactgcatggcttcagggtaaattccagggaaggccccagcacactcaggtctatcagaaagagcagtgccctgccggtcaccaagtgatgaaggaggcatttggcccggaggatggactccaaagattgacctggtggtgcccacagtgtcaaccacagctttccgaagagcctgagcagtgtcagttcagttag

SEQ ID NO: 25241 - DNA, 954 bp, Artificial Sequence
  Description of Artificial Sequence: Synthetic coding sequence
atgcccgagggccccctggtgcggaagttccaccacctggtgagcccttttgtcggccagcaggtggttaagacaggtggcagcagtaaaaagttgcagcccgcctctttgcagtctctgtggttgcaagacactcaagtccatgggaaaaaactgttcctgagattcgacctggatgaggagatgggacctccaggatcatcaccaacccctgagccccctcaaaaagaggtccaaaaaaaaacccttgacgggtcatcgcgctccgcagagttagtgcctcagggggaggatgatagcgagtatctggagcgggacgctcccgcgggcgacgcaggtcgctggctcagggtgagcttcggcctattcgggtccgtgtgggtgaatgacttcagtcgcgccaaaaaagctaacaagcggggcgattggcgggacccctctcctagacttgtgcttcactttgggggaggaggcttcctagctttttacaactgccaactttcatggtcaagctccccagtggttacgccgacctgcgatatcttgagtgaaaagttccataggggacaggcccttgaagcgctaggtcaagcacagcccgtgtgttatacgttactggatcagcggtatttttctggtctggggaatatcattaaaaacgaagcattataccgggcgggaatacacccattgagcctgggctccgtactgagtgcgagcaggcgcgaggtcctggtagatcacgtggtggaattctcaacagcctggctgcagggcaagtttcagggaaggccgcaacacacccaggtttaccagaaagagcaatgccccgcgggacatcaggtgatgaaagaggcattcggccccgaggacgggttgcagagactgacttggtggtgcccgcagtgtcagcctcagctgagcgaggagccagaacagtgtcaattcagctag

SEQ ID NO: 25242 - DNA, 816 bp, Artificial Sequence
  Description of Artificial Sequence: Synthetic coding sequence
atgggcccccccggcagcagccccacccccgagcccccccagaaggaagtgcagaaggaaggcgccgccgacccaaagcaggtcggcgaaccgtctggccagaaaacactggatggaagctcacgctccgcggagctggtccctcagggggaggatgatagcgagtacctcgaacgggacgcccccgccggagacgcaggtcgatggttacgcgttagtttcggactgtttggatcggtgtgggtcaatgatttctcgcgcgctaagaaggccaacaagagaggcgactggagagatccttccccacgcctcgtccttcactttggtggagggggctttctggccttttacaattgccagctctcttggtcgagttcgcctgtggtcacccctacttgtgacatcttatctgagaaatttcatagaggccaagcactggaggccctaggacaggctcaaccagtttgctataccctcctggaccagcgctatttttcaggactgggtaacattataaaaaatgaagctctgtaccgggccggcatccatcccctttccctagggagtgttctgtcagcctcccggagggaggtgctggtggaccacgtcgtggagttctccaccgcctggctccaaggaaagttccaaggaaggccacagcacacacaagtttatcagaaggagcagtgcccagcggggcaccaggtgatgaaagaagcctttgggccggaggacggccttcagagacttacgtggtggtgcccccaatgtcaaccccagctgagcgaagagccagagcagtgccaattttcctag

SEQ ID NO: 25243 - DNA, 999 bp, Artificial Sequence
  Description of Artificial Sequence: Synthetic coding sequence
atgcccgagggccccctggtgcggaagttccaccacctggtgagccctttcgtgggtcagcaggtggttaaaaccgggggctcatctaaaaaactacagcctgcaagcctacagagcttgtggctgcaggatacccaggtgcacggcaagaagctattcctgcggttcgacctggatgaagagatgggcccaccaggatccagtcctacgcccgaacctccacagaaggaagtgcagaaggagggcgcagcagaccctaagcaggtgggcgaaccttccggccagaagacactcgatggcagcagtaggtccgcggagctggtcccacagggggaggacgacagcgagtacctcgagagagacgccccagccggagacgcgggcaggtggctgcgggtctcctttggactgtttgggtcagtgtgggtcaatgacttttcacgcgccaaaaaggcaaataaaagaggtgactggcgagacccatccccgcgcctcgtgctgcattttggcgggggaggcttcctggctttttataactgccagctatcctggagcagctctccagttgtcacgcccacatgtgacatcctctccgagaaatttcaccgtgggcaggccctggaggcactgggccaggcccagcccgtgtgctacacgctgctcgaccagagatacttcagtggcctgggaaatattatcaagaacgaggcactgtaccgcgctggcatccaccccctgagtcttggcagcgtcctgagcgcatctcgccgagaggtgctcgttgaccacgtggtcgagttctcaacagcatggctgcaggggaaattccaggggcggccccagcacacgcaagtataccagaaggagcaatgccctgcgggccaccaagtaatgaaggaagccttcggtcccgaagacggtttgcagcgcctcacatggtggtgcccccagtgtcaaccacagctctcggaggagcccgagcagtgccagttctcgtag

SEQ ID NO: 25244 - DNA, 999 bp, Artificial Sequence
  Description of Artificial Sequence: Synthetic coding sequence
atgcccgagggccccctggtgcggaagttccaccacctggtgagcccatttgttggacagcaagtggtgaagaccggcggcagctctaaaaaattacagcctgcatcccttcagtccttgtggctccaggatactcaggtgcatggcaagaaactgtttctgcggttcgacctagacgaggagatggggcccccgggctcctcccccacacccgagccgccacagaaagaggttcagaaagaaggggctgctgatcccaagcaggtgggggagccctccggccagaagaccctggacggatctagcaggtcggccgaactcgtacctcagggcgaggacgactctgaatatctggagcgcgatgcaccagcaggggatgcgggacgctggttgagagtgtctttcggactgttcggctctgtttgggttaatgatttttctcgagcgaaaaaggcaaacaagagaggggactggcgggatccttcccctcgcctggtgttgcacttcggcggagggggctttttggctttctacaattgccagttatcttggtcttcatccccagtggtgacacccacatgcgatatactctccgagaaatttcacagaggtcaggcgttagaagcactcgggcaggctcaacccgtgtgctacaccctgctcgaccagcgatactttagtgggcttggcaacatcattaaaaatgaagcgctgtatagggcaggtatacaccctctgtccctaggctctgttctatctgcaagccgacgggaagtgctggtggatcatgtcgtggagttttcaacagcatggttgcaaggtaagttccaagggcgtcctcagcacactcaggtctatcagaaggaacaatgccctgcaggacaccaagtcatgaaggaggcatttgggcccgaggatggcttgcaacggctcacatggtggtgcccccagtgccagccccagctttcagaagagcctgaacagtgtcagttttcttag

SEQ ID NO: 25245 - DNA, 651 bp, Artificial Sequence
  Description of Artificial Sequence: Synthetic coding sequence
atgcccgagggccccctggtgcggaagttccaccacctggtgagcccgttcgtgggccaacaggtggtgaagaccggaggtagtagtaaaaagcttcaaccggccagtcttcagtcattatggcttcaagacactcaagtaagactagtgctgcatttcggcggaggaggcttcctggcattctacaattgtcaactaagctggtcttcgtcaccagttgtgactcctacgtgcgacatcctgagcgagaagttccaccgtggacaggcactcgaggcgctcggtcaagcacagcctgtctgctacaccctgctggatcagagatatttctccgggttgggcaatattatcaagaacgaggcactgtaccgggcgggtattcacccgttaagtctagggagtgtgctgtccgcctcacggcgtgaagtgctagtggatcacgtggttgagttcagcacagcgtggctgcagggtaagttccaggggcgcccccagcacacacaggtctatcagaaggaacagtgtcctgctggccatcaagtaatgaaggaggcattcggccccgaggatggacttcagaggctgacctggtggtgtccgcagtgccagccacaattgtcggaagagccggagcaatgtcagttttcctag

SEQ ID NO: 25246 - DNA, 1818 bp, Artificial Sequence
  Description of Artificial Sequence: Synthetic coding sequence
atggtggagggccccggctgcaccctgaacggcgagaagatccgggccagagtactacctgggcaggccgtcaccggcgtcagaggctcagcccttcgatccctgcaggggcgggccctaaggctggcggcctcaactgttgtggtcagtccgcaggctgccgctttaaacaacgactccagccagaacgtacttagcttgttcaacggatatgtgtatagcggagtggagacgctgggcaaggaactcttcatgtacttcgggccaaaagccctgaggatacacttcggtatgaaaggttttattatgattaatccgctggaatacaaatataagaatggagctagccccgtgttggaagtgcagctgacgaaagacctgatttgttttttcgacagctcagtagaattgaggaacagcatggagtcccagcagaggattcgcatgatgaaggagctggacgtatgctctcccgaattctccttcctgagagcagaaagcgaggtcaaaaagcaaaagggcaggatgctgggcgacgttcttatggaccaaaatgttctgcccggagtcggcaatatcattaaaaatgaagcactctttgatagcggactgcatccggccgttaaggtgtgtcaactgacagatgagcagatacaccatctaatgaagatgattagagatttttccatccttttctaccggtgccgaaaggccgggctcgcactttctaaacactacaaggtgtataagagacctaactgtggacaatgccattgccgcatcacagtctgtcgcttcggagataacaacaggatgacctacttctgtccccactgccagaaagagaatccacagcatgtggatatatgtaagttacctacccgcaacacaatcatctcgtggacgagttcccgggtagatcatgtgatggattctgtggccaggaaaagcgaggaacactggacatgtgtggtgtgcacccttattaataagccaagcagcaaagcatgcgatgcatgcctgacatcaagacctatcgactcggtgctcaagtcagaagagaactcaaccgtgttctcccatctgatgaaatatccgtgcaatacatttgggaaacctcacactgaggtcaaaatcaacaggaagacagcgttcgggacgacgacgctcgtgctaacagatttcagtaacaagtcctctaccctcgaaagaaagacaaagcagaatcaaattctcgacgaggagtttcagaattcgccccccgccagtgtgtgcctgaatgatatccaacacccttctaaaaagacaaccaacgacataacgcagccttcctccaaagttaatatcagcccgaccatctccagcgaatctaaactgtttagtcccgctcacaaaaaacctaagactgcacagtactctagtcccgagttgaaaagttgcaatcctggctactctaatagtgagctccagatcaacatgaccgacggcccgagaacattgaatcctgattcacctcgctgctccaaacacaatcggctttgcattctcagggtggtgggtaaagacggggaaaacaaggggagacagttttatgcatgtcccctgcctcgggaggcccagtgtggcttcttcgagtgggcagatctcagttttccattctgcaaccacgggaaaaggtctacaatgaagactgtgctcaaaattgggcctaataatgggaaaaatttcttcgtttgtcctctcggaaaagagaagcagtgtaacttctttcagtgggccgaaaatggtcctggaatcaaaataattcccggatgctag

SEQ ID NO: 25247 - DNA, 1743 bp, Artificial Sequence
  Description of Artificial Sequence: Synthetic coding sequence
atgcccggctggccctggggcctgctgctgaccgccggcaccctgtttgccgcccttagtcctgggccacccgccccggccgacccatgccacgatgaaggcggggcacctcgcgggtgtgtccccggactagtaaacgctgctttgggccgtgaagttctggcatcatccacctgcggacgcccggccaccagggcatgcgatgcttctgaccctcgcagggcccatagtccagcccttcttactagcccgggtgggactgcaagcccactctgctggagatctgagagtctgcctagagctcctctgaatgttacgctcactgtgccccttggtaaggccttcgagctagtttttgttagcctgcgtttttgctcagcccctcccgcttcagtcgctttactcaagtcccaggatcacggacgcagttgggccccgctgggtttctttagctctcattgcgatcttgattacgggcgtctccctgcgccagcaaacgggccggcaggaccgggcccggaggctctgtgttttcctgcccctctggctcaaccagatgggagtggactgctcgccttcagcatgcaggactcgtcccctcccggtctcgacttggattcctcgccagtgctgcaagactgggtcacggcgacggacgttcgcgtggtgctgactcggccctctaccgcaggagatccgcgcgatatggaggccgtggttccttactcctatgctgcaactgatctccaggtcgggggacgatgcaagtgcaatggacacgcgtctcgatgtcttctcgacacccaaggtcacctgatatgtgattgccggcacggaaccgagggcccagattgcgggaggtgtaaacctttttactgcgacaggccatggcagagggccaccgcccgagagtcgcacgcttgcctggcatgtagctgcaacggtcatgcaaggcggtgccggttcaacatggaactgtaccggttgtcgggacgtcgcagcgggggagtgtgcttaaattgccgccataataccgctgggagacactgtcactactgcagggagggtttttatagggaccctggacgcgcgctgtccgacagacgggcctgtcgggcctgcgactgccatccagtgggcgcagccgggaagacatgtaaccagacaacaggccagtgtccatgtaaggacggagttacaggactcacatgtaataggtgcgctccaggttttcagcagtcacgtagtccagttgcgccctgcgtgaagacacctattcctggcccaactgaggattcatctccagttcagcctcaggattgtgattcccattgcaagcctgctcgtggcagctatcggatatctctcaagaaattctgtaaaaaagattatgccgtgcaggtggccgtcggcgcaaggggtgaagctcgtggcgcctggacaagattccccgtggcggtgctggccgtctttcgatcaggggaagagagggcccggcgcggatcatctgctttgtgggtcccagctggggatgccgcctgtggctgccctaggcttctcccgggccgccggtatctgctgctgggaggcgggcccggagcagcagcaggcggtgcaggcggtaggggacctgggttgatcgccgcccgggggagtctggtgcttccttggcgagacgcgtggactagaaggcttaggcgcctgcaaaggcgggagaggcgaggtaggtgcagcgccgcctag

SEQ ID NO: 25248 - DNA, 2547 bp, Artificial Sequence
  Description of Artificial Sequence: Synthetic coding sequence
ctgttctgcttcgtgttcagcgtgagcctgcaggtggacatcgtgcctagtcagggagagatcagcgtgggggagtccaaatttttcctctgtcaggtagccggggacgccaaagataaggatatctcctggttcagccctaatggcgagaagctgacaccaaatcagcaacggatcagcgtcgtgtggaatgatgatagtagttctaccctgacaatctataatgcgaatatcgacgatgcaggcatttataaatgtgttgtgacaggcgaggatggctctgagtcggaagcgactgtgaatgtcaaaatttttcagaagctgatgttcaaaaacgcccctactcctcaggagttccgcgagggagaggacgccgtcatcgtttgcgacgtggtgtccagcctcccacccactattatttggaaacacaagggaagagacgtgatactcaaaaaggacgttcgtttcatcgtcctgagtaataactatttgcagattaggggcattaaaaagaccgacgagggcacatacagatgtgagggtcgaattctggctcgcggtgagattaattttaaggacatccaagtgatcgtgaacgtcccaccaacaatccaggcccgccagaacatagtgaatgcaacggccaatctcggtcagagcgtcacattagtgtgtgatgccgagggattcccagagccaacaatgtcatggacaaaggatggggagcagattgaacaggaggaggatgacgagaaatacattttttctgatgactcttcccaactcacaatcaagaaggttgacaagaatgacgaagcagaatacatctgtattgccgagaacaaggctggggagcaggatgcaacaatccatctgaaagtcttcgccaaacctaaaatcacctacgtggagaatcaaacggccatggagctcgaagaacaggtcacactcacgtgcgaggcaagtggagaccccatcccctcaattacctggcgtacttctaccaggaacatcagcagtgaggagaaagcaagctggacccggcccgagaagcaggagactcttgacggccacatggttgtcaggtcacatgcacgagtgtcatctctcactctgaagtccatccaatatactgatgccggcgaatacatctgcaccgcctctaatacaatcggccaggactcgcaaagcatgtacctggaggtccagtacgcccccaaattgcagggacctgtggctgtgtacacttgggaggggaatcaggtgaacataacctgtgaggtgttcgcgtatcctagcgccactatctcctggtttcgcgacggacagttgttgccctcctccaattactcaaatataaaaatttacaatacaccctctgccagttacctggaggtcactcctgactccgagaacgacttcgggaattacaattgtactgcagtgaataggataggacaagagagtctcgagtttatacttgtgcaggccgacacaccaagcagccccagcatcgatcaggttgaaccttactcctctactgcccaggttcagtttgatgaacccgaggccacgggcggtgtgcctattctaaagtataaggcggaatggagagccgttggtgaagaagtatggcactcaaaatggtatgacgctaaagaggcttcaatggagggtatcgtaaccatcgttggacttaagcccgagacaacctacgcagttcgcttggctgccttgaatggtaaaggcttgggcgagatttcagctgccagcgagtttaaaactcagcccgtgcccggagagccctcggctcccaaactggagggccaaatgggagaagatggaaactccatcaaggtgaaccttattaagcaggacgatggaggcagcccaatccgccactacctggtccggtacagggccctgagctccgaatggaagccagagatccggttgccctccgggagtgaccacgtgatgctcaaaagcctggattggaatgccgaatatgaagtctacgtcgtggccgaaaatcagcagggcaagagcaaagctgctcattttgtctttcgtacctctgcacagccaaccgccatacccgctaacggttctcccactagtggactgtctaccggcgcaattgtcggaatcttaatagtgattttcgtattattgcttgtcgtggttgatattacttgctactttctaaataagtgtggcctgttcatgtgtattgctgtgaacctatgtggcaaagccgggcccggggctaagggtaaggacatggaagaaggcaaagccgctttcagtaaagacgagagtaaggagcccatagtggaggtgcggacggaagaggaaagaacccccaaccatgatggtggcaaacacacagaaccgaatgagacaaccccactgactgaaccagagaagggtcccgtagaagcgaagccagaatgccaggagaccgaaacaaaacccgctccagcggaagtgaagacagtgccaaacgacgcgactcagaccaaagagaatgaatccaaagcgtag

SEQ ID NO: 25249 - DNA, 1995 bp, Artificial Sequence
  Description of Artificial Sequence: Synthetic coding sequence
atcaccatccgggacgagatctgggtgctgttctgcttcgtgttctcggtctctctccaagtagacattgttccctctcagggtgaaatctcagtgggcgaatcaaagttcttcttgtgtcaggtcgctggagatgcgaaagacaaagacatttcctggttttctccaaacggcgagaagcttacccccaatcagcagcgcatctcagtggtgtggaatgatgattcatcctctaccctgacaatttacaatgctaatattgatgacgccggcatttacaagtgtgtggttaccggcgaggacgggtccgagtccgaagctactgtaaatgtgaagatattccagaagctgatgttcaagaacgctcccactccccaggaatttagggagggagaggatgccgtgatcgtctgcgatgttgtgtctagtcttcccccaactatcatctggaagcataaaggccgggatgtcattctgaaaaaagatgtcaggttcatcgttctatcgaacaattacctgcagatcagagggattaagaagactgacgagggcacataccgctgcgagggtcgcatcctcgccaggggagaaattaatttcaaggacatccaggttatagtgaatgtgccaccaacaatccaggcaaggcaaaacatcgtcaatgcgaccgctaatttgggccagtcagtcactttggtttgcgacgccgaaggttttcccgagccaaccatgtcatggaccaaagacggggaacagatagaacaagaggaggacgatgaaaagtacatcttttcagacgacagcagccagctgactattaagaaggttgacaaaaatgacgaagcggaatatatctgtatagctgagaataaagctggcgagcaggacgcgacgatccacctgaaagtctttgcaaagccaaagatcacttatgtggagaatcagacagctatggaactggaggagcaggtgactctgacttgtgaggccagcggtgatcccatcccttcaattacgtggcggacgtccactagaaacatctcaagtgaagagaaggccagttggacacggcctgagaaacaagaaacactcgacggtcacatggtggtgaggtcccacgcaagggtctcttcactgaccttaaaatccattcaatatactgacgcgggtgaatatatctgcaccgctagtaatacaatcggtcaagactctcagtcaatgtacctggaggtgcagtacgctcctaaactccagggtcccgtggccgtgtatacttgggaggggaatcaggtcaatattacatgtgaagttttcgcatacccaagcgccaccatttcatggtttagagacggccagctcctgccctcctctaattatagtaacataaaaatttacaacactccgtcggctagctacttagaagtaacccctgacagtgaaaatgatttcggtaactacaactgcacagccgtgaatcgaattgggcaggagtccctggagttcatcctggtgcaggccgatacccccagcagccctagcatcgatcaggtggaaccttactccagtaccgctcaggtgcaatttgacgagcccgaagcaaccggaggcgtccccatcctgaaatacaaagcggagtggagggccgtcggagaagaggtgtggcacagcaaatggtacgatgcaaaagaggcgtctatggagggcatcgtcaccatagtgggacttaagccagagactacctacgcagtacgcctagcggctttaaacggaaagggcctcggagagatctctgccgcaagcgagttcaagacacagcccgtgcaggccccgccaccaacggcctctgcatccagcagcacgccagtgcccctgagccccccagacaccacatggcctctccctgccctcgcaaccaccgaaccagcaaaaaacattgcccagaaccattgttgcaacatgttccaagctggactccataacgcgctgatgaaatag

SEQ ID NO: 25250 - DNA, 942 bp, Artificial Sequence
  Description of Artificial Sequence: Synthetic coding sequence
atggagggcatcgtgaccatcgtgggcctgaagcccgagaccacctatgcggttcgcctagccgcactcaatggaaaaggacttggagaaatcagtgcagcgtctgagtttaaaacccagccagtgcacagtccgccccctccagcatcagcttcctctagtactcccgtgccactctccccacccgatacaggagagccgtctgcccctaaacttgaaggccagatgggtgaagacggcaattcgattaaagttaaccttatcaagcaagacgacggaggatcccctattagacattacctggtgcgttaccgagctctctcctccgagtggaagccagagatccggctgccgagcgggtctgatcatgttatgctcaagagcctcgattggaatgccgaatatgaggtgtacgtggtcgccgagaatcaacagggcaaatctaaggccgcacacttcgtgtttcggacatccgcacagccgactgcgattcccgccaatggatcaccaacaagtggtttgtccacgggcgcaattgttgggatactgatcgtgatctttgtgctgttactagtggttgtcgacattacctgttatttcttgaataaatgtggcttatttatgtgtattgccgtgaatctttgcggcaaagcaggaccgggggccaagggaaaagatatggaagagggcaaagccgccttttccaaggacgaaagcaaggagccaatcgtagaggtccggacagaagaagagcgcacacccaaccacgatggcggaaagcacacagaacctaatgagacaacacccttaaccgagcctgaaaagggtcccgtggaagctaagcccgaatgtcaggagaccgagactaagcctgcccctgctgaggtcaaaactgtccctaatgacgccacccagactaaagagaacgaatctaaggcctag

SEQ ID NO: 25251 - DNA, 570 bp, Artificial Sequence
  Description of Artificial Sequence: Synthetic coding sequence
atgaccgagtacaagctggtggtggtgggcgccggcggcgtgggcaagtccgccctgaccatccaactgattcaaaatcacttcgtggatgaatatgacccgaccattgaggattcttataggaaacaagttgttatcgacggagagacatgtttactcgatattctggatacagcaggtcaggaagaatattctgctatgagggatcagtacatgcgtacgggggagggattcctgtgtgtgttcgctattaacaactctaagtcctttgcggatattaacctctaccgcgagcagatcaagagagttaaagattctgacgacgttcccatggtcttagtaggcaacaagtgcgatctgccaacacgcaccgttgatacaaagcaggcccacgagcttgccaagagctacggcattccctttattgaaacttccgcaaaaacccggcaaggagtcgaggatgcattctatacacttgtgagagagattaggcagtaccgcatgaaaaagctgaatagcagcgacgacggaactcagggatgtatgggccttccctgtgtggtgatgtag

SEQ ID NO: 25252 - DNA, 651 bp, Artificial Sequence
  Description of Artificial Sequence: Synthetic coding sequence
atgcccggcaacctgatgagccagaccagccgggccgtgagcatctggaaatttcccgcaaagctggggaagactcatggtcaccgggcactggaggctaccggcatgatgctcagagtcctggtgggggctgtgttgcctgcaatgctgctggccgctcctcccccaatcaacaaactcgctttattcccagataagagcgcctggtgcgaggcaaaaaatataacccaaatcgtcggtcacagcgggtgtgaagcgaagtcaatacaaaatcgcgcttgcctgggacagtgcttctcttactctgtcccaaacacattcccgcaaagcaccgaaagcttggtccactgtgattcatgcatgcccgcccagtcgatgtgggagattgtgactctagagtgccctggacacgaggaggtgcctcgggtggacaagctggtagagaaaatcctgcactgcagctgccaggcttgtggcaaggagccttctcacgaaggcctcagtgtatacgtgcaaggcgaggatggacctggttcccaacccggcactcacccccatccgcaccctcatccgcatcctgggggccagacaccagaacctgaagacccacctggggccccacatacagaggaggaaggtgccgaggactag

SEQ ID NO: 25253 - DNA, 546 bp, Artificial Sequence
  Description of Artificial Sequence: Synthetic coding sequence
atgatgctgcgggtgctggtgggcgccgtgctgcccgccatgctgctggcagcacccccaccaataaacaaactggctctgttccctgataaatctgcatggtgcgaggcaaaaaacattactcagatcgtggggcattcaggctgcgaggccaaatcaatccaaaacagggcttgtttaggacagtgtttttcctactccgtccccaatacttttccccagtcaacagaatctcttgtgcattgcgattcatgtatgcccgcccagtccatgtgggaaatcgtcacactggaatgtcctgggcacgaggaggtgccgagggtcgacaagctagtcgagaagatcctgcactgctcatgccaggcatgtggtaaggagccctcacacgaaggcctgtctgtgtacgttcagggcgaagatggtccagggagtcagcctggaacccacccccatccccatcctcatccccatccaggggggcagacccccgagcccgaagatccccctggagccccccatacagaagaggagggtgccgaagattag

SEQ ID NO: 25254 - DNA, 351 bp, Artificial Sequence
  Description of Artificial Sequence: Synthetic coding sequence
atgatgctgcgggtgctggtgggcgccgtgctgcccgccatgctgctcgcagcaccccctcccattaacaaattggctctgttccctgacaagtccgcatggtgcgaggctaagaacattacgcagatcgtgggccactcaggatgcgaagctaagagcatacagaatagagcttgtctgggtcagtgttttagctactctgtccctaacaccttcccgcagtcaaccgaatcactcgtccactgcgactcatgcatgcctgctcagagcatgtgggagatcgtgactcttgaatgcccgggccacgaggaagtgccgcgcgtggataaactcgtggagaagattctgtag

SEQ ID NO: 25255 - DNA, 492 bp, Artificial Sequence
  Description of Artificial Sequence: Synthetic coding sequence
atgctgcgggtgctggtgggcgccgtgctgcccgccatgctgctggctgccccaccccccataaacaagttggcgctgtttcccgataagtccgcttggtgtgaagctaagaacattacccagatcgtgggtcactcaggctgcgaggcaaagtctatacaaaacagagcctgcttgggccagtgcttttcttacagcgtgccgaatacattcccgcagagcactgagtccctggtccactgcgactcctgcatgcctgctcagagtatgtgggagatcgtgaccctcgaatgtcccggacacgaggaggtccctagagtcgacaagttggtggaaaaaatcctccactgctcttgccaggcttgcggcaaggagccctcccatgaaggcctgtccgtctacgttcagggagaagacggccccgggtcccagccaggcactcatcctcacccccacccccatcctcaccccggtgggcaaacgcccgaatag

SEQ ID NO: 25256 - DNA, 354 bp, Artificial Sequence
  Description of Artificial Sequence: Synthetic coding sequence
atgatgctgcgggtgctggtgggcgccgtgctgcccgccatgctgctggccgcacctccaccgatcaacaagcttgctttgttccccgacaaaagtgcttggtgcgaggcgaagaacatcacacagatagtgggacactctggttgcgaggccaagtccattcagaacagagcgtgcctgggccagtgcttctcttatagcgtgcccaatacttttccccagtccacagaaagccttgtacactgcgattcttgcatgcctgctcagtccatgtgggagattgttaccctagaatgccctggacatgaagaggtgcccagggttgacaagcttgttgaaaagatactgcattag

SEQ ID NO: 25257 - DNA, 330 bp, Artificial Sequence
  Description of Artificial Sequence: Synthetic coding sequence
atgatgctgcgggtgctggtgggcgccgtgctgcccgccatgctgcttgctgcccctccgccaattaataagcttgcattgttcccagataagtccgcctggtgcgaggcgaaaaatatcacccagatcgtaggccacagcgggtgtgaggccaaatccatccagaacagggcatgcctcgggcagtgtttttcttactcggtgccaaatactttcccccagtccacagagtcactagttcactgtgactcttgtatgcccgcccaaagtatgtgggaaatagtaactctggagtgcccaggacacgaagaggtgccaagagttgactag

SEQ ID NO: 25258 - DNA, 387 bp, Artificial Sequence
  Description of Artificial Sequence: Synthetic coding sequence
atgatgctgcgggtgctggtgggcgccgtgctgcccgccatgctgttagcagccccacctcctatcaacaagctggctcttttccccgataagagcgcgtggtgcgaggctaaaaacataacccagattgtgggtcacagtggctgtgaggcgaaatctatccagaacagggcctgtctgggccaatgtttcagttatagtgtgcccaatacatttcctcagtcgacagagtcactggtccactgtgatagctgcatgcccgcccagagcatgtgggaaatcgttaccttagaatgtccgggacatgaggaagttcctcgagtcgataagctcgttgaaaaaattctccattgttcctgtcaggcctgcggcaaagaaccaagctag

SEQ ID NO: 25259 - DNA, 543 bp, Artificial Sequence
  Description of Artificial Sequence: Synthetic coding sequence
atgctgcgggtgctggtgggcgccgtgctgcccgccatgctgctggcagctccacccccaatcaataaactggctctgtttccagacaagagcgcctggtgcgaggccaagaatatcactcaaatcgtcggacactccggctgtgaggcaaaaagcatacaaaatcgggcttgtctcgggcagtgtttctcctactccgttccaaacacctttccccagagtaccgagagtttggtgcactgtgacagctgtatgccggcccagtccatgtgggagattgtgacactggagtgcccagggcacgaagaagtaccgcgggtagacaaactcgttgaaaagatacttcattgcagctgccaagcttgtggcaaagaaccctcacacgaaggtctatccgtttatgtccagggtgaggatggtccaggttctcaacccgggacccacccacaccctcacccccatcctcaccccggcgggcaaacccccgaacccgaggacccacctggagcaccacacaccgaggaggagggggctgaggattag

SEQ ID NO: 25260 - DNA, 8457 bp, Artificial Sequence
  Description of Artificial Sequence: Synthetic coding sequence
atggccgcccaccggcccgtggagtgggtgcaggccgtggtgagccgcttcgatgaacagctgcccatcaaaactggacagcagaacacacacactaaagttagcacggagcataacaaggagtgcctaatcaatatctccaagtataaattttccctcgtcatcagcggcctcaccaccatactgaaaaatgtgaacaatatgcgcatattcggagaggcggccgagaaaaatttgtatctgtcgcagctcataatcttagacaccctcgagaaatgcctggcagggcaacccaaggataccatgcggctggatgaaaccatgttggtcaagcagctgctgcctgaaatatgccacttcctgcacacatgtagggaaggaaaccagcacgcagccgagttgcgcaatagcgctagtggagtcctgttcagtctatcctgcaataactttaatgccgtcttctccagaatatcgacccgccttcaagaactgactgtgtgctcggaggataatgttgatgtccacgatattgagctgctacaatacattaacgtagattgcgcaaagcttaagaggttgctcaaggagaccgcttttaagttcaaagccttgaaaaaagttgcccagctggccgtcataaactccctggagaaagctttctggaattgggtggaaaattatccggacgaatttacaaaactgtaccagatccctcagaccgacatggccgaatgtgctgagaagctgttcgatttagtcgacgggttcgccgaatctacaaagcgaaaagccgcggtttggcccttgcagatcatacttctgattctctgccctgaaatcatccaggatatctccaaagacgtcgttgacgaaaacaatatgaacaaaaaattattcttggattctttgcgcaaggctctggccggccacggaggctcgcgccaactgaccgaatctgctgcgatcgcttgtgtgaaactatgtaaggccagcacatatataaactgggaggataacagtgtcatttttctcctagtgcaatcgatggtggtcgatctgaagaatttactgttcaacccctcaaaacctttctctagggggtcccagccagcagacgtggatctgatgattgattgtctcgtgtcttgctttagaatcagccctcataacaaccagcactttaagatctgtctcgcccagaattctcccagcacctttcactatgttctcgtgaattcgctgcacaggataattaccaacagcgctttggactggtggcccaagatcgatgccgtctattgccactcagtggaattacgcaacatgttcggagagacacttcacaaggcagtacagggatgcggggctcaccctgccatacgaatggctccatctttgacatttaaggagaaggtgacctctctcaaatttaaagaaaagcctaccgacttggagactagaagctacaaatatctcctgttgtcgatggtgaaactaatacacgccgaccccaaactcctgttgtgtaatccccgtaagcagggaccagaaacccagggttcaactgccgaactgattaccggattagtacagctggtgccacagtcccacatgcctgagatcgcacaggaagccatggaagctctcctggtactgcaccagctggactcaatagacttatggaatcccgacgcccctgtggagactttctgggaaatctcaagtcaaatgcttttttacatttgcaaaaaactcaccagccatcagatgctgtcaagcactgagatcctaaagtggctgagagaaatattaatctgtcgaaacaaattcctgctgaagaataaacaggctgatcggtcctcctgccatttcctgttgttttacggcgtcggatgtgatatcccgtcttcaggcaatacctcccagatgtccatggatcacgaggagttattgcgcacacccggggcatctctgcggaagggcaaggggaacagctccatggactccgcagctggatgcagtgggactccccccatttgtaggcaggcccagactaaactcgaggtggctttgtacatgttcttgtggaatcccgataccgaggccgtgctggtcgctatgagttgcttccgccacctgtgcgaagaagccgacatcagatgcggcgtagacgaggttagcgtgcataacctgctgcccaactataacacctttatggaatttgcatccgtgtctaacatgatgtctaccggccgagccgccctccaaaagcgtgttatggccttgcttagaagaatagagcatccaaccgccggaaatacagaggcgtgggaggatacacacgcaaagtgggaacaggcaactaaactcatcctaaactaccccaaagcgaagatggaggacggacaggccgcggaatctctgcacaagaccatcgtaaagcgaagaatgtcacacgtgtctgggggtggatccatcgatctgtcggatacggactccctccaagagtggataaacatgaccggcttcctgtgtgcccttggtggcgtctgtctgcagcagcgaagcaattctgggctcgcaacatacagcccacccatggggcccgtgtcagaacggaaggggtccatgatctccgttatgtcatccgaaggtaatgccgatacgccagtgagcaaatttatggataggctgctgtccctcatggtctgtaaccacgaaaaggtcgggctacaaatcaggactaacgtaaaggatttggtggggctcgaactgtcacccgccctctatcctatgttgttcaataaactaaagaacacaatcagcaagttttttgattcgcaggggcaggtcctgctgacagataccaacactcagtttgtggagcagacaatcgccattatgaagaatctgttggataaccatactgagggatctagtgagcacctgggacaggcctcaatcgagacaatgatgttgaacctcgtgcgatacgtgcgagtcctgggcaatatggttcacgctatccaaatcaagaccaaactatgtcaacttgtcgaggttatgatggccagacgggacgatcttagtttctgtcaagagatgaagtttcggaacaagatggtagaatatctgaccgactgggtgatgggtacatccaaccaggctgctgacgacgatgtgaaatgcctcacaagagacctggatcaggctagtatggaagccgttgtcagccttttggcaggcctgccacttcagcccgaagagggcgatggtgtggaacttatggaagccaaatcccaattgttcctgaagtatttcactctgttcatgaacctgctaaatgactgctctgaagtggaagacgaatccgcgcagacgggcgggagaaagcggggtatgagtaggaggctcgctagcctgcgccattgcaccgttctcgccatgagtaatctcttaaacgccaacgtggactctggcctgatgcactctatcggcctcggatatcataaagacctacagacacgcgcgacattcatggaggtcctgaccaagatcctgcagcaaggaaccgaattcgacaccctcgcggagacagtgctcgccgaccggttcgagcggttggtagagttagtaaccatgatgggggaccagggcgagctacccatcgcgatggccctggctaacgtagtgccttgttcccagtgggacgagctggcccgtgtcttagtgacactcttcgactcacggcacctcctgtaccagctgctgtggaacatgtttagcaaagaggtggagcttgccgacagtatgcagaccttattcagaggtaacagccttgcttcaaagattatgacattctgctttaaggtgtatggagctacctacctccagaagttgctagatcccttacttagaatcgtgataacttcgagcgattggcagcacgtgtcctttgaggtggatccaactagattggagcctagtgaatcccttgaggaaaaccagagaaacttgttgcagatgacagagaagttctttcacgctataatttcatcatcgagcgagttcccaccacagctgagatccgtctgtcactgcctttatcaggtggttagccagaggttcccccagaattctatcggcgctgtaggctccgccatgttcctcagattcattaaccctgcgattgtctcaccttacgaggctggtattttggacaaaaaacctccgccgcgaattgaaaggggcctcaagcttatgtctaagatcttacagagtatcgccaatcatgtgctattcaccaaggaggagcacatgcgtcctttcaacgacttcgtgaagtctaacttcgacgcagccaggagattcttcctggatatagcatccgattgccccacctctgacgcggtaaaccattcactttcattcatttccgatggcaacgttcttgctctgcatcgccttttatggaacaatcaagagaagattgggcagtatctaagctctaaccgggatcacaaagccgtggggcgtcgccctttcgacaaaatggccacactattagcgtacctgggtcccccggaacacaagccagtggcagatacccactggtcctcattgaatctaacttccagtaaatttgaggaatttatgacaagacaccaggtccatgagaaagaagaatttaaggcccttaaaactttgtcaatcttttaccaggccggcactagtaaagctggaaatcctatcttctactatgtcgcacggagattcaagacggggcagataaatggcgatctcctgatctaccatgttctgttgactcttaagccgtattacgctaagccttatgaaatcgtcgtggacctgacccacacgggccccagcaatcggttcaaaacagactttttgagtaagtggttcgtggttttcccgggattcgcctatgacaatgtaagcgccgtctacatctacaattgcaattcttgggtcagagaatacacaaagtaccatgagcggctgctcaccggcctcaagggatccaaaaggctggtgtttatcgactgtccaggtaagttggccgagcacattgaacacgaacagcagaaattgcccgccgcaactctggccctggaagaagatctcaaagtttttcacaatgcactcaagttagcccacaaggacaccaaagtgagtatcaaggtcggatccacggcggtccaagtgacttctgcagagcgcacaaaggtgttgggccagtcggtgttcctaaacgatatctattatgccagcgaaatagaagagatctgcttggtcgacgagaaccagtttaccttaacaatcgccaatcaggggactcccttgactttcatgcatcaggaatgcgaagccatagtccaatcgatcattcacattagaaccagatgggagctgagccagccagattctattccacagcatacaaagatcagaccaaaagacgtaccaggaacgctgctcaacatcgccctattaaacctgggctctagtgatcctagtctgcggagcgcagcttataacctactgtgcgccttaacgtgcaccttcaatctaaagattgagggtcagctgctcgagaccagtggactttgtatcccagctaataacactctctttatcgtgtcaatcagtaagaccctggccgccaatgagccgcatcttacactagagtttctagaggaatgcatctctggtttttcaaaaagcagcatcgaactgaagcacctttgtttggagtacatgacgccttggctaagcaacctcgtccggttctgtaaacataatgatgatgcgaaacgtcagcgtgtcaccgccattctggacaagctgatcactatgaccattaatgaaaagcaaatgtatccatcgatccaggcaaaaatctggggtagcctcggccagatcacagaccttctcgacgttgtgctggacagcttcatcaagacgagtgccactggagggctgggatccatcaaagctgaagtgatggccgataccgctgtagctcttgctagcggaaacgtcaagctggtgtcctctaaagtaatcggccgtatgtgcaaaattatcgataagacctgtctgtcaccaacaccaactctggagcagcaccttatgtgggacgatatcgctatcctggccaggtacatgcttatgctgtcttttaacaactcactggatgttgctgctcacctcccatatctgttccacgtcgtgacctttttggtggctactggaccactaagtttgagagcgtccacacacggactcgtgatcaatatcatccattctctttgcacttgtagccagctccatttcagtgaggagaccaaacaggtgttacggctgtcgcttacagaattttcactgccgaagttctacctgttatttggaattagcaaggtgaagtcagccgccgtcatcgcatttagaagctcctacagggatcgaagtttttcccccggaagttacgaacgcgagacatttgctctcacatcactcgaaacagtaaccgaggccttgctagaaataatggaggcatgcatgagagacatccccacctgcaaatggttagaccagtggactgaacttgcccaacgattcgcattccagtacaatccctctcttcagccccgcgcgttggtggtttttggctgtatcagcaaacgcgtcagccatggccaaatcaagcagatcattcgcattctgagtaaggccctcgagagttgtcttaaagggcctgacacgtataactctcaagtgctcattgaagccacagtgatagctcttaccaagttgcaaccacttcttaacaaggattcccccctccacaaggctctgttttgggtggcggtcgcagtactgcagctggacgaggtgaatctgtactctgctggcaccgccctgcttgaacagaatttgcatacattagactctcttaggattttcaatgacaagagcccagaagaagtgttcatggcaatccggaaccccctggagtggcactgtaagcagatggaccattttgttgggctaaatttcaactctaattttaatttcgcgctggtgggtcatctgctgaaaggttaccgacaccctagcccagccattgtggcccgaactgtacggattcttcacacactgctcacattagtaaacaaacatcggaattgtgataaattcgaggtgaatactcaatctgttgcgtacctggcggcgctgctcactgtttctgaggaagtacgatctcggtgcagcttgaaacataggaagagtctgctcttgaccgatatcagcatggaaaatgttccaatggacacatatcccattcatcacggtgatcctagttataggaccttgaaggaaacacaaccttggtcatcaccaaagggatccgagggatatctggctgccacttatccaaccgtggggcaaaccagccctcgggcaagaaaatctatgagtttggacatggggcagccgtctcaggcgaataccaagaaactgctgggcacgcggaaatctttcgaccatctgatctccgacactaaagccccaaagcggcaggagatggagtcaggaattacaacacctcccaagatgagacgggtggcagagaccgattacgagatggaaactcagagaatctcttcatcccagcagcacccccaccttcgtaaggtctccgtttccgaaagcaacgtgctccttgacgaagaggtcctgacagaccccaagatacaggcgctgcttctgactgtcctcgctacattggtcaaatacaccaccgatgagtttgaccagaggatattgtacgagtatcttgctgaggccagcgtagtgttcccaaaggtgttcccagtggtgcataatttactggactccaagatcaacactctgctttcattgtgccaggaccccaacctgctcaatcccattcatggaatcgtccagagcgtggtttaccacgaagagagcccaccccaataccaaacctcttatctgcagtcctttgggttcaacggattgtggcgcttcgcaggcccctttagtaagcaaacgcagatcccggactatgccgaactgatcgtgaagttcttggacgcgctcattgacacttacctgcctggtatcgacgaggagacatcagaggagtcactactcactcctacttccccatacccccccgctctacagtcccaactgtccattacggccaatcttaacctgtcaaactctatgacgtcactcgccacatctcagcactctccgggcatcgacaaggagaatgtcgagttgagccctactacaggacactgcaattccggcagaactaggcacggctctgcctctcaggtccagaagcagcgctccgctggaagttttaaaaggaattccataaaaaagattgtgtag

SEQ ID NO: 25261 - DNA, 8520 bp, Artificial Sequence
  Description of Artificial Sequence: Synthetic coding sequence
atggccgcccaccggcccgtggagtgggtgcaggccgtggtgagcaggttcgacgaacagttacccatcaaaacaggtcagcagaacacacataccaaagtgtcaacagagcacaacaaggaatgcctgatcaatatctccaagtacaagttctctctggtgatcagtggcctcactacgatactgaagaacgtgaataacatgagaatctttggggaggccgccgagaaaaacctgtatctttctcagctcatcatacttgatacactcgagaagtgccttgcagggcagccgaaagacacaatgcggctggacgagactatgctcgtgaagcagctgctgcccgagatctgccactttctgcacacttgtagagaggggaaccagcatgcagccgagctgaggaactcagccagtggagttctattttccctgagttgcaataactttaatgctgtgttttctcggatcagcactagattgcaggaattgaccgtgtgcagcgaggacaacgtggatgtccatgacattgaactcctccagtatatcaacgtggactgcgctaaactaaagcggctgctgaaggaaacagcgtttaaattcaaggccctcaaaaaagtcgcccagctggctgtcatcaactccctggagaaggccttctggaattgggtagagaactacccagatgaattcacaaagctctaccaaattccccagaccgacatggctgaatgcgctgaaaaactcttcgatctggtcgacggattcgcggagtcgaccaaaagaaaggctgctgtctggccattgcaaataatcctgttgatattatgtcccgaaattatacaggacatctctaaggacgttgttgacgagaataatatgaataagaagttatttctcgattccctgagaaaagctcttgccggtcatggcggctctcgccagttgaccgaatctgctgccatagcctgcgtaaagctgtgcaaggcgtctacgtacattaactgggaagataactctgtcatttttttattggtccagagtatggtagttgatctgaaaaacctgttattcaatccctctaagcccttctctagagggtcacagcccgcggacgtggacctgatgatcgattgtctggtgagttgctttcggatctctcctcacaacaatcagcattttaaaatctgtctggcgcaaaattctccgtccactttccactatgttctggtgaatagcctgcataggataatcacaaacagcgcactggattggtggccgaagattgatgccgtgtactgtcatagcgttgagctaaggaacatgttcggcgaaacgctccataaagccgtgcaaggctgcggcgcccatccagcaattcgaatggcaccatccttgacgttcaaagagaaggtcacgagtcttaagtttaaggaaaagcctacggatttggaaacaagaagttataaatacctccttctgtctatggtgaagttgatccacgccgaccctaagctcctgctgtgcaatccgaggaaacagggaccggagacccagggtagcaccgcagaactcattaccggactagtccagttagttcctcagtcccacatgccagaaatcgctcaggaggctatggaagcgctgctggttcttcaccagctcgatagtatagacctgtggaatccagacgcccccgtggaaaccttctgggaaatttcatctcaaatgctgttctacatctgtaaaaaacttacaagtcatcagatgctgtcatctacagaaatcctgaaatggctgcgcgaaatcctgatctgtagaaacaagttcttgcttaagaataaacaggcagatagatcctcttgccactttctccttttttacggggttggatgtgacatcccaagcagtggaaacacatctcagatgtccatggatcatgaagaactactgaggactcccggcgcaagcctacggaagggcaagggcaattcctccatggattctgccgctggctgttctggcacccctcctatctgccggcaagcccagaccaagttagaagtggcgctgtacatgttcctttggaaccccgatactgaggctgtgctcgtggctatgagctgttttcgccacttatgcgaagaggcagacattcggtgcggagtcgacgaggtctctgtccataatctgcttccgaactataatacgtttatggaattcgcctcagtgagcaatatgatgagcaccgggagggccgcactccagaaacgcgtgatggcactgctgcggcgcattgagcaccccaccgccggaaataccgaggcatgggaggacacccatgctaaatgggagcaggctaccaagctgatcctgaactatccaaaagcaaaaatggaagatggacaggcagccgagagcctgcataaaaccatcgttaagagacgcatgtcccacgtatccggcggcggaagtatcgacctttctgatacagacagcctgcaagaatggattaatatgaccgggtttctgtgcgccctcggaggagtatgtctacagcagaggtcaaactctgggctcgctacttactcccctccaatgggtcccgtctctgagaggaagggcagcatgatatcagtgatgagctctgaaggcaatgctgacacccctgtgagcaaatttatggatagactccttagcctgatggtgtgtaaccacgaaaaggtcggcctccagatccgaaccaacgtgaaggacttggtcggactagagctttctccagccctttaccctatgctgtttaacaaacttaagaacactatcagtaaattttttgattcccagggacaggtcctgttaacggatactaacacacagttcgtggaacagacaatagctatcatgaagaacctgctggacaatcacactgaaggcagctcggagcatctaggtcaggcctccatcgagacaatgatgctcaacctggtacggtacgtgagggtcttaggcaatatggtccacgcaattcagatcaaaaccaagctctgccagctggtagaagtgatgatggcgaggagagatgatctgagcttctgtcaggagatgaaattcagaaacaagatggtggaatacctgaccgactgggtgatgggcacatcaaaccaggctgccgatgacgatgtgaagtgtctgacacgggatctggaccaggctagtatggaagctgtggtgtctctcctcgccggtttgccccttcagcctgaggaaggagacggggtagagctcatggaagccaaatcacagctcttcctgaagtacttcaccctctttatgaatcttctcaacgattgctctgaggtggaggacgaatctgcgcaaaccggcggaaggaaacgtgggatgtccaggagactcgcgtcacttaggcactgcaccgtgctagcaatgtccaaccttctgaacgcaaatgtggattcaggcctaatgcacagtattggcctggggtaccacaaagatctccagactcgggccaccttcatggaggtgttaacgaaaattctccagcaggggaccgagttcgacactctcgcagagacagttctggcggatcggttcgaaagacttgtggagctcgtgactatgatgggagaccagggggaattgcccatagctatggctctggctaacgtagtgccatgttcacaatgggacgaactggcccgcgtcctcgtaaccctgttcgacagccgtcatttgctataccaattgctgtggaatatgtttagcaaggaggtcgagctggcagattccatgcagacactctttcgtggaaacagcctagcatccaagatcatgacattttgtttcaaggtgtacggtgccacgtatctgcaaaaactgctggaccctctgttgcgaatcgtgataacctcatccgattggcaacatgtgtctttcgaggtcgatcctactcggctagaacctagcgagagtctagaagagaatcagcgtaacctgctacaaatgactgaaaaattcttccatgccattataagctctagttcggaatttcctccccagttacgttcagtgtgtcactgcctgtaccaggccacatgtcatagcctcctgaacaaagctacagtgaaggaaaaaaaggaaaacaagaaaagcgtggtctctcagcgttttccccagaactcaatcggggctgtgggaagcgcgatgttcctgagattcataaaccccgcgatcgtgtcaccatacgaagcaggcatccttgacaagaagcctccgccccgtatcgaacgcgggctgaaactgatgtccaaaatcctccagtcgattgccaaccatgtgctttttacgaaggaggagcacatgagaccctttaatgattttgttaaaagcaacttcgatgcggctaggcgattttttctcgacatcgcgtccgattgtccgacatctgacgcagtgaaccatagcttgtcatttatttccgacggtaatgtcctggcgctgcataggttactttggaataatcaggagaaaatcgggcagtacttatcctcgaaccgggatcacaaggctgtcggtcgccgtccgtttgataaaatggctacccttctggcttatttaggccctccggaacacaagccggtggctgacactcattggtcaagcctgaatctcacctcgtccaagttcgaggagtttatgaccaggcatcaggtccacgaaaaagaggaattcaaagcactcaagaccctgagcattttctatcaggccggcacgagcaaagcggggaaccccatcttttactacgttgccagaagattcaaaactgggcagattaatggcgatctattgatttatcatgtgctactgactctgaagccttactacgccaagccttacgaaatagttgtggatttgacccacactggcccctctaatcggtttaagacagacttcctgtccaagtggttcgtagtgtttccaggctttgcatatgataatgtctccgccgtctatatctataattgcaatagctgggttcgggagtatacgaagtaccatgagcgcctcttgaccggcctgaagggatcaaaacgcctggtgttcattgactgccccggcaaacttgccgaacatattgagcatgaacagcaaaaactacccgccgcgacactggctctggaagaggatctgaaagtctttcataacgctctgaaattggcgcataaagacacaaaggtaagcatcaaagtgggaagtacggctgtccaggtcacatcagcagagcggactaaggtgctgggtcagagcgtcttccttaacgatatctactacgcctccgagatcgaggagatttgccttgtggatgagaatcagtttactttgaccatcgcgaaccaggggacgcccctgaccttcatgcaccaggagtgtgaggccatcgtgcagtcaatcatccatatccgcacaaggtgggaacttagtcagcccgactccatccctcagcatactaagatccggccgaaagacgtgcctggtactctcctcaatattgccctcttgaatctggggtcctctgatcctagcttgcggtccgccgcgtataatctgttgtgcgccctgacttgcacttttaacttaaaaatcgagggccaactgctggagacatccggattgtgtatacctgcgaataataccctgtttattgtgagtatttctaaaaccctggcagcaaacgaaccccatctgactctggagtttctggaggagtgcatctcagggttctccaagagtagtatcgagctgaagcacttatgtcttgaatacatgacgccctggctgtccaatttggtgcgcttttgcaaacacaacgatgatgctaagcgacaaagggtgaccgccattctggataaattaataacgatgaccatcaatgagaaacagatgtatcctagcatacaggccaagatatggggttcgctcggacaaattacagacctgttggacgtggtgctggatagttttataaaaacgagcgcaaccggcggccttgggtccatcaaggccgaggtcatggctgacactgccgtggctctagccagcggcaacgtaaagctcgtgtcgagcaaggtcatcggccgtatgtgtaagattatcgataagacatgcctctccccaactccaacgcttgaacagcacttgatgtgggacgatatcgctatcttggctcgttacatgctgatgctgtccttcaacaattctcttgacgttgctgcccacctgccatacttattccatgtagtgacttttctcgtagccacagggccattgtcactgagagcatctacccacggcctcgtgataaacatcattcattctctgtgcacctgctcgcagctgcactttagcgaggaaaccaaacaggttctgcggttgtctctcactgaattttcgctacccaaattctatttactcttcggcattagcaaggtaaagtccgccgcggtgatcgccttccgcagttcctacagagatcgctccttttcccccggaagttatgagagagagacatttgccctcacatccctggagacagtgacggaagccttgcttgagataatggaagcatgtatgagagatatccccacgtgcaaatggctcgaccaatggactgaacttgcccagcggttcgcttttcagtacaacccaagcctgcagcccagggctctggtagtgttcggctgcatatccaagcgcgttagtcatggacagataaagcaaatcattagaattctcagcaaagctttagagtcgtgcctcaagggacccgacacctataacagtcaggttctgatcgaggccacagtgatagcactgactaagttacagcccctgttaaacaaggatagccccctgcacaaggccctcttttgggtggccgtggctgtgctgcaactcgacgaggtgaatctctatagcgcaggcacagccttgttggaacaaaacctgcacaccctcgattccttaaggatttttaacgataaaagcccagaagaggtctttatggcaatacgcaaccctcttgagtggcactgtaagcagatggaccacttcgtggggttaaactttaattctaactttaatttcgcactagtcgggcaccttttaaagggctatcggcatccaagccctgcgatcgtagccaggactgttcgcattctgcatacactgttgaccctagtaaacaagcaccgcaattgcgacaaatttgaggtgaacacacagtctgtggcctatctcgcagccctcctcactgtgtctgaggaggtgagaagccgctgctcactgaaacacagaaaatcccttctcctgacagatatttctatggagaatgtcccaatggacacttatccgatacatcatggggatcctagctacagaaccctgaaggagacccagccttggagctcgcctaagggatccgaagggtacctggctgccacctatccaaccgtgggccagaccagtccacgcgcccgaaaatcaatgtcactcgatatgggccagccgagtcaggccaacacgaaaaagttactcggaactcggaaatcttttgaccacctgatatccgataccaaggccccaaaacgtcaggagatggagtcaggcatcaccacccctccaaagatgaggcgggtagcagaaacagactatgagatggaaacacaacgcatcagcagtagtcagcaacacccacacttgcgtaaagtgtcagtgtcggaatctaacgtcttgctagacgaagaggtactgaccgaccctaagattcaggcactgctcttaacagtgctcgcaactctggtgaaatacaccactgatgagttcgatcagcggatactgtacgagtatctggccgaggcgtctgtggttttccccaaggtctttcctgtggttcataatctcttggattccaaaatcaacaccttgctgtcactgtgccaagatcctaacctgctgaatcccattcatgggattgtgcagtctgtggtgtatcatgaggaatctcccccgcagtaccaaacctcgtatctccagagttttggctttaatgggttgtggcgctttgctggtccctttagcaaacagacacagatcccagattatgctgaactcatcgtgaagttccttgatgccctcattgatacttatctcccaggtatcgacgaggaaacctccgaagagtcgctgctcacaccgactagtccatatccacctgccctccagagccagctctctatcactgccaacctgaatctatcaaattctatgacaagcctggcaacctctcaacacagtcctggaatagacaaggagaatgtagaactttctccaaccacaggccactgcaacagcggaaggacacgtcacggatctgcttcgcaggtccagaaacagagaagtgccgggagctttaagagaaattctatcaagaagattgtatag

SEQ ID NO: 25262 - DNA, 615 bp, Artificial Sequence
  Description of Artificial Sequence: Synthetic coding sequence
atgcacgagcggtacagcaacgtgcaggtggccggccccgtggacaggacgtcttccaaagatagcccactgcacaaagcgctattctgggttgccgtcgccgttctccaactcgatgaagtgaacctttactccgctgggactgcgctgctggagcagaatttacacacattggactccttgcgaattttcaatgataaatcacctgaggaggtgtttatggcaattcgcaatcctctggagtggcactgcaaacagatggatcattttgtcgggctcaactttaatagcaatttcaattttgccctagtgggccacctcctgaagggataccggcacccaagtcctgccatcgttgccagaacagttcggatactccacacactcctgacgctggtaaataagcacaggaattgcgataagtttgaggtgaatacacagtcagtagcttacctggccgctctcctcaccgtgtccgaggaggtgcggtcccgatgttcacttaaacacaggaagagtctactgctcacggatattagtatggaaaacgtgcccatggatacgtaccccattcatcacggcgacccctcataccgtaacaaagagaagttctag

SEQ ID NO: 25263 - DNA, 1782 bp, Artificial Sequence
  Description of Artificial Sequence: Synthetic coding sequence
atggccgcccaccggcccgtggagtgggtgcaggccgtggtgagccggtttgacgagcaactgcccattaagacaggccagcagaacacgcatacgaaagtgagtaccgagcataacaaagagtgcctgattaatatctctaaatacaaatttagcctcgtcatctccgggttgacaacaattctgaaaaatgtgaacaatatgcgtatcttcggcgaagctgccgaaaagaatctctacttatcacagctcatcatcctcgatacccttgaaaagtgtttggctggccagcctaaggacactatgcggctcgacgaaaccatgctggtaaagcaactgctccctgagatttgccacttcttacatacttgcagagagggcaatcaacacgccgccgagctgagaaacagcgcgtccggggtgctgtttagcctaagctgcaacaacttcaacgcagttttcagccggatatcaacgaggcttcaggaactgacagtatgctcggaggacaacgtggacgttcatgatatagaactgctgcaatatatcaatgttgattgtgccaagctgaagaggctgctgaaggagactgcgtttaaatttaaggcactgaagaaagtcgctcagctcgcagtgatcaatagtctagaaaaggcattctggaattgggtcgaaaattaccctgacgaattcaccaagctctaccaaatcccacagacagacatggcggagtgcgccgaaaaactctttgacctagtagatggcttcgccgagtctactaaacggaaggccgcagtgtggcctctgcaaatcattctattgatcctatgtccagagattattcaggacatatcaaaggacgtcgttgatgagaataatatgaacaagaaactgtttctggattcactgcggaaggcgctggccggacacggaggctccaggcagctgacagagtcggccgccatcgcctgcgttaagctttgcaaggcttccacctatataaactgggaagacaactctgtgatatttctgctcgtgcaatccatggtggtagacctgaagaatctgctgttcaacccctccaagccattttcacgtggctctcagccagccgatgtcgatttgatgatcgattgtcttgtgtcttgcttcagaatctccccccataacaatcagcattttaagatctgtctggctcaaaattctccaagcactttccactatgtgctggtgaattcattgcaccgaatcatcacaaattctgccctggactggtggcctaagattgatgcagtttactgtcattctgtggagctccggaatatgttcggagaaaccctccacaaggccgtccaggggtgcggcgctcatcccgctattcgcatggcgcctagcctcacattcaaggagaaagttacctcgctgaaatttaaggagaaacccactgatctggaaacaagatcatacaaatatcttcttctgtccatggtaaaactcattcacgccgatcctaagcttttgctttgtaatcctcggaaacaaggtcccgagacccagggcagtactgctgaacttattactggtctggtccagctggttccgcaaagtcacatgcccgaaattgctcaggaggccatggaggcactcttggtcctgcaccagttagatagtatcgacctttggaaccccgatgcccctgtggagactttctgggagatccgctatatgtatttctacttcctgaacagcacatttaaattctactttgtttttctgtcatag

SEQ ID NO: 25264 - DNA, 1917 bp, Artificial Sequence
  Description of Artificial Sequence: Synthetic coding sequence
atgcacgagcggtacagcaacgtgcaggtggccggccccgtggaccgcacgtcctcgaagttctgtggaagcttcaactgcaggtttgcctttcagtacaacccgagtctgcagcctcgcgccctcgtggtgtttggatgcatttctaagcgtgttagtcatggacaaattaaacaaatcatccggatcctgagcaaggcattagagtcgtgtctgaaaggccctgacacgtacaacagccaggtcctcatcgaggccacagtgattgcccttacaaaactgcaaccactgttaaataaggatagtcctctccacaaagcactgttttgggttgccgttgccgtcctgcagctggacgaggtcaatctgtacagtgctggaaccgctcttctggaacaaaatctgcatactctggattccctcaggatctttaatgataagtctcccgaggaggtctttatggctatacgaaatccactcgaatggcattgtaaacagatggaccacttcgtggggttgaacttcaactctaattttaacttcgcgctggtcggccacctcctcaaaggataccgccaccctagccccgccatagtggccagaaccgtgcgtatactccatacattattgaccctggtcaacaagcaccgcaactgcgacaaattcgaggtgaacacgcagtcagtggcatacctagctgccctgttgacagtgtcagaagaagtgaggtcgcggtgcagcttgaaacacaggaaatctctcctgctgaccgacatctccatggaaaatgtaccaatggatacatatcctattcatcatggggatccatcctacagaactttgaaagagacacagccctggtcgtccccaaaaggctccgagggttatctggcagccacatacccgaccgtgggacagacttcccctagggcccgtaagtccatgagtctggacatgggccaaccttctcaggccaatactaagaagctgctgggcactagaaaatccttcgaccacttgatatccgacacgaaagcgcctaagaggcaggagatggaaagtggcatcaccacccctccaaaaatgcgcagagtggccgagacggattatgagatggagacccagaggatctccagtagccaacagcaccctcatctgaggaaagtctcagtgtctgaatcaaatgtgctgcttgacgaagaagtgttgactgacccaaagattcaggcgctcctgctcacagtgttagccactcttgtcaagtacacaacagatgaatttgatcagcgcatactttacgaatacctggccgaagcgtccgttgtgtttccgaaggtgttccctgttgtgcataacctgctggacagtaagatcaatacgctcctaagcctgtgccaagatccgaatctgctgaacccaattcacggaatcgtgcagagcgtagtgtatcatgaggagagtccccctcaatatcagacttcctacctccaatcatttggcttcaatggactttggaggttcgctggcccctttagcaaacagacccagatccccgactacgccgaactgatcgtcaagttcctcgacgctttgatcgacacatacctgccagggatagatgaggaaacctccgaagaatccttgctgactcccacttctccttaccccccagctctgcaatcacagctcagtattaccgccaatcttaatcttagcaactctatgactagtctggcaacaagccagcattcgccagggattgataaggagaacgtggagctgtctccaacaaccggccactgtaattcgggaagaacgcgtcacggctcagcctcccaagtgcagaaacagcggtcggcggggagctttaaactggccctgttaaatctcctcactgctcaccaaaattcattgtag

SEQ ID NO: 25265 - DNA, 7509 bp, Artificial Sequence
  Description of Artificial Sequence: Synthetic coding sequence
aactgggaggacaacagcgtgatcttcctgctggtgcagagcatggtggtagacctgaagaatctacttttcaatccaagcaagccattcagtcggggcagccaaccagctgacgttgatctgatgattgactgtttagtgagttgctttcgtatctcccctcataataatcaacacttcaagatctgtctggcgcaaaattctccgtccacatttcactatgtgctagtaaactcactgcatcgcattattacaaactcggccctcgactggtggcccaagattgacgcagtgtactgtcattctgtcgagctaaggaatatgttcggagaaactctgcacaaagccgtgcagggatgcggggctcaccccgcaattcgaatggctccaagtttaacattcaaggagaaggttacctccctgaaatttaaggaaaaaccaactgacctcgaaaccaggagctataagtacctgttgctgtcaatggttaagttgattcacgccgatcctaagctgctcttgtgtaacccacggaagcagggcccggagactcaggggtctactgccgagctcataactgggctggttcagttagtgccacagagccatatgcctgaaatcgcccaagaggccatggaagcattgctggtgctgcaccagctggatagcattgatctgtggaaccccgatgctcccgtcgaaaccttttgggagatttccagccagatgcttttttatatctgcaaaaagttgacctcccaccagatgttatcttctaccgagatcctgaagtggctgcgggagatcctcatttgcaggaataaattcctgctgaaaaacaagcaagcagatcgctccagttgtcacttcctgctgttctacggagtcgggtgcgatattccgtctagcggaaacacctcacaaatgtcgatggaccacgaggaattgctgagaacaccaggcgcctcactacgaaaaggcaaagggaatagctccatggattcggctgcaggctgctccggcacacctcccatttgccggcaagcgcagaccaaactggaggtcgctctgtatatgttcctttggaacccagatacggaggcggtcttggtcgccatgagctgctttcgacatttgtgcgaagaggccgacattcgctgcggtgtcgacgaggtgagtgtacacaatcttctgccaaactacaacacctttatggaatttgcaagtgtctcaaatatgatgtccaccggccgggccgcattacagaagcgcgtgatggctctgttaagaagaattgagcaccccacagcaggaaataccgaggcctgggaggatacacatgctaagtgggagcaggcaaccaagctgattctcaactacccaaaggccaagatggaggacggccaagccgcagaatcattgcacaaaaccatagttaaacggagaatgtctcatgtgtcagggggcgggagcattgacctctcggataccgattccttgcaggaatggataaatatgactgggttcttgtgtgcattagggggggtatgtttacagcaacggtcaaattccggactggcaacatacagcccaccgatgggtcctgtgtcagagagaaaaggatccatgatatctgtcatgagttcagagggcaacgcggacaccccagtgagcaagttcatggaccgtctgctttccctgatggtttgcaatcatgagaaggtagggttacagatccggaccaatgtgaaggatctggtcggcctggaattgtctcctgccctgtatcccatgctctttaacaagctcaaaaacaccatatctaagtttttcgactcccaaggccaagtgctgttgacagacaccaatacacagtttgttgagcaaaccatcgcgatcatgaagaatctcctcgacaatcacacagagggcagctcagagcacctcgggcaggcaagcatcgaaaccatgatgctgaaccttgttcggtatgttcgcgtgctgggtaatatggtccatgcaatccagattaaaactaaactctgtcagctggtcgaggtgatgatggcccggagagacgatctctcattttgccaggaaatgaagttccgcaacaagatggtggagtacctgacagactgggtgatggggacctctaaccaggcggccgacgacgatgttaagtgtctgactagagacttggaccaggcgtctatggaggccgtcgttagtctgctggcgggtctccccctccagccagaggaaggggacggcgttgaactcatggaggccaaaagccaattgtttctgaaatatttcaccctgttcatgaacttgctcaacgattgctccgaggtagaagatgagagcgcccaaactggaggacggaagagaggaatgtccaggaggctcgcctctctccgccattgcacggtcctcgccatgtctaacctcctgaacgccaatgttgactctgggctgatgcactctataggccttgggtaccataaggatctccagacgcgcgcgacttttatggaagtgctgacgaagatcttgcagcagggtacagagttcgacaccttagctgagacggtgctggctgaccggtttgagaggctagttgagctggttactatgatgggcgatcagggagagctccccatagctatggcactggcgaacgtggtgccctgctctcagtgggatgagctggcccgggttcttgtgaccctgttcgattcacgtcacctgttgtatcagctgctctggaacatgttttcaaaggaagttgagctggccgactctatgcagactctgttcaggggaaatagcctagcatctaagatcatgacattctgttttaaggtgtatggtgcaacatatttacagaaattgctggatccactgctcaggatcgtgattaccagtagcgactggcagcacgtgagcttcgaggtggaccccacaagacttgaaccctcagaaagcctcgaggagaatcagagaaacctgctacaaatgaccgagaagtttttccatgcgattatctcaagttcctccgagttcccgccccagttacgcagcgtttgtcattgtttgtatcaggtggtctctcaaaggttccctcagaatagcattggggcggttgggtcagccatgtttctgaggttcatcaaccccgccattgtaagtccatatgaagctgggatccttgataaaaagcctccaccaagaatcgagaggggactgaagcttatgtctaaaatcctgcagtcaattgctaaccatgtgttgttcaccaaagaggagcatatgcggccttttaacgatttcgttaagtctaattttgacgcggccaggagattctttctggacatagcctcagactgtccgacatcagatgcggttaatcactcattatcctttattagcgatggtaatgtcttggcgcttcatcgactgctgtggaacaaccaggaaaaaattgggcagtacctgtcttctaacagggaccacaaggccgtgggaaggcgaccgtttgataagatggccacactcctcgcatacctgggacctccagagcacaagcctgttgctgacacccactggtcatcactgaatctgaccagtagtaaatttgaagagttcatgacacgccaccaggttcacgaaaaggaagaatttaaggccctgaagactctttctatcttctaccaggcaggtacaagcaaggccgggaatccaattttctactacgtagctcggcgattcaagacgggtcagattaacggagatctcctgatatatcatgtgttactgaccctgaaaccctattacgccaagccatacgagatcgttgtcgatcttacgcacacaggccccagcaatcgattcaaaaccgattttctgtccaaatggttcgtagttttccctgggtttgcttacgataacgtgtccgccgtatacatttataactgtaactcgtgggtgcgcgaatatacaaagtaccatgagagactgctcaccgggcttaagggatctaagaggttggtgtttatagattgtccaggaaaattagcggaacatatcgaacacgagcagcagaagctgcctgcagccacactggcccttgaggaagacctcaaagtcttccataatgctctgaagctagcccacaaggacactaaagtgtcaattaaagtgggatcaacagctgtacaggtcacgagcgccgagcgcacaaaagtgctgggacagtcggtttttctcaatgacatttattacgccagcgagatagaggagatctgtttggtggatgagaatcagtttacgctgactattgccaaccaagggacgccactcacatttatgcaccaagagtgtgaagccatcgttcagtcaatcatccatatccggaccaggtgggagctctctcagccggacagtatacctcagcacactaaaatccgaccaaaagacgtgccagggacacttctgaatatagctttgctcaatctgggaagtagcgacccctccctgagaagcgccgcttacaatctgctgtgtgccctcacctgcacctttaatcttaaaatcgagggccagctactggagaccagtggtttatgtattcccgcgaacaacactctgtttatcgtcagcatctccaaaacactagcagcaaacgagccacacctcacgcttgagttccttgaggaatgcataagcgggttttccaaaagtagtatcgagctgaagcatctttgtctcgagtacatgaccccgtggctaagcaacctcgtccggttttgtaagcacaacgatgacgccaagaggcagagggtgacagcaattcttgacaagctcataacaatgacaatcaacgaaaagcagatgtatccttctattcaggcaaaaatttgggggagccttgggcagataacagacttgctcgatgtcgtccttgattcatttatcaagacctcagctacaggcggcctgggttcgatcaaggctgaggtgatggctgacactgccgtagcactggcgtccggcaacgtgaagctcgtgagctctaaggtgattgggcgtatgtgcaagattattgataagacttgtctttctcccaccccaaccctagagcagcatttgatgtgggacgacatagctatcctggcacgctatatgctcatgctctcttttaataatagtttagacgttgcagcacacctcccttacttgttccatgttgtgacttttctggtggctaccggcccactaagtcttcgggcctccacgcatggcctcgtgataaatattattcacagcctgtgtacctgcagccagctgcacttctccgaggaaaccaaacaggtcctgaggttgtcgctgaccgaattttccctgcctaagttctatctgctatttggaatatcgaaagtgaagtccgcggccgtgatagcattcagatcgagttacagggataggtctttctcacctggttcctacgagcgggagactttcgctttgacgagcctggagactgttacagaggccctcctggaaataatggaagcgtgtatgagggacatcccaacgtgcaagtggctagaccaatggacggagctcgcgcagaggttcgccttccagtacaaccccagtttacagccgagggctctggtcgttttcggatgtatctctaagagagtttctcatggccagatcaaacaaattattcgtatcctatccaaggccctcgagtcatgcctgaaaggacctgatacttataatagccaagtgctgatagaagctactgtcatcgccttaacaaaactgcaacccttactgaacaaggacagccccctccataaggcactcttctgggtcgccgttgccgttctccaactggacgaggtgaacctctactcagccggaaccgcattactcgagcagaatttgcacacccttgattctttaaggatcttcaacgataaaagcccagaggaagtatttatggctattagaaaccctctggagtggcattgtaaacagatggatcacttcgtgggccttaactttaactccaactttaactttgctctggtcggacacttgctcaaagggtaccggcaccctagtccagcaatcgtagcaaggacagtgcgcatcctgcatacactcctgaccctggtaaacaagcacagaaactgcgacaaattcgaggtgaatacccagtctgtggcctaccttgcagcacttctgactgtctcagaagaggttagaagccgttgttcgcttaagcatcggaagtcactgctgctgactgacatctcaatggagaatgtcccaatggatacatacccaatacatcatggtgaccccagttatcggactctgaaagagacgcagccatggagttctcctaagggaagcgagggttatctcgcagcgacctatcccaccgtgggacagacaagtcccagggccagaaagagtatgagtttggacatgggccaacctagtcaagccaatacgaaaaagctcttaggcactcgtaaatctttcgatcacctcatatcagacactaaagcacccaagcgtcaagagatggagtctggcatcacaaccccccccaagatgcgacgcgtggcggagacagattatgagatggagacacagagaattagctcaagccagcagcatccacaccttaggaaagtttcagtgagcgagtccaacgtgctgttggatgaagaagtgttgactgaccctaagatacaagccctcctcctgacagtcctggccactctagtcaaatatactacagatgagtttgaccagaggatactgtatgagtacttggccgaggcctccgtggtatttcccaaagtgttccccgtagttcacaacttactggacagcaagatcaacacacttctgtctctctgccaagatcctaaccttctcaatcccattcatggaatcgttcagagtgtagtgtaccatgaagagagtccgccccagtatcagacctcctatctgcaaagctttggctttaacggactttggaggttcgcagggcccttcagcaagcaaactcagatcccagactatgctgagcttattgtgaagtttctggatgctctcatcgatacttatttgccaggaattgatgaagaaacctcagaggagagtcttctcaccccgacaagcccatatcctcccgctctccaatctcagctgtcaatcaccgccaacctgaacctgagcaattctatgacctcactggccactagccagcattcacccgcgtccctgccatgctccaaatcagccgtgtttatgcaactcttccctcaccaggggatagataaagaaaatgtggaattgagtcctactaccggtcactgcaattccggacgcactcggcacggaagcgccagtcaggtccagaagcagaggtccgctggatcattcaaacgcaatagcataaaaaagatcgtatag

SEQ ID NO: 25266 - DNA, 1524 bp, Artificial Sequence
  Description of Artificial Sequence: Synthetic coding sequence
atggccggcgccatcgccagccggatgagcttcagcagcctgaagcgaaagcagcctaagacttttacagtcagaattgtgaccatggatgctgaaatggagttcaattgtgaggtcaagaagcagatccttgacgagaagatctattgtccacctgaggcctcagtgttactcgctagctacgctgttcaagccaaatatggagactacgacccttctgtgcacaaaaggggtttcctcgcacaagaggagttgttacctaagcgcgttataaacctataccaaatgacgccagagatgtgggaggagcgcatcaccgcctggtacgcagagcaccggggacgagccagagatgaggctgagatggagtatcttaagatcgcccaggacctggagatgtacggcgtcaactacttcgcaattcgaaataaaaaagggacagagttgctcctgggagtggatgcgctagggctgcacatctatgacccagaaaatcgcctcacccctaagatctccttcccatggaatgagattagaaatatttcatacagtgacaaggagtttaccatcaagcctctcgacaagaaaattgatgtgttcaagttcaacagcagcaagctgcgcgtaaataaactcatcttacagctctgcatcgggaatcatgacctcttcatgcgccgtaggaaggcagatagtctcgaggtgcaacagatgaaggcccaggctcgcgaagaaaaggctcgtaagcagatggagcgccagcggttggcccgtgaaaaacagatgagggaggaggctgaaaggacacgagacgagctggagcgacggctgttgcagatgaaggaagaagccaccatggccaacgaggctctcatgcgcagcgaagaaaccgccgatctgcttgcagaaaaagctcagattacagaagaggaggccaagttgctggctcagaaagccgctgaggccgaacaggagatgcagagaataaaagctaccgccataagaacagaggaggagaaacgcctgatggagcagaaagttttggaggccgaggtcctagctctgaaaatggcggaggagagtgagcggcgcgcaaaagaagctgaccagctcaagcaggacctccaggaagcccgggaagcagaacgcagagctaaacagaaattgctagagatcgcaaccaagcctacatacccccctatgaatccaatacccgcccctttgccccccgatattccctctttcaacctgatcggagatagcttaagtttcgactttaaagatacggatatgaaacggctgtccatggaaatagaaaaggagaaggttgaatatatggaaaaaagtaaacacctgcaggagcagctgaacgagctgaagaccgaaatcgaggcattgaagctgaaagagcgggaaaccgctctggacattctccataacgaaaattcagacaggggagggtccagcaagcacaatactataaagaagccacaggcccaaggaaggcgtccgatatgtatctag

SEQ ID NO: 25267 - DNA, 1788 bp, Artificial Sequence
  Description of Artificial Sequence: Synthetic coding sequence
atggccggcgccatcgccagccggatgagcttcagcagcctgaagagaaagcagcccaagacatttactgtcagaatcgtgactatggatgcagagatggagttcaactgcgaaatgaagtggaaagggaaggacttgtttgaccttgtatgtagaaccctcggactgagggaaacctggttctttggcctgcagtacaccatcaaggataccgtcgcctggctaaaaatggacaagaaggtgctcgaccacgacgtgagcaaggaggagccggtcacgttccactttcttgctaaattttatcctgagaacgccgaagaagagctggtgcaggagatcactcagcacctgttcttcctgcaggtaaaaaaacaaatccttgatgagaagatttattgcccaccagaagccagtgttttattggcctcttacgcggttcaggcaaagtatggcgattatgatccatccgtccataagagaggcttcctcgcgcaagaggagctgttgcctaaacgcgttatcaatctgtaccagatgaccccagaaatgtgggaggagcgaattacagcctggtacgccgaacacagaggaagggctagggatgaagcggagatggagtatctgaagattgcccaggacctggagatgtacggggtgaattattttgccatccgtaacaaaaagggcacggaattgttattaggcgtggacgctctcggccttcatatctatgatcccgagaaccggctcactcctaaaatttcgttcccctggaacgagattcggaatatatcctactctgataaagaattcacgattaagccccttgataaaaaaattgacgttttcaaattcaacagttccaaactgcgggtgaacaaactgattttgcagttgtgcatcggaaaccacgatctatttatgaggaggagaaaggccgattctctagaggtgcaacagatgaaggcgcaggcccgcgaggagaaggctcgcaaacagatggagcggcaaagattggcccgagaaaaacagatgagagaggaagctgaacggacccgggatgaactggaacgcagactgctgcagatgaaggaagaggccacaatggccaatgaagccttgatgagatccgaagaaaccgccgatctgcttgcggaaaaggcccagattaccgaggaggaggctaagctcttggcgcaaaaggctgccgaagctgagcaggagatgcaaagaatcaaagcaactgctattcgcacagaagaagagaaacgcctgatggagcaaaaagtgttagaggctgaagtgctggctttaaagatggcggaggagtctgaacggagggccaaagaagccgaccagctcaagcaggacctgcaagaggctagagaagctgaacggagggcaaagcagaaactcctggaaatcgctaccaagcctacctacccgcccatgaacccaattccagcccctttgcctcctgatattccttcctttaacctgattggcgatagcctcagcttcgatttcaaagacactgacatgaagcgcctcagtatggagatcgaaaaagaaaaagtagaatatatggaaaaaagcaagcacctacaggaacagttgaatgagctgaaaactgagatcgaggcactgaaattgaaggagcgtgagacggctctggatatcctccataatgagaactctgaccgtgggggatcctccaagcataacactatcaagaaactgaccttacaatccgccaagtctagggtggcttttttcgaagaactctag

SEQ ID NO: 25268 - DNA, 663 bp, Artificial Sequence
  Description of Artificial Sequence: Synthetic coding sequence
atggccggcgccatcgccagccggatgagcttcagcagcctgaagagaaaacagccgaagaccttcactgttcgcattgttactatggatgccgagatggagtttaattgtgaagttaagaaacagatcctggatgaaaagatatactgccctcctgaggcttctgttctgctggcaagctatgccgtgcaggccaagaacaagaaaggcacagaacttctgctgggcgtggacgcactcggcctgcacatttatgatcccgagaacagattgacccccaaaattagcttcccttggaatgaaataagaaatatcagttacagtgataaagaatttactattaaaccattagataaaaaaatagatgtcttcaagttcaactcgagtaagcttagagtcaataagctgatattacagctgtgcatcgggaaccacgatctgtttatgagacgacgcaaagcagactctctggaggtgcagcaaatgaaggcccaggccagagaggagaaagctagaaagcaggggcagcggggaagatccgccgaagccggtcctgcaggatctacaagaggcggggctaagtcccaggcggaggcacccggggactgtcaccaggctcatgttccggcacacgaacctaattcctccaccgttgcgagttag

SEQ ID NO: 25269 - DNA, 1524 bp, Artificial Sequence
  Description of Artificial Sequence: Synthetic coding sequence
atggccggcgccatcgccagccggatgagcttcagcagcctgaagagaaagcaaccaaaaacctttaccgtgcgaattgtgaccatggacgccgagatggaatttaattgcgaggtcaagaagcagattcttgatgaaaagatctattgccctcccgaagcctctgtcctgctggcgtcctatgcagttcaggccaagtatggggactacgaccccagtgtccacaagagaggctttcttgcccaggaagaattactgccgaagcgagtgattaatttatatcagatgacgccagaaatgtgggaagagcgcattaccgcgtggtatgcggagcacagggggcgtgcccgcgatgaggcggagatggaatacctcaagatagcacaggatctagagatgtatggggtaaactatttcgccatccgtaataaaaaaggaaccgaactcctcctgggcgttgatgccctcggcctgcatatttatgaccccgagaaccgcttaacaccgaaaatttcctttccttggaatgaaattcgcaatatctcttactccgacaaggagttcacaattaagccgctggataagaagatcgatgtcttcaagttcaatagcagcaagcttcgcgtaaacaaactgattctccagctctgcattggtaaccacgatctgttcatgagacgtcgaaaggcagactccttagaggtgcagcagatgaaagctcaagcgagagaagagaaagcccggaagcagatggagaggcagcgcctggccagagagaagcagatgagggaggaagctgagagaacaagggacgagcttgagagaaggctgttgcagatgaaggaagaagccacaatggctaacgaggctctaatgcgctcagaagagactgcagacctgttagcagagaaggctcaaattactgaagaggaggcaaaacttcttgcacagaaagccgcagaggcagagcaggagatgcagcgcatcaaggcaacagccatcaggacagaggaagagaagcggctgatggagcagaaggtgcttgaggccgaagtactggcgctgaagatggccgaggagtctgaacggcgagcaaaggaagcagaccagctgaagcaggatctgcaggaggcacgtgaggccgagcgaagggcgaagcagaagttactggagatcgccaccaaacccacatacccccccatgaatccgatcccagcccctctcccgccggatatcccatcattcaacctcatcggggattctctcagttttgattttaaggacaccgacatgaagcgactctctatggaaatcgaaaaagaaaaagtcgagtatatggaaaaatccaaacacctccaagagcagctgaacgagcttaagacagagatagaagcattgaagcttaaggaaagggagactgcacttgatatactgcataatgagaattccgaccgtggcggcagttcaaagcataacaccattaaaaagcctcaggcgcaggggagaagacccatctgcatttag

SEQ ID NO: 25270 - DNA, 1773 bp, Artificial Sequence
  Description of Artificial Sequence: Synthetic coding sequence
atggccggcgccatcgccagccggatgagcttcagcagcctgaagcggaagcaacctaagactttcactgttcgcatagttaccatggacgcggagatggaattcaattgtgaaatgaaatggaagggaaaagacctcttcgatctcgtgtgcagaacgctggggctgcgcgagacctggtttttcgggctccaatacacaatcaaagacacagtggcctggctcaagatggacaagaaggtgctggaccacgacgtgagcaaggaagagcctgtcactttccattttttagctaagttctatcctgagaatgctgaagaggagctcgtccaagagataacccaacaccttttttttctacaggtcaaaaagcagatccttgatgagaagatctattgtccaccagaggcttcggtactcctcgcttcatacgcggtacaggcaaaatatggggattatgaccccagtgtccataagcggggtttcttagcccaagaggagctgctgccaaaaagggtgatcaacctgtaccagatgacacctgaaatgtgggaagagagaattaccgcgtggtatgccgaacatagaggtagggccagagacgaagctgagatggagtatttgaagatcgcccaggacttagagatgtatggtgtgaactacttcgccataagaaacaagaaaggtaccgagcttctactcggggtcgacgctcttgggctgcacatatatgacccagagaatcgccttactcccaaaatcagtttcccctggaacgagataaggaatattagctactccgataaggaattcaccatcaagccacttgacaaaaaaatcgacgtgttcaaattcaattcatcaaagctccgtgtcaataagttgatcctgcagctgtgtattgggaaccatgatctgttcatgcgcaggcggaaggcggattctctggaagtgcagcaaatgaaggcgcaagctcgggaggaaaaagctaggaagcaaatggaaaggcagcgcctcgctcgtgagaaacagatgagggaggaagctgagaggaccagggatgagttagaacgccgactgttacagatgaaggaggaggcaacaatggctaatgaggctctcatgcgcagtgaggagacagctgacctgcttgctgagaaggcacaaatcactgaagaagaagccaaactgctagcccagaaggcagctgaagcagaacaggaaatgcagcggattaaggcaacagcaatccgaactgaggaagagaagcgtttgatggagcagaaggtgctagaggccgaggttctggcgttgaaaatggctgaggaaagcgagcgtcgcgcaaaggaagctgatcaactgaagcaggacttgcaggaagccagggaagccgagagacgggccaagcagaagctgctggaaattgcgacaaaacccacttacccacccatgaatcctatcccggctcctttgccccctgacatcccctctttcaacctgatcggcgacagtttatcatttgattttaaggatacagacatgaagagactgtccatggagattgaaaaagaaaaggttgaatacatggagaagtccaaacacctgcaggaacaactaaatgaactgaaaacagagattgaggcacttaagttgaaggaacgtgaaactgccttggacatcctccataatgagaattcggatcgaggcgggtctagcaagcacaataccatcaagaaaccacaggcacaaggcagacggcctatctgcatctag

SEQ ID NO: 25271 - DNA, 1650 bp, Artificial Sequence
  Description of Artificial Sequence: Synthetic coding sequence
atggccggcgccatcgccagccggatgagcttcagcagcctgaagagaaaacaacccaaaactttcactgtgaggattgtcaccatggatgctgagatggagttcaactgtgagatgaaatggaaaggcaaagacctgtttgatttagtgtgccggaccctcggcctccgtgagacgtggtttttcggtctccagtacacaatcaaagacactgttgcatggctgaagatggataaaaaggtcaaaaagcagattctcgacgagaaaatctattgtcctccagaggcttctgtgcttctggcctcctatgcagtgcaagctaaatatggtgattatgatccaagcgtgcacaaacggggcttccttgcccaggaagaactgctgcccaagcgcgtgatcaacttataccagatgaccccagaaatgtgggaagaaaggatcacggcatggtacgccgagcatcgcgggcgggccagagacgaagccgagatggagtatttgaagattgctcaggatctagagatgtacggtgtcaactactttgcaattcggaacaaaaaagggactgaactcctgctcggcgtcgatgcgttaggcctgcacatctacgatccggagaaccggctcacacccaaaatctcattcccatggaatgaaattaggaacatcagctattctgacaaggaatttaccattaagcccttggataaaaaaatcgacgttttcaaattcaattcgtcgaagctccgagtgaacaagcttatcctgcagctctgcataggaaaccacgatctgttcatgaggcggcgaaaggctgactcattggaagttcagcaaatgaaggctcaggccagggaagagaaagcaaggaagcagatggaaaggcaacggctcgctagggagaagcaaatgagggaggaggctgaacgaaccagagatgaactggagcggcggctcctgcaaatgaaggaagaggcaaccatggctaatgaggccctgatgcgcagcgaggaaacggcagaccttctggctgagaaagcgcagatcaccgaagaagaagccaagctgctagctcaaaaggccgccgaggctgaacaggagatgcaacggattaaggctacggccattcgaacggaagaggagaagcgacttatggagcaaaaggttctggaggcagaagtgctcgctcttaaaatggccgaagaatcagagcggagggccaaggaagcagaccagcttaagcaggacctccaggaagcacgggaggccgaacgccgcgccaaacagaaactcctcgagattgccaccaaaccaacgtatccaccgatgaatcctattccagctccccttcctccagatatacccagtttcaacctcatcggagactccttatcttttgactttaaggatactgacatgaaacggctgtctatggaaattgaaaaagagaaggtcgaatacatggaaaagtcgaaacacctgcaggagcagctgaatgagctcaagacagagattgaggccctgaagcttaaagagagggaaaccgccctagatatcttacacaacgagaatagtgataggggggggagtagcaaacacaacactattaaaaagccacaggcccaaggcaggcgccctatctgtatttag

SEQ ID NO: 25272 - DNA, 1647 bp, Artificial Sequence
  Description of Artificial Sequence: Synthetic coding sequence
atggccggcgccatcgccagccggatgagcttcagcagcctgaagcgcaaacagccaaaaactttcacagtcaggatcgtaactatggacgctgaaatggagtttaattgtgaggtgctcgaccatgacgtctccaaggaagagccagttaccttccacttcttggccaaattctatcccgagaatgctgaggaagagctggtgcaagagataactcagcacctattcttcctacaggtgaagaaacaaatactagacgagaaaatctactgcccccctgaggcctcagtcttgctggcctcatatgctgtccaggccaagtacggtgattatgatcccagcgttcacaaacgcggctttctagctcaagaggaactgctgcccaagcgggtgatcaacctgtatcaaatgacccccgagatgtgggaagagcgaattacggcctggtacgcagaacaccgaggtagggcacgggacgaagcagagatggaatatctgaagatcgcccaggatctcgagatgtatggtgtcaactacttcgccatcaggaacaagaaaggcaccgagctcttgctcggcgtggacgcactgggactgcacatttatgaccccgaaaacagactgacccctaagatcagttttccatggaatgagatccgtaacatcagttattcagacaaagaattcacaatcaagcctttagataaaaaaatcgatgtatttaaattcaattcttctaaactgcgggtgaacaaactgatcctacagctgtgtataggcaaccacgacctatttatgcggaggcgcaaagctgacagccttgaggtacaacagatgaaagcccaggctagagaagaaaaggccagaaaacagatggaacgccagcgccttgcaagggaaaagcagatgagggaagaagcggagcggacccgcgatgagcttgagcggcggctgttacagatgaaggaggaggcaacaatggccaatgaggctctcatgcgatccgaggaaacagctgatctgctggcagaaaaggcccagatcaccgaggaggaagctaagctcctcgctcagaaagccgctgaggcagagcaagaaatgcagcgcattaaggcgacagctattcgtacagaagaagaaaagcggctaatggagcagaaggttctggaggcagaggtgctcgcactgaagatggcggaagagagcgaaagaagagcaaaggaggccgatcagctgaaacaggacctgcaagaagctcgagaagctgaacggcgggctaaacagaagctcctggagatagccacaaagcctacctatccacccatgaaccctatcccagctcccttaccccctgatataccttcctttaatttaattggtgacagcctctcttttgatttcaaagatacagatatgaagagactctccatggagattgaaaaagagaaagtggaatacatggagaagagcaagcacctgcaggaacaactaaacgaattgaagaccgaaatagaggctctgaaactgaaagagagggagaccgccctggacatcttgcataatgagaacagtgatagagggggctcaagtaaacataacacaatcaagaagcctcaggcccaagggcggagacccatatgcatttag

SEQ ID NO: 25273 - DNA, 1773 bp, Artificial Sequence
  Description of Artificial Sequence: Synthetic coding sequence
atggccggcgccatcgccagccggatgagcttcagcagcctgaagaggaagcagccgaagacgtttactgtgaggatcgtgacgatggacgccgagatggaatttaactgtgagatgaagtggaagggcaaggacttatttgacctggtgtgtcgtactctggggctgcgagaaacttggttcttcgggctccagtatacgataaaagacactgttgcctggcttaagatggacaagaaagtactagatcacgatgttagtaaagaagagccggtgacatttcatttcctggccaagttctatcccgaaaatgcagaggaagagttggtgcaagagataacacagcatctattcttcctgcaggttaaaaagcagatcttggatgaaaagatttactgtccacctgaggctagtgttctccttgcaagctatgccgtccaggccaagtacggcgactatgacccttcagttcacaagcgtggtttccttgcccaggaggaactgttgccaaaacgtgtgatcaatctgtaccagatgacccccgaaatgtgggaggagcgaataacagcctggtacgcagagcatagaggtcgtgcccgcgatgaagccgaaatggaatatctgaagatagcacaggaccttgaaatgtacggcgtgaattattttgcaattaggaacaagaaagggacagagcttctgctcggagtggacgccttaggcttgcacatctacgatcccgaaaaccgtctgaccccgaagatttctttcccctggaatgagataaggaacatctcctactccgacaaagagttcaccattaaacctctggataagaagattgacgtgtttaagtttaactcctcaaagctgagggtgaataagttgattctgcagctgtgtattggtaaccacgatttattcatgaggagacggaaagcagacagcctggaggtgcagcagatgaaagcacaagcacgggaagagaaagcaagaaagcagatggaaagacagcgattagctagagaaaagcaaatgagagaggaagctgagcgcactagagatgagctagaaagaaggctgctgcaaatgaaagaggaagcaaccatggccaacgaggccctgatgaggtcagaggagacagccgacctcctcgcagaaaaagcccagatcactgaggaagaggccaaattgctcgcccagaaagctgccgaagcagagcaggaaatgcagaggattaaggcgactgcaatccgaaccgaagaggaaaaaaggcttatggagcagaaagtcttggaagcggaagtgcttgccctaaagatggctgaagaatccgagcggagagccaaggaggccgatcagctcaaacaggacctgcaggaagctcgcgaggccgagaggcgggcaaagcagaaacttctggagatagcaaccaagcctacttaccctcccatgaacccgatacccgcccccctccctcccgacatccctagctttaacctcatcggcgattccctgtcattcgacttcaaagacaccgatatgaagagactgtcaatggagatcgaaaaagagaaggttgagtatatggagaaatctaaacatctgcaggagcagttaaacgagctgaaaaccgaaatcgaagcactcaagcttaaagagagagaaaccgccctggatatactgcacaacgagaactctgatagaggggggagctcaaagcacaacaccatcaaaaaacctcaggcccagggccgtcgcccgatctgcatatag

SEQ ID NO: 25274 - DNA, 1806 bp, Artificial Sequence
  Description of Artificial Sequence: Synthetic coding sequence
atggccggcgccatcgccagccggatgagcttcagcagcctgaagagaaagcaacccaagaccttcaccgtcaggatagtgaccatggatgccgagatggagtttaattgtgaaatgaaatggaaagggaaagacctttttgacctcgtctgccgcactctaggtttgcgcgagacctggttcttcggcttacaatacacaattaaggacaccgtggcatggctgaagatggacaaaaaggtgctggatcacgacgttagcaaggaagagcctgttactttccatttcctggcgaaattctatcctgaaaacgccgaagaggagctagtgcaggagatcacacagcacctgtttttccttcaagtgaagaagcagattctggatgagaagatttattgcccgcccgaggcctctgttctgctggctagttatgccgtgcaggctaaatacggcgattatgacccatccgtgcacaaaagaggctttctggctcaggaagagctactcccaaaaagggtcatcaacctgtatcagatgacacccgagatgtgggaagaacgcatcaccgcttggtatgcagaacacagaggacgtgcgcgcgatgaagcagagatggaatacttgaagatcgcacaggatctggagatgtacggtgttaattacttcgcgattaggaataagaagggcaccgagctcctcttgggcgtggatgctttagggttgcacatctatgaccccgagaatcgcttgactcccaaaatatcctttccctggaacgagatccggaatatctcctactccgacaaggagtttactattaagcccctggacaagaagattgacgtgtttaaatttaactcctcaaagctacgggtgaacaaactgatccttcagctgtgcataggaaaccacgatttatttatgcggcgccgtaaagccgactccctggaggtgcagcagatgaaggctcaggcaagggaagagaaggcacgcaagcagatggagcggcagcggcttgctagggagaaacaaatgagagaagaagcagaaagaaccagggatgaacttgagaggcggctactgcagatgaaggaggaggcaaccatggcaaacgaggctcttatgcgctctgaagaggccgaacaagaaatgcagaggattaaggccacagccattcgcaccgaagaggaaaaacgactcatggaacagaaggtgctcgaggccgaggttctggcattaaaaatggccgaggagtcagagcgacgggcaaaagaggcagaccaactcaagcaggatctgcaagaggctcgcgaggcagaaaggcgggcaaaacagaaactgttagagattgccacaaagcccacatacccaccaatgaatcccatccccgcaccgctgcctccggatatcccctcttttaatctgatcggagactctctctcgtttgatttcaaagacactgacatgaaaaggctctcaatggagatcgagaaagagaaggtggagtatatggagaagagcaagcacctgcaggaacaattaaatgagcttaagactgaaatagaagctttgaaattaaaggagcgagagacggctctcgatattttgcacaatgagaattccgatcgtggcggcagcagtaaacataacacgatcaaaaaaggcatgttcttgttcttcttcatactgttctgctggttctccctgaagcctaaggccgaggatctatcggccttcgaacctagcaactcgccctgtcgcgcccccagtcccgaatggcccagcctgaaatcctcatcacgatag

SEQ ID NO: 25275 - DNA, 1686 bp, Artificial Sequence
  Description of Artificial Sequence: Synthetic coding sequence
atggccggcgccatcgccagccggatgagcttcagcagcctgaagcggaaacaacctaagacattcactgtccgaatcgtaaccatggacgctgaaatggaatttaattgtgagatgaagtggaagggaaaagatctgttcgatctggtctgccgcaccctgggcttgcgggagacatggttctttggactacagtacacaatcaaggacaccgtggcatggctcaagatggataagaaagtgctcgatcatgatgtttccaaagaggagcctgttacttttcactttttggcaaagttctatcctgagaatgccgaagaggaactggttcaagagatcacgcagcacttgtttttcctgcaggtgaaaaaacagattctcgatgagaagatttactgtcctccagaggcatcagtactgctggcctcctatgccgtccaggccaaatatggagactacgatccctcagtgcacaaaaggggattcctggcccaggaggagctgttgcctaaacgagtcatcaacctatatcagatgactcccgaaatgtgggaggagcgcattactgcctggtacgccgagcaccggggcagggcccgcgacgaggctgagatggagtatctgaaaatcgcccaggatttagaaatgtacggcgtgaactattttgcaatacgaaacaagaagggcaccgagttgctgctgggtgttgatgcccttgggctccatatctatgacccagagaatagattgaccccaaaaataagttttccttggaacgagatcagaaacatttcctactccgacaaggaatttacaatcaaacctttggataaaaaaatagacgtgttcaaattcaactcgagtaagctgcgggtgaataaactcatcctgcagctttgtatcggtaatcacgatttatttatgagacgccgcaaggccgacagtttggaggtccagcaaatgaaggcacaggccagggaagaaaaagccaggaagcagatgaaggaggaagcgacgatggccaacgaggctctgatgaggagcgaagagacagctgaccttctggctgagaaagcgcaaattactgaagaggaggccaaactgctggctcaaaaagcagcagaggcagagcaagaaatgcagaggattaaagccacagctattagaacggaagaggagaagaggctgatggagcagaaggttctggaagcggaagtcctcgcactcaaaatggccgaagaatccgaacgccgggccaaggaggccgaccagttaaagcaagatctgcaagaagcacgcgaagctgagcgaagggccaaacagaaactgctggagattgcaaccaaaccaacgtaccctccaatgaatccaattcctgccccactccctcctgacatcccctcatttaatctgatcggcgattcactgtcattcgactttaaagacacagatatgaagcgcctaagcatggaaatcgagaaggagaaggtggagtatatggaaaagtcaaaacaccttcaagagcagctcaacgaactgaaaaccgaaattgaggctcttaagttaaaggagcgggagacggctttggacattttacacaatgagaactccgatcgaggcggttccagcaagcacaacacaatcaaaaagcctcaagcacagggtagaagaccgatttgcatctag

SEQ ID NO: 25276 - DNA, 1773 bp, Artificial Sequence
  Description of Artificial Sequence: Synthetic coding sequence
atggccggcgccatcgccagccggatgagcttcagcagcctgaagcgcaagcaaccgaagactttcactgtgagaattgtgaccatggacgcagagatggagttcaattgtgaaatgaagtggaaggggaaggacctcttcgacctggtgtgccgtacactcggattgcgcgagacctggttcttcgggctccagtatactatcaaggacaccgttgcatggttgaaaatggacaaaaaagttctcgatcacgatgtatctaaggaggaaccagttacctttcactttctggcgaaattctacccagagaatgccgaggaggagctagtgcaagagattacccagcacctgttctttttacaggtgaaaaagcagatcctggacgaaaagatttattgtcctcccgaagcctccgtgcttttagccagctacgcagtccaggccaagtatggcgactacgatcccagcgtgcataaacggggttttcttgcgcaggaagaactgctacccaagcgcgtgataaatttgtaccagatgactccggagatgtgggaggagcggatcaccgcctggtatgccgagcatagagggagagcacgggacgaggcagaaatggagtacctgaaaatcgctcaggacctagaaatgtatggggtgaactactttgctatccgaaacaaaaaagggactgaacttctcctcggtgtcgacgccctgggcctacatatttatgatccagaaaatcgcctgacacccaagatctcattcccatggaacgaaatcaggaacatcagttacagtgataaggaatttacgataaagccactggataagaaaattgacgtcttcaaattcaattccagcaagctccgcgtcaacaagctgatccttcagttgtgcattgggaaccacgacctattcatgagaagacgcaaggctgactcgctagaggtgcagcaaatgaaggctcaggcgcgcgaggagaaggcacgaaagcagatggagaggcagaggcttgctagggagaaacagatgcgcgaggaggcagagcggaccagggatgagctcgaaaggcgccttctgcagatgaaggaagaagcgaccatggccaatgaagccttaatgcggagcgaggagactgcagacctgttggcagagaaggctcagatcaccgaagaagaggctaaattgttggcgcagaaagcagcagaagctgagcaggagatgcagcgcattaaggcaacggcaattcgcacagaggaggagaagaggctgatggagcagaaggtgctcgaagccgaagtcctggctcttaagatggcggaagagagcgaacgcagagccaaagaggcggaccagctgaaacaggatttgcaggaagccagagaagcggaacgcagggctaagcagaaattactggagatcgctactaagccaacgtacccaccaatgaatccaattccggctccactcccacccgacataccgagcttcaacctcatcggggattcactgtctttcgattttaaggacaccgacatgaaacgcctttctatggagatcgagaaggagaaggttgagtacatggagaaatccaaacacttacaggagcagcttaatgagttgaagaccgaaattgaagcgctgaaactgaaggaaagggagactgccttggatatattacataacgaaaattcagaccgcggcggctctagcaagcataacacaatcaaaaagccacaagcccaggggcgtcgccccatctgcatttag

SEQ ID NO: 25277 - DNA, 498 bp, Artificial Sequence
  Description of Artificial Sequence: Synthetic coding sequence
atggccggcgccatcgccagccggatgagcttcagcagcctgaagcgaaagcaacccaaaaccttcacagtccggattgttacaatggatgcagaaatggaatttaattgtgagatgaagtggaagggcaaggatctgtttgacctggtgtgtaggacactgggcctgagagagacatggtttttcgggctgcagtatacgatcaaggacaccgtggcctggcttaaaatggacaagaaagtcctggatcacgatgtgtcgaaggaagagcctgtgacattccactttctggcaaaattttatcccgagaacgccgaggaggagttggtccaggagatcacacaacatctttttttcctgcaggtaaagaaacagatcctggacgaaaaaatctattgtcccccagaagcttccgttctcctcgccagctatgcagtccaggccaagcttaccctgcaaagcgccaaatctcgcgtcgccttctttgaggagctttag

SEQ ID NO: 25278 - DNA, 663 bp, Artificial Sequence
  Description of Artificial Sequence: Synthetic coding sequence
atggccggcgccatcgccagccggatgagcttcagcagcctgaagaggaaacagcccaaaaccttcacagtacggatagtgacgatggatgctgagatggagttcaactgtgaggtgaaaaagcaaatcttggatgaaaagatctactgccctcccgaagcatccgttctgttagcctcctacgccgtccaggccaagaataagaaaggcactgagctcttgctcggagtggatgcgctgggcttacacatatacgatccagaaaatagattaactcccaagatatcatttccctggaatgagatcaggaacatctcctactctgataaggagtttacaattaagccactggataagaagattgatgtgttcaagttcaatagttcaaagctcagagtgaataaacttatccttcagctctgcatcggcaaccacgatttattcatgcgccgccgcaaagctgactccctggaagtgcagcagatgaaagcccaagcaagggaggagaaagcaaggaagcaaggccaacgcggaagatccgcagaggcaggacctgcaggatcaacacggggcggagcaaaatcccaagcagaggcacctggtgattgtcatcaggcgcacgtcccagctcacgagcccaattctagtacagtggcgtcgtag

SEQ ID NO: 25279 - DNA, 2772 bp, Artificial Sequence
  Description of Artificial Sequence: Synthetic coding sequence
atggagcggggcctgcccctgctgtgcgccgtgctggccctggtgctggctccggctggagccttccgcaacgacaaatgcggagacaccataaaaattgagagccccggatacctgactagtcctggatacccccacagctaccacccctcggagaaatgtgaatggttaatccaggctcctgacccctaccaaagaataatgatcaatttcaatccacacttcgatctcgaggatcgggattgcaagtacgactacgttgaagtgtttgatggcgagaatgagaacggccacttcagagggaaattctgcgggaaaatcgctccaccgcccgtggtctccagcggccccttcctcttcattaagttcgtgtcagactacgagacacatggcgccggtttcagtatcaggtatgagattttcaagcgggggcccgagtgttcccagaattacactaccccttctggtgtcatcaagtcccctggcttcccagagaaatatcccaattccctcgagtgtacttacatcgtgttcgtgcctaagatgtctgagatcatactagagtttgaatcctttgacctggagccagacagcaaccctcccggcgggatgttttgtcggtacgaccggctggaaatctgggatggcttcccagacgtcgggccccatataggtagatactgcggacagaagacacctggaaggattcggtcgtcctccggaatcctgtctatggtattctatactgactccgccatcgcaaaggaaggcttttcggccaactacagcgtgttgcagtcctccgtgagcgaagattttaagtgcatggaagccctgggaatggaatccggtgagatacatagcgaccagataactgcaagctcccagtacagcacaaattggtctgcggagcggtcgagactgaattaccctgaaaatgggtggacccctggagaggactcctaccgggagtggatccaggtcgacctggggctgcttaggttcgttaccgccgtgggaacgcagggcgctattagcaaggagaccaaaaagaagtactatgttaagacatacaaaattgacgtttcttccaacggcgaagactggatcaccataaaagagggcaataagccagtgctattccagggcaatacaaaccctactgatgtggtcgtggcggtctttccaaagcccttgatcacaaggttcgtgcggatcaagcctgctacctgggagactggaatctcaatgcgattcgaggtgtacggctgcaagatcactgactacccctgctctgggatgcttggaatggtgagtgggttgattagcgattcccagattacctcttctaaccagggtgataggaactggatgcccgaaaacatcaggcttgtgacttctaggagcggatgggccctccctcctgctccccactcctacataaatgaatggctccagatagacctgggagaagagaagatcgtgcggggaatcattatacaaggcggtaagcaccgcgagaacaaggtctttatgcggaaattcaaaattgggtattccaacaacggcagcgattggaaaatgattatggacgatagcaaaaggaaggctaagtcatttgagggcaacaacaactatgatacccccgaactgagaacgttcccagcattgagcaccaggtttattcgcatttaccccgagagggctacacacggcggcctaggccttcgtatggaattgttagggtgcgaggtggaggctccgaccgcaggacccacaacccctaatggaaacttggtggatgagtgcgatgacgatcaggctaattgccacagtggaacaggtgatgacttccagctaaccggagggacgaccgtgctcgctaccgaaaagcccactgtcatcgactcgaccatccagagcgaatttccaacctacggcttcaattgtgagtttggatgggggagccacaaaacattttgtcattgggagcacgacaaccatgtgcagttgaaatggagcgtcctgacaagcaagactggcccaatccaggaccacacaggagatggtaacttcatttattcccaggctgatgagaaccagaagggtaaggtagcccgcctggtgtcgcctgtagtgtattcacagaactctgcccactgtatgactttctggtaccacatgagtggcagccatgttggcacactgcgcgtcaaattgagataccaaaaaccagaagagtacgaccaattagtctggatggctatcggacatcagggagatcactggaaagagggtcgagtcttactgcataaatctctgaaactctatcaagtcatctttgagggcgaaataggtaaaggaaacttggggggcattgcagtcgacgacatctctataaacaatcatatatcccaggaggattgcgccaaaccggccgacctggacaaaaaaaatcctgaaattaagattgacgagacaggaagcacccctggctacgagggggagggggagggcgataagaatattagtagaaaaccgggcaacgtgctcaagactctggatcccatcttgatcacaatcatcgctatgagtgccctgggggtcctgctgggtgcagtgtgtggggttgtgttgtactgtgcctgctggcataatggcatgagcgagcgcaacctgagtgctttggagaactataactttgagctcgtggacggcgtaaagctcaagaaggataagttgaatacccaatctacttattcggaagcatag

SEQ ID NO: 25280 - DNA, 420 bp, Artificial Sequence
  Description of Artificial Sequence: Synthetic coding sequence
atggacgacagcaagcggaaggccaagagcttcgagggcaacaacaattacgacacaccagagctgaggaccttccccgctctcagcacacggtttatccggatctacccggagagagcaacacacggcggtctggggctgagaatggaacttcttggctgcgaagtcgaagccccaactgcaggccccaccactcccaacgggaatctggttgacgagtgcgatgacgatcaggctaactgccatagtggcaccggcgacgatttccagcttacaggtggcaccacagtcctggctactgagaaaccaactgtgattgatagcacgattcaatcaggatcccggttttttaagcaccaccacaaacaacaaagtatgcgcccacaaaacctgcatcataattccattctcctcctctag

SEQ ID NO: 25281 - DNA, 1926 bp, Artificial Sequence
  Description of Artificial Sequence: Synthetic coding sequence
atggagcggggcctgcccctgctgtgcgccgtgctggccctggtgcttgcccctgcgggggctttccgaaacgacaagtgcggcgacaccatcaagatcgaaagtcctggatacctaacatcccccgggtacccccatagttatcatccctccgagaaatgtgaatggcttatccaggcaccagatccttaccagaggatcatgatcaatttcaacccccacttcgatctcgaggaccgagattgcaagtacgactacgtagaggtcttcgatggagaaaatgaaaatgggcacttccgggggaagttttgcgggaagatcgcccctccccctgtggttagttcaggtccctttctctttatcaagttcgtatccgattatgaaacacacggcgctgggttctccatcaggtatgagatcttcaagcggggcccagaatgcagtcagaattatactactcctagcggggtgattaagtcccccggctttccggaaaaatatcctaactctcttgaatgcacgtacatcgtgttcgtgcccaaaatgtcagaaattatcctggagtttgaatcctttgacctggaacccgacagcaatcctccaggcggcatgttttgtaggtatgaccgtctggagatttgggacggattcccagatgtggggccacacattgggcggtattgtggtcaaaagacccccggtcgcattagatcttcgtccggtatcctgtcaatggtgttttacactgactctgctatcgctaaggaggggttctcagctaattattccgtacttcagtccagtgtaagtgaggattttaagtgtatggaggccctcggaatggagagtggtgagattcactccgatcaaatcaccgcaagcagtcagtattcaaccaattggagtgccgaacggtcgcgactgaattatccggaaaacggctggacccctggcgaggacagctatcgcgagtggatccaggtcgacctggggctgctgagatttgtaacggccgtgggaacacagggcgctattagcaaggagactaaaaagaaatattacgtcaagacttacaaaattgacgtgtcctccaatggtgaggattggatcactatcaaagagggaaataagccggtgctgttccaaggcaacaccaatcccacggacgtggtggtggccgtattccctaagcccctaattaccaggtttgtgcgaatcaagcccgccacctgggaaaccgggatctcaatgcgctttgaggtctacggctgtaagataactgattatccctgttccggcatgctaggcatggttagcggcctgatttcagactcacaaatcacctcttctaatcagggcgatcggaactggatgccggagaacattagattggttacctctagatcagggtgggctctgccccctgcaccgcattcttatataaatgagtggctacaaatcgatctgggagaggagaagattgtgcgtgggatcataatccagggtggtaagcatcgggagaacaaggtgtttatgcgcaagtttaagatcggctacagtaacaacggatccgactggaagatgattatggatgacagcaagcggaaggcaaaatcatttgaaggaaacaacaattacgacaccccagagctcagaacatttcctgctctgtccacccgtttcatccgaatttaccccgaaagggccacacacggaggtcttgggctccggatggagctattgggctgtgaggtcgaggggaccattaacaccgatcaagaatgcccctgcgctcgtgccctcgccaaagacgcgaagaagaagaagagatgggcagatagcacccattgtcgctgcgtgagaagcatccacggagagatgtggtcttctggcaaaggcgtttgttccctggacgcaaacctgtag

SEQ ID NO: 25282 - DNA, 567 bp, Artificial Sequence
  Description of Artificial Sequence: Synthetic coding sequence
atgagcgagatcatcctggagttcgagagcttcgacctggagcccgatagcaatccgcccgggggaatgttttgccgatatgacagacttgagatctgggatggctttcctgacgttggccctcacattggacggtattgtgggcaaaaaacacctggaaggatccgcagcagtagcggcatcctgtcaatggtattctacacagattccgcaatagctaaggagggattctccgccaattatagtgtactgcagagttccgtatctgaagacttcaagtgcatggaggccctaggaatggagagcggcgagattcactcagatcaaattactgcgtcatcacagtactccactaactggagcgcagaacgctctcggctgaattaccctgagaacggatggacccccggcgaagactcttacagggagtggatccaggacgccaaataccggctgcgggtgtccgtcgttagatcgaagtcatcttcctcgtctacatcccttgagccccgccccctctcttcactgaagctctcatttttctcttacaaaatcaagattacctag

SEQ ID NO: 25283 - DNA, 1830 bp, Artificial Sequence
  Description of Artificial Sequence: Synthetic coding sequence
atggagcggggcctgcccctgctgtgcgccgtgctggccctggtgcttgctcctgcaggagcttttcggaatgacaaatgtggtgacacaattaaaatagagagtccggggtacctgacgagtcctggctatccacattcctatcacccatccgagaagtgtgaatggcttatccaggcgcctgacccctaccagcggatcatgataaattttaatcctcatttcgatctcgaagatcgcgattgtaaatatgattatgtagaagtgtttgacggcgagaacgagaacgggcattttagggggaagttttgcggaaagatcgcacctccgcccgtagtttcaagcggaccatttcttttcattaaattcgtgagcgattatgaaacccacggcgcaggatttagcatccggtacgagatcttcaagcgagggccggagtgcagccaaaattacaccaccccatccggcgttattaagagccctggctttccagaaaaataccccaactcgttggaatgtacatatatcgttttcgtgccgaaaatgtccgaaattattctagagttcgaatcattcgacttagaaccggactcaaacccacccggcgggatgttttgcaggtatgatcgcctggagatctgggacggatttcccgacgtaggtccccatattggtcgctattgcggtcagaagacccctggcagaatccgaagctcgtctggcatcctcagcatggttttctacactgacagcgcaatcgcgaaggagggcttcagcgctaactactctgtacttcaatcctccgttagcgaggatttcaaatgcatggaggcccttggaatggaatccggagagatacattccgaccagatcaccgcctcaagccagtattccacaaactggagcgccgagcgatctcgcctgaactatccagagaatggttggacccccggagaggattcttatagagaatggatacaggtggatcttggattgctgaggttcgtcacagccgtgggcacccaaggtgccatcagcaaggagacgaagaaaaagtactacgtgaaaacatacaaaattgatgtgagctcaaatggagaagactggattacgattaaagagggaaacaagccagtcttgtttcaggggaacaccaacccaacagatgtcgtagtcgccgtgttccccaaaccccttattacaagattcgttcggatcaagcccgcgacttgggagaccggcatttcaatgcgcttcgaagtttatgggtgtaagattactgattatccatgctccggcatgctgggcatggtctctggactcatcagcgattcccaaattacctcttccaaccagggagacaggaactggatgcccgagaatattcggcttgtgacatccagatccggctgggccctcccgccagctcctcacagctacatcaacgaatggctgcaaattgatctgggcgaagagaaaattgtgagaggcatcattatacaaggagggaaacatagggagaacaaagtctttatgcgcaaatttaaaatcggctattcgaataacgggtcagactggaaaatgatcatggacgactctaaacggaaagcgaaatcttttgagggcaataacaattacgatacaccggaattgagaacttttcctgccctaagcacaagattcattcggatttaccccgagcgagcaacccacggaggtttgggattgcgtatggagctgctgggctgtgaagtggaggggggcaccactgtcctcgctactgagaaacccacagtcatcgatagtactatccagtcgggcataaaatag

SEQ ID NO: 25284 - DNA, 1935 bp, Artificial Sequence
  Description of Artificial Sequence: Synthetic coding sequence
atggagcggggcctgcccctgctgtgcgccgtgctggccctggtgctggcaccggctggcgccttccggaatgataaatgtggcgacaccataaaaattgagtccccaggatacctgacatctcccggttatccccactcttatcacccctctgagaagtgcgaatggctgatccaagcacctgacccctaccagagaattatgattaacttcaatccacatttcgatttagaagatcgggattgtaagtatgattacgtcgaagtcttcgacggcgagaatgaaaacggacacttccgaggcaagttctgtggcaagattgcccccccacccgtggtctcgtccgggcccttcctttttatcaagtttgtgagcgactatgaaactcatggcgccggtttttccatccgatacgagatcttcaaacgcgggccagaatgctcacagaattacaccaccccgagtggagtgatcaagtcacctggatttcctgagaagtacccaaattctctggagtgtacatacatcgtgttcgttcccaagatgtccgaaatcatcctcgagttcgagtcttttgacctggagccagatagcaatccgccaggcggaatgttctgcagatatgaccgcttggaaatttgggacggctttccagatgtgggaccccatataggacgttactgtggacagaaaaccccgggccggatccgatcgtccagcggaatactgtcaatggtgttttataccgacagcgcaatcgccaaggaggggttttctgccaattactcagtgctacagtcttccgtgtctgaagatttcaagtgtatggaggcgctgggaatggagagtggcgagattcatagtgaccagataactgcatccagtcagtattctacaaattggtcagcagagcggtcgcgtctgaattatcctgaaaacggttggactccaggtgaggactcttatcgcgagtggatccaggtcgacctgggtctgctcaggttcgtgaccgccgtgggcacacagggtgctatatcgaaggagactaagaagaagtactatgtcaagacttataaaatcgatgtttcatcaaatggagaagattggattacaattaaggaggggaataaacctgtcctcttccagggaaacacaaaccccactgacgtcgtggtcgctgtgtttccaaagcctctgataacccggttcgtccgcatcaagccggccacgtgggaaaccggtatcagcatgcgattcgaagtgtacggatgcaagatcactgattacccatgcagcggcatgctcggcatggtgagtggcctcatttccgacagccagataaccagctctaaccagggggacagaaattggatgcccgagaacatccggctggttacatctaggagtggttgggcgcttcccccagctcctcactcatatattaacgagtggctccaaattgacctcggagaggaaaagatcgtcagaggaatcataatccagggtggtaagcatagggaaaacaaggtgttcatgcgcaaattcaagatcgggtactcgaataacggctccgactggaagatgataatggatgactctaagcgtaaggcgaagagtttcgagggaaacaataattacgacaccccagaacttagaacgttcccagccctcagcactagattcatccgcatctaccctgagagagctactcatggaggccttggactgcggatggaactgttgggttgcgaagttgaagccccaaccgccggtccgaccactccaaatggcaacctcgtcgacgagtgtgatgacgatcaggccaactgtcattcggggacaggagatgatttccaactgaccggaggcactacagtgctcgccaccgagaaaccaacagtcattgatagtacaattcagtccggcattaaatag

SEQ ID NO: 25285 - DNA, 2115 bp, Artificial Sequence
  Description of Artificial Sequence: Synthetic coding sequence
atggagcggggcctgcccctgctgtgcgccgtgctggccctggtgctggcccctgccggcgccttccgcaatgacaaatgtggggacacgatcaagatcgaaagtcctggatacttaacttctcctggatatccccattcttaccaccccagcgagaagtgtgagtggctgatacaggctccggacccctaccaaagaatcatgataaacttcaatccgcattttgatttggaggacagggactgtaagtacgattatgtcgaagtcttcgacggcgaaaatgaaaacggtcacttccgcggaaagttctgtgggaaaatcgcaccaccgcccgttgtctctagtggtcccttccttttcatcaagttcgtcagcgattatgagactcacggagccgggttctctattcgttacgaaatatttaagcggggacccgagtgttcgcagaattacacaaccccatctggcgtgattaaatcgcctgggttcccggaaaagtacccgaacagcctggagtgtacatatattgttttcgtgcctaagatgagtgaaatcattctggaattcgaatcatttgatctcgaacctgattctaatcctcccggtgggatgttttgcaggtacgaccgccttgaaatctgggacggatttcctgacgtgggcccacacataggacgctattgcggccaaaaaacacctggccgaattcgaagcagtagcggcatcctgtccatggtcttctacaccgactctgctatcgctaaggaaggattttccgctaactattcagtgctgcagtccagtgtctcagaagactttaaatgtatggaggctctcggtatggagagcggagaaatacattcagaccaaatcaccgccagtagtcagtactcaaccaactggagtgccgagcgatcccggctcaactatcccgaaaacggctggactcccggtgaggatagttaccgagaatggatacaggtcgacctgggccttctgaggttcgtaactgccgtgggaactcagggggcaatcagtaaggagactaagaaaaaatattatgtgaagacctacaagatcgacgttagctcaaacggtgaggactggatcactataaaggagggtaataaacccgtgctgttccagggaaacactaatccaaccgacgtcgttgtggctgtgtttccaaagcctctgatcacgcggttcgtccgtataaagcccgctacctgggaaacaggcatctccatgcgctttgaggtatatggatgcaaaatcactgattatccgtgctcagggatgctgggtatggttagtggcctcatcagcgattcacagatcacttctagcaatcaaggggacaggaactggatgcctgaaaatatcaggctcgtgacgtcacgcagtggctgggcactccccccagcacctcacagctacatcaatgagtggctgcaaatcgatctgggagaagaaaaaatcgtccgtggcattattatacagggtggtaagcaccgcgaaaacaaagtctttatgaggaagttcaagatagggtacagcaacaatggtagtgactggaaaatgattatggacgactccaagcggaaggcgaaatccttcgaaggaaataacaactacgatacccctgagctgcgtacttttcccgcactgagtacccgcttcatacggatctatccagagcgggcgacccacggcggtttgggcctgaggatggagctcctgggctgcgaggtggaggcacctactgctggcccaacaacccccaatggtaaccttgtggacgaatgcgatgatgaccaggccaactgccattccggcaccggagacgactttcagcttaccggagccgagacaatattcattcccttgttatatcatttttccagttgcttgagctgggaccagcttacgcccgtgtgcgtgcttgtcaccccacacggccgggaactccctaggaaccggtcctgcttagctcggacccgcgcatcatcattcccccatgtcatatggattgatgagcttttccttatcgccaccaccatctgcaataacaacctctcccactttgaatcgcagcggctcgggttatcctag

SEQ ID NO: 25286 - DNA, 261 bp, Artificial Sequence
  Description of Artificial Sequence: Synthetic coding sequence
atggagctgctgggctgcgaggtggaggcccccaccgccggccccaccaccccgaatggcaacctagtggacgagtgcgacgatgaccaagctaactgtcactccggtactggtgacgactttcaattgaccggcgggaccacagtgctggctaccgagaaaccaacagtgattgactctactatccaaagtgcccggttagaggtatcaacactaaacctatctttgcataatccccctcagcagaaggccctgatatag

SEQ ID NO: 25287 - DNA, 2772 bp, Artificial Sequence
  Description of Artificial Sequence: Synthetic coding sequence
atggagcggggcctgcccctgctgtgcgccgtgctggccctggtgttagctcctgcaggtgcgttcaggaatgataagtgtggggatactatcaaaattgagtcgccgggctatttaacaagtccagggtatccccattcttaccatccctcggagaaatgtgaatggctgattcaagccccagatccatatcaacgcattatgatcaactttaaccctcacttcgatctggaagatcgcgactgtaagtatgattacgtggaggtgttcgatggagagaacgagaacggacactttcgcggaaagttctgtgggaagattgcaccccctcctgtagtctcatctgggccttttttgttcatcaaattcgtatcagattacgagacgcatggcgccgggttttccattcggtacgaaatttttaaaagaggcccagaatgctcccaaaattacaccacaccctctggagtcatcaagtcacctggcttcccagaaaaatacccaaatagtcttgaatgcacttacattgtgtttgtgcccaaaatgtcagagatcatcctagagtttgagtcctttgacctggaaccagacagcaatccccccggcggaatgttttgtcggtatgacagactggagatctgggatggcttccccgacgtgggcccacacattggaagatattgcgggcagaagacgcccgggaggattcggtctagctcaggaatactgtcaatggtgttttacacagactcagccattgctaaggagggtttctcagcaaattatagtgtccttcaatcttccgtgagcgaagacttcaagtgcatggaagctctggggatggaatccggcgaaattcattcagatcagattaccgctagcagtcagtactcgacaaactggtctgccgaaagatctcgactgaattaccctgagaatggatggacgcccggggaagatagttaccgtgaatggatccaagtggacctcggacttctccggttcgtcaccgcggtcgggacccagggagccatttctaaggaaacaaagaagaaatattatgttaagacatacaaaatagatgtctcctcaaatggcgaggactggatcaccattaaggaaggaaacaaacccgtgctgttccagggcaatactaatcctacggatgtggtggtggctgtctttcctaaaccactaataaccaggtttgtcaggatcaagccagccacctgggagacaggtatttctatgcgcttcgaggtatacggttgcaagattacagattatccttgttccgggatgctgggaatggtgagtggcctaatctcagacagccaaatcaccagctccaaccaaggagacagaaactggatgcccgagaatattcggttggtgacctcgcgctccgggtgggcactgccaccggccccgcacagctacatcaatgaatggttacaaatcgatcttggggaagaaaaaatagtgagagggataatcatccaggggggaaagcatcgcgagaacaaagtgtttatgcgaaaattcaaaatcgggtattcaaataacggctccgactggaagatgattatggacgacagcaaacggaaagctaagagcttcgagggtaacaataattacgacacccccgaattgaggacattcccagccctttctactcggtttattcggatttatcctgagcgcgctactcacgggggacttgggctcaggatggaattgctaggatgtgaggtggaagcccccacggcaggacccactacacccaacggcaacttggttgatgagtgtgacgatgaccaggcaaactgccactccggcaccggcgacgattttcagttgactggaggtactactgtcctcgccaccgagaaacctacagttatagacagcacaatacagtccgagtttccaacatacggatttaattgtgagtttggatggggatcccataaaacattctgtcactgggagcacgacaaccacgtccagctcaagtggtcagtccttacaagcaagacaggaccaatccaggatcacactggagacggtaacttcatctactcacaagccgacgaaaaccagaaggggaaagtcgcgagactggtgagtcctgttgtgtactctcaaaattccgcccactgtatgactttttggtaccatatgtcaggaagtcacgttgggaccttgagggtgaagctacggtaccagaagcctgaggagtacgatcagctcgtctggatggccattggccaccagggggaccattggaaagaaggacgggtactgctccacaagagtttaaagctgtatcaagtgatcttcgaaggagagattggcaaagggaatctagggggcatcgctgttgacgacatcagcatcaataaccatatctcacaagaggattgtgccaaaccagccgatttagacaagaaaaaccctgagattaaaattgacgagacagggtcaaccccgggctatgagggcgagggcgaaggcgacaagaatattagtaggaaaccaggtaacgtccttaagaccttagaccccatcttgatcaccataattgcaatgagcgctttgggtgtcttactgggggcagtttgcggtgtggtactctactgtgcatgctggcacaacggcatgagtgaacgcaatttgagtgctctggagaattataactttgaactggtagacggagtgaaattgaagaaggacaaattgaatacacagtccacttactccgaggcttag

SEQ ID NO: 25288 - DNA, 2208 bp, Artificial Sequence
  Description of Artificial Sequence: Synthetic coding sequence
atgagcgagatcatcctggagttcgagagcttcgacctggagcccgattcaaatccaccaggaggtatgttttgccggtacgaccggctggagatttgggacgggtttcctgatgtcggaccccatattggaagatactgcggccagaaaacaccaggaaggattcgatctagttcaggcatcttatccatggtcttttacaccgacagcgccatagccaaggagggttttagcgcgaattatagtgtactgcagagctcagtgtccgaggactttaaatgcatggaagctctgggcatggaatccggcgaaatccactccgatcaaatcacagcctctagtcagtactccaccaattggagtgccgagagaagccgactgaattatcccgaaaacggctggacccctggggaggactcctaccgagagtggatccaggtcgatctgggacttcttcgttttgtcactgccgttgggacacagggggctatctcaaaagaaactaaaaagaaatactacgtaaaaacatataaaattgacgtgtccagtaacggcgaggactggatcacaattaaggaggggaacaaacctgtgctcttccagggaaataccaaccccactgatgttgtagtggctgtgttccctaagcccctgataacaaggttcgtgcgaatcaagcccgctacttgggaaaccggcatcagcatgcggtttgaagtctacggatgcaaaattacagattacccctgtagtggtatgctgggtatggttagcggcctcattagcgactctcagataacaagcagcaatcagggagaccggaactggatgcccgaaaacattagactcgtgacctcccggtcaggttgggcccttcccccagctcctcactcatatattaatgagtggcttcagatagacctaggggaggaaaaaattgtgagaggcattatcatccagggaggaaaacacagggaaaacaaagttttcatgcgaaagtttaaaattggttattccaacaacggctccgactggaaaatgattatggatgactcaaaacggaaggctaagagttttgaaggtaacaacaattatgacactcccgaactgaggacattccccgccctgtccacccgattcatccgcatctatcctgaaagggccacccacggagggctgggactgagaatggagctgctgggatgtgaggtggaagctcctaccgccggacccactaccccaaacggcaatttagtcgacgagtgcgacgatgaccaagccaactgccatagcggcacagggggaaccaccgtcctggccactgagaaacccaccgtaattgattccaccatccaatctgagtttcccacttatgggttcaattgcgagtttggatggggatcgcacaaaactttctgtcattgggagcacgataatcacgtacagctaaaatggagcgtcctgacaagtaaaaccggaccgatccaagaccacactggagatggcaactttatatactctcaagcagatgaaaatcaaaaggggaaagtggccagattggtctcacccgtggtctactcacaaaattctgcacactgcatgactttttggtatcatatgagtggttcccacgtggggactctccgcgtgaaactgagatatcagaagcctgaggaatatgatcagctcgtgtggatggcgatcggacaccagggggatcattggaaggagggccgggtgctactccacaagtcactgaaactatatcaagtcatctttgagggagaaataggcaagggcaacctgggaggtattgctgtggatgacatctccattaataatcacatatctcaggaggactgcgctaagcctgccgatcttgataaaaagaaccccgagattaaaatagatgagaccggcagcacacccggatacgaaggagaaggtgaaggcgacaagaatatctcccggaagccagggaatgtgctcaaaacgctggatcccatactaatcaccattatcgcaatgtcagcgctgggagtcttgctgggagccgtttgcggcgttgtgttgtactgcgcttgttggcataatggcatgagcgagcgcaatctgagcgcactcgaaaactacaactttgaactggttgatggagtcaagctgaaaaaggataagcttaatacccaaagtacttattctgaggcatag

SEQ ID NO: 25289 - DNA, 2721 bp, Artificial Sequence
  Description of Artificial Sequence: Synthetic coding sequence
atggagcggggcctgcccctgctgtgcgccgtgctggccctggtgctagctccagcgggggcgttcaggaatgataaatgtggggacacaatcaaaatagagtcgccgggctacctgactagtcctggttatccccacagttaccatccctcagagaagtgtgagtggctgatccaggcgcctgatccttaccagcgtatcatgatcaatttcaatccacacttcgatttggaggatcgcgactgcaagtatgattacgtggaggtgttcgatggtgagaacgagaatggtcactttcgcggaaagttctgcgggaagatagctcccccaccggtggtctcatcaggtcctttcctgttcataaagttcgtgagcgactatgaaactcacggcgccggcttcagtataagatatgaaattttcaagagagggccagagtgcagtcagaattataccacccccagtggcgtcatcaaatcgccgggtttccctgaaaaatacccgaattctcttgaatgcacgtatattgtcttcgtgcctaagatgtcagaaatcatcctagagttcgagagctttgacctggagccagatagcaatcccccaggaggcatgttctgcaggtatgatcgactggagatttgggatgggtttccagatgtgggtccccacatagggcggtactgcgggcaaaagactcccggtaggatccgatcatcctccggaatcctgtccatggtcttttacacagattccgcaattgccaaagagggttttagtgctaattattcagtccttcagtcttccgtgtccgaggactttaagtgcatggaggccttaggtatggaatccggggagattcacagtgaccagatcactgcatcttcacaatattccactaactggagtgcagagaggtctaggctgaactaccctgaaaacgggtggacccccggtgaagatagttatagagaatggattcaagtcgacttgggcttgcttcgctttgttactgcagtgggtacccagggagctatctctaaagagaccaagaagaagtattatgtgaaaacatacaagatcgacgtgtcttccaatggggaagactggatcaccatcaaagagggaaacaagccagtgctgtttcaaggtaacacaaacccgactgacgtcgtggtggctgtgtttcctaaaccactaatcactcggtttgtgcgcatcaagcctgcgacgtgggaaacaggcatttccatgcgtttcgaagtctatggatgcaagatcacggactacccctgcagtggcatgttaggaatggtgtctggtctcatcagtgattcccagattacctcatccaatcagggcgaccggaattggatgcctgaaaacattagacttgtgacctcccggagtgggtgggccctccctcccgctcctcattcctatatcaatgaatggcttcagatcgacttgggcgaggagaagattgtgagaggaatcattattcaaggcggaaaacatcgtgaaaataaggtgtttatgaggaagtttaagattggttactccaacaacggcagcgattggaaaatgatcatggatgattcaaaaaggaaagcaaagagctttgaagggaataataattacgacacccccgagctgaggacttttcccgccctctctacgcgtttcatccgcatttacccagagagggcaactcatggcgggctgggtttgcggatggagctacttggatgcgaggttgaggcacccacagctggacctactacccccaacggcaatctggtggacgaatgtgatgatgatcaagccaactgtcacagcggcaccggcgatgattttcagcttaccggagggacaacagttctcgccactgagaaacccactgttatcgactcaacaatccagagtgaatttcccacatacggatttaactgcgagttcggttggggtagccacaagacgttttgtcactgggaacacgacaaccatgtgcagttaaaatggtcagtgttgacctctaagactggccccatacaggatcacaccggcgacgggaacttcatttacagccaggctgacgagaatcagaaagggaaagtggctaggctcgtgtcccccgtggtttactctcagaacagcgcccattgtatgaccttctggtaccacatgtcgggtagccatgtgggtactctgcgagttaagctgaggtatcagaaacccgaagaatatgatcagttagtatggatggccatcggacaccagggcgatcactggaaagagggccgcgttctcctgcataagagtctaaagttatatcaggttattttcgagggtgagatcgggaaaggaaatctcggaggcatcgctgtggatgacataagcattaataaccacatatcccaggaagattgtgctagatcaacgcctggttatgagggggaaggcgagggcgacaagaatatttccaggaaacccggcaacgttcttaaaactcttgacccgatactaataactatcatcgctatgtctgctctaggagtgctgctaggggccgtgtgcggcgtcgtcctctattgcgcctgctggcacaatgggatgtcggaacgcaacttgagcgctctcgagaactacaattttgaactggtagacggcgtgaagctaaagaaggataagctcaatacccagtccacgtatagcgaggcctag

SEQ ID NO: 25290 - DNA, 318 bp, Artificial Sequence
  Description of Artificial Sequence: Synthetic coding sequence
aaccacatcagccaggaggactgcgcccggagcacccccggctacgagggggagggcgaaggggacaagaacatcagcaggaaacctggcaacgtgctcaagacattggaccctattctgatcaccattatcgctatgagcgccttgggcgtcctgttgggcgcggtgtgcggcgttgtgttgtactgtgcatgctggcacaacggcatgtccgaacggaacttgagtgctttggagaactacaattttgagctcgtagacggagtcaagctgaaaaaagataaactgaatactcagagcacgtactcggaagcttag

SEQ ID NO: 25291 - DNA, 234 bp, Artificial Sequence
  Description of Artificial Sequence: Synthetic coding sequence
tgacccaccgccggccccaccacccccaacggcaacctggtggacgagtgcgatgatgaccaggccaactgtcacagcggaaccggggatgattttcagttaaccggcggcactacagtcttagcaacagagaaaccgaccgtgatcgattccaccattcagtccgcccgactggaggtgagcaccctcaacctgtctctccacaacccacctcagcaaaaggcactgatctag

SEQ ID NO: 25292 - DNA, 303 bp, Artificial Sequence
  Description of Artificial Sequence: Synthetic coding sequence
tgaacccacggcggcctgggcctgcggatggagctgctgggctgcgaagtagaagccccaaccgctggacccactacacccaatgggaatctcgtggacgagtgcgatgacgatcaggccaactgccatagcggaactggagacgacttccagcttaccgggggaaccaccgtgctggccaccgagaaacctactgtgattgactccacaatccaaagtggcagcagattttttaaacaccaccataaacagcagtccatgcggcctcagaacttgcaccataactcaatcctgctgctctag

SEQ ID NO: 25293 - DNA, 711 bp, Artificial Sequence
  Description of Artificial Sequence: Synthetic coding sequence
gtggacctgggcctgctgcggttcgtgaccgccgtgggcacccagggcgccatctctaaggagaccaagaagaagtactacgtcaaaacttacaagatagacgtgtcttctaacggagaggactggattaccattaaggaaggtaataaaccggtactgtttcagggaaacactaaccccaccgacgttgtggtggcagtcttcccaaaacccctgataactagatttgtgcgaataaaacccgccacctgggagaccgggatttctatgagatttgaagtgtatggctgtaaaatcactgattacccctgtagcgggatgttgggtatggtcagtggactgatctcggacagtcagatcactagttcaaatcaaggggataggaactggatgcctgagaacataaggctcgtgacctctcggtcaggatgggctctgccccccgcaccccattcttacattaacgaatggttacagatagatcttggcgaagaaaaaatcgtgaggggtatcattatccagggaggaaaacatcgggaaaataaagtgttcatgcggaagtttaaaataggctatagtaataatggaagcgactggaagatgatcatggacgacagtaagcgcaaggcaaaggttagagcaggggattgggaggaagtgatcccatatgttttggactttaaccagggccccctggccttctcccgctag

SEQ ID NO: 25294 - DNA, 513 bp, Artificial Sequence
  Description of Artificial Sequence: Synthetic coding sequence
tgacccggcggcatgttctgccggtacgaccggctggagatctgggacggctttccagatgtggggcctcacattggccgctactgtggccaaaagaccccaggacggatccggagctcatcaggtatcctgtctatggtcttctatacagattctgcgatcgctaaggaggggttttctgcaaattacagcgtgcttcagtcatctgtctcagaggatttcaagtgtatggaggcattaggcatggaatcaggagagatacattcagatcagataacggcgtcctctcagtactcaaccaactggagcgctgagcggtcgaggctgaattaccccgagaatggatggacgcccggagaggactcctacagagagtggattcaagatgccaagtatagactcagagtatctgtggtgcgaagcaagtcaagctcatcaagtacctctctggagccacgcccactatcatccttgaaattgtcctttttttcttataaaattaagattacatag

SEQ ID NO: 25295 - DNA, 2721 bp, Artificial Sequence
  Description of Artificial Sequence: Synthetic coding sequence
atggacatgttccccctgacctgggtgttcctggccctgtacttctcccggcatcaggtgagaggacagcctgatcccccctgcggcggccgcctcaattccaaggacgccggctatattacatcaccaggctaccctcaggactacccttctcaccagaactgtgagtggatcgtctacgcgccagagcccaatcagaagattgtgttaaatttcaacccccattttgagatcgagaaacacgattgtaaatacgatttcatcgagatcagagatggcgatagcgagtctgccgacttacttggtaagcactgcggaaacatcgccccgccaaccattatcagctcgggctcaatgctctacattaggtttacaagcgattatgcgaggcagggtgctggctttagtttgcgctacgagatcttcaagaccggctccgaggattgtagtaagaactttacttctccaaacgggacaatcgaaagtccaggcttccccgagaaatacccccataatttagactgcacgttcacaattctggctaagccaaaaatggaaataatattacaatttctgatctttgacctagagcacgacccccttcaggtaggcgaaggtgattgtaagtacgattggctcgacatctgggatggtatcccccatgtgggcccactgatcgggaagtattgcggtacgaaaactcccagtgaactgagatccagcactggaatcctgtcgctaacctttcatacagatatggcagtggccaaagacggattttctgccagatactacctagttcaccaagagccgctcgaaaatttccagtgcaacgttccgctgggcatggagagtggccggattgcaaatgagcagatctcggcgagttcaacatactccgatgggaggtggacacctcagcagagcagactgcacggcgacgacaatggttggaccccgaacctcgacagtaacaaagagtatctgcaggtggatttgagatttctgacaatgctcacagcaatcgccactcagggcgctatctcgagggagacgcagaacggatattatgtaaagtcatataagttagaggtgagtactaacggcgaagattggatggtgtatcgccacggtaagaatcacaaagtctttcaggcaaataatgacgcaacggaagtggtgttgaataagttgcatgcccccttactaacaaggtttgtgcgcattcgacctcagacttggcactctgggatagcgctgcggctcgaactcttcgggtgtagagttactgacgcaccatgttccaatatgcttggcatgctgagcgggttgatagccgactcccagatctctgcatcttccactcaggagtacctgtggagtccctccgcggcccggctggttagctcccgcagcgggtggttcccccggatcccacaagcccagcctggcgaggaatggttacaggttgatctcggcacaccaaagaccgttaagggcgtaattattcagggagcacggggcggagacagcatcacagccgtagaggcgcgagccttcgtgcgcaaattcaaggttagttatagcttaaatggaaaggactgggagtacattcaggatcccaggacacagcagccaaagctattcgagggtaacatgcattacgacactcctgacattcgaaggtttgacccaatcccagcccagtatgtgcgggtctaccctgaaaggtggagccccgcaggaataggtatgaggctcgaggtcctgggatgcgactggaccgactcaaagcccacagtggaaacactcggccccaccgttaagtccgaagaaactactactccctatcccacagaagaagaagccaccgagtgcggcgagaactgttccttcgaggatgataaggacctgcagcttcctagcggcttcaactgtaacttcgatttcctggaggagccttgtggatggatgtatgaccacgcaaaatggctgcgaactacgtgggcaagtagctccagcccgaatgataggacttttcctgatgatagaaactttttaagactgcagtctgacagtcaaagggagggccagtacgcccgactcatatccccgcccgtgcacttaccccgatcaccagtttgcatggagtttcagtaccaggccactgggggtaggggcgttgcactgcaggtggtgagggaggcttcccaggagtctaaactgctttgggtgattagggaggatcagggaggagagtggaagcacggacgcattatcctgcccagctatgacatggaataccaaatcgtttttgagggggtgatcgggaagggaaggtccggggaaatagccattgatgacattagaattagcactgacgttccactcgagaattgtatggaaccaatttcagctttcgccggcgaaaacttcaaagggggtacgctgcttcctgggacagaaccaaccgtagatacggtgcctatgcagcccataccagcctattggtattatgtcatggcggccggtggtgccgtgctcgtcctagtatcggtggcactggcactggtgttacactaccaccgcttccggtatgcagccaaaaagaccgatcattcaattacctacaagacaagccactatactaacggcgcacccctcgcagttgaacccactttaacaattaagctggagcaggaccgtggctcccattgttag

SEQ ID NO: 25296 - DNA, 300 bp, Artificial Sequence
  Description of Artificial Sequence: Synthetic coding sequence
atggacatgttccccctgacctgggtgttcctggccctgtacttctcccgacatcaggtacgcgggcagccagatcctccctgcggcggccggttaaatagcaaggacgctggctacataacatcacccggctatccccaggactatccctcccatcagaattgtgaatggattgtgtacgcacccgagccaaatcagaagattgtactgaatttcaatcctcattttgagatcgaaaaacatgattgtaacttgctgtccgcatggaagatctccctgacgtcacgcagctttgcttag

SEQ ID NO: 25297 - DNA, 1668 bp, Artificial Sequence
  Description of Artificial Sequence: Synthetic coding sequence
atggacatgttccccctgacctgggtgttcctggccctgtacttctccagacaccaggtgcgaggtcagcctgatccaccctgcggagggcgcctcaactctaaggatgccggctatataacctcacccggctatccacaggattacccaagtcaccagaattgcgaatggattgtgtatgcccccgaaccgaatcaaaagattgtcctgaactttaatccccacttcgagattgagaagcatgattgtaagtacgattttattgaaattagggatggggactccgaaagtgctgatctactgggcaagcattgcggcaatattgctcctcccaccatcatctccagtgggagtatgctgtacattcgtttcaccagcgactatgctcggcagggcgctggcttttcactccgctacgagattttcaagactggttctgaggattgctctaagaacttcacctccccaaacggtaccatcgagagccccggatttcctgagaagtacccacacaatttagattgcacttttactatccttgccaaaccaaaaatggagatcatcctgcagtttctcatctttgatctggagcatgaccctctgcaggtgggagagggcgactgtaaatacgattggcttgatatatgggacggaatcccacatgtgggccccctcatagggaagtattgtgggaccaagacgccttctgagctacgctcctccaccggaatattgagcctgacctttcatacggacatggcagtggccaaggacggcttctctgcacgctactacctcgttcaccaagagccccttgaaaatttccagtgcaacgttcctctcggcatggaaagcggtaggatcgctaatgaacaaattagtgcaagctcaacatattctgatgggcgttggaccccccagcaaagtaggctacacggcgacgataatggctggacccccaatttggattccaacaaagagtacctacaggtggatctaaggtttcttaccatgctgactgccatcgctactcagggcgcaatttctcgggagacacagaacggatactatgtcaagtcctacaagctcgaggtttccactaacggcgaagattggatggtgtatcggcatggcaaaaaccataaggtgtttcaggccaataacgatgccactgaagtggtgctaaacaagctgcatgcccctctgctgacccgcttcgtgcgaattcgcccacagacgtggcacagtggtattgccttgcgcctggagttgtttgggtgcagggtgacagacgctccgtgtagtaacatgctgggaatgctttcaggacttatcgccgacagtcagatctctgctagctccacccaggaatacctttggagtccatccgccgccaggttggtgtccagccgcagcgggtggttccctcggatcccacaagcacagcctggggaggagtggctgcaggttgacctggggacgcctaagactgttaaaggggtcatcattcagggcgccagagggggggatagcatcacagcagtggaagcccgagctttcgtaagaaaattcaaagtgtcttactcccttaacgggaaagattgggagtacattcaagaccccaggactcagcagcctaaagtggggtgcagctggcgcccactgtag

SEQ ID NO: 25298 - DNA, 2706 bp, Artificial Sequence
  Description of Artificial Sequence: Synthetic coding sequence
atggacatgttccccctgacctgggtgttcctggccctgtacttcagtaggcatcaggtacgggggcagccagaccctccctgcgggggccgcctcaactccaaggacgctggttacattacatctccaggctacccacaggattatccatcccaccaaaattgcgagtggatcgtctatgcccccgaaccgaatcagaaaattgtgctgaattttaaccctcatttcgaaatagagaaacatgattgcaaatacgacttcatcgagatccgggacggcgattcagagtctgccgacctgcttggcaaacattgcggcaatatcgccccacctaccatcatatcctctggatccatgctctatatcaggtttacgagcgattacgcgcgccagggagccggattctcactgcgttacgagatattcaagactggctctgaagattgttctaagaactttaccagccctaacggcacgatcgaatccccaggatttccggaaaagtacccccacaatcttgactgtacattcaccatcctggctaagcccaaaatggagattatactgcagtttctgattttcgacctggagcacgatccactgcaggtgggcgagggggattgtaaatacgactggctggacatctgggacggcattccacatgtgggacctctgatcggaaaatattgtggaaccaagacccccagcgagttacgaagttccacaggcatcctatctttgacgttccataccgacatggcggttgcaaaggatggtttctccgcacgctattacttggtccatcaggagccactagaaaattttcagtgtaatgtcccgcttgggatggagtctgggcgcatcgccaatgagcagatctccgcctcatcaacgtactccgatgggcgctggaccccacagcagtcacggctccacggtgacgataatggctggacacctaacctggacagcaataaggagtacttgcaagtcgatctccgctttctgaccatgcttacagcaatagctactcagggggcaataagccgggagactcaaaacggatattatgtcaaatcttacaagctcgaggttagcactaatggagaggattggatggtttaccgtcatggaaaaaatcacaaggtgttccaagcaaataatgacgctacggaagttgtgctgaacaaactgcacgctccactgttaacaaggtttgtgcgtatccggcctcagacctggcatagcggtatagccctccgcctggagttgttcggctgtagggtgaccgacgccccctgctccaatatgctggggatgctaagcggacttatagccgacagccagatctcagcctcttctactcaggagtatctgtggtctccgtcggctgcccggctggttagctctcggtccggctggttccctcgcattccccaggcgcagccaggggaggagtggcttcaggtggacctgggtacacctaagacagtgaagggggttattatacagggcgccaggggtggggactccatcactgctgtggaggcccgagcattcgtgagaaagtttaaggtttcctatagtttgaacgggaaagattgggagtacatccaggaccctaggactcagcagccgaaactctttgagggcaatatgcactacgacacccctgatatcaggaggtttgatccaatccctgcacaatatgtcagagtgtatccagaacgctggagcccagctgggattggaatgcgcctcgaggttttaggttgtgattggacagacagcaaacccacggtggaaacactgggacccactgtgaaatccgaagagactacaaccccctatccgactgaggaggaagcaacagagtgcggagagaactgctctttcgaggatgacaaggatttgcagctgccatccggctttaactgcaattttgactttctagaagagccctgcggctggatgtacgaccacgccaagtggctacgcacaacctgggcaagctcctcttcgccaaatgatcgaacatttccagatgatcgcaactttttgcgtcttcagagcgattctcagagggaaggtcagtacgccagattgatcagtccacccgtccacttgccaaggtctcctgtctgtatggagtttcagtatcaggcgaccggggggcggggcgttgctctccaagttgtgcgggaggcatcacaggaatccaagctcctatgggtgattcgtgaagatcagggcggggagtggaaacacggccgtattattctgcctagctacgatatggagtatcagattgtgtttgaaggcgtcatcggaaaaggtcgatcaggcgagattgccattgacgacatcaggattagtactgacgtccccctggagaactgcatggagccaattagcgccttcgcaggcgggacacttctacccgggacggagcccacagttgacacggtgcccatgcagccaattcctgcatattggtactacgttatggctgccggaggtgccgtgcttgtcctagtgtccgtcgcacttgcgctcgtgctgcactatcaccgcttccggtatgccgcaaaaaagaccgatcactccattacatacaagacctctcattatacgaatggcgctcccctggccgtggagcctacactcacaattaaactggaacaggatagagggagccactgttag

SEQ ID NO: 25299 - DNA, 2781 bp, Artificial Sequence
  Description of Artificial Sequence: Synthetic coding sequence
atggacatgttccccctgacctgggtgttcctggccctgtacttcagtcggcaccaagtgagagggcaacccgacccaccctgcgggggtcgacttaactccaaggacgctggatatatcacttcccccgggtaccctcaggactatcccagtcatcaaaattgtgaatggattgtctatgcccccgaacctaaccaaaagatcgttctgaacttcaatccacacttcgagatagaaaaacatgactgcaagtacgactttatcgagattcgggacggggattccgagagtgccgacctgttggggaagcattgcggcaacattgctcctcccacaatcatcagcagtggatccatgctgtatatccgttttacctccgattacgccagacagggagccggcttctcactgcggtacgaaattttcaagactggtagtgaggactgctccaaaaatttcacaagtccaaacggtacgatcgaaagtcctggcttccctgaaaagtacccacataacctggactgcacattcaccattttagcaaaaccaaagatggaaatcatcttgcagtttctaattttcgacctggagcacgatcctctccaggtaggcgaaggcgattgcaagtatgactggttggacatttgggacgggatccctcacgttggccctctaattggcaaatattgtggtactaagacaccgagcgagttgcggagctcaactgggatcttaagcctcacattccatacagatatggctgtggccaaagacgggttcagcgctcgttactatctcgtccaccaagagccactcgagaattttcagtgcaacgtgcccttagggatggagagcggccgcatcgcaaatgagcagatctcagcatcaagtacgtattcagacggaagatggaccccacagcagtcacgtttacatggggacgataacggctggactcccaaccttgattcaaataaagagtatctgcaggtcgacctccgatttttgaccatgctcactgcgatcgcaacccagggagccatcagtcgcgagacacaaaacggctactacgtcaagagctacaagctcgaagttagtaccaacggggaggactggatggtgtatagacacggaaaaaatcacaaggtgttccaggctaacaacgatgctactgaggtcgttctcaataagctccacgctccattgctgaccaggtttgtgcggattcgcccccagacttggcactcaggtatagcactccgtttggagctgtttggctgtcgggtaaccgacgccccctgttctaacatgttagggatgctctctgggctgatcgcagactcccagatcagcgctagttccacccaggagtatctgtggagccccagcgctgcgcgccttgtgagttcacgctctggatggttcccaaggattcctcaagcacagcctggggaagagtggctgcaagtcgatttgggaacgcccaaaacagtgaaaggcgtgattatacagggcgctcggggtggcgactctataactgcagtcgaagccagagcctttgttcgcaagttcaaggttagctatagcttgaatggaaaggactgggagtatatccaggaccctcgcacacaacaacctaagctgtttgagggcaacatgcattacgataccccagatatccgccggttcgatcctatacccgcacaatatgtgagagtgtatccggagagatggagcccggcaggcatcgggatgcgcctggaggtgctcggatgtgattggaccgacagcaagccgaccgtggagacgctcggccccaccgtgaaatctgaagagactaccacaccttatcctacggaggaggaagctacagagtgcggggagaattgcagctttgaggacgacaaggacctgcagctgcctagcggctttaactgcaatttcgacttcttggaggaaccctgcggctggatgtatgatcatgcgaagtggctgagaaccacctgggcttctagttcttctccaaatgatcgtacctttcccgacgatcgaaactttttgaggttgcaaagtgattcacagagagagggacaatacgcacgtctgatttcccccccagtccacttgccgcgatcaccagtgtgtatggaattccagtaccaggccactggaggtcggggagtggctctccaggtcgtacgtgaggcgagccaagagtcaaaactgctgtgggttatccgcgaggaccaaggaggtgaatggaaacacggcaggatcattctccccagttatgacatggaataccagatcgtgtttgaaggggtgattgggaaaggcagatcaggtgaaattgcaatagatgacattcggatttctacagacgttccgttggaaaactgcatggagcctataagcgccttcgcagtggatataccagagatccatgaacgggaaggctacgaagatgagatcgatgacgaatacgaagttgactggtctaattcttcctcggcgactagtggatctggcgccccatccaccgataaggagaaatcatggctgtacactttggacccaatactcattaccatcatcgcgatgtcatccttgggcgtgctgctcggcgccacctgtgctggtctattactgtactgcacatgctcctacagtggactatcatcacggtcatgtactacactggagaattataactttgagctgtatgacggactcaagcacaaagtgaaaatgaaccatcagaagtgctgtagcgaggcgtag

SEQ ID NO: 25300 - DNA, 2796 bp, Artificial Sequence
  Description of Artificial Sequence: Synthetic coding sequence
atggacatgttccccctgacctgggtgttcctggccctgtacttcagccgacaccaggttcgaggccagcccgatcccccttgtggagggcgcttgaattcgaaggatgctgggtacattacatccccgggatacccacaggattatccaagccatcaaaactgtgagtggattgtatacgcaccagagcccaaccagaaaattgttcttaattttaacccgcattttgagattgaaaaacacgactgtaaatacgactttattgaaatccgcgacggcgactccgaatccgctgatctgctgggaaaacattgtggcaatatagccccaccaaccattatttcctccgggagtatgctgtacatccgctttaccagcgactacgctcgacagggagctggcttctcccttagatacgaaatcttcaaaaccggaagcgaggattgcagcaagaacttcacgtcaccaaacggaaccattgaatccccaggattccccgagaaatatccgcataatctagactgtacattcacaatactggctaaaccaaagatggaaattattcttcagttcctgatctttgacctggaacacgaccctttgcaagtgggcgagggggactgcaaatacgactggctagacatttgggacggtatcccgcacgtggggcctttgatcggcaagtattgcggcacaaagacaccatcagaactcagatctagtactggaatcctttcactaacttttcacactgatatggcggtcgctaaggacgggttttctgctaggtattatctcgtgcaccaggaacccctggagaatttccagtgtaacgtgcccctcggcatggaaagtggacgcattgccaacgagcaaatcagtgcttcatcgacttactccgatggtcgctggaccccccaacagagcaggctacacggggatgataacggatggactccaaatctggattcaaacaaagagtatttacaggtagacctgaggttcctcaccatgctgacggcaatagcaacgcagggagccatcagccgtgagacacaaaacggctactatgtgaaatcatacaagcttgaggtatccacgaatggggaagattggatggtttaccgtcatggtaaaaaccacaaggtgttccaagccaataacgacgccactgaggtggtcctgaacaaactccatgctcctctcctgacaaggtttgttaggattaggccccagacatggcactccggaatcgccctgagactggagctttttggctgccgggtaaccgatgcgccatgtagcaatatgctcggaatgctcagcgggctgatagcagatagccagatttccgcctccagcacgcaggagtacctctggagcccctctgccgccagactggtcagttcccgatcagggtggttcccgcgcatcccccaagcgcaacccggggaggagtggttgcaggtggatctgggaacgcccaaaaccgtgaaaggcgtaatcatacagggggcacggggaggcgatagcatcaccgccgtcgaggcaagggctttcgtcagaaagttcaaggtgagctatagcctgaatgggaaggactgggaatacattcaggaccctcgcactcagcagcctaaactttttgaggggaacatgcactacgacacaccagatattcgcagatttgatcctattcccgcccaatacgtccgggtgtatccggagagatggtccccagcaggcatcggcatgcgactcgaagtgctgggctgcgattggacagactcaaaacctacagtagaaactcttggccctactgtaaaatcagaagagaccactactccataccctacagaggaggaagcgacagagtgcggcgagaactgctcttttgaggatgataaagacctgcagctaccctctggatttaactgcaatttcgatttccttgaagaaccgtgtgggtggatgtacgatcatgcgaagtggctacgcacaacgtgggcatcctcttccagcccaaatgatcgcacctttccagacgatagaaattttctgcgcttacagagtgacagtcagagagagggccaatatgccaggctcatatccccgccagtgcaccttcctagatctccggtgtgcatggaattccagtatcaggcaactggcggcaggggtgtggccttgcaggtagtgagggaagcttctcaggagtctaagctcctatgggtgatcagggaagatcaggggggcgagtggaagcacggccggatcatactgcctagctatgatatggagtaccagattgtgtttgagggtgtcattggcaagggccgctccggggagattgctatcgacgatatccggatttctactgacgtgcccctcgagaactgcatggaacctatatccgcctttgcaggagagaattttaaggtggacatccccgagattcacgaaagggaaggttatgaagacgagatcgacgacgagtatgaggtagattggagtaactcatcgagtgctaccagtggctctggcgcaccttcaacagacaaggagaagtcatggctctacaccctcgaccccatccttattactatcatcgccatgagctcccttggcgtgttactcggcgctacctgcgctggactgcttttatattgtacttgtagctattccggcttgtcaagccgcagctgcacaaccttggagaactacaatttcgagctgtatgatggattgaaacataaagttaagatgaatcaccaaaagtgctgttccgaagcctag

SEQ ID NO: 25301 - DNA, 2730 bp, Artificial Sequence
  Description of Artificial Sequence: Synthetic coding sequence
atggacatgttccccctgacctgggtgttcctggccctgtacttcagccggcatcaggtgcgggggcaaccggacccgccttgtggtggacgtttgaactctaaggacgccggttacattacctctcccgggtaccctcaggattatccttcccaccagaattgcgagtggattgtctacgccccagaaccgaaccaaaagatcgtcctcaatttcaatccacatttcgagatcgagaaacatgattgtaagtatgacttcattgagatcagggatggggactcggaatctgccgatcttctcgggaagcattgcgggaacatcgctccaccaactataatctctagtggaagcatgctgtatattaggttcacatcagattatgctaggcagggagcaggcttctctttaagatacgagattttcaagaccggttctgaagactgcagtaagaactttacatctcccaacggtacaattgaaagccctggatttcccgagaagtacccacacaatcttgactgcaccttcaccattctggccaagccaaaaatggagattatcctgcagttcctaatttttgacctggaacacgatcctctgcaggtgggagaaggcgattgcaagtacgattggctcgacatctgggatggaatcccccatgttggacccctcattgggaaatactgcggaaccaagacaccatccgagctgagaagctcaacgggtatactatcactaactttccatacagacatggccgtggcaaaggacggctttagtgccaggtactacttagtgcatcaggagcctctcgagaatttccagtgtaatgtgcccctcggcatggagtccggaagaattgccaacgaacaaatctctgccagctctacttattcggacggccggtggacaccgcaacagagcaggttgcatggggatgacaacgggtggactccaaacctggattcgaacaaggaataccttcaggtagatctgagattcctgaccatgctgaccgccattgccactcaaggcgccatttctcgggaaactcagaacggctactatgtgaagtcttacaaactggaggtgtccactaacggcgaagactggatggtgtataggcatggcaagaaccataaggttttccaagcaaacaatgacgctacagaggtggttcttaataagttacacgcaccactgctaacccggttcgtaaggatcaggcctcagacatggcactcaggtattgccctgcggctggaactgttcggatgccgtgtcaccgacgctccatgctccaacatgctcggcatgctgagcggattaattgcagacagccagatctctgccagcagcactcaagagtatctgtggagcccttccgctgcaaggctcgtgtccagccggtcaggatggtttcctaggattccacaggctcagccaggggaagagtggctccaggttgacctgggtaccccaaaaaccgtaaagggggtgattattcaaggtgctcgcggaggcgacagtattacagcagtcgaagcaagagcgtttgtccgcaagtttaaagtgagctactccctgaacgggaaagactgggaatacatccaagatccgcgaacgcagcagcccaagctgtttgagggaaacatgcactatgacacaccggatatcagacggtttgatcccataccggcccagtacgttcgtgtataccctgaaagatggtccccggcaggaatcggcatgagattggaggtgctggggtgtgactggacagattcaaaaccaaccgtagagactctcggccccacagtgaagtctgaggaaactaccaccccttatcccaccgaagaagaagcaacggagtgcggagagaattgcagtttcgaggacgacaaggacttacagctgcctagcggcttcaattgcaactttgactttctcgaggagccatgcgggtggatgtacgaccacgcaaaatggttgcgaaccacatgggccagttcgagcagccctaatgaccggacatttcctgacgaccgcaacttcctgcgcctccagtcagactcccagagagagggacagtacgctcgtttaatctcaccgcctgtgcacttgcctcgtagtccagtgtgtatggagttccagtatcaggccacaggaggcagaggagtggctctgcaagtggtccgagaagcgagtcaggaatcaaaactgctgtgggttatcagggaagaccagggaggcgagtggaaacatgggaggattatacttccctcatacgacatggagtatcagattgtgtttgagggcgtcattgggaagggacggagcggtgagatcgccatcgacgatattcggatcagtacagatgtccctcttgagaactgtatggaaccaatctccgcctttgccgatgaatatgaggtcgattggtccaattcctcgtctgccacgtctggctccggtgctccctccactgataaagagaaaagttggctttacacgcttgaccctatcctcataactatcatcgccatgagtagcctaggagtgctattgggcgctacatgcgccggattgttgctctattgcacctgttcatattccggactatcctctcgcagctgtaccactttagagaactacaatttcgaactgtacgacggattaaaacacaaggttaagatgaaccaccagaagtgttgttccgaagcatag

SEQ ID NO: 25302 - DNA, 1668 bp, Artificial Sequence
  Description of Artificial Sequence: Synthetic coding sequence
atggacatgttccccctgacctgggtgttcctggccctgtacttctccaggcatcaggtgagaggacagccagatccaccctgcggtggtagactgaatagcaaggatgctggatatataacatctccaggctatccccaggattaccccagccaccagaactgtgaatggatcgtgtacgcacctgaaccgaatcagaaaatcgtcttgaattttaatccccacttcgagatcgaaaaacacgattgtaagtatgacttcatagagattcgtgatggcgacagcgaatcggccgatctgctcgggaagcattgtggcaacatcgctccacccaccattatatcaagcggctctatgctatatattcgatttacctccgactatgcgaggcagggcgccggttttagtctacgctacgagatctttaagacaggtagcgaggattgcagcaaaaactttacttcccctaatggaacaatcgagtctcccggctttcccgagaagtaccctcacaatcttgattgtacattcactatcctcgcgaagccaaagatggagataatcctccagtttctcatattcgatctcgaacacgatcctcttcaagtcggggaaggggattgtaaatatgattggctggatatctgggatgggatccctcatgttggaccacttattgggaaatactgtgggactaaaactccctctgaacttcgatccagtaccggcatcctgtcactcacctttcacacggatatggccgtggccaaagacgggttttctgccagatattaccttgtgcaccaggaaccactggaaaattttcagtgcaacgtgcccctggggatggaatccggaagaatcgccaatgaacagatcagcgcctcaagtacctactctgacgggaggtggaccccacagcagagtcggttgcacggggatgataacgggtggactccaaacctcgacagcaataaggagtacctgcaggtggatttaagatttttgacaatgctgacagccatcgcaacccaaggtgctatcagtagagagacacaaaacggctactacgtcaaatcctataagctggaggtttcaactaacggtgaagactggatggtatacagacatggaaaaaatcacaaggtttttcaggccaacaacgacgctactgaagtggtccttaataagctgcatgcaccacttttgacccgctttgtgcggattcggcctcagacttggcattcaggaatcgccctaaggcttgagctgtttgggtgtcgggtcacagacgcaccctgttccaatatgttaggaatgctgtcagggcttatcgcggacagccagatttccgcctctagtactcaggaatacttatggtctccctctgccgctcgcttagtaagctcccgaagcggctggttcccgcgtatcccccaggcgcaaccgggcgaggaatggcttcaagtggacctggggacacccaagactgtgaagggtgtgattatacagggtgcccgcggtggggattctatcactgcagtagaagcccgggcctttgtgcgcaaattcaaggtgagttattcgctaaatggcaaagactgggagtatattcaggacccccggacacagcagcctaaagttggctgtagttggagaccactgtag

SEQ ID NO: 25303 - DNA, 309 bp, Artificial Sequence
  Description of Artificial Sequence: Synthetic coding sequence
atggacatgttccccctgacctgggtgttcctggccctgtacttcagcagacatcaggtgcgaggccaaccggaccctccgtgcggcggacggctgaattccaaagacgctggctatattactagccctggctacccccaggactatccctcacatcagaattgtgagtggatcgtatatgccccggaacccaatcagaagattgtgctgaactttaaccctcatttcgaaatagaaaagcatgactgcaagtacgactttatcgagattagggatggtgatagtgagtcagcagatctgctcgggtag

SEQ ID NO: 25304 - DNA, 2781 bp, Artificial Sequence
  Description of Artificial Sequence: Synthetic coding sequence
atggacatgttccccctgacctgggtgttcctggccctgtacttctcgagacaccaagtgagaggccagccagatcctccatgcggtggacgactcaattcgaaggacgcgggatatataacatcgcccggctatccacaggactatccctcccatcagaattgcgaatggatagtttacgctcccgagcccaaccaaaaaatcgtgctgaatttcaatccgcattttgaaatcgaaaaacacgattgtaaatacgattttatcgaaatcagagacggcgactcagagagtgcggacttactcggtaaacactgtgggaacatcgcacctcctacaattatctcatcaggatcgatgctgtacatcaggttcacaagcgattatgctcggcaaggcgctggcttctccctccgctacgaaattttcaagaccggaagcgaggactgttcaaagaactttacctcccctaatggtacaatcgagagcccaggatttcccgaaaaatacccccacaatctggattgtacattcactatcttggcaaaacccaaaatggaaatcattctccagtttcttatattcgacctcgagcacgacccactacaggtgggcgaaggagattgcaaatacgactggcttgatatctgggacggtatccctcacgtgggaccccttattggaaagtactgtggaaccaagaccccctccgaactcagatcgagcacagggatactgtctcttaccttccataccgatatggccgtcgctaaggatggtttttccgccagatattatttagtccaccaggaaccgcttgaaaacttccagtgcaacgtgcccttgggaatggagtccggaagaattgccaacgagcagatttctgcgtcctctacttactccgacgggagatggacacctcagcaatcaaggctgcacggcgatgacaatggctggacacccaatttagactccaataaagagtacctgcaggttgatctgcggttccttacaatgttaacagccatcgccacccagggggcaataagccgggagactcaaaatggctactacgttaagtcttataaactcgaggtttccactaatggcgaagactggatggtgtatagacatggaaagaatcacaaagtatttcaagccaataatgacgcaactgaagtggtgctgaacaagctgcatgcaccactgctcacaagatttgtaaggattcgacctcagacgtggcatagcggcatcgccttacggctcgagctatttggctgtcgcgtgaccgatgccccctgttccaacatgctgggcatgttgtccggccttatagccgatagccagatctcagccagttctacacaggagtacctctggtccccatcagccgcccggctggtgtcttctagaagcggttggttcccgcgaataccacaggctcaaccaggagaggaatggctccaggtggatctcggaacacctaaaactgttaaaggcgtgattatacagggagcgaggggcggagacagcattaccgccgttgaagcgcgggcctttgtccgaaaattcaaggtttcatatagcctgaatggtaaggactgggagtacattcaggatccccggactcagcagcccaaactatttgagggcaacatgcattatgatacccctgacatccgacgatttgaccccatacccgctcaatatgtgcgcgtctatcccgaaaggtggtcccccgctggaatcggtatgcgactggaagtattgggctgcgattggacagactcaaagcccaccgttgagacgctggggccgacggtcaaaagcgaagaaactacaactccgtatcccactgaagaagaggccaccgaatgtggggagaattgctctttcgaggatgacaaagacctgcagttgcctagtggcttcaactgtaattttgacttcctagaagaaccttgtggctggatgtatgaccacgcaaagtggctgcgtacaacttgggccagtagctcatcacctaacgaccggacattccccgacgataggaatttcctgcggctccaaagtgactcccagcgggagggtcagtacgctcgcctcatctcccctccagtccatctgccaagatcaccagtgtgtatggagtttcaataccaggccaccggcggacggggggttgccttgcaggtcgtccgtgaagccagccaagaaagcaaactgctttgggtaattagggaggatcaagggggtgagtggaagcacggcagaattatactgccttcctacgacatggagtaccaaattgttttcgaaggcgtcattggaaaggggaggtccggggagatagctatcgatgatatcagaatttccaccgatgttccgttagaaaattgcatggccactgtaagcgcgtctatcgttgatattccggagatacacgagagggaggggtacgaggacgaaattgatgatgaatatgaggtcgactggtctaactcatctagtgccaccagcggctctggagccccatctacagacaaggaaaaatcatggctttacaccctggaccctattctgataacaattatcgccatgtcctcattgggagtgctgctcggggctacatgcgcaggccttctcctgtactgcacttgcagctactcgggcctaagttccaggagctgtactacactggaaaactataattttgagctctacgatgggttaaaacataaagttaaaatgaatcaccaaaagtgctgttcagaggcctag

SEQ ID NO: 25305 - DNA, 2730 bp, Artificial Sequence
  Description of Artificial Sequence: Synthetic coding sequence
atggacatgttccccctgacctgggtgttcctggccctgtacttctcccgccaccaagtcaggggtcagcccgatccaccatgtggcggccgattgaattctaaagatgccggctacatcactagccccggctatcctcaggactaccccagccatcagaactgcgaatggattgtttatgcccccgaacctaaccagaaaattgtactgaacttcaacccacacttcgaaattgaaaaacacgactgcaagtacgattttatagaaattcgagacggagatagtgagtcagctgatctgctcgggaagcattgtggtaacatcgcaccaccaacaataatttcatctggctccatgctctacatcagatttactagcgactacgcgcgccaaggggccgggttcagtctgcgctacgagatctttaagacaggatcagaggactgctccaaaaattttacttcacccaacggaactatcgaaagcccaggctttcctgaaaagtatccccacaatctcgactgtaccttcacaatcctggcaaagcccaagatggaaattatcctacagtttctgatctttgaccttgaacacgaccccttacaagtgggcgagggcgactgcaagtacgactggttagatatttgggatgggatacctcacgtcggccctctgattggaaagtactgtggcactaaaacaccatctgagcttcggtcgtccactgggatcttatccctcacattccatactgacatggctgtcgccaaagacggtttctcagccaggtattatctggttcatcaggagcccctcgaaaactttcagtgtaacgtgcccttaggtatggagagcggaaggatcgctaatgagcagataagcgcatcttccacttactccgacggtaggtggactccacagcagtctcggctgcacggcgacgataacgggtggacccccaatctcgactcaaacaaggaatatctgcaggtggatctcaggttcttaaccatgttgactgcaatagcaacgcaaggtgctatcagtcgggagacccaaaacggctattacgtgaaaagctacaaactcgaggtgtcaacaaacggcgaggactggatggtttataggcacggaaagaatcacaaggtgtttcaggccaacaacgatgccacagaggtggttctgaataagctccacgcccctttgctcacccgcttcgtacgtattagaccacagacgtggcactctgggatcgcactgcgtttagaattattcggttgtagggtgacagacgctccatgtagtaacatgctgggcatgctctccggcctgatcgctgacagccagatctctgcaagcagtactcaagaatacctgtggtctccctccgccgcccgtttggtgtccagtagaagcgggtggtttcctcgaatacctcaggcccagccaggggaagagtggctgcaggtagacctgggaactcctaaaaccgtgaagggtgtcataatccaaggggctcgggggggcgattcaatcaccgccgtggaggcccgggcctttgtaaggaagtttaaggtcagctacagcctaaacggaaaggactgggagtatatccaggatcctaggacacagcagcccaagctatttgaaggaaatatgcactatgatactcccgacataaggagattcgatcccattcccgcacaatacgtccgagtctacccagagcggtggtcgccagctggtatagggatgaggctcgaagtgctgggctgcgattggacagattcaaagccaacagtcgaaaccctcggccctacggtcaaaagtgaggaaacaaccacaccatatccaacagaggaggaggcaactgaatgcggcgagaattgctcattcgaggatgacaaggacctgcagctcccaagtggtttcaactgcaattttgatttcctcgaggaaccttgtggatggatgtacgatcacgccaagtggctgagaactacctgggccagtagcagctctccaaacgaccgcacctttcctgacgatcggaatttcctgcggctgcagagcgattcgcagcgtgagggccagtacgcacggctgatcagccctccagtgcacctgcccagatctcctgtgtgcatggagttccagtatcaggcgactggaggtcggggtgtcgcgctgcaggtggtgagagaggcctcccaggagagtaagttactgtgggttattcgggaggatcagggaggcgaatggaaacacggccgaatcatcttgccctcctatgatatggagtatcagattgtcttcgaaggtgtgatcggtaaaggtagatctggggagattgctatagacgacatccgcatctccaccgacgtacccctcgaaaactgtatgggcccaaaggcttgtatcgcagatgagtatgaggtggattggtctaattcctctagcgccacatcagggtccggggctccgtccacagataaggagaaatcctggctgtacaccctggatccgattttaatcaccattattgcaatgagcagtctgggtgtgttactgggcgccacttgtgctggccttctgctctactgcacctgtagctatagtgggctctcttccagatcctgtacaactctcgagaactataactttgaactgtatgacggattgaagcataaggtcaagatgaatcaccaaaaatgctgtagtgaggcatag

SEQ ID NO: 25306 - DNA, 462 bp, Artificial Sequence
  Description of Artificial Sequence: Synthetic coding sequence
atgaccaagatcaaggccgaccccgacggccccgaggcccaggccgaagcctgctccggggaaaggacgtatcaagagctgttagttaatcagaaccccatcgctcagcccctggcttcgcgcagactgacccggaagctgtacaagtgcattaaaaaggctgtaaaacagaagcagatcaggcgaggcgtcaaagaggtgcagaagtttgttaataaaggcgagaagggcatcatggtgctggcaggagacacacttcccatcgaggtgtactgtcacctgcctgtcatgtgcgaggatcgtaatttaccctatgtatatatcccatcgaaaacggatcttggggccgcggctgggtctaaaaggccaacctgtgtgattatggtaaagcctcacgaggagtaccaggaggcctatgacgagtgcctggaagaggttcagtcccttcccctccccttatag

SEQ ID NO: 25307 - DNA, 273 bp, Artificial Sequence
  Description of Artificial Sequence: Synthetic coding sequence
atgaccaagatcaaggccgaccccgacggccccgaggcccaggccgaggcttgctccggtgagcgaacatatcaggagctgctggtgaaccagaaccccatcgcacagcctctggccagccggaggctgaccagaaaactctataaatgcattaaaaaggctgttaagcagaagcaaatccgccgaggtgtgaaagaagtgcagaaattcgtgaacaagggtgagaaaggcacatgggtccaaccacaggccccatcagccccaccagtgtag

SEQ ID NO: 25308 - DNA, 2265 bp, Artificial Sequence
  Description of Artificial Sequence: Synthetic coding sequence
atgtggaagctgctgcccgccgccggccccgccggcggcgagccctatagactgctgaccggcgttgagtatgtggtaggtcggaagaactgcgcgattcttattgaaaatgatcagtccataagccgtaaccacgcggtcctgactgccaacttctccgtaaccaatcttagccaaacagacgaaatccccgtgctaacactgaaggacaattctaagtatggtacattcgtgaatgaggagaagatgcagaacgggttttcaaggacccttaagtctggcgacggaatcacctttggtgtgttcggatcaaagtttcgcattgaatacgaacctctcgttgcctgctcaagctgcctcgacgtatccggcaagacggcacttaatcaggccatcctgcagctgggggggtttacagtcaataactggactgaggagtgcacacatctggtcatggtgtcggtgaaggtgaccatcaagacgatctgcgcccttatctgtggccggcccatagtaaagccagagtattttaccgagttcttaaaagctgttgaatccaagaaacagcccccacagatcgagtccttctatcctccactggacgagccctccatcgggagtaagaacgtcgacttgtcagggcgccaggaacgaaaacagatcttcaagggcaaaacgttcatttttctaaacgctaaacagcacaagaaactgtcaagtgctgtggtgtttggtggcggagaggcacgactgattacggaagagaacgaagaagagcataacttttttctagcccccggcacctgcgttgttgacacggggattaccaactcacagacccttataccggattgtcagaagaaatggattcagtctattatggatatgctgcagcgccagggcctaagaccaatccctgaggctgagatcggactcgccgtgatcttcatgaccaccaagaattattgcgatcctcaaggacatccatccaccggtcttaaaactacaacaccgggcccatccctgtcacagggcgtttctgtagatgagaaactcatgccttccgctcccgtgaataccacgacatatgttgctgacacagagtccgaacaggcagatacctgggacctatccgagagacccaaagaaattaaggtgtcaaagatggaacagaaattccggatgctgtctcaggacgcacccaccgttaaggagagctgcaaaacttcttccaacaataattctatggtgtcaaacacgctggctaaaatgcggattcccaactatcagctgagtcctaccaaactcccatcgatcaacaaatccaaagatcgggctagtcaacagcaacaaaccaattcaattcggaactatttccagccgagtacgaaaaagagagagagggatgaggaaaaccaagagatgtcctcctgcaaaagtgctaggattgagacctcctgcagtcttctggagcaaacacaacccgcgaccccatccttgtggaagaacaaggagcagcatctcagcgagaacgagcctgttgatacaaattccgacaacaacctatttaccgacactgatctgaaatcaattgtcaagaactcagcctccaagtcccacgcagccgagaagctcagaagcaataaaaagcgggagatggatgacgtcgccatcgaagacgaggttcttgagcagctctttaaggacacaaagcctgagctggagattgacgtcaaagtgcaaaagcaagaggaggacgttaacgtgcggaaacggcctcgtatggacattgagaccaatgatacatttagtgacgaggcagtgccagagagctccaaaatcagccaggaaaatgagattggcaagaaacgcgaactgaaggaagactctctctggtcggctaaggagatttctaacaatgacaaactgcaggatgattctgaaatgctccccaaaaaattgcttctgaccgagtttcggtctctcgttatcaaaaacagcacgtctagaaacccgtccggcattaacgatgactatggtcagctgaagaattttaaaaagttcaagaaagtgacatatcctggagccggtaagctcccccatatcattggcggaagcgatctcatagcacaccacgctcggaagaacaccgagttagaggagtggttgcgccaggagatggaggttcagaaccagcacgcgaaagaagagtctttagctgatgacctattcagatacaatccctatctgaagagaagacgttag

SEQ ID NO: 25309 - DNA, 1437 bp, Artificial Sequence
  Description of Artificial Sequence: Synthetic coding sequence
atgtggaagctgctgcccgccgccggccccgccggcggcgagccctaccgcctgctgacaggcgtggaatacgttgtggggcgcaagaactgcgccattctgatcgagaatgaccagagtatatcccgcaaccacgcagtcctcacagcgaacttcagcgtgactaatctctcacaaacagatgagattccagtgctgacattgaaggacaattctaagtacggcacattcgtcaacgaggagaaaatgcagaatggtttcagtcggactttgaaatctggggacggcatcacatttggagtatttggctcgaagtttagaattgaatacgagcccttggtcgcatgtagcagctgtttggatgtcagcgggaagactgctctgaaccaggctatacttcaattgggaggtttcactgtgaacaactggacggaggaatgcacgcacctggtgatggtttcagttaaggtcacgattaaaacaatctgtgccctgatctgcggccgtcctattgtgaaacccgagtactttacagagtttctgaaagccgtcgaatcaaagaagcagccaccccagattgagtccttctatccacctctagatgagccatccattggcagtaagaatgtcgacctgtcaggcaggcaggagagaaagcaaatcttcaagggaaaaacgttcatttttctgaacgccaagcagcataaaaagctgagctcagccgtggtcttcggtgggggcgaggccagactcatcaccgaagagaacgaggaggaacacaacttctttctagcccccggcacttgcgttgtggatacaggtatcacgaattctcagactctgatcccggattgtcagaagaagtggatacagagcatcatggacatgcttcagcggcaggggctgcgacctattccagaggctgagatcgggttggccgtgattttcatgaccacgaagaattactgcgaccctcaagggcaccccagcacgggcctgaaaactaccacaccagggccctccttatcccagggagtaagcgtggacgaaaaattgatgccctccgctccagtcaacactacaacctatgtcgccgacactgagtccgagcaggctgatacgtgggatctgagcgaacggccaaaggagattaaggtgtccaagatggagcagaagtttaggatgctgtcccaggacgcacctactgtgaaagaatcctgtaaaacaagttctaacaacaactcaatggtgtcaaacactcttgccaaaatgcggatcccaaactatcagctatcccctacgaagcttccaagcattaacaagagtaaggaccgagcgtctcagcaacaacagactaatagtatcagaaactactttcagccatcaacaaagaagcgggagaggttgcatcttaagaaaaaaaagaagaagaagtag

SEQ ID NO: 25310 - DNA, 333 bp, Artificial Sequence
  Description of Artificial Sequence: Synthetic coding sequence
atgggcgccagcggcagcaaggcccggggcctgtggcccttcgccagcgctgcagggggaggaggctccgaggccgctggagccgaacaagcgctggtccgcccaaggggcagagccgtccccccctttgtcttcactcgccgggggtcgatgttctacgatgaggatggcgacttggcccacgaattctatgaggagactatcgtcaccaaaaacggacagaagcgggctaagttgcgccgtgtgcataaaaacctcataccgcagggcatagtgaagcttgaccaccctcgcatccacgtcgattttcctgtcattttgtatgaggtatag

SEQ ID NO: 25311 - DNA, 1206 bp, Artificial Sequence
  Description of Artificial Sequence: Synthetic coding sequence
atgtggagcggcggcagcggcaaggcccggggctgggaggccgccgccggggggcgatccagcccgggacgcttgagtcgccgcagaataatgtcaatgagccccaaacatacgacacccttttcagtgtctgatatcctgtcccctcttgaggaaagttataaaaaggtaggaatggagggaggtgggctgggggctcctctcgctgcctatcgccaggggcaggccgccccccccactgcagctatgcaacagcatgccgtcggccaccacggggccgtgacagctgcgtatcatatgactgcggccggagtgccacagttatcccattcagcagtgggcggatattgtaacggcaatctcggcaatatgtccgagctgccaccataccaggatacaatgcgtaattcggccagcggtcctgggtggtatggcgcaaaccccgaccctagatttcccgctatctcacgtttcatggggcccgcctccggtatgaatatgagcggtatgggcggtttgggctcattaggagacgtgagtaagaacatggcccctcttccatcagcgcccagaagaaaaaggcgggtcctgttcagccaggcacaagtctatgagctagagcgtaggtttaagcagcaaaaatatttaagcgctcctgaacgggagcatctagcctcgatgatccacctcacaccaacccaggtgaaaatctggttccagaatcacaggtataaaatgaagcggcaggccaaggacaaggctgctcagcagcagctgcagcaagatagcggtggcggcggaggtggtggtggcacaggatgtccgcagcagcaacaggcccagcaacagtctcctcgaagagtagccgtgcccgtgctggtgaaggacggtaaaccctgtcaggccggcgcccccgcaccaggcgcagcctctttgcagggacatgcccaacagcaagctcaacatcaagcacaggcggcccaagcggccgctgcagcgatttctgttggcagcggcggcgctggacttggagcacatccaggtcaccagcctggtagcgccggacagtctccggaccttgcccaccatgctgccagccctgcggcactccaaggccaggtgtcatccttatcccacctcaactcctccggctccgactacggcacaatgtcttgctccacactgctgtacgggaggacttggtag

SEQ ID NO: 25312 - DNA, 1116 bp, Artificial Sequence
  Description of Artificial Sequence: Synthetic coding sequence
atgagcatgagccccaagcacaccacccccttcagcgtgagcgacatactgagccccctcgaggagtcctacaaaaaggttgggatggaaggcggcggtctcggcgcacccctcgccgcatacaggcaggggcaggcggccccacctaccgccgctatgcagcagcatgcagtcggacatcacggggcagtaacggccgcctaccacatgacagccgccggggtgccccagctgagccactcagccgtgggcggttactgcaacggcaatctggggaacatgagcgaactgccaccctaccaggatactatgaggaatagtgccagtggccctggatggtacggcgctaatccagacccccggttccctgcaatttctcggtttatggggcccgctagcggcatgaatatgtctggcatgggagggctcgggtccctcggggacgtgtccaagaacatggcacctctcccctcggccccaagaaggaaacgacgggtgctgtttagccaagcccaagtgtacgagctagaaagaagattcaaacagcagaaatacctgtccgcaccagaacgggaacacctcgccagcatgatacatcttacgccgacccaagtgaagatctggtttcaaaatcatcgctataagatgaagagacaagctaaggataaggcggcgcagcagcagctgcagcaagatagcgggggaggggggggtggtggggggacgggttgcccacaacagcaacaggcccaacagcagtcacccaggcgtgtcgccgtgcctgtgctcgtgaaggacgggaagccctgccaggccggagctcctgcccccggagcagcaagtctgcaaggccacgcacagcaacaggcacagcatcaggcccaggcggcacaggcggcagccgctgccattagcgtaggcagcggaggggccggcttgggcgcccacccaggacaccagcctggttctgccgggcagtccccagacttggctcaccatgcggctagccctgctgccctacagggtcaagtgtcatcactctcacatcttaatagtagtggctccgattacgggaccatgtcatgttcaaccctgttatatggtcgaacatggtag

SEQ ID NO: 25313 - DNA, 1116 bp, Artificial Sequence
  Description of Artificial Sequence: Synthetic coding sequence
atgagcatgagccccaagcacaccacccccttcagcgtgagcgacattctgtcaccacttgaggaatcgtataagaaggtgggtatggagggggggggactgggcgctcctttagctgcataccggcagggtcaagccgccccgccaaccgctgccatgcagcagcacgccgtgggacatcatggagccgttaccgctgcctaccacatgaccgcagctggagtcccacagttgagtcattctgccgtcggcggttactgtaatgggaatcttggaaacatgtcagaactgcccccataccaggacacaatgaggaacagtgcctccggtcccggttggtacggtgcaaatccggaccctagatttcccgccattagccgttttatggggcctgcgagtgggatgaacatgagcgggatgggcggacttggcagtctgggggatgtcagcaaaaacatggctcctctcccttccgcgcctcgcagaaaaaggcgagttcttttttcacaggcccaggtctatgaactggagcgccgcttcaagcagcagaagtatctcagcgcccccgagcgcgaacacttggcttccatgattcacctcacacccacacaggttaaaatctggttccagaaccaccgctacaaaatgaagcgacaggcgaaggataaagcagctcagcagcagctccagcaggacagcggaggaggggggggcgggggcgggaccggatgcccacagcagcagcaggcccaacagcagtcgccacggagagtggccgtccccgttctggtcaaggatgggaagccttgtcaggccggcgcaccggcccccggcgccgcatcacttcagggtcacgctcagcaacaggcgcagcaccaagcacaggcggcacaagccgcggccgcggccatttcggtggggagtggcggcgccggtttgggcgcccatcccggacatcagccagggagcgccggacagtccccagacctagctcatcacgccgcttcaccggccgccctccaaggccaggtgtccagcctatcacacctaaactcctctggtagcgattatgggaccatgtcctgttccacccttctctatgggagaacatggtag

SEQ ID NO: 25314 - DNA, 1116 bp, Artificial Sequence
  Description of Artificial Sequence: Synthetic coding sequence
atgagcatgagccccaagcacaccacccccttcagcgtgagcgacatcctttctccgctggaagagtcctataagaaggtgggaatggagggcggtgggctcggcgcaccgctggcagcataccgacagggacaggccgcccctcctaccgcggccatgcagcagcatgccgtaggtcaccacggcgctgttacagcagcgtaccacatgactgcagctggcgtgccacagctcagccattcagccgtgggaggttactgtaatggaaaccttgggaacatgtcagaactgcctccttaccaggatactatgcggaactctgccagcggccctgggtggtacggggcgaatcccgaccctcgctttcccgctatctccagattcatggggcccgcctcagggatgaacatgtctggaatgggaggccttggatctctcggcgatgtgtcaaaaaacatggcccccctcccatccgctccacgcaggaagaggcgagtactctttagccaggcccaggtttacgaattggagaggcggtttaaacagcaaaagtatcttagcgcgccagagcgcgagcaccttgcgtctatgattcacctgacaccgacccaagtcaaaatttggttccagaatcaccggtacaagatgaagcgccaggctaaggacaaggcagcccagcagcagctgcagcaagattctggcggcggcgggggtggagggggtacaggatgcccgcagcagcagcaggcgcaacaacagtccccacgaagggtggccgtgcctgtgcttgtcaaggacgggaagccatgccaggccggcgcccccgccccgggcgccgcctctctccaaggccacgctcagcaacaggctcagcaccaggcacaagccgcccaggccgcagcagccgccatctccgtcggctctggaggcgctggcctaggagcgcacccaggccatcagcctggcagtgccggacagtcccccgatctcgcccaccacgccgcttctcccgcggccctgcaaggccaggtttcttcactgtctcacctgaattctagtggctctgactacggaacgatgagctgtagcactcttctgtatggacgcacctggtag

SEQ ID NO: 25315 - DNA, 105 bp, Artificial Sequence
  Description of Artificial Sequence: Synthetic coding sequence
atgtggagcggcggcagcggcaaggcccggggctgggaggccgccgccggtggtcgtagttcacccggccgtctatctgcatacgcccctcctttggttgcttag

SEQ ID NO: 25316 - DNA, 573 bp, Artificial Sequence
  Description of Artificial Sequence: Synthetic coding sequence
atgctgcgggtgcccgagccccggcccggcgaggccaaggccgagggtgcggcacctcccacccccagcaaaccattgacttccttccttatacaggacatcctgcgcgacggtgctccagaagaggcggaaacactcgcggagacggagcccgagagacaccttggctcttatcttctggattcagagaatacttctggagccctcccacgattgcctcagactcccaaacaaccacaaaagaggtcaagagctgctttctcccatacacaggtgatagagttggaacggaagtttagtcaccaaaaatatctgagtgcccccgaaagggcccacctggcaaaaaaccttaagctgaccgaaactcaggtcaaaatctggtttcagaacaggagatacaagaccaaacgcaagcagttgtctagtgagctgggcgatttagaaaaacacagctccttgccggctttgaaagaagaagccttcagcagggcaagtttggtgagcgtctacaacagctacccttattacccctacttgtactgtgtgggatcatggtctcctgctttttggtag

SEQ ID NO: 25317 - DNA, 705 bp, Artificial Sequence
  Description of Artificial Sequence: Synthetic coding sequence
atgctgcgggtgcccgagccccggcccggcgaggccaaggccgagggagccgccccacccaccccgagcaagcctttgacctcattcctcatccaggatatcctgcgggatggcgcccagaggcagggtgggcgcacttcctcccaaagacagcgggacccagaaccagaacccgagcctgagcccgaagggggccgctcccgagcaggcgcccagaatgaccaactaagcactggtccacgagcagctcccgaggaagcagagaccttggccgaaaccgaaccggagcgccatcttggcagctatttgcttgactccgagaatacatcgggggccctcccacgcctgcctcagaccccaaagcagccacagaagaggagccgcgcagccttctcgcatacccaggtgatcgaattggagcgtaagttttctcaccagaaatatctgtccgccccagagcgggctcatctggcaaaaaatctgaagctcacggaaacccaggtaaaaatatggtttcagaatcgccgctacaaaacgaagcgcaaacaactttcatccgagcttggcgacctcgaaaaacactccagtctacccgctcttaaggaggaagcattcagtcgcgcctcattagtcagcgtttacaactcttatccttactatccttatctatactgcgtgggatcatggagcccagctttttggtag

SEQ ID NO: 25318 - DNA, 480 bp, Artificial Sequence
  Description of Artificial Sequence: Synthetic coding sequence
atgctgcgggtgcccgagccccggcccggcgaggccgagaccctggccgaaaccgagccagagcggcacctcggctcgtatctgctggatagcgagaatacatcaggtgcacttcccaggcttccccagacacctaagcagccccagaagaggagtagggctgctttctcccatacgcaggtgatcgaattggagaggaaattttctcaccaaaaatacctgagcgctcctgaacgagcccacttagctaaaaacctgaaacttactgagactcaagtgaaaatttggtttcagaataggcgatacaaaactaagcgtaagcagctgagctctgaactgggcgacctggagaaacattctagtctaccagccttaaaagaagaggcattctcaagggctagcctcgtatcagtgtataattcgtacccctactacccctacctctattgcgtagggtcttggtcccccgccttctggtag

SEQ ID NO: 25319 - DNA, 4212 bp, Artificial Sequence
  Description of Artificial Sequence: Synthetic coding sequence
atggccacccagcagaaggccagcgacgagcggatcagccagttcgaccataatctgctgccggaactgtccgcccttctcggacttgatgccgtgcagcttgcaaaggaactggaggaggaggagcagaaagaaagggccaagatgcagaagggttacaacagccagatgcggtccgaggccaagcgccttaagacctttgttacttatgaaccttattctagctggattccacaggaaatggctgcagctgggttttactttaccggtgtcaagtccgggattcagtgtttttgctgcagcctaatcctttttggcgcaggacttacgcggctacctatcgaagatcataagcggttccacccagattgtgggttccttctgaacaaggatgtcggtaacattgctaagtacgacattcgggttaaaaatttgaaatctagattacgtggggggaaaatgcgataccaggaggaggaggctagactggcctctttcaggaactggccgttttatgtgcagggaatttccccttgcgtgctgtctgaagccggatttgtgtttacagggaagcaagacaccgtacagtgcttttcctgtggaggatgtctgggtaactgggaggagggtgacgatccatggaaggaacacgccaaatggttccccaagtgcgagtttttgcggagtaaaaaaagtagtgaggaaattacgcagtacatccagtcgtacaaggggtttgtggacattacgggagagcattttgtgaattcatgggtccagcgggagctacctatggcttcagcctactgcaatgatagcatttttgcctatgaggagctcaggctggactcattcaaggattggccccgcgaaagcgctgttggcgtcgcagctctcgccaaggctgggctgttctatacgggaatcaaagatatcgtgcagtgcttttcatgcggcgggtgcctcgaaaaatggcaggaaggtgacgaccccctggatgatcacacacgctgttttcctaattgcccgttcctccagaacatgaaatcctctgccgaagtgacgcctgacctgcagtctaggggagagctctgtgaacttctggaaaccacctcggagagtaacctggaagatagcattgccgtaggaccaattgtgcctgagatggcccagggcgaggcccaatggttccaggaggctaagaatctgaatgaacagttacgcgccgcctacacgtctgcgagttttcggcacatgtcactcctcgacataagctctgatctggcaactgaccatctgttggggtgcgatttgagtattgcatcaaagcacattagcaagcccgtccaagagcctcttgtgcttcctgaggtgttcggtaatctgaactctgtgatgtgcgttgagggggaagccggcagcgggaaaactgtcttgttgaaaaagattgcatttctctgggcctccggatgttgcccccttcttaatcgctttcaacttgtgttctacttgagcctgagttcgactcgccctgacgagggtcttgcatccataatctgcgaccagttgcttgagaaggaggggtctgtgacagagatgtgcgtcaggaatatcatccaacaactgaagaatcaggtgctgtttcttctagatgactataaagaaatatgttcaattccccaggttatcggaaaactgatacagaaaaatcatctatctaggacttgtctgcttattgcagtgagaactaatcgagcgcgcgacatccgcagatatctcgaaaccatcctcgagattaaggcttttccattctacaacaccgtgtgtattctccgtaagttattcagccacaacatgaccaggctgcgcaagttcatggtgtacttcgggaagaaccagtccttgcagaagatccagaagacacctctctttgtcgctgctatatgcgcccactggttccagtacccattcgacccgtctttcgacgacgtggctgtctttaaaagttacatggaaagactttctctccggaacaaagctacagcagaaattctcaaagccaccgtgagtagttgcggcgaacttgcgctgaaggggttcttttcatgttgcttcgagtttaatgatgacgacctggcagaagcaggggtcgacgaagatgaggatttgaccatgtgcctcatgtcaaagttcacggctcagcggctgcgccccttctatcggttcctgtcacccgccttccaggaatttctcgctggcatgcggttaattgagctcctcgacagcgaccgccaggagcaccaagatctaggtttgtaccacctcaagcagatcaactcgccaatgatgactgtcagtgcctacaataattttctgaattacgtgtcatcactaccgagtactaaagccggcccaaagattgttagccatctgctgcatctagtagacaacaaagagagcctggaaaacatctccgagaacgacgattatttgaagcaccagcccgagatctcactccagatgcagctgctccgagggttgtggcagatatgtccccaggcctattttagtatggttagcgagcatcttctcgtcctggcactgaaaacagcttatcagtcaaataccgtggccgcctgtagtccctttgtcttgcagttcctgcaggggaggaccctgaccctgggggccttgaacctgcagtatttttttgatcacccagagagtttgtcgctattgaggtcaatccactttccaatcaggggcaacaagacaagccctagggctcattttagcgtgcttgagacttgctttgacaaaagccaggtccctaccatcgaccaagattacgcctcggcctttgagcctatgaatgagtgggagcggaacctagctgaaaaggaggataacgtgaaaagctatatggatatgcagcgccgagccagcccagacctgagcacaggatactggaaactatccccgaagcagtataaaattccctgtctcgaggtagatgttaacgacatagatgtggtggggcaggacatgctggagattctgatgactgttttctcggcttcccaacggattgaactacacctgaatcactctcggggctttattgaatcaatccggcccgcccttgaactgtccaaagctagcgtgacaaaatgttccatttcgaaacttgaactcagtgctgctgagcaggagctgttactgactctcccctccctcgaatctctcgaggtgtccggaaccattcagtcccaggatcaaatattcccaaacttggataagtttctgtgcctcaaggaattgtcagttgacctagaagggaacataaatgtgttctcagtgatccccgaggagtttccgaattttcatcacatggagaaattactcattcagattagtgctgagtatgacccaagtaagctggtcaaattaatccagaactccccgaatctgcatgtctttcatcttaaatgtaacttcttttccgacttcgggtccctgatgacaatgttggtgagttgtaagaagttaactgaaatcaagtttagcgactccttttttcaagctgtgccatttgtggcctcattacccaattttatctccctgaaaatcctcaatctagaaggccagcagttccctgatgaggaaacgagcgaaaagttcgcttacatactgggatcgttgtcgaacctagaggaacttatccttcccacaggagacggcatctatcgtgtggctaaactcattattcagcagtgtcagcaactgcactgccttagggtgctgtctttcttcaagactctgaacgacgactctgtggtggagattgctaaggtagctatctcaggtggtttccaaaagcttgagaacctcaagctcagtataaaccataagattactgaggaaggttaccgaaattttttccaggctttggacaacatgccaaatctgcaagagttagatattagccgccactttaccgagtgcatcaaggctcaagcaaccacggtaaaatctttgtcccagtgtgtacttcggctaccaagactgattaggttgaacatgctgagttggctgctggacgcggatgacattgctcttctgaacgtaatgaaggagagacatcctcagtctaaatacctgactatcctacaaaagtggatccttccattctctccaatcatccagaagtag

SEQ ID NO: 25320 - DNA, 3726 bp, Artificial Sequence
  Description of Artificial Sequence: Synthetic coding sequence
atgcccctgcacatcggcgacttcgtgtgggacagcaaggtgcacagtctgcagtccagccttaatatcttttcattgctgcccacaaaagggagaacggagcatctgtttttctcacacatactctcttttcactggcctgcattttcttccattcgtttagagctgtggataaacctacggtgtgaatttctcaggtccaaaaagtcctccgaagagataacccagtacatccaaagttataaagggttcgtcgatataactggcgagcactttgtaaactcatgggtgcagagggaactgccaatggcctctgcgtactgcaatgatagtatctttgcctatgaggaactgcgcctggactcattcaaggattggcccagggagtctgccgtgggggtggcagcactagctaaggctggcctgttttacaccggcatcaaggacatcgttcagtgcttctcctgcgggggctgcttagagaaatggcaagagggtgatgatcccctggacgaccataccaggtgcttcccaaattgtcctttcctgcaaaatatgaagagctctgccgaggtaactccagacctgcagtcccgtggtgagctgtgtgagcttctagagacaaccagtgagagcaatctggaggactcgattgcagtcgggcctattgtgccagagatggcccaaggggaagctcagtggtttcaggaggctaagaatctgaacgagcagctccgggcggcatacacatcagcctccttcagacacatgtcgctcctcgatatcagcagcgatctggccacagaccacctactgggttgcgacctttcgattgcttccaagcacatcagcaaaccagttcaggaacccctggtcctcccagaagtctttgggaacctgaatagcgtgatgtgcgtagagggggaagccggatcaggcaagacagtgctgctgaaaaagatcgctttcctgtgggcatccggatgttgccccctgcttaaccgcttccagctggtattctatctgagcctgtctagcacgcgtccggatgaaggactcgccagtattatctgtgaccagctgctcgaaaaggaaggttcggtcaccgagatgtgtgttagaaatatcattcagcagctgaaaaatcaggtgctcttcttgctggatgactataaggaaatctgtagcattccacaggtgatcgggaaactgattcaaaagaatcatttatcaagaacctgcttattgatcgcagtgagaaccaatcgggctcgcgacatccggcgctatctcgagactatcctcgagattaaagccttcccattttataacaccgtctgcatattgagaaaactattctcacataacatgaccaggcttagaaaattcatggtctattttggtaaaaaccagtcactacagaagattcagaagactccacttttcgtcgcagccatctgcgcccattggtttcagtacccgttcgacccctcatttgacgacgtggctgtctttaagtcgtacatggagcggctgtccttaagaaacaaggccactgcggaaatactgaaagcaaccgttagtagttgtggggaactggcactgaaaggattcttctcttgctgtttcgaatttaacgacgacgatttagcagaggccggtgtcgacgaagacgaagacctgaccatgtgcctgatgtcaaagtttactgctcagagactccgaccgttctatcgattccttagccctgcgttccaagagtttcttgccggaatgcgactgatcgaactccttgacagcgatcgccaagagcaccaggacttgggactgtaccacctcaagcagatcaacagccccatgatgacagtttctgcatacaataactttttaaactacgtgagctctctcccctccactaaagctgggccgaagatagtgtcgcatttattacatctagtggacaataaggagtctcttgaaaatatttctgagaatgacgactatctgaaacatcagccggagataagtctccagatgcagcttcttcgagggttgtggcaaatctgcccacaggcctatttcagcatggtgtctgaacatctgctggtgctagctctgaaaacagcctaccagagtaatactgtggccgcctgtagtccttttgtgctgcaatttcttcaaggaaggactttgacattgggggcactgaacctccagtatttcttcgaccatcccgaaagcctgtcactcctacgttctatccattttcccatacggggtaataaaactagtccccgcgctcacttctcggtcctggagacttgcttcgataaaagccaggttccaaccattgatcaggactatgctagcgcctttgagccaatgaacgaatgggaaaggaatctggccgaaaaagaagacaacgtgaagtcgtatatggacatgcagcggagggcgtcgcctgacctcagcaccgggtattggaaattgagtcctaaacaatataagattccctgccttgaagtggacgtgaacgatatcgacgtagtgggccaggacatgctcgagatcctcatgactgtgttctcagctagccagcgcattgaactgcatcttaatcactccaggggttttatagagtccattagacctgccttagaactttcaaaggcttccgtgaccaagtgttcaatcagtaaacttgagcttagcgctgcagagcaggagctactgcttaccctgccatccctcgagtctttggaagtaagcggcacaatccagtcacaggatcaaatattccctaatctggacaagttcctctgcctgaaagaactgagcgtagaccttgaggggaacatcaacgtgttttcggtaatccccgaggagtttcctaatttccaccacatggagaaattactcatccagattagtgcagagtacgacccaagtaagttagtgaaattaatccagaactctcccaatctccatgtgttccatctcaagtgcaactttttctcggattttggttccctgatgaccatgctggtctcctgcaagaagctgaccgagatcaaattctccgactcattttttcaggccgtgccatttgtcgcgtcactgcccaacttcatttctctaaaaatcctgaacctcgagggccagcagtttccggatgaggaaacatccgagaaattcgcctacatattagggagcctgtcgaatctcgaggaactaatactgccaacgggcgacggcatatacagagtggctaaactgattatccaacagtgtcagcagttgcactgtctcagggtgctgagtttctttaagaccctgaacgacgacagcgtcgtggagattgctaaagtcgccatttccgggggctttcaaaaactagagaatttgaagctcagcataaaccataagataacagaagaaggctacagaaacttcttccaggccctggataacatgccgaacttgcaggaactggatatcagccgacattttactgaatgtatcaaagcacaggctaccacagtgaagagcttgtcacagtgtgtgctgcggctcccacgactgatcaggctcaacatgttaagttggcttctcgatgccgatgacattgccctgctcaacgtgatgaaggaaagacatccacagagtaaatatttaacaattcttcagaagtggattctccccttttctccaattatccaaaagtag

SEQ ID NO: 25321 - DNA, 4212 bp, Artificial Sequence
  Description of Artificial Sequence: Synthetic coding sequence
atggccacccagcagaaggccagcgacgagcggatcagccagttcgaccacaacctgctgcctgaactttctgcccttttgggtttagacgccgtccagctcgccaaagagcttgaggaggaggagcaaaaggagcgagccaaaatgcagaaaggatacaattcccagatgcgaagcgaggccaaacggcttaaaacctttgtaacgtacgagccatactccagttggatcccgcaggagatggctgcggccgggttctactttacaggcgtcaaatcgggcattcaatgcttctgttgctcgttgatcctttttggcgccggcctgaccaggcttcctatcgaggatcataaacgcttccatcctgattgtgggttcctgcttaataaggacgtcggcaacattgcaaaatatgacatccgggtcaaaaacttaaaatctcgtttgaggggcggcaagatgcgttatcaggaggaagaagcaaggctagcatctttcaggaactggccattttacgtacagggcatctccccttgtgtactgagtgaggctggctttgtgtttacagggaaacaggacactgtgcagtgtttcagctgtggtggttgcctgggcaactgggaggaaggggatgacccttggaaagaacatgccaaatggttcccaaaatgtgagttcttaaggtctaagaaatccagtgaagagattactcagtacatccagagctacaaaggctttgtagacattacaggcgagcactttgtaaactcatgggtacagcgagaactgcctatggcaagcgcgtactgtaacgattcgatcttcgcttacgaagagttacggctggacagcttcaaagattggccaagagagtctgccgttggagtggctgccctcgccaaggcaggattattctatactggaattaaggacatcgtacaatgtttctcctgtggaggctgcctggaaaaatggcaagaaggggacgacccactggatgaccatactagatgtttccctaattgtccatttctacaaaacatgaagagcagcgccgaggtgacacccgacttgcaatccaggggagaactgtgtgagttgttggaaaccacatctgagtcgaatctggaagactcaatcgccgtaggaccaattgtccccgagatggcgcagggtgaggcacagtggtttcaggaggctaagaatttaaacgagcagttaagggccgcttacacttcagccagcttccgccacatgagtttactcgatattagctccgatctcgccactgaccatctcttgggttgcgacctcagtattgcttcaaaacacataagtaaaccagtgcaggagcccctggtccttcctgaggtcttcggcaatttgaattccgtgatgtgtgtagaaggggaggctggatccggcaaaactgtgctactaaagaaaattgcttttttatgggcttcgggttgttgtccactgcttaaccgttttcaattggttttttatctgagtctgagcagcacacgcccggacgagggcctggcttccatcatatgcgaccagctgctggaaaaggaaggctctgtgactgaaatgtgcgtgagaaacattattcagcagctgaaaaaccaagtactctttcttttggacgattataaggaaatttgttctatccctcaggttatcggaaagctcattcagaaaaatcatctgagccggacatgcctgctgattgcagtgcgcacaaaccgtgcgcgggacatccggagatatctggaaaccattctcgaaatcaaggctttccccttttacaataccgtatgtattttgcgaaaactattttcccacaatatgacccgactccgaaaatttatggtgtattttgggaaaaaccaatccctccagaagatccagaaaacaccactgttcgtggctgccatctgtgctcattggtttcagtacccctttgatcctagttttgatgatgtggccgtcttcaaaagttacatggaaaggctttcactaaggaataaagccactgccgagattttgaaggccaccgtgtcaagctgtggtgagctagccctgaaagggtttttctcctgttgtttcgaattcaacgatgacgacttggccgaagctggagtagacgaggatgaagacctgacaatgtgcctcatgagcaagtttaccgcccaacgcctccggcctttctatcgcttcctgagccccgcctttcaggagttcctcgccggtatgagactcatcgagctgttggactctgataggcaagaacaccaagatttgggcctgtaccaccttaagcagatcaactcacctatgatgactgtttccgcttataacaattttctgaactacgttagcagcttgccgtctaccaaagcagggcctaagatcgttagccatctgctgcaccttgtcgataataaggagagcctggaaaacatcagcgagaatgatgattacctaaaacatcagcctgagattagtcttcagatgcagctgttaaggggcctgtggcaaatctgtccccaggcttatttcagcatggtttctgagcatttgctcgttcttgctctcaagaccgcttaccagtcaaacactgtggccgcttgctctccatttgtgcttcagtttctgcaaggcagaactctcaccctgggagcgctcaatttacagtacttttttgatcacccggaaagcctttcactactgagatcgattcattttccaattaggggcaataaaactagtccaagagcgcactttagcgtattggaaacctgtttcgacaagagccaagtcccaaccatcgatcaggactatgcgtctgcctttgaacccatgaacgaatgggaaagaaacttggccgagaaagaagataatgtgaaatcttacatggacatgcagcgtcgagcatcccccgacctcagcacaggctactggaaactcagccctaagcagtataaaataccttgtctagaagtggatgtgaatgacatcgacgtggtgggccaagacatgctggaaattctgatgacagtgtttagtgcaagccagcggatcgaactgcacctaaatcactccaggggatttattgagtcgatcaggccagccctcgagttatccaaggcttccgttacaaagtgttcaatctcgaaacttgaattgagcgctgcagaacaggagctgctgctgacgctccctagcctggagtctttggaggtgtctggcacaatccagagtcaggatcagatatttccgaatttggacaagttcttgtgtctgaaagagctttccgtggacctggagggaaacatcaacgttttttctgtgattcctgaagaattccctaacttccaccacatggagaaactgttgatccagatcagcgctgagtacgacccgagtaaactggttaaattaatacagaatagtccaaacctgcatgtgtttcaccttaaatgcaacttcttctccgactttggctcactgatgacgatgctcgtaagttgtaagaagctgaccgaaattaagttcagcgacagctttttccaagccgttccattcgtggctagtttgcccaacttcatctctctcaagattttaaacctggaagggcagcaatttccagacgaggaaacgagtgagaagtttgcctatattcttggctcactttcaaacttggaggaactcatcttgcccaccggggatgggatttatagggtggcaaaactgatcatccaacagtgccaacagcttcattgccttagggtactaagcttcttcaaaacgttgaatgatgacagcgtggttgagattgccaaggtggctatttcaggggggtttcagaaattggagaacctgaagctctctatcaatcacaagattaccgaggagggctatcgcaatttctttcaagccctggataacatgccgaacttgcaggagctggatatctcacgacacttcactgagtgcatcaaggcccaagcaaccaccgtgaaaagcctgagccagtgtgttctcaggctccctcgcttgattaggcttaatatgctgagctggctcctggacgcggacgatatcgctctccttaatgtgatgaaagagcggcacccacaaagcaagtatctcacaatcctgcaaaaatggatcctcccattctcacccatcattcagaaatag

SEQ ID NO: 25322 - DNA, 3726 bp, Artificial Sequence
  Description of Artificial Sequence: Synthetic coding sequence
atgcccctgcacatcggcgacttcgtgtgggacagcaaggtgcactcattgcagtcttcgctcaacattttctccctgctgccaacaaagggtcgcacagagcacctcttcttttctcacatcctgagcttccactggccagcctttagctccatccggttggaactctggattaatctgcgctgcgaatttttgcggtctaagaagtctagcgaagaaatcacgcagtatatccagagctacaaaggattcgtcgatatcactggtgaacatttcgtcaattcctgggtgcagagagagttacccatggccagtgcctactgcaatgattcaatcttcgcttatgaggagctgcgccttgatagctttaaagattggcctcgggaatccgcagtgggcgtggctgccttggccaaggctggtctgttttatactggcattaaagatatcgtgcagtgcttctcatgtggcggctgcttagagaagtggcaggagggagatgaccctttggatgaccacacccggtgttttccgaactgcccgtttcttcagaacatgaagtccagcgctgaagtgactcccgaccttcagagccgaggagagttgtgtgaacttctggagacaaccagtgaatccaatttagaggattcaattgccgtcgggccgatcgtccccgaaatggcccaaggagaggctcagtggtttcaagaggctaaaaacctcaacgaacagcttcgggcagcttacaccagcgcctcatttcggcacatgagtctgctcgacatcagctctgacctcgctacggaccacctactcgggtgcgacctgtctatagcgagtaagcatatcagcaagccagttcaggagcctctggtcctccccgaggttttcggcaatcttaactctgtgatgtgcgttgagggcgaggcagggtccggtaagacagtcctgctgaagaaaattgctttcctctgggcctccgggtgttgtccactcctcaatcggtttcaactggtgttttatcttagcctttctagcacgcggcctgatgaaggactcgcgagcattatatgtgatcagctgctggagaaagaagggtccgtgactgagatgtgtgtcagaaacattattcaacagctgaagaatcaggttctgtttctgcttgacgactataaggaaatctgttcgatccctcaagtaatcggaaaactcattcagaagaatcatttaagcaggacctgtctgctgatagctgtacgaacaaatcgagcaagagacattaggcgatacctggaaactatcctggaaatcaaggccttccccttctacaacacagtttgcatactgagaaagttgttctcacacaacatgacgcgactgagaaaattcatggtctatttcggcaaaaaccagtccttacagaaaatccagaagacaccgctcttcgtagccgctatctgtgcccattggtttcagtatcccttcgacccttcttttgatgacgtggcagtgttcaaatcctacatggaaagactgtcccttcgcaataaagctacagctgagatattgaaagccaccgtgtcttcctgtggggaactggccctgaagggcttcttttcttgttgttttgagtttaacgatgacgatctggcagaggcaggggtggatgaagacgaagatttgactatgtgcctgatgtccaaatttacagcacagagactcaggcccttctaccggttcctgtcccctgctttccaggagttcctggccgggatgcgtttaatcgagctgttggactctgataggcaggaacaccaggatctgggactctaccacctgaaacagatcaacagccctatgatgacagtttctgcttacaataactttctcaattatgtgtcatccctgcctagcacgaaagctggccctaaaatcgtgtctcaccttcttcacctcgttgacaataaagagagtctcgaaaacatttcagaaaatgacgattacctgaaacatcagccggaaatctccctgcagatgcagctactccgaggtttgtggcagatctgccctcaggcctatttttcaatggtgtcagagcacctcctcgtcctggccctgaaaactgcctaccagagcaacaccgtagccgcatgctccccattcgtgctgcagttcttacaagggcggaccctcaccctcggagctctgaatctccaatactttttcgaccaccccgaatcattgtctctgctcagaagcatccatttccccattagggggaacaaaacgtccccccgcgcacacttttctgtcctggaaacatgcttcgataagtcgcaagtccctacaatcgaccaggattatgcatcagcctttgagccaatgaatgaatgggaaaggaacctcgccgagaaagaggacaacgtgaagtcatacatggacatgcagcgacgcgcatcacctgacctgtccacaggctactggaaactttccccaaagcagtataaaattccttgtctcgaggtggacgtaaatgacattgacgtcgtgggccaggatatgctggagatcttgatgacggtgttttccgcctcccagcggattgaactgcacctgaatcattccaggggattcatagagtcgatcaggcccgcccttgagttgtccaaagccagcgttacgaaatgttctattagtaagctagaactgtcagccgccgagcaggagcttttgctgaccctcccgtcgctggaatccttagaagtcagcggcacaatccagtctcaggatcagatatttccaaacttggataaatttctttgtctgaaagaactctcagtggacttggagggcaatatcaatgtattttcggttatcccagaggaattccctaactttcaccacatggagaagctgctgatacaaattagtgctgaatatgatccatctaagctggtaaaattaatacaaaattccccaaacctccacgtgttccatctcaaatgcaatttcttctccgatttcggatctcttatgacaatgctggtgagttgcaaaaaactcaccgaaatcaagtttagcgattcttttttccaggccgtcccctttgtcgcaagcctcccaaattttatctcacttaaaatcctgaatttggagggccagcagttcccagatgaagaaaccagtgaaaagttcgcatatatcttaggcagtctttcaaacctcgaggaactgatactccctacaggggatggcatctaccgggtggctaaactaatcatccaacagtgtcagcagctccattgcttgagggttcttagtttcttcaagacgctaaacgacgactctgttgtggaaatcgcaaaggttgcaatatcgggagggtttcagaaactggaaaatctgaagctttccatcaaccacaaaataacagaggaggggtatcgcaattttttccaggcccttgacaacatgcccaatctgcaggagctcgacatcagcagacacttcaccgagtgcattaaagcccaggcaacgaccgtgaagtccctgagccagtgtgtcctacggctaccacggctcatcagacttaatatgctgtcgtggttacttgacgcggacgatatagcactgttgaatgtcatgaaggagaggcaccctcaatctaaataccttactatcctacagaagtggatactgcccttttccccaatcatccagaagtag

SEQ ID NO: 25323 - DNA, 678 bp, Artificial Sequence
  Description of Artificial Sequence: Synthetic coding sequence
atgctgggcctggacgcctgcgagctgggcgcccagctgctggagctgctgaggctagcactctgcgcgagagtcctcttagctgataaggaagggggccctcccgcagtggacgaagtactggatgaagcagttcctgaatatagagcccccgggcgcaagtccctccttgagatccgacagttggatccagatgatcggagcctcgccaagtataaaagggttctcctcggaccgctgccccctgcagtggatccaagtctccccaatgtgcaggtcacccggctcactttgctgtctgagcaagctccaggacccgtagtgatggatttaacgggtgacctggccgtactgaaagatcaagtctttgtgttaaaggaaggggtggattatcgcgtgaagatctctttcaaggtgcaccgggaaatcgtgagcggcctaaagtgcctgcatcacacatatcggagagggctccgggttgacaagactgtgtacatggttggaagctatggccccagtgctcaggaatacgagttcgtaacccctgtcgaagaagccccaagaggcgctctcgttagaggtccatatttagtggtgtctctattcacagacgacgataggacgcaccatctcagttgggaatggggcctgtgcatctgccaggactggaaggattag

SEQ ID NO: 25324 - DNA, 882 bp, Artificial Sequence
  Description of Artificial Sequence: Synthetic coding sequence
atgcccgcccggagcggcgcccagttctgccggcggatgggccagaagaaacaaaggcctgcacgagccgggcagccccattcctcaagtgatgccgcccaggctcctgcagaacagcctcatagcagcagtgacgccgctcaagctccctgccctcgggaaaggtgcctgggacctcccactactcccggcccgtaccggtctatctatttcagctcacctaaagggcacctcacaagactggggttggagtttttcgaccagcccgcagttcccctggctcgtgccttcctggggcaagtgctcgtgagacggttgccgaatggaaccgaactcagaggccggattgtggaaaccgaggcatacctcggtcccgaggacgaggcggcacattcccgcggtggacggcagacacccagaaataggggcatgtttatgaagccaggcacactctatgtctatataatatacggtatgtacttctgcatgaatattagctcccaaggcgacggtgcttgtgtgctgctgagggccctggaacccctggagggcctggaaactatgaggcagctgcgatccactcttcggaagggcacagcctcaagggtgcttaaggacagggaactatgctctgggccaagcaaactctgtcaggccctggctataaataagtccttcgatcaaagggatctggcacaagatgaggctgtgtggctcgagagaggacctttagagccatccgaaccagcagttgtagcagccgcgcgagtcggggttggacatgctggtgagtgggcgaggaaaccattgaggttttatgtgcgggggtccccttgggtttcagtcgtagacagagtggccgaacaggatacccaggcctag

SEQ ID NO: 25325 - DNA, 846 bp, Artificial Sequence
  Description of Artificial Sequence: Synthetic coding sequence
atgggccagaagaagcagcggcccgcccgggccggccagccccacagctcatcagacgcagcacaggccccagctgagcagcctcatagcagctcagacgccgcacaggccccctgccccagggagcggtgtttaggaccccctaccacacccggcccctaccgctccatatattttagttctcccaaaggccacctcaccaggctggggcttgagttcttcgaccagcccgccgtcccattggccagggcattcctcgggcaggtattggtccggcgcctgcccaacggaactgagcttcggggacgcattgtcgagacagaagcctatctagggccagaggacgaggctgctcactcccgcggcggtagacagacaccacgcaatagagggatgttcatgaagcccgggaccttgtacgtttacatcatttatggcatgtatttttgtatgaacattagctcgcagggagatggtgcatgtgttctgctccgagcgctcgagcccctcgaggggctggagactatgagacaactgcgcagcacactcagaaagggaactgctagtagagtgctgaaagaccgtgagttatgttccggtcccagcaaactgtgtcaagcactggcaatcaataagagtttcgatcagagggacttggcacaggatgaggcagtctggttagagcggggcccgctcgagccatccgagccagcagtggtggccgccgccagagttggggttgggcacgccggggagtgggcgcggaaaccattacgcttctatgtgcgcgggagcccttgggtaagcgttgttgaccgtgttgcggagcaggatacgcaagcgtag

SEQ ID NO: 25326 - DNA, 756 bp, Artificial Sequence
  Description of Artificial Sequence: Synthetic coding sequence
atgggccagaagaagcagcggcccgcccgggccggccagccccacagctcttcggacgctgcacaggctcctgcagaacaaccacactcaagttcggatgcagcacaggcaccctgccctagagaaagatgcctgggaccgcccacaacccctggcccatacaggtctatctatttttccagtcctaagggccacctgacacggctgggtctggagttcttcgaccagcctgcagtcccattggcgagagcattcctggggcaagttctcgtacgacgcctccccaacggaacggaactgagaggccggatcgtggagacagaagcctacctcggacctgaggacgaagccgctcactctcgcggtggccggcagacgccccgcaaccgcggcatgttcatgaagcctggcactctttatgtgtacataatctacggaatgtatttttgcatgaacattagtagccagggcgatggcgcatgcgtactcctacgagcgctggaaccgcttgaaggactggagactatgcggcagctcaggagcacactccgaaaaggcaccgcttccagggtactgaaagaccgtgaactatgttccggaccgagtaagctgtgccaggcactcgccattaataagtcgtttgaccagagagatcttgcacaggatgaggccgtgtggcttgaacgtggaccacttgagccctccgagccggcggtagtggccgctgctcgggtgggagtgggccacgctggctag

SEQ ID NO: 25327 - DNA, 1044 bp, Artificial Sequence
  Description of Artificial Sequence: Synthetic coding sequence
atgcacgcccactgcctgcccttcctgctgcacgcctggtgggccctgttgcaggctggggccgccacagttgccaccgccctgctccgtacaaggggccagccgtcttccccatcaccgctcgcctacatgctgtcgctgtatagggatcccttgcctagggccgacatcattcgttccctgcaggccgaggatgtggcggtggatggtcagaactggactttcgctttcgatttcagcttccttagccagcaggaagatttagcttgggccgagcttcgactccagctctcatcacccgtcgacttgcctacagaaggctctctggccattgaaatattccaccaacctaagcccgacacagagcaggctagcgactcttgtctcgagcgatttcagatggatctgtttacggtgactctaagccaagtgacatttagtctggggagcatggtgttggaagtaactaggcccctttccaagtggctcaagcacccgggcgcccttgagaaacagatgtccagagtggccggcgagtgctggcccagaccacctaccccgcccgcaactaatgtgttgctgatgctttattccaatctgtcacaggaacagcggcaattgggcggatctactcttctgtgggaagccgagtcttcatggagggcccaagaagggcagctaagctgggagtggggtaagcgccataggcgacaccacctcccggatcgctctcaattgtgcaggaaagtgaagttccaggtggacttcaacctgatcggatggggttcatggataatttaccccaaacagtataacgcttatagatgcgagggggaatgtcccaatccagttggagaagaattccaccctacaaatcacgcctatatccaatcgttgcttaaaagatatcagccacacagagtaccctccacttgttgtgccccagtgaaaaccaaacccctttctatgctctacgtcgacaatggacgcgtgctgctggaccaccacaaagatatgatcgtggaggagtgtggatgcctgtag

SEQ ID NO: 25328 - DNA, 879 bp, Artificial Sequence
  Description of Artificial Sequence: Synthetic coding sequence
gaccagcagctgggcatccagaccaaggacgtggccgtggacggccagaactggacatttgcgtttgacttctcctttctgagccaacaggaagatctggcctgggcggagctgcgtctgcagctgagttcgccagtggatctgccaaccgaaggctcactggccattgaaatctttcaccagccaaagccagatactgagcaggcttctgacagctgcctcgaaaggttccagatggatctatttacggtcaccctttcacaggtgaccttctctctgggttccatggtcttagaagtaacccgccctctgtcaaaatggctcaaacaccccggggccttggagaagcaaatgtcccgagtcgcaggggagtgttggccacgccccccaactccccccgctacaaacgtgcttttgatgctgtattcgaatctctcacaggagcagcggcagctcggtggatccacattgctgtgggaggcggagagctcatggagggcgcaggaaggtcagcttagttgggaatgggggaagagacaccgtaggcaccatctccccgataggagccaattgtgtagaaaggtgaagttccaagtggacttcaatctcatcggctggggatcttggattatttatcctaaacagtacaatgcttataggtgcgagggtgagtgcccaaaccctgtcggtgaagagttccacccaacaaaccatgcatatatccagtccctgctgaagcgatatcaaccccatcgagttcccagcacttgctgtgctcccgtcaagacaaaacctctgtccatgctatacgttgacaacggcagagtactgctagaccatcataaagacatgatcgtggaggaatgtggatgcctgtag

SEQ ID NO: 25329 - DNA, 534 bp, Artificial Sequence
  Description of Artificial Sequence: Synthetic coding sequence
atggtgctgctgagcaccctgggcatcgtgttccagggcgagggccctcctattagttcatgtgataccggcaccatggctaactgcgagagaacttttatcgctatcaaacctgatggtgttcaacgcggcttagtaggcgaaatcattaagaggttcgagcagaaaggcttccgattggtaggtctcaaatttatgcaggcgagtgaggatttattaaaagaacattatgtggatttgaaggataggcctttcttcgcaggtctggtcaaatatatgcactccggtcccgtcgtcgctatggtctgggaaggcctgaacgtcgtaaaaactggtagggtgatgctgggtgaaactaaccctgcagactccaagcctggaacaatcagaggagacttttgcattcaggtgggcaggaacatcattcatggatcagacagtgtcgaatccgctgagaaagagattgggctgtggttccatcccgaggagttagtggattatactagttgcgcccaaaattggatttacgaatag

SEQ ID NO: 25330 - DNA, 534 bp, Artificial Sequence
  Description of Artificial Sequence: Synthetic coding sequence
atggtgctgctgagcaccctgggcatcgtgttccagggcgagggccctcctatatctagttgtgatacaggaacaatggctaactgcgaacggacctttatcgccataaagcccgatggtgtccagagagggcttgttggagaaattatcaagcgattcgaacaaaaaggattcagactcgtcggactgaaattcatgcaagctagtgaagatcttcttaaagagcattacgtcgacttgaaagacagaccattttttgccggccttgtgaaatacatgcattccgggccagtggttgccatggtttgggagggactcaacgtggtgaaaacgggcagggtaatgctcggagaaacgaatccagcggactcaaagcccggtaccattaggggagatttttgcatccaggtcgggagaaacatcatccacgggagtgattccgtggagtctgcagagaaagagattggactctggtttcaccccgaagaactggtggattacactagttgtgctcagaactggatctatgagtag

SEQ ID NO: 25331 - DNA, 459 bp, Artificial Sequence
  Description of Artificial Sequence: Synthetic coding sequence
atggccaactgcgagcggaccttcatcgccatcaagcccgacggcgtgcaacgcgggctagtgggggagattatcaagcgctttgagcaaaaaggcttcagattagtgggtttgaagttcatgcaggctagcgaagatctactcaaggaacattacgtggatctgaaagataggccattttttgctggtctcgtgaaatatatgcattctggacccgtcgtcgccatggtatgggaaggcttgaacgtggtcaagaccgggagggttatgctaggcgaaacaaaccctgctgatagcaaaccagggacaatacgtggtgatttctgcattcaggtcgggcgcaatatcatccatggtagcgactctgtggaaagcgcagaaaaggagatcggactctggtttcaccctgaggagctggtggactatacgagctgtgcacagaactggatctacgagtag

SEQ ID NO: 25332 - DNA, 183 bp, Artificial Sequence
  Description of Artificial Sequence: Synthetic coding sequence
atggtgctgctgagcaccctgggcatcgtgttccagggcgagggcccgcctattagtagttgcgatactggcacaatggctaattgcgaacggacctttatagccatcaagcctgacggcgtgcagcgaggcttggtaggagaaatcataaaacgatttgagcagaaaggcttccggttatag

SEQ ID NO: 25333 - DNA, 1443 bp, Artificial Sequence
  Description of Artificial Sequence: Synthetic coding sequence
atggccaccgtgcccggcctgcagcccctgcccaccctggagcaggacctggagcaagaagagatactgattgtgaaggtcgaagaagatttctgcttagaggaggaacccagtgtcgaaactgaagatccaagtcctgagacattccggcagctgttcagactgttctgctaccaggaagtcgctggacccagagaagccttatctaggttatgggagctctgttgtagatggctccggcccgaactgcggaccaaagagcagattctcgagttactggttctggagcagtttttgaccgtacttcctggcgagattcaagcgagggtacgtgaacagcagccagagagtggcgaagaggcggtggttcttgttgagggcctgcaacggaaaccgcgtaaacacaggcagcgcggaagcgagttactcagtgacgacgaggtccctctaggcattggggggcagttcctcaaacatcaagcagaggcacagccagaggaccttagtctggaggaggaggccagattttccagtcaacagccgcccgctcaactgtcccatcggccccagcgagggccattgctgtggcctgagcggggacctccagccccgcgacaccaggagatggcaagcgcctcaccatttctgtctgcttggagccaggtgccagttaaccttgaggacgtggcagtttaccttagtggcgaggagccacggtgtatggatcctgcgcagcgagatgcacctctggaaaatgaaggcccgggaatccaactggaggacggcggggacgggcgggaggatgcccctcttagaatggagtggtaccgcgtgcttagtgctagatgtcagggacctggacacccattgcctggacagcgccccgccccagtgaggggcctagtgaggcctgatcagcctaggggcggtcctccgcctggcagacgcgccagccacggggcagataagccctatacatgcccagaatgcggcaagggcttctctaagacaagtcatcttaccaaacatcaacgtactcatacaggtgaacggccttataagtgcttagtgtgcggcaaggggttttcagatagatcaaacttctcaacccaccagcgggtgcacactggcgaaaaaccgtacccctgtcccgagtgtggaaaaagattctcacagagcagctccctcgtgatccatcggcgtacgcattccggcgagaggccatatgcttgcacgcaatgcggtaaaagattcaacaattctagccacttcagtgcacatagaaggacacatacaggagaaaagccatacacctgtccagcgtgtggccgagggttcagacgaggcactgacttgcataaacaccagcgtacccatatgggggctggcagcctcccgacacttcagcccgtggcacccggcggccccggtgcgaaggcctag

SEQ ID NO: 25334 - DNA, 588 bp, Artificial Sequence
  Description of Artificial Sequence: Synthetic coding sequence
atgggcggcctgttctggcggagcgccctgcggggcctgcggtgcgggcccagggcaccaggaccatctctgctagtgcggcacggtagtgggctgcctccaagcgccctgaagcgaggtccgagttggacaagggagcggactctggtggcagtgaaaccagacggtgtgcagcgtaggctagtcggggacgtaatccaaaggttcgagcggcggggcttcactcttgtgggaatgaaaatgctccaggcacccgaatccgtgttggccgaacattaccaggacctccgacggaagccattttatcccgcactgataaggtatatgtcatcgggtcctgtggtggcaatggtttgggagggatataacgtggtccgagcgtcaagggcaatgataggtcacacggactccgctgaggccgcccctggaactataaggggcgacttctccgtccacatttcccgaaacgtcatacatgccagtgattccgtcgaaggtgcccaaagagagatccaactttggtttcagtcctcagagctggtgtcctgggctgacggcgggcagcacagcagcattcaccccgcctag

SEQ ID NO: 25335 - DNA, 354 bp, Artificial Sequence
  Description of Artificial Sequence: Synthetic coding sequence
atgaagatgctgcaggcccccgagagcgtgctggccgagcactaccaggatctgaggcggaagcctttctacccagccctgatcagatacatgtctagcgggccagtggtggcgatggtgtgggaggggtataacgttgtccgggccagccgagcaatgatcggacacacagatagtgcagaggccgccccaggtaccatcaggggcgatttctctgtccacattagccgcaatgtgatccacgccagcgactcggttgagggagcccagcgcgaaatccagttgtggttccagagctccgaactcgtttcctgggcagacggtggtcagcattcatccatacaccctgcctag

SEQ ID NO: 25336 - DNA, 510 bp, Artificial Sequence
  Description of Artificial Sequence: Synthetic coding sequence
tgatggcggagcgccctgcggggcctgcggtgcggcccccgggccccaggtccctcactcctcgtgcggcacggcagtggcgggcctagttggacacgagaacgcacactggtcgccgtcaagccagacggcgtgcagaggcggctggtcggagatgtgattcagcgattcgaaaggcggggatttacgcttgttggtatgaaaatgttgcaggcacccgagtccgtactcgccgagcattatcaagacctccggaggaagccgttctatcctgcactgatcagatacatgagttctggacctgtggttgccatggtgtgggaaggctataacgtcgtcagagccagtagagccatgatcggacacactgatagcgctgaggccgccccgggaacaatcagaggtgattttagtgttcatattagtagtcacagactggccccactcgatagaggccagcgtgagcagcagatggtacctggaatccctcagggggcccacgaagcctag

SEQ ID NO: 25337 - DNA, 702 bp, Artificial Sequence
  Description of Artificial Sequence: Synthetic coding sequence
atgggcggcctgttctggcggagcgccctgcggggcctgcggtgcggcccccgggcccctggaccctctcttcttgtgaggcacggcagtggcgggccaagctggactcgggaaagaactttagtggctgtcaagccagatggtgttcagcgacgcctcgtgggtgatgtaatccagcggttcgagcgccggggcttcaccctggtcgggatgaaaatgctgcaagctcccgagagtgtgttggcagaacactatcaggacctgagaagaaaacccttctaccccgctctcattagatatatgtcttctggtccagttgtggccatggtttgggaaggttacaacgttgtccgtgctagtagggccatgattgggcacactgactcggccgaggccgcccccgggactattagaggggatttctctgtccacatttcaagaaatgtcattcatgcgtccgatagcgtggaaggggcgcagcgggagatccagctgtggtttcaaagcagcgaacttagtcccaccggcgctccatggccatccagaagacccacctggagaggcacgactgtttctccacgtactgccacctcttctgcacggacatgttgtggaactaagtggccttcctcacaagaggctgcacttggcctgggaagcggcttgcttcgcttctcctgtgggaccgctgctattcgttag

SEQ ID NO: 25338 - DNA, 354 bp, Artificial Sequence
  Description of Artificial Sequence: Synthetic coding sequence
atgaagatgctgcaggcccccgagagcgtgctggccgagcactaccaggacctcagacgcaaacctttctaccccgctctgatccgatatatgtcctccggccctgtcgtcgcgatggtctgggaaggctacaatgtcgtccgggcatcccgtgccatgattggacacacggactcagccgaggctgctcccggcacaattcgcggcgatttctccgtgcatataagccgcaacgtgatacatgcgtcggactctgtggaaggcgctcagcgtgagatacagctctggttccagagtagcgaacttgtctcgtgggctgatggtggccagcactctagtattcacccagcctag

SEQ ID NO: 25339 - DNA, 114 bp, Artificial Sequence
  Description of Artificial Sequence: Synthetic coding sequence
atgaagatgctgcaggcccccgagagcgtgctggccgagcactaccaggacctgcgtcgcaaacctttctatcccgctctaattcggtatatgtctagcggcccagttgtgtag

SEQ ID NO: 25340 - DNA, 195 bp, Artificial Sequence
  Description of Artificial Sequence: Synthetic coding sequence
atgttcctgcagtactacctgaacgagcagggcgaccgggtgtacacgctgaaaaagttcgaccccatggggcagcagacatgtagcgctcaccctgcccgatttagccccgatgacaagtactcacgacaccgaattaccatcaagaaacgattcaaggtcttaatgacgcagcagcctagacccgtattatag

SEQ ID NO: 25341 - DNA, 7668 bp, Artificial Sequence
  Description of Artificial Sequence: Synthetic coding sequence
atgccccccctgctggcccccctgctgtgcctggccctgctgcccgccctagcagctcgcggtccaagatgttcccagccaggcgagacgtgtttaaacggaggtaaatgtgaggccgcaaatgggacagaggcctgtgtgtgcggcggtgcgttcgtcggaccacggtgccaggacccaaacccctgtttaagcacaccatgtaaaaacgccggtacctgtcacgtggtggataggcgcggggtcgccgattatgcatgtagctgtgctctcggcttctccggaccattatgccttactccacttgataacgcctgcctgacgaatccgtgcaggaatggaggtacttgcgacctccttacactgacggagtataagtgccgatgtccacctggctggtccggcaaatcctgccagcaggcagatccctgtgctagcaacccgtgcgctaacggtgggcagtgtctcccctttgaggcctcatatatctgccactgtcctccaagttttcatggcccaacgtgtaggcaagatgttaacgagtgtggccagaaaccgggactgtgtagacatggcgggacctgccacaacgaagtagggtcttaccgctgcgtgtgccgggcaactcacacaggtcctaactgtgaaaggccctacgtgccgtgcagcccgtccccttgtcagaatggcggaacctgcaggccgaccggggatgtaactcacgaatgcgcatgcctaccgggctttacaggccagaactgtgaggaaaatatagatgattgtcctggcaacaattgtaaaaacgggggcgcctgcgttgacggcgtgaacacatataattgcagatgcccacccgagtggactggacagtattgtaccgaagacgttgacgagtgccagctgatgccaaatgcttgccagaatggagggacttgtcacaatacccatgggggttacaattgtgtatgcgtcaacggatggaccggggaagattgtagcgaaaatatcgacgactgtgcaagcgccgcctgctttcacggggccacatgccacgacagagtggctagcttttattgtgagtgcccgcatggacggaccgggctcctctgtcatctgaatgatgcgtgcatttcaaacccttgcaacgaaggatccaattgtgacacaaaccccgtgaacggtaaggctatttgtacctgtccctctgggtacacggggccagcgtgcagccaagacgtagatgagtgctccctgggcgcgaatccttgtgagcacgctggcaagtgtataaatacactggggtcatttgagtgccaatgcctccaggggtacacaggacctcggtgtgaaattgatgtaaacgaatgtgtaagtaacccctgccaaaacgatgctacctgtctcgaccagatcggcgaattccaatgtatttgtatgccaggatatgaaggcgtgcactgcgaagtgaacactgacgaatgcgcctcaagcccttgccttcataacggaaggtgcctagataagatcaatgagtttcaatgtgagtgtcctacaggcttcaccggacacctatgtcagtacgatgtggatgaatgtgccagcacaccatgtaaaaatggagcgaagtgtctggacgggccgaatacttatacatgtgtctgcaccgagggatacacagggacacattgcgaagtggacattgatgaatgtgatcctgacccgtgccactatggttcttgcaaggacggagtcgctacttttacttgcctgtgtcggccagggtacacaggacaccactgcgagacaaatataaacgagtgctcaagccaaccatgccggcacggagggacatgtcaagatcgggacaacgcttacctgtgcttttgtcttaaagggaccactgggcctaattgcgaaattaaccttgacgactgcgcatcttcgccatgtgatagcgggacgtgcctggacaagatagatggctatgagtgtgcctgcgagccaggttacacagggagtatgtgcaacatcaatatcgacgaatgtgctggaaacccgtgtcacaatggggggacatgcgaggacggcatcaacggctttacgtgcagatgccccgagggataccacgatcccacctgtctaagcgaggtcaacgaatgtaactctaatccctgcgttcacggggcttgtcgtgatagtctgaacggatacaaatgtgattgtgatcccggatggtctggaactaactgtgacatcaacaataacgaatgcgagagtaatccctgtgtgaatgggggaacatgcaaggacatgacgagcgggtatgtgtgcacatgccgcgagggattctctggcccaaattgccaaaccaatataaatgagtgcgccagtaatccctgtctcaatcagggcacatgcattgacgatgtcgccggatacaagtgtaactgccttcttccgtatactggcgcaacgtgcgaggtggtgctcgctccttgcgcgccctctccctgccgaaacggaggagagtgtcgtcaatcagaagattatgagtctttctcttgtgtgtgccccacaggctggcaaggccagacctgcgaggttgatatcaatgaatgcgtgcttagcccctgcagacatggcgcctcatgccaaaacacccatggagggtacaggtgccactgccaagctggttactcaggacggaattgtgaaacggacatcgacgattgcagacccaacccctgtcataacggcggaagttgtaccgacggcatcaatacggccttttgcgattgcctgcctgggttccgaggcactttctgtgaggaggatatcaacgaatgcgccagcgatccttgtaggaatggagcgaattgcaccgattgcgtagactcttacacatgcacctgtcctgcgggctttagtgggatccactgtgagaataacactccggactgtactgagtccagttgttttaacgggggaacatgcgttgatgggatcaactcattcacctgtctttgcccacctggtttcacaggctcctattgtcagcatgatgtgaacgaatgtgactctcagccctgcctacatgggggcacgtgtcaagatggttgcggcagctacagatgcacttgcccacagggctacacgggcccaaactgccagaacctagtgcactggtgtgatagctctccatgcaagaatggtggaaaatgctggcagacacacactcagtaccgttgcgagtgccccagcggctggaccgggctgtactgtgatgtgcccagcgtgtcctgtgaggtggccgcccaaaggcagggtgtggacgtcgcccggctgtgtcagcatggaggcctctgcgtggacgccgggaatacacaccactgcagatgtcaggccggctacaccggctcctactgtgaagacttggttgatgagtgttccccatccccatgccagaatggtgccacctgtaccgattatctggggggatattcctgtaagtgcgtggcagggtatcacggggttaattgcagtgaggagattgatgaatgtcttagtcatccctgccagaatggaggaacttgcttggatctgccaaacacatacaagtgtagttgtccacgcggaacccagggagtgcattgcgaaattaatgtggatgactgcaatcccccggtggaccccgttagccgctcgcctaagtgctttaataacggtacttgcgtcgatcaggttggtggttactcatgtacttgtccccccggtttcgtgggggagaggtgcgagggcgacgtgaacgagtgcctgtcgaatccgtgcgatgccagggggactcagaactgtgtgcagcgggtcaatgattttcattgtgaatgcagagccggacacactgggcgccgttgcgagtctgtgatcaacgggtgcaaggggaaaccttgcaagaatggcggcacttgcgctgtggccagtaacacggcccggggttttatttgtaagtgcccagctggctttgaaggagccacttgtgaaaacgacgcgcgcacctgtggctccctaaggtgcctaaacggcggaacatgcatcagcgggccccgcagtcccacatgtttatgcctgggaccgtttaccggaccggagtgtcaattcccagccagtagcccttgtctggggggcaatccctgttataaccagggaacatgcgagcccactagcgaatcccccttttaccgatgcttgtgtcctgctaagtttaacgggttgctgtgtcacatcctggactactcatttggaggtggcgcaggaagggatatacccccaccgctcatcgaggaggcttgcgaactcccggaatgccaggaggatgctggcaataaagtgtgttccctgcagtgtaacaaccacgcttgcggttgggacggcggcgactgttccctgaacttcaatgatccctggaagaattgcacccaatccctacagtgctggaagtactttagcgatggtcactgtgacagccagtgcaactcggccgggtgtctattcgatggcttcgattgtcagcgggcggaggggcagtgcaatccactctacgaccagtactgcaaggaccacttcagtgatggccattgcgatcaagggtgcaattcagctgagtgcgagtgggacggcttagactgcgctgagcacgtgccagagcgtctagcagcaggaacccttgttgttgtggtcttgatgcccccagaacagctgcggaactcaagctttcatttcctcagagagttgagcagggtcctgcatactaacgtcgtatttaagcgggacgctcacgggcagcagatgattttcccttactacgggcgtgaggaggagctccggaaacatcccatcaagagagctgctgagggatgggctgccccagatgcattattggggcaggttaaagctagtctcctaccaggtggcagtgagggcggccgtagacgtcgcgagctcgatcctatggacgttcgtggctccatcgtttatctggagattgacaatcgccaatgtgttcaggccagcagccagtgctttcagtctgccactgatgtggccgctttcctgggtgcactggcctctttaggttctcttaatatcccctataaaatagaggccgtgcaaagcgagacagttgaaccaccccctcctgcccagttgcatttcatgtacgttgccgctgctgcctttgttctattatttttcgttggctgtggcgtacttctatctcgcaaaagaagacggcagcacgggcagctctggtttcctgagggctttaaagtgtccgaggcatcaaagaaaaagagacgcgaacccctaggcgaggattccgttgggctgaagccactgaaaaacgcatctgatggtgccttgatggacgacaatcaaaatgagtggggcgatgaggacttagagaccaagaagtttcggtttgaggaaccagtagtccttccggacctagatgatcaaactgaccacaggcagtggacccagcagcacctcgatgccgccgacctgaggatgtctgctatggctcctacccctccacaaggcgaagtggacgcagactgtatggatgtgaatgtgaggggtcccgatgggttcacccccctgatgatagcttcatgcagcggggggggactcgagaccggcaactccgaagaggaagaagatgctcccgctgtaatctcagactttatctaccagggcgcctctctgcacaatcaaaccgatcgtaccggggagacggccttgcatctggccgctcgatatagtagaagcgatgctgccaagcggcttttggaagcgtcggccgacgccaacatacaggacaatatgggacgaacaccgctgcatgccgctgtctcagccgacgcacagggagtcttccagatcctcatccgtaaccgggctactgacctagatgctaggatgcatgacggaaccaccccactgatcttggccgcaagacttgcagtagagggcatgctggaagacctcatcaattcccatgcggacgtcaacgcagtcgatgatcttggcaaatcagcgctgcactgggccgccgcggttaacaacgtggacgctgcagtggtcttactgaaaaatggagctaacaaggatatgcagaacaacagggaagaaaccccactgtttttggccgcacgagaaggctcttatgagactgccaaagtgctgctggatcacttcgctaatagagatatcactgaccacatggacaggctcccacgcgatatcgcgcaggaacggatgcatcatgatattgtgagacttcttgacgagtataatcttgtccggtcaccacagctccatggagcccccttgggcggaactccaaccttgtcacccccactgtgctctcccaacggctatctcggcagtctgaagcctggggttcagggtaagaaggtccgcaagccatctagtaaaggtctggcgtgtggtagcaaggaagctaaagatctcaaggcccgcaggaaaaagagccaggacggtaaaggctgcctcctagattctagcggcatgctgtctccagtcgattctctcgagtctccacatggttatctgtcagatgtcgcatccccacccttgcttccatcaccttttcagcagagcccttcagtcccacttaatcacctcccaggtatgcctgatacgcatttagggatcggacacctgaacgttgccgccaagcctgagatggctgcactagggggggggggacgcttagcgtttgagacaggccctccaaggttgtcacacttaccagtggcttctggaacatctaccgtcctcggctcatcttcgggcggagccctgaatttcacggtcggcgggtctaccagcctgaacggccagtgtgagtggctgtctcgcttacagtcaggaatggttccgaatcagtataatccccttcgcgggtcagtggcccccggacctctatcaacacaggctccatctctgcaacacggcatggtggggcctttacattcctcactggctgcaagcgccctatcacagatgatgtcctaccagggcctgcccagcacgagactggccacacaaccacatctggtccagacccaacaggtacagccgcagaatctgcagatgcagcagcagaacctgcagccagctaacatccagcagcagcagtccctgcaaccacccccaccaccgccacagcctcatctgggagtttcgtctgctgccagcggtcatttgggtcggtcgtttctctccggggaaccctcacaagcggacgtccagcctctcggacccagctccctagctgtacatactatcctcccgcaggagtctcctgccctaccgacctccctcccaagctccctggtcccgcctgttacggctgcacaattcctcacgccacccagtcaacattcgtactcttcacccgtggataataccccttcacatcagttgcaggttccagaacaccctttcctcacgccttccccagagagcccagatcaatggagtagttcctcaccacactctaacgtctcggactggagcgagggtgtctcttcccctcctacatctatgcagtcacagatagcacgaatccccgaggcctttaagtag

SEQ ID NO: 25342 - DNA, 6012 bp, Artificial Sequence
  Description of Artificial Sequence: Synthetic coding sequence
atgcagccccccagcctgctgctgctgctgctgctgctgctgctgctttgtgtcagcgttgtgagaccacgcgggcttctgtgcggatcattccctgagccatgtgccaacggcggcacctgcctgagtctcagcctcggtcagggtacttgtcagtgcgccccaggctttctgggggagacatgtcagtttccagacccgtgccaaaacgcccaattatgccaaaatggcggaagctgtcaagccctgctgcctgcccccctggggctccctagcagcccaagcccgctgacaccttcttttctgtgcacctgtctccccgggtttacaggagaacgctgccaggccaagcttgaggacccatgcccgcccagcttctgcagtaagcgcgggagatgccacattcaggccagtggaaggccccagtgcagctgtatgcccggctggacaggtgagcagtgccagcttagggacttttgctctgccaatccttgtgtgaacggtggggtgtgtctcgcaacctacccacagatacagtgccattgccccccggggtttgaggggcatgcttgtgagagagatgtgaatgagtgcttccaggaccctggaccctgccccaagggaacttcctgtcacaatactctgggctcttttcagtgtttatgtccagtggggcaagagggaccccggtgcgaattgagagctggtccgtgccccccaaggggctgctcgaacggtgggacctgtcagctgatgcccgagaaagattccacatttcacctgtgcctgtgccctcccggattcatcggccccgactgcgaagtgaacccagataattgcgtgtctcaccaatgccaaaacggcggaacctgtcaggacggtcttgatacctatacatgcctctgcccagaaacatggacagggtgggattgttctgaagatgtggatgagtgcgagactcagggcccaccacattgccgaaatggaggtacctgccagaacagcgccggctccttccattgcgtctgcgtgagcgggtggggaggaacctcctgcgaagaaaatctcgacgactgtattgccgcaacttgtgcccccggctccacatgcattgatagagtcggcagcttctcttgtctttgtcctcctgggagaactggcttgctgtgtcacctggaggacatgtgcctaagccagccttgtcacggtgacgcccagtgctctacgaacccgctaacaggctctacactgtgtctgtgccagccgggttactctggccccacttgtcatcaagacctggatgaatgtctgatggcgcagcagggcccctccccgtgcgagcatggcggatcgtgtctcaacacaccaggttcatttaattgtctgtgcccacctggttacacaggcagccgttgtgaagccgaccacaatgagtgcctttcacaaccatgtcacccagggtccacctgtctagaccttctggctacctttcactgtttgtgtccccctggcctcgaaggtcagctctgtgaagtggaaaccaatgagtgcgcttcagccccatgtctcaaccatgccgactgtcacgatcttctgaatggctttcagtgtatctgtctgcctggtttcagcggaactagatgcgaagaagacatcgatgaatgtagaagctcaccatgcgcgaatgggggccaatgccaggaccagccgggtgcttttcactgtaaatgcctgccagggttcgaaggcccccgctgtcagaccgaggtggacgagtgcctgagcgacccgtgccccgtgggtgcttcatgtctcgatctgcccggagcctttttttgcttgtgcccatccggatttactggacaactctgtgaggtccctctgtgtgcgcccaacttgtgccagcctaaacagatttgcaaggaccagaaagacaaagcaaactgcttatgccccgatgggtcccccggctgcgctcctcctgaggataattgtacttgtcaccacgggcattgtcagagatcgtcatgcgtctgtgacgtgggctggacaggtcccgagtgtgaagccgaactgggcgggtgtatcagcgcaccatgcgcgcacggcggaacttgctacccacagccgagcggatacaactgcacttgtccgacaggatacacaggacccacatgctcggaagaaatgacggcttgtcactctggaccatgtctcaatggcggttcctgtaacccaagccccggaggttattactgcacctgcccaccaagccacaccggccctcagtgtcaaacaagtaccgattattgcgtgagcgcaccttgcttcaacggaggaacatgcgtgaatcgcccaggtactttctcatgtctgtgtgccatgggctttcaggggccccggtgtgagggtaagttaagacctagttgcgccgattccccttgtagaaaccgcgccacttgccaggatagtccccaggggcccaggtgtctctgtccgacagtgtacactggggggtcatgtcagactttgatggacctctgcgcccagaagccatgcccaagaaactctcactgcctccagacagggccgagtttccattgtttatgcctgcaagggtggaccggtccgctgtgcaatttacccctttcctcctgccaaaaagccgccctctcccaagggattgatgtgtcatcactgtgccacaacgggggactctgtgtggactcggggccatcctacttttgtcactgccctcctggctttcaagggagtctgtgccaagatcatgtcaatccttgtgaatcaaggccctgtcagaatggagccacctgcatggcacaaccctcaggctacctgtgccagtgcgccccaggctacgatgggcagaattgttccaaggagctggatgcctgccagtcccaaccttgccacaatcatggaacttgtactcccaagccaggtggttttcattgtgcttgccctcctggttttgtagggctgcggtgtgaaggagatgttgacgagtgcttagaccaaccttgtcaccccactgggactgcagcttgtcacagcttggccaatgccttctattgccaatgcctgccagggcatacaggtcagtggtgcgaagtggagattgacccttgtcattctcagccctgcttccatggaggtacctgcgaggcgacagccggctctccactcggattcatctgtcattgccccaagggattcgagggtccgacctgtagccaccgcgctcctagctgtggctttcatcactgccaccatggagggttatgtctcccatctcctaagcctggattccccccacgttgcgcatgtctgagtgggtacggggggcctgattgcctcacacccccagcgccaaagggttgcgggccaccaagcccttgcctgtacaacgggagctgttccgagaccacaggcctgggcggcccagggtttaggtgctcgtgccctcattcgagtcctggcccccgatgtcagaagccaggcgctaagggctgcgagggccggtcaggggacggagcctgcgatgcgggttgctccggtccaggcggcaactgggacggaggcgattgcagccttggcgtgcctgacccctggaaggggtgcccatctcactcaagatgctggctcctctttcgcgacggccagtgccacccccagtgcgattcagaggagtgcctctttgatgggtatgactgcgagacccctcccgcttgtaccccagcctatgatcagtactgccacgatcattttcacaacggacactgtgagaaaggctgtaataccgctgagtgcggctgggatggcggagattgtcgccccgaggacggcgaccctgaatgggggcccagcttggccctgcttgtagtgctttctccacccgcgctggaccaacagttgtttgccctcgcccgcgtcctaagtctaactctgcgcgtaggcctgtgggtccgcaaagacagagacggacgcgatatggtgtatccttacccgggggctcgggcagaggaaaaactagggggaaccagggaccccacctaccaggagagggctgccccacagacccagcccctgggcaaggaaactgattccttgtcagccggttttgtggttgtgatgggcgtggacctttctagatgcggcccagatcacccagcttcaagatgtccatgggatccaggcctcctgctgcgttttctcgctgcaatggccgcagtcggcgccctcgaacctttactgccagggcctctcctagccgtgcatccccacgcaggaaccgctccacccgctaaccagcttccttggccagtcctttgttcaccggtggctggggttattttgcttgcgttaggtgccttgctggtgctgcaactgattcgaagacggcggagggagcacggggctctttggctgcctcccggattcactcggcgtccccgcacacagtctgcccctcacaggaggaggcctcccctgggcgaagattccatcgggttaaaggccctgaagcctaaggcggaggtggacgaggacggagtggtgatgtgcagcggacctgaagagggcgaggaggtggggcaggccgaagagacaggccctccttcaacctgccagctttggtcactgtcggggggatgtggagctctccctcaagcagccatgttgactccgccacaggagagcgaaatggaggccccggacttagacacccgaggtcctgacggcgtcacgcctctgatgagcgcagtgtgctgtggggaagtccagtcaggcacctttcagggcgcctggttggggtgccctgagccttgggagcccctccttgacggcggtgcctgtcctcaggcacacaccgtcggaaccggcgaaacccccctccacctggcagctcgcttctcacggccaacggccgctcgaagactcctggaagctggcgcaaatccaaatcagcccgatcgagccggacggaccccactgcacgccgcagtcgcagcagacgcaagagaagtgtgtcagctgctgttgcgatccaggcagacagccgtagatgcccggacagaggacggaacaacaccactgatgctggctgctaggctcgccgtcgaagatttggtcgaggaattgatagccgctcaggccgatgtgggcgccagagacaaatggggaaagacagccctccactgggccgcagctgtcaataatgcacgagcagctagaagcctactgcaggcaggtgctgacaaggacgctcaggataacagagagcagacgcctcttttcttggccgcgcgcgagggcgccgtggaggtcgcccagctcctgctgggcctgggcgcggccagggagctacgcgaccaggctggtctggcacctgcagacgtcgctcatcagaggaaccactgggacctgctgactctcttggaaggcgccggcccccctgaggcccgtcacaaggcaactcccggtagagaggctggccctttcccccgagcccgaaccgtctcagtgtcggtccccccccacggtggaggtgccttacccaggtgcagaactctctctgcaggggcgggacctaggggtgggggggcgtgcctgcaagcacgaacgtggagcgtcgacctggctgcccgcggggggggggcatatagccactgtcgctcgctcagcggcgtgggggccggaggaggaccaacaccacgcggaaggaggttctccgctggcatgcgtggcccacggcccaaccccgccattatgaggggaagatatggcgttgccgccgggcggggaggaagagtctccaccgatgattggccatgcgactgggtggcactgggcgcctgcgggtccgcttctaatatacccatccctcctccctgtctcacgccatcccccgaacgaggaagtccacaactagattgcgggccgccggctttgcaggaaatgccaattaatcagggcggcgaggggaagaaatag

SEQ ID NO: 25343 - DNA, 561 bp, Artificial Sequence
  Description of Artificial Sequence: Synthetic coding sequence
atgagcgccgtgtgctgcggcgaggtgcagagcggcaccttccagggggcatggctgggatgtcctgagccatgggagcccctgctggatggcggggcctgcccgcaggctcacaccgtcggcactggagagacccctctgcaccttgctgcccggttttctcggcccaccgctgcacggcggctgctggaagccggagccaatcccaatcaaccagaccgtgcgggtcgcacacctctacacgctgccgtcgcggcagacgctagggaggtgtgtcagttattactgcgatctcgtcagacagctgtggatgccaggacagaagacggcactaccccactgatgctcgccgccagactggccgttgaagacttagtagaggagctgatagctgcccaggccgatgtgggcgcgcgggacaagtggggcgcagacgcggccatccctggaggcgcggggagaagtggggggtcctcaccagccacagcaggcgcaggtgggtccccacgagcagccggacccggctgggcctcagcaggtgggagaagaagcccaacttag

SEQ ID NO: 25344 - DNA, 1734 bp, Artificial Sequence
  Description of Artificial Sequence: Synthetic coding sequence
atgcactggctgcggaaggtgcagggcctgtgcaccctgtggggcacacaaatgagtagtcgcactctttacatcaatagccgccagctggtatcgctccagtggggacatcaggaggtccccgcgaagttcaatttcgctagcgatgttctggaccactgggcggacatggagaaggccgggaagcgcttgccttcgccagctctgtggtgggtgaacggtaaagggaaggagctgatgtggaactttagagagctctcagaaaacagccagcaggccgctaacgtactgagcggtgcctgcggactgcagcgcggagatcgtgtcgccgtggtactaccacgagtgccagaatggtggctagtcattctggggtgtattcgggcaggattgatctttatgccaggcactatacagatgaagtctacggacatcctgtacaggctgcagatgagcaaagcaaaggctatagtggccggcgacgaggtcatacaagaggttgatacggtggcctcggagtgtccctccctacggattaagttgctcgtgtcagagaaatcttgcgatggctggctgaactttaaaaagctgttgaacgaggcaagtactactcaccattgcgtggagactggctcacaggaagcgagtgccatctactttacatcagggacctctggcctgcctaaaatggccgaacacagctactcatcactgggactcaaggcaaagatggatgcggggtggaccggtctgcaggccagtgacataatgtggaccatctcagataccgggtggatactgaacatcttgtgttctctcatggagccatgggccctgggtgcatgtacttttgtgcaccttctcccaaaatttgatcccctagtcatcctcaaaaccctgagctcctatccaattaaaagtatgatgggagcaccgatcgtgtacaggatgctcttgcagcaggaccttagctcttacaaatttccgcacctgcagaactgtgttaccgtcggggaatcactgctgcctgaaacactggaaaattggagggcacagactggcctggatatacgcgagtcttacggacagacagaaactggtctgacgtgtatggtgtccaagacaatgaagattaaacccggatacatgggaactgcggcatcctgttacgatgtgcaaatcatcgacgataagggtaatgtgctccctccagggacagaaggggatattgggatccgggtgaaacctatcaggccaatcggtatattctcagggtacgtggacaaccccgataaaaccgcagccaacatacgcggagatttctggctactgggcgatagaggaatcaaggacgaagacgggtatttccaattcatgggcagggccaatgatatcattaactcttcagggtatcgcattgggccttccgaagtggaaaatgctctcatggagcaccccgccgtcgttgaaacggccgtcattagctcccccgaccccgttaggggagaggtggtcaaggcattcgtggtgttggcgagtcagttcctctctcacgaccccgagcagctcactaaagaactacagcaacatgtcaaatcggttaccgccccgtacaagtatccccgtaaaatcgagttcgtccttaacctcccaaaaactgttaccggtaagatccagcgagcgaaattaagggacaaagagtggaaaatgagcggaaaggcccgggctcaatag

SEQ ID NO: 25345 - DNA, 4368 bp, Artificial Sequence
  Description of Artificial Sequence: Synthetic coding sequence
atgggcggcgcctgcagcagcttcaccaccagcagcagccccaccatttactccacctctgtaaccgatagcaaagcgatgcaggttgagtcttgctcaagcgccgtaggagtaagtaaccgtggagtcagtgaaaaacaactgacctcgaatacagtgcagcagcatccctccacacccaagaggcatactgtgctgtatatctcccccccccccgaagacctcttagataactcccgaatgagttgtcaggacgaaggctgtggactcgagagcgagcagagttgtagcatgtggatggaagactcacccagcaatttttctaatatgtccactagttcctacaacgataatacagaggttcctaggaaatcgcggaagcgtaaccccaaacagaggcctggagttaaaagaagagactgcgaggagagtaatatggacatctttgacgcagattccgctaaagcacctcattatgtcctctctcagctgaccactgacaacaagggaaactcaaaggccgggaacggaaccctggaaaaccaaaagggtacaggggttaagaagagcccaatgctgtgtggtcagtatccagtgaagtcggagggtaaagagcttaaaattgtggtgcaacctgaaactcagcatagggctagatacctgactgagggaagtcgcggttctgtcaaggatagaacccaacagggctttcccacagttaaactcgaaggccacaacgaacctgtggtccttcaggttttcgttggaaacgactctggcagagttaagccccatggtttttatcaggcctgcagggtcaccggaagaaataccacaccctgtaaggaagtggacattgaagggacaactgttattgaggttggcttggaccccagtaacaacatgactctggccgtggactgcgtgggcattcttaagctgaggaacgctgacgtcgaagcacgtatcgggatcgcaggctccaaaaagaaaagtactcgcgcccgcctcgtctttagagtaaacataatgcggaaagacggatcaacactgaccttgcagacccctagctctccaatcctgtgcactcagcctgccggggtacctgaaattctcaaaaagtctctgcatagctgctcagtcaaaggtgaggaggaggtgtttctgataggaaagaacttccttaagggaaccaaggttattttccaagaaaatgtctccgatgaaaattcctggaagagcgaggccgaaattgatatggagttattccatcagaaccacctaatcgtgaaagttccaccttaccacgaccaacacatcactctgcctgtctcagttggcatttacgttgtcaccaacgccggtagaagccatgatgtgcagccattcacctacacacctgatcctgccgcagccggggccctaaatgtgaacgtaaagaaggaaatttccagccctgctagaccttgctctttcgaggaggcaatgaaggccatgaagaccaccgggtgcaacctggacaaagtgaacattatcccaaatgctctgatgacacccttaattccctcgtcaatgatcaagagtgaggatgtcaccccgatggaagtcacggcggagaaacggtcttcgactattttcaagactaccaagtcggtcgggtcaactcagcaaacgctggagaacatatccaatattgccggtaacggcagcttctcatctccgtctagttcacaccttccctcagagaacgagaagcagcagcagatccaacctaaagcttacaatcctgagactctgacaactatccagacacaggacatatctcagcccggcacttttccggctgttagtgccagcagccagctccccaactcagacgcactacttcagcaggccacccagtttcaaactagagagacgcagtcacgggaaatactacagtcagacggtacagtggtgaatttatcccaactgacggaggcgtcccaacagcaacaacagtcgccacttcaggagcaggcccagaccctacagcagcagatcagctcaaacatttttccgagccccaactcagtgtcccagctccaaaatactattcagcagctccaggctggctcttttactggcagtaccgcctcaggctctagcgggagcgtagaccttgtgcaacaggtacttgaggctcaacagcaactgtctagcgttctcttcagtgctcctgacggaaacgagaacgtccaggaacagctttccgctgacattttccagcaggttagtcaaatccaatctggcgtgtctccaggaatgttcagcagtaccgagccgactgtgcacactcggcctgacaacttactgcccgggcgtgctgagagtgtgcacccccagtctgagaacaccttgagcaatcagcagcagcagcagcagcagcagcagcaagtgatggagtcatcagcggcaatggtgatggaaatgcagcaatctatatgtcaagctgcggcccagattcagtccgagctgtttccctcaactgcatcagcgaatggaaacttacagcagtcccccgtgtatcagcagacttcgcacatgatgtctgctctgagtacaaacgaagatatgcagatgcagtgcgagctgttctcctccccaccagctgtctccggcaatgaaacaagcacaactacaacccagcaggtggcaacccccggaacaaccatgtttcagacatcaagctctggcgatggcgaggagacagggacacaggcgaagcagatccagaacagcgtttttcagaccatggtccagatgcagcacagtggcgacaaccaacctcaagtgaatctgttttcttctactaaatcgatgatgtcggtgcagaattcagggacacagcagcaggggaacggactcttccagcagggtaacgaaatgatgtccctgcaatctgggaactttctgcaacaatcatctcacagccaggcacagctgttccacccgcaaaaccctattgctgacgcacagaacctatctcaggaaacacagggtagtctgttccatagtccaaatccaattgtccacagccagacctctaccaccagcagcgaacagatgcaaccacctatgtttcatagccagtcaacaatcgctgtgctccaggggagcagtgttccccaagatcagcagtccacaaacatcttcctctcacaatcacctatgaacaacctacagacgaataccgtcgcccaggaagccttcttcgcagctccaaactctatatccccgctgcagtccacctccaactctgagcaacaggctgcctttcagcagcaggcacccatttctcacattcagacccctatgctttcccaggagcaagcgcagcccccccagcagggtttattccagccccaagtggcactcggctccctgccccctaatcccatgcctcagagccaacaaggaacaatgttccagagtcaacacagcatcgttgctatgcagtcaaacagtccgagtcaagaacaacagcaacagcagcagcaacagcagcagcagcagcaacagcagcaacagagcatccttttcagtaatcagaacacaatggcgacgatggcatctccaaagcagccccctccgaacatgattttcaaccccaatcagaaccccatggccaatcaggagcagcagaatcagagcatcttccaccagcagtcaaatatggctccgatgaatcaggagcaacaaccaatgcaattccagtctcagtctaccgtgtcatcccttcagaatcccggaccaacccagagcgagtctagccagactccgctcttccattctagccctcaaattcagctggtgcaggggagtcctagcagtcaagagcagcaggttactctgttcctaagcccagccagcatgtccgctttacagacttccatcaaccagcaggacatgcagcagtcccccctgtatagtccccagaacaatatgccaggaatacagggtgccacgagcagcccgcaaccccaagctacactttttcacaacactgcaggcgggactatgaaccagctgcagaattccccaggatctagccaacagaccagtggtatgttcttgttcggcatccagaacaattgcagccagctgttaacttcggggcccgccacactcccagaccagctcatggccattagccagcccggccagccccagaacgaaggccagcctcctgttacaaccctgctctctcagcagatgcccgagaatagtcctttagccagtagtatcaacactaatcagaatatcgaaaaaatagacctgctggtgtcactccagaaccaaggtaacaatctgaccggctccttctag

SEQ ID NO: 25346 - DNA, 4647 bp, Artificial Sequence
  Description of Artificial Sequence: Synthetic coding sequence
atgcccagcgacttcatcagcctgctgagcgccgacctggacctggagagcccaaaatcactctattctagggacagcctgaagctgcacccaagccagaatttccacagagctggcctgttggaagagtctgtgtacgacctcctgcctaaggagttacagctgccccccagccgagaaactagcgtggcctcaatgagccagacgtctggcggcgaagccggttcgcctccacccgctgtagtggcagccgatgcatctagtgcaccaagctcatcctctatgggtggcgcatgttcctctttcactacaagctcatcccccaccatatacagtacatcagtcacggacagcaaagcaatgcaagtagagtcgtgctccagtgcagtcggggtgtcaaatcgtggagtttcggagaaacagctaacttctaatacagttcaacagcacccttcaacgcctaagaggcatactgtgctgtacatcagtccacctcctgaggatctgctggataattcccgcatgagctgtcaagatgagggatgcggtcttgaaagtgaacaatcatgcagcatgtggatggaagactctccctctaatttcagcaatatgtcaactagctcctacaatgacaacacagaagtacccaggaagagtcgaaaacggaaccccaaacagaggcccggggtgaagcggcgcgactgtgaagaatcaaatatggatattttcgacgcagatagtgcaaaggctcctcactatgtgctgtctcaactgacaactgataacaaggggaattctaaggcgggcaacggcactctggaaaaccagaagggcaccggtgtcaaaaaatctccaatgctgtgtggacaatatcccgtgaagagcgaagggaaagaactgaagattgtggtccagcctgaaacccagcatcgtgctcgctacctcacagagggctcacgtgggtcagtgaaagacaggacccagcagggctttcctacagttaagcttgaaggtcacaacgagcctgtagtgctccaagtgttcgtgggcaacgattccggtcgggtgaagcctcacggtttttatcaggcctgtcgcgttactggtcggaataccacaccatgcaaagaggtggacatcgaaggcactaccgtgattgaggttggactggatccatctaacaacatgactttggcggtggattgcgtcggaattttaaaacttagaaatgcagatgtcgaagctcgcataggcatcgccggctccaagaagaaatccacccgcgcccgcctggtgtttagagtgaacatcatgaggaaagatggctctaccctcacgcttcagacgccgtcttctcccattttgtgtacccaacccgcaggggtacctgagatcttgaaaaagtctctacacagttgctcggtgaagggcgaagaagaggtgtttttgattgggaagaacttcctcaagggcacaaaggttatattccaggagaacgtcagcgatgaaaatagttggaagagtgaagctgaaattgatatggagctcttccaccagaaccacctgatcgtaaaggtgcccccataccacgaccagcacattacccttccggtgtcagtgggtatttatgtagttacaaatgcaggcagaagtcacgacgtgcaacctttcacatacacccctgatccagccgcaggggcccttaacgtgaacgtgaagaaggaaatatcttctcccgcgagaccttgctccttcgaggaggccatgaaagctatgaagaccaccggctgtaacctggacaaggtcaatatcattccaaacgcactgatgactccgctcatcccgtcctccatgatcaaaagtgaggacgtgacccctatggaagtcaccgccgaaaaacggtcttctactattttcaaaaccaccaagtcagtggggtctactcagcagactcttgaaaatattagcaatatagccggtaacggatccttctcatccccctcaagttctcacttgccgtcagagaatgaaaagcagcagcaaatccagcccaaggcctataacccagagactctaactactatccagacccaggacatatcacagcccggcactttccccgccgtgagcgcatccagccagctgcctaattccgacgccttgctgcagcaggccactcagtttcaaacacgcgaaacgcaaagcagagagattctgcagtccgacggcaccgtcgtgaatctttcccagctcacggaagcaagccagcagcagcagcagtctccgctccaggagcaggcacagactttgcaacaacagatcagtagcaatattttcccaagtcctaactcagtgtcacaactgcagaataccatacaacagttgcaggccggaagctttactggcagtacagcctctggtagtagcgggagtgtggacctagtccagcaggtactggaagctcagcagcagctttcttctgtgttgttttcagctccagacggtaacgagaacgtccaggagcagctgtcagcagatatcttccagcaggtctcacagatccaaagtggtgtcagtcctgggatgttctcctcgacggagccgacagtgcacactcggcccgataatctcctgccgggacgcgccgagagcgtccaccctcagtctgaaaacaccctgagcaaccaacaacagcagcaacagcagcagcagcaagttatggaaagcagcgcggctatggtgatggagatgcaacagagtatatgtcaagccgctgcgcagattcagagcgaactgttccccagtacagcctccgctaacggaaatttgcagcagtctcccgtttatcagcagacctcacatatgatgtcagccctgagtacaaatgaggatatgcagatgcaatgtgagcttttctctagtcctcctgccgtatccgggaacgagacatcaacaacaacgacacaacaggtggcgacacccggcaccactatgttccaaacatctagctcgggggacggagaggaaactggcacacaggcaaaacagattcagaactccgtctttcagacgatggttcagatgcaacatagcggagataaccaaccacaggtgaacctcttttcttctaccaaaagcatgatgtctgtgcaaaatagcggcactcagcagcagggtaacgggcttttccagcagggaaatgaaatgatgtccctgcagtccggtaactttctgcaacagtcctctcattcccaggctcagctttttcacccccagaacccaatagctgatgctcagaacctgtctcaggagactcagggttccttgtttcacagcccaaatcccatagttcattcccagaccagcactacttcttctgaacaaatgcagccgccaatgttccacagccagtccaccatagccgtgctgcaggggtctagcgtgccacaggaccagcaatctactaatatctttctgtcacaaagcccgatgaataacttacagacgaatactgtggcccaggaagccttttttgccgctcccaactccatcagccccttacagtctacatctaactctgaacagcaagccgcatttcagcagcaggcacccatcagtcacatccagacgcctatgctatcacaagagcaagcacaaccaccacaacagggactgttccagccgcaggtcgcccttggatcactgccaccgaatcccatgccccagtcccaacaaggaaccatgttccaatcccagcactctattgtagctatgcaaagcaatagccccagccaagagcagcaacagcagcagcagcaacagcagcagcagcaacagcagcaacaacagtccattcttttcagcaaccagaacacgatggcaactatggcttctcctaaacaacccccaccgaacatgattttcaacccaaatcaaaatccaatggcaaatcaagagcagcagaaccagagcatttttcatcaacagagcaatatggcaccaatgaaccaggaacagcagccaatgcaattccagagtcagtcgaccgtttcaagcctgcagaatcctggacccacgcagtctgaaagcagtcagacacctctgtttcatagctcccctcaaatccagctggtgcagggtagccctagcagccaggaacagcaagtgactctgttcctgtcgccggccagcatgtccgcgctgcagacttccattaaccagcaggacatgcagcagagccccctgtatagcccgcaaaataacatgccagggattcaaggtgccacgtccagcccccagccccaggccactctatttcataatacagccggtggaacaatgaaccagctgcagaacagccccggctcgtcccagcagacatcagggatgttcttattcggcatccaaaacaattgtagtcagctgttgaccagtgggccagccactctcccagatcaacttatggccattagtcagcccggacagccgcagaatgaggggcagcctcccgtgacaactctcttgtcccagcagatgcccgaaaatagcccccttgcgtcttctattaataccaatcaaaacattgaaaagattgacctgttggtctcattacaaaaccagggcaataatctgactgggtcattctag

SEQ ID NO: 25347 - DNA, 4368 bp, Artificial Sequence
  Description of Artificial Sequence: Synthetic coding sequence
atgggcggcgcctgcagcagcttcaccaccagcagcagccccaccatttactctactagcgtgacagactcaaaggctatgcaggtagagtcatgctcgtcagcagtcggtgtgtccaaccggggtgtgtccgaaaagcagcttactagtaataccgtgcaacagcatccatcaaccccgaaacgccacaccgtcctgtacatctcccctccccctgaggacctgctggataactcaaggatgagttgccaagacgaaggctgtggactggagagcgagcaatcttgctccatgtggatggaggactcaccgtcaaacttctccaacatgtcaacttcttcatacaacgacaacacagaggttccaagaaagtcccgcaagagaaaccccaagcagcgccctggagtgaaacgtagggattgtgaagagtctaatatggacatctttgacgcggatagtgcaaaagcaccccactacgtgctgtctcagctgacaactgataataagggaaactccaaggccgggaatggaaccttggagaatcagaagggaacaggtgtgaaaaaaagcccaatgttgtgtggacagtacccagtgaaaagcgagggtaaggaactgaagattgtggtccagccagaaacccaacatcgcgcccgctatttgaccgaagggagtagaggctccgtgaaagaccgtacgcagcagggttttccaacggtcaaactggaaggccacaacgagcctgtcgtgttacaggtctttgtgggaaatgatagtggaagggtgaaaccccacggcttttatcaggcctgtcgcgttaccggtcgcaatactaccccatgcaaggaagtcgatattgagggtaccaccgtgatcgaggtaggcctggatccttctaacaatatgaccctggctgtggactgtgttggaattcttaaactcagaaacgcagacgttgaggctcggattgggatcgcgggatctaagaaaaaaagtacccgagcacggcttgtcttccgcgtcaacattatgagaaaggatggctccacgctgacactccagaccccctctagtcccatcttgtgtacccaaccggccggcgtccccgaaatcttgaagaagtccctgcacagttgctcagtcaagggggaagaagaggtttttcttatcggtaaaaactttctgaaaggaactaaggtcatcttccaggagaatgtgagtgatgagaatagctggaagtcagaggccgagatcgatatggaactcttccaccagaaccatctaattgtgaaggtgcccccataccacgatcagcatatcaccttgccagtgagtgtcggaatatacgtcgtaacaaacgcaggacgtagtcacgacgtgcagccattcacttataccccggacccagccgccgccggagctctcaatgttaatgtgaagaaggaaatttccagtcccgctcggccctgctcatttgaggaggcgatgaaggcaatgaaaactaccggctgcaatctggataaagttaacataatacccaatgctctgatgacacctctgattccatcgtccatgatcaagtcagaggatgtgacccccatggaggtgacggcagagaagaggtcgagcactatctttaagaccaccaagagtgttggctccacacagcagaccttagagaatatttctaatatagccggaaatggctcatttagctcccccagcagttctcatttaccatcagaaaacgaaaaacagcagcaaatccagccaaaggcctacaatcctgaaacactcacaaccatccaaacccaggacatcagtcagcccggcacatttccagctgtctcagccagttcacaactgccaaactctgacgccttgctgcagcaggcaactcagtttcagacaagagagacccagagccgggagatcctccaatcagacggcaccgtggtgaacctgtcacagctgacagaggctagccaacagcagcagcagtcacccttacaggaacaagcgcagaccctgcagcaacagatcagcagtaacatttttcctagtcccaattcagtgtctcagcttcagaatacgatccagcaactgcaggccgggtcttttaccggtagcacagcatctggtagtagcggaagcgttgatctagtgcagcaggtgctagaagcgcagcagcagctttcttctgtcctgttctccgctcctgatgggaatgaaaacgttcaagagcagctgagcgccgacattttccaacaggtgtcccagatccagtccggtgtctcaccgggaatgttttcaagcaccgaacctacagtccacacaaggcctgataacctcctcccaggccgtgcagagtcagtacatccacagagcgaaaacaccctgtctaatcagcaacagcaacagcagcagcagcagcaggtgatggagagctcagccgccatggtaatggagatgcaacaatccatctgtcaggccgcagcacagatccagtcagaattatttccgtctacagcaagtgcgaatggaaacctccaacagtcaccggtatatcaacagacctcgcatatgatgagcgccctctccacgaacgaggacatgcagatgcagtgcgaattatttagcagccccccggcagtgagcggaaatgaaacaagtaccactactacccagcaggttgccacacccggcaccaccatgtttcagacatcttcaagtggggacggagaggagactgggactcaagcaaaacagatacagaacagtgtctttcagaccatggttcagatgcagcactccggggataaccaaccacaagtgaacctcttctcttcaactaagtcaatgatgagcgtgcaaaattctgggactcagcagcaaggaaacgggcttttccagcaaggcaatgagatgatgagccttcaatcaggaaattttttacagcagtcttcccatagccaagcccagctctttcatcctcagaaccccattgccgacgcacagaatctttctcaggaaacgcaggggtctctattccattctcctaatccaattgttcattcacaaaccagcaccacttcctcagagcagatgcaaccaccaatgttccatagccagtctactatagctgtgctccagggttcgtcagtcccccaggaccagcagagtacaaatattttcctgagccagagtcctatgaataatctgcaaactaacacagtggcacaagaggccttctttgctgcaccaaatagcatcagccctctacagagcacgtcgaacagcgagcagcaggccgcatttcagcagcaagcaccaatatcccacatacagacccccatgctgtctcaggaacaggcacagcccccccagcaggggctgttccagccacaggtggcactgggcagcttgccgcccaaccccatgcctcagtcgcagcaggggaccatgtttcagagtcagcactccatcgttgcgatgcagagcaattccccttcccaggagcagcagcagcaacaacagcagcaacagcagcagcagcaacaacaacaacaatccatcctcttcagtaaccaaaacaccatggccactatggcaagtccaaagcagcctcccccaaacatgattttcaatccgaatcagaaccccatggccaaccaagagcagcagaaccagagcattttccatcaacagtcaaacatggctccaatgaaccaagaacaacagcccatgcagttccagtctcagtctaccgtctcctccttgcagaaccctggtccgacacagtctgagtcaagccaaacaccactgtttcacagctccccacagattcaactcgtccagggttccccttcatcacaggaacagcaggtgaccctattcctctcacccgcatctatgtctgcactccagacaagcattaatcagcaagacatgcagcagtcccccttatacagcccccagaacaatatgcccgggatccagggcgctacttcatctccccaaccacaggctactctgttccacaacaccgcgggggggaccatgaatcagctgcaaaattcaccgggttcgtcccagcagaccagtggcatgtttctgtttggcattcagaataactgctcacagcttctgacttcaggtccagccactcttccggatcagctgatggcaatatctcagccaggccagccacagaatgaggggcaacctcccgtgacaactctcctgagccagcagatgccagagaacagccccctcgcctcttcaataaatacgaaccagaatatagagaagatcgatttgctggtgtcactgcaaaaccaaggaaataacctgactggaagcttctag

SEQ ID NO: 25348 - DNA, 4596 bp, Artificial Sequence
  Description of Artificial Sequence: Synthetic coding sequence
atgcccagcgacttcatcagcctgctgagcgccgacctggacctggagagccccaagtccctgtattcacgagagtccgtgtatgacctacttcccaaagagctccagctgccaccttctagagagaccagcgtggcatctatgtcccagacaagtgggggagaggctggcagtcctcctcccgcggtggtcgccgccgatgcaagcagcgccccctctagtagctccatgggaggggcttgtagttcctttaccacctcctcttctccgaccatttattcaacctctgttacagattcaaaagcaatgcaggtagaatcttgctccagcgcagtgggcgtttctaacaggggggtcagcgagaagcagcttacttctaacacagtgcagcaacaccccagcacccccaagcgccacacggtgctgtatatctcacccccgcccgaggacttgctggataattcacgcatgagttgtcaggatgagggatgtggactggagagcgaacagtcttgctccatgtggatggaggattctccctctaattttagcaacatgtctacttcgagttacaatgacaacacagaggtgcccaggaagtcccgtaagcgaaatccaaagcagcggccgggtgtcaagaggcgagactgcgaggagagtaacatggatatcttcgacgctgattcagccaaagctccccattatgtcttaagccagctgaccacggataataaagggaattcaaaagccggcaacggcacattggaaaatcagaaaggtaccggcgtgaagaaaagtccaatgctctgcggacagtaccctgtcaagtctgagggtaaggaacttaagatcgtggtccagcccgaaacacaacaccgcgcaagatacctcactgaagggagccgcggatctgttaaggatagaacccaacagggctttcccaccgtgaaactggaaggacacaatgagcccgtagtgcttcaggtgttcgtgggcaatgactctgggcgggttaaaccacacgggttctatcaggcgtgtagggtgaccggacggaacactacaccttgcaaggaggtggacatcgaggggaccactgtgatagaagtggggctcgaccctagtaacaatatgacactcgctgtcgactgtgtcggcatcttgaagctaaggaacgcagacgtggaagcaagaattggtatagccgggtcaaagaaaaagtcgacccgcgcacggttagtgtttcgggtcaatattatgaggaaagacgggagcacgctgactcttcagacaccgtcgagtccaatcctgtgcactcagcccgctggggtgcccgagatccttaaaaagtctttgcactcgtgctcagttaaaggcgaagaagaagtctttttgatcgggaaaaacttcctgaagggcacgaaagtcatattccaggaaaacgtgtccgacgagaacagttggaaaagtgaagcagagatagacatggaattgtttcaccagaaccacctgatcgtgaaagtccccccctaccacgatcagcatatcacgctccccgtcagtgtgggcatctacgtggtcaccaatgcgggcagatcacacgacgtacagccatttacgtatacacccgacccggcagcggcaggggccctcaacgtcaatgtcaagaaggaaatctccagtccggctaggccatgcagcttcgaggaagccatgaaggctatgaaaactaccggctgcaacttggataaggtcaatattataccaaatgcacttatgaccccacttattcccagctctatgatcaaaagcgaggatgtcacccctatggaagtcactgccgaaaagaggtcttccaccatatttaagacaactaaaagtgttggctctacccaacagacattggaaaatatctctaacatagccggcaacggatccttttcaagtcccagcagttcacatttaccctccgagaacgaaaaacaacagcagatccagccgaaggcttataatccagaaactcttacaacaattcagacacaggacattagccagcccggaacctttcctgcagtcagtgcctctagtcaactgcccaacagcgatgcacttttacagcaagccacccagttccagactcgcgaaacgcaaagtcgggaaatcttacagagcgatggcacggtggtcaatctgtcgcaactgacagaggcctctcagcagcaacagcagagtcctctccaagaacaggcccagaccctgcagcagcagataagctcgaatattttcccctcaccaaatagcgtcagtcagctgcaaaacactatccaacaactgcaggctggctcttttaccggatcaaccgcctctggaagcagcggttcggttgacctggtgcagcaggtgctggaagctcaacagcaactctcttccgtgctgtttagcgcacctgacggtaacgagaatgtgcaagagcagctgtcagccgatattttccagcaggtgagtcagattcaatcaggggtgtcacccggaatgttttcatccacggagcccaccgtccacactcgtcccgataaccttctgcctggtcgcgcagagtccgtgcatccacagtccgagaatacactatctaaccagcagcagcagcagcaacaacaacagcaagtgatggaatcttcggccgcgatggtgatggagatgcagcagtcaatttgccaggccgcagcccaaattcagagcgagttgttccctagcaccgcttctgcaaacggcaatctccagcagtccccggtctaccagcaaacgtctcacatgatgagcgctctttcgaccaacgaggatatgcagatgcaatgtgagctctttagcagcccaccagcggtgtctggtaacgagacctccactacaacaacccagcaagtagctactcctggcacgacaatgtttcagacttcctctagcggagacggcgaggagacaggcacccaagccaagcagattcagaattccgtgttccagacaatggttcagatgcagcacagtggtgataatcagccacaggtgaatctgttttccagcacaaaatcaatgatgtcagtgcagaattcggggacccagcagcagggcaatggtctgtttcagcaaggcaacgagatgatgagcttacagtccggaaatttcctacaacagtctagtcatagccaggctcagctctttcacccccaaaatcctattgccgacgcccagaatcttagccaggagactcagggaagtctttttcacagccctaatcctatcgtgcactcccagacttcaaccaccagttcagagcagatgcaacccccgatgtttcactctcagtcgaccatcgcggttttgcaaggctcttcagtgccccaggatcagcaatccacaaacattttcctttcccagagtcctatgaataatctccagaccaatacggttgcccaggaggcctttttcgctgcaccaaacagtattagtcccctccaaagcacttccaactcagagcagcaggctgctttccagcaacaggctcccatttcacacattcaaacaccaatgcttagtcaagagcaggctcagccccctcaacagggtctgtttcagccacaagtggccctaggttcactgccaccgaacccaatgcctcagtctcaacagggaactatgttccagtcacagcatagcatcgtggcgatgcagtctaactccccatcccaagagcagcagcaacaacaacaacagcagcagcagcagcagcagcagcagcagcaaagtattttgttctccaaccagaacaccatggctaccatggccagccctaaacagcctcccccaaatatgatcttcaaccccaatcagaaccccatggcaaaccaagagcagcagaaccaatccatttttcatcaacagagcaacatggctccaatgaaccaggaacaacagcctatgcagtttcagtcccagtccacagtcagcagcctgcaaaaccccggccctacccagtcagagtctagtcagactcccctgttccactcatctccgcagatccaactggtacaaggatctccatccagtcaggaacaacaggtgacactgttcctgtctcccgcctcaatgtctgccttgcagacttccatcaaccagcaggacatgcaacagagccccctgtattctcctcagaacaacatgcccggcatccagggagccacatcctcaccccaaccacaggccaccttattccacaacacggcgggcggaacaatgaatcagctgcaaaactcccccgggagtagccagcaaacgtcaggcatgtttttgttcggcatacaaaacaattgtagccagctgcttacttccggtccagcgaccctgcccgaccagcttatggccattagtcaacccggtcaaccccagaacgaaggacaaccccctgttactaccctgttaagccagcagatgcctgaaaattcaccactggcatctagcatcaatacgaatcagaacatagagaaaattgacctgcttgtgagcctgcagaatcaaggcaataatcttacagggtcattctag

SEQ ID NO: 25349 - DNA, 4368 bp, Artificial Sequence
  Description of Artificial Sequence: Synthetic coding sequence
atgggcggcgcctgcagcagcttcaccaccagcagcagccccaccatttacagtacaagcgtaacagatagcaaagcaatgcaggtggaatcatgttccagcgctgtaggggtgagtaaccgaggagtgtccgaaaaacagctcacgagcaacacagtgcagcagcacccctcaacacctaagagacacacagttctgtatatctccccaccacccgaggatctgttagacaacagcaggatgtcttgccaggacgagggatgcggcttggaaagtgagcaaagctgcagcatgtggatggaggatagcccatcaaattttagtaatatgtccacctcaagttataacgacaatactgaggtgccgcggaaatcaaggaaacggaatcccaaacaacgtcccggcgtgaaacgacgggattgtgaggaaagtaacatggatatttttgatgctgacagcgccaaggcaccacactacgtcctctcccaattgacaactgacaataagggaaatagtaaggctggcaacggcacccttgaaaaccaaaaagggacgggtgtgaagaaatcccctatgctctgtgggcaatatcctgtcaagtctgagggtaaggagctgaaaatcgttgtacagcctgagacacagcaccgagctcggtatcttacggagggcagcagggggtctgtgaaggacagaacccagcaggggtttcccactgttaagctagaaggacataacgagccagtcgtgttacaggtgtttgttgggaatgatagcgggagagtgaaaccacacggcttctaccaggcgtgccgagtgactggccggaacacaaccccttgcaaggaagtagacatagagggcacgaccgtgatagaggtgggcttagacccttccaataacatgacactggctgtggattgcgtaggaattttaaaactgaggaatgccgatgttgaagcccgcattggcatagccggaagtaaaaagaagtccacgcgggcccgtctggtctttcgagtgaacattatgaggaaggatggctcaaccttgacattgcaaactccgagctcccctatcttgtgtacacaaccagcaggagtgcccgaaatcctaaagaagtccttgcattcctgctctgtcaaaggcgaggaggaagtgtttctgatcggcaaaaatttcctgaaaggcacaaaagtgatcttccaggagaacgtctcagacgaaaacagctggaaatcagaagccgagattgatatggaactgtttcaccagaaccacctgatcgtgaaagttccaccctaccatgaccagcatatcaccttgcccgtatccgtgggcatttatgtcgtcaccaatgcaggtaggagccatgacgtgcagccatttacatatacccccgatccagccgctgctggggctttgaacgttaatgtcaagaaggagatctctagtccagcacgcccatgcagcttcgaggaggcgatgaaggccatgaaaacgactggttgcaacctggataaggtgaatatcataccaaatgcccttatgactcctttaatccctagttcgatgattaagtccgaggatgtcactcctatggaagtgactgccgaaaagagaagttccactattttcaaaacaacgaagagtgtggggagcacacagcaaactctcgagaatattagcaatattgccggaaatggcagcttctctagcccctcctctagccatttgccaagcgagaacgaaaagcagcagcagatacagcctaaggcctataatcccgagaccctgaccactatccagacacaggacatctctcagccaggcacttttccagcagtctcagccagcagccaactgccgaacagtgacgctttactccagcaggcaactcagttccaaaccagggaaactcagtcgcgcgagattttgcaatcagacggtactgtggtgaatttgtcccagctgactgaagctagccagcagcagcaacaaagccctctccaagagcaggctcagactctgcagcaacagattagttctaacattttcccttctccaaatagtgtgagccagttacagaacactattcaacagctgcaagcaggctcctttacggggtcaacagcatccggctcctctgggagtgtggacctggttcagcaggttctcgaggcgcaacagcagctaagttccgttctgtttagcgcacccgatggtaacgaaaatgtgcaagagcagctgagcgccgatatattccagcaggtgagccagatacagtccggcgtttcgcccggtatgtttagcagtacggaaccaaccgttcacactcgcccagacaacctcttgcccgggcgagccgagagcgtgcatccgcaaagcgagaatactctgtccaatcagcagcagcagcagcagcagcaacagcaggtaatggagtccagtgccgccatggtcatggagatgcagcagtcaatctgtcaggccgctgcgcaaatccagagtgagctgttcccatcaactgcctccgcaaatggaaacctgcagcagtcgccagtctaccagcagaccagccacatgatgtcagcattgtctacaaatgaagatatgcaaatgcagtgtgagcttttcagctcgccgcctgcagtgagtggcaacgaaacatcaacaaccaccacacagcaggtggccacccccgggaccaccatgttccaaacatcttcttcaggggacggcgaagaaaccggtacccaggctaagcaaatccagaactctgtgtttcaaacaatggtacagatgcagcactccggtgacaatcagcctcaggtgaacctcttctcaagtactaagtcaatgatgtctgtgcagaatagcgggacccagcaacagggtaacggcctttttcagcagggcaacgagatgatgtctttacagagcgggaactttctacagcagagctcgcactctcaggcccaactgttccaccctcaaaacccaattgctgatgcgcaaaacctttctcaagagacacaagggtcactattccacagtcccaacccaatcgtgcacagccagactagcacaaccagctcagaacaaatgcagcccccaatgttccactcccagtcaaccatcgccgtcctacagggatctagcgttccacaggatcaacagtctacaaacatttttttgtcgcaatctccgatgaataatctacagacgaacacggttgctcaagaggcttttttcgcagcaccaaatagcatatcacccttacaatccacctctaacagtgagcagcaggccgccttccagcagcaggctcctatctctcatatccagacccccatgctgtcccaagagcaggctcagcccccccagcaggggttatttcagccgcaggttgcactgggatccctgccgcctaatcccatgccacaatcacagcagggaacgatgtttcagtcccagcattctattgtggcaatgcagagcaacagccccagccaggaacagcaacagcagcaacagcagcagcaacagcagcagcagcaacagcagcagtcaattttgttctcgaatcagaacacaatggccacaatggctagcccaaagcagcccccaccaaacatgatattcaaccccaatcagaatcccatggcgaatcaggagcagcagaaccagagcatcttccaccagcagagcaacatggccccaatgaatcaggagcagcagccgatgcagtttcagagtcaatctacagtgagctctctgcagaaccccgggccgacccagtccgagagtagccagacacccctgtttcatagttcccctcagatccagctagtgcaggggtcaccgtcaagccaagaacagcaggtgactttgtttctatcccccgcttcaatgagcgccctgcaaaccagtatcaaccagcaggatatgcaacagagtcccctgtacagcccacagaataatatgcctggcatacagggggccacgagttcaccccagccccaggcaacccttttccataatacagctgggggcactatgaaccagctccagaactccccagggtccagtcagcaaacaagtgggatgttcttgtttgggatccagaacaactgcagccaactcctgacctccgggcccgcaaccctacctgatcagctgatggcaatctctcagcccggccagccacagaacgagggtcagccacctgtgaccacgttactttctcaacagatgcctgaaaattcccctctggcctcatccatcaacactaaccagaatattgaaaagatcgaccttctcgtttcactgcagaaccaaggaaataacctaaccggatccttctag

SEQ ID NO: 25350 - DNA, 4647 bp, Artificial Sequence
  Description of Artificial Sequence: Synthetic coding sequence
atgcccagcgacttcatcagcctgctgagcgccgacctggacctggagagtcccaagtccctgtactctcgcgactcgttgaaacttcacccttcccaaaatttccacagagccggtctcttggaagaaagcgtttatgatctcctgcccaaagagcttcagttgccccccagtcgtgaaacatccgtcgcgtctatgtctcaaaccagcggtggtgaggcaggaagtcccccaccagcagttgtggccgctgacgcctcttccgctcctagttcctcaagcatggggggggcctgttcctctttcacaacttcatcttcacctaccatttactccacgagtgtgaccgacagcaaggcaatgcaggttgagtcttgtagctccgctgtcggagtgagcaacagaggtgtctccgaaaaacagctgaccagcaacaccgtgcagcaacatccttctacaccgaaaaggcacacggtgctatatattagcccaccgccggaggacttattagataactccaggatgtcttgccaagatgaaggttgtggcctcgagagcgaacagtcttgctctatgtggatggaggattcccctagtaacttcagtaatatgtccaccagctcatataacgacaacaccgaggtccctcggaagtcgaggaagaggaatcccaagcagcgacccggggttaaaaggagagactgtgaggagtctaatatggatatctttgatgcggactccgccaaggctccacactacgtcctgagccaactcacgacagataacaaagggaatagcaaggcaggtaatggcacgttagaaaatcagaaggggactggcgtaaagaaatctcctatgttatgcggccagtaccccgtgaagagtgagggcaaagaactgaagatcgtggttcagcctgagacccagcatagggccagatatctgacagaaggaagtcgcggtagcgtaaaagatcgtacacagcagggattcccaaccgtgaaactcgaagggcacaacgaacctgtggttttgcaagtcttcgttggaaacgattccggtagggttaagccgcacgggttctatcaggcttgtagagtaaccggccggaacacaacaccttgtaaggaggttgatatagagggcacgaccgtcatagaagtgggtctggacccgtccaataacatgactcttgctgttgattgcgtaggaattctgaaactgaggaacgccgacgtagaagcaaggattgggattgcaggatcaaaaaagaagagcacgcgggctcgcctcgtgtttcgcgtcaatatcatgcgtaaggacggttctaccctgactctgcaaacaccaagctcccccattctttgcactcagcctgctggcgtgcctgagatattaaaaaagtcactgcactcctgctcggtgaaaggcgaggaagaggtgttccttattggcaagaattttttgaaaggcaccaaagtcatcttccaggagaatgtttctgatgagaacagctggaagagtgaggcagaaatcgacatggagttgtttcaccaaaaccatctgattgtgaaagttcccccctaccacgatcaacacataacgctccccgtttccgtcggcatctatgttgtgacaaacgccggcagaagccacgacgttcaaccctttacatatacccctgaccccgcggccggggctctaaacgtgaacgtgaaaaaggagatcagcagtcctgcacgcccttgctccttcgaggaggcaatgaaggccatgaaaaccaccggttgcaatctggacaaggtgaatataatacccaacgcgctcatgacccctctcataccgtctagcatgatcaagtccgaagatgtgacaccaatggaggtgacagccgagaaaagaagttcaaccatctttaaaacaacaaaaagtgtcggttcgacacaacaaaccctcgaaaatatttctaacatcgcaggcaacggctccttctccagtccctcttcctcccacctccccagtgagaacgaaaagcagcagcagatccaaccaaaagcgtacaaccccgagactctgaccaccatacagactcaagacatctcgcagcctggaaccttccccgctgtttcagcgagcagccaactgcccaattcagacgcactgctccagcaggcaacgcaattccagaccagagaaactcagtccagagaaatcctccagtccgatgggactgtcgttaatttgtctcagctgaccgaagccagccagcagcaacagcaatcacctctgcaggaacaggcccagactctgcagcaacagatctctagcaatatcttcccctcccccaactccgtgtcccagctccagaacacaattcaacagctgcaagctggatcttttacaggctcaacagcgtctggttcttccggctctgtggatctggttcaacaagtactcgaggcgcaacagcaacttagttcagtgttgttttctgccccggatggcaatgagaatgtccaggagcagctctctgcagatattttccagcaggtaagtcaaatccagtctggggtcagtcctggtatgttttcaagtactgagcctaccgtccatactagacccgataacctgcttccgggcagagcagagtcagtgcacccacagtctgagaacacccttagcaatcagcaacagcaacagcagcagcagcagcaagtgatggagtcaagtgcagccatggtgatggagatgcagcaaagcatttgccaagccgccgcacagattcagtccgaattgttcccctcgacggcctccgccaatggcaacctccaacaaagcccggtctaccaacaaaccagtcatatgatgtctgcactgtctactaatgaagatatgcagatgcaatgcgaactcttttctagtccacccgccgtgtcaggaaacgagacctctactacgaccacccagcaggtcgccactcctggtaccaccatgtttcagacctcctccagcggagatggcgaggagaccggaacgcaagcaaaacagatccaaaacagcgtctttcagaccatggtgcagatgcaacactctggcgataatcagccccaagtcaatctgttttctagcactaagagtatgatgtccgttcagaactcaggcacccaacagcagggaaatggtctctttcagcagggtaacgagatgatgtctctccaatccgggaactttcttcagcagtcttctcattctcaagctcagctcttccacccccaaaatcctatcgcagatgctcagaacctgtcccaagaaactcagggcagtctgttccacagtcctaacccaattgtacacagtcagacttctacaacttccagtgaacagatgcagccgcccatgttccactcccagtccaccatcgccgtgctgcaaggcagtagtgtcccccaggaccaacagagtaccaacatctttcttagccaaagccccatgaacaatcttcaaaccaacactgtggcccaggaggccttttttgctgcccctaactctatctcgccgttgcagagcactagtaactctgaacagcaggccgcttttcaacagcaggcaccgatttcacacatccagactcctatgctgagccaagaacaggcccagcctccacagcaggggctgttccaacctcaagtcgccctgggttctctccctcccaacccaatgccccaatctcagcagggcacaatgttccaatcgcagcactccatcgttgccatgcagtcaaattctccctctcaggagcagcagcagcaacaacaacagcagcagcagcagcagcagcaacaacaacaaagcatactcttcagcaaccagaacaccatggctaccatggcctcccctaagcaacccccccccaatatgatattcaatccgaatcagaaccctatggcaaaccaggagcagcaaaaccagagtatattccaccagcaatccaacatggcccctatgaatcaggagcagcagcctatgcagttccagtcccagagcaccgtcagcagtctgcagaacccaggaccaacccagtccgagagcagccagactcccctgttccacagctcccctcagattcaactggttcaggggagcccttcaagccaggaacagcaagttaccctcttcctgtcccccgcttccatgtctgcactacagacatcaatcaatcaacaggacatgcaacaatctcctctctacagccctcagaataatatgcccggcattcagggggcaacaagtagtcctcagccccaggccacgctcttccacaacactgctggagggacaatgaatcagctgcagaattctccgggatcctcccagcaaacctcaggcatgtttttattcggaattcaaaataattgttcccagctattaacttccggtcctgctactctccccgatcagctgatggcaatctcacaacctgggcagccacaaaacgagggccagccacccgtcacaaccctcttgagccagcagatgccagagaattcccccctggccagcagtatcaacactaatcagaatattgagaaaattgatctcctcgtgtctctccagaaccagggtaataacttaacagggagcttttag

SEQ ID NO: 25351 - DNA, 4650 bp, Artificial Sequence
  Description of Artificial Sequence: Synthetic coding sequence
atgcccagcgacttcatcagcctgctgagcgccgacctggacctggagagtccaaagagtctttattccagggattctctcaagctgcatccctcacagaatttccacagagcagggttactggaggaaagtgtgtacgacctgctccccaaggaactacagctccccccatctcgggagactagcgtggcgtccatgtctcagacaagcggtggcgaggcgggctcccctccgcctgccgtggtcgcagccgatgcgtcctctgctcctagttccagcagtatgggaggtgcctgctccagcttcaccacctcttcaagtccaactatttactccaccagcgtgacggactctaaggccatgcaagtcgaatcatgcagttcggctgtgggagtttcaaataggggagtgagcgagaagcagctaacttctaacacagtgcagcaacatccctctacccccaaacgccatacggtgttatacataagtcctccccctgaggaccttctggataacagccgtatgtcgtgccaagatgagggctgcggactagagtctgagcagagttgttcgatgtggatggaggactccccgagtaacttttctaacatgagtacctcttcttacaatgataatactgaagtgccccgaaaaagtagaaagagaaatcccaagcagcggcccggagtcaaaaggcgcgactgcgaggagagtaatatggatatcttcgatgctgattccgccaaggcgccacactacgtgctgagccagctcaccactgataataagggtaattcgaaagccggcaacggcacactcgaaaaccagaaggggactggcgtgaagaaatcccctatgctgtgtggacagtacccggtgaagagtgagggcaaggagctaaagatcgtcgtgcagcccgagacccaacaccgggcacgctacttgaccgagggatcaagagggagtgtcaaagacaggacacaacaggggttccccaccgtgaaactcgagggacacaacgagcccgtcgttcttcaggtgttcgtaggaaacgatagtgggagggtgaagcctcacggattctatcaggcctgtcgagtcacagggcgcaacaccaccccgtgtaaggaggtagacatcgaggggaccaccgtgatcgaggtgggtctggaccccagtaacaatatgactctggccgtggattgcgttggcatactcaaattacgcaatgccgacgtcgaagcgaggataggcatcgctggaagcaagaagaagtcaaccagagctaggttagtcttccgtgtcaacatcatgcgaaaagatggctcaacattgaccttgcagacacccagctctccgatactttgtacacagcctgccggtgtcccagaaatccttaaaaagagtttgcattcttgtagtgtgaaaggcgaggaggaagtgttcctgataggtaaaaactttttgaaagggaccaaggtgatttttcaggagaacgtttccgacgagaactcatggaaatctgaggcagaaatcgacatggaactgtttcaccaaaaccatcttatcgttaaggtgcccccatatcatgaccagcatatcaccttgccagtgtccgtgggcatctacgtcgtcactaacgccgggagatctcatgatgtccagccgtttacctacaccccagaccctgccgccgccggagcgctgaatgtaaacgtgaagaaagagataagcagtcctgcgcgaccttgctcatttgaggaagccatgaaagctatgaagacaacgggttgcaatctcgataaggtcaacatcatcccgaatgctcttatgactcccttgattccatctagcatgattaagagtgaagacgtaacgccaatggaagtgacagccgagaagagatcaagtacaattttcaagactactaagagtgtggggtccacgcagcagactcttgagaatatttccaacatcgctgggaacggtagcttcagtagcccaagctcttctcatctgccatctgagaatgagaaacagcagcagatacaacctaaagcttataaccccgagaccctaacaaccatccagacacaggatatttcacagcccggcactttccctgcagtctcagcctcttcccagttgccaaatagcgatgctctgttgcagcaagctactcagttccagacccgcgagactcagtctcgcgagatattacagtccgatggcactgtggtcaatctgagccaattaacagaagcctcccagcagcaacagcagagccccctgcaggaacaagcccagacactccagcaacagatttcctccaacatctttccaagccctaactctgtttcacaattgcaaaacactattcagcagttgcaggccgggtcattcaccgggagcactgcatccggctccagcggatcagtggatctggtgcaacaggttttggaggctcagcagcagttgtcctccgtgctgttcagcgcgcctgacggtaatgagaacgtccaagagcagctctctgcagacatatttcagcaggtttctcagattcagtcaggagtgagccctggcatgttcagtagcacagagccgacagtacatacaaggcccgacaatctgttgccgggccgggctgaatctgtgcaccctcagtccgaaaatactctaagtaatcaacagcagcagcagcaacagcagcaacaggtcatggagtcatctgcagctatggtaatggagatgcagcagagtatctgccaagccgctgcacagatacagagcgaactgtttccatcgactgccagtgccaatggaaacctacaacagtcacccgtctaccagcagactagccacatgatgtcagcactgtccaccaacgaagacatgcaaatgcagtgtgaacttttctccagtccccctgccgtttccgggaacgagacatccaccacaactacccagcaggtggccacccctggcacgactatgttccaaacttcttcttctggtgacggtgaagagactggcacccaagcgaaacaaatccagaattctgtgtttcagaccatggtgcagatgcaacactctggagacaatcagccccaggtcaatctcttctcaagcactaagtcgatgatgtcagtccagaattcaggcacccaacagcaggggaatggcctctttcagcaggggaacgagatgatgagtctgcagagtggtaacttcctccagcagtcaagtcactcgcaggcccagctttttcatccgcaaaatcccatcgctgatgcacagaacctcagtcaggagactcaagggagtcttttccattctccaaatcccatagtgcatagccaaacaagcactacctcatcagagcagatgcaaccgccgatgttccacagtcagtctacaatcgccgtgctgcaggggagttcagtgcctcaggaccagcaatctactaacatcttcctttcacagtctcccatgaacaatctccaaacaaatacggttgctcaggaagccttctttgcggcaccaaactcaatttcgccactgcagtcaacttcgaactccgaacaacaggctgcctttcagcagcaggcccccatttcccatatccaaaccccaatgttaagccaggaacaggcccagcctccccagcaaggcctgtttcagccacaggtggctctgggtagtctgcccccaaatccgatgcctcagagtcagcagggcactatgttccagtcacagcattccatcgtcgccatgcagagtaacagcccatcacaggagcagcagcagcagcagcagcaacagcagcagcagcagcagcagcaacagcaaagcatcttgttttccaatcagaacactatggcgaccatggcctctcctaagcaacccccaccgaacatgatctttaaccccaatcaaaatcccatggcaaaccaggaacagcagaaccaatccattttccatcagcagagcaacatggcccccatgaatcaggaacaacaaccgatgcagtttcaaagccagtccacagtgagctctctccaaaaccctggccccacccagtcagaaagctctcaaaccccactgttccatagttcaccacagatccagcttgtccaaggctcaccctcatcccaggaacaacaagtgaccctattcctcagtccggcatccatgtctgctctccagacctccattaaccagcaagatatgcagcagagccccctgtatagtcctcagaataacatgccaggtattcagggggccacaagttccccacagcctcaggcgacattgttccacaacacagccggtggaaccatgaatcagcttcaaaatagccccggcagctcacagcagacatccggaatgttcttgttcggaatccagaataattgttcccagctgctcactagcggtccggctacgttgcccgatcaactgatggccatcagtcagccagggcaaccacagaacgaaggtcagccaccagttaccaccctgctgtcacagcagatgccagaaaattctccgcttgctagttccatcaataccaaccagaacattgaaaagatagacctgctcgtcagcctgcagaatcaagggaacaatctcactggcagcttctag

SEQ ID NO: 25352 - DNA, 2151 bp, Artificial Sequence
  Description of Artificial Sequence: Synthetic coding sequence
atgcccagcaccagcttccccgtgcccagcaagttccccctgggcccagcggctgctgtgtttgggaggggtgagaccctgggcccagcccctcgagctggcgggacaatgaagtctgccgaggaagagcattatggctacgcttcatccaatgtgagcccagccctgcctctcccgacggctcatagcacgctgcctgcaccttgccacaacttacagacgtctacaccaggcatcataccaccagctgatcatccgtctggttacggagccgctttggatggaggtcccgccgggtactttctaagcagtggacacacccggccggacggtgctcccgctctggagtcaccccgcattgaaatcactagctgcctcggcctgtaccataacaataatcagttctttcacgacgtcgaggtagaggatgtgcttccttcaagcaaacgcagcccctcaacggccacgctttcccttccttccttggaggcttatagggatccaagttgcttgtcaccagcctcctccctttctagccgatcctgcaacagtgaagcctcaagctacgagagcaattactcttatccatatgcaagcccacagacatccccatggcagtctccttgcgtgagtccaaagacaacagaccctgaagagggctttcctaggggacttggagcctgcaccttactgggctcaccaagacattccccaagcacatccccacgcgcgtcagtgaccgaagagtcttggcttggagcccgttcgtcaagacccgccagcccttgcaacaagagaaaatactcgctcaatgggcggcaaccaccatactctcctcatcactcacctaccccctcgcctcacgggagtccacgagtcagcgttacggatgacagctggctgggtaatacgacacagtatacaagctctgctatcgtcgctgccatcaatgctttgacaacagacagctcgctcgatctcggggatggcgtcccagtcaagagtcggaagaccaccctcgagcaaccgcccagcgtcgcgttgaaagttgagccagtcggggaggatcttggatcacctccaccaccagcagattttgcacctgaagattacagcagctttcaacacatccggaagggggggttttgtgaccagtacctagctgtccctcagcatccttaccaatgggccaaaccaaagcccctctcccctacatcgtacatgtctcccacccttccagcgctcgattggcagctccctagccactctggaccttacgagctgcgtatcgaggtccagcccaaaagccatcatcgggcacattacgagactgagggctccagaggggcagtgaaggcttctgccggtggccaccccattgtccaactgcacggctatctggagaacgaacccctgatgctccaactcttcataggcaccgccgacgaccgtctgctgagaccccacgctttctaccaggtgcatcggattactgggaaaacagtgagcactacgtcacacgaggcaattttaagtaacaccaaagtcctcgaaattcctcttctgcccgagaatagtatgagggctgttatagattgcgccggcatcctcaaattgcgcaatagcgatattgagctgcgcaagggcgagacagatatcgggagaaagaatacacgcgtacgattggtttttcgggtccacgtccctcaaccctccggtcgcaccttatcactgcaagtagcatcaaaccccattgagtgttctcaacgctcggcccaagaactgccgctggtggagaagcaatctaccgattcataccctgtggtgggcggtaagaaaatggtgttgagcggtcacaatttcctgcaggattcaaaagtaattttcgtcgaaaaggcacccgatggacaccacgtgtgggagatggaagctaaaacggaccgcgatttgtgtaaacccaacagccttgtagtggagatccccccgttccggaaccagcggattaccagcccggtacacgtatccttttacgtttgcaatggaaagcggaaaagaagccagtaccagcgattcacatatctgccagctaacgggaatgccatatttctgaccgtaagtcgagaacatgagcgggtggggtgttttttctag

SEQ ID NO: 25353 - DNA, 2478 bp, Artificial Sequence
  Description of Artificial Sequence: Synthetic coding sequence
atgcccagcaccagcttccccgtgcccagcaagttccccctgggccctgctgcagcagttttcggaaggggggagactctgggacccgcccccagggcaggcggtacgatgaaatcggccgaagaggaacactacgggtacgcttctagcaacgtctcacccgcactgccactcccgactgcgcactccaccctcccggccccctgccacaatctgcaaacttctacgcctgggataataccgccggctgaccaccccagcggatacggagccgctctggacggcggacccgctggctactttttgtcatccggccacacaagacccgacggagcaccagcccttgaatctccccggatcgagatcacttcttgtctcggcctctaccacaacaataaccagttcttccatgacgtggaggtggaagatgtcctgccgtccagcaaaaggagcccctccaccgccaccctatcactgccctccttggaagcatatcgcgatccgtcttgtctgagccccgctagctcactatcaagccggagttgcaatagcgaagcgagttcgtacgaatcgaactacagctacccctatgcttccccacaaacctcaccctggcagagcccttgcgtgagccccaaaaccacagatcctgaagaagggttcccccggggactgggtgcctgtacattattagggagccctaggcattcaccttccacatctccgagagcgtccgtaaccgaggaatcctggctgggagcgcggagtagtagacctgcctcaccctgcaataagcggaagtactcacttaatgggaggcaacctccatatagtccacaccatagtccaacacccagcccccacggatcccctagggtgtcggtgacagatgattcgtggctgggaaacaccacccagtacacctctagcgccatcgttgccgcaatcaatgctctgacaaccgattcttccctggacttaggcgacggggtgcctgtgaagagtaggaaaacaaccctggaacagccaccttcagtggcccttaaggtcgaaccagttggggaggatctggggtccccccccccgcccgctgactttgcccccgaagattactcgtccttccagcacatcagaaagggcgggttttgtgaccaatatctggcagtccctcagcacccgtatcagtgggccaaacctaaaccgctctctcctactagttacatgtcccccacgttgccggccctcgactggcagctgccatcgcactccggaccatatgagctgagaatcgaggtccaaccaaaatctcatcatagagcccactatgaaaccgagggatctaggggggcagtgaaggctagtgcaggcgggcatcccatcgtacagttgcacggctacctggagaacgaaccgcttatgttacagttgtttattggtacagccgacgaccgtctactaagaccccatgctttttaccaagtgcacaggatcacagggaaaaccgtatcaacgacatcccacgaagccatcctctcaaacaccaaggttttggaaattccattgctgcctgagaactccatgagggctgtgattgattgcgccggcatacttaagcttcgaaactcagacattgagttacggaagggggaaacggacatcggtcgcaaaaacacccgcgtgcgcttagtgtttcgcgtacatgtgccacaaccatctggcaggacactgagcctgcaggtggctagtaacccgattgaatgcagccagcgctcagcccaggaacttccactcgtcgagaagcagagcacagattcctacccggtggtgggaggtaagaaaatggtacttagcgggcacaactttctgcaggactccaaggtgattttcgtggagaaagctcccgatgggcatcatgtatgggagatggaggctaaaactgaccgggatctgtgtaagccgaattccctagtcgtcgagatccccccatttcggaatcagcggataaccagcccagtacacgtgagcttttatgtgtgtaatggcaaaaggaaaaggagccaatatcagaggtttacctatctccctgctaatgtaccaatcatcaaaacagagcccacagatgactatgagcctgctcccacgtgtggacccgtctcacagggattatccccgctgcctaggccctactactcccagcagctggcgatgcctcctgacccatcttcctgtctggttgctggattccccccgtgtccgcagcgctccacactgatgccggccgcccctggcgttagcccgaaactgcatgacctcagtcctgctgcatataccaagggagtggcgtccccagggcattgccacctgggcctgccccagcctgccggagaagcgccagcagtccaagatgtgccgcgccctgtggccacccacccgggatctccgggtcaacctccacccgcattgctcccgcagcaatag

SEQ ID NO: 25354 - DNA, 2832 bp, Artificial Sequence
  Description of Artificial Sequence: Synthetic coding sequence
atgcccagcaccagcttccccgtgcccagcaagttccccctgggccccgctgcagcagtgttcggaagaggcgagacactcggacctgcccctagggccggagggaccatgaaatcggccgaagaagagcattatggttatgctagctctaatgtgagcccagcgctaccattgcctaccgcgcacagtaccttacctgccccctgtcacaatctacagacctctacccccggtatcattccacccgcagaccatccctcaggatacggcgctgccctcgatggagggcctgcaggctatttcttatcctctgggcacacccgaccagatggtgcgcctgctctggagagcccccggatcgaaatcactagctgcttgggtctttatcataataacaaccagttttttcacgatgtggaagtagaggatgtcctcccaagcagcaagcgttccccatccaccgcaacactgtcactcccttcacttgaggcatatagggatccttcctgtctttctcccgcctcgagcctctcctctcggagctgtaattctgaggcctcaagctacgagagcaattactcgtacccttacgcatctccacagacgtctccttggcagagcccttgcgtgtcccctaagactaccgatccagaggaaggcttccctcggggactcggcgcttgcacccttctaggttctccacgtcattcaccctccacgtctcccagagcctccgttaccgaggagtcatggctcggggcccgatcctccagacccgcatctccgtgtaataaaaggaaatacagtctcaacggcagacagccaccctactctcctcaccattccccaactccctctccccatggaagcccaagggtgtcagtgactgacgatagttggctgggcaacacaacccagtacacatcctcagcgattgttgccgctatcaacgcacttaccaccgattcttccctcgacctcggcgacggcgtcccagtaaaaagcaggaagaccactctggaacagcccccaagtgttgctctgaaagtcgagcccgtgggagaggacctgggctcacccccaccacccgccgactttgcacctgaagattattcatctttccagcacattaggaagggtggtttctgtgaccagtacctggcagtcccccagcatccttaccagtgggccaaacccaagcccctgtcgcccacctcttacatgtccccgacactgcctgccttggactggcaactgcccagccactcaggcccctacgaactgagaatagaggtccagcccaaatctcaccatagggcacactacgagacagagggctctaggggggccgtgaaggctagtgcaggcggccatccaatcgtgcagctgcacggatatttagagaacgagcccctgatgctgcaactgttcatcggaaccgccgatgacaggctcttgcgcccacacgcattttaccaggttcataggattaccgggaaaaccgtgtccacaacttcccacgaggcaatcctgtcaaatacaaaggttcttgaaattccgctgttgcccgaaaatagcatgcgtgccgtcattgactgcgccgggatactgaagttacgtaattctgatatcgagctgagaaagggtgaaaccgacatcgggagaaagaataccagagtgaggcttgtctttagagtgcacgtgccacagccaagcggaaggaccctttccctgcaggttgcatccaatcctattgagtgcagccagcgaagtgcccaggaattacctctggttgagaagcaatccacggattcttatccagtcgtgggggggaagaaaatggtgctaagcggccataacttcctccaggattccaaagtcatcttcgtggagaaagctccggatggccaccacgtttgggaaatggaggccaagactgacagagacctgtgcaagccaaatagtctggttgtggagattcccccctttaggaatcagcggatcacaagcccggtccacgtttctttctacgtgtgtaatgggaagaggaagcgaagccagtaccagaggtttacctatctccccgccaacgtgccgattattaagactgaaccaacagacgactatgaaccggctcccacctgtgggccggtgagccaagggctttccccactgccgcggccctactacagtcagcaacttgcaatgccccctgacccatccagttgtctcgtggctggctttccgccatgtccccagagaagcaccttgatgcctgcagcgccgggcgtgagtccaaagcttcacgacctctctcccgccgcctatacaaagggggtggcttcccctggccactgccacctcgggctgccccagcctgcaggagaggcccctgcagttcaagacgtgccacgccccgtggccacccatcctggcagtccaggccagcctccccccgccctactgccccagcaggtcagcgccccaccttctagcagctgcccaccggggttagagcattcactgtgccccagcagcccgtcaccccctctgccacccgccacgcaagagcctacctgcctccagccctgtagcccggcttgcccacccgctacaggacgcccccagcaccttcccagcacagtgcgcagagacgaaagcccaactgcgggtcctcggcttctccctgaggttcatgaagacggaagtccaaacctggcaccaattcccgtcacagtcaaaagagagcctgaagaacttgaccagctgtacctggacgatgtcaatgaaatcataagaaacgatttgagttccacttccacacacagttag

SEQ ID NO: 25355 - DNA, 2793 bp, Artificial Sequence
  Description of Artificial Sequence: Synthetic coding sequence
atgaccggcctggaggaccaggagttcgacttcgagttcctgttcgagtttaaccaaagggacgagggcgccgccgcagccgccccagagcattatggctatgcaagctcaaacgttagccccgcactgccccttcctacagcacacagcacgctgcctgcaccctgtcataatctccagacctcaacacctggcattattccccctgccgatcaccccagcggttacggggcagccctggatgggggtccggccggctattttctgagctcggggcacactaggcctgacggggcaccagctctggaaagcccaagaatcgagattacttcttgtctcggcctttaccacaacaacaatcagttttttcacgacgtggaagtcgaggacgtgctaccttcttctaagaggagtccctctacagccacactgtccttgccgagcctggaagcttacagagacccctcgtgcctctcacctgcgtcgtctctgagctccaggagctgtaattcagaagcctcctcttatgagagtaactacagttatccttacgcaagcccccagaccagcccctggcagtccccttgtgtgagcccaaagacaacagaccctgaggaggggtttccacgcggcctaggtgcttgcacgctgctcgggagtcccagacattctccttctacctcccctagagcttcggtcactgaagagtcctggctgggtgcacggtcctcccggcctgcaagcccctgcaacaagagaaagtactctctcaatggcagacagccgccttacagtccccaccattcaccaactccctcccctcatggtagcccccgggtttctgttactgacgactcatggttgggcaacacgactcagtacacatcctcggccattgtagctgcgatcaatgccctcacaacagattcaagtctcgacttgggggacggagtgcccgtgaagagccggaaaacgacacttgaacaacccccctcagtggctctcaaagtcgaacccgttggggaggatttgggaagcccaccaccacctgccgattttgcccctgaggattattcttcctttcagcatattaggaaaggaggcttctgtgaccagtacctcgccgttccccagcacccttatcagtgggccaaaccaaaaccgctgtcccccacatcctacatgtcccccacgcttccagctttggactggcaacttccaagccacagcggaccatacgagttacgcatcgaagtgcagcctaaatcccatcatcgcgcacattacgagaccgagggttctagaggcgcggtgaaggcaagcgccggagggcaccccattgtccagcttcatggctatcttgagaacgagccgctcatgttgcagctttttataggtaccgccgacgatcggctgcttagaccgcacgctttttaccaagttcaccgcatcaccggcaagacagtgagtactacttcccacgaagctattctgagtaacaccaaggtgctggagattcctcttctgcctgaaaattccatgagagccgtaattgattgcgcaggcatcctgaagcttcgaaattctgacatagaattacggaagggagagactgacatcgggcgcaagaatacaagagtcaggctggtgtttcgggtgcatgtgccacagccttccggccggacccttagtcttcaggtcgcttccaatccgattgaatgttcccagaggtcggctcaagaactgccattagttgagaagcaaagcaccgatagctatcccgtggtcggaggtaaaaaaatggttctgagtggccacaattttcttcaagattccaaagtcattttcgtggagaaagcccctgatggccatcacgtatgggaaatggaagcaaagaccgatcgcgacctatgcaagccaaactccctcgtggtcgagatccccccattccgaaaccagcgaatcacgtcacctgtccacgtttccttctatgtttgtaacggaaagaggaaacggtcccagtatcagaggttcacatacttacctgccaatgtcccaataattaaaacagaaccaaccgatgactacgaacctgcacccacctgtggacccgtctcccaaggcttatcacctctccctcgcccttattatagccagcagctcgcaatgccgcctgacccctcatcctgtctcgtcgcgggattcccaccttgtccccagaggtctactctaatgcctgcagccccaggcgtaagtcccaagctccacgatctgtccccagccgcctacacgaagggggttgcctcccctggccattgtcaccttgggctgccacagcccgctggcgaggctcctgctgtgcaagacgtcccaagacccgtggctacccatcctggaagccctggccagccaccccccgctctgttacctcaacaggtgtctgccccaccatcttcctcgtgcccaccagggctggagcactcactgtgccctagttcacccagccctcctttgccaccagcaacacaggaacccacctgcctgcagccttgctccccggcctgtcctcccgccacaggaagacctcagcacctgcccagcactgtcaggcgggatgaatccccaaccgctggacccaggctgctgcccgaagtgcatgaagatggatctccaaacttggcacctattccggtgactgttaagcgggagcccgaggagctggaccagctgtacctagatgatgtcaacgagatcattcggaacgaccttagttcgacatccacccacagctag

SEQ ID NO: 25356 - DNA, 1062 bp, Artificial Sequence
  Description of Artificial Sequence: Synthetic coding sequence
atgctgcagctgttcatcggcaccgccgacgaccggctgctgcggccccacgccttttatcaggtccaccgaattaccgggaaaactgtgagcactacaagtcatgaggcgatcttgagcaatacaaaagttctggagatccctttattgcctgagaatagcatgcgcgccgtgattgattgcgcaggcatccttaagctgaggaattctgacatcgaactgagaaagggagagactgatataggccgaaaaaacacccgggtgagacttgtcttccgcgttcacgttccccagccctcagggcgaactctcagtctgcaggtagccagtaaccccattgagtgctcacagcgttccgctcaagaactgcctctggttgaaaagcagtccactgactcttatccggtcgtgggcggcaagaaaatggtgctgagcggacataacttcttacaggactccaaagtcattttcgtggaaaaagctcccgacggtcaccacgtgtgggaaatggaggcaaagaccgatcgtgatttgtgcaagccaaactctctggtggtagagattccgccctttcgtaatcagagaataacaagcccagtgcatgttagtttctatgtttgtaacggaaagcggaaaagatcccagtaccagcgttttacttacctccctgctaacgtgccgatcattaagacagagccaaccgacgactacgaaccagctccgacttgcgggccggtgagccaagggctgtcccccttaccgaggccgtactactcccagcagctggcaatgccacctgatccctcttcctgcctcgtcgccggatttcccccttgcccccagaggtccacacttatgcctgccgctccgggtgtgtcaccgaaactccacgatctgtctcctgctgcttacactaaaggggtggcctccccagggcattgtcacctgggactgccacagcctgccggcgaggcaccagcagtgcaggacgtgcctaggccagtagcaactcatccagggagtcctggccagcctcctcctgccctgcttcctcagcagtag

SEQ ID NO: 25357 - DNA, 2724 bp, Artificial Sequence
  Description of Artificial Sequence: Synthetic coding sequence
atgaagagcggcaccctggagcactacggctacgccagcagcaacgtgagccctgccttgcccctccccacagctcattccacactccctgccccctgtcataaccttcagacatccactcctggcatcatacctcccgccgaccatcctagcggctatggagcagctttggacggggggcccgccggatattttcttagctccggtcacacacgcccagatggcgcaccggcactggagtccccacgcatcgaaattactagttgcctgggcctataccacaacaataatcagtttttccacgatgtggaagttgaagatgtcctcccgtcaagcaaaagatctccctcaacggcaacacttagcctgcccagtctggaggcctatcgggacccttcctgcctgtcgcctgcttcttctttatcatctcgctcgtgtaattctgaagctagtagttacgagagcaattactcttacccttacgccagcccccagacctctccttggcagagtccatgtgtctcgccaaagacgacggacccagaggagggcttccccagagggttgggcgcctgtacacttctcggctcccccaggcacagccccagcacaagccctagagcttctgtcacggaggaaagctggctgggcgcacgcagctctcgtcctgcttcgccatgcaataagaggaagtattcactaaatgggcggcagcctccatactcaccccaccatagtcccactcctagccctcatggctctccgcgagtgtctgtgaccgacgattcatggctgggcaacacaacccagtatacttcgagtgcaatcgtggctgctattaacgccctgactactgactctagtctcgacctcggtgatggcgtgccagttaagtcccgaaagacaacattggagcagcccccatctgtcgcacttaaggtggagcccgtcggggaggacctgggatccccaccgcccccggccgatttcgctcctgaggactactccagcttccagcatatccgtaagggaggtttttgtgaccaatacctagcagtgccacagcatccttatcagtgggcaaagccaaagccgctgagccccacctcatatatgtcaccaactcttcccgccctagattggcagctcccatctcacagcgggccctatgagctgagaatcgaggtccagcctaagtcccaccacagggcccactacgaaacagaggggtcgcggggagctgtaaaagcatcagccggtggccatccaattgtccagctgcatggatacctggaaaacgagcctcttatgctgcagctgttcattgggactgctgacgaccgcttgctccggccgcatgctttttatcaggttcaccgcatcactggaaaaacagtgagcacaaccagtcatgaagcaatcctcagtaatacaaaagttctcgagatcccactcctgcctgaaaacagtatgcgggctgtgattgattgcgctggaatactcaagctgaggaattcagacattgagctccgtaaaggcgagaccgatatcggtcgtaaaaacacacgcgttcgtttagtgttcagggtacacgtgccacagccaagcggtcggaccctatctctgcaagtggcgtccaaccccatcgagtgttctcagagaagcgctcaggaactcccactggtggagaagcagtctacagactcatatcctgtcgtcggcggcaaaaagatggtgcttagcggccacaatttcctccaggatagcaaggtgatcttcgtcgaaaaagcccctgacggccaccacgtgtgggagatggaggcaaagactgatcgtgatctatgcaagccaaatagcttggtcgtggagatcccacctttcagaaatcagcgcatcacttccccagtccacgtgtccttctacgtgtgcaacggcaaaaggaaacgatcccagtatcagaggttcacatacctgcccgccaacgtcccaattattaagaccgagcccacggacgactatgaacccgcccctacttgcgggccagtgtctcagggcctgtctccccttccccgaccttattattctcagcagctcgcaatgccccctgacccatcgagctgtctggtggccgggttcccaccatgcccacagaggtccacgctgatgcctgctgcgcccggcgtcagccccaagctgcacgatcttagtccagctgcctacaccaagggagtagcttcccctgggcactgccatcttggtttaccacagccagcaggggaggctcctgccgtccaggatgtgccccgtcctgttgccactcatcccggcagccccggacagccccctcctgccctcctgccacaacaggtgtccgctccgccctcttcaagttgccctcctggactggaacactctctctgcccttcttcaccttctccaccgctccctcccgcaacgcaggagcccacatgcctccagccctgctcccctgcctgcccacctgctactggaaggccccaacatcttcccagcaccgtacgtcgtgatgagagccccacagcaggcccaagactgctccctgaagttcacgaggatggctccccaaatctcgcacccattcccgtgaccgtgaaacgcgaacccgaagagctggatcagctgtaccttgacgacgtaaacgagataatccggaacgatctgagcagtacttctacacactcctag

SEQ ID NO: 25358 - DNA, 2745 bp, Artificial Sequence
  Description of Artificial Sequence: Synthetic coding sequence
atgaccggcctggaggaccaggagttcgacttcgagttcctgttcgaattcaatcagcgggatgaaggggccgcggcggccgccccagagcattacggatacgcctcctctaatgtgagtcccgccttgccattacctactgcccatagcacactgccggctccatgtcataacctgcagacgagcacacccgggatcatcccaccagctgatcatccttctggatacggggcagccctagacgggggcccggcaggatatttcctttcctcaggccacactaggccagacggcgctcctgcccttgaatcacctagaatagagatcacttcttgtctcggcttatatcacaacaataatcagttcttccacgacgtcgaagtggaagacgtcttaccttcgtcaaaaagaagcccgagcacagcaactttgagcttgccttcacttgaagcctatagggatcccagctgtctcagccccgctagctcactcagttcaaggagttgtaacagtgaggccagtagttacgagtcaaactattcctacccttacgcatcccctcagacctcaccatggcagtcaccttgtgtgagcccaaaaaccactgatccggaggagggcttcccacgcgggctcggagcatgtacattgttgggctctcccaggcactccccatcaacttctcctcgagcttctgtaacggaagagtcgtggctaggagcacgttccagtagacccgctagcccatgcaataaacggaaatacagcctaaacggaagacagccaccttacagcccacatcactctcctacgcccagtccccatggatcgccgagagtctccgttacagatgattcctggttgggaaataccacccagtacacaagcagcgccatagtggccgcaatcaacgctcttaccacggatagctccctggacctcggcgacggcgttcccgttaaatctcggaagacaaccctcgagcagcccccttctgtggcgctgaaggtcgaacccgtgggcgaagatctgggctccccccccccacccgcagatttcgccccagaagattattctagtttccaacacattaggaagggtggattctgcgaccaatacctggcagttccgcagcacccgtatcagtgggccaagcccaaaccactctctcctacgagctatatgtcccctactctgcctgcattggactggcaactcccatcacattctggtccctatgagctcagaatcgaggttcaaccgaaatcacatcatagggctcactacgagacagaagggtcccggggagcggtgaaagcttcagccggtgggcacccaatcgtgcagctgcacggatatctggagaatgagccccttatgctccagttgtttatcggtaccgctgacgatagactgctacggccccacgccttctaccaagtgcatcgcatcacaggcaaaaccgtcagtaccacctctcacgaagccattctgtccaatacaaaggtgctggagatacccctgctcccagagaactccatgcgtgccgtgatcgattgtgccgggattctgaagctgcggaatagcgatatagaactgaggaagggcgaaactgatattggtcgaaagaacacacgggttagactggtgttccgagtgcatgtacctcagccatcgggtcggaccctctctttacaggtggcatccaatcccattgaatgtagtcagcgatctgctcaggagctgcccctcgtggagaaacagagcaccgattcgtatccagtggtcggcggaaaaaagatggttttgtccggacataacttcttgcaggattctaaggtgattttcgtggaaaaagccccagatggccaccacgtctgggaaatggaggcaaagacggacagggacctctgtaagccaaatagtttggtggtggagatccccccctttcgcaatcagcggattacttcccctgtgcatgttagcttttatgtgtgcaatgggaaaagaaagcggtcacagtatcaacgcttcacttatcttcccgccaatgtaccaatcataaagacggaacccactgacgattacgagcccgccccaacctgcggtcctgtaagtcagggcctatcacctcttcccaggccctattattctcaacaattggcgatgccccccgaccccagtagctgcctcgtggcagggttccctccttgtccacaacggtcaactctaatgcctgctgcccccggtgtttcccctaaactgcacgacctttcaccagcggcttatacgaaaggcgtggcctctccaggtcattgccacctggggttaccacagcccgcaggggaagccccggcagttcaggacgtaccgcggcctgtggctacacatcctggttccccgggtcagcctccccccgctctgctgccacagcaggtgagtgctcctccttcgagctcctgtcctcctggtctcgagcattccctgtgcccctcgtcaccaagcccccctctgcccccggctacccaggagcccacgtgcttacagccctgctcaccggcgtgcccgcccgcaacaggtagacctcagcacctcccaagtactgtgagaagagatgagtcaccaaccgcaggacctcggcttctccccgaggtacacgaggacggcagtccaaaccttgctcctattcctgttaccgtgaagcgggagccggaggagctcgatcagctttatctcgacgattag

SEQ ID NO: 25359 - DNA, 2142 bp, Artificial Sequence
  Description of Artificial Sequence: Synthetic coding sequence
atgcccagcaccagcttccccgtgcccagcaagttccccctgggcccggcagcagccgtgtttggcaggggcgaaactttaggcccagcaccgcgtgctggtggaaccatgaaatccgctgaagaagaacattatgggtacgcgtcgagtaacgtttcacccgcccttcccctacccacagcacacagtactctacccgcaccatgccataatctgcagacatccacgcccggcataatcccccctgccgaccacccctcaggctacggagctgcactagacggcggccccgcgggatactttctgagttcaggccatacgcggcccgatggcgcacctgccctcgagtccccacggatcgaaattacctcctgcctgggcctataccataacaataaccagttcttccacgatgtcgaagttgaggatgtcttaccttcatcaaaaagatcacctagcaccgccacgctatcactcccttcactggaggcgtatcgagacccaagttgcctttcccccgcatcatctctgtcatctagatcatgtaactctgaagcttcatcatatgagtccaactacagctatccttacgcctcgccacagacctcaccctggcagtcaccctgcgtttccccgaagacaacggatccggaggaggggtttcccagaggtcttggggcctgcacgttactcggaagtcctaggcacagcccgtctacttccccacgtgcaagtgtgaccgaggaaagttggctgggcgccagatcctctcggccagcaagtccctgcaataaacgcaagtatagcctcaatggccgacagcccccctacagtccccaccactcccccactccatcgcctcatggaagcccacgagtgtccgtgacagacgactcgtggttgggcaacaccactcagtacacctcctccgccatcgtggcagccatcaatgcactaacgacagactcctccttggacctcggtgacggggtccctgtcaaatcccgaaaaaccaccctggagcaaccaccctcagtcgcgctgaaagtggaaccggtgggtgaggatctgggttcacctccacctcctgcggattttgcccctgaggattattcaagtttccagcacatacgtaaaggcggattctgtgaccagtacctggctgtaccccagcacccctaccagtgggctaagcctaagcctttgtctccaacatcttacatgtctcctacactgcctgcccttgactggcagctgccctctcatagcggtccgtatgaactacgcattgaggtccagccgaaatcacaccaccgggcgcattatgagactgagggcagcaggggagctgtaaaagcttccgctgggggccaccctattgtccagctccacggttacttggaaaatgagcccctaatgctgcaactgttcatcggcacagctgatgacagactcttaaggccgcacgcattctaccaggtccatcgaataactggaaaaaccgtctcgaccacaagtcatgaggccattctgtccaatacgaaggtgctggaaatccctcttctgcccgaaaacagtatgcgcgcggttatcgactgcgccggcattctcaagctccgaaattctgatatagagcttagaaagggagaaacggatatcgggaggaagaacactcgggtgaggctcgtgttcagggttcatgtcccccagccctcagggcgtacgctttccctgcaagtggcttccaatccaatagaatgctcgcaacgaagcgcacaagaactgcccctcgtggaaaaacagtcgactgacagctatcctgttgtcggtggaaagaagatggtgctgtctgggcataactttctccaagactcaaaggtgatcttcgtcgagaaagcacctgatggacatcacgtgtgggaaatggaagccaaaacggatagagacctgtgcaagcccaattcactggtcgttgagattccccctttcaggaaccagagaattacttctcccgtacacgtgagcttttacgtatgcaacggaaaacgcaagcgaagccaatatcaaaggtttacgtatctgcctgcaaacgtgaatgagattatccgaaacgacctgtcgagtacaagcacccactcatag

SEQ ID NO: 25360 - DNA, 1416 bp, Artificial Sequence
  Description of Artificial Sequence: Synthetic coding sequence
atgctgcagctgttcatcggcaccgccgacgaccggctgctgcggcctcacgctttttatcaggtgcatagaattactggcaaaaccgtctccaccacctcccatgaagctattctgtctaatactaaagtcctggagatccctctgctgcccgagaattccatgcgcgccgttatcgattgcgcaggcattttgaaactaagaaatagtgacatcgagctgagaaagggagagaccgatatcggcagaaagaacacacgcgttcggctggtcttccgagtgcatgtgccacagccctccggcagaacccttagtttgcaggtagcgagtaatcccatcgaatgttcgcaacgcagtgcacaggagcttccgctggttgagaagcaatctacagactcctatccggtcgtggggggaaagaaaatggtgctctccggccataactttctgcaggactccaaggtgatctttgtcgagaaggccccagatggccaccacgtttgggaaatggaggctaagacagaccgagatctgtgtaagccgaattcactggtcgtcgaaatccccccattccgaaaccagaggatcacaagtcctgtgcacgtatcgttttatgtatgcaatgggaaacgcaagaggtcacagtaccaacgctttacctacctgcccgcgaatgtcccgattatcaagaccgagccaaccgacgactacgagcctgcccccacttgtggccccgtgtcgcagggtctgtctcctctgccccgcccatattatagtcagcagctggccatgccccccgacccaagctcctgtctggtagccggtttccccccgtgcccccagagatcgaccttgatgcctgcagctccaggtgtgagccctaaactgcatgacctctctcccgccgcttatactaagggagttgcgtccccaggacactgtcacctgggactgcctcagccggccggagaggctcctgccgtgcaagacgtacccaggcctgtggctactcatccaggctctcccgggcagccccctcccgcgctgctgccccagcaggttagtgccccccccagtagctcctgcccgcccggactcgagcacagcctttgcccctctagtccttcccctccactgccccccgctacccaggaacccacatgcctccagccttgttcgccagcttgcccacccgccactggcaggccccagcatctcccttctacagttaggcgtgacgagtctcccaccgcaggaccacggctcctgccagaggttcatgaggatggatcccctaatctggccccaatccctgtcacagtgaaaagggagccggaggagcttgaccagttatatcttgacgacgtcaacgaaatcatcaggaatgaccttagcagcacatcaactcactcttag

SEQ ID NO: 25361 - DNA, 2766 bp, Artificial Sequence
  Description of Artificial Sequence: Synthetic coding sequence
atgaacgcccccgagcggcagccccagcccgacggcggcgacgcccccggccatgaacccggtggaagtccccaagacgaactcgacttcagcattctgtttgattacgagtacctgaaccctaacgaggaggagcccaatgctcacaaggtggcatctccgccctcagggcctgcctaccctgatgacgttcttgactatggtctgaaaccgtactcccctttagcctcactgagcggcgaaccaccagggcgctttggtgaacccgacagggtcggacctcagaagttcctaagtgccgctaaacctgccggtgcatcaggcttgagccccaggatcgagattacaccaagtcacgaactcatccaagctgtgggtccactccgaatgcgggatgcaggcctcttagtagaacaaccccccttggccggcgtcgctgcctcaccccgttttacgttgcccgttcctggctttgaaggatatagagagcctctctgcctttcaccggccagcagtggctcttccgcatcgtttatcagtgatacattctcaccatataccagtccatgcgtatccccgaataacggcggtccagacgacctatgcccccagttccaaaacattccagcccattactctccacgaacctcccccattatgtctccccgtacaagtctagccgaagattcttgtctgggacggcattcacccgtgcccaggccagcctctcggagtagctcacctggggccaaacgaaggcactcatgcgcagaggcactggtggcccttcccccgggagcatccccacagaggtctagatcaccctccccccagccctcctctcacgttgccccgcaggatcacggctctcctgctggttatcctcccgtcgccggctccgccgtcatcatggacgccctaaattcccttgccaccgatagtccctgcggcatcccccccaagatgtggaagacatcccccgaccctagccccgtcagtgccgcccctagcaaggctgggctgccccgtcacatctaccccgcagttgaatttctgggaccctgtgagcagggggaaaggcgtaatagcgcccctgagtctatcctcctagttcctcccacgtggccaaaaccacttgttccagctattccaatctgctctatccccgtgaccgcctcacttcctcccttagaatggccactgtcaagccaatctgggtcgtacgaacttaggatcgaggtgcagcccaaacctcaccaccgagctcactatgagactgagggtagcaggggcgccgtgaaggcccctactggcggccaccctgtggtccaactgcatgggtacatggaaaacaagcctttgggcctccagatcttcatcgggactgcagacgagcgaatcctgaagccccatgccttttaccaggttcatcggattaccggcaagactgtcacaaccacatcctacgagaagattgtgggtaacactaaggtacttgagatccccctggagcccaagaacaacatgcgtgcaaccatcgactgcgccggaatcctgaagctcaggaatgccgacatcgaacttaggaaaggagagacagacatcggacggaagaacacgcgggtgcgcttagtatttagagtgcacatcccagagtcttcaggcagaattgtgtccctgcagacagcctcaaatccaatagaatgtagtcaacggtccgcccacgaactgcctatggtcgaacggcaggacactgacagctgtttggtctatggggggcagcagatgatcctgacaggacagaatttcacatccgagagcaaggtcgtgttcactgaaaagactaccgacgggcagcaaatatgggagatggaggcaacggtggataaggacaaaagccagcctaacatgctgtttgtcgagatacccgaatatagaaacaagcatattagaacccctgtaaaggtaaacttttatgttataaacggaaagcgtaagagaagtcagccccagcactttacctaccacccagttcccgccattaaaacggaacctaccgacgaatacgaccccacactcatctgttccccaactcatgggggacttggtagccagccatactacccacaacatccgatggtcgcagagtctccgtcatgcctagtcgctacaatggcgccttgtcagcagttcaggacaggactgagttcccctgacgctcgataccaacagcagaacccggcagctgttctgtatcaacggagtaagtcactgtccccttccctcctcggctatcaacagccagccctcatggccgcacctctgagccttgcagatgcccataggagcgtactggtgcatgcggggtcacagggacagtcttccgcgttgctgcatccctctcctaccaaccagcaagcttcccccgtcattcattacagcccaacgaatcagcagctgaggtgcgggtcacaccaggaattccagcatattatgtattgcgagaatttcgctcctggaaccacacggcctgggcccccacccgtttcacaggggcagcgattaagcccaggcagctaccctacagttatccagcagcagaacgcaacatcacagcgcgccgcgaagaatggcccccccgtttcagatcagaaggaagtgctgccagccggagtgacaatcaagcaggagcagaatctggaccagacctatctcgacgatgagctgatcgacacccatctctcctggattcagaatattctttag

SEQ ID NO: 25362 - DNA, 978 bp, Artificial Sequence
  Description of Artificial Sequence: Synthetic coding sequence
atgagcccccggaccagcctggccgaggacagctgcctgggccggcactctcctgtcccccgtcctgcaagccgttcttcatctccaggcgctaagcgcaggcacagctgcgccgaggcactggtggctctgccccccggggcctctccccagaggtcacgatctcccagtccacagccatcatcccatgtcgctccccaggaccacggctctcccgccgggtatccacctgttgctgggtccgcggttattatggatgccttaaacagtctagccactgactctccctgcggaattccaccgaagatgtggaagactagccccgacccttcgcccgtctctgcggctcccagtaaagccggactgccaaggcatatttatccggccgttgaatttctcggcccttgtgaacaaggcgagaggcggaactcggctcccgagtcgatcctgcttgtgccgcccacatggcccaagcctttagtaccagcgatccccatctgtagcattcccgtgacagctagcctacctcctctcgagtggccgctgtcctcccaaagtggctcctatgagcttcggattgaagtgcaacccaaaccacatcaccgagctcactacgagactgagggtagccggggcgcagttaaggcgccaaccggcgggcatcctgtggtgcagctccacggatatatggaaaataaacctctgggactccagatcttcattgggaccgccgatgagcggatcctgaagcctcatgcgttctaccaggtccacagaattaccggcaagaccgttactactacttcttacgaaaagattgtggggaacaccaaagttttggagattccattggagcctagcaccgccccacacctgctctccccgtttatgttcatttcccaacccggtgttcatacacgcatcaatgtctgggctctgtcaggactttctcttaaagaactggctacatcactgtag

SEQ ID NO: 25363 - DNA, 2778 bp, Artificial Sequence
  Description of Artificial Sequence: Synthetic coding sequence
atgaacgcccccgagcggcagccccagcccgacggcggcgacgcccctgggcatgagccaggcggcagccctcaggacgagttggatttctcaatcctgttcgattatgagtatctgaatcccaacgaggaagaacccaacgcccacaaagtggcgagtcctccctccggccctgcgtaccccgacgacgtcctcgactacggcctgaaaccttactcccctctcgcttccctttcaggagagcctccagggaggtttggtgaacccgatcgcgtcgggccacagaaattcttgtcggcggccaagcctgccggtgcctctggtctgagcccaagaatcgaaattactcctagccatgagctgattcaggcggtcgggcctctgaggatgcgggatgctggtcttctagtggaacaacctcccttagctggtgtagctgcgagcccccgtttcacgctgccagtcccaggattcgaaggctatagggaacccctatgtttgtcacccgctagctccggtagtagcgccagttttatttctgatacctttagtccgtataccagcccatgcgtgtcccccaataatggcgggcctgatgacctatgtcctcagtttcagaacattcccgcccattactccccccgaacaagccccatcatgtcaccacgtacctccctggccgaagacagctgcctcggccgccattctcccgtgccacgcccggcctcccgctcatcctcacctggcgcgaagcggagacattcctgtgccgaggcattagtggcactgccacccggcgcttctccacagcgcagtcgcagcccaagccctcagccaagcagccatgtcgcaccccaggaccacggaagcccggcaggttaccccccggtggctggatcagcggtgatcatggacgcacttaattccctggccactgactccccctgcgggatccctccaaagatgtggaaaactagtcccgatccaagccccgtgtcagcagctccctccaaagccggccttccccggcacatctatccagccgtggagttcctgggcccatgcgaacaaggggagcgaaggaatagtgcccctgaaagcatcctgttagttcccccaacatggccaaagcccctggtacccgccattcctatctgcagcatccctgtcaccgccagcctcccacccctcgagtggccgctgagttcacaaagcggcagctatgagctgaggatcgaggtgcaaccaaagcctcatcaccgcgctcattatgaaaccgagggctctaggggcgccgttaaggccccaaccggagggcacccagttgttcagctccacggatatatggaaaacaagcctctcggcctccagatcttcatcgggacagctgatgagagaatcctgaagccgcacgccttctatcaggtgcacagaatcacaggaaagactgtaacaacaacatcttatgaaaagattgtggggaacactaaagtgttggagataccacttgaacccaaaaataatatgcgggcaactatagattgcgccgggatattgaaattgcgcaacgccgatatcgaattgcgcaaaggggagacggacattggtagaaagaataccagggttcgtctggtgttcagggtgcacattcccgagtcttcgggaagaatcgtaagcctgcaaactgcttccaaccctatcgagtgttctcagcggtctgcccatgagctgcccatggtggaaagacaggataccgacagctgcctggtgtacggagggcagcaaatgattctaaccggccagaatttcacctcggagagtaaagtggtcttcactgaaaaaacaacagacggccagcaaatttgggagatggaagctactgtcgataaggacaagagtcagccgaatatgctcttcgtcgaaatcccagaatatcgcaataagcacatcagaactccagtgaaggttaacttctatgttattaatggaaagcggaagagaagccagcctcagcatttcacgtaccaccccgtgccagccatcaagacagaacccactgacgaatatgaccctaccctgatctgtagcccgacccacggggggctcggctcgcagccttactatccccagcaccccatggtggcggaatccccttcctgtttggtggccaccatggctccctgccagcaattccgaacgggcctgagttccccggacgcacgctaccagcagcagaacccggcggcagtcctgtatcagcgatcgaaatcactttccccctcacttctcggctatcagcaacctgcgttgatggccgctcctctctccctggccgacgcacaccgatccgtgctggtccacgccgggagtcaaggccagtcgtctgccctcctccacccgtcccctactaatcaacaggcgagcccagtgatccattattctccaacaaatcaacaactgcgctgtggcagccaccaggagttccaacacatcatgtattgtgaaaactttgcgccaggcacgaccagacctgggccaccaccagtctcacagggacagagattatctcctggttcctaccccactgtcatacaacagcaaaatgccacgtcacaaagggccgccaagaacgggcctccggtatctgatcagaaggaggtcctgcccgctggtgtcacaattaagcaggagcagaatctggaccaaacatacttggatgatgtcaacgagatcattaggaaagagttctcaggaccccccgcaaggaatcagacatag

SEQ ID NO: 25364 - DNA, 2706 bp, Artificial Sequence
  Description of Artificial Sequence: Synthetic coding sequence
atgcagcgggaggccgccttccggctgggccactgccaccccctgagaataatggggtctgtggaccaggaggagcccaacgcacataaggtggcctctcctccatccgggccggcttacccagacgacgtgctggattacggactcaaaccctatagcccactggctagtctttcaggcgagcctcctggccggttcggggagcctgatcgtgttggacctcagaagttcctgtctgcagcaaagcctgcaggagcgagcggcctttcccccagaatagagatcacacccagccacgaactgatccaggcagtggggccattgcgtatgcgcgatgcaggcttgctcgtggaacagccccctctcgctggcgtggccgcctcccctaggttcactctaccagtccctgggttcgaaggctatcgcgaacccctctgtcttagcccggcctcctcgggctcgtccgcttcttttatatctgatacatttagcccctatacctccccgtgcgtgagcccaaataacggagggccagacgacctgtgtccacagtttcagaatattcccgcccattatagccctaggacgagtccaatcatgagccccagaaccagtctcgccgaggactcttgccttgggaggcacagccccgtacctcgacccgcaagtcggtccagcagccctggtgccaagcggagacactcttgtgccgaggcattggttgccctaccacctggcgcttctccccaacgttcgcgcagccccagccctcagccgtccagccatgtagccccacaagaccatgggtcccctgcagggtacccgccagttgctggatccgccgtgatcatggacgcactgaattcactcgctaccgactccccatgtggcatcccacctaaaatgtggaaaacatccccagaccccagcccggtgagtgccgccccttccaaagccggactgccccgccatatttacccagctgtggaatttctgggcccatgcgaacagggtgaacgccgtaactctgcaccggagtcaattctgctggtgccacccacatggcccaagccgctggtgcccgccattcctatctgttccattcctgttactgcctccttacctcctttggagtggcccctgtcctcccagagcgggtcttatgaactccggattgaggtccaaccaaaacctcaccaccgagcgcactacgaaaccgagggatctcggggggctgtgaaggcgcccacaggcggccacccagtcgtgcagctgcacggctatatggagaacaagcccctgggacttcagatttttatcggcacagccgacgaaaggattctgaaaccccacgctttttatcaggtacataggatcaccggaaagacagtgacaactacttcgtacgagaagattgtgggcaataccaaggtgctggagatcccacttgagccaaaaaataatatgagggctaccatcgattgtgccggaatcctcaagttaagaaacgccgacattgagctgcgcaaaggcgagacagatatcggacgcaaaaacacccgcgtccggctcgtgttccgggtgcatatcccggagagttcaggtcgaattgtgtctcttcaaacagcctctaacccaattgaatgcagccagaggagcgcccatgagctgcctatggtggaacggcaggataccgactcttgtctggtgtacggcggtcagcagatgatcctcacgggccagaattttacctcggagtctaaagtagtatttacagagaaaaccaccgacggccagcagatatgggaaatggaggccacagtggacaaagacaagtctcaacccaacatgctgtttgtggaaattcctgaatataggaacaagcatattagaacacccgttaaggtgaacttctatgtgatcaacgggaagaggaaacgctcacagccccagcactttacgtatcaccccgtgccagcaattaagacagaacccacagatgagtacgatcctacactgatctgcagccccactcatggcggattagggtctcagccctactacccccagcatcccatggtcgcagaatccccttcgtgcctggtggccactatggccccatgccaacaattccgtacaggcctgtctagcccagacgctcgctatcagcagcagaatcccgccgcagtgctctaccaaagatccaagagtctgagcccgagtctgctggggtaccaacagcccgccctgatggccgccccactgtctctcgccgacgcccatagatccgtgctggtccacgcggggtcccaggggcagagctcagctctcctccatccatctcctacaaaccagcaggcttctcccgtcatccactacagcccaacaaaccagcagctcaggtgtggaagccatcaggaattccaacacatcatgtactgtgaaaacttcgctcccggcaccacgcgtccaggacctcctcccgtgagtcaggggcaacggctgtctccaggttcctatccaactgtaattcagcaacagaatgctactagccagcgcgcggccaagaacggtccaccagtgagcgatcaaaaggaagtcttgccagccggcgtgaccataaagcaggaacagaatttagatcagacctatctggatgacgagctgattgacacccatctttcatggatacaaaacattctgtag

SEQ ID NO: 25365 - DNA, 3207 bp, Artificial Sequence
  Description of Artificial Sequence: Synthetic coding sequence
atgaccaccgccaactgcggcgcccacgacgagctggacttcaagctcgtttttggagaggacggagcacctgctccccccccccccggaagtagacccgctgacttggagcctgacgactgtgcttctatttacatcttcaacgtagacccccctccctccacccttacaacccccctgtgtttacctcatcacggactgccctcccactcgagcgtgttatcaccaagcttccagctgcagtcacacaagaattacgaggggacctgcgagatcccggagtcgaaatatagcccccttggtgggcccaaaccttttgagtgtccatcgatccaaatcacctctatcagtcctaattgccaccaagaactcgacgcacatgaagatgatctccaaattaacgatcctgagcgcgagttcctcgaacggccatccagggatcatctctacctaccattagaacccagctaccgagagtctagcctgagtccatctccagccagtagcatttcgagtcgctcctggttcagtgacgcatcctcatgcgagtcactgtcccatatatatgatgacgttgatagcgagctcaacgaggctgccgctagattcactctgggttctcctctcacatctcccggcgggtcccctggcggctgcccgggagaagagacttggcaccagcagtacggccttggtcattccctgtctcctcgccagtccccctgtcactcaccccggtcctccgtcacagacgagaattggttgtctcctcgccccgcttcaggcccgtccagtcggcctacaagcccatgtggtaaacggcggcactcgagcgcagaagtttgttatgctgggagtctgtctccacaccatagcccagtgccctcaccagggcactctcctagaggcagcgtaacagaagatacgtggctcaatgcgtccgtacacggcggatccggactggggccagctgtgttccctttccaatattgcgtcgagacagacattccgctgaagactcggaagacctcagaagaccaggccgctattctgccaggcaaactggaattgtgctccgatgatcaggggagcttatcacctgcaagagagacgagtattgatgatggcctaggtagccagtaccccctaaagaaggactcctgcggggatcagttcctgtctgtaccgagccccttcacttggtccaagcctaagcccggacatactcccatctttcgaacatcctcgttaccacccttggattggcccttacccgcccacttcggccagtgcgaactcaaaattgaagttcagccaaagacacatcacagggcccactacgagacagaggggtcgcggggggccgtgaaggcatctacaggaggacaccccgtggttaagctgctgggctataacgaaaagccgatcaacctgcaaatgttcattggaaccgccgacgatagatatctgagacctcacgcattctatcaggtccataggatcaccgggaaaacagtcgcgaccgctagccaggagattattattgcaagtacaaaagtgctggagatcccactgctgcctgaaaacaatatgtctgcctccatcgactgcgcaggcattctaaaattgcgaaactccgacatcgagctacgtaagggtgagacagacatcggtaggaagaataccagggtgcgcctggtattccgtgtgcacattcctcaaccatctggtaaggtcctgtccctccagatcgcttccattccagttgagtgctcacaacgctcagcccaagaacttccacacatagagaaatattccatcaattcctgctcagtgaacggaggacacgagatggtggtcacgggaagtaactttctgccggagtctaagatcattttcctggagaagggccaggacggcagacctcagtgggaagtggagggaaaaattatccgcgaaaaatgtcagggcgcccatattgtgttagaggttccaccctaccataaccccgcagtaacggccgctgttcaggtgcacttttacttatgtaacggcaaaaggaagaaatcgcagagccagcgttttacatacactcccgttctcatgaaacaggagcacagagaggaaattgacctgagtagcgtgccttcactgccagtccctcacccagctcagacccagcgcccttccagcgattccggctgttctcacgactccgtgctgtccggtcagaggtccctgatatgctccatcccccagacctacgcatcgatggtgacttcaagtcatctgccccagttgcagtgccgagacgaaagtgtgtctaaagagcagcacatgattccgtcgcccatagtgcaccagccatttcaggtgactcctaccccaccagtgggctccagttaccagccaatgcagacaaacgtagtgtataatggccccacttgcctgccgatcaatgctgcttctagtcaggagtttgacagtgtactcttccagcaagacgctactctgtcaggactcgttaacctcggatgccagcccctctcttccatcccatttcacagcagcaattccggttcaactggccacctgctcgctcacacgccccatagcgtgcataccctgcctcatctgcaaagtatgggttatcattgctcaaataccggccagcgctctctgtcatcgcccgtggctgaccagattaccggacaaccaagctcgcaactgcagcccatcacttatggaccttcccatagcggatcagctactaccgcctctcctgccgccagccaccccttggccagttcgcctctcagcggaccaccctccccgcagctccagcccatgccctaccagtcaccatcgagcgggactgcctctagtccttctccagccactcgtatgcatagtgggcagcacagcacacaagcccagtctacggggcaggggggtctgtctgcccccagtagtcttatttgccactccctctgtgatcctgcctcgtttccaccagacggcgcaacggtgagtatcaagccggagcctgaagacagagaacccaactttgctacgatcgggctccaggatatcactctagatgacgatcagtttatctcggatctggaacaccaaccctccggctccgcagaaaagtggcctaaccactcagttctgtcttgtcctgcccccttctggcggatctag

SEQ ID NO: 25366 - DNA, 3228 bp, Artificial Sequence
  Description of Artificial Sequence: Synthetic coding sequence
atgaccaccgccaactgcggcgcccacgacgagctggacttcaagctagtgttcggagaagacggggctccagcccctccgccaccaggctcccgccccgccgacttagagcccgacgactgtgcctcaatatatatcttcaatgtggatccacctcccagcaccttaacgacacctctgtgtctaccccatcatggcctccccagtcatagtagcgtgttatccccgtcattccagcttcagagccataagaattacgagggtacatgcgagatcccagaaagtaaatattctccccttggggggccgaaaccatttgagtgcccatccatccagatcacgagcattagtcccaattgtcaccaggagctggacgcacatgaggatgatctgcagatcaacgacccagaaagggagtttttggagaggccctctcgcgaccatctgtatctaccactggaacctagttacagagaaagtagtcttagcccctccccagctagcagcatctcctcccgcagctggttcagtgatgcatcctcttgtgaatccctttctcatatttatgacgacgtcgacagcgaattgaatgaggctgcagccagattcaccctcggatccccactgacaagcccgggaggatccccaggaggttgtccaggcgaagagacatggcaccagcaatacggcctgggccattctttatcgccgcgccagagcccctgtcactcccctagatctagtgttaccgatgagaattggctgtccccccgcccagcaagtgggccatcaagccgtccaacttccccatgcggtaaacgtcgccatagctccgccgaggtttgttacgcaggatccctgagtccacatcacagccctgttccgtcacccggtcactcccctcggggctcagtgaccgaagacacatggctaaatgcctctgtccacggcggcagcggcctggggccagccgtgtttcccttccagtactgtgttgaaactgacatccccctgaaaacccgcaaaactagtgaggaccaggccgctatcctgcccggtaagctcgagttgtgtagtgatgatcagggctctctctctcccgctagggaaacctcgattgacgatggcttggggagccaataccccctaaagaaagattcatgcggtgaccagttcctgagtgtgccatcacctttcacatggagtaagccaaagccaggccatactcctatttttcggacctcttccttgcctcctcttgactggccccttcccgcccactttggacagtgtgagctcaagatcgaagtgcagcccaaaacacaccatagagcccactatgaaacagagggatcacgcggcgctgtcaaggcttccaccggaggacatcccgtcgtaaagctcctgggctacaatgagaagccgatcaatctccagatgttcataggaactgctgacgacaggtacctccgcccccatgcattctatcaagtgcaccggattacgggaaagacagtcgccaccgcttcacaggagatcattatcgccagcacaaaggttttggaaattcctctgctcccagaaaacaatatgagcgcctctattgattgcgccgggatcctcaagctgaggaatagtgacattgaactcaggaaaggcgaaacggatataggtcggaagaacaccagggtgcgtttagtgtttagagtgcatatacctcagccttccggtaaggtgttgtccctgcaaattgcctccattccagtggagtgtagccagaggagcgcacaggagttgccccacatagagaagtactctataaactcctgttccgttaatggcggacacgagatggtcgtcaccggtagtaactttctgcccgagtctaaaattatcttcctcgagaaaggtcaggatgggcgcccacagtgggaagttgagggcaaaataatccgggagaagtgtcaaggagcacacattgttctggaagtgcccccataccataatccagcagtgacggctgcagtgcaggtgcacttttatctgtgtaatggcaaaaggaaaaaatcacaatcacagcgctttacctatacaccggtgttgatgaagcaagagcaccgggaggagatcgatctaagctccgtgccctccctccctgtgccacacccggctcagactcaacggccatcaagcgacagtgggtgcagtcacgattcagtgttgtccgggcaaaggtccttaatttgctcaataccccaaacgtacgcctctatggttacttcttcacacctcccccaactgcagtgcagagacgaatccgtgagcaaagagcagcacatgattcccagccctatcgtgcatcagcccttccaggtgacacctacgcctccagtgggaagctcttatcagccaatgcagacaaatgtggtctataacgggccaacttgtttgcccatcaatgctgcttcatcacaggagttcgacagcgtgctgtttcaacaggacgcgactttgtccggacttgtcaatctggggtgccagcccctctcttcaatcccattccacagttctaattctggaagtactggacacttattggctcatactccccatagcgtgcatacactgccacacctgcagagcatgggctaccactgctctaacacagggcaacggagcctgagttccccggtcgccgaccagatcacagggcagccgtcgtcacagctgcagccgatcacctacgggccctctcatagcggcagcgctacaacagctagccccgcggctagtcatcccctcgcctcatcaccactctctggtccacccagtccccagctacaaccaatgccttaccaatccccttcaagtggcactgccagttcccccagccctgccactcgcatgcactccggtcagcacagcacccaagcgcagagtaccggacaaggaggtctgagtgcacctagttcattgatatgccacagcctctgcgatcctgcaagctttccgcctgatggggccactgtctccatcaagcctgagcctgaagaccgggagccgaattttgccactatagggctgcaggacattacccttgatgacgtgaatgagatcatagggagagatatgagtcaaatatccgtttcgcagggcgccggcgtgtctcgccaggcacccctgccttcacccgaatcgctcgacctgggcagatccgacgggctatag

SEQ ID NO: 25367 - DNA, 3198 bp, Artificial Sequence
  Description of Artificial Sequence: Synthetic coding sequence
atgaccaccgccaactgcggcgcccacgacgagctggacttcaagctagtcttcggtgaagatggtgcaccagccccacccccacccgggtccaggcctgcggaccttgagcccgatgactgcgccagcatctacattttcaatgtagatccacctccgagtacactgaccaccccactgtgcttgccacaccatggcctaccctcgcacagttctgtcctgagtccctctttccaactgcagtctcacaagaattacgaggggacctgcgaaatcccagagtcgaaatacagtcccttgggaggtcctaagccgtttgaatgtcccagcattcagatcacatccatcagcccaaattgtcaccaggaactagatgcgcacgaagatgatctgcaaatcaacgaccccgagcgtgaatttctggagcggccctccagagatcatctgtacctgcccttagagccttcttatcgcgaatcatccctgtctccatcacctgcttcatcaatctcttctaggagctggttttccgatgcctcctcttgcgagagtctcagtcatatttatgatgacgtggactccgagctgaacgaagcggccgcaagatttactctgggctccccattaacgtcccccggagggtctcccgggggctgccctggggaggaaacctggcaccagcagtacggcctgggacactctctgtcccctcgccaatccccctgccattctcctagaagtagcgtgacagacgagaactggctgtctccaaggcccgcttcaggaccaagcagcagacctacttccccctgtggcaaacgcaggcatagtagcgccgaagtgtgctatgctgggtcactttcacctcaccattcaccagtgccttccccagggcactccccgaggggttcagtcaccgaggacacctggctcaatgccagcgtgcacgggggctctggcctgggccccgccgtatttccctttcaatattgtgttgagacagacatacctctgaaaacccgaaagacctcagaagatcaggcagccattctccccgggaaactggagctgtgctccgacgatcagggcagtttgagtcctgcccgcgagacctcaatcgacgacggcctggggtcccaatatccacttaagaaggattcttgcggggatcagttcttgtctgtgccgagcccttttacgtggtccaagccaaaacctggccacactcccatttttcggacctcttccctgcccccactggattggcctctgccggcacattttggacaatgcgagctgaaaatagaggtacagcccaagactcaccacagggcccattatgaaacggagggaagtagaggtgctgttaaggctagcacaggggggcaccctgttgtgaaactgctgggctataatgagaaacccatcaatctgcaaatgtttattgggactgctgacgacagatatttgagaccacatgcattctatcaggtccatcgcatcaccggcaagaccgtcgctacggcttctcaagaaataatcattgcttcaaccaaggtgctcgaaatccctcttctgcctgagaacaacatgtctgcctcaatcgactgcgcagggattctgaagctgcgcaactcagatattgaactcagaaaaggagagaccgatatcggtcgcaagaacaccagagtgcgtcttgtattccgggtacacatacctcagcctagtggcaaagttctatcccttcagattgctagtatcccagtggagtgtagccagcgtagcgcccaagaactgccccatattgagaagtacagtataaactcctgcagtgttaacgggggccatgagatggttgttactggttctaatttcttaccggagtcaaagatcatcttccttgagaagggccaagacggtcgccctcagtgggaagtggagggaaaaatcatccgcgagaagtgccagggggcccacatcgttctggaggtcccgccatatcataatcccgccgtgaccgctgcagttcaagtccatttctatctttgtaacggaaagaggaagaaaagtcagtcccagaggttcacgtacacacctgtactgatgaaacaggaacatcgggaagagatcgatctgtccagcgtgccctctctacccgttccccacccagcccagactcagagaccttccagcgatagcggctgctcccacgactcagtactctccggtcaacgatcgctgatttgttcaattcctcaaacctacgcctccatggttacgtcatcccacctcccacagctgcagtgtcgtgacgaaagcgtatccaaggaacagcacatgatcccctctcctatagtgcaccagcctttccaggttacccccactcctccagtgggatcctcataccagccaatgcagaccaacgttgtatataatgggcccacatgtctccccattaatgccgcttcatctcaggagttcgatagtgtgctgttccagcaggacgctactctgagcggactcgtgaatttgggctgtcagccgctttcctctatcccattccattcctcaaactctggctccaccggtcacctgctggctcacacacctcacagcgtccacacactgcctcacctgcagtctatgggctatcattgtagtaacacaggacagagatccttgtccagcccggtggcggaccaaatcactggccaaccttcgtcacagctgcagcctatcacttacggcccttctcattctggcagcgccaccactgcaagtcccgccgcttctcaccccttagcttccagtcccctttccggccccccttcaccccagctccaaccaatgccctatcaatcacctagcagtggtactgcctccagcccttcccccgcgactcgaatgcactctgggcaacattctacccaggcccagagcaccggccaaggcgggttgtctgctccttccagtttgatctgtcactcactatgcgaccccgcctcattcccaccagatggggcgaccgtatccatcaaacctgagcctgaggaccgtgagcccaatttcgcaactatcggattgcaggatattaccctggatgatgatctgtttacttcaaataatttcgatctcctgcaattaaggcctacattttggccagttccagccggccggtacctacgaaacctcgagtag

SEQ ID NO: 25368 - DNA, 1770 bp, Artificial Sequence
  Description of Artificial Sequence: Synthetic coding sequence
atgttcatcggcaccgccgacgaccggtacctgcggccccacgccttctatcaggtccaccggatcacaggcaagaccgttgctacagcctctcaagaaattatcattgcttcgacgaaagtgttagaaattcctcttctgcctgagaataacatgagcgcaagcattgactgtgctggcatcctgaagctgcgcaactcagacatcgaattacgcaagggggaaacagatatcggacgtaaaaatactcgagtccgcctggtctttagggtgcatatccctcagccctccggcaaggtgcttagcttacaaattgcatcaatcccagtcgaatgctcccagaggtccgctcaagagctcccacatattgagaaatacagcatcaactcttgcagtgttaatgggggtcacgaaatggtcgtaacgggatcaaattttttaccagagtccaaaatcatttttttagagaagggtcaggacgggagacctcagtgggaagtggaaggcaagattattagagagaaatgccagggcgctcacatagtcctcgaggtgcctccgtatcacaatccagccgtgacagccgcagtacaagttcacttttacctgtgtaacggtaagcggaaaaagagccagtcacagcgcttcacctataccccagtcctcatgaagcaggaacaccgcgaggagatcgatttgtcttcggtgccctctctgcctgttcctcaccccgcccagactcagaggcccagctccgactccggctgctcccatgattcggtactgtccgggcaacgttctctgatatgttcaattccacagacgtacgccagtatggttacttccagccatctgcctcagctgcagtgccgggatgaatccgtctccaaggagcagcacatgattcctagccctattgttcatcaaccattccaagtgacccctacgccccctgttgggtcctcctaccaacccatgcaaacgaacgtggtgtacaatgggccgacatgcctgcccatcaatgccgcttctagtcaggagttcgactccgtgttgttccaacaggacgccacgcttagtggtctagttaatctgggctgtcagccactgagctccattccatttcactcttcgaacagcggcagcaccggccacctgctggctcacactccccattctgttcatacgttaccccacctgcagagtatggggtaccattgtagcaacaccggccaacggagtctgtcttcccccgtggccgaccagattaccgggcaacctagctcacagcttcagcccatcacatatgggccatcccattccgggtctgctactacagcctctccagccgcatctcaccctctggcttccagtccgctatccgggccaccatctcctcagttacagccaatgccttatcagagtcccagctcaggcactgcttcctcaccatctcccgccacacggatgcattccggacagcatagcacccaggcccagtccactggacagggcgggctctcggccccaagtagtctcatttgtcactcactatgtgaccctgcttcgttcccaccggatggcgcgacagtatctattaaacccgagccagaagaccgcgaacccaacttcgcgaccattggtttgcaggacattactctggacgacgatcagtttatttctgatcttgagcatcagccatcagggtcagccgagaaatggcccaaccactcagtgctctcttgccctgctcctttctggagaatctag

SEQ ID NO: 25369 - DNA, 2709 bp, Artificial Sequence
  Description of Artificial Sequence: Synthetic coding sequence
atgggcgccgccagctgcgaggacgaggagctggagttcaagctggtgtttggcgaagaaaaagaagcacctcccctcggggctggtggcttgggggaggaactcgacagcgaggacgcccccccctgttgtcggctggctctgggggaaccaccgccttatggagctgctcctatcggcatccctagaccacctccgccacggccgggaatgcactccccaccacctcgacctgccccctcgcccgggacctgggaatcacaacccgcaaggtctgtacgtctgggtggacccggggggggggccgggggcgcaggcggcggtcgcgtactcgagtgtccaagtatccggataacgtctatttccccgacccctgaacctccagcagccctggaggacaacccagatgcttggggtgatggcagcccgcgagactatccgccacctgaaggattcggaggctatagggaagctgggggtcagggcggaggcgcattcttcagtccatcaccgggatcgtcgtccctctcttcatggtcctttttttccgacgcttctgatgaggcggctttgtacgccgcttgtgacgaagtggaaagtgagctcaacgaagccgcgtcccggttcgggcttggatcgcccctgccgtcaccacgggcttcgccccggccatggacacctgaagatccttggtcactgtacggcccctctccaggcgggcgaggccccgaagattcctggctgctcctgtccgctcctggcccgactccagcctcacctaggccagcctcgccctgcggcaagaggcgctacagttctagtggtacaccatcatctgcctcccccgcactgagccgacgggggtcgttaggtgaggaaggcagtgaaccgccgcctcccccaccactaccgctagctcgcgatcccggctctcctgggccattcgattacgtaggcgctccgcctgcagagtccattcctcagaagacccgacggaccagttcagaacaagccgtagctttaccacgttcagaggaaccagctagctgcaatggcaagctgcctctgggcgcagaagaaagcgtggcccctccaggcggctctcgtaaggaagtggccgggatggactatctggctgttccttcccctctggcctggagcaaggcaagaatcggagggcactctccaatcttccgcacttctgcactgccccccctggactggcccctgccatctcaatatgagcagcttgaattgaggattgaagtacaaccacgggcacaccacagagcgcattatgagactgaagggtcaaggggcgctgtaaaggccgctcccggcgggcacccagttgtgaaacttttagggtattcagagaagccactaacacttcagatgttcatagggactgccgacgaacgaaacctgcggccacacgcattctaccaggttcatcggatcaccgggaaaatggtcgctactgcatcttacgaggctgtcgtgtcaggcacaaaggtgctggagatgactctgctgccagagaataacatggctgccaatattgactgtgccggcatcctgaagttgcggaatagtgatatcgagctaagaaagggcgaaacggacatagggcggaagaacacaagggtgaggttggtgtttcgggtgcacgttccacaaggtggaggaaaggttgtcagtgttcaggcggcctcagtccctatcgaatgctctcagcgatccgcacaggagctgccccaagtcgaagcctactctccctcagcttgtagcgtgcgagggggggaagagcttgtgcttactggatccaattttttgccagactccaaagttgttttcatcgagcgtggaccagatggcaagctgcagtgggaagaagaggcaaccgtcaataggctgcaatccaacgaggtgactcttactctaactgtgccggaatatagcaacaagagggtgtctaggccagtgcaggtctatttttacgtttcaaatgggcgtcgcaaacggtctccaacccaatcctttcgctttctgccagtcatctgcaaggaggaaccgcttcctgatagctctcttagaggattcccatcagcaagtgctacaccgtttggaaccgacatggacttcagtccacctcggccaccctacccttcgtacccccacgaggaccctgcctgcgagacaccttacttgtctgaggggttcggctatggcatgcccccactgtatccccaaacaggacctccaccatcataccgccccggactccgcatgttccctgagaccaggggaactacgggctgcgcacagccacccgccgtgtcctttctcccccgccccttcccaagcgatccttacgggggacgagggagctcatttagtctagggctgccatttagtccaccagcccctttcagaccgccaccactcccggccagccctcccctcgaaggacctttcccctcccagtctgacgtgcaccccctgccagcagagggctataataaggtagggcctggatacggccccggtgagggtgcacctgaacaagagaagtctaggggcggttattccagtgggttcagagattccgtgcctatccaggggataaccctcgaagaggtgagcgagattataggccgcgatctgagcggttttcccgccccgccaggagaagagcccccggcttag

SEQ ID NO: 25370 - DNA, 2895 bp, Artificial Sequence
  Description of Artificial Sequence: Synthetic coding sequence
atgatcaccaccctgcccagcctgctgcccgccagcctggccagcatctcccaccgggtgacaaacttgccatccaacagcctgtcacataaccccggactcagcaagcccgactttccgggtaatagctcccccggtctcccaagttccagctccccaggtagggatctcggagcccctgctggttcaatgggagcagcgagctgcgaagatgaagagctggagtttaaactcgtgttcggagaagagaaagaggcaccccctctaggggcgggggggttgggcgaagagctcgattcagaggatgctccgccgtgttgccggttagccttgggcgagcccccgccctatggggctgcgcccatcggaatcccacggccaccccctcctcgacccggcatgcactccccacccccacgccctgccccctcccctggcacctgggaaagccagccagcgcgatcagtgagactcgggggcccaggcgggggggccggaggggccggcggcggacgcgtgctcgagtgtcccagtatccgcatcacaagcatatccccaactcctgagccaccagccgccctcgaggacaatcccgacgcgtggggagatgggagcccgcgcgactaccctcctccggaggggtttggcgggtaccgggaggctggaggccagggtggcggcgctttctttagtccctcaccgggttccagcagtctgtcctcatggtccttcttttctgatgctagcgacgaggccgctctgtacgccgcctgcgacgaagtcgagagcgagttaaatgaggccgcaagtagattcggccttgggagcccactcccctcaccacgggcatctcccagaccatggacgcccgaggacccatggagcttgtacgggccctcacctggtgggcggggcccggaagattcctggctgctgcttagcgcccccggtcccacccctgcgtcccccaggcccgcatctccttgcggaaagcgtcggtacagttcatcaggaaccccaagcagcgcgtctccagctctgtcacgcagaggttcactgggggaggaaggcagtgagcccccaccccctcccccacttcctttagcaagagaccctgggtcacccggcccatttgactacgtcggggcgcctccagcggagtctattcctcagaaaacaaggcgcaccagctccgagcaggctgttgcactgccccgctccgaagagccagcctcctgcaacggtaaactgcccctaggggccgaggaatccgtggctccacctggcgggagtaggaaggaggttgctgggatggactacctggcagtcccttctcccctggcctggagtaaggccagaatcggcggtcacagtcccatctttagaacttctgccttaccccccttagactggccactgccatcccaatatgagcagctggaactgagaatagaagtgcagcctcgggcccatcacagggcacactatgaaaccgagggcagccgcggagccgtaaaagcggctccggggggtcatcccgtcgttaagcttctaggctactcagagaaaccactgaccctgcaaatgtttattggcaccgccgacgaaaggaaccttagacctcacgccttctaccaagtccaccgcatcaccggcaaaatggtggccaccgcttcttatgaagcagttgtgtccggaactaaggtcctggaaatgactctcttgccagagaataatatggcggcaaacatcgactgtgctggtatcctgaaactccggaacagtgacatcgaattgcggaagggggagacggacattgggaggaagaatacacgcgtacgactggtgtttcgtgtgcacgtgccacagggcgggggcaaggttgttagtgtgcaagcagcctccgtgcctattgagtgctcccagcgatccgcccaggagctgccacaggtagaggcatattctccctcagcgtgctccgtgcgaggtggtgaagagcttgtccttaccggaagtaacttcctcccggatagtaaggttgtgttcatagaacggggccccgacgggaaattacagtgggaagaggaggccactgtcaacaggttacaaagcaacgaagtcaccctgaccctgacagtgcccgaatactctaacaagcgcgtctctagaccagtgcaggtgtacttctacgtatccaacggaaggaggaagcgaagcccaacacagtcttttcgcttcctccctgtgatctgcaaagaagaaccactccctgactcttcgcttcgggggtttccttctgcttctgccactccttttggtaccgacatggacttttccccgccacgcccaccctatccaagctacccacatgaagacccagcttgcgaaaccccctatctcagcgagggatttggttatggcatgccccccctttaccctcagacagggccacctccttcctataggcctggcctacgcatgtttcctgagacgaggggcaccactggatgtgcccagccaccggctgtgtctttcttgccaaggccatttccatccgatccctacggcggccgagggagcagctttagcctcggtctgccctttagtccacctgccccattccggcctcctcccttgcccgcatcaccacctttagaggggcctttcccatctcagagtgatgttcacccactccccgccgaggggtacaataaggtggggcctggctacggacctggagaaggtgcccccgagcaggaaaagagcagaggtggatattcaagtggattcagagattctgtcccaattcaaggaatcactctggaagagggagggtgtggaaccggaggttgtgagtgcgagtgtgtccaagagatcgcactgcacgtgtgctag

SEQ ID NO: 25371 - DNA, 2670 bp, Artificial Sequence
  Description of Artificial Sequence: Synthetic coding sequence
atgcccgccagcatcagcagcatcttccccggccccaccctgctgctcagctgtgggagcgaggaactcgactctgaagatgcacccccctgttgccgcctggccctaggggagccacccccctatggcgccgcccctataggcatacctcgacctcccccccctcgacccgggatgcatagtcctccgccccgcccagcacccagtccaggcacatgggagtcacagcccgcaaggtctgtgcggctgggcggaccaggcgggggggcgggaggggctgggggcggacgcgtcctcgaatgcccaagcattcgcattacgagcatctctcccacgcctgaaccaccagcagcccttgaggacaatccggatgcatggggagacggaagcccaagagattatcctccccctgaaggcttcgggggctacagagaagcagggggacaaggcggtggggcctttttcagccctagtcccggctccagcagtctaagttcctggtcttttttcagcgatgccagcgacgaggccgcactgtatgccgcatgtgatgaggttgagagcgagcttaacgaagcggcatctcgcttcgggctcgggtccccgctccctagtccccgcgcctctccccggccgtggaccccagaagacccatggtcactttacggacccagtcctggcggacggggtcctgaagacagttggttactgctgtcggcacccggtcctaccccagcttctcccagacccgcgtctccctgtggcaaacgacgttattcaagtagtgggacaccttccagtgcttccccagcactgtcccgcagaggcagtctgggcgaggagggcagcgagccaccgccaccccctcctctgccgctggcacgtgaccctggttcaccaggccctttcgactacgtcggagcgccgcctgctgaatccattcctcagaaaactaggcgtacctcatcggagcaagccgtggcactcccgagatctgaggaaccagcctcctgcaacggaaaactgcctctaggcgccgaagagtcggtggctcctcctgggggcagcaggaaggaggtggccggaatggactatttagccgtgccttctccactggcatggtccaaggcgcggatagggggccattctccaatattcaggacgtctgccttaccgccgctggattggcccctccctagccagtacgaacaactggagctgcgcatagaagtccaaccaagagctcatcaccgtgcacactacgaaacggagggctcaaggggggcagtgaaagccgcccccggcggacatcctgtcgtcaaactgctgggatattcagaaaagcccctgacgctgcagatgttcatcggtaccgccgacgaacgcaatcttcggccgcacgcgttctaccaggtgcaccggatcactggcaagatggttgcgaccgccagctacgaggccgtggtttcgggaacgaaggtattggaaatgactttgctccctgagaataatatggcagccaatatcgactgcgctggaatccttaagctgcggaattcggacatagaacttcgaaagggagaaacagatataggtcgcaagaatactagagtccgcctggtttttcgggtgcatgtgcctcagggaggcggtaaagtagtgtctgttcaggcagctagcgtgccaatcgagtgttcacagcgttcagcccaggaactcccacaggttgaagcttacagcccctcggcctgctccgtgcgagggggtgaagagctggttttgactggatccaattttctgccagacagtaaagtggttttcattgagcgagggcctgatggcaagctgcaatgggaggaggaagccacagtcaaccgcttgcagtccaatgaagtcaccttaaccctaacggtacccgagtattccaacaagagagtgagcagaccggtacaggtatacttttacgttagtaacggtcgtaggaaaaggagccccacccaatctttcagatttctccccgtgatttgtaaggaggaacccctgccagactctagtctaagaggatttccatcagcaagcgccacaccattcggcacggacatggacttcagcccgccaagacccccctacccttcttatccccatgaggaccccgcttgtgaaaccccctacttgagcgagggcttcggctatggtatgcctcccttatacccacagaccggcccccctcccagttaccgccccggactcaggatgttccccgagacccgcggcaccacggggtgtgcccagccgcctgcagtgtcctttttgcccaggccttttcccagcgacccttacggaggcagagggtcatccttcagtctcggactgccgttttccccccctgcacccttccggcctccaccacttccagccagcccaccactggaggggcctttcccctctcaatctgatgttcaccctctgcctgcagagggctacaacaaggtgggccctggctacggccctggcgaaggtgcccccgaacaagaaaaaagccgaggcggctatagctctggtttcagagattcggtacccatccagggcatcactctggaagagggcggctgtggcacagggggatgcgaatgcgagtgcgtacaggagatagccctgcatgtgtgttag

SEQ ID NO: 25372 - DNA, 2745 bp, Artificial Sequence
  Description of Artificial Sequence: Synthetic coding sequence
atgctgagcggccgggacctgggcgcccccgccggcagcatgggcgctgcgagttgcgaggacgaggaactggaattcaagttagtgttcggcgaggagaaagaggctcccccactgggtgctgggggactcggcgaagaactagattcggaggacgccccgccctgttgcagactggcactgggcgagccgcccccttatggagccgccccaatcggtataccgcgcccaccacctccccgaccaggaatgcatagccccccccccagacctgccccctctccggggacttgggaatcccagccggctcggagcgtgcggcttggaggccctggaggtggcgctggcggcgccgggggagggcgggtattggaatgtccatctatccgcattacctctataagtccaacgcctgagccccccgccgcattagaagataacccagatgcctggggcgacggtagtccaagggattatcctccgcccgagggattcggcgggtaccgcgaggcaggaggacagggggggggagcctttttttcaccatccccaggctcctcttcgctctctagctggagtttctttagtgacgcgtctgacgaggctgcactgtacgctgcttgcgatgaagtcgaaagtgaacttaatgaggccgcgagtaggttcggactgggatctcccttgccaagccctcgggctagcccccgaccttggacacctgaggatccatggtccctctacggaccaagcccagggggcagaggccccgaagacagctggttgctgttgagcgcgcccggccctacacctgccagtcctcgaccagcttccccctgcggcaaacggcggtatagcagcagcggcaccccatccagtgcttctcccgctctcagccgtcgtgggagcctgggcgaggagggctccgaaccacccccgcccccaccacttcctctagcacgggatcctgggtcccccgggccgttcgattatgtgggggcccctcctgcagagtcgataccacagaagactcgccgtacctcttcagaacaggctgtggccctgcctaggtccgaggaacccgcgtcttgtaatggtaagctacccttgggcgcagaggaatctgttgcacccccgggggggagccggaaggaggtcgctggcatggattacctggccgtccccagcccactggcttggtccaaagccaggatcggaggacacagcccaattttccggacatccgccctgcccccattggactggccattaccgtcccagtatgagcaactcgagctgcgaattgaagtccaaccacgagcgcaccacagggcgcactacgaaaccgagggttccaggggcgccgttaaggccgcccccggtggtcatccagttgtgaagcttctcggatattccgaaaaaccgctgacacttcagatgtttattggaactgccgatgagcgtaatctcaggccccacgcattctaccaggtccaccgaatcacaggcaagatggtggctacagcctcttatgaagccgttgtgtccggcacaaaggtcctggagatgaccttgctaccggagaataacatggccgccaatatcgactgtgccggcattctaaagttaaggaatagtgacattgaactgcgtaagggggaaacggatattggccgcaagaatacccgcgtcaggctcgtgtttcgggtccatgtgcctcagggtggaggaaaggtggtttccgtgcaggcggcctccgtgccgatcgagtgcagtcaacggtccgcgcaggagctcccccaggtagaggcatactctccctccgcatgttccgttcgagggggcgaagagctggttttaacgggtagtaacttcctgcctgacagtaaagtcgtttttatcgaacgaggacccgatgggaagcttcagtgggaggaggaggctactgtcaataggctgcagtcaaatgaggtcaccttaacgttgactgtacccgaatacagcaacaagcgtgttagcaggccagttcaggtctacttttacgtgagcaatgggcggaggaagcgcagccctacacagtcctttcgtttcttaccggttatttgcaaagaagaaccgttgcctgattcctcccttagaggctttccgtccgcctcagccacacctttcggaaccgacatggatttcagcccccctagacctccttacccttcctacccgcacgaagatccggcatgcgagactccgtacctgagtgaggggtttggatacggaatgccccctctttatccccagacgggaccccctccatcgtatagacctggcttgcgaatgttcccggagactaggggcaccacaggatgtgctcaaccacctgccgtctcatttcttcctaggccttttccaagcgacccatatggtggcagaggctctagcttttccctggggctgccgttttccccccctgccccttttcgccctccacccctccccgccagtcccccacttgaggggccttttccctcacagagcgacgtccacccgttgcccgcagaggggtacaacaaagtgggtcccggttacggaccgggagagggtgcccccgaacaggaaaaatcccgagggggatacagttccggctttagagactctgtgccaatccagggaatcaccctggaggaagggggctgcggaaccggggggtgcgaatgcgaatgcgtccaggagatcgcactgcatgtgtgctag

SEQ ID NO: 25373 - DNA, 2802 bp, Artificial Sequence
  Description of Artificial Sequence: Synthetic coding sequence
atggccgacggcggcgccgacagcgccgcccagcggctgcccgaggggcctggacgagtggccccaggaagggatcttggtgcccctgccggttcgatgggagccgcttcctgcgaagatgaagagctagagtttaagttggtgttcggcgaggagaaggaagcccctcctctcggagcagggggacttggggaggaattagacagcgaagacgcccctccttgttgtagactagccctgggcgaacctcctccttacggagctgccccaatagggattccgaggccccctccccctagacccgggatgcactcaccacctccccgacccgctccatcacctggtacatgggaatcccagcctgcccgatcagttcgcctgggtgggcctggtggcggtgcgggcggggcggggggaggcagggtgttggaatgccctagcatcagaatcacatccatctctcctacgcccgagccacccgcagcgttggaagataatccagatgcatggggtgatgggtctcccagggattacccaccacctgaaggattcggaggttatcgggaggctgggggtcaaggcggtggggccttcttcagcccctctccggggtcgtcttcactgtcatcctggtcgttcttctccgacgcttccgacgaggctgctctctatgccgcgtgcgatgaggtggaaagtgagcttaacgaggcagctagcaggttcggacttggctcccctcttccctcccctagagcctcgccacggccctggacccctgaggatccttggtctctgtacggcccctctcccggcggacggggacctgaggattcctggctactgctttccgcacctggccctacacccgcatctcctcgacctgcttccccttgtggaaagagacgatattcttcctctggaactccaagttccgctagtcccgccctctcaagaaggggctctcttggggaagaaggttccgaaccaccccctcctccccccctcccactggcccgggaccctggctctcctggacccttcgattatgtaggcgcccccccggctgagtcaataccacaaaagacgaggagaacgtcttcggagcaggcagtggcgctgcctaggtctgaggaacccgcctcctgcaatggtaaattgccactcggagccgaggagagcgtagcacccccgggcggatctcgaaaagaagtcgccgggatggattacctcgcagttcccagcccgcttgcttggtcaaaagcgcgtattggtggccattctcctattttccgaacctctgccctcccaccccttgattggcccctaccgagccagtacgagcagctcgagctgcgcatcgaagttcagcctagagcccaccacagggctcattatgagaccgagggatctcgcggggctgtgaaagccgctccaggcggccaccctgttgttaagctgctgggctatagcgagaagcctcttacacttcagatgttcattggaactgctgatgagaggaacctgaggccccacgccttttatcaggttcaccgcatcactggtaagatggtggctaccgcttcctatgaagctgtggtgtccgggacaaaagtattagaaatgaccttgctgcctgagaataacatggcggccaatatcgattgcgccgggatcttaaagttacgtaacagcgacatcgagctgcggaagggagaaacagacattggccgcaaaaacacccgggtacgtctggtgtttagagttcacgtgccccaaggcggcgggaaggtggtgtctgtgcaggccgcctctgtgccaatcgagtgcagccagagaagcgcacaagagctcccccaggtagaggcttattctcctagtgcctgcagcgttcgtggcggcgaagaactggttctcactgggagcaacttcttaccagatagcaaggtggtgttcatcgagcgagggcctgacggtaaactccagtgggaggaagaggccacagtcaatagactgcagtctaacgaagtgactttaacactcacggtccctgagtacagcaacaagagagtgtctaggcccgtgcaggtgtatttctatgtgtctaacgggcggagaaagcggtctcctacccagagcttccggttcctgcctgtgatttgcaaggaagaaccccttcctgacagttctctccggggttttccctccgcctctgcgaccccctttggcactgacatggattttagcccgccccgaccgccctatcctagctacccacacgaagaccctgcgtgcgaaaccccatacctctcagaggggttcgggtacgggatgcccccactttatcctcagactggaccacccccttcctaccgacccggtctgcggatgttccccgaaacacgaggaaccaccggctgtgcccagcctcccgccgttagtttcctgcctcgtcctttcccgtctgacccttacggtggaaggggatcgagcttttctcttggcctcccattctctcccccagcgccatttaggccaccccccttaccagcatctcctcccctggagggcccattccccagtcagtccgacgtccaccccctgcccgccgaggggtacaacaaggtgggccctggctatggacccggtgaaggtgcaccagagcaggaaaagagtcgcggagggtactccagcggcttcagggacagtgttccaattcagggcataaccctggaggaaggagggtgcggcacaggagggtgtgagtgcgaatgcgtgcaggagattgctctccatgtgtgctag

SEQ ID NO: 25374 - DNA, 2481 bp, Artificial Sequence
  Description of Artificial Sequence: Synthetic coding sequence
atggccgacggcggcgccgacagcgccgcccagcggctgcccgaggggccaggacgagtggcacctggcagggacctgggcgcccctgccggctccatgggggctgccagttgcgaagatgaggagcttgagtttaaacttgtcttcggcgaagaaaaagaggctcctcctttgggagcaggaggcctcggtgaagaactggactcggaagatgccccgccatgttgccgtttggcactcggggagcctcctccatatggagccgcaccaatcggcatcccacgtccccctccccctcggccgggcatgcactctccacctccccgccccgctccgtctcccggtacctgggagagtcaacccgccagaagcgtgcggctaggcgggccagggggcggagctgggggcgcgggaggcggcagggtgctggagtgtccttcaatacggattacctccatctcccccacaccggagccacctgcagcattagaggacaatcccgatgcttggggtgacggttccccaagggattaccctcctcccgaagggtttggcggatatagggaagccggtggccagggagggggtgcattcttttccccttcacctggctcatcttcactctcatcttggagtttcttttctgacgcatctgacgaggctgcactctatgccgcatgtgacgaagtagagtctgaactcaacgaggcagcgtcccggtttggcctgggcagcccgcttccctcgccgagggcaagcccccgtccttggactcccgaggatccttggagtctgtacggcccttctcctggggggcggggccccgaagatagctggttgctgctttcagcccctgggcccacacctgcgtctccaaggcccgcaagcccctgcggcaaacgtaggtatagcagttcgggtacgcctagctcagcctctcccgccctcagcaggcgcggatccttgggggaggagggatctgagcctccaccccctcccccgttaccccttgctcgagatccagggtccccgggtccttttgattacgtgggggccccccctgccgagagtatccctcagaaaacgcgaaggacgagttctgaacaggccgtggccctgcccaggagcgaggaaccagcgagttgcaacggtaaacttcccttgggcgcggaggagtcagtcgccccccccggtggatcccgcaaagaagttgctggcatggactatctggcggtgccctccccgttggcctggtccaaagccaggattggcggtcactctcctatttttcgtacaagcgccctgcctcccctagactggccattgcctagccagtacgagcagcttgagcttcgcatcgaggtccagcctagggctcaccaccgagcacactacgagaccgagggctctcggggagcagtcaaagcagcacccggaggccaccccgtggtgaagctgctgggatattcagagaagccgctgactctgcaaatgttcatcggcaccgctgacgaacgcaaccttaggccccacgccttttatcaggtgcacaggattactggtaaaatggtggcaacggctagctacgaagccgtggtctccggcacaaaggtcctggagatgacccttctgcccgagaataacatggctgctaatatcgactgcgcaggaatactaaaattacggaactcggacatcgagctccgtaaaggcgaaacagatatcggacggaaaaatacgcgggtacggctggtatttcgagtgcacgtgccacaaggcggggggaaggtggtgtctgtgcaggctgcgtctgttccaattgagtgttcacagcggtctgcccaagagctgccccaagtggaggcctacagtccttctgcctgctctgtcagagggggggaagagctggtgctcacagggtcaaactttctgcctgactccaaggtggtgttcatagagcggggtcctgatgggaagctccagtgggaggaagaagccacagtcaacagactgcagtccaatgaagtaacgctgactctgacggtgccagagtactctaataagagggtctctagaccagtgcaggtctatttttatgtctcaaatggacggcgtaagcgctcaccaacccagagcttccggtttttacccgtgatatgcaaggaggagcctctcccagatagtagtctgaggggattcccctcagcttcagcgactcccttcggcaccgacatggatttctccccaccccggccgccctacccttcatacccccatgaggatcctgcatgcgagacgccctacctgtccgaaggctttggatacggaatgcctccgctgtacccccagacaggccccccgcctagctaccgacctggcctgagaatgtttccggaaaccagaggcacaaccgtgtctgagataataggtagggacctgagcggttttccagcgcctcctggagaagagccgccagcctag

SEQ ID NO: 25375 - DNA, 2706 bp, Artificial Sequence
  Description of Artificial Sequence: Synthetic coding sequence
atgggcgccgccagctgcgaggacgaggagctggagttcaagctggtgttcggggaggagaaggaggccccccccctcggtgccggtggcttaggagaagaattggacagtgaggatgcacctccttgttgccggttggccttaggcgagcctcctccctacggggctgcaccaattggtattccaaggcctccaccacctaggcctgggatgcatagcccccccccgagaccagcccctagccccggaacctgggaatcccaaccggccagatctgtgagactaggcggtcctggtggaggagcaggcggtgccggcggaggtcgggtcctcgagtgcccgtcgattcggattacaagtatttctccgacgcctgaaccacccgccgccctggaagacaacccagatgcctggggagatggttcacccagggactatccaccccccgaaggttttggcggctatcgtgaagccgggggtcagggtggcggcgcatttttttccccatcgccgggcagttccagcctctcaagctggtctttcttctctgacgcttcagacgaggccgcgctatacgccgcatgtgatgaggttgagagcgagcttaatgaggccgccagccggttcggtctgggatcaccattgcccagcccccgcgccagtccaagaccgtggacacctgaagatccatggtccctgtatggcccaagccccggtggccgcgggccagaagattcttggttactcctcagtgcacccggccctactcctgcctcccccaggcccgcaagcccttgtggcaagaggagatactcatcttctggaacaccaagcagtgcatccccagccctttcaaggcgcgggtcattgggcgaagagggcagtgagcctccaccgcctcctccactcccactggccagagaccccggctcgcccggccccttcgactacgttggagcgccccctgccgaatcaatccctcagaagacccgtaggactagctccgagcaggccgtggccctcccccgatccgaggaacctgcctcctgtaacggcaagctcccattaggcgctgaggaatctgtcgccccccccggcggcagccgcaaggaggtcgctggcatggattatttggcagtccctagcccgctcgcctggtcaaaggctagaattggtggccactcacccatctttaggacttcagccctgcccccgctggattggcctctgccctcccagtacgaacagctggagctgaggatcgaggttcaaccgagggctcaccaccgagctcattacgagacggaaggctcaaggggcgccgtcaaggctgccccaggaggccatccggtggtgaagctccttggctacagcgagaagcccctgaccctgcaaatgttcattggcacagccgatgagaggaatttgcgaccccacgccttctaccaggtgcacagaattacaggcaaaatggttgccaccgctagttatgaagcagtggtcagcggaactaaagtgctggaaatgacactgctccctgaaaataacatggctgccaatatcgactgtgccggcatcctgaagctgagaaattccgacatagaactgcggaagggtgaaacagacatcggccgcaaaaatactcgtgtgcggcttgtctttcgagtgcacgtcccacaggggggggggaaggttgtgagtgttcaggccgcctctgtgcccatcgagtgttcacagcgcagcgcgcaggaacttccacaagttgaggcctatagtccttctgcatgctcggttcgtggcggagaagaacttgttctcactggaagtaacttcctcccggactctaaggtggtgtttattgagaggggcccagatggtaaattgcaatgggaggaggaggccacagtgaatcgcctgcaaagtaacgaggtgacactcacgcttaccgtgcccgaatacagcaacaaaagagtgagcagaccagtccaggtgtacttctacgtgtctaacggtagacggaagagaagtccaacacagagcttcagatttcttcctgtgatttgcaaggaggagccgctcccagatagctcactgcggggcttcccttcagcaagtgcgactcccttcggcaccgatatggacttttccccacctaggccaccatatcccagctacccacacgaagaccctgcatgcgaaactccctatctgtcagaggggttcggctatggaatgccacctctgtacccacagactggaccgccgccctcgtataggcccggattgagaatgtttcccgaaaccagagggacaacggggtgcgctcaaccacctgctgtgtccttcctaccccggccttttcctagcgacccatacggtgggagaggatcttctttctctttgggcctccctttctctccgccggccccctttaggccacccccgctacctgcatctcctcctctcgaggggccatttcctagccagtcagacgtgcaccctcttcctgctgaaggttacaacaaggtcgggcctggctatggccccggagaaggggccccggagcaggaaaaatcccggggcggttacagctctgggttcagggactccgtgccaattcaaggcataactttggaggaaggtggctgcggcactggtgggtgcgagtgcgaatgtgtgcaagagattgcgctgcacgtgtgttag

SEQ ID NO: 25376 - DNA, 2499 bp, Artificial Sequence
  Description of Artificial Sequence: Synthetic coding sequence
atgcacagcccccccccccggcccgcccccagccccggcacctgggagagccagcctgcgcgcagcgttcgcctgggtgggcccggcggaggtgctggaggagccggcggcggtagagtgctggagtgtccgagcattaggataacatccatatccccaacccccgaacctcctgcggcactcgaggacaatcctgatgcctggggggacgggtccccaagagactatcctcctcctgagggattcggaggctacagagaagccggaggtcagggcggtggtgcctttttctctccctcaccaggcagcagctccctatccagctggtctttttttagcgatgcctccgatgaggcggccctctacgctgcttgtgatgaggttgagagcgaactgaacgaagccgcatcacgattcggactggggtcacccctgccctctccacgggccagccctagaccctggacccctgaagatccatggtccctctatggaccgagtccaggcggtcgcggccctgaagatagctggctgctgctctccgctcctggaccgacccccgctagcccccgccctgcctccccttgcggaaagcggcgttactcctcttcaggcacgccttcatcggcctctcccgccctctcccggaggggaagccttggcgaggaggggtctgaaccgccacccccgccccccttgcctctggcgagagatcctgggtcacccggcccattcgactacgtgggggctccacccgctgaaagcatcccacagaaaactcgtcggaccagctccgagcaagcagttgcattaccaagatcagaagaacccgcatcttgtaacggcaaactccctctaggagctgaagagtcggtggccccccctggaggttctcgcaaagaagtggctggcatggactaccttgcggtaccatcgcccttagcctggtcaaaggctcgcataggtggacattctccgattttccggacctcggctctgccccccttggattggcctctgccctctcagtacgagcagctggaactgcggattgaggttcagccccgtgcccaccaccgcgctcactacgaaactgagggtagtcgcggtgccgtcaaggcagccccgggaggtcatcctgttgttaagctgttgggctacagtgaaaaacctctgacgctccaaatgttcatcggaacagcggatgagcggaacttacggccacatgccttttatcaggttcacaggataactggtaagatggtggctacagcatcctacgaggcagtagtatctggtactaaggtgctcgaaatgacactgctgcctgaaaataatatggccgcgaacattgattgtgccggaatcctcaaacttcggaatagcgacatcgagcttaggaagggagaaacggatatcgggaggaagaacacccgtgtgcgactggtgttccgagttcacgttccacaaggggggggcaaggttgtaagcgtgcaagcagcctcagtgcctattgagtgctcacagcggagcgctcaggagctgccgcaagttgaggcctacagtccctccgcttgctccgtgagaggaggagaggagttagtcttgactggctctaattttttaccagacagtaaggtagtctttattgagaggggccctgacggtaagctgcagtgggaggaggaagccacagtgaatagattacaatcaaacgaagtgacattgacgctgacggtccctgagtatagcaataagcgagtaagtcggcctgtacaggtgtacttctacgtgtccaacggacgccgcaaacgctcgcctactcagtccttccgcttcctgcctgttatatgtaaggaagagcccctgcctgactcatctctaagagggttcccgtctgcctccgctactcctttcggtaccgacatggacttctccccgcctcgaccaccctacccatcctacccacacgaagacccagcttgcgaaacgccctatctgtccgagggtttcggatacggcatgcctcctctctatccccaaacgggaccaccaccgagttaccgccctggactcaggatgtttcctgagacaagaggcaccacggggtgtgctcagcctccggcggtaagcttccttcctcggcctttccctagcgacccctacggcggtcgaggatcttcatttagcttgggattgcccttttcacctcctgcccctttccgcccccctcccctacccgcaagtccccctctggaaggaccctttcctagtcagtcagacgtccatccgcttcctgcagaagggtacaacaaagttggcccaggatacggcccgggggaaggcgccccggagcaggagaaaagccgagggggctacagctccggattcagagactccgtccctatacagggaataacacttgaggaggtgtcggaaattataggccgagatctgagcggcttcccagccccaccgggcgaagagccaccggcctag

SEQ ID NO: 25377 - DNA, 2385 bp, Artificial Sequence
  Description of Artificial Sequence: Synthetic coding sequence
atgggcgccgccagctgcgaggacgaggagctggagttcaagctggtatttggcgaagaaaaggaggcccctcctctgggcgctggcggcctaggggaggagctggacagtgaagacgcacccccatgttgtcgcttggccctgggggagcctccgccttatggcgcagcgcctattggaataccccgccccccacccccccgccctggtatgcactcaccaccaccccgccctgcaccctctcccggcacctgggagtcacagccggcaaggagcgtgagactgggcggacccggcgggggcgccggcggggctggaggcggccgcgtgttagagtgtcccagcattcgcatcacatctatttcgccgacacctgaaccgccagccgcacttgaggataatcctgatgcttggggcgatgggtcacctagggactacccccccccagagggcttcggaggctacagagaagctggggggcaggggggcggggctttcttctctccctcaccagggtccagctctctttctagttggtccttcttctccgatgctagcgatgaagccgctctatatgcggcatgcgacgaggttgagagcgaattaaatgaggcggcctcccgttttggcctcggcagtcctctcccatccccccgcgcatctccgaggccctggacccctgaagatccctggtcgctgtacgggcccagccccggcggcagaggaccggaagattcctggttgctcctgagcgctcctggacctaccccggctagtccacgccccgcaagcccttgtggcaagcgtagatattcttcttctgggactccgtcatcagcatctccagctttaagtaggcggggctcactcggagaagaaggaagcgagccaccgccaccccccccattgccactcgccagggatccaggttcccccggcccattcgattacgtaggcgctccaccagctgagtcgatccctcaaaaaacacgacgcacgagctcggagcaggccgtcgccctcccaaggagtgaggaacccgcttcttgcaacggaaagctccccttgggcgcggaagaatctgtggccccacccggggggtcaagaaaggaggttgccggaatggattatctggcggtgccatctcccctcgcttggtctaaggccaggatcgggggccactcgccgatctttaggacctctgctctgcctcccctggactggcccctgccatcgcaatatgagcagctcgaacttaggatcgaggtccagccaagagcccaccacagggcccactacgaaacggagggtagcaggggggccgttaaggcagccccgggagggcatcccgtcgtgaaactgctggggtatagtgaaaaaccgcttacgctgcagatgtttattggaaccgctgacgagaggaatctaaggccacatgctttctaccaagtgcaccgcattaccggcaagatggtggcaaccgccagctatgaagccgtggtaagcgggaccaaagttctggagatgaccctgctgcccgaaaataatatggctgcaaacatcgattgcgcaggtatcctcaagctgcggaattcggatattgagctccggaagggagagacagatatcggcagaaaaaacacaagagtcagactggtgtttagagtccatgtgccgcagggcggcggtaaggtggttagcgtgcaggcggcttcagtgcccatcgaatgttcccagcggtctgctcaggaattaccgcaggttgaggcctattctccctcagcatgttccgtgcggggcggggaagagctggtcctcaccggtagcaatttcctgcctgactcaaaagtggtgtttatcgaacgcggaccagatggaaaattgcagtgggaggaagaggctaccgtgaatagactgcagtcgaatgaggtgaccttaactctgacagtcccggagtattctaataaacgcgtgtcaagaccggttcaagtctacttctatgtgagtaacggcagacgaaagagaagtcctactcagtcttttcgctttcttcccgtgatttgtaaggaggagcccctgccggacagctcgctgcggggctttccatccgccagcgctactcccttcggcaccgatatggatttttcgccccctcgacctccatacccatcttatccgcatgaggatcccgcttgtgaaacaccctacctgagtgaaggattcggttatggtatgcccccactgtaccctcaaaccgggccccctccttcctataggccaggtctcaggatgtttcccgaaactaggggcacaacggtgagcgagattattgggcgggatctatcagggttccctgctcctccgggagaagagcctcctgcctag

SEQ ID NO: 25378 - DNA, 2499 bp, Artificial Sequence
  Description of Artificial Sequence: Synthetic coding sequence
atgcacagcccccccccccggcccgcccccagccccggcacctgggagagtcagcctgcgcgctccgtgcgactgggagggcctgggggtggggcaggtggcgccggaggcgggcgggtcctggagtgtccttcgatccggattacatccatctccccaacccctgagcctccagcagccctggaagacaaccccgatgcctggggggacgggtcaccccgcgattaccctcccccggaagggtttggaggttaccgagaagcgggcggccagggcggaggggcttttttctcacctagccccgggtctagctctctgtctagttggagttttttcagtgatgcttcggatgaggccgcgctgtacgctgcttgtgatgaagttgaatccgaacttaacgaggctgcttccaggttcggcttaggcagccctctcccatcaccaagagcctcccctcgaccatggacccctgaagacccctggtccttgtatgggccctctccagggggcagaggtccagaggactcgtggctgttgctcagcgcccctggccccacaccggcgtctccaaggccagccagcccttgtggaaagcgcaggtattcctcatctggtacgccaagctccgcatccccggccttaagccgcaggggcagcctgggagaggaaggatccgaacccccaccacctcctcccttaccactggcacgggaccctggaagccctggaccatttgactatgtcggtgctcccccagccgagtcgatcccccagaagacccgccggacctcatctgagcaggctgttgcgctcccaagaagtgaggagccagccagctgcaatgggaagcttcccttaggagctgaggaatctgtggcaccccctggcggaagcaggaaggaagttgcagggatggattatttagcagtaccttcacccctggcctggtcgaaggcccggatcggcggtcactcaccaatcttccggacctctgcccttccgcctctcgactggcccctccccagccagtacgaacagttggaactaagaatcgaggttcaacccagagcccaccacagggcccactacgaaaccgagggaagtaggggtgctgttaaggccgctccaggcgggcaccccgtcgtcaagctcctgggctactctgagaagccccttacacttcagatgttcattggtacggctgacgaacgcaacttacgcccacatgctttctatcaggtgcacagaatcactggtaaaatggtcgctactgcttcttacgaagcagttgtaagtggcacgaaggtgctggaaatgacactgctcccagagaacaacatggccgcgaacatcgactgcgcaggtatcttgaagttgaggaatagcgacattgagcttagaaagggcgaaaccgatatcggccggaaaaatacacgggtgcggctggtcttccgagtccatgtgcctcagggaggcggtaaggtcgttagcgtccaggccgcgagtgtccctatcgagtgcagtcaacggagcgcccaggagttgcctcaagtggaagcatattcgccatctgcctgcagcgtccggggaggcgaggagctggtgctaaccggaagcaacttcttgcctgatagcaaggtggtctttatagaacggggacccgacggtaaactgcagtgggaagaagaggccactgtaaatcgactgcagtcaaacgaagtcaccctcaccctgaccgtacccgaatacagcaacaagcgtgtgagcaggcctgtgcaggtatacttttacgtgagcaatggacgaagaaaaaggtctcccactcagagcttccggttcttgcctgttatctgcaaagaagagcccctgccagacagtagcttgcgtggcttcccctccgcctccgcgacaccatttggaacagacatggacttttctccacctcgccctccctacccctcatacccccacgaagatcctgcttgtgagaccccttatctgagtgaaggcttcggatacggaatgccacccctgtacccccagacagggcctccccccagctaccgaccagggctacgcatgtttccagaaacgagagggacgacgggatgtgctcagcctccagcagtttctttcttacccaggccattcccgtctgacccctatgggggcagaggctcaagtttcagcttagggcttcctttttctcctcctgcaccattccgacctccgcctctcccggcctccccaccgcttgaaggacccttcccctcccaatccgacgtgcacccactccccgccgagggctacaataaggtggggcccgggtatggtcccggtgagggtgccccagaacaggaaaaatccaggggagggtactccagcggcttccgtgatagcgtgccgatacaaggcatcaccctggaggaagtcagcgaaatcattggccgggatcttagcgggttcccagccccccctggagaggagccccccgcctag

SEQ ID NO: 25379 - DNA, 990 bp, Artificial Sequence
  Description of Artificial Sequence: Synthetic coding sequence
atgttcatcggcaccgccgacgagcggaacctgcggccccacgccttttatcaggtgcatcgcattacagggaaaatggtggccaccgctagttacgaagccgtcgtatcaggtactaaagttttagaaatgaccctgctcccggagaataatatggcggccaacattgattgcgccggcatcttgaaactccgcaactcagacattgagctgcgaaaaggtgagaccgacataggtagaaagaatacccgggtcaggctggtctttcgggtgcacgtcccacagggcggtggcaaagtggtgtctgtgcaggccgcctctgttccaatcgagtgtagtcaacgaagcgcacaggaactgccacaggtcgaggcctattccccaagtgcgtgtagtgttcgcggaggggaagaactggtgctgactggatccaacttcctgcccgactctaaggtcgtgtttatagagcgcggacccgatggaaaacttcaatgggaagaagaagccaccgttaaccgcctgcagtccaatgaagtaaccctgacccttacagtgcctgagtattctaacaagcgagttagcaggcccgtgcaagtttacttttatgtctcaaacggacggcgcaaaaggagccctactcaatcttttagattcctgccagtcatttgtaaggaagaacccctgcccgattcttcgctccggggcttcccctcggcctccgcaaccccatttggaacggatatggatttctcaccgccgagacccccttatcctagctacccccacgaggatcccgcctgtgaaaccccatacttgtcagagggtttcggctacggcatgccgccgctctatccccagaccggtcctcctccctcatatcgacctggtctgcggatgttccctgagacccgaggcacaaccgtgagcgagattatcggccgggatctgagcggttttcccgccccaccaggagaggagccaccggcctag

SEQ ID NO: 25380 - DNA, 2574 bp, Artificial Sequence
  Description of Artificial Sequence: Synthetic coding sequence
atgatcaccaccctgcccagcctgctgcccgccagcctggccagcatcagccacagagtgaccaacctgcccagcaattctctatctcataaccccggactcagtaagcccgactttcccggcaatagcagcccaggcctgcctagctccagctcacctggccgtgatttgggagctcctgccgggagtatgggagccgccagctgtgaagacgaggaattggagttcaagctcgtattcggcgaagaaaaagaggctccaccactaggcgccgggggtctgggagaggaacttgatagcgaggacgctccaccgtgctgtagacttgctctcggtgaaccccctccatatggagctgctcccatcggcatacctcggcccccgccccctcgcccggggatgcattcgccacctccccgcccagccccaagccccggtacctgggagtctcagcccgccagaagtgtccgtctggggggccccggtggtggtgcgggaggcgccggaggcggtagggtgttagagtgcccatccataagaataaccagcatttcccccacacctgagcctcccgcggctctggaagacaaccccgacgcatggggcgacgggtcacctcgagattatcctcccccagaggggttcgggggctacagggaagcgggcggacaggggggcggcgctttcttctcgccgagccccgggagctcctcgctgagcagctggagctttttttccgacgcgagcgatgaggcagctctttatgccgcgtgtgacgaagtcgagtctgaactgaatgaagctgcgtcacggtttggcctcggaagtcccctgccttctccacgggcaagtcccagaccctggactccagaggacccctggtctctgtatgggcccagcccagggggtcggggacctgaggacagttggctgctcctttccgcaccaggtcccactccagcatcacctcggcccgcttctccctgtggcaagcgtagatactcaagcagtggtacaccatcaagcgcgagtccggcactgagccgaaggggcagcctcggggaggagggctcagaacctccaccgccaccgcctctgcctctagccagggaccccggatcacctgggccattcgattatgttggcgcccccccagctgagtcaattccacagaagactagacgtacttccagcgagcaggctgtggctcttccccggagtgaggaaccagctagctgcaatggtaagctgcctctgggggcagaggagagcgtcgctcctccggggggcagtcggaaggaagtggccggcatggattatttggcagtacctagtcctcttgcctggtcaaaagctagaattggaggacacagcccgatatttcgaacttctgcactgcccccccttgattggcctctcccttctcaatacgaacaactcgaactgagaattgaggtccagccccgggctcaccaccgagcacattatgagaccgaaggttcaagaggtgcggtgaaggctgccccaggcggacacccagttgtgaaattgttaggatatagtgaaaaaccgctcacgctgcagatgttcataggtaccgctgatgaaaggaacctgcggcctcacgcattctatcaggtccatcgcattactgggaaaatggtcgcgaccgctagttacgaagcggtggtgagcgggacaaaggtgttagaaatgactttgctacccgaaaacaacatggcggctaatatcgactgcgctggcatactcaagcttaggaacagcgacatcgagttgcgtaagggtgaaacagatattggaagaaaaaatacccgcgtgcgactggtgtttagggtgcatgtaccccaggggggcggcaaggtggtctctgtgcaagccgcttcagtccctatcgaatgttcccaaagaagtgctcaggaacttccccaagtggaggcgtactcgccgagcgcctgtagcgtgcgggggggcgaggagctggtgctcacaggctcaaactttttgcccgactccaaggtcgtgtttattgagagggggcctgatggaaaactgcaatgggaggaagaggctaccgttaaccgacttcaaagcaacgaggtaaccctgacgttaacagtgcctgagtatagtaataaaagggtgagcaggcctgtacaggtgtatttctacgtctcaaacggacgacgcaaacgcagcccgacccaatcctttcggttcctgcctgttatatgtaaggaggagccattacctgacagctccctgaggggattcccgtcagcttccgccacccctttcggaacggatatggatttctcgcctccgagacctccctatccttcttatccgcacgaggacccagcttgtgagactccctacctttctgaaggctttgggtatggaatgccccccctgtatcctcagactggtcccccaccaagctaccgtcctggactgcgtatgttccccgagacgcgcggaactacagttagcgagatcatcggcagagatcttagtggctttccagcgcccccaggagaagagccaccagcatag

SEQ ID NO: 25381 - DNA, 2175 bp, Artificial Sequence
  Description of Artificial Sequence: Synthetic coding sequence
atgcacagcccccccccccggcccgcccccagccccggcacctgggagagtcagcccgctaggtctgtgcggctggggggtcccggtgggggggccggcggggccggtggaggacgcgttctggagtgtcccagcattcgtatcacgtcaatctctccaacgcctgaaccacctgccgctctcgaagacaacccagatgcctggggcgacggaagccccagagattacccccctccagagggcttcggggggtatagggaggcaggcgggcagggaggcggcgcattctttagcccctcccctggctcttctagcttgagctcatggagctttttttctgatgcctcagatgaggccgccctgtatgcagcttgcgacgaggtggaaagcgagctaaatgaagccgcctctagatttgggcttggttctccactgccttcaccccgggcatcaccaaggccttggacccccgaagacccttggagtctgtatggccctagtcccggggggaggggaccagaggattcctggctgttgctgtcagcccctggccctactcctgcctcacctcgaccagcatcaccctgcgggaagcggcgttattcctccagtggcaccccctcttcggcttcgccagccttgtctaggcgagggtctctgggcgaggagggatctgagcctccccccccaccgcctctgccactggcaagagaccccggctcccctggaccctttgactacgtgggcgccccgcctgcagagtctatcccacagaagacgcgccggacttccagcgaacaggccgtggctctgcctcggagtgaagaacccgcatcctgcaacggcaaactcccactgggagctgaggaaagcgtggctccaccgggcggctcacgcaaggaagtagccggaatggactacctggccgtcccttccccccttgcatggagtaaagcacggattggtggccatagcccgatcttccgtaccagtgccttgccccccctggactggcctctaccgtctcaatacgaacagctcgagctgcggattgaagtgcagcccagagcacaccatagggcgcattatgagactgaaggctcacgaggtgcagttaaggctgctcccggaggccacccagtggtcaaactgcttggatacagcgagaagccactgacactgcagatgttcattggtactgccgatgagaggaatctgcggccacacgctttctatcaggtgcaccggatcaccggaaagatggtagcaacagcatcatatgaggcagtggtctctgggacaaaggtcttagaaatgactctgctgcccgagaataatatggccgccaatatcgattgcgccgggatcttaaagttgcggaacagcgatatcgaattacgcaagggagaaacagacattggccggaaaaatactagagtgcgcctggtatttcgggtgcatgtcccccagggcggggggaaagttgtctctgtccaggctgcctcggtgccgattgagtgctctcaacggagtgcccaggagctgccccaggtcgaagcatactctccttccgcatgttcggtgcggggaggtgaggagcttgtgctcacgggttctaatttcctgcctgatagtaaagttgttttcatcgagcgtggccctgacggtaagttgcagtgggaagaagaagccacagtgaatcgccttcaatcaaacgaggtgacattaacgttaactgtgcctgagtactctaacaaaagagtgtcacgtcccgtgcaggtctatttttacgtaagcaatggcagacggaaaagaagccccactcaaagttttagattcttgcccgtgatttgcaaagaagagccgttacccgactccagcctgagaggattcccttccgcctcggccaccccattcgggactgatatggacttctctccacccaggccaccatacccttcctatccacatgaggaccctgcttgcgagactccgtatctcagtgaaggctttggctacgggatgcccccactttatccgcagacggggcctccacccagctaccggccggggttgagaatgttcccagagacacgcggaaccaccgtgagtgaaatcataggaagagatctgtcaggctttcccgctcctcccggagaagagccgcctgcttag

SEQ ID NO: 25382 - DNA, 432 bp, Artificial Sequence
  Description of Artificial Sequence: Synthetic coding sequence
atgggcgccgccagctgcgaggacgaggagctggagttcaagctggtttttggagaggagaaagaagcacctcctcttggagccggcggactgggcgaagaattagatagcgaggatgcccccccatgttgtagattggccttgggggagccccctccctatggggccgccccaatcggcatcccccggccgccacctccccggccagggatgcattctcctcctccccggcccgccccctcccccgggacgtgggagagccagcctgcaaggtcagtgcgtctgggaggaccaggtggcggagctgggggcgcaggtggggggcgcgtgctcgaatgccccagcatccggataaccagcatctcccccactcccgaaccgcctgctgctctcgaggataatcctgacgcgtggggagatgggagtccctag

SEQ ID NO: 25383 - DNA, 2424 bp, Artificial Sequence
  Description of Artificial Sequence: Synthetic coding sequence
atgctgagcggccgggacctgggcgcccccgccggcagcatgggcgcagccagctgtgaggatgaagagctagagtttaagctcgtgttcggtgaagagaaggaggcaccgcctctgggggccgggggacttggagaagagctggatagcgaggacgcaccaccctgctgccgtttggctctcggcgaaccccctccctatggtgcagcccccattggcatcccccgccctcctcctcctcggcctggaatgcactccccaccgccccgacctgccccatctccgggcacctgggagagccagcccgcccgcagtgttaggctcggtggaccagggggaggcgctggaggcgcaggcggcggccgcgtgctggagtgccccagcatccgaataacctctatatctccaactccagaaccacccgccgccctggaggacaatcctgacgcctggggtgacgggagcccccgggactaccctccgccagagggctttgggggctatagggaagcgggtggtcagggagggggcgcctttttctctccttccccagggagctcatctctctcctcttggagctttttctccgacgcatcagacgaggcagccttgtacgcggcatgcgatgaggtggaatccgagctgaacgaggcagcttccaggtttgggctagggtcccccctaccctcgcctcgtgccagccctcgaccttggaccccagaggatccttggagcctgtacgggccctctcccggagggcgcggaccagaagatagctggctgttgttgtctgctccgggcccgaccccagcgtccccgaggcccgccagtccatgtggcaaaagaagatactcctcatccggcacaccatccagcgcctccccagctttgagtcggcggggtagcctgggagaggagggcagtgaaccaccccctccccctccactgccactggcacgcgacccaggctctcccggcccgttcgattacgtgggtgccccccccgcggagtccattccccagaagaccagacggacctcctccgagcaggcggtcgcacttcctcgctccgaggagcccgcctcttgtaacggaaagctccctttgggagcagaggaatcagtggctccgcccggagggtctaggaaggaggttgccggtatggattacttggccgtgccatcgccactggcttggtccaaggcgaggatcggtggccacagccctatatttagaacctctgccctgccaccactcgattggcctctgccctctcaatacgaacagttggaactacggatcgaagtccaacctagagcccatcacagagctcactacgagaccgagggctctcggggggctgtcaaggcggctcccggcggacatcctgtggtaaaactgctggggtatagtgagaaacccctgacactgcagatgtttattggcactgccgacgagcggaacctgcggcctcacgccttttatcaagtgcatagaatcaccggcaaaatggtggcaaccgcatcttacgaggctgttgtctccggtactaaggtgcttgagatgacactccttcctgagaataatatggctgcaaacatcgattgcgccggcattctcaagctgaggaattccgacatcgagctcaggaagggagaaactgacatcggcagaaagaatacccgcgtgcgtctggtcttccgtgtgcacgtgccacagggaggaggtaaagtggtcagcgtccaggcagcctctgttccaatcgagtgttcccagcggtcggcccaggaattgccccaagttgaagcttattctccatctgcgtgcagtgtcaggggtggcgaggaactggtactgacaggaagcaattttctccctgacagtaaagtggtgttcattgagagagggcctgacggtaagctgcagtgggaagaagaagccactgtcaatcgtctccagtcaaacgaggtgaccctcacattgaccgtgcctgaatactccaataaacgcgtgtccagacccgtacaggtgtatttttatgtgagtaacggcaggcgaaaaaggagcccaacgcagtctttcagatttttgccggtgatctgcaaagaggaaccgctcccagactccagtctgcgcgggtttccatctgccagtgccaccccattcggtacagatatggatttcagcccgccccggcccccttacccgtcctacccacacgaagacccagcctgcgaaactccttatctctccgaggggttcgggtacggcatgccccctctgtaccctcagacaggcccccctccatcatatcggcccggactgagaatgtttccagagacacgaggtacaaccgtttccgagatcatcggcagggacctatctggtttccctgcccctcccggagaagagccaccagcatag

SEQ ID NO: 25384 - DNA, 1311 bp, Artificial Sequence
  Description of Artificial Sequence: Synthetic coding sequence
atgttcatcggcaccgccgacgagcggaacctgcggccccacgccttctatcaggttcatcggattaccggtaaaatggtggccaccgccagttacgaagctgtggtgagcggcactaaagtgctggaaatgaccctgctcccagaaaacaatatggctgcaaacatcgactgtgcaggcatcttgaagttaaggaactcggatattgagttgcgcaaaggcgagacagatattggaagaaaaaacactagggtgagactcgtgtttagagtccacgtccctcaagggggaggaaaagtagtgagcgtgcaggccgcaagcgttcccatcgaatgttcacagcggagtgctcaggaactgccccaagtcgaggcctactccccttccgcatgctcagtacggggcggggaggagctggtcttgaccgggtctaacttcctcccggactccaaggttgtgttcattgaacgtggccccgacgggaaacttcagtgggaagaggaggctactgttaatcgactgcagagcaacgaagtgactctcacgctaacagttcctgagtactctaataagagagtatctcgacccgtgcaggtgtatttttatgtatccaacgggcgacgaaagcgctctccaacacaaagcttccgcttcctgccggtgatttgcaaggaggagccactgcccgactcttccttgcgcggtttcccgagtgcatctgctactccatttgggaccgacatggacttttccccacctaggcccccatacccatcataccctcacgaagaccccgcctgtgaaaccccatacctctccgagggttttgggtatggcatgccccccctataccctcagacgggtcctcctcctagctataggcctggactacgtatgtttcctgagaccagaggaacaaccggctgcgcgcagcctcccgccgtgagttttcttcctcgcccttttccctctgatccctacggcggaagaggcagctcttttagcctgggcctgcccttcagcccacccgcaccattcagacccccccctctgcctgccagcccgccattggaaggaccatttccatctcagtctgatgtgcaccccctgcccgccgaaggctataataaggtcgggccaggctacggtccaggtgaaggtgcacctgaacaagaaaagagccgcgggggatacagctctggctttagggattcagttcccatccaaggaatcactcttgaggagggaggctgtggtactgggggatgcgagtgtgagtgcgtccaagagatagctcttcacgtttgctag

SEQ ID NO: 25385 - DNA, 570 bp, Artificial Sequence
  Description of Artificial Sequence: Synthetic coding sequence
atggacttcagccccccccggcccccctaccccagctacccccacgaggacccagcttgtgagactccatacctcagcgaaggttttggctatggtatgccccctctctatcctcagaccggtccacctccttcttacagaccgggcctgcgcatgttccccgagacgcgcgggactactggatgtgcacagccccccgctgtgagctttttacctcgaccctttccctcggatccttacggcggaagaggaagttccttcagcctcggtctgccattttcaccacccgcgccctttagaccgccacccttgcccgcctctccccctctggagggccctttcccttctcaaagcgacgtacacccgttaccggccgaggggtacaacaaagtgggccctggatatggaccaggcgagggggcgccagagcaggagaaaagccgcgggggttacagtagtggatttcgcgactccgtgcctatccaaggcattaccctggaagaggggggctgcgggacggggggttgcgagtgtgagtgtgttcaggagattgcactccacgtctgttag

SEQ ID NO: 25386 - DNA, 2673 bp, Artificial Sequence
  Description of Artificial Sequence: Synthetic coding sequence
atgcccgccagcatcagcagcatcttccccggccccaccctgctgttgagctgcggcagcgaggaactcgacagcgaagatgctcctccctgctgccggctggctctaggtgagccaccaccctatggcgcggcacccatcggcattccaagaccacctccacccagaccggggatgcactcaccccctccacggcctgccccttcacccggcacatgggaaagccagccggcccgaagtgtgcggctcggtggccccgggggtggcgcagggggcgctggtggaggtcgcgtgctggagtgcccatctatcagaattacctcgatatcaccaactcctgagcctcctgctgctctggaggacaatcctgatgcctggggcgatggtagtcctagagactacccacctccggaaggtttcggaggttatagggaagcaggaggacaaggtgggggagccttcttttccccttcacccggatcgagttcactgtcctcttggtccttcttctctgatgcctccgatgaagccgccctgtatgcggcatgcgacgaggtggaaagcgagttgaacgaggccgccagcagatttggcctcggatcacctcttcccagtcctagggcatcaccacggccgtggacccccgaggacccttggagcctttatggaccatcccctgggggacgcggtcccgaagatagctggctgctgctctccgctccggggcccacgccagcctcacctagacccgcctcaccatgtggtaaacgacgatacagcagttctggaacgcccagcagcgcaagtcccgccctcagcagaaggggcagcctaggtgaggagggctccgagccaccccccccacctcctttgcccttggcgagggatcccgggagcccggggccgttcgattatgtcggagccccaccggcagagtcaatccctcagaaaactagaagaaccagctctgagcaggcagtggccctgccccggagcgaagagcccgcttcctgtaatgggaagctgcctctgggggctgaggagtcagtggcgcctccagggggctcccgtaaggaggttgccggaatggattatctggccgtcccttccccgctggcctggagcaaggcacggatcggcggccactcacccatttttcgcacatctgcccttccgcctctggactggcccttgccctctcagtatgagcagctggagttgagaattgaggtgcagcccagggcccaccatcgcgctcactacgaaactgaaggtagtagaggcgcagtgaaggccgctccagggggtcatccggttgtcaagttgttggggtacagcgagaaacccttgaccttgcagatgttcataggcacagcagacgagaggaacctgagaccgcatgccttttaccaagtgcaccgcattacagggaaaatggtggcaaccgcctcctacgaagccgtggtgtccggaactaaggttttagaaatgacactgctacccgagaacaatatggcagcaaacatcgactgtgccgggattctaaaactccggaattctgatatcgaactccgtaagggcgaaactgacatcggtagaaaaaatacccgcgtgcgcctggtttttcgagtccatgttccacagggcggagggaaggtagtgtccgtgcaggccgctagcgtgcctatagagtgttcacagcgctccgctcaagaactaccgcaggtcgaggcatactctccctccgcatgttcggttcgcggcggagaggaattggttcttaccgggtccaatttccttcccgattccaaagtcgtatttatagaaaggggcccagatggaaaactgcagtgggaagaggaggccaccgtcaatcggctccagtccaatgaagtgactctaactctgaccgtcccagagtactccaacaagagggtcagccgaccagtgcaggtgtatttctatgtctccaatggccgtcgtaaaaggtctcccacacagtcatttaggttcttacccgtgatttgtaaagaggaaccccttcctgattcctctttacgggggtttccttctgccagtgccacgccattcggaacggatatggacttcagtccccccagaccaccttacccctcgtacccccacgaagatcctgcctgtgagactccatatctcagtgaaggctttggctacggaatgcctccactgtaccctcagaccgggcctccccccagttatagacctggcctgcgcatgtttcccgagactcgcggaactactggctgtgcacagcctccggcagtctccttcctacccagacccttcccttcggatccctacggaggacgcggaagcagctttagtttagggttgcctttctccccccctgcgcccttcaggcctcctccacttcccgccagtccccctctcgagggaccctttccctcccagtccgacgtgcatcccctgccggctgagggatacaacaaagttggacctggctatggccctggagagggagccccagaacaggaaaaatctcgcggcgggtactcttccggctttcgcgattcagtcccgatccagggaattacactggaagaggtgtctgaaatcattggtagagacctgtctggcttccccgcgcccccgggcgaagagcccccagcctag

SEQ ID NO: 25387 - DNA, 2748 bp, Artificial Sequence
  Description of Artificial Sequence: Synthetic coding sequence
atgctgagcggccgggacctgggcgcccccgccggcagcatgggcgcagcaagctgcgaagacgaggagctcgagttcaaactggtgttcggcgaggagaaagaggccccccctctgggagccgggggcctcggtgaagagctggatagtgaggacgctccgccatgctgtcggttagctctcggggaacccccaccctacggtgcagcgccaattggaatcccaagacctccaccaccgcgtccgggcatgcatagccctcctcccagacctgcgccgtcccctggcacatgggagagtcagcctgcaaggtcagttcggctgggcgggcccggcgggggcgctggtggggccggaggcgggagagtgctggaatgtccatccatcaggatcacatcgatctcccccacccccgagcctcctgcagcccttgaggataacccagacgcctggggagacgggagtccccgcgactatcccccacctgagggttttggcggctatcgggaggccgggggccagggggggggggcattcttctcaccgtccccaggctcctctagcctgagctcgtggtccttctttagtgatgcctcagatgaagctgctctttacgcagcttgtgacgaagtggagagtgaattgaacgaggccgcgagccgctttgggcttggaagccctcttccctccccacgagcctcacccaggccatggacacccgaggacccatggagcctatacggcccctccccgggtggtcgggggcccgaggacagctggctgctgctttccgctcccggacctacccctgccagtcccaggcctgcctcaccttgtggcaagcggcgttatagctcttcaggaaccccttcttccgcttcccctgctcttagcaggagaggatctcttggagaagaaggctctgagccacctcccccaccaccccttcctttagctcgcgatcctgggtctccaggtccattcgattacgtaggagctccccccgcagaatctattccccaaaagacccgccgaacaagctctgagcaggccgtggcactgccgcgttctgaggagcccgcgagttgcaacggaaagcttcccctgggagcagaggagtctgtggccccgccaggcgggtcacgcaaggaggtcgccgggatggattaccttgcagtgccatctcctctggcatggagtaaagcacgtatcggagggcattctcctatctttcgcacgtccgcactgcctccattagattggcccctgcccagccagtacgagcagctcgaactcaggatcgaggtccaacctagagcccaccacagagcccattacgaaaccgaaggatcacggggagcagtgaaggcggcccccgggggccatccggttgttaaactacttggctattcggagaaacctctgacactccaaatgttcatcggcaccgccgatgagagaaacctccgacctcatgctttttaccaggtccatcggattacaggaaagatggtggccactgctagctacgaggccgtggtcagcggcactaaagtactggagatgactctgctccctgagaacaacatggcggccaacattgattgtgccgggatcctgaagctgcggaactctgatattgaattacgaaagggggaaaccgatattgggcgcaagaatactcgcgtgcgattggtctttagggtccacgtgcctcaaggggggggcaaggtggtctctgtgcaagcagcttccgtgccgattgaatgttctcagcgatctgcacaggagctgcctcaggttgaggcctatagcccctcagcctgttccgtccgcgggggcgaggaacttgtcttgactggctctaactttttgccagattctaaagtggtgtttatcgaacggggccccgatgggaaacttcagtgggaggaagaagcaaccgtcaacaggctgcagtctaatgaggtgactttgacactaactgtgccagagtatagcaacaagcgggtaagtcgccccgtgcaggtttacttctacgttagcaacggaaggaggaagcggagcccaacacagagtttcagattcctcccggtaatctgcaaagaggagcctctgccagactcgtcgctccgaggcttcccctccgctagcgccactccttttgggaccgacatggactttagccctcctagaccgccctacccgtcctacccccacgaggatccagcctgcgaaacaccctacctgagcgagggattcggctacgggatgcccccactgtacccccagacaggcccacccccctcgtaccgccctgggctaagaatgttccccgagactcggggtactacaggctgcgctcaacctcctgccgtaagctttctgcccaggccttttccaagtgacccttacggagggagggggtcctctttcagcctgggcctgcctttttctccccctgcgcccttccggccacctccacttccagcctctcctccactcgagggacccttcccgagccagagcgacgtccatcccctgccagctgaggggtataacaaggttggtccggggtacgggccgggcgagggagcaccagaacaggagaaatcccgcggcggatactcctcaggtttcagagactccgtgccaatccagggaataaccctggaagaggtgtcagagatcatcggaagagatcttagcgggtttcctgccccccccggcgaagagcctcccgcgtag

SEQ ID NO: 25388 - DNA, 573 bp, Artificial Sequence
  Description of Artificial Sequence: Synthetic coding sequence
atggacttcagccccccccggcccccctaccccagctacccccacgaagatccagcttgcgaaaccccctacctgtctgaaggcttcggatacggcatgccaccattgtacccacagacaggtccgcccccgagctataggccgggtctccggatgtttccggagacacgagggacaacagggtgtgcacagccaccggcagtgagtttcctgcccagacccttcccttcagacccatatggcggccggggttccagtttctccctcggtctccccttcagtcctcctgcacctttcagacctccacccttgcccgccagccctcccttagaggggccgtttccttcacagtctgacgtgcatcctctgcctgctgagggatataataaggtgggacctggctatggacctggcgaaggcgccccagaacaggagaagagtcggggcggctactcctcgggtttccgagattctgtccccatccaagggatcactcttgaagaggtttccgagattatcggtagggacctgtctgggttccccgccccccccggtgaggaacctccggcatag

SEQ ID NO: 25389 - DNA, 2349 bp, Artificial Sequence
  Description of Artificial Sequence: Synthetic coding sequence
atgcccgccagcatcagcagcatcttccccggccccaccctgctgctcagttgtggatccgaggaattagacagcgaagatgctcccccttgttgccggctggccttaggagagcccccgccctacggcgcagcaccaataggaatacctcgcccacccccacctcggcccggtatgcatagcccgcccccgcggccagctcccagcccggggacctgggagagtcagcccgccaggtccgttagattaggtggacccggcggcggcgctggaggagccggcggcggccgtgtactagaatgtccatcaattcgaattaccagtatctctcctacacccgaacctccggccgccctcgaagacaaccctgacgcttggggtgatggatcaccgcgcgattacccccccccagaaggattcggagggtaccgagaagcgggaggacaaggtggaggagcatttttcagccccagccccggaagctcttccctttcctcatggtcatttttctccgacgccagcgacgaagccgccctgtacgcggcttgcgacgaggtcgaaagtgaactgaacgaagccgcatcgaggttcggcctgggtagtcctctccctagcccaagagctagtcctagaccctggacgcccgaggacccatggagtctgtacgggccatcacccggcgggagaggaccggaagacagctggttattactgtccgctccgggtccgactcctgcctccccacggcccgcctcgccctgtggaaagcggaggtatagctctagtggcaccccgtcgtcggctagtccggcgctgtcacggagaggcagtctgggggaggaaggcagcgagcccccaccaccgcctccactgcccctggccagagacccagggagtccaggaccctttgactacgtcggcgcaccaccggccgaaagcattccacaaaagactcgacgtaccagctctgagcaggcagtggccctcccacgcagtgaagaacctgcaagctgtaacgggaagctgcctctgggagccgaggagtcagtggcccctcctggtggaagccgcaaagaggtggccggtatggactaccttgcagtgccgtcaccattagcctggagtaaggctaggatcggtggccattctccgatatttaggacctccgcgctgccgcctcttgattggcccttgcctagccaatatgagcagctggaacttcggatcgaggtccaaccccgagctcaccacagagcccattatgagacagaaggttccaggggagccgtgaaggccgcccctggaggacacccagtggtcaagctccttgggtactcagaaaagcctctcacgctgcagatgttcatcgggaccgctgacgaacgtaaccttaggccccacgccttctaccaggtgcaccgcattacggggaaaatggtggccacggctagctacgaagccgtggtcagcggaactaaggtgctcgaaatgaccttgctgcccgaaaataatatggccgcaaacatagattgcgccggaattctaaagcttaggaattctgacatcgagctaaggaagggagaaaccgatatcggcagaaagaatacaagggttcgtctggtattccgcgtgcatgtgcctcagggtggtggtaaagtggtgtctgtccaggccgcttcagtgccgattgagtgttcacagcgctcagcccaggagctgccgcaggtcgaggcttactccccctcagcatgctctgtgaggggaggagaagagctggtgctgaccggttctaattttcttcccgattcaaaggttgtgtttatcgaacgaggtccagatggtaagctgcagtgggaggaagaggccactgtgaatcgcttacagtctaatgaggtgactttgacactgactgtgccagaatacagcaataagagagtttcaaggcccgtgcaggtgtacttctacgtttctaacgggcggcggaagagaagccctacccagtctttcagattcctccctgtgatttgcaaagaagagcccttaccagactccagcctcaggggatttccgagtgcttctgcgactcccttcgggacagatatggatttttctccccctcggcctccctatccgtcatatccccatgaagaccctgcctgtgaaacaccttacctatccgagggctttgggtatggtatgccgcccctttatcctcagactgggccaccaccatcataccgccctggcttgagaatgttcccagaaactaggggcactacagtgtcggagattattggcagagatttgagcggattccctgcgccacctggcgaagaaccaccagcttag

SEQ ID NO: 25390 - DNA, 2805 bp, Artificial Sequence
  Description of Artificial Sequence: Synthetic coding sequence
atggccgacggcggcgccgacagcgccgcccagcggctgcccgaggggccaggacgcgtcgcccctggccgggacctgggcgcgccggcaggaagtatgggcgccgccagctgcgaggacgaagagttagagtttaaactggtgttcggagaagagaaggaagcaccacccttaggagctggcggacttggagaggagctggactccgaagacgctccaccttgctgtcgtttggccctgggcgaacctcccccatatggagcagcgcccatcgggattccccgcccaccccctccaagaccaggcatgcactccccccctcccaggccagccccaagtccaggaacctgggagtcccagcctgcccggtcagtaaggttaggcgggccaggcggaggggcaggaggagccggaggtggacgcgtgcttgaatgcccaagcatccgcattactagcatcagcccgacacctgaaccaccagcagcactagaggacaacccggacgcttggggcgacggttcaccgagagattaccctccacctgaagggttcggtggatacagggaggccgggggtcaagggggcggtgcattcttttcacccagccccggaagcagctcgctaagctcttggtcctttttcagcgacgcctcagacgaggcagcattatatgcagcctgcgacgaagtcgagtccgagcttaacgaagctgcgtcccgctttggcctcggctcgccactgccttcaccacgggcttcgccgagaccatggactcccgaggatccatggtcgttgtatggaccgtctccaggcggaagggggcctgaggattcttggttgctactgtcagctcctgggcccacacctgcaagcccccgaccagcatctccgtgcggaaaacggcggtacagttcatcaggcactcctagcagtgccagtcccgctttatccagaagaggttctcttggtgaggaagggagcgaaccacctcccccacccccactccctctggcccgggaccctggctctcccgggccctttgactacgtcggagcacccccagctgaaagcatcccccagaagaccaggcgtaccagctccgagcaggcagtcgccttgcctagatcagaggaacccgcaagttgcaacgggaaactgccgctgggcgccgaggagtccgtggctccaccaggaggtagtaggaaggaggtggccggtatggattatctggccgttcccagtccgttggcatggtctaaggcccggattggggggcactctcctattttcaggacctcagcattacctcctctggattggcccctaccctcccagtacgaacaacttgagctgcggatcgaggtacaaccacgggcacaccaccgggcccattacgaaacagaggggtcccggggggctgtgaaggctgcacctggcgggcacccagtggtgaagctcctgggctatagcgagaaaccgctgacacttcagatgttcattggaacagccgatgagaggaacctgagaccacacgccttctatcaagtccaccgcatcacggggaagatggttgcgacggcgtcctatgaggctgtggtcagcggcacgaaggtcttggaaatgactttactgcccgagaataacatggctgcgaatattgattgtgcggggatcctgaaactcagaaattcggatatcgagttacgcaaaggagagaccgacatagggcgcaaaaacaccagggttaggttagtttttcgcgtgcacgttcctcaaggaggcggaaaggttgtttctgtgcaagcagcaagtgtaccgattgagtgttctcagcgcagtgctcaggaactgccccaggtggaagcttactccccttctgcttgctcagtaagggggggagaagagctggtgcttactggatccaacttcctgcccgatagcaaagtagtctttatcgaacggggccctgatgggaaactacagtgggaagaagaggcaacggtcaaccggttgcagtccaatgaggtgaccttgactctcacagtgcccgagtatagcaacaagagggtaagtcggcctgtgcaggtctacttctatgtatcgaatggccgccgtaagcgatcgccaacacagagcttcaggtttttaccagtcatctgcaaggaggagcctctgcctgactcctcactgcgaggcttccctagcgcatctgcaacacccttcggaaccgatatggatttcagcccgccccgcccaccttaccctagctatccccatgaggatccagcatgtgaaactccgtacctcagtgaaggcttcggttatggcatgccgcccttgtatcctcagaccggcccaccaccatcatatcgaccagggctgcggatgtttccagagacccgcggaacgactggctgcgcccagcccccagccgtttcattcttgccacggccgtttccatccgacccctacggcggcagaggcagctctttttcccttggactgccctttagcccccccgctccatttagaccccctccattgcctgccagtccacctctggagggcccttttccctcccagagcgacgttcatcctctacctgcggagggatacaataaggttgggcccggatacggcccaggtgaaggcgcacctgagcaggagaagtccagaggcggttattcatctgggtttcgagacagcgtgcccatacagggcatcacattggaagaggtgtcggaaattataggacgcgacctttccggttttcctgcacctcccggggaagagccgccagcctag

SEQ ID NO: 25391 - DNA, 1314 bp, Artificial Sequence
  Description of Artificial Sequence: Synthetic coding sequence
atgttcatcggcaccgccgacgagcggaacctgcggccccacgccttctaccaggttcacaggatcacaggcaagatggtcgccactgccagttacgaagcagtcgtgtcggggaccaaagttttagagatgaccttgttacctgagaacaacatggcagcaaacattgactgtgccggcatccttaaacttcggaatagcgacattgagttgcggaagggcgaaactgacattgggcgaaagaacactcgagtgcgactcgtgttccgagtgcatgttcctcagggaggaggcaaggtcgtctccgtgcaggcggctagcgttcccatagaatgttcacagcggagcgcccaggaactcccccaagtggaagcatacagcccttcagcttgtagtgtgcgcggtggtgaggagctggttttgacaggcagtaattttctacccgatagcaaagtggtgtttatcgagcgtggaccagacgggaagctgcagtgggaggaggaagccaccgtgaatcgactgcagagcaacgaggttactctgacactgaccgtccccgagtactctaacaagcgggtgagtaggccagttcaggtgtacttctacgtatctaatggcaggaggaagcggtctccaacgcagagcttccgatttctgcctgtgatctgtaaggaggagccattacccgactcaagcctccgagggtttccgtctgcatcggccacaccattcgggactgatatggatttctctcccccaaggccaccctatccctcttaccctcacgaagacccagcgtgtgaaaccccttacctcagcgagggctttggctatggcatgcccccattgtacccccaaacggggcccccaccctcataccgtccgggtttgagaatgttccctgagacccggggcaccaccggttgtgcccaacctccagctgtgtccttcctgccccgccccttcccttcagacccctacgggggaagagggagcagtttctcactcggcctgccttttagcccccctgccccattccgtcccccacccctgcccgctagcccccccctggaggggccctttccatcccagagcgatgtgcatccattgcccgctgagggatacaataaggtgggtccgggttacgggccaggagagggcgcccctgaacaggaaaagagtagaggaggatattcctccggttttagggattcagtgcctatccaagggattacgttagaggaagtgagcgagatcatcgggcgcgacctgtctgggttccctgctccaccaggggaggagccccctgcctag

SEQ ID NO: 25392 - DNA, 2496 bp, Artificial Sequence
  Description of Artificial Sequence: Synthetic coding sequence
atgcacagcccccccccccggcccgcccccagccccggcacctgggagtcacagcctgcacgatccgttagactgggcggtccaggcggcggggctgggggagcaggcgggggtagagtcttggaatgtccttccattcgtataaccagcatctccccaacccccgagccgcccgccgccctggaggacaatccagatgcgtggggcgatggctcacccagggactatcctcctccagagggctttgggggatatagggaggcgggcggccagggaggtggcgcttttttttccccttccccagggtccagcagcctgtcttcctggagttttttctctgacgcatcggacgaagccgcgctgtacgccgcttgcgatgaggtcgagtccgagctcaatgaggcagctagtcgatttggcctcgggtcgccgctacccagcccgagagcctctccccgaccatggactccggaggacccttggtctctctatggcccatctcccgggggtaggggacctgaagacagttggctgctgctgtcagctcccggcccgaccccggcaagtccacgacccgcttcgccttgcgggaagagacgctattctagctccggtacaccctcatctgcgagtcccgccctgtcacgacgcgggtctcttggagaggaaggctcggagcctccgcctccccctcctttgccactggctagagatccaggatctcctggccccttcgattatgtaggtgcgcctccagccgaatccataccacagaaaacacgaagaacgtcaagcgaacaggcagtggccctgccgcgctccgaagaacctgcctcctgcaacggaaagctgcctctgggcgcagaagagagcgtcgctcccccagggggttcgcgcaaggaagttgcaggaatggactacctggcggttccctctcccctggcgtggagcaaagcacgcatcggcgggcactctcccatcttcaggacttccgcattgccgccgctggactggcctcttccgtctcagtatgagcaattggaattgaggattgaggtgcaaccccgcgcccaccaccgtgcacactacgaaaccgagggatcacgcggcgccgttaaggccgccccaggcggccaccctgtggtcaaactgttgggatactctgaaaaaccgttgaccctgcagatgtttatcggaaccgctgatgagaggaaccttagaccccacgcattctaccaagtccaccgaatcactggaaaaatggttgcaaccgcctcctacgaagcagtcgtgtcaggtaccaaggtcttggagatgacattgctgcctgagaacaatatggccgccaatatcgactgcgcggggatcctcaagctccgcaatagcgacattgagctccggaagggcgagaccgacatcgggcggaaaaatacaagggttaggctggtctttagggttcacgtgcctcagggcggtggtaaagttgtgtcagtgcaggctgcatccgtcccgattgaatgcagtcagaggagcgctcaagaactacctcaggtcgaggcttattcaccatccgcttgctcggttcgaggaggagaggagctggttttgacgggaagcaacttcctgccggacagcaaggtagtgtttattgagaggggaccggacggcaaactgcagtgggaggaggaggcaacagtgaaccggttacagagcaatgaagtgaccctgacactcacagttccggaatatagcaacaaacgcgtgtcccgaccagtgcaggtgtacttttacgtgtccaatggccgaaggaaacgaagtccaacacaatctttccggttcctccctgtgatatgcaaggaagagccacttcctgatagtagcctgagagggttcccatcagcaagcgcgacaccatttggcacagacatggattttagccctcctaggccaccctaccccagttatcctcatgaagatcctgcctgcgaaactccgtacctctccgagggtttcggatatggcatgccccctttatatccccagacaggaccgcccccatcctacaggcccggcctgcgcatgttcccagagacccgcggtactacgggttgtgcacagcccccagcagtgtcgttccttccgcggcctttcccatctgacccctatggaggtcgcggatcttctttctctctgggtttgccgttcagccctcccgcacctttccgaccaccccctcttccagctagtccaccccttgagggaccgtttcccagtcagtcggatgttcacccactgcctgccgaaggatacaacaaagtggggcctggctatggcccaggtgagggggcacctgaacaggaaaagtccagaggcggctattcatctggttttcgagatagcgtgccaatacagggaattacactggaagagggtggctgcggaaccggggggtgcgaatgtgagtgcgtgcaggaaatcgctttgcatgtgtgttag

SEQ ID NO: 25393 - DNA, 249 bp, Artificial Sequence
  Description of Artificial Sequence: Synthetic coding sequence
atggacttcagccccccccggcccccctaccccagctacccccacgaggaccccgcttgcgagacaccatacctcagcgaggggttcggctatgggatgccccctctatatccgcagacaggaccaccaccttcctacaggcctgggttacgcatgtttcctgaaacaagaggcaccacagtctccgaaatcattggtcgtgatctaagcggttttcccgctccacccggggaggaacccccagcctag

SEQ ID NO: 25394 - DNA, 315 bp, Artificial Sequence
  Description of Artificial Sequence: Synthetic coding sequence
atgagcagcgccgcccggagccggctgacccgggccacccggcaggaaatgctgttcctggccttgctgctgttgcctgtcgtagtggcatttgcgcgtgctgaagcagaggaagacggcgacctacagtgtctgtgtgtgaagacaacatctcaggtccgacctaggcatattaccagcctggaagttatcaaagcggggcctcactgtcctacggcccagctcatagccaccctaaaaaacggacgtaaaatctgtttagatctgcaggctcttctgtataagaagattattaaagagcatctggaatcatag

SEQ ID NO: 25395 - DNA, 2907 bp, Artificial Sequence
  Description of Artificial Sequence: Synthetic coding sequence
atggccgaggacgacccctacctgggccggcccgagcagatgttccacctggatccctctctcacccatacaattttcaaccctgaggtgttccagccacaaatggcactgcccacagacggtccatatctccagatactggaacaacccaagcagcgcggttttagatttcgatatgtctgcgaagggcctagccacggtggtctgccaggcgctagctccgaaaaaaacaagaagtcatacccacaggtgaagatctgtaattacgtgggacccgctaaggtcatcgtgcagttagtgaccaatgggaaaaatatccaccttcacgcacattccttggtgggaaagcactgtgaagatgggatatgtacagttaccgcaggaccaaaagacatggttgtaggcttcgccaacctgggcatcctgcatgtcactaaaaaaaaggtgttcgagactctggaagctcgaatgaccgaagcctgcatacgaggttacaaccccggcctgctggtccatcccgacctggcttatctgcaggcagaagggggcggagaccgccagctgggcgaccgggagaaggaattaatccgacaggccgcactccagcagacgaaagagatggatctttctgtcgtcaggctgatgtttaccgcttttctccccgactcaaccggcagtttcacaagacggctcgagcctgtcgtgagtgatgccatctacgattcgaaggcccctaatgcatctaatctgaagattgtgcgcatggatcggaccgcaggctgcgttacagggggcgaggagatctacctgttatgcgataaagtgcagaaggatgatatccagatccgattttatgaagaagaagaaaacggcggcgtgtgggagggtttcggggatttctcaccaaccgatgttcaccgccagtttgcgatcgttttcaaaacgcctaagtataaagatattaacataaccaagccggcctcagtgtttgtccagctgcgaagaaaatcggacttggaaacctcagagcctaagcccttcctgtattatcccgaaatcaaggataaggaggaggtgcagaggaagcgccagaagttaatgccaaacttcagcgatagttttgggggaggcagcggcgcaggggctgggggcggaggtatgtttggatccggcggcggggggggggggacagggtctactggtccgggctattcatttccgcactatggatttcccacttatggaggaattaccttccatcccggaactacgaagagtaatgccggcatgaaacatggcacaatggacaccgaatccaaaaaagatcctgagggctgtgataagtcagatgataaaaataccgtgaatttatttggtaaagtgatagagacgaccgagcaggaccaggagcctagcgaagccaccgttgggaacggagaggtgaccctcacttacgcgacggggacaaaggaggaaagcgccggcgtgcaagacaacctgtttctggaaaaggctatgcagctggccaagcgtcacgcaaacgcattgtttgattacgccgtgaccggggacgtgaaaatgctcctggctgttcaacggcatctaactgctgtgcaggacgagaatggggatagcgtgctgcacctggccataatccatcttcatagccagctcgtacgcgatctgctggaggttacctctggtctgatctcagacgacatcatcaatatgcgcaatgacctctaccaaactcctctccacttagccgttattaccaagcaggaagacgtcgtggaggacttacttcgtgccggtgccgacctctcccttctagatcgactcggaaattccgtgcttcacctcgccgcgaaagagggccacgataaggttttgtctattcttctgaagcacaagaaagccgccctgctgttggaccatcccaacggtgatgggctgaatgccatccatctcgccatgatgtcaaatagcctcccatgcctactgctgctcgtggccgctggcgccgatgtgaacgcccaagagcaaaaatcaggaagaactgccctacatctagccgtggagcatgacaatattagtttggcaggttgccttcttctggagggggacgctcatgtggactccacaacctatgatggcacaaccccactccatatagcagctgggagggggtccacacgcctggcggctctgttgaaggcagcgggggccgacccactggttgagaactttgagccactatatgacttggatgattcctgggaaaacgcaggggaagatgaaggagtcgtgcccggaactacacctctagatatggcgacatcatggcaggtgtttgacattctcaatggaaagccctacgagccagagtttacttcagacgacctgctcgctcagggagacatgaagcagctcgccgaagacgtgaagttgcagctatataagctgctagagattcctgaccctgataaaaattgggctactctagcccagaagctgggcttgggcatcttgaataacgcctttagattatccccagcaccatccaaaactctgatggataattatgaggtttctgggggaaccgtgagggaattagtggaggcgctgcgccagatggggtacaccgaggccatcgaggtgatacaggccgcatcctctcccgtcaaaactacctcacaggcccactctctgcccctcagtcccgcatccaccaggcagcagatagatgagttaagagactctgattcagtgtgtgattctggggtagagacctcttttcgcaaactgtccttcactgaaagcctgacatcaggagctagtctcttgacactgaataaaatgcctcatgattatggtcaggagggacctctcgaaggcaagatctag

SEQ ID NO: 25396 - DNA, 2907 bp, Artificial Sequence
  Description of Artificial Sequence: Synthetic coding sequence
atggccgaggacgacccctacctgggccggcccgagcagatgttccatctcgacccgtctctcacacacacaatctttaatccagaggtgtttcagccacagatggcgctcccgaccgatgggccctatctgcaaattttagaacagcctaagcagcggggctttcgattcaggtatgtctgtgaaggcccaagccacggcggccttcctggcgcttcctctgaaaagaacaagaaaagctacccacaggtcaagatctgcaactacgtggggccagctaaagttatcgttcagctggtcactaatgggaagaatattcatctgcacgcacactctctggtggggaagcactgcgaggatggcatctgcactgtgaccgccggacccaaggatatggtggtgggattcgcgaatctggggattctgcacgtaaccaaaaagaaagtttttgaaacattagaagcgagaatgactgaggcttgcattagggggtataatcctggactccttgtacacccagacctggcatacctgcaggctgagggcgggggcgaccgccaactgggagatagggagaaagagctcatacgtcaggccgccctccagcaaaccaaggagatggatctctcggtcgtgaggctgatgttcaccgctttccttccagacagcaccggctcttttacacgacgcctggagcccgtcgttagtgatgcgatctatgactcaaaagctcccaatgcctccaacctaaaaatcgtgaggatggacaggaccgccggctgtgtgacaggtggagaagagatttacctactctgtgacaaggtgcagaaggatgatatacaaatcaggttctatgaagaagaagagaacggaggcgtttgggagggcttcggcgacttttccccaacggatgttcacaggcagttcgcaattgtgtttaagactcctaagtacaaagatattaatattaccaaacctgcaagtgtatttgtgcagctgagacggaaatccgatttggagacctccgaaccaaaaccttttctctattaccctgagattaaagacaaggaagaagtgcagagaaagcgtcagaagctcatgccaaatttcagcgattctttcggagggggatcaggtgctggggccggcggtggcggcatgtttggtagcggaggcggtggtggaggtacgggctccacgggacccgggtatagctttccccactatggtttccccacttacggaggcatcacattccatccaggtactactaagagcaatgccggaatgaagcatggaactatggatacagagtctaaaaaggaccctgagggttgtgataagtcagacgacaagaacaccgttaatctttttgggaaggtgatcgagactaccgagcaggaccaggaaccttctgaagccaccgtgggaaatggagaggtgaccttgacgtacgccaccggaaccaaagaagagagcgccggtgtacaggacaatctgtttcttgaaaaggccatgcagttggccaagcgccatgccaacgctctgttcgattatgccgtaaccggcgatgtgaaaatgctcctcgcagttcagcgccatctgactgccgtccaggacgaaaacggggattccgtgcttcacctggctattattcatcttcactctcagttagtgcgtgacttactggaagtgacatccggtctgattagtgatgatatcatcaatatgcgaaacgacctttatcagacaccactgcacctggctgttatcactaagcaggaagatgtcgtcgaggatctactgcgggcaggagccgatttgagcctgttggataggcttgggaactccgtccttcatctggcagcgaaagaggggcacgacaaggtcttaagcattctgctgaaacataagaaagcggccttgctccttgaccacccaaatggcgacggattgaacgccatacacctcgccatgatgtccaattcactcccttgccttttgcttttagtcgccgctggtgccgatgtcaacgcccaagagcagaagtcaggaagaacggcactccatctcgccgttgaacatgacaatatctcacttgccggctgccttttattggaaggggacgcccacgtagactctaccacttatgacggcacaaccccccttcacatcgccgctggtcgaggctcaactaggttagctgccctgctcaaggccgctggcgctgatccgctagtagagaactttgaacctctgtatgacctggacgactcctgggaaaacgccggggaggatgagggcgtcgtcccagggaccacgccactcgacatggctacaagctggcaggtcttcgacatccttaatgggaaaccttatgagccagaattcacgtccgacgaccttctggcacaaggggatatgaagcaactagcggaggacgtgaaacttcagctttacaagctgctggaaatccctgatcctgacaaaaattgggccacactcgcccagaaactcggactcggaatcctgaataacgctttcaggctcagtcctgccccatcaaaaaccctcatggataattacgaagtctctggggggaccgtgcgcgagctcgtggaagccctcagacagatggggtataccgaagcaatcgaagtgatacaggccgccagctccccagttaaaacaacaagccaagcccatagccttcccctgagcccagccagcacccggcaacagatcgacgagttacgagacagcgactctgtctgcgacagtggggtcgagacatctttccgcaaactcagttttacagagtcgctcaccagcggcgctagccttctcactctaaataagatgccccacgactacggacaggaggggcccctggagggaaaaatctag

SEQ ID NO: 25397 - DNA, 438 bp, Artificial Sequence
  Description of Artificial Sequence: Synthetic coding sequence
atggccgaggacgacccctacctgggccggcccgagcagatgttccatttggacccttcccttacccataccattttcaacccggaggtctttcagccgcagatggccttaccgactgcggatggcccctacctccagattttagaacaacctaaacagcgcggcttcagatttagatacgtgtgcgagggcccctctcacggaggcctcccaggtgccagttccgaaaagaacaagaagagctaccctcaggtgaagatctgtaattacgtgggacccgcgaaagtaattgtgcagcttgtgacgaatgggaagaatatccatctgcacgcccacagtcttgtgggtaaacactgtgaagatggtatttgcaccgttaccgcaggtcctaaggatatggttgttggcttcgcaaacttgggcatactgcatgtatag

SEQ ID NO: 25398 - DNA, 225 bp, Artificial Sequence
  Description of Artificial Sequence: Synthetic coding sequence
atgaagcggaccaccagcttccggatggccgaggacgacccctacctgggcaggccggaacaaatgtttcatctggacccttctcttacgcacaccatctttaatcctgaagtctttcaaccccagatggcccttcccaccgatgggccttatcttcagattctcgaacaaccaaagcagaggggattcaggtttagatatgtttgcgagggccccagccattag

SEQ ID NO: 25399 - DNA, 1923 bp, Artificial Sequence
  Description of Artificial Sequence: Synthetic coding sequence
atggccgccctgtaccggcccggcctgcggctgaactggcacggcctctctccccttggatggccaagttgtagaagtattcagacccttcgagtgctgtccggcgatctcggccaactgcccaccggtatccgagacttcgttgagcactctgctcggctgtgtcagcccgaggggattcatatttgtgacggaactgaagccgagaacacagccactcttacattactggaacagcagggtctcattaggaaactgcccaaatataacaactgctggctggcccgaactgacccaaaggacgtggcacgcgtcgagagcaagacagtgattgtcacaccaagtcagagggacaccgtccagctcccacccgggggggcacggggccagctcggaaattggatgtccccagccgacttccagcgggccgtcgacgagaggttcccaggctgcatgcaaggcaggactatgtacgtcctgccgttcagcatgggccccgtgggaagcccattatccaggataggagttcagctgacagacagcgcctacgtcgttgcgagcatgcggataatgacccgcctgggaacaccagtacttcaagccctgggagacggggattttgtgaagtgcctacacagtgtgggacagccactgaccgggcaaggggagcccgttagtcagtggccttgtaacccggagaaaactctgatcggacatgttccggatcagcgggaaatcatcagcttcgggtcaggatatggcggtaatagtcttcttgggaagaagtgtttcgcccttcggatcgcctccagactggccagagacgaggggtggctggctgagcacatgctgattcttgggattacctctcccgccggaaaaaaaaggtacgtagctgccgccttcccatcggcctgtggcaagaccaatcttgccatgatgcggccagctcttccgggatggaaggtcgaatgtgtcggcgatgacatagcctggatgcgttttgattctgaggggcgattgcgagctatcaacccagaaaacggattctttggtgtggccccaggcactagcgcgactaccaacccgaatgcaatggccacgatccagagtaatacaatcttcaccaacgtcgcagaaaccagcgacggaggcgtgtactgggagggcatcgaccaaccgctgcctcctggcgtcactgtgaccagctggttaggtaagccctggaagcccggggataaggagccctgcgcgcaccctaacagtaggttttgcgctcctgcacgccaatgcccaatcatggaccccgcttgggaggctccagagggtgttcccatcgacgctatcatcttcggcggtcgaagacccaagggagtgcctctcgtctatgaggcctttaactggagacatggcgtgttcgtgggatccgcaatgaggagcgagagcactgcagcagccgagcataaggggaagataattatgcacgacccttttgcaatgcgaccgttctttggctacaactttggccattacttagagcattggctgtcgatggagggacgaaagggcgcacaactgccccggatctttcatgtgaactggttccgtcgtgacgaggcaggtcattttctttggcccgggtttggcgagaacgcccgcgtcctggactggatttgccgccgattggagggcgaggacagtgcccgggaaacacccattggcctcgtgccaaaggagggtgcgttggacctgagcggcctacgcgctatcgataccacccaactgttcagcctgccgaaagatttttgggagcaggaggtaagagacatccgctcatatttaactgagcaggtaaatcaggaccttcccaaggaggtccttgctgaactggaggcactggagcggagggttcataagatgtag

SEQ ID NO: 25400 - DNA, 3477 bp, Artificial Sequence
  Description of Artificial Sequence: Synthetic coding sequence
atgacccacggcgaggagctgggcagcgacgtgcaccaggacagcattgtcctcacgtacctggaaggtcttctgatgcatcaagctgctgggggcagcgggacagcagttgacaaaaaaagcgcaggccacaatgaggaagaccagaattttaacatctccggcagtgcatttcccacgtgccagtccaacggtcccgtgcttaatacccacacatatcagggcagtgggatgctgcatttaaagaaagccaggctgcttcagagttccgaggattggaatgccgcgaagaggaaaagactttcggactcaattatgaacctaaacgtaaagaaagaagccctgctcgctggtatggtcgattcggtgcccaaaggaaagcaggattccactttgctcgcctctctgctccagtccttcagctccagactccagacagtagccctgtcccagcagatccgtcagagtctgaaagagcagggttacgccctttcgcacgatagtctgaaggtagaaaaagacttgagatgttatggagtagcttcttcccatctcaagaccttgcttaagaagagcaaagtaaaagatcagaaacctgataccaatctgccagatgttacaaagaacctgatcagagatagatttgccgagtctccccaccatgtgggtcagtcaggaaccaaggtgatgtctgaacccctatcttgcgccgccaggctgcaggcagtggccagcatggtagagaaacgagcttcccctgcgaccagtccaaagccctccgtcgcctgttctcagctcgcgctactgttgtcttccgaggcccacctacaacaatatagtagagaacacgcccttaagacacagaacgcaaaccaggctgcatccgagaggctagctgccatggcccggctgcaagaaaatggacagaaagacgtcggctcttaccaactccccaaaggcatgtcttcccacttgaatgggcaagcgaggacctcaagctccaaactcatggcatcaaaaagcagcgccactgtgtttcagaatcctatgggcatcatcccctcttccccgaagaacgctggctacaaaaacagcttagagcggaacaatatcaaacaggctgcgaacaactctctgttgctccaccttttgaaaagccagactattcccaaaccgatgaatggccactcccattctgaaaggggcagtattttcgaggagtcttctacccccactacgatcgacgagtacagcgataacaatccgtctttcacggatgatagctccggcgacgaaagtagctacagcaactgcgtaccaatcgacctgtcttgtaaacatagaacggagaaatccgagagtgaccagccagtctcactcgacaattttactcagtctttgctgaacacatgggacccgaaggtgcctgacgtggacattaaggaggaccaggacaccagcaaaaatagtaagctaaactcacaccagaaggtgacactgctacagctgctccttggccacaaaaatgaagagaatgtggagaagaacacatctccgcaaggagtgcacaatgatgtcagtaagttcaacacccagaactacgcccgcacaagtgtcattgagagtcccagcactaacaggaccacgcccgtgtcaacgccccccctgctcacttcaagcaaagctggcagcccaatcaatctgtcacagcatagcctggtgatcaaatggaacagcccaccttatgtatgctccacacagagcgaaaagctcactaataccgcctcaaatcactctatggacctcactaagtccaaggatccccccggcgagaaacctgctcagaatgagggagcccagaacagcgcaaccttctctgctagcaaattgctgcagaacctcgcccagtgtgggatgcaaagcagcatgtccgtcgaagaacagcgcccttcaaagcaactgctcactgggaacactgacaagccaataggaatgatcgaccgcctgaacagtcccctcctctcaaataagacaaatgcagtcgaggagaataaagcatttagtagccagccaacaggccctgaacctggcctgtccgggtcagagattgaaaatcttctggaacggcgtaccgttctgcagctgctgctgggaaatcctaacaaaggaaaaagcgaaaaaaaggagaaaaccccgctcagagatgaaagtacccaagagcatagcgaaagagctctgtctgagcagattcttatggtcaagattaagtccgaaccttgcgacgacctgcaaatccccaacactaacgtacatctgtcccacgatgccaaatctgctccttttctgggaatggcaccggccgtgcagcgctccgcccctgccctcccggtctccgaggactttaagagtgaaccagtgtcgccccaggatttctcattctccaaaaacgggctgctgtcgagactgctgcgacagaaccaggacagttacctggcagacgactccgataggagccacaggaacaatgagatggcactgttagagagcaagaatttgtgtatggtcccgaaaaagcgaaaactgtacacggagccccttgaaaacccattcaagaaaatgaaaaataatattgtggacgccgccaacaaccactcagcccccgaggtgctgtacgggtctctgctgaaccaggaagagctgaaattttcccggaatgacctggagtttaaataccccgctggtcatggctccgccagcgaatcagaacacaggtcttgggctcgcgaatcaaagtctttcaatgtcctgaagcagctgctgttgagtgaaaactgcgtgcgggacctctctccgcataggagcaactccgtagcagacagtaagaagaaaggccacaaaaacaacgttacgaatagcaaaccggaattctctatcagtagcctcaacggcttaatgtatagctctacgcaacctagcagttgtatggataaccgcacgttcagctaccctggcgtggttaaaaccccagtgtctccaacattccctgagcacctgggctgtgcggggtctcgtcctgaatctgggctcttgaacggctgctccatgccaagtgaaaaaggcccgatcaagtgggtcatcacggatgcagaaaagaatgagtatgagaaagacagtccacgactgacgaaaacgaatcccatcttatactatatgctgcagaagggggggaactcagtgactagtcgggagacacaagataaggacatctggcgcgaagcatctagcgccgaatccgtgagtcaggtgaccgcgaaagaggaactgctgccaacagccgaaacaaaggcctctttctttaatctgcgctccccttacaatagccacatggggaacaacgcctcgcgcccacattccgcgaacggagaggtctatggcctgttagggtctgtgctcactatcaaaaaggagtctgagtag

SEQ ID NO: 25401 - DNA, 3477 bp, Artificial Sequence
  Description of Artificial Sequence: Synthetic coding sequence
atgacccacggcgaggagctgggcagcgacgtgcaccaggacagcatcgtgttgacatacttggagggattgctgatgcatcaggccgctgggggaagcggtaccgcagttgataaaaagtctgccggtcataacgaggaggatcagaatttcaatataagtggttccgcattcccaacttgccagtctaatgggcctgtcctcaatacccacacttatcagggtagtggcatgctgcatttgaaaaaggcacgccttctacagtccagtgaggattggaacgctgctaagagaaagagactctctgactccatcatgaaccttaatgtgaaaaaggaggccttgctggcaggaatggtggattctgtgcccaagggcaaacaggactctaccctcctggctagtctgcttcagagctttagctcccgattgcagacagtggcactgtctcaacagattcgccagagcctcaaagagcagggttacgcgttgagtcatgactctttaaaagttgaaaaagatctgaggtgctacggtgtggcttccagccatcttaaaaccctcctgaagaagagcaaggttaaggatcagaagcccgacactaacctccccgacgtgactaagaacttgatccgagaccgctttgcggaaagcccccaccacgtgggacaaagcgggacaaaagtgatgagtgagcccctctcctgtgccgctagattgcaggccgtggcctcgatggtcgaaaagagagcatcccccgcaaccagtcctaagcccagtgtggcttgttcccaactcgcccttctgttgtcttctgaggcacaccttcaacaatattctagagaacatgcgcttaagacacagaacgcgaatcaggccgcgtcagagaggctcgcggccatggcccgcctgcaggagaacgggcaaaaggacgtgggatcgtaccagctccccaaaggcatgtcatcccatctgaacgggcaggcccggacttcatcatcaaagctgatggcttctaagtccagtgccacagtcttccagaaccctatgggcatcattccatctagtccgaaaaatgccggctacaagaacagtctggaacggaataacatcaagcaggcggctaacaactctctccttctgcaccttctcaaatcacagactattcccaagcccatgaatggtcatagccactcagagcggggatctatcttcgaagaatcatccacccccaccactatagatgagtatagcgataacaacccgtcgttcacggacgattcctccggcgacgagtcgagctattcaaactgcgttcctattgacctgagctgtaagcacagaactgagaaatcagagtccgatcagccagtatccctggacaactttacccagagcctcctgaacacctgggatcccaaggtgccggacgtcgatataaaggaggaccaagacacctccaaaaattccaaattgaacagtcatcagaaagtgaccctattgcagctgctattgggtcacaaaaacgaagagaatgtggagaagaatacaagtccacaaggcgttcataatgatgtttccaaatttaacacccagaactacgctaggacgtccgttatagagagtccctccactaatcgcacgacccccgtgtctactccaccactgctaactagcagcaaggcaggaagccctatcaatctgtcacaacactcactggttatcaaatggaatagccctccttatgtgtgttctacccaatccgaaaagctcaccaacaccgctagcaatcattcgatggatcttacaaaatctaaagacccacccggcgagaagccggctcagaacgaaggggctcagaactccgccacattcagcgcatcaaaactcctccaaaacctggctcagtgtggaatgcagagctcaatgtcagtggaggagcagcgtccgtctaagcagctgctcacaggaaataccgacaaaccaatcggaatgattgatcgcctgaacagtcctctgctcagcaacaagactaatgccgtggaggaaaataaagccttcagctcacaacctacaggtcctgaacccggcctttctgggagtgagattgagaaccttctggaacgtcgtacagtcttacagctgctacttggtaacccaaataaaggtaagtctgagaaaaaggaaaaaacacccttgcgcgacgaaagcacccaggagcacagcgaacgcgctctgagcgaacagatcttaatggtgaagatcaagagcgagccctgcgatgatctgcagatacctaatacgaacgtgcatctatcccacgatgcaaagtccgcccctttcctggggatggcccccgccgtgcaaagatccgcacctgcactgcctgtgtcagaagactttaagagtgagccagtaagcccacaagattttagcttttccaaaaacgggctactctcccgccttttacgacaaaaccaagattcttaccttgccgatgatagcgatcggtctcatcgcaacaatgagatggccctgcttgagtctaaaaatctgtgcatggtgccgaaaaaacgcaagctgtataccgagccactcgagaacccctttaaaaagatgaaaaacaatatcgtggatgcggccaataatcattctgccccggaagtgttgtatggctccttgttaaatcaggaggaactcaaattcagccgaaacgatcttgaatttaagtatcctgccggacacggcagtgctagtgaaagcgaacatcggagctgggcaagggagagcaaatcattcaatgtgctgaaacagctgctcttgagcgagaactgtgtgcgagatttatctccccatcgatccaattcagtagccgattctaaaaaaaaggggcataagaacaatgtcaccaattcgaagccagagttcagtatttcaagtctcaacgggcttatgtactcttctacacagccaagttcatgcatggacaatcggaccttttcgtaccctggggtggtgaagacgcccgtgtcacccacattccccgagcacctgggctgtgcggggagccggcccgagtcgggcctgctgaacggctgctccatgcccagcgagaaaggaccaattaaatgggtcattactgacgcagagaagaatgagtatgaaaaggactctccccgtcttactaagacaaacccaatactgtattatatgcttcaaaaggggggcaactctgtcacaagtagggaaacccaggacaaggatatttggcgggaagctagctccgcagagtccgtatcacaagtaactgctaaggaagagctgcttcccaccgctgaaacgaaagctagctttttcaatttgcggagcccttacaatagccacatgggtaataacgcgagcaggccgcattcggctaatggggaggtctacggtcttctcggatcggtgctaacaattaaaaaagagtcagagtag

SEQ ID NO: 25402 - DNA, 3477 bp, Artificial Sequence
  Description of Artificial Sequence: Synthetic coding sequence
atgacccacggcgaggagctgggcagcgacgtgcaccaggacagcattgtgcttacgtacctggaaggcttgctcatgcatcaggcagccggaggatctggcactgccgtcgataaaaagagtgccgggcataacgaggaagatcagaattttaatataagcggcagcgccttccccacatgccagtccaacggcccagtgttgaacacacacacgtaccagggttccggtatgcttcaccttaagaaggctagactgcttcagagcagcgaggattggaacgcagctaagcgcaagaggctgtcagattccatcatgaatctgaatgtgaaaaaggaggcattgctggcgggaatggtggactcggtgcccaaaggaaagcaagactctacgctcttggcaagcctcctgcagtccttctcaagtcgtctgcagacagtggccctgagccagcagattcgacaatcccttaaagaacagggctacgcactttcccatgactcccttaaggtggagaaggatctccgatgctacggcgttgcaagcagccacctgaagaccttgctgaagaagtcaaaagtaaaggatcaaaagccagataccaatctcccagacgtaaccaaaaatctcatcagggacagattcgccgaatccccacaccacgtaggacaatcaggaacaaaggtcatgtccgagcccctgtcgtgcgccgctcgccttcaagccgtggcctccatggttgagaagcgcgcatctccagctacctctccaaagccgtcagtcgcttgttcccaactggctttattactgtcatccgaggcacatctgcagcagtacagtagagagcatgccctcaagacacagaacgctaatcaggcagctagtgaaagactggctgctatggctcggcttcaggaaaacggccaaaaggatgtgggctcgtaccagctgccaaaaggcatgtcgtcacatctgaacggacaggcacgaactagctcctccaagctgatggcatctaagagctcagctacggtattccagaacccgatgggcatcattccatcatcccctaagaacgccggatacaaaaactccctggagagaaacaacattaaacaagccgccaacaactctctgttgcttcacctgctcaaatcacaaaccattcctaaacccatgaatggacactcacattccgaaagagggagcattttcgaggagtctagtacacccaccactatcgacgagtactccgataacaacccgagctttactgatgactcatcaggcgacgaatcatcttactcgaactgcgttcccatcgacctttcctgcaaacatcgcaccgaaaaatccgagtcggatcagcccgtgtctctggacaacttcactcagagcttgctgaacacatgggaccctaaagtaccagacgtggatataaaagaagaccaagacacgtccaagaattccaagctcaactcccaccagaaagtcacactgttgcagctgcttctgggacacaaaaacgaggagaacgtagaaaaaaacacaagcccccagggcgtgcataatgatgtcagtaaattcaacacccagaactatgctcgtacctcagtgattgagtccccatctacgaataggactacacccgttagtacgcccccgcttttaacatcaagcaaagctggcagtccaatcaacctgtcacagcatagcctggtgattaaatggaactctccaccatacgtctgcagtacccagtcagagaagctgaccaatacggcatccaatcactcaatggacctgaccaaatccaaggatcctcctggcgagaagcccgcccaaaacgaaggcgcgcagaacagcgcaaccttctccgcatctaagctgctccagaatttggctcagtgtggaatgcagtcctccatgagcgtcgaggaacagaggccatctaaacagctgctgacaggcaatacagacaaaccaatcgggatgatcgaccggctcaatagcccactcctgtcgaataagaccaacgccgtcgaggaaaacaaggcattcagtagccagcctacagggcctgagcctgggctctctgggtcggagatcgaaaatttgttggagagacgcacagtgctacagctgctgctcggaaaccctaacaaaggcaagtcggagaaaaaggagaagacgcccctgcgtgatgaatccacacaggagcactccgaaagggctctatccgagcagatactaatggtcaagatcaaaagcgagccatgcgatgatcttcagatccctaacaccaatgttcatctgagtcacgacgccaagtctgctccttttctcgggatggcacctgctgtccagcggtctgctcccgcccttccagtaagtgaggatttcaagagcgagcccgtgagtccacaagattttagttttagcaaaaatggcctgctgagcaggctgctgcgccagaatcaggatagctacctggctgacgattcagaccgaagccaccgaaacaatgaaatggccttgctggaatctaagaatttgtgcatggtccctaaaaaaagaaagctgtacacagaacctttagagaatcccttcaaaaagatgaagaacaatattgtcgatgctgcaaacaaccattctgcgccagaggtgctttatgggagcctgttaaatcaggaggaattaaagtttagccgaaatgatctcgaattcaagtacccagccggtcacgggagcgcctccgagtcagaacataggagctgggctagggaaagcaaatctttcaatgttctcaaacagttgttgctttctgaaaactgcgtgcgggacctttccccacatcggtccaacagcgtggcagacagtaagaaaaaaggccacaagaataacgttactaactctaaaccggagtttagcatctcttcactaaacggccttatgtactcctccacccagccctctagctgcatggacaacaggaccttttcatatccaggggtggtgaaaactccagtgagcccaaccttccctgagcatcttggatgcgctggctctcggccggagtctggcctactgaatgggtgtagcatgccttccgagaaggggcctattaaatgggttatcactgatgccgagaaaaatgagtacgaaaaggattccccacgtctgaccaagacaaaccctattctgtattacatgctccagaaaggcggtaacagcgtgacctctcgcgaaacccaggataaagatatctggcgtgaggcctcctcggcggagtctgttagccaggtgacagcaaaggaggaacttttgccaacggcagagaccaaggctagcttcttcaacctcaggtctccctacaacagtcacatggggaacaacgcttccaggccgcattcggctaatggggaggtctatggtcttcttggctctgttttgacgatcaagaaggaaagcgaatag

SEQ ID NO: 25403 - DNA, 201 bp, Artificial Sequence
  Description of Artificial Sequence: Synthetic coding sequence
atgacccacggcgaggagctgggcagcgacgtgcaccaggacagcatcgtattaacctacttggagggcttattgatgcaccaggcagcaggaggatccgggacagcggttgacaagaagagcgctggacataatgaggaggatcaaaacttcaatatttctgggagtgccttcccaacgtgccagtcaaacggcccgtag

SEQ ID NO: 25404 - DNA, 4176 bp, Artificial Sequence
  Description of Artificial Sequence: Synthetic coding sequence
atgcccagcagcctgctgggcgccgccatgcccgccagcaccagcgccgctgcacttcaggaagcgttggaaaatgccggaaggcttattgatcgccagctgcaggaggaccgtatgtatcccgatctctctgagctacttatggtttctgcgcccaacaaccccaccgtcagcggaatgagtgacatggattatcctctgcagggaccgggcctcctctcggtacctaatctccctgagatcagttctattaggagagtgccactaccacccgagctagtggaacagttcggtcatatgcagtgcaactgtatgatgggtgtgttcccccctattagccgagcctggctcaccatcgacagcgacatcttcatgtggaactatgaggatggcggagatcttgcttactttgacggactttcagagacgatccttgcggtgggtcttgtcaaaccaaaggcaggcatatttcagccccatgtgcgccatctcctggtcctggccacgccagtcgacatagtgatcctggggttatcttatgctaacctgcaaactggaagcggcgtcctgaatgattctctgtcaggaggtatgcaactgctccctgatcccctgtactccctccctaccgataacacttatttattgaccataacaagtacggataacgggagaatcttcctggctggcaaagacgggtgcttgtacgaagttgcctaccaggcggaggccggatggttcagtcagagatgccggaaaatcaaccatagcaagtcttccctttccttccttgtcccctctttgctccaattcacattctcagaagacgatcccatcctgcagattgccattgataacagtagaaacatcctttacacgagaagtgagaagggtgtgatccaagtatacgatctgggccaggacggccagggcatgtcgagagtcgcatcggtgtcacagaatgcaattgtatctgccgcaggtaatatcgctagaaccatagatagaagtgtttttaaacctattgtacagatcgctgtgatcgaaaatagcgaatcacttgactgccagctgttagctgttacacacgcaggcgtgcgactctatttcagcacctgtcctttccggcagcctctggcgcggccaaacaccctgaccctggtgcatgtgaggttgccacctggattctctgcctcgtcaaccgtcgaaaagcctagcaaggttcatagggcactgtattccaaaggaatcctgctcatggcggcttctgaaaatgaggataacgatatcctgtggtgcgtgaatcacgatacgttccctttccagaaaccaatgatggagacccagatgaccgctggggtcgatggccatagctgggctctctctgccattgacgaactgaaggtggacaagattatcacccccttgaacaaggaccacataccaatcacagacagccccgtagttgttcagcaacatatgttgccgccaaagaaatttgtactgctctctgctcaaggatcgctgatgtttcataaattgcgccccgtcgaccaactccggcacctgctagtctctaacgtgggcggcgacggtgaagaaatcgagcgtttcttcaaactccatcaggaggatcaggcctgtgccacatgcctgatcctcgcctgcagcaccgcggcctgtgacagggaagtatccgcatgggcaactagagcattcttccgttatggcggcgaagcccaaatgaggtttcctactaccctgccaccaccgtccaatgtgggccctattctcgggtctccagtgtacagctcttcccccgtgcccagcggtagtccctaccctaacccttcctttcttggcaccccttcgcacggaatacagccccctgccatgagtaccccagtgtgcgcactgggcaaccccgccactcaagccaccaatatgtcatgcgttaccggccccgaaatcgtgtatagcggtaagcacaacggtatatgtatctatttctcacgcataatgggtaatatctgggatgcatcactggtggtcgagcgtattttcaagtcaggcaacagagaaatcaccgctattgaatcatccgtaccatgtcaactgttggagtcggtgctgcaggagcttaaaggacttcaagaattcctcgacagaaattctcagtttgccggcgggcctctgggtaatccgaatacaactgctaaggtccagcagcgactgattgggttcatgagacccgagaacggaaacccacagcaaatgcagcaggagctccagagaaagtttcatgaagcccagttaagcgagaaaatcagtctgcaagcgattcagcagctcgtgcgcaaatcttatcaagcactcgccctgtggaagctcctatgcgagcatcaatttaccatcatagttgctgagctccaaaaggaattgcaggagcaactgaagatcactaccttcaaggatctagtgatacgggacaaagagttaaccggtgctcttatcgccagtcttattaattgctacattcgggacaatgcagccgtggacgggatcagtctgcacctgcaggatatttgtccactcttgtacagcaccgatgatgccatttgttctaaagccaacgaactacttcagcgttcccgacaggttcagaataagaccgagaaagaaaggatgttgagagagagtctaaaggaataccagaaaatttccaatcaggttgacttgtccaatgtgtgcgcgcagtaccgccaggtgcggttctacgaaggggtggtagaactctcactgaccgctgccgaaaaaaaagacccgcagggcctgggcctacacttttataagcatggagaaccagaggaagacattgtaggtttacaagcatttcaggagagactaaacagctacaaatgcatcacagacacccttcaggagttggtgaaccagtctaaggccgcaccacagtcgccttccgtgcccaagaagccaggcccccctgtgctgtcctcagaccctaatatgctttccaacgaagaggctggacaccacttcgagcagatgctcaagctgtcacagcggagtaaggacgaactgtttagcatcgccctgtacaactggctgatccaagtggatcttgctgacaagctgcttcaggtggctagccccttcctcgaacctcatttagtgagaatggctaaggtggaccagaaccgcgtgaggtatatggatcttctttggcggtattacgaaaagaatagatccttttctaacgccgccagggtgttatctcgtctggccgatatgcactccacggaaatttccctccagcagagactggaatacatcgccagagccatcctctctgccaagtcctctacagccatttccagtatcgccgcagacggtgaatttctccacgaattagaggagaaaatggaggtagctcgcatccagctccagatacaggagacgctccagaggcagtattcacaccactcttcggtccaagacgctgtctctcagctcgactctgagctgatggatataacaaagctctacggggaattcgcggatccatttaagctggccgaatgtaagttagcaatcatacactgcgctgggtatagcgaccccattttggtgcaaacactgtggcaagatatcatcgaaaaggagctgtctgatagcgtgaccctgtcttcttcagacaggatgcacgcactgtccttaaagatcgtattgttgggtaagatatacgccggaacacctaggtttttcccccttgactttatcgtccaatttctggagcagcaggtatgcactctaaattgggacgtcggctttgttatccaaacgatgaatgagattggagtgcctctgccacgattgttagaggtgtacgaccagctatttaagagtagggaccctttttggaataggatgaaaaagcctcttcacctgttggattgcatacacgtgcttctgatcaggtacgtcgaaaatccaagtcaggtgctgaactgcgagcggaggcggttcaccaacctttgcctggacgcggtatgcgggtaccttgtagagctgcaatctatgtcatctagtgtcgctgtccaagctatcactggtaacttcaaatccctgcaggctaaactggaaagactgcactag

SEQ ID NO: 25405 - DNA, 2334 bp, Artificial Sequence
  Description of Artificial Sequence: Synthetic coding sequence
atggacagcaaggagagcctgacccccggccgggaggagaacccctcctctgtcctggcccaggaaaggggagatgtcatggatttttacaaaaccctgagaggtggcgctacagtcaaggtatctgcatctagtccttcacttgcggtagcttcacaatcggacagtaagcagaggcgcctgcttgtcgatttccccaagggctcagtgtctaacgctcagcagcctgatctcagcaaggccgtgagcctgtccatgggcttatatatgggagaaacagagaccaaggtgatggggaacgacctaggctttccccagcagggccagattagtctgtcttctggagagacagacttgaagctgcttgaggagtcaatcgccaacctaaaccggtcgacctcagtacccgagaaccctaaatcctccgcttcaaccgcggtctctgctgcccccactgagaaggagtttcctaagacacattctgacgtgtccagtgagcaacagcatcttaagggccaaacagggactaacggtggtaacgtgaagctgtacacaaccgaccagtcaacattcgatatcctacaggaccttgagttctcgagtggttcccccggtaaagagaccaatgagtcaccatggagaagcgacttgctgatagatgagaattgcctgttgagcccgctcgcaggcgaggacgactcattcctcctggagggaaattcaaatgaggattgcaaacccttaattctgcctgacactaaaccgaaaatcaaggataacggggacttggtgctaagcagtccatccaacgtgacgttacctcaagttaagaccgaaaaggaagactttatcgagttatgcactccaggcgtgataaagcaggaaaagctgggaactgtctattgtcaagcttcctttccaggcgctaacatcatcggtaacaagatgagcgccatatcagttcatggtgtgtctacttccggaggccagatgtaccactacgatatgaacacagcttctctttcccaacagcaggatcaaaagccgatcttcaatgttataccaccaattcccgttgggagcgaaaattggaataggtgccaagggtccggggatgataatctgaccagcttaggcacattgaacttccccgggcgtaccgtattttccaacggctatagcagtcccagtatgaggccggacgtaagcagccccccttcgagctcctctacagctacaacagggccccccccaaagctctgcttggtgtgttccgacgaagcatccggctgtcactatggcgtgctcacctgcggaagctgtaaagtgttcttcaaacgggctgtggaagggcaacacaattacctgtgtgccggccggaacgattgtatcatagacaaaattaggaggaagaattgccctgcatgccgatatcggaagtgtctgcaggccggcatgaaccttgaggctcgtaagaccaaaaagaagatcaaagggatacagcaggccaccactggagtatcccaggaaacctccgagaaccctggaaacaagacaattgtgccagcgactctgccccagctgacgcctaccctggtatccctactagaggtgatcgagcccgaggtgctctacgcaggctacgattcaagcgtgcctgattcaacctggagaatcatgacaacgctcaacatgctggggggccggcaggttatagccgccgtgaagtgggcaaaggcaatcccaggcttccgaaatctgcatctggacgatcaaatgaccctgctccagtactcctggatgtttcttatggcatttgctctcgggtggagatcataccgtcaaagctccgccaaccttctttgttttgcccctgatctcattatcaatgagcagcgcatgaccctcccatgcatgtatgatcaatgtaagcatatgctgtatgtgagtagtgagttgcaccgcttgcaagttagctatgaggagtatctctgtatgaagactctactgctgttgtcaagcgttcccaaggacgggctgaagtcacaggaactgttcgatgagatcaggatgacatacatcaaggagctgggaaaggcaatcgtgaagcgcgaggggaactctagtcagaactggcagcgcttctaccagttgactaagctgttggactccatgcatgaggtggtggagaacttgcttaattactgctttcagacattcctggacaaaacaatgtccattgaattccctgaaatgctggccgagataataaccaatcaaatccccaagtattcgaacggcaacatcaagaagctcctgtttcatcaaaagtag

SEQ ID NO: 25406 - DNA, 1782 bp, Artificial Sequence
  Description of Artificial Sequence: Synthetic coding sequence
atggacagcaaggagagcctgacccccggccgggaggagaaccccagctcagtactagcccaagaaaggggagacgtgatggatttctacaaaactttacggggcggcgctaccgtgaaggtgtccgcctcaagccccagcctggcggtggcttcccagtcagacagtaagcagagacgcctgttagtcgacttccctaaaggctcagtgtccaacgcccaacagccagatctctcgaaggctgtgtctctttctatgggcctctacatgggcgagaccgaaactaaagtgatgggtaacgacctgggattcccccagcaaggccaaataagcctgtcatccggcgaaactgacttaaagcttctcgaagagtcaattgcaaacttgaatcggtccacgagcgtgcctgaaaatcctaaatctagcgcatctacagccgtgagcgctgctcctacagagaaagaattccctaagacgcattcagacgtatcatcagagcagcagcaccttaaaggacagacggggaccaacggtggcaacgttaagctctatacgactgatcaaagcacttttgacatcctgcaagacctggaattttcaagtggaagcccaggaaaggaaaccaacgagtcgccttggaggagtgacctgctgattgatgagaactgtctgctctctccactggccggagaagatgattcctttttgttagaagggaactctaacgaggattgcaaacctttgatcttgcctgataccaagcccaagatcaaagacaatggagacctggtcctatcatcaccgagcaacgtaacccttcctcaagttaaaaccgagaaagaagatttcattgagctgtgtaccccgggcgtgatcaagcaagagaaactggggaccgtttactgccaggcctccttccccggtgccaacatcatcggtaataagatgagtgccatcagcgtgcacggtgtgtctacaagtgggggccagatgtatcactacgatatgaacacagccagcctctcgcagcagcaagaccaaaagcccatcttcaatgtcattccccctatccccgttggttcagagaattggaaccggtgccagggaagcggagatgacaaccttactagtctcgggacgctaaactttcccggtcgaaccgtgttctccaatggatatagctcaccctccatgcgcccagacgtgagtagccccccgagcagttcatccacagccaccaccggccccccgcctaagctatgtttggtctgctctgacgaggcaagcggttgtcattatggcgtgctgacatgcggatcttgtaaggtgtttttcaagcgcgcagttgagggtcagcacaactatttatgcgccgggcggaatgattgtattatcgataagatcaggcgtaaaaattgccccgcgtgtcggtacaggaagtgccttcaggctggtatgaatctggaagtggtgcccaaggacggcctgaaatcacaagaattatttgacgagatacggatgacctacattaaggaactgggaaaagccatagtgaagagagagggaaattcatctcagaattggcagaggttttaccagctcactaagctgttagatagtatgcacgaagtggttgaaaatcttctgaactattgctttcagacgttcctggacaaaaccatgtcaatagagttcccagaaatgctcgcagagattattaccaaccagataccaaaatacagcaacggaaatatcaaaaaactcctgttccaccagaagtag

SEQ ID NO: 25407 - DNA, 2334 bp, Artificial Sequence
  Description of Artificial Sequence: Synthetic coding sequence
atggacagcaaggagagcctgacccccggccgggaggagaaccccagctctgtattggcacaggagcggggcgacgtcatggatttctacaaaaccctgcggggtggggccacagttaaggtgagcgcctcctccccttcgctcgccgttgccagccaaagtgactccaagcagagacggctgcttgtcgacttcccaaaggggtctgtgtcaaacgctcagcagcctgatctgtccaaagccgtgtccctgtccatgggactttacatgggggagactgagacaaaggtcatgggaaatgatctaggatttccgcagcaagggcagatctcattgtcatcaggcgaaacggacctcaagctgctcgaggaatcgattgcaaaccttaacaggtcaacaagcgtgcctgagaatcccaagtctagcgccagcactgcggtgtcagccgcaccaaccgaaaaagagtttcctaaaacacattccgacgttagcagcgagcaacaacatctaaagggacagacggggaccaatggcggaaatgtcaagttgtataccactgatcagagcacatttgatattctccaagacctggagttttcatcagggagccctggaaaagaaactaacgaaagcccctggcggtccgacttattaatcgatgagaattgcctgctgtctcctctggccggagaagacgatagcttcctcctggaggggaacagtaatgaggattgtaagcctttgatcctgcccgacaccaaacccaagatcaaagacaatggcgaccttgttctctcaagtccatccaatgtgactctccctcaggtgaaaaccgagaaagaggactttatcgaactgtgcacgcctggagtcatcaaacaggagaaattgggcaccgtgtactgtcaagcctcttttccgggagccaatattatcgggaacaaaatgagtgcgatctctgtgcatggagtgtccacttccggaggacagatgtatcactacgacatgaacactgcatctttaagccagcaacaggaccagaaacctattttcaatgttatccctccaatccctgtggggtccgaaaactggaaccgttgtcagggcagtggcgatgataacctgaccagtttaggaaccctgaattttcctggacgaaccgtgttcagcaatggatacagctctccttcaatgcggccagacgtttcttctcccccaagttcaagcagtactgccactacaggtccgccgcccaaactgtgtttggtctgctcggatgaggccagtggttgccactatggggtgctgacctgcggttcgtgcaaagtgttctttaagcgggccgtagaaggccaacacaactatctgtgcgctggcaggaacgattgtatcatagacaagattcgaaggaagaactgtccagcctgtagatatagaaaatgtctgcaggcagggatgaatcttgaagcgcggaagacaaaaaagaagatcaaaggtatccagcaggcgacaactggggtttcacaggaaacttccgaaaaccccggcaacaaaacgatcgtccccgccacgctaccgcagttgaccccaactcttgtgtcactattggaagtcatcgaaccggaagtgctgtacgcaggctatgactcatccgtgccagattcaacatggcgtatcatgaccacgctgaacatgctgggcgggagacaggtgatcgctgccgtgaagtgggctaaagccatccctgggtttcgcaatctccatctggacgaccagatgactctgctgcagtactcctggatgttcttaatggctttcgccctcgggtggaggagttaccgccagtcttcagccaatttactgtgcttcgctccagatttaataataaatgagcagcggatgaccctcccctgcatgtacgatcagtgtaagcacatgctgtacgtcagttccgagctccaccggcttcaggtttcctacgaggagtatctgtgtatgaagaccctgctcctgctgagctctgtgcctaaagacgggcttaaaagccaggaactgttcgatgaaatccgcatgacatatatcaaggagcttggtaaagccatcgtaaagagagagggtaattcttctcagaactggcagcggttctatcagctgacaaagttgctggactcaatgcacgaagtcgtggaaaatctcctgaactactgtttccagaccttcttggacaaaaccatgtcgattgagttcccagaaatgctggctgaaatcatcacaaatcagatcccaaaatattccaacggaaacatcaagaaactgctgtttcaccaaaagtag

SEQ ID NO: 25408 - DNA, 2337 bp, Artificial Sequence
  Description of Artificial Sequence: Synthetic coding sequence
atggacagcaaggagagcctgacccccggccgggaggagaacccctctagcgtgttagctcaggaacggggtgacgttatggacttctataaaacactgcgcggcggggccacagtgaaagtctcagccagttccccatcccttgctgtcgcttcccaatccgactcgaagcagaggcgcctgctcgtggacttcccaaagggcagcgtatctaacgcccagcagcccgacctgtctaaggcggtaagcctgtcaatgggcctgtacatgggagaaacagagaccaaggtcatgggcaacgacttaggcttccctcagcagggtcagatcagcctgtcttccggcgagactgacctgaagcttctggaggaatccattgctaatctcaataggtctacatctgtgccagagaatcccaagtctagcgccagtactgcagtgagcgcggcacccacggagaaagagttccctaagactcacagcgacgttagcagcgagcaacagcacctgaagggccagactggcacgaacggcgggaacgtgaaactgtatacgaccgatcagtcgaccttcgacatcctgcaggatctggagtttagctcagggtccccgggcaaggagaccaatgaatctccttggaggagtgacctattgatcgacgaaaactgtttgttatcacctctggccggcgaggacgatagctttcttttggagggtaattcaaatgaggactgcaaacccctgattctacccgacactaagcctaagatcaaagataacggcgatctagttctttcatcgccttccaatgtgactctccctcaggtgaagaccgaaaaagaggacttcatagaactgtgcacccctggcgttattaaacaggagaaactggggacggtgtactgtcaagcctcctttcccggggccaatatcatcggaaacaagatgagcgccataagcgtgcacggggtgagcacttccggtggccaaatgtaccactacgacatgaataccgcttcactcagtcaacaacaggatcagaaaccgatcttcaatgttatacccccaatcccagtcgggagtgaaaattggaaccggtgccaaggttccggcgatgataacctgaccagcttaggtacactgaactttccgggtaggactgtcttttctaacgggtacagcagccccagcatgcgccccgacgtaagttcacctccctcaagcagctctaccgccaccacaggaccaccgccaaagctttgccttgtctgctccgacgaagcaagcgggtgtcattatggtgtgctcacctgcggatcttgtaaggtgttcttcaaacgtgcagtggaaggacgccagcacaactacctttgtgcaggtaggaacgattgtattattgataagatcagacgaaaaaattgcccagcctgcaggtatcgaaagtgcctgcaagccggcatgaaccttgaagctaggaagacgaagaagaaaatcaagggtatccagcaggctacaaccggcgtgagccaagaaacttccgaaaatcctggcaacaagactattgtgccagccaccctgccacagctgacacccaccttggtgtccctgctggaagtgattgagccagaggtgttgtatgctggatacgatagctccgtgccagactcaacatggcggattatgactacactcaacatgctggggggtcgccaggtaattgctgctgtcaaatgggccaaggccatccctggcttccggaacctccacctggacgaccagatgacgctgttgcaatattcctggatgtttctcatggcatttgccctcggatggagaagttacaggcagtcttcagctaacctgctgtgcttcgcacctgatctcatcataaacgagcagaggatgacactgccttgtatgtacgaccaatgtaagcacatgctttacgtgtccagtgagttgcaccggcttcaggtatcttacgaggagtatctttgcatgaagacactgctcttgctgtccagcgttcctaaggatggtctgaagtctcaggagttattcgatgagatccgaatgacctacattaaggaattggggaaggcgatcgttaagagagagggcaacagcagtcagaattggcagcggttttaccagctcacgaagctcctagactccatgcacgaagtggtcgaaaatctcctcaattattgcttccaaacattccttgacaagaccatgtctattgagttccctgagatgttagctgaaattattaccaatcagattcccaagtacagcaatgggaacatcaagaaattgttgtttcaccaaaagtag

SEQ ID NO: 25409 - DNA, 2229 bp, Artificial Sequence
  Description of Artificial Sequence: Synthetic coding sequence
atggacagcaaggagagcctgacccccggccgggaggagaacccctcatctgtccttgctcaagaaagaggggatgtcatggacttttataaaactcttcggggcggcgctactgttaaagtctccgcttcctcaccttctctggctgtagcgagccagtcagatagtaaacagcgcagattattggtggacttccctaagggctctgtgagtaacgcccagcagccggacctgtctaaagccgtgagcctgtccatggggttatacatgggagagactgagaccaaagtgatgggaaacgaccttgggtttccacagcagggccagatctccctgagctcaggagagacggatctgaagcttctggaagaaagcatcgcaaacctcaaccggtcaacgtccgtcccagagaacccaaagtcatcagccagtacggccgtgtcagcagcccctacagagaaagagtttcctaagactcatagcgatgttagctccgaacagcagcatctcaaaggccaaacgggtacaaacgggggaaatgtaaagttatatacaactgaccagtcgacgtttgacattctgcaggatctggaattttccagcgggagtcctggcaaggaaactaacgagagtccttggagaagcgacctccttattgacgaaaactgcttgctttctccgctggcgggtgaggacgattccttcctgctagagggtaattctaacgaggattgtaagccactcattctgccagacacaaagcctaagatcaaagataatggcgatcttgtgctgtctagcccaagcaacgttacactaccgcaagtcaagacagagaaagaggatttcatcgagctgtgtactcccggagtgattaaacaggagaagctgggaaccgtatactgccaggcatccttccccggtgccaatatcatcggaaacaaaatgagcgccatctcagtgcacggggtgagcacttcaggcggacaaatgtaccactatgatatgaacactgcgagcctgagtcagcagcaggatcagaaacctatctttaacgtaatacctccgattcctgtgggatctgagaactggaacagatgtcagggtagcggagacgataatctgacgagtctgggaacacttaactttcctggacggacagtcttcagcaatggctacagcagcccatcgatgcggcccgacgtctcatcacccccctcatcttcctccacagcaactaccgggcctccccctaaactttgtctggtgtgctccgacgaagcttcagggtgccactacggtgttctgacatgtggcagctgtaaggtcttctttaaaagggccgtggaaggtcaacacaattatctgtgcgcaggacgaaacgattgcattattgataagattcggaggaagaattgtcccgcctgccggtaccgtaagtgcctccaggccggcatgaacctggaggctagaaagacaaagaaaaaaataaaggggatccaacaggcaacaacaggtgtgtcgcaggagacctccgaaaacccaggaaacaaaacaatagtgcctgccaccctcccgcagctgacccccaccctggtgtctctcctcgaggtgatcgagccagaagtcctgtatgccggctacgattcctccgtgcccgattcaacatggcgcatcatgacgaccctcaacatgctgggtgggcgccaggtgattgccgcagttaagtgggctaaggccatcccggggttccgcaatctgcacttggacgaccaaatgaccttacttcaatacagctggatgtttctaatggcctttgctttagggtggagatcctatcggcaatcaagtgctaatctgctttgcttcgcccctgatctgatcattaatgaacagcggatgacgctgccatgcatgtatgaccaatgtaagcacatgctatacgtgtcttcagaattgcatcgattgcaggtgtcatacgaggaatatctctgtatgaagaccctgttactactgtcctccgtgcccaaggacggcctcaaaagccaagagctgttcgacgagatcagaatgacctacatcaaggagctgggcaaggccatcgttaagagggagggaaattccagccagaattggcagcggttttaccagctcactaaactgctcgattccatgcacgaaaatgtgatgtggctaaagccagaaagcacgagccacaccttgatctag

SEQ ID NO: 25410 - DNA, 1143 bp, Artificial Sequence
  Description of Artificial Sequence: Synthetic coding sequence
atgcggcccgacgtgagcagcccccccagcagcagcagcaccgccactacaggaccaccgccgaaactttgcttggtctgcagtgatgaggcaagcggatgccattacggcgttctgacatgtgggtcgtgtaaggtgttctttaagcgggccgtcgaggggcagcataactatctgtgcgccgggcgcaatgactgtatcattgataagatcagacgcaagaattgcccagcgtgtcggtaccgaaagtgtctccaggcaggcatgaatctagaggcacgcaagaccaaaaaaaagatcaaggggattcagcaggctacaacaggagtgtcacaggaaacctctgaaaatccaggaaacaagactattgttccggccacactgccccaactgacacctaccctggtgtcattactggaagtgatcgagccagaggtgctgtacgccggctacgattctagcgtccccgactccacatggcgcattatgacaacattaaatatgctcggcgggcgtcaggtcatagcagcggtgaagtgggcgaaggccattcccggcttccgcaaccttcacctcgacgatcaaatgaccctcttgcagtatagttggatgtttttgatggccttcgcccttgggtggcgaagttaccggcagagcagcgccaatctgctttgcttcgcaccggacctgatcattaacgaacaaaggatgaccttgccgtgcatgtacgaccagtgtaagcacatgctctatgtcagttccgagttacaccgccttcaagtcagctatgaggaatacctctgtatgaagacacttttacttctgagttcggtgccaaaggacggactaaaaagccaggagctttttgacgagatcagaatgacctacataaaggagctgggaaaggctatagttaagagagaggggaattcatcgcagaattggcagcgcttctatcagctgaccaagctcctggacagtatgcatgaggtggttgagaaccttttgaattactgcttccagaccttcctcgacaaaacaatgtccatagaattcccagaaatgctcgcagagattattactaaccagattccaaaatatagcaatggaaatatcaaaaaattgcttttccaccagaaatag

SEQ ID NO: 25411 - DNA, 2256 bp, Artificial Sequence
  Description of Artificial Sequence: Synthetic coding sequence
atggacagcaaggagagcctgacccccggccgggaggagaaccccagctcagtcctcgctcaggaacgtggcgatgtcatggacttctacaaaacgttgagaggtggggccacggtcaaggtttctgcctcaagccctagtcttgcagtggcttcccagagtgatagcaaacaacggagactcctggtagattttcctaagggaagtgtttccaatgcacagcaaccagatctcagtaaggcagtctccctctcaatgggcctgtacatgggcgagacagagacgaaagtgatggggaacgatttagggtttccgcaacaggggcagatttctctcagctcaggggagacggacctgaagcttctggaggaatctattgccaacctcaatcgctctacgtctgtgccagagaatcctaagtcgagtgccagcaccgccgtgagcgccgcccctaccgagaaggagttcccaaagactcacagtgacgtgagctccgagcaacaacatctcaaagggcaaactggcaccaatggtggaaacgtgaagctgtacactaccgatcagtcaactttcgatatcttgcaagatctggagttctctagcggaagccccgggaaggaaaccaacgagtcaccctggagaagcgatttgctcatcgatgagaactgcctcctgtctcccctagcaggtgaagatgactcttttctcctggagggcaattcaaatgaggactgtaagcctctcattctgcccgatactaaaccaaagatcaaggataatggcgatctggtgctatcttctccctcaaacgtgacccttccccaggttaagacagagaaggaagattttatagaactctgcactcccggagtgatcaagcaggaaaagctgggaaccgtgtattgccaggctagttttcccggagccaacatcattgcctccctctctcagcagcaggatcagaaacctattttcaatgtgattccgccgattcccgtggggagcgagaactggaacaggtgccagggctcaggagacgataatctgacatctcttggtactctgaacttccccgggcgcacagtgttttcaaatgggtattcgagcccctcaatgaggcccgatgtttcgagcccaccatcaagtagcagcactgcaacaaccgggccaccaccgaagctgtgcttggtgtgttcagacgaggcaagtggctgccattacggtgtcttaacgtgcggttcgtgtaaagtattttttaagcgggccgtagaaggtcagcacaactatctatgcgcagggcgcaacgattgcattatagacaagattcgcagaaagaactgcccagcgtgcagatatcgcaagtgtctccaggccggcatgaatttggaagctagaaagacgaagaagaaaattaaaggcattcaacaggctactactggagtgtcacaggaaacttccgagaaccctggaaacaagaccattgtaccagccaccctgccgcaactgacaccgacacttgtttctctactggaggtgatcgagccggaggtcctctatgctggatacgattctagcgttccagacagcacttggcggatcatgaccacgctcaacatgctgggagggcggcaggtgatcgcagccgtgaaatgggctaaggccatccccggatttcgcaatctccacttagacgatcagatgacactcctccagtatagttggatgtttttgatggcctttgcgttgggctggagatcatatcgacaatccagcgccaacctgctctgtttcgctccagacctcattataaacgaacagcgcatgacccttccctgcatgtacgaccagtgcaagcacatgctgtacgtatcatctgaactgcatcgtttgcaagttagctatgaggagtatctttgtatgaagactttattgttgctgagctccgtacccaaagacggactgaagagtcaagaactgtttgatgaaatcagaatgacgtacataaaagaacttggcaaagctattgtgaaaagagaggggaacagctctcagaattggcagcggttctatcaactgacgaaactgttggactctatgcacgaggtggttgagaacctgcttaactattgctttcagacatttctggacaagacaatgtccatcgaattccccgagatgctggctgagattattactaaccagattccaaaatacagcaatggaaacattaaaaagttactgtttcatcagaagtag

SEQ ID NO: 25412 - DNA, 435 bp, Artificial Sequence
  Description of Artificial Sequence: Synthetic coding sequence
atggacagcaaggagagcctgacccccggccgggaggagaacccctcctcagtcctagcccaggagaggggcgacgtgatggatttttataagaccctgagaggcggcgctactgtgaaggtgagcgcatcctctccaagcttagcagtggcatcacaatccgactctaagcagcgccgattgctggtcgatttccccaagggatccgtatccaacgcccagcaacccgacctgtcaaaggccgtgtcattatccatgggactgtacatgggcgaaacagaaaccaaagtcatgggcaacgatcttggctttccacaacaggggcaaatcagcttgtcatcaggtgagactgacttaaagttacttgaggaatcgatcgccaatcttaatagatccacctcggtccctgagaatccaaaatcttctgccagctag

SEQ ID NO: 25413 - DNA, 438 bp, Artificial Sequence
  Description of Artificial Sequence: Synthetic coding sequence
atggacagcaaggagagcctgacccccggccgggaggagaacccctcttctgttttggcacaggaaagaggagatgtgatggatttttataagaccctgcggggtggggcaacagtgaaagtgagtgcttcctcacccagtctcgctgtggcttctcagtccgactctaagcagcggcgcctactggtggactttcctaagggttctgtgagcaacgcccaacagcctgacctgtctaaagccgtttccctgagtatgggattgtatatgggcgaaactgaaacgaaagtgatgggaaacgatctgggctttccacagcaggggcagatctctctatcctcgggggagaccgacctgaaactgctagaagaaagcatcgcgaacttgaaccgcagcacgagcgtacccgagaacccgaaaagttccgctagtacgtag

SEQ ID NO: 25414 - DNA, 2334 bp, Artificial Sequence
  Description of Artificial Sequence: Synthetic coding sequence
atggacagcaaggagagcctgacccccggccgggaggagaacccctcctccgtgttggcccaagaaaggggcgacgtgatggacttttacaaaaccttgagaggcggagcgaccgtaaaggttagcgcaagcagcccttccctggccgtcgcatctcagagcgatagtaaacagaggcggctactggtggattttcctaaaggcagcgttagtaacgctcagcagcccgatctctcgaaagcggtgagcctgagtatgggattgtatatgggcgaaacagaaaccaaggtgatgggtaatgatttaggattccctcagcagggacagatttcacttagttccggtgagacagacttaaagctgttggaggaaagtatcgcaaatctgaatcgctctaccagcgtgcccgagaacccaaagagctccgcctctaccgctgttagtgccgcccccaccgagaaggagttccccaaaacccacagtgacgtgagctctgagcagcagcaccttaaaggtcagaccggcacgaacggcggcaacgttaagctgtatactacagatcagtccacattcgatatcctccaggacctcgagtttagcagtggcagtcctggcaaggagaccaatgagtccccgtggcgctcagacttacttatcgacgagaactgcctcctcagcccactggcgggagaggatgattctttcctgctagagggtaacagcaatgaagattgtaagccgcttatcttgcctgacaccaagccaaagatcaaagataatggtgatctggtgctgtcaagcccatctaatgtaactctgccccaggttaagacggagaaagaggatttcatcgagctttgcacacctggtgtgatcaagcaggagaaactcggcactgtgtactgccaggcctcctttcccggagcgaatattattggcaacaaaatgtccgctatcagcgtgcacggtgtctcaaccagtggaggtcagatgtaccactatgatatgaataccgcatcactgtcacagcagcaagatcaaaaaccgatctttaacgtaattccacctataccagtcggctctgagaactggaaccgatgccagggatctggcgacgataacttgacctccttaggtaccctcaactttcccggccgcactgttttctctaatggctatagttctccgtccatgcggcctgatgttagttcaccccccagcagcagtagcacagcgaccacaggtcccccacccaagctgtgcctggtctgctcagatgaggctagcggctgtcactatggggtgctgacatgcggctcttgcaaagtcttctttaagcgcgctgtcgagggacagcataactacctgtgtgcaggccgaaacgactgtatcatcgacaagataagacggaagaattgccccgcctgtcggtatagaaagtgtctgcaggctggaatgaatctagaagcccggaagaccaagaaaaagattaaaggcattcagcaggcaaccacaggggtgtctcaggagacttccgaaaatcccggaaataagacgattgttcctgcaactttgccgcaactcacccctactctggtgtctctgcttgaggtaatcgagccagaggtgctttatgctggctatgattccagcgtgccggattctacatggagaattatgaccaccctaaatatgttggggggtcgccaggtcatcgctgccgtgaagtgggctaaagctattccagggttccgcaatctccatttagatgatcagatgacactactccagtactcatggatgttcctgatggccttcgcgctgggctggcggtcttaccgacaaagctctgccaacttactgtgttttgcacctgatctgatcattaacgaacagaggatgactttgccctgcatgtacgatcagtgtaaacatatgctgtatgtgtctagcgaactgcaccgcctccaggtctcttacgaagaatacttatgcatgaaaacactcttgctccttagctctgtgcctaaggacggcctgaaatcccaggagctgttcgatgagattcgcatgacctacattaaggaactgggaaaggcaatagtgaagagagagggaaactccagccagaattggcaacggttctaccaactcaccaagctgcttgattctatgcacgaagtggtggaaaacctgctaaattactgcttccaaactttcctggacaagaccatgtccattgaattccctgaaatgctggctgagataatcacaaaccagatccctaaatacagtaacggtaatatcaagaagctgctgttccatcagaagtag

SEQ ID NO: 25415 - DNA, 2337 bp, Artificial Sequence
  Description of Artificial Sequence: Synthetic coding sequence
atggacagcaaggagagcctgacccccggccgggaggagaaccccagctcagtgctagcacaagagagaggagatgtaatggatttttacaagactcttcggggtggagccactgttaaagtatcagcatcaagcccctctctcgccgtggcgtcccaaagtgatagcaaacagcgcagacttctagtggactttccaaaagggtcagtgtcgaacgctcagcagcccgatctctcgaaggccgttagcctctctatgggcctgtacatgggagaaaccgaaacaaaggtgatgggtaatgacctggggtttccgcagcaggggcagatttccctctcctctggtgagaccgatctaaaattgctcgaagaatcgatcgccaacttgaaccgaagtacatcagtgcccgaaaaccctaagtctagcgccagcaccgcggtcagtgccgcgccaaccgagaaagaattcccaaagacccattccgacgtgtccagtgaacagcaacatctgaaaggccagacgggcaccaatggtggcaatgtgaagttgtacacaacagaccagagcaccttcgacatcttacaggatctagagttttcaagcggctccccaggaaaggagacgaacgaaagtccttggcgctcagatctcctgattgatgagaattgtcttctctccccactggctggcgaggatgacagtttcctcctggaggggaacagtaacgaggactgtaagcccttgattctgcctgataccaaacctaaaataaaggataatggagacctggtgttgtcgagccctagcaacgtcaccctgccgcaggtaaaaacagagaaagaagactttattgagctgtgcacccccggagtgatcaagcaggagaagctgggcaccgtgtattgccaggcctcttttcccggtgcaaatattatcggaaataagatgagcgcaatatcagtccacggtgtgtccacttcgggtgggcagatgtatcattacgatatgaatactgcgagcctaagccagcagcaagaccagaagcctatcttcaacgtcatccctccgattcctgtggggtctgagaattggaacagatgtcagggaagcggggacgataaccttacctcactgggcaccctgaacttccccggaagaaccgtattctcaaatggatattcctctccgtcaatgagacccgatgtgagcagccccccttcctcctcttctaccgcgaccacagggccacctccaaaactctgtttagtgtgttccgacgaagcaagtggatgccactacggtgtcttgacctgcggttcttgtaaggtgtttttcaagcgggccgtcgaaggaaggcaacacaactacctgtgtgcgggccggaatgactgtattattgataagattcgccgcaaaaactgtcccgcctgccggtacagaaaatgcctgcaagccgggatgaacctggaagcccgcaaaactaagaagaagatcaaggggatacagcaagcaacaaccggagtgagtcaggagacttccgaaaatcccggcaataagacaatcgtgcccgccactttaccgcagttgacaccgacactggtctccctcctggaagtgattgagcctgaggtgctgtatgcaggatatgattccagcgtgcccgattctacatggcgcatcatgaccactcttaacatgctcggcggacgacaggttatagctgccgttaaatgggcaaaagcgatcccaggcttcagaaatctacacctggatgaccagatgaccttacttcagtactcatggatgtttttaatggccttcgcactgggatggaggagttataggcaatcttcggccaatctgttgtgttttgcaccagacctcattatcaacgagcaaaggatgactctgccttgcatgtacgatcaatgtaagcacatgctctacgtgagctctgaactccaccgactccaagtgtcgtacgaagagtatttatgtatgaaaaccctactcctgctgagttctgtgccaaaagatggcctcaaatcccaggaactttttgatgagattcgcatgacgtatattaaggaattgggaaaggctatcgtcaagcgagaagggaattcctctcagaactggcagagattctaccagctcacaaaactactggattcaatgcatgaagtggtcgagaacctccttaactattgtttccagacctttctggataagacgatgtctatagagttccccgagatgttggcagaaataataaccaatcagataccaaaatacagtaacggcaacatcaaaaaactactctttcaccagaagtag

SEQ ID NO: 25416 - DNA, 438 bp, Artificial Sequence
  Description of Artificial Sequence: Synthetic coding sequence
atggacagcaaggagagcctgacccccggccgggaggagaacccctccagcgtattggcccaggagcgcggggacgtgatggatttttataaaacattgcgagggggagcgactgtcaaagtgtctgccagctccccttcgctggctgtcgccagccagagcgattccaagcagcggaggttgcttgtagatttcccaaaagggtcagtgtctaatgcacagcaaccagatctgagcaaggctgtcagcttaagcatgggcctgtatatgggggagacagagaccaaggtcatgggtaatgatctgggattcccccagcaaggacagatttccctatcctctggagaaacggacctgaagctcctagaagaatcgattgcaaatttgaaccgcagcacttcagtacccgaaaatcctaagtcttccgcttctacctag

SEQ ID NO: 25417 - DNA, 438 bp, Artificial Sequence
  Description of Artificial Sequence: Synthetic coding sequence
atggacagcaaggagagcctgacccccggccgggaggagaaccccagctctgttctggcccaggaacgcggcgacgtgatggatttttataaaacactgcggggaggagccacagttaaggtaagcgcctccagtccctctctggccgtcgcttctcagtctgactctaagcaacggcgtctgctggtcgactttcccaaagggagcgtgtctaatgcccagcagccggatctgtctaaggccgtctcgctgagcatggggttatacatgggcgaaacggagacgaaggtcatgggtaacgatctcgggtttccccaacaaggccagatcagcctgagcagtggagaaaccgaccttaagctgctggaagaaagcatcgcaaaccttaaccgttcaacatcggttcccgagaatcctaagagttccgccagcacgtag

SEQ ID NO: 25418 - DNA, 438 bp, Artificial Sequence
  Description of Artificial Sequence: Synthetic coding sequence
atggacagcaaggagagcctgacccccggccgggaggagaacccctctagcgtcctggctcaggagagaggcgatgtgatggacttctataagactctaagaggaggggcgaccgtgaaggtctcggcgtcaagcccatctctcgctgtggcttctcaatcagactcaaaacaacgacggctgctggtggactttcccaagggctccgtatctaacgcgcaacaacccgatctcagtaaagcagtctctctgtctatggggctttacatgggagaaacagaaaccaaggtcatgggtaatgatctcggctttccgcagcaggggcagatttccttgagctctggcgagactgacctgaagctcttagaagagtctattgccaatctgaaccggtcgacctctgtccctgagaatcccaagagtagtgcctccacttag

SEQ ID NO: 25419 - DNA, 1914 bp, Artificial Sequence
  Description of Artificial Sequence: Synthetic coding sequence
atgcacgacagcatccggttcggcaacgtggacatgccctgcgtgcaggcgcagtactcaccgtcacccccaggatcaagctatgcggctcagacatattcatctgaatacactacggaaattatgaacccagactataccaagctcactatggatctaggatcaacagagattacggcaactgcaaccacatctctcccctccatcagcaccttcgtggagggatattctagtaactatgagttgaaaccaagttgcgtataccagatgcagagaccattgatcaaggtcgaggaaggccgcgccccctcctatcaccaccaccaccaccatcaccaccatcaccaccaccaccaccagcagcagcaccaacagccatccatcccacctgcttcatctcccgaagatgaggttctgccctccacctccatgtatttcaagcagagccccccaagcacgcccacaactccagcttttccacctcaagccggagccctgtgggacgaggcccttccaagcgctccaggctgtattgcgcccggtcccctgttggaccctccgatgaaagcagttcctactgttgctggagcgcgattccccctattccattttaagccctctcccccgcaccctcctgcaccgtcccccgcagggggccatcacttaggttatgatcccaccgctgctgctgcgctgtctttacctttgggagccgccgctgccgcggggtctcaggcagcagctcttgagtcccatccctatggcctgccactggctaagcgcgcggccccattagcatttcccccactcggcctcacgccatccccgaccgcatcctccctgctaggagaatctcctagcctgccatcaccgccatctcgcagtagcagcagtggcgaggggacctgcgccgtgtgtggagacaatgctgcttgtcagcactacggggtgcgcacgtgtgaagggtgcaaaggttttttcaaacgcaccgtgcagaaaaacgcaaaatatgtttgcctggctaacaaaaattgtcccgttgacaaacgcaggcggaataggtgtcagtactgccggtttcagaagtgcctgagcgtgggtatggtgaaggaagtggtgcgtaccgactctctgaagggacggcgagggagactcccatctaagcccaaatcccctctgcagcaggagccatctcagccttccccccccagccccccaatttgtatgatgaacgcattggtccgggctctgaccgactctactccaagggatctggactacagtaggtactgcccaacagatcaggccgccgcggggactgatgcggagcacgtgcagcagttctacaacctacttacagcctccatcgacgtctccaggtcttgggcagagaaaataccaggattcactgacttaccaaaagaagatcaaactttgctgattgagagcgcctttttggaactgttcgtcctgcggctaagcattaggagtaataccgcggaggataaatttgtgttttgtaatggtctagtgctacaccgcctgcaatgtctgcggggattcggagagtggctggacagcatcaaagatttctcattgaatcttcagagtctgaacctggatatccaggcgcttgcatgcttgtccgctctttccatgatcaccgaacggcacggcctgaaggagcccaaacgcgtggaggagctctgcaataagataacttccagcctgaaggaccaccagtccaagggtcaggctctggagcccacggagtctaaggtcctgggcgcactggtggaactgaggaaaatctgtaccttgggcctgcagagaatcttctacctgaagctggaagacctagtctctcctccaagcattattgacaaactttttctcgataccctgccgttttag

SEQ ID NO: 25420 - DNA, 1332 bp, Artificial Sequence
  Description of Artificial Sequence: Synthetic coding sequence
atgccctgcgtgcaggcccagtacagccccagcccccccggcagcagctatgcggcccagacttactcgagtgagtataccaccgaaatcatgaaccccgattatactaaacttacgatggacctcggctcaacagaaattacagccacggccacaacctctttgcctagcatcagcacattcgtcgaaggatacagcagtaattacgaactcaaaccctcttgtgtctatcaaatgcaaaggccgttgataaaagtggaggaagggagggccccatcataccaccatcaccaccatcatcaccaccaccatcatcatcaccaccaacagcagcatcaacagcctagcattcctccagcatcatctccagaggacgaggtactcccaagtacaagcatgtattttaaacaaagtcctcctagcacccccaccaccccagctttcccaccccaggctggcgcactctgggatgaggctctccccagcgccccaggatgcatcgcacctgggccactgcttgaccccccgatgaaagctgtacctaccgtagctggcgcacggttccctctcttccactttaagccaagccccccacacccccctgctccaagccctgccggtggccatcatctggggtatgaccccactgcagccgcggcgctctccctccccttgggagccgctgccgccgccgggtcccaggcagctgctcttgagagccacccttatggcctaccactggctaagcgggctgctcccctggcattccccccactgggcctcacaccgagtccaacagccagtagcctccttggggagagtccaagcctgcctagccctccttcacgtagctcaagcagtggggagggaacctgtgcggtttgtggtgacaacgcggcttgccaacactatggtgtgaggacttgtgaaggctgtaaaggcttctttaagcggacagtgcagaaaaacgcgaaatatgtgtgtctggccaacaaaaactgccctgtagacaaacgccgacgcaataggtgccagtactgcaggttccagaaatgtctgtccgttggaatggtgaaggaggtggtgagaactgattcgctgaagggacggcggggcaggctccctagcaaacctaaatccccactgcagcaggagccctcccagcctagccctcccagtcccccaatctgcatgatgaacgcattggttcgggcgctgacagatagcacccctcgtgacctggactacagtcgggtctccttcatgatctcatgcttccagatgaacgaccaagggctttatctgtggctcctcgtgatccgcgtggactag

SEQ ID NO: 25421 - DNA, 894 bp, Artificial Sequence
  Description of Artificial Sequence: Synthetic coding sequence
atgaaggccgtgcccaccgtggccggcgcccggttccccctgttccacttcaagccgagccctccgcatccccctgccccaagcccagccggcgggcaccaccttggctatgatcccactgcagctgccgcgctttcactgccactaggggccgcagctgccgctggatcgcaggcggctgcattggagagccatccttatggccttccgctagcaaaaagagctgcccctctggctttcccaccactaggattgacaccttcgcctacagccagtagtctgttgggcgaaagcccttctttgcctagtccccctagccgatcatcttcctccggtgaagggacctgtgcagtctgtggagacaatgctgcatgtcagcactatggggtccgaacctgcgagggttgtaagggattttttaagcgcacagtccaaaagaacgccaaatacgtctgtctggcaaacaaaaattgtcccgtggacaaacggaggcgtaatcgctgccaatactgtagattccagaaatgtctatccgtggggatggtgaaggaggtcgtgaggaccgatagtctgaaggggcgcaggggaaggcttccatcgaagccaaagagcccattgcagcaagagccaagtcagccgtcacccccctcgccaccaatctgtatgatgaacgctctggttcgggccttgaccgactctacacctcgggatttagactatagtagagtttcgttcatgatcagttgctttcagatgaatgatcaaggcctttacctgtggctgctggttattagggtgctggattcctttcacacctttagcatttttctggcctctttctccaattcggtccatcctctccaacagataatctttgcccttctgaatttatag

SEQ ID NO: 25422 - DNA, 1881 bp, Artificial Sequence
  Description of Artificial Sequence: Synthetic coding sequence
atgccctgcgtgcaggcccagtacagccccagcccccccggcagctcgtatgctgcgcaaacatatagtagcgagtatactaccgaaataatgaatcccgactataccaaactcacaatggatcttggctccacggagattactgccacagccacgacctcccttccctcgatatcaaccttcgtcgaaggctacagttccaattatgagctgaagccaagttgtgtataccagatgcaaagacctttgattaaggtagaggaaggacgagcccccagctaccaccaccatcaccatcaccaccatcaccaccaccaccatcaccagcagcagcatcagcagcctagcatccctcccgccagcagtccggaagatgaagtgttaccctctacatcgatgtattttaaacaatccccaccgtctacccctactacccccgcctttcccccacaggcaggtgccctctgggatgaagccttaccctccgcaccaggctgtatcgctcctggaccattattggacccccctatgaaagccgttccaaccgtggccggagcccggtttcccctgttccacttcaagccatcaccgcctcacccccctgcccccagccctgctggcgggcatcatctgggctacgaccccactgctgctgccgcattatccctgcccctgggagccgctgctgccgcgggctcacaggcagccgccctggaaagccacccctatggattacccttggcaaagagagccgcaccactggccttcccccccctaggactcactccgagccccacagcaagcagtctactcggcgagagtccatcgctgccttcccctcccagcaggagttccagtagcggtgagggtacctgcgctgtatgtggggataacgcagcttgtcagcactacggcgtgcggacctgcgagggttgcaaaggcttcttcaagcgcacagtccagaaaaatgctaagtacgtgtgcctggcaaacaagaactgcccagtcgacaagcgaaggcgtaatcgttgccagtactgccgctttcagaagtgcttatcagttgggatggtgaaggaggttgtccgcacggattcattgaagggccggcgcggaagattgccgtcaaagccgaaaagtcccttacagcaagagccgagtcagccctcccctccatccccacccatttgcatgatgaacgctctggtgagagcccttaccgattccactccccgggacttagattacagcagatactgtcccaccgaccaagccgcggccggtaccgacgctgagcacgttcagcagttttataacctgttgacagccagcatcgacgtctcgcgttcgtgggccgagaaaattcccggctttactgacctgcccaaggaggaccaaactctcctgatcgagagtgcctttctggagctgttcgtgctcagattaagtatcagaagcaatacggctgaagataaatttgtcttctgcaacggtttggtgctgcaccgcctacagtgcttgcgcgggttcggagaatggttagactctataaaagatttttccctaaacctccaaagcttgaacctcgacatccaggctcttgcctgcctttctgctttgtccatgattacagagcgccacggccttaaagaacctaaaagggtcgaagagctgtgtaataagataacttcgagcctcaaggaccatcaatccaaaggtcaggccctagagcctaccgagagcaaggtgctgggcgcattggttgagctgagaaaaatctgcacgcttggactccaacggattttctacctcaagctagaggatctcgtgtctccaccttccatcatcgacaaactgttcctggacacccttcccttctag

SEQ ID NO: 25423 - DNA, 627 bp, Artificial Sequence
  Description of Artificial Sequence: Synthetic coding sequence
atgggcaacgcccaggagcggcccagcgagaccatcgaccgggagcgtaagagacttgtcgaaacactgcaagctgactcgggtctgcttctggacgcactgcttgccagaggggtcctaactggaccagagtacgaggcattagatgcccttccagacgccgaaagacgcgtcaggcggctcctattgctggtgcaaggcaagggggaagctgcttgtcaggaattgctgagatgtgcccagaggaccgccggagcccccgaccctgcttgggattggcaacatgtgggtcccggctacagagaccggtcatatgatccaccttgccccggccactggactccagaggcccccggctcagggactacatgtcccgggctcccccgcgcctccgatcctgacgaggcaggcggtcctgaaggcagtgaagcagtgcagtctgggacaccggaagagccggagcccgaattggaagcagaggctagcaaggaagccgagcccgagccagagccggaacccgagctggagccagaggctgaggccgagcccgagcccgaactggaacctgagccagatcctgagcccgaacccgacttcgaggagcgcgatgagtcagaggatagctag

SEQ ID NO: 25424 - DNA, 627 bp, Artificial Sequence
  Description of Artificial Sequence: Synthetic coding sequence
atgggcaacgcccaggagcggcccagcgagaccatcgaccgggagcggaagcgcctcgtcgagaccctccaagccgactccggcctcctcctggatgctctgctggcccgtggagtgcttacgggccccgagtatgaagctcttgatgccctgccggacgccgaacgccgcgtcagacgacttctgctcttagtacagggcaaaggggaagccgcttgccaggaactcttgcggtgtgcccagaggacagccggggcccccgatcccgcctgggactggcagcacgttggtccaggctatcgggatcgaagctatgacccaccctgtcccggccactggactcctgaggctccggggtcgggaacaacctgtcccggacttccgcgagcaagcgaccctgacgaggctggcggccctgaggggagtgaggcagtgcagagcggtactcctgaggagccggagccagagctagaggctgaggccagtaaagaagcagaacctgagcccgaaccagaacccgagctggagccagaggccgaggcagagcctgagcccgagctcgagccggaacctgatccagaacccgagccagatttcgaggaacgggacgaatcagaggactcctag

SEQ ID NO: 25425 - DNA, 2133 bp, Artificial Sequence
  Description of Artificial Sequence: Synthetic coding sequence
atggtgaagctggccaaggccggcaagaaccagggcgaccccaagaaaatggccccacctccaaaggaggttgaggaagactcagaggatgaggagatgagcgaggatgaggaggacgacagctctggcgaggaagtggttatcccacagaaaaagggcaaaaaggcagctgcaacatcagccaaaaaggtagtagtgtcccccaccaagaaggttgccgtggccaccccggcaaagaaggcggcagtaacccctggtaaaaaggctgcagctacaccagcgaagaaaacagtgacaccggcaaaagctgtgactacaccaggcaaaaagggggctactcctgggaaggctctggtggcgacacctgggaaaaaaggagctgcaatccccgccaagggcgctaagaacggtaaaaacgccaagaaggaagatagtgatgaggaggaagacgatgattccgaggaggacgaggaagatgatgaggacgaggacgaagacgaggacgagatagaacccgcagcaatgaaagccgccgctgcagcccctgcgagtgaggacgaggacgacgaggatgatgaggatgatgaggatgacgacgatgatgaagaagacgacagtgaggaagaggccatggaaaccacgcctgccaagggtaagaaggcggctaaagtagtgcctgtaaaagccaaaaatgtggccgaagacgaggatgaggaagaagacgatgaggacgaagacgacgatgacgatgaggacgacgaggatgatgatgatgaggacgacgaagaggaagaagaggaggaggaagaggagcctgtgaaagaagctcccggtaagcgtaaaaaggaaatggctaaacagaaagccgccccagaagctaagaaacagaaggtggaagggaccgaacccacaactgcttttaacttattcgtcgggaacctgaactttaacaaatctgcgcccgaactgaagaccggtatatcggacgtgtttgcaaaaaacgacctggctgtggtggatgttaggatcgggatgactaggaaatttgggtacgtagactttgagagcgcggaggatctggagaaggctcttgaactgactggcttgaaagtgttcggaaacgagatcaagctggaaaaacctaagggcaaagatagtaagaaggagagggacgcccgcactcttttagctaagaatctaccatataaagtgacccaggatgaactaaaagaagtattcgaagacgccgccgaaattagattagtaagtaaggatggtaaatccaagggcattgcatacatcgagttcaaaactgaggccgacgctgaaaagacatttgaggaaaagcagggcacggaaatcgatggcaggagtatatcattatactataccggtgagaaaggacagaatcaggattatcgcggcggcaaaaattctacctggagcggggagagtaaaacgctggtgctctctaatctgtcttattctgccacagaagagaccctccaggaggtctttgaaaaggctaccttcatcaaggtgccccagaaccagaatggaaagtcaaagggatacgcctttattgagttcgcaagcttcgaggacgccaaggaggcgctcaattcatgcaataagcgtgagatcgaaggcagggccattcgcctcgaactgcagggacctcgaggctctccaaatgcccgaagccagccgtccaaaacattgttcgttaagggcctgtctgaagatacaacagaggagaccttgaaggagtcctttgacggcagcgtgcgggcgagaatagtcaccgaccgggagacagggtcaagtaaagggttcggatttgtggacttcaattctgaagaagatgcgaaggccgctaaagaggccatggaggatggagagatagatggaaataaagtaacactcgattgggcaaaacctaagggcgaggggggctttgggggccgcggcggcggcagaggcggcttcgggggaaggggcggcggacgcggtgggcgcgggggatttgggggacgcggaagagggggcttcggtgggcgcggaggatttcgcggcggacgcggaggaggcggcgaccataagccccaagggaagaaaacaaagtttgagtag

SEQ ID NO: 25426 - DNA, 1449 bp, Artificial Sequence
  Description of Artificial Sequence: Synthetic coding sequence
atggtgaagctggccaaggccggcaagaaccagggcgaccccaagaaaatggctccccccccaaaagaggtcgaggaggactccgaggacgaggagatgtccgaagacgaggaagacgattcctcaggagaggaagtagttatcccacagaaaaagggaaaaaaagcagcagccactagcgctaagaaagttgtagtgtcacctactaagaaggtagccgtggccactccagcaaagaaagccgctgttacccccggtaagaaagccgctgctacccccgccaagaaaactgtgacccctgccaaggcggtcacgactccagggaaaaaaggagccactcctggaaaggctctggtggcaacgccaggtaagaagggtgctgcaatccctgctaaaggcgccaagaacgggaagaacgctaaaaaggaagacagcgacgaagaggaggatgatgatagcgaagaagatgaggaagacgacgaggatgaggatgaggacgaggatgaaattgagcccgccgccatgaaagcggccgccgccgccccagcatctgaggacgaggacgatgaagatgatgaggatgacgaggatgggaaatctaagggcatcgcctacatcgaattcaaaaccgaggctgacgctgagaaaacctttgaagaaaagcagggtacagaaattgatgggagatcgatcagcctatattacacaggagagaaaggccagaaccaggattaccggggcgggaagaacagcacatggtcaggggaatctaaaaccctggttctctcaaaccttagctactccgctacagaagaaacattgcaggaagtgttcgagaaagccacatttattaaggtcccccagaatcagaacggaaagagtaaaggatatgcatttatcgagtttgccagcttcgaggacgccaaagaggctctgaatagttgtaacaaacgtgagatcgaggggcgtgccatccgactcgaattacagggcccaagggggtcacctaacgccagatcacaaccttctaaaacactctttgtaaaaggattaagcgaggataccacagaagaaactctgaaagagtcttttgacggatctgtaagggcacgcatcgtgactgaccgcgagacaggtagttcaaagggattcgggtttgtcgactttaattctgaggaggacgccaaagcagcgaaggaggccatggaagacggcgagatcgatggtaacaaggtgaccttagattgggcgaagcccaagggcgagggcgggtttggcggccgaggcggggggagaggaggcttcggcggacgcggcggagggcggggtgggagaggcgggtttggtgggaggggcagaggcggatttggcggacggggcgggtttaggggcggacgaggaggcgggggggaccataagcctcagggcaaaaaaaccaaatttgagtag

SEQ ID NO: 25427 - DNA, 1809 bp, Artificial Sequence
  Description of Artificial Sequence: Synthetic coding sequence
atggtgaagctggccaaggccggcaagaaccagggcgaccccaagaagatggctcctccacccaaagaggtggaagaggatagtgaggatgaggagatgagcgaggacgaggaagacgactccagcggggaggagttaaacgatgacttctatcaaacaaccatgcatacattgtggaagaaaggtaaaaaagccgccgccacttctgcgatacctgccaaaggagctaaaaacgggaagaatgccaagaaggaggactccgatgaggaagaggacgatgattcggaggaagatgaggaagacgatgaggacgaagatgaggatgaggacgaaatcgagccagctgccatgaaggccgccgcagcggctcctgcaagcgaagacgaggatgacgaagacgatgaggatgacgaggacgacgacgacgatgaagaggatgacgatgacgacgaagatgatgaggaagaagaagaggaggaagaagaggaacctgtgaaggaggcgcccggcaaacggaagaaggagatggctaaacaaaaggcagcccctgaagccaagaaacaaaaagttgaaggcacagagccgacaactgcctttaacctttttgtgggcaatctgaatttcaacaaatctgccccagagctgaagacaggcatttctgacgtctttgccaaaaacgacctggcagtggtggatgtgaggatcggcatgacgcggaaattcgggtacgtcgacttcgaaagtgccgaagacctcgagaaggcattggagctcacgggtctgaaggtgtttggtaacgagattaagttggagaaacccaagggcaaggatagtaaaaaagaacgggatgctcgcacactgctggccaaaaatttaccctacaaggtgacacaggacgagctgaaagaggtttttgaagacgcggcagagattaggttggtgagtaaggacggtaaatcaaaagggattgcctatattgagttcaagacagaagctgatgctgagaaaacctttgaagagaaacaaggtacggaaattgacggccgcagcatcagcctctactatacaggggaaaaagggcaaaatcaggactatcgaggtgggaagaactccacgtggtccggggagagcaagacactggtgttgtccaaccttagctatagcgcaaccgaggagactctccaggaagtgtttgaaaaggctaccttcatcaaagttcctcagaatcagaacgggaaatccaaaggctacgcctttattgagttcgccagcttcgaagatgcgaaagaggccctgaacagctgtaataaaagagagatagaaggacgtgcaattagactggagttacaaggcccacgaggttctcccaatgccaggtctcagccttcaaaaacattatttgttaaaggcctgagtgaagatactacagaggagacactgaaagagtcattcgatggatccgtccgagctcgtatcgtgacagaccgggaaactggatcttcaaagggtttcggttttgtggacttcaactctgaagaggacgcaaaggctgccaaagaggcaatggaagatggcgagatcgatgggaataaggtcactctcgattgggcaaagcctaaaggagaaggcgggttcggaggccgtggaggagggaggggtggatttggcgggcggggtggagggcgggggggtaggggtgggttcggaggaagaggccggggcggctttggtggccgcggcggcttccgtggcggccgaggtgggggtggcgaccataagccacagggcaaaaagacaaaatttgagtag

SEQ ID NO: 25428 - DNA, 885 bp, Artificial Sequence
  Description of Artificial Sequence: Synthetic coding sequence
atggaggacagcatggacatggacatgagccccctgcggccccagaactacctcttcgggtgcgagctcaaggccgacaaggactaccactttaaggtagacaatgacgaaaacgaacatcaactctcattgcgcacagtgtctctgggggccggggcaaaagacgagctgcacattgtggaagcagaggcgatgaactacgaaggcagccccattaaagtgaccctggcaacattaaaaatgtccgtgcagcccactgtgagtctgggaggcttcgaaatcacccctccggttgtcctgcggctcaaatgcgggagtgggcctgtgcacatcagtggtcagcatctagtcgccgtcgaagaggacgccgaatctgaggatgaagaggaggaggatgtgaaactactgagcatttccggcaagaggtctgcacccggtggaggatccaaggtgccacaaaagaaggtcaagctagcggcagatgaagacgacgacgacgatgacgaagaagacgatgacgaagatgatgatgatgacgacttcgacgatgaagaggcagaagaaaaagccccagtcaagaagtcaatccgtgacacccccgccaagaatgcccaaaagtccaatcagaacggaaaagactccaaaccaagctctactcccaggtcgaagggacaggaatcttttaaaaaacaggagaaaactccgaagacacctaagggaccttcctccgtggaggacatcaaggccaaaatgcaggcttcaatagaaaagggcggcagcctacccaaagtggaagccaagttcataaactacgttaaaaattgctttcggatgaccgatcaagaggccatacaggatttgtggcagtggaggaagagtctttag

SEQ ID NO: 25429 - DNA, 798 bp, Artificial Sequence
  Description of Artificial Sequence: Synthetic coding sequence
atggaggacagcatggacatggacatgagccccctgcggccccagaattacctgtttggatgcgagttgaaggcggataaggactaccactttaaagtggacaacgatgaaaacgagcaccagctaagcctgcgtaccgtttccctcggggccggagcaaaggacgagcttcacatcgttgaggccgaagctatgaattatgaggggagccccataaaagtgacattagcgactcttaagatgtcagtgcagcccaccgtctcactggggggattcgaaatcaccccccctgtagtgctgagattgaagtgtggtagcggtcctgtgcacattagcgggcagcatctggtggcggtagaagaggacgctgagtccgaggatgaagaggaggaagacgttaaactcttaagcattagcggaaagcggtcagccccgggtggtggctctaaggtgccccaaaagaaggtgaagttggccgccgatgaagacgacgacgacgatgacgaggaagacgatgacgaggacgacgacgatgacgactttgacgacgaggaagctgaggaaaaggcgcctgttaaaaagggccaagagagtttcaagaaacaggaaaaaacacctaagacccctaagggccctagctcagttgaggacatcaaagcaaagatgcaggcgtcaatcgaaaagggagggtcactgcccaaggtcgaggctaaattcattaattacgttaagaattgcttccggatgacagatcaggaagctattcaagatttgtggcagtggcgtaagtctctgtag

SEQ ID NO: 25430 - DNA, 780 bp, Artificial Sequence
  Description of Artificial Sequence: Synthetic coding sequence
atggaggacagcatggacatggacatgagccccctgcggccccagaattatcttttcggttgcgagctcaaggctgacaaggattaccatttcaaagtggataatgacgaaaatgagcatcaattgagcttgcggacagtttccttgggcgcaggagcaaaggacgaattgcatatcgtcgaggccgaagcgatgaactacgagggcagccctatcaaggtgaccctggcaacccttaaaatgtctgtccagcctactgtgtctctgggcgggttcgaaattacccccccagtcgtcctccggctgaaatgcgggagcgggcctgtgcacattagcggccagcatctagttgcagttgaagaggatgccgaatcagaggacgaggaggaggaggatgtgaagctgttgtcaatatcaggcaaacggagtgccccaggtggcggctcaaaggtgcctcagaagaaggtgaagctcgccgctgatgaggatgacgatgacgacgacgaagaggacgatgatgaggacgacgacgatgatgacttcgacgacgaggaggccgaggagaaagcccctgtcaaaaaatcaatacgcgatacccccgccaagaatgctcagaagagcaaccagaacggaaaggatagtaagcccagctctaccccccgctctaagggacaggagtcttttaaaaagcaggagaagaccccgaaaacccctaaaggtccatccagtgtcgaggacatcaaggcaaaaatgcaggcctcgatcgaaaaggcacactag

SEQ ID NO: 25431 - DNA, 885 bp, Artificial Sequence
  Description of Artificial Sequence: Synthetic coding sequence
atggaggacagcatggacatggacatgagccccctgcggccccagaattatctctttggctgtgagctaaaagctgacaaagactatcattttaaagtcgacaatgacgaaaacgaacaccagctcagtttgagaactgtgagtcttggagccggagccaaggacgagctgcacattgtcgaagcagaggctatgaactatgagggcagcccaattaaggtgaccctggctaccctgaagatgagcgtgcagccaacagtgagcctgggcgggttcgagatcacaccccctgtggtcctcaggctgaaatgtggaagtggccctgtgcatatcagtggtcagcacctggtcgccgttgaagaagacgcagagtctgaggatgaggaagaggaagatgtgaaattgctgtctatatcgggaaagaggtctgcaccagggggaggttctaaggtgccacaaaaaaaggtgaagttagccgcagatgaggatgacgacgacgacgatgaggaggatgatgacgaggacgacgatgatgatgactttgatgacgaggaggcggaggaaaaggcacccgtgaagaaaagtatccgtgatacccctgccaagaacgctcagaaatcaaaccagaacggcaaggactccaagccctccagcaccccccgttcaaaaggccaggagtcctttaaaaaacaagagaaaacccccaagacaccaaaagggccctcatcagtggaagatatcaaagcgaaaatgcaggccagcatcgagaagggcggaagcttacctaaagtggaagccaagtttatcaactatgtgaagaattgctttaggatgactgaccaagaggctatacaagatctgtggcagtggagaaaaagcctgtag

SEQ ID NO: 25432 - DNA, 867 bp, Artificial Sequence
  Description of Artificial Sequence: Synthetic coding sequence
atgaaggaccggacccaggagctgcggaccgccaaggacagcgacgacgacgacgatgtcgccgtgacggttgatcgggatagatttatggatgaatttttcgaacaggtggaagagattcgtgggtttatcgacaagattgctgagaatgtggaggaagtcaagaggaagcacagcgccatcctggccagcccgaacccagatgaaaagacaaaggaggaacttgaggagttaatgtccgacataaagaaaacggccaacaaggtacggtcgaaattgaagagcatcgaacaatccatcgaacaggaagagggtttgaataggtcaagcgcagacttgagaatcagaaaaactcagcactcaacgctctcacggaaattcgttgaagtgatgtcagagtataacgccactcagtccgactacagagagaggtgtaagggccgaatccaaaggcaactcgagataacagggcgcactaccactagcgaagaattagaggacatgctggagtccgggaaccccgccatcttcgcttccggaatcatcatggacagctcgatttccaagcaagccctgtctgagatagagactaggcacagtgagatcattaagctggaaaacagtatccgagaactgcatgacatgtttatggatatggctatgctcgtcgagagccagggtgagatgattgatcggatcgagtacaacgtcgaacacgcagtcgattacgtggaacgtgctgtctcagacacgaaaaaagcagtgaaatatcagtccaaagcaagaagaaaaaaaatcatgatcattatttgctgtgttatactggggatcgtcatcgcatcaactgttggcggcatcttcgcctag

SEQ ID NO: 25433 - DNA, 183 bp, Artificial Sequence
  Description of Artificial Sequence: Synthetic coding sequence
atggaggagcagggccacagcgagatggagatcatccccagcgagagccacccgcacattcagctactcaagagcaaccgcgaactcctagtgacccacattcggaacacacagtgtttggtcgataatcttttgaaaaacgattatttcagcgccgaggacgcagaaattgtgtgcgcctag

SEQ ID NO: 25434 - DNA, 183 bp, Artificial Sequence
  Description of Artificial Sequence: Synthetic coding sequence
atggaggagcagggccacagcgagatggagatcatccccagcgagtcacacccgcatattcaactgctcaaatccaaccgtgaactgctggtgacccacattcggaacacccagtgccttgtggacaacctgctcaagaatgactatttttctgccgaggatgctgaaatcgtgtgcgcctag

SEQ ID NO: 25435 - DNA, 138 bp, Artificial Sequence
  Description of Artificial Sequence: Synthetic coding sequence
atggaggagcagggccacagcgagatggagatcatccccagcgagtcgcatccccatattcagctgctgaagagtaatagagagctgctggttactcacatcagaaatacacagtgcctggtggacaacttgctctag

SEQ ID NO: 25436 - DNA, 183 bp, Artificial Sequence
  Description of Artificial Sequence: Synthetic coding sequence
atggaggagcagggccacagcgagatggagatcatccccagcgagagccaccctcatatccagttgcttaagagtaaccgtgagcttctcgttacacacattcgcaatacgcagtgtctggtggacaatctcctcaaaaacgactacttctcagccgaggatgctgagattgtctgcgcctag

SEQ ID NO: 25437 - DNA, 750 bp, Artificial Sequence
  Description of Artificial Sequence: Synthetic coding sequence
atggaggagcagggccacagcgagatggagatcatccccagcgagtctcacccccatatccagctattaaaatctaatagggagctcctggttacccacatccgaaatacccagtgtctagtggacaacctcctgaaaaacgactattttagcgctgaagacgccgagatcgtctgtgcctgccccacacagccagataaagttcgaaagattctggatttggtgcagagcaagggagaagaagtctcagaattttttctgtacctcttacagcagttagctgatgcctatgtcgacctgagaccttggcttctggagatcggcttttccccatctctgctcacccagtcaaaggttgtggtcaatactgatcccgtgtctcgttatacacagcaactgagacaccacctgggcagagactccaaattcgtcctctgttacgctcagaaggaggaattactgcttgaggagatctacatggacactatcatggagttggtcgggttctccaatgagagtctagggtcactgaactctctagcttgcctcctggatcataccaccggaatactcaacgagcaagcggcctccagaaaagtgactggttgcgtctgtaggacctgctcatcttcaaccactgcgacccagtctggaacccctcgcaggtgtctcccaagctgctgcgcatcgccgacatggcccagctccccgtcaatggcatggacttcctgtaccaggacctggacctag

SEQ ID NO: 25438 - DNA, 2340 bp, Artificial Sequence
  Description of Artificial Sequence: Synthetic coding sequence
atggaggagcagggccacagcgagatggagatcatccccagcgagtcccacccacacattcagttgctcaaatccaaccgggagctgcttgtgacgcacatccgtaatactcagtgccttgtggacaatctactaaagaacgactacttttcagccgaagacgccgaaatcgtttgtgcttgccctacacagccagacaaggttaggaaaatactggatctggtgcagtctaaaggagaggaggtctctgagttttttctatatctccttcagcagctggctgacgcatacgtggacctcagaccctggttgctggaaattggctttagtccaagcctgctcacgcagtccaaggtcgttgtcaataccgaccccgtgagtcgatacactcagcagctacgacaccacttaggtagggacagcaaatttgtattatgctacgcacagaaagaggaactattactggaggagatctatatggatacaataatggagctggtaggattttcaaacgagagcctcgggtctctcaatagcttggcatgtctcctggatcacaccactgggatccttaatgagcagggcgagactatttttatcttaggcgatgccggcgttggcaaatcaatgctgcttcagcgactccaatcactttgggccacgggcagactcgacgcaggcgtgaagttcttctttcacttcaggtgccggatgttttcctgtttcaaggagtccgatcgtctttgcctgcaggatctgctgttcaaacattattgttatcccgagagagatccagaagaagtgtttgctttcctcctgaggttcccccatgtggcattgttcacattcgatggactggatgagttgcacagcgacctagatctgagtcgggtgcccgattcaagctgcccttgggaaccggctcatcctctcgtcctcctcgccaatctactgagcggcaagcttctaaagggcgcctccaaactgctgactgcccgcactggcatcgaagtgccaagacaatttctacggaagaaggttctcttaagaggcttctctcctagtcacctcagggcatatgcacggcgcatgtttcccgaaagggcattacaggaccgccttctgtcacagcttgaggctaacccaaacttgtgttctctctgttctgtgccgctcttctgttggattattttccgttgtttccagcactttcgtgcggcattcgagggctcccctcagttacccgactgcaccatgacattgacagatgtgtttttactggtaacagaagtacacctgaaccgaatgcagccttcctctctcgtacagagaaacacgagaagccctgtcgagacactccacgccggaagagacacattgtgctcactcggtcaggtcgcccaccgcgggatggagaagagcctatttgtttttacgcaggaagaagtgcaagccagcgggcttcaggagagggatatgcagctcggcttcttgcgagctttacccgagctcgggcctgggggcgaccagcagagttatgagttctttcatctaacgttgcaggcttttttcacggctttcttcctagtcctggacgatcgagtcggcacacaggaactgttgaggttttttcaggaatggatgccccccgcgggggctgccacaacctcttgttacccaccatttttgccatttcaatgtctgcagggcagcggtccagcccgggaggatttgtttaaaaataaagatcacttccagttcacaaatctatttttatgtggccttttatcaaaagcaaagcagaaactcctgagacatctggtccccgccgcggctcttcggcggaagcggaaggcactttgggctcatttgttctcatccctgcggggttacctgaaatccttgcccagggtgcaggtggagtcattcaatcaggtgcaggctatgcccacttttatctggatgctgcgctgcatctacgaaactcaatcgcagaaggtgggccaattggctgcccgggggatttgtgcaaactacttgaagttgacttactgtaatgcctgcagtgccgactgttctgcattgtccttcgtgcttcatcattttcccaagagattggccctcgacctagataataacaacctgaacgattacggtgtgagggagctccagccctgcttctccagactaaccgtgttgagactcagcgttaatcaaattaccgacgggggcgttaaggtactgtcagaggagctgacgaaatataaaatagtcacgtacttgggtttgtggaagagcgtggacacgatatgtttcaagaagcagggattgctgaaatag

SEQ ID NO: 25439 - DNA, 495 bp, Artificial Sequence
  Description of Artificial Sequence: Synthetic coding sequence
atgaagtgcaagcccaaccagacccggacctacgaccccgagggctttaaaaagagggccgcctgcttgtgtttccggagcgaacgcgaggacgaggtgcttttggtatccagcagtcgctatcccgatagatggatcgtccccggcggcggcatggagcctgaagaggagcccgggggcgctgccgtccgtgaggtgtacgaagaggctggagttaaaggcaaattgggtcggctcctgggggtattcgaacagaatcaggatcgcaaacaccgcacctacgtctacgttcttaccgtcaccgagctactggaagattgggaggatagcgtatcaataggaaggaagcgggaatggtttaaggttgaagatgccatcaaggttcttcagtgccataaacccgttcacgcggagtacctggaaaaacttaagctggggggttctccaaccaacggcaactccatggcaccctcctctcccgactctgatccttag

SEQ ID NO: 25440 - DNA, 792 bp, Artificial Sequence
  Description of Artificial Sequence: Synthetic coding sequence
atgagcctgtactgcggcatcgcctgccggcggaagttcttctggtgctacagactactttctacatatgtcaccaagacccgctacttgttcgagctcaaagaggatgatgatgcgtgcaaaaaagcccagcaaaccggagctttttacctgtttcattctttggcacctttactccagacaagtgcacaccaatacttagcacccagacattcattactagagctcgagaggctgctgggcaaattcggacaggatgctcagagaatcgaagattcagtgctcattggctgctcagaacagcaagaggcatggttcgccctggatctgggcctagacagcagcttttccatttcagccagcctccacaaacccgagatggaaacggagttgaaaggctcatttatcgaattgcggaaggctctctttcagctcaatgctagggatgccagtctgctctccaccgctcaggcactgctacgctggcatgatgcccaccagttttgtagccgaagtggtcagcctaccaagaagaatgtggcaggctctaagcgcgtatgccctagtaacaatataatttactaccctcagatccaggtgaacctccgcgagctggagacggctgcctggttctctcatgacgaagttgccactgcactcaaaagaaagggaccttacacccagcagcagaatggtaccttccctttttggttgccaccaaagctggctatctcacaccagctgattaaagaatgggtggagaagcagacatgctccagcttaccagcttag

SEQ ID NO: 25441 - DNA, 1059 bp, Artificial Sequence
  Description of Artificial Sequence: Synthetic coding sequence
atgagcctgtactgcggcatcgcctgccggcggaagttcttctggtgctatcgtctcctcagtacatacgttactaaaacacgctacttgttcgagctgaaggaagatgacgatgcctgtaagaaggcccagcagaccggtgctttttacttgttccactctctggcccccctgctccagacctcggcccatcagtacctcgcccctcgccattccctactggagctggagagactcctggggaaattcggccaggatgctcagcgaatagaagatagtgtcctcataggctgctctgaacaacaggaggcttggtttgctcttgatcttggcctcgattccagtttctccatttctgcgagcttacacaaacctgagatggaaacagagctgaaggggtccttcatagaactccgcaaggccctctttcagttgaacgccagggatgcttctctgctaagtaccgcccaagctctgctgagatggcatgacgcccatcagttctgtagccgaagcggacaacccaccaaaaaaaacgtggccggctctaaacgcgtgtgcccatcaaataacattatctattatcctcagatggccccagtggccatcactttggtgagcgacggcacacgctgcctgctcgctcgacaaagtagctttcctaagggcatgtatagcgcgctcgctgggttctgcgatatcggtgagagtgtggaagagactatccgtagagaggttgccgaagaagttggactggaagtggaatctcttcagtattacgcatcccagcactggccattcccatccggctctcttatgatcgcttgtcacgctacggtaaagcccggccagaccgaaattcaggtgaacctgagagagttggagacggctgcttggttctcgcatgacgaggtcgctaccgctttaaaacgaaaaggaccatacactcagcagcaaaatggtactttccccttttggcttccccctaagctggctatttctcaccaattgattaaagagtgggtggagaaacagacctgctcctctctgcctgcatag

SEQ ID NO: 25442 - DNA, 708 bp, Artificial Sequence
  Description of Artificial Sequence: Synthetic coding sequence
atgagcctgtactgcggcatcgcctgccggcggaagttcttctggtgctaccgccttctctcaacatacgtaactaaaacaaggtacctttttgaattgaaggaggatgacgatgcttgtaaaaaggcacaacagaccggagccttttatctcttccacagcctggcccccctgctccagacaagcgcccatcaatacttggcgcccagacactcattgcttgaactggagaggcttctgggaaagtttggacaggatgctcaacggatagaggatagcgttcttatcggctgttctgaacagcaagaggcttggttcgcactcgatcttggcctggattcttcattttccatcagcgcctccctgcacaaacctgaaatggaaactgagttaaaaggctcgttcatcgaattgcggaaagcattattccagctcaacgcgcgcgatgcctctcttctgtcaacagcacaggctctgctgagatggcacgacgcccatcagttttgcagccggtccggccagccaacgaagaagaatgtggctggatctaagcgcgtgtgtccctcaaacaacatcatctattacccccaagttaaggtgtggaaacgccccagcgcggagaaattgcagaaacgctgggattggaggtggaaggcttgcagcactatgcatccatcaatcgggccatctctcgtcgctcatagctag

SEQ ID NO: 25443 - DNA, 468 bp, Artificial Sequence
  Description of Artificial Sequence: Synthetic coding sequence
atggcccccgtggccatcaccctggtgagcgacggcacccggtgcctgctggcgcgtcagtccagcttccccaagggcatgtatagtgcactggctgggttctgcgatataggcgagtccgtcgaggaaaccatccgcagagaggtcgctgaagaggtgggtctggaggttgaatctctccagtactacgcctcccagcactggccttttccctcaggtagcctgatgattgcctgccacgcgactgtcaaacctggacagactgagatccaggttaacttacgcgagctcgaaaccgccgcctggtttagtcatgatgaagtggccacagccctaaagcgcaagggaccgtatactcagcaacaaaatggaactttccctttctggctgccgccaaagctcgccatctcccatcaactgatcaaggagtgggtcgaaaaacagacctgctcttcgctgcctgcctag

SEQ ID NO: 25444 - DNA, 681 bp, Artificial Sequence
  Description of Artificial Sequence: Synthetic coding sequence
atggagaccgagctgaagggcagcttcatcgagctgcggaaggccctgtttcaactaaacgccagagacgctagcctgctctccactgcacaagcactgctgcggtggcacgacgcacaccaattctgttctcgctccggacagcccacgaagaaaaacgtggccggctcaaagcgggtgtgtccctccaataacatcatatactatccccagatggcgcctgtggcgattaccctagtgagtgatggaacgagatgcctgttggctaggcaaagttctttccccaaaggaatgtactcggccctggccggcttttgcgatatcggtgagagtgtagaggagacgatcaggcgtgaggtggcagaggaagtcggccttgaagtggaatcgctgcagtattatgccagccaacattggccctttccctcaggctcactaatgattgcgtgtcacgccaccgtgaaaccaggacagacagaaatacaggtcaatttacgggagctcgaaactgctgcatggttcagtcacgacgaggtcgctaccgccctgaagaggaagggtccatacacacaacagcaaaacggaacctttcctttctggcttccccccaaactggctatttcgcatcagttgatcaaagagtgggttgaaaagcagacatgcagctcactgcccgcctag

SEQ ID NO: 25445 - DNA, 717 bp, Artificial Sequence
  Description of Artificial Sequence: Synthetic coding sequence
atgctgggccagcccgcccccctggagcggttcgccagccggcggcctcaggtgctggccgtcaggacagtctgcgaccttgtcctcgggaagatggacaaggactgtgaaatgaagcgtacaaccctggattcacccctgggtaagctggaactgtccgggtgtgaacagggactgcacgaaattaaactccttggcaaaggcaccagcgctgccgacgcagttgaagtccctgccccagcagctgttctcggggggcccgaaccactgatgcaatgcaccgcctggctaaacgcctactttcaccaacctgaagccatcgaagagtttccagtgccagccctccaccacccagtcttccagcaggaaagctttacgcgtcaagttctttggaagctgctgaaagttgtcaagtttggtgaggtaatctcctaccagcaactagctgctctagctggaaatcctaaagctgcacgcgccgtaggaggggctatgcgcgggaaccccgtgccaattctgattccatgtcacagagtcgtgtgctcttccggtgccgtgggcaactattcagggggcctcgcagttaaagagtggctgctagcccacgagggacataggctgggcaaaccaggtctgggaggatcctccggtctggcaggagcttggctcaagggcgccggcgctacttccggctcccctcctgctggtcgcaactag

SEQ ID NO: 25446 - DNA, 1569 bp, Artificial Sequence
  Description of Artificial Sequence: Synthetic coding sequence
atgagcagccggcccctggagagcccccccccctaccggcccgacgaatttaagcccaaccactacgcaccatctaacgacatttacggcggcgagatgcatgtcaggcctatgctcagtcagcccgcctatagtttctatcctgaagatgagattcttcacttttataagtggacgagtcccccaggagtaattcgcatcctcagcatgctaatcatcgtcatgtgtattgctattttcgcctgcgtggcgtctacattagcctgggatcgaggctacggaacctcgctcttaggcggctccgttgggtacccctatggaggtagcggcttcggaagctatggctcagggtacgggtacggatacggctatggctacggctatggtggatacacagatccacgagctgccaaaggctttatgcttgccatggctgctttctgtttcattgccgccctcgttatcttcgtgacaagcgttatccggagcgagatgagccgaacaagaagatactatctaagcgtgattatcgtgagcgccatcctggggatcatggtgtttatcgccacaattgtatatattatgggtgtcaatcccacagcccagagctcaggctcactgtacgggagccagatatatgccttgtgtaaccaattctatacacctgcagccaccggtctttacgtggatcagtacctttatcactattgcgtggtggatccgcaagaggccatcgcgatcgttcttggattcatgatcatcgtggcctttgctctgatcatcttcttcgccgtaaaaaccaggagaaagatggataggtatgacaaaagcaacatcctttgggacaaggaacatatctacgatgaacagcccccaaatgtggaggagtgggtaaagaacgtctctgcggggactcaagacgtgccctcacccccatcagattacgtggagcgggtcgactctccgatggcctatagcagtaatggcaaagtaaacgataagcgcttctatccggagtctagctataagtctacccccgtgcccgaagtggtgcaagagctgccactgaccagtccagtggacgactttcggcaaccgcggtactcctctggtggaaattttgaaacacccagcaaacgcgcccctgcaaagggtagagccggcaggtccaagaggacggagcaggatcattacgagactgattacaccacaggcggagaatcttgtgatgaacttgaggaagattggatccgtgagtaccccccaatcacaagcgaccagcaaagacaattatacaagcgcaactttgacacgggacttcaggagtacaagtcccttcagtccgagctggacgagatcaataaagagctcagtaggctcgataaggaactggatgactatcgggaggaaagcgaggagtatatggctgctgcagatgaatacaataggctcaagcaggtgaaaggcagcgccgattataagtcaaagaagaatcactgtaaacaattgaagtccaagctgtcccacataaaaaagatggtcggcgattacgaccggcagaaaacctag

SEQ ID NO: 25447 - DNA, 1407 bp, Artificial Sequence
  Description of Artificial Sequence: Synthetic coding sequence
atgagcagccggcccctggagagcccccccccctaccggcccgacgagtttaaaccgaaccactacgcaccttcaaacgacatctatggcggtgagatgcacgttcggcccatgctatcgcaacccgcctacagcttttatcctgaggacgagatcctgcacttctataaatggacatcacctcccggggtcatcagaatccttagcatgctgataatcgtgatgtgtatagcgatttttgcgtgtgtggcttcgacactggcctgggacagagggtatgggacttctctcctgggggggagcgtgggatatccctacggcggttctggatttgggtcctacggctccggttacggttatgggtatggttatgggtacggatacggcggctacacggatccacgcgccgctaaaggattcatgttggccatggctgctttctgtttcatagcagcccttgtgatctttgtgaccagcgtgatcaggagcgaaatgtctcgaactcgccgatattacctctccgtaatcattgtatctgccatactgggaattatggtgttcatagccacaatagtgtacatcatgggtgtgaaccccaccgcccagagcagcgggtcactttacggctctcagatctacgccttgtgtaatcagttctatacgcctgctgcgactgggctatatgtcgatcaatatctgtaccactattgcgtggtagacccccaggaagtgaagaacgtatctgcgggaacacaggacgttccatctcctcctagtgattacgtggagcgcgttgattccccaatggcctactcatccaatggcaaggtgaacgacaagcgcttttaccccgaatcatcgtataagtccacacccgtcccggaagtggtgcaggaactccccctgaccagcccagttgatgacttcaggcagccccgatactcctctggtggcaactttgagacccccagcaagagagcacctgcaaaggggcgggcggggcgcagcaagagaaccgagcaggaccattatgaaacagactataccaccggtggcgaatcttgtgacgagctggaagaggattggattcgagagtaccctcctattacctctgatcagcaacggcagctctataagagaaacttcgatacgggcctgcaagagtataagagcctgcagagtgaactcgacgaaatcaacaaggagcttagcagactggataaagagctagacgactatcgggaggagtctgaggagtatatggcagcagctgatgaatataataggctcaagcaggtcaaaggttcagccgactacaagtcaaagaagaaccactgcaagcagctgaagtcaaaattgagccatatcaaaaagatggtgggggattatgacagacagaagacatag

SEQ ID NO: 25448 - DNA, 1569 bp, Artificial Sequence
  Description of Artificial Sequence: Synthetic coding sequence
atgagcagccggcccctggagagcccccccccctaccggcccgacgagtttaagcccaaccattacgccccaagcaatgacatctatggcggtgagatgcacgtgagaccaatgttgtcccagcccgcgtattcattctatccggaggatgaaatcttgcacttttacaaatggacctcccctcccggcgtgattagaattctctccatgctgattattgtgatgtgcatcgcaatatttgcctgcgtggcctccaccctggcctgggaccgcgggtatggaacctcactgctcgggggatcagtgggatacccttacggcggatccggatttgggtcctacggcagcggctatgggtatgggtatggctacggttatggctatggcggatacaccgaccctagagcagcaaaaggctttatgctcgcaatggctgccttttgcttcatcgccgccctggtcattttcgtgacctcagtaattagatccgagatgtctcgtaccaggagatattatctctccgtcatcattgtgagtgccattcttggcatcatggtattcatcgctacaattgtgtatattatgggggtcaacccaacagcccagtcttcggggtccttgtacggctcccagatatacgcactgtgtaatcagttctatacgcccgccgctaccggcctttacgtcgaccagtatctgtaccattactgcgttgtggatccacaggaggcgatcgcaattgtgcttgggttcatgatcatagtcgcattcgcacttattattttttttgccgtgaagactaggcgcaagatggatcgctatgataagagcaacatactgtgggacaaggaacatatatacgatgagcagccgcctaatgtggaggaatgggtgaaaaacgtcagcgctggaacccaagatgtcccctctccccctagcgactatgtggaaagagttgactcacccatggcttattcctccaacggcaaggtcaacgacaaacggttctacccagagtcctcctacaagtctacccccgttccagaggtggtgcaggagctccctctcactagtccagtggacgattttcgccaacctaggtattctagtggcggtaatttcgagactccttctaaacgcgccccggccaaaggaagggctggaagatcaaagcggactgagcaggatcactacgagaccgactacacgaccggcggggagagctgcgacgagctcgaggaggattggatcagggaatacccacccatcacgagtgatcagcaaagacaactctacaagaggaacttcgacacaggactgcaggagtataagtcacttcaaagtgagctcgacgagattaacaaggaactatccaggctggataaggagcttgatgactatagagaagaaagtgaggaatatatggctgccgcggacgagtataacagactgaagcaggttaaggggtccgccgactacaagagcaagaagaaccactgcaaacaactgaaaagcaagttatctcatattaagaaaatggtgggggactatgaccggcaaaagacatag

SEQ ID NO: 25449 - DNA, 816 bp, Artificial Sequence
  Description of Artificial Sequence: Synthetic coding sequence
atgatcatcgtggccttcgccctgatcatcttcttcgccgtgaagacccgaagaaagatggaccgctacgacaaatctaacattctatgggacaaggaacatatctacgatgaacaaccacctaacgtcgaggagtgggtgaagaatgtgagtgccggcacgcaggacgttccgagcccccccagcgattacgtggagagagtcgactctcctatggcgtacagctcgaatgggaaagttaatgataagcgtttttaccccgagagcagttacaagagtactcctgtgcccgaagtggtgcaagagctgcccctcacatcgccggtcgatgactttcgacagccccgttattccagcggaggaaactttgagaccccctccaagagagctccagctaagggcagagccggaagatctaagagaaccgagcaggaccactacgagacagactacacaacaggaggcgaatcatgtgacgagttagaggaggattggatcagagagtacccccccattacgtcagaccagcagagacaactgtacaagcgaaatttcgatactggacttcaagagtataagtccctgcagagtgaactggatgagatcaacaaagagctaagtaggctcgacaaagagctcgatgactatagggaggagtcagaggagtacatggcagccgctgatgagtacaacagactgaaacaggtgaaggggtctgccgattacaaaagcaagaagaaccactgtaagcagctgaagtctaagctgtctcacattaaaaagatggtcggggattacgatagacagaagacttag

SEQ ID NO: 25450 - DNA, 603 bp, Artificial Sequence
  Description of Artificial Sequence: Synthetic coding sequence
atggcctacagcagcaacggcaaggtgaacgacaagcggttctaccctgagtccagttataaatctacccccgtgccagaagtcgttcaggagcttccactgacaagtcccgttgatgacttcagacagccgcggtacagctcaggtggcaactttgagaccccatccaagcgagcccctgccaaaggacgggccggaagaagcaaacgcactgaacaggatcactacgagaccgactacacaaccggaggcgaatcttgcgacgagctggaggaagattggatccgggagtaccccccgatcacatccgatcaacagcgccagctctacaagaggaattttgataccggtctgcaggaatacaagagtttacaatctgaactggacgaaatcaataaagagctctctcgtttggacaaggaacttgacgattaccgcgaggaatctgaagaatatatggctgctgctgatgaatacaacaggcttaagcaggtgaagggtagcgcagactataagagtaaaaagaatcactgcaaacaactgaagtcgaaactgagccacattaaaaaaatggttggcgattacgaccgccaaaagacctag

SEQ ID NO: 25451 - DNA, 3114 bp, Artificial Sequence
  Description of Artificial Sequence: Synthetic coding sequence
atgtggcggtgcggcggccggcagggcctgtgcgtgctgcggcggctctctggaggacacgcccaccacagagcctggaggtggaatagcaacagagcatgcgagagggcgctgcaatataaactgggagacaagatccatggatttacggtgaaccaggtcacaagtgttcctgagctgtttttaaccgccgtgaagctcacacacgatgacactggagcccgttatctgcacctggccagggaagacactaataacctgtttagcgtgcaattcaggacgacgccgatggacagcactggagtgcctcacatcctggaacacaccgtactgtgtggatcacaaaagtatccttgccgcgatcctttctttaaaatgttaaatcggagtctcagcactttcatgaacgcatttacagcttcagactacactttgtacccttttagtacacagaatcccaaggactttcagaaccttctttccgtctatctcgatgccaccttcttcccatgtctgagggagctggacttctggcaggaggggtggaggctggagcatgagaatccaagtgacccccagaccccacttgtgttcaaaggagttgtcttcaacgagatgaagggcgcctttgttaataacgagaggatatttagccagcacttacagaacaggttgctgcccgaccacacttattccgtcgtctcaggaggcgatcccctgtgtatacccgagctcacttgggagcagcttaagcagtttcacgctactcactatcaccctagcaacgcccggttcttcacgtacgggaatttccctctggaacagcaccttaaacaaattcacgaggaggccctttctaagttccagaaaattgagccatcaacagtggtacctgctcaaactccctgggataagccacgggagttccagattacatgcggcccagacagtttcgctacagaccccagcaagcagaccaccatttccgtgagcttcctgttgccggatattaccgatactttcgaagccttcaccttgtcattgctcagttcactgcttacttctggacctaacagccctttctacaaggcactgattgaatcaggcttggggaccgatttctctccagatgtcggatataacggctacacacgggaggcctatttcagcgtgggcctgcaagggatcgccgaaaaggacatagaaaccgttcgctcattgattgacagaaccatcgacgaggtggtggaaaagggtttcgaggacgatagaatcgaggccctgttacacaagatagaaatccaaatgaaacaccagagcacctcatttggcctgatgctcactagctacatcgcctcatgctggaatcatgacggagacccagttgagctgctgaagctggggaaccagctagcaaaattccggcagtgcctacaagagaacccaaagttcctgcaggagaaggtgaaacagtattttaaaaataaccagcacaagttgaccttgtccatgcgccctgatgacaaataccacgagaagcaggcacaggtagaagcaacaaaactgaaacaaaaagtggaagccctgtctcctggcgacagacaacaaatttatgaaaaggggcttgaattgcgctcccagcagagcaaaccccaggacgcttcctgtttgcccgctctgaaggtctctgacatcgaaccaacaattcccgtcacagagttggacgttgtactaaccgccggtgacattccagtccagtactgtgcccagccgaccaatggcatggtgtactttcgcgccttttcgagtctcaatactcttcccgaggaactgaggccatatgtgcctctattctgtagtgttcttacaaagttggggtgtggacttctagattaccgagaacaggcccagcagatcgagcttaaaaccggcggcatgtcagcctcaccccacgtactgcctgacgattctcatatggatacatacgagcaaggcgtcctgttttcctcactgtgtctggatagaaacctgcccgacatgatgcagctgtggagtgaaattttcaataatccctgcttcgaggaggaggaacacttcaaggtacttgtcaagatgaccgcccaggaactcgctaatggcattcctgatagtggccacttatacgcttcgattagggccgggagaaccctgacaccagcaggggaccttcaggagaccttttccggcatggaccaagttcgactcatgaaaaggatcgctgagatgaccgacatcaagcctatcctgagaaaactaccccggatcaaaaagcacttgttaaacggcgacaatatgcggtgttccgtaaatgcaacgccacagcaaatgccccagactgagaaagcagtcgaggacttcctacgctcaattgggagatccaagaaggagagaaggcctgtgagaccccatacagttgagaagccagttcccagctcaagtggaggcgatgcacacgtgccccacggatcccaggtcatcagaaagctggtcatggagccaactttcaagccgtggcagatgaagactcattttctcatgcccttcccagttaactacgtgggcgagtgtattcgcactgtgccatatactgatcccgatcacgcatctctgaagattttggcccggcttatgactgccaaatttctccacacggagatccgggagaaaggaggcgcatacggaggcggagccaaactgagtcataacggtatcttcaccttgtattcttaccgagatcctaatactatcgagacactgcagtctttcggaaaagccgtggactgggctaagtctggaaaattcacacagcaggatatagatgaagccaagttaagtgtgttctcaactgtcgatgctcccgtcgccccttccgacaaggggatggaccatttcctttacggattgagtgatgagatgaagcaggcgcatcgcgagcagcttttcgccgtttctcatgataaattgttggctgtgagcgataggtacctcgggacaggaaagagcacccacggtctggccatcttgggccctgaaaaccctaagattgctaaggacccctcctggatcattcagtag

SEQ ID NO: 25452 - DNA, 1107 bp, Artificial Sequence
  Description of Artificial Sequence: Synthetic coding sequence
atgcagcccggcagcagccggtgcgaggaggagacccccagcctgttgtgggggctggatcctgtcttcctggcattcgccaagttgtatattcgggacattttagacatgaaagagtccagacaagtgcctggcgtattcctgtacaacgggcatcctatcaagcaagtagacgtgctaggcacagtgattggcgtgagggagagagatgcattctacagttacggcgtagacgactcgactggcgtcataaactgtatctgctggaagaagctaaataccgagtccgtctctgctgcacctagcgcggctcgggagctctcactcacgagtcagctgaagaaactccaagagactatcgaacaaaaaactaaaatcgaaataggagatacgatcagagtgcgaggcagcatccgcacatacagggaggaaagagagatacatgctaccacttactataaggtcgatgatcctgtctggaacatacagatcgcccggatgttagagttaccgaccatttacagaaaagtgtatgaccagccgtttcactcctctgctctggagaaggaagaagcccttagcaatccgggcgcattagatctgccaagccttacgagcttgctctctgagaaagctaaggaattcctgatggagaatcgagtgcagagtttctaccagcaggagctggaaatggttgaatcactcctgagcctagctaaccaacctgtgatccattccgcttcctccgatcaagtgaattttaagaaagacacaacgtctaaggctatccactcaatattcaaaaacgctatccagcttttgcaagagaaaggcttggtattccagaaggacgacggtttcgacaatttatattatgtgactagggaagataaggacctgcatagaaagatccatagaataatccagcaggactgtcagaagcccaatcacatggagaaggggtgtcactttctgcacattctggcatgcgcccgcctttcaattagacctggtctgagcgaggccgtcctacagcaggtgctggaacttcttgaggaccagagcgacatcgtgagcaccatggagcattactataccgctttctag

SEQ ID NO: 25453 - DNA, 1038 bp, Artificial Sequence
  Description of Artificial Sequence: Synthetic coding sequence
atgggcgtgtgcggctacctgttcctgccctggaagtgcctggtggttgtcagtctgcgcttgttgttcctggtgcccacaggcgtccctgttcgctccggggacgccaccttccctaaggctatggacaacgttactgtgcggcaaggagaatctgccaccctccggtgcaccattgatgatcgcgtcactcgcgttgcctggctgaaccgaagtactatcctctacgccgggaatgataagtggagcatcgatccacgggtgatcattctcgtcaatacccccacccagtatagcattatgatccaaaatgttgatgtgtatgacgaaggcccatatacctgttcagtacagaccgataatcatccgaagaccagccgagtacacctgatcgttcaggtgccacctcagatcatgaacataagtagtgacataaccgtaaacgaaggatctagcgtgacactcctgtgtttggcaatcggcagaccagagcctaccgtaacttggcggcatctgagtgtgaaggaggggcaggggtttgtgtctgaagacgaatatttagaaatatctgatatcaagcgcgaccagtcaggcgaatacgagtgctctgcacttaatgatgtggctgcccccgatgtccggaaagtaaagattaccgtcaactaccccccctacatatccaaagcgaagaataccggtgtctccgtcggccaaaaagggatcttgtcatgtgaagccagcgccgtgcccatggcggaattccagtggtttaaagaggaaacccgtctggctactggtcttgacggcatgagaatcgaaaacaagggacgaatgtccactctcacattctttaatgtaagcgaaaaagactacggaaactacacctgtgtagcaaccaacaaacttggcaatacaaatgcttcgatcaccctatatggacccggagcagtgattgatggtgttaactcggcttctcgcgccttggcctgcctatggctgtccgggactctgttagcacacttctttattaagttttag

SEQ ID NO: 25454 - DNA, 939 bp, Artificial Sequence
  Description of Artificial Sequence: Synthetic coding sequence
atgtaccaccccgcctactgggtggtgttcagcgccaccaccgccttgctgtttatccccggcgtacccgttcgttcaggcgacgccacctttccgaaggcaatggacaacgtgaccgttcgacagggcgagtcagcgacacttagatgcacaattgacgacagagtaacccgtgttgcatggctgaaccggagcactattatgatccagaacgttgatgtgtatgacgaagggccttacacctgcagcgtccagaccgataatcacccgaagacctctagggtgcaccttatagttcaggttcccccccagatcatgaacatctcatcggacattactgttaacgagggcagctcggtgaccctgctctgcctcgccattgggcgcccggaacccactgttacttggagacatcttagcgtgaaggagggacaggggtttgtcagtgaagacgaatacctggagatttcagacattaaacgcgaccagtcgggggaatatgaatgcagtgcgctgaatgacgtggctgctccagacgtgcgcaaggttaagatcactgtcaattatcctccctacatttcaaaggccaagaatactggagtgagcgtcggccagaagggcattcttagctgcgaggccagcgcggtgcctatggctgagtttcagtggttcaaagaagaaactcgcctggccaccggactggacggaatgcggatagagaataaagggcgcatgagcacccttactttctttaatgtgtcagagaaggattacggcaattacacctgtgttgcaacaaacaagctgggcaatacaaatgcctccattaccctgtacggccctggggcagtgatagacggggtcaattctgcctcgcgtgctctggcctgtctgtggctcagcggcactctgctggcccacttctttataaagttttag

SEQ ID NO: 25455 - DNA, 1017 bp, Artificial Sequence
  Description of Artificial Sequence: Synthetic coding sequence
atgtaccaccccgcctactgggtggtgttcagcgccaccaccgccctgctcttcatccccggagttcctgtcagatcaggagacgctacttttcccaaagctatggacaatgtgactgtgcgacagggcgagagtgctacactgcggtgtaccattgacgatcgggtgacccgggtcgcctggttaaaccgtagcaccattctttatgccggcaatgacaagtggtcaatcgacccccgggtgataatactggtaaacacaccaacccaatactccattatgatccagaacgtggacgtgtatgacgagggtccttatacatgcagcgtgcagactgacaatcaccccaagacctctagggttcatctgatcgtccaagttccaccacagatcatgaatatcagctccgatattacagtcaacgagggcagctctgtaaccctgctctgcctggccatcggtcggccagaaccaactgttacctggcgccacttgagtgttaaggaaggccagggcttcgtgtcagaggacgagtacttggagattagcgatattaaaagagatcagtcaggagagtatgagtgctccgctctcaacgacgtagctgcccctgacgtacgaaaggtcaaaatcactgtaaactatcctccttacatctcaaaggccaaaaataccggcgtttccgttgggcagaagggtatactgagctgcgaagcatccgccgttccgatggctgagttccagtggttcaaagaggagacaagactagctactggtctcgacggaatgcgcattgaaaacaaaggccgcatgtcaactttaaccttcttcaatgtgtccgagaaggactacggcaattacacttgcgtagcaactaataagctcggcaacactaacgcttcgataacattgtatggccctggggccgttatcgatggagtgaacagcgcttctcgagccctggcttgtctctggctaagcggcaccctgctcgcccactttttcattaagttctag

SEQ ID NO: 25456 - DNA, 1065 bp, Artificial Sequence
  Description of Artificial Sequence: Synthetic coding sequence
atgggcgtgtgcggctacctgttcctgccctggaagtgcctggtggtcgttagtctgagactgctgttcctagttcccaccggtgttccggtgcgtagcggtgacgctacatttccgaaggccatggacaatgttactgtccgacagggcgagtctgccacactccgctgtacaatcgacgaccgagtcactcgcgttgcttggctgaaccgctctacaatcctgtacgccggaaatgacaagtggagcatcgacccccgggtcattatcttagtcaatacccctacacagtattccattatgatccaaaatgttgacgtgtacgatgaggggccgtacacatgttctgtgcagaccgataatcaccccaagacctccagagtccacttgatcgtccaggtgcctcctcaaattatgaatatttcctctgacattacagtcaacgagggatcatctgttaccctcctatgcttggcaatcgggagacctgagccaacagtgacatggcggcacctgagcgtgaaagaaggccagggctttgtttctgaggatgagtatctggagatctccgatatcaaacgagatcaatcgggagagtatgaatgttccgccctcaacgacgtggctgctcccgacgtgcgcaaggttaaaattacagtgaattatcccccctacatctccaaggcgaagaatactggagtgtccgtgggccagaaaggtatcctgtcctgtgaggcctctgcagtgccaatggccgaattccagtggttcaaggaagagaccagactggcgaccgggctggacggtatgcgcatcgaaaacaaaggaagaatgagcacattgactttctttaatgtctccgaaaaggactacggcaattatacctgtgtggcgaccaacaaattggggaatactaacgcttctatcacactgtacgagatttcacctagcagcgccgttgctgggccgggggctgttatcgacggggtcaactcagcaagtcgggctctcgcatgcttgtggctgagcgggacactcttagcacactttttcataaagttttag

SEQ ID NO: 25457 - DNA, 1662 bp, Artificial Sequence
  Description of Artificial Sequence: Synthetic coding sequence
atgagcaacaacggcctggacatccaggacaagccccccgccccccccatgaggaacacgtctaccatgataggggcagggagtaaggatgccggaactcttaaccacgggtccaagcccctcccaccaaatcccgaggaaaagaagaaaaaggaccgcttctaccggagcattttgcccggtgacaaaacaaacaagaagaaggagaaggagcgtcctgagatcagtctcccatctgatttcgagcatactatacacgtaggcttcgacgctgtcaccggcgagtttacaggcatgccggagcagtgggctcggcttctgcagacaagcaatattacaaagagcgagcaaaagaaaaatccacaggcagtgctcgatgtgctggagttttataattccaaaaaaacgtcgaattctcagaagtacatgtcttttactgacaaaagtgccgaagactacaacagctccaacgctttgaacgtgaaagccgtgtctgagacacctgcggtgccacccgtctctgaggacgaggacgacgatgacgacgatgcgactccacctcccgtcatagccccacggccggaacatactaagtccgtctacacgcgatctgtcatcgaaccattaccagtgacaccaacccgagacgttgctacatctcctataagtcccacggagaacaataccacccctcctgatgcccttacgcgcaacacggagaaacaaaaaaagaaacccaaaatgtcagacgaggagatactggaaaaactgcgatctatagtttcggtaggagatcctaaaaaaaaatacacccgctttgagaagattggccagggggcttccgggaccgtgtatactgctatggatgtagccacgggccaggaggtggctataaaacagatgaatctgcaacaacagcctaagaaagaactgatcattaatgagatcctggtcatgcgagaaaacaagaaccccaacattgttaactacctggactcctatttagtgggcgacgagctgtgggtggtaatggagtacttggcagggggatcgttgacagacgtggtgactgagacatgtatggacgaagggcaaatcgcggcagtgtgtcgggaatgtctacaggccctggagttcctccattcgaatcaggtcatccatcgggatattaaatccgacaacatcctgctgggaatggacggctctgtgaaattgacagacttcggcttctgcgcccagatcacccctgagcagagtaagagatctaccatggtggggacaccatattggatggctcccgaagttgtcacacgcaaggcatacgggccaaaggtagatatctggagcctggggattatggcgatcgaaatgatcgaaggcgaaccaccatatctgaatgaaaatcctcttagagcgctttacttaattgccactaacggtaccccggaactccagaatccagaaaaactctctgcgatcttccgggactttctgaaccggtgtttagagatggacgtggaaaagcgcgggagcgcaaaagagctgctgcaggtgcgcaaactgcggttccaggtgttttcgaatttctctatgattgccgcaagtattcccgaggattgccaggccccactccaaccccattcaaccgactgttgctcctag

SEQ ID NO: 25458 - DNA, 1638 bp, Artificial Sequence
  Description of Artificial Sequence: Synthetic coding sequence
atgagcaacaacggcctggacatccaggacaagccccccgccccccctatgcggaatacatccactatgattggcgccggcagcaaagatgctgggacactgaatcacggcagtaaaccattacctcctaacccggaggagaagaaaaaaaaagaccgcttctatcgcagtattctgcccggagacaagaccaataaaaaaaaggaaaaggaaaggccagaaatcagccttccctccgactttgaacacaccatacacgtgggcttcgatgccgtgaccggtgagttcacaggcatgccagagcagtgggctcgactccttcagacttctaatataacgaaatcggaacagaaaaaaaacccacaggctgtgctagatgttctcgaattctacaattcaaaaaaaacaagtaactcgcagaagtatatgtcattcactgataagtccgctgaagactacaactcgagcaacgccctgaacgtgaaggcagtttccgagacccccgccgtgcccccggtatctgaggacgaggacgatgatgacgacgatgctacgcccccacccgttatcgccccccgacccgagcatacaaagtctgtgtacacacggagcgtgattgaacccctgcccgtcaccccaacccgcgacgtcgccaccagcccgatcagtcctaccgagaataatactaccccgccagatgcactgactcgcaacaccgagaagcaaaagaaaaaaccaaagatgagcgatgaagagatcctcgagaagcttagaagtatcgtcagcgtgggggatccaaagaagaagtataccaggtttgaaaaaattggtcagggagctagtgggaccgtttatacagccatggatgttgcaacgggccaggaagtggcgatcaagcagatgaatctgcagcagcagccgaaaaaggagctgatcatcaatgaaatcttggtgatgagggagaacaagaacccaaatatcgtcaattatctggacagttacctggtgggcgacgagctgtgggtggtgatggagtaccttgccggaggctctctgaccgacgttgttaccgaaacttgcatggatgagggacaaatcgcagctgtgtgccgagagtgcttacaggcactcgagtttttgcacagtaaccaggtgatccatagagacattaaaagcgacaacatcctgctggggatggacggatccgtcaagctgacagacttcggcttttgtgcgcagatcacaccggagcaatccaagaggtccaccatggtaggcacaccgtattggatggcacctgaggtggtgacccgaaaggcttacggaccaaaggtggatatatggtcactggggatcatggcaattgagatgatcgaaggggagcctccctatttaaacgagaaccccctgagggctctctatttaatagctactaatggcaccccagaactgcagaaccctgagaaactaagtgcgattttcagagacttcctgaaccgatgtttagaaatggacgtggaaaagagaggctcagctaaagaattgctccagcatcagttcttgaagattgctaaacccctgtccagcctgacccccctcatcgctgcagcaaaagaagccactaaaaataaccactag

SEQ ID NO: 25459 - DNA, 300 bp, Artificial Sequence
  Description of Artificial Sequence: Synthetic coding sequence
atgagcaacaacggcctggacatccaggacaagccccccgcccccccaatgcggaatacttccactatgattggggcgggatccaaagatgcaggaaccctgaaccatggcagcaaacctttaccccctaacccagaggagaaaaaaaagaaagaccgcttctaccgatccatcctacccggagataaaacaaacaagaaaaaggagaaggaaagacctgagatatcactccctagcgattttgaacacaccatccatgtcggttttgatgcagtgacgggagaatttactggcatgtag

SEQ ID NO: 25460 - DNA, 81 bp, Artificial Sequence
  Description of Artificial Sequence: Synthetic coding sequence
atgagcaacaacggcctggacatccaggacaagccccccgccccccctatgagaaatacaagtactatgatcggtgcttag

SEQ ID NO: 25461 - DNA, 270 bp, Artificial Sequence
  Description of Artificial Sequence: Synthetic coding sequence
atgagcaacaacggcctggacatccaggacaagccccccgccccccccatgaggaatacgagtactatgatcggcgccggcagtaaggatgctggcactctgaatcacggctctaagcctctgcccccaaaccccgaggaaaagaagaagaaggacaggttttacaggagtatacttcccggcgataagaccaataaaaaaaaggaaaaggaaagacccgagatctcactcccgtccgacttcgaacataccattcacgtgggtttttag

SEQ ID NO: 25462 - DNA, 192 bp, Artificial Sequence
  Description of Artificial Sequence: Synthetic coding sequence
atgagcaacaacggcctggacatccaggacaagccccccgccccccctatgagaaacacaagtaccatgatcggtgctggatctaaagacgcaggtacactgaaccatggctccaagccgctccccccgaatccagaagagaagaaaaagaaggaccgattctaccgatcgatcttacctggggataagtag

SEQ ID NO: 25463 - DNA, 321 bp, Artificial Sequence
  Description of Artificial Sequence: Synthetic coding sequence
atgagcaacaacggcctggacatccaggacaagccccccgccccccctatgcggaatacttcaactatgatcggggccggcagcaaagatgctggtaccctgaatcatggctccaaacctctgccacccaatcccgaagagaagaagaaaaaggatcgcttctataggagcatcttgcctggagacaagaccaataagaaaaaggaaaaggaacgacccgagatctccctgccaagcgattttgagcatacaatccacgttggcttcgacgcggtgaccggggagttcacagggatgcctgagcagtgggcacgcctttag

SEQ ID NO: 25464 - DNA, 1569 bp, Artificial Sequence
  Description of Artificial Sequence: Synthetic coding sequence
atgagcaacaacggcctggacatccaggacaagccccccgccccccctatgcgtaatacatctaccatgattggagctgggtccaaagatgctggcactctgaaccacggatccaagccgctgccacccaacccagaagagaagaagaaaaaggatagattttacagatcaattctgcctggtgataaaaccaataaaaaaaaggaaaaagagcggccagagattagcttgccctccgacttcgagcataccattcacgttggctttgatgccgtgacaggggaattcactgggatgcccgaacagtgggcacgactgctccagacctctaatataaccaagtctgagcagaagaaaaatccgcaagctgtcctagatgtgcttgaattttacaacagcaagaaaacatccaattcccagaaatatatgagctttacagataagagtgctgaagactacaacagctctaatgctctaaatgtgaaagcggtgagcgagactccagccgtgcctccagtctctgaggacgaggatgatgacgacgacgacgcaacacctccgcctgtgattgcacctcgccccgagcacacaaaatcagtgtacacaaggagcgtgatcgagccgttgccagttaccccaacaagggatgtcgccacgagccctatctcaccgactgagaacaacacgacaccccctgatgccctcacgcggaataccgagaagcaaaagaaaaaaccgaagatgagtgatgaggagattctggagaagctgagatccatcgtctcagtcggtgatccaaaaaagaaatatacacgttttgagaaaatcggccaaggcgcctccggaactgtttataccgcgatggacgtcgccaccggacaggaggtcgccatcaagcagatgaatctgcaacagcaaccaaagaaagagctaattatcaacgagattctggtgatgagagaaaacaagaacccgaacatcgtcaactatctcgactcatatctcgtgggagacgaactgtgggttgttatggaatatctggcaggcggttccctgactgacgtggtcaccgagacttgcatggatgaaggacagatagcagcagtgtgcagggagtgtttacaggctctggagttcctccattccaaccaagtgatccaccgggacattaaatcagataacatccttcttgggatggatggcagcgtcaaacttactgattttggcttctgcgcacagattactcccgagcagagcaagaggagtaccatggttgggacaccgtattggatggccccagaggtcgtgacccgtaaggcatatgggccgaaagtggacatctggagtctaggcattatggctatagagatgatagagggcgagcccccgtatctgaacgagaacccacttcgagcgctctacctaatcgcaaccaacgggactccagagctacagaaccccgaaaagctcagtgcaatcttccgagacttcctgaacagatgtctggaaatggacgtcgaaaaacgcggctcggctaaggagctattacaacactcaagcagactctag

SEQ ID NO: 25465 - DNA, 1317 bp, Artificial Sequence
  Description of Artificial Sequence: Synthetic coding sequence
atgttcggcaagcggaagaagcgggtggagatcagcgcccccagcaatttcgaacatcgggtccacacggggttcgaccaacatgagcaaaaattcaccggtctgccccgccaatggcagtctttgattgaggaatctgcacggcgccccaagccgctggtagatcctgcttgtataacctctatacagccgggagcccccaagggcgagccccacgacgtggcgcccaacggccccagcgctggcggcctggcaattcctcagagctcttcatcttcctcgcgtcctccaactcgcgctcgcggggccccgagcccaggagtgctaggtccacacgcatccgaaccacagcttgccccccctgcctgcactccggccgccccagccgtcccaggcccacccggccctaggtccccacagagagagcctcagagggtcagtcatgaacaattcagggccgccctacaacttgtagtagatcctggggatcccagatcctatctagacaatttcatcaagataggcgaaggtagcacgggtattgtctgtatcgcgactgtgcgctcatccggaaaactagttgccgtgaagaagatggacctgaggaagcagcagagaagggaactactgtttaacgaggtagtgatcatgcgtgattaccaacacgagaatgtcgttgagatgtataactcctatctcgtgggcgacgagttatgggtggtgatggagttcctggagggaggcgctctgaccgatatcgttacgcacaccaggatgaacgaggagcagattgctgccgtatgtctggcagtgctgcaagccctctcagtgctgcatgctcaaggagtaatacatcgtgacatcaaatctgattcaatcttgctgacccacgatggccgggtgaaattatccgacttcggattttgtgctcaggtgtcaaaggaggttccacgaagaaaaagccttgtcggcacgccatattggatggccccggaactcatctcacgcctcccttatggtccggaagtggatatttggtcgctcggcatcatggtgatcgaaatggtggacggagagccaccatacttcaacgaaccgccccttaaggcaatgaagatgattcgggataacctccccccacgccttaagaacttgcataaggtgtcaccgagcctgaagggcttcctggaccgtcttctggtccgagatccggctcagcgggccactgccgccgagttactgaaacacccctttctggcgaaggccggcccacctgcgagcatcgtcccactgatgcggcagaatcggacaaggtag

SEQ ID NO: 25466 - DNA, 1776 bp, Artificial Sequence
  Description of Artificial Sequence: Synthetic coding sequence
atgttcggcaagcggaagaagcgggtggagatcagcgcccccagcaattttgagcacagagtacacacaggatttgatcagcatgaacagaagttcacagggcttcctagacagtggcagagtcttattgaggagtctgcccgtcggcccaagccgttggtcgatccggcttgtattacgtccattcagccaggagcccctaagacaatcgtccggggaagcaagggagccaaggatggcgccctgaccttgttgcttgatgagtttgagaacatgtcggttacacgtagcaattctctgcgccgggattcgcctcctcccccggcccgcgcacgccaggaaaacgggatgccagaggaaccggcgaccaccgcccgtgggggcccaggtaaagctggttctcgggggcgcttcgcggggcattccgaagccgggggcggctccggcgaccggaggagggccggaccagaaaaacgcccgaaatcctcacgagagggctcaggcggacctcaggagtccagcagggacaagcgcccactttccggacccgatgtgggtactcctcagcctgctggactcgcctcaggtgcaaaactagccgcgggcagaccgtttaacacctacccacgcgccgatactgatcatccatcgaggggggcccagggcgagcctcatgacgtagcacccaatggccctagcgctgggggcttggccatcccccagtcctcctccagctcctcacgacctcccacacgagcccggggcgctccatctccgggggtgctgggacctcacgcatcagagccccagttagccccgcctgcatgcactcctgcagcccccgctgttcctgggccccctggccctcggtccccgcagcgcgaaccccagagggttagccacgaacagtttcgggccgctctgcaactggtggtcgatcctggtgacccccgctcatacctggataacttcatcaagataggcgaaggctccaccgggatcgtgtgtatcgccaccgtgagatcgagcggaaaattggtggctgtcaagaagatggacttgaggaagcagcagagaagagaattgctctttaatgaagtggtgataatgagggattatcagcacgaaaatgtggtggagatgtacaacagttatcttgttggcgatgaactgtgggtggtcatggaatttctggagggcggcgcccttactgacatagttacccacactagaatgaacgaggagcagatcgctgcagtatgccttgccgttctgcaggctctgtctgtacttcacgctcagggggtcatacatcgtgacatcaagtccgactccatccttctgacgcatgacggaagagttaaactgagcgacttcggcttttgcgcgcaggtgtccaaagaagtccctaggagaaagagtctcgtggggacaccgtactggatggctcccgagttgataagccgtcttccttacgggcccgaagtggatatatggagcctcggaatcatggtgattgagatggttgacggcgaaccaccctattttaacgagcctccacttaaggcaatgaagatgatcagggacaatttacccccaagactcaagaaccttcacaaagtgtctcccagccttaagggttttctggatcgactgcttgtgcgggatcctgctcagcgtgccaccgccgcagaactgttaaagcaccctttcctggctaaagctgggccccctgcctcaatcgtgccattaatgcgtcagaatcggaccaggtag

SEQ ID NO: 25467 - DNA, 1188 bp, Artificial Sequence
  Description of Artificial Sequence: Synthetic coding sequence
atgggctgccagcggagccggcccttcaacacctacccccgggccgacaccgaccatccgtctcgaggtgcccagggagaaccacatgacgtggcacctaatggcccaagcgctggcggactcgccatccctcaaagttcctctagcagctcgagaccccctacaagggctcgcggagcaccaagtccaggggttctcgggccccatgctagtgaaccccaacttgctccccccgcgtgtacgcccgccgcgccagccgtgcctggtccacctggtcctcgcagccctcagagggaaccgcagagagtttcacatgaacagttcagggcagccctgcagttagtggtcgatccgggcgacccaaggtcatacttagacaacttcattaaaattggggagggtagcacaggcattgtatgcatagcaacggtaaggtcctctgggaagttagttgcggtcaaaaaaatggacctcagaaagcagcagcgccgcgagcttctcttcaacgaggtggttattatgcgggactaccagcatgagaatgttgtcgagatgtacaattcataccttgttggggacgaactctgggttgtgatggagtttctggaaggcggcgcattaaccgatatagttacacatacgaggatgaatgaggagcaaattgctgctgtttgcctggccgtcctacaagccttgagcgtactccacgcccagggggtcattcatcgtgatatcaagagcgatagtatcctgttgacacatgacgggcgggtgaagctgtcagattttggcttttgtgcgcaggtcagtaaagaggtccctcggcggaagtctctagtgggcacaccatactggatggctcccgagcttataagccgactcccgtatgggcccgaggtggacatctggtcactgggcattatggtcattgaaatggtggatggagagcccccctacttcaacgagccccctctgaaggccatgaagatgattcgagataatctgccgccaagactgaagaacttacataaggtctctccatccctcaaaggtttcctagatcgcctcctcgtccgagacccagctcagagggctacagccgctgaactactaaagcaccccttcctggcaaaagcggggcctcccgcatccatcgttcccctaatgcgccagaatcgcacccgctag

SEQ ID NO: 25468 - DNA, 1776 bp, Artificial Sequence
  Description of Artificial Sequence: Synthetic coding sequence
atgttcggcaagcggaagaagcgggtggagatcagcgcccccagcaattttgagcatagggtgcataccggatttgaccagcatgaacaaaaattcacaggactccccaggcagtggcagagtctcattgaggagagtgctcgtaggcccaagcccttggtggaccccgcctgtatcacatccatccagcccggagctccgaagaccatcgtacggggatctaaaggcgccaaagatggggcgttaactctgcttcttgatgagtttgagaacatgagcgtcaccaggtctaactctctgaggagggattcaccccctccccccgcccgggcgcgccaggaaaacggaatgccggaggagcctgccacgacggcacgcggcggtccaggtaaagccggttcacggggccggttcgccggccactctgaggctggggggggatctggcgatagaagacgcgcaggacccgagaaacggcccaaaagtagccgggagggctctggcggcccgcaggagtcgagccgcgataagagacccttgtcagggccagacgtaggcacgccacagcctgctggactcgcctccggggcaaaactcgccgcaggccggcccttcaacacctacccccgcgctgacactgatcacccgtctagaggcgctcagggtgaaccacacgatgtggcccctaatggaccctctgccggtggcctggccattcctcaatcctcgtctagtagcagccgaccacctacaagagctcgtggcgctccgagtcccggcgttttaggcccccacgccagtgagccccaactcgcccccccagcctgtacccccgcggcacccgctgttcctggcccccctggaccaaggtctcctcagagggaacctcagcgggtgagtcatgagcagttcagagccgccctgcagctggtcgtcgaccctggcgatccccgcagttatctggataatttcatcaaaattggagagggttccacaggtatcgtttgcatagcaacagttagaagcagtggcaagctggtggctgttaaaaagatggatctgcgaaagcaacaacgcagggagcttctcttcaatgaagtcgtgatcatgcgtgattaccagcatgaaaacgttgtcgaaatgtacaattcctatcttgtgggggacgaactctgggttgtgatggagttcttggaaggcggggctctgaccgacattgtcacacacacaagaatgaacgaggagcaaattgccgccgtttgcctggctgtcctccaggccctctccgttctgcacgcccagggcgtcattcacagggatatcaagagtgattccatcctcctgactcatgatggcagagttaaactcagcgattttggattctgtgcccaagtcagtaaagaagttccacgacggaagtccctggtcggcactccatattggatggccccagagttaatcagtagactgccatatgggcctgaggtggatatatggagtcttgggattatggtcatcgagatggtggacggtgagccaccctacttcaatgaaccacctctgaaagccatgaaaatgattagagacaacctacccccccggcttaaaaatctgcacaaggtgagcccatccctgaaaggcttcctggatcgtcttctcgtccgggaccctgctcagcgtgccaccgccgccgagcttctcaagcacccatttctcgctaaggcagggccccccgcctcaatcgtaccattgatgagacagaatagaaccagatag

SEQ ID NO: 25469 - DNA, 1776 bp, Artificial Sequence
  Description of Artificial Sequence: Synthetic coding sequence
atgttcggcaagcggaagaagcgggtggagatcagcgcccccagcaacttcgagcaccgagtccatacagggtttgatcagcatgagcaaaagtttaccggactacctcgacagtggcagagtcttattgaggagtcagctcggaggccaaaacctctggtggatccagcctgcatcactagcattcagccgggagcccctaagacgatcgtccgcggcagtaaaggggctaaagatggagcgctgacactcctcctggatgaatttgagaacatgtcagtgacgagatcgaatagcctccgtcgggactctcctcccccacctgctagggcccgacaagagaacggaatgccggaagaaccagctaccacagcgagaggcggcccaggcaaggccgggtccagaggacggtttgccggccactctgaggctggcggggggagtggcgaccggcgccgggccgggcccgaaaagcggcctaaaagctctcgcgaaggtagcggggggcctcaggagtcatctcgggataaacggcctctgtcagggccagacgtcggtaccccccagcctgcaggcctcgcctctggcgctaaactggccgccggcaggccttttaacacctatcccagggctgatacagatcatccatcaagaggagcccagggagaaccgcacgatgtggcccctaacgggccgagcgcaggcggactggccatcccacagagcagttcatcttcgagcaggcctccaacacgagctcgtggcgctccttctccaggagttctgggtccacatgcctcagaaccccaactggcaccgcccgcgtgcactcccgcggcacctgctgtgcctggacccccagggcctagatcacctcaaagagagcctcagagggttagtcatgaacagttcagagcggcgctgcaattggtcgttgaccctggggatcctagatcctatttggacaattttatcaagattggtgagggctctactgggattgtttgtattgccactgtgcgatcttcgggcaaattggtggctgtgaagaaaatggatctgcgcaagcaacaaagaagagagctgctgttcaacgaagtggtgatcatgcgtgattaccagcatgagaacgtggttgaaatgtataacagctacctggtgggtgacgaactgtgggtggtcatggaattcctggagggaggagctctcacggacatcgtgacccacactagaatgaacgaggagcagattgccgccgtttgcctggcagttttacaagcattgtccgttctccacgcccagggcgttatacatcgcgatattaaatcagacagcatactgctgacccacgatggtcgcgttaaactgtccgatttcggcttttgcgctcaggtgtcaaaggaagtgccaaggcggaagtctcttgtgggaactccttactggatggccccggaacttatctctcggctcccctatgggccagaggtagatatctggagtcttggcattatggttattgagatggttgatggtgaacccccttatttcaacgagcccccgctgaaggcaatgaaaatgatacgcgacaacctcccaccacgactaaagaatctacacaaggtctctccgtcccttaagggtttcctcgatagactgctcgtgcgagatcctgcccagcgcgctactgctgccgaactcttgaagcatccattcctggctaaggccggtccccctgcctctatcgtccccctgatgcgccaaaaccgaactagatag

SEQ ID NO: 25470 - DNA, 1044 bp, Artificial Sequence
  Description of Artificial Sequence: Synthetic coding sequence
atgacctggcccctgaccggccaccagcggggcgcctggcccagcccttccccccctccaccaccaccagggttgcccccagaacccgaagtgcctccagctttagagtgttgggatcccactccccaatcaccaaggagtccccagcgcgaacctcagcgagtaagccacgaacagttcagggcagccctgcaactggttgtggacccgggtgacccccggtcttatctggataactttatcaagataggagaagggtcaaccgggatcgtttgtatcgctacggtccgctcttcagggaagttagtagcagtgaagaaaatggatcttagaaagcaacagagaagggagctgctgttcaacgaggtggtgataatgcgggactaccaacacgaaaatgtggtagaaatgtacaattcatacctagtgggcgacgagctgtgggtcgtgatggagttcctggaaggtggcgctttgaccgatattgttacccacaccagaatgaatgaagaacagatcgcggctgtctgcctcgccgttctgcaggccctgagcgtccttcacgcgcagggcgtgattcaccgggacataaagtccgattctatattgctgacccatgatggccgtgtgaaactgtctgattttggattctgcgctcaggtctcaaaagaggtgcctcggaggaagagcctggtgggtaccccctattggatggcccctgagcttatttccaggctcccttacggtcctgaggttgatatttggagcctcggcataatggttatcgagatggttgacggcgagcctccttatttcaatgaaccacctttgaaagcaatgaagatgatcagagacaacttacctccaaggctcaaaaacctccataaggtcagcccctcactgaaaggatttcttgataggctgctcgtgagggatccagcacagagagctaccgccgcagagcttctgaagcatccctttctcgctaaagcaggccctcctgcatctatcgtgcccctgatgaggcagaacagaacacgctag

SEQ ID NO: 25471 - DNA, 1776 bp, Artificial Sequence
  Description of Artificial Sequence: Synthetic coding sequence
atgttcggcaagcggaagaagcgggtggagatcagcgcccccagcaattttgaacaccgggtccacaccggctttgatcagcacgaacagaagtttaccgggctgccccggcaatggcagagtcttatcgaagagagcgcacgccggcctaagccccttgtcgacccagcatgtataacgtccattcagccaggcgctccgaaaacgatcgtacgcggatcaaagggcgccaaggacggcgctctgacactgctgctcgatgagtttgaaaatatgtcggtcactcgatcaaattcactgagacgagatagcccgccccctcctgcccgcgccagacaggaaaatgggatgcctgaggagccagcgacaaccgcccgcggtggtcccggaaaagcgggctccaggggcaggttcgctggacattctgaggcaggcggtggatctggagatcgtagaagagccggcccagagaagcgtcccaagagcagcagggagggctccggaggcccccaggagtcctcgagggacaaaaggccgctgagcgggcccgacgtcgggacccctcagccagccggactcgcctccggtgccaagcttgccgcggggcggccatttaacacttaccctcgcgccgataccgatcatccttcccgaggcgcccagggtgaaccacacgatgtggctcccaacgggccctctgctggcggactcgcaatcccacagtcttcctcatcgtcgtcaagacctccgacgagagctaggggcgccccgtcacccggcgttttgggtccgcacgcttctgagcctcaactggcgccgcccgcctgtacacccgccgctcccgcagtgccgggacccccaggacctagaagtccccagcgcgagcctcaacgcgtgtctcacgaacagttcagggcagcactccaacttgtggttgaccccggggacccccgatcctatcttgacaatttcattaaaataggggaggggagtactggcatcgtatgcatcgccactgttcggtcatctggaaagctcgtcgcagtgaagaagatggacttgcgcaagcaacagcgaagggagttgttgttcaatgaagtggtgataatgcgcgattatcagcatgaaaatgtggtagaaatgtataattcatatctggttggcgatgaactgtgggtggtaatggaattcctggaaggaggggcccttaccgatatagtcactcataccaggatgaatgaagaacagatcgctgccgtctgtcttgccgtactgcaggctttatccgttcttcatgcacagggggttatccacagggatattaaaagtgatagcattctgctgacccacgatgggagagtcaagctctcagactttgggttctgtgcccaggtgtctaaagaggtaccccgacgtaaaagtctggtggggactccatattggatggctccagaactgatctcacgtttgccatacggacctgaagtagacatctggagtttaggtattatggtaattgagatggtggacggcgaacctccctacttcaatgagccccccctgaaggcgatgaagatgattcgcgacaatctccccccgaggcttaaaaatctccataaggtctccccaagcctgaaaggcttcctggaccgtctcctggttcgggaccccgctcaacgtgccacggccgctgagctcctgaaacacccattccttgctaaggccggcccccccgcttccatcgtacctttaatgcgtcaaaatcggacccgatag

SEQ ID NO: 25472 - DNA, 1317 bp, Artificial Sequence
  Description of Artificial Sequence: Synthetic coding sequence
atgttcggcaagcggaagaagcgggtggagatcagcgcccccagcaactttgaacacagagtgcacaccggatttgaccagcacgaacaaaagttcaccggcttgccccgtcagtggcagagcctcatcgaggaatcagcccgccgccccaaacccctggtggatcctgcctgtattacttctatccagccaggggcgccaaagggagaaccacatgacgtggctcctaatgggccaagtgctgggggtctggccatcccccaatcctccagcagttcctctaggccacctacaagggcacgcggggcgccctcccccggcgtgctggggccgcacgcctccgaaccacagctcgcccctcccgcatgtaccccggccgcaccagctgttccaggaccccccggtccacggtcaccgcagcgggaaccgcagagagtaagccacgaacaattcagggctgctttgcagctggtggtggatcccggcgatccaaggtcatacctggacaatttcattaagatcggcgaaggaagcacaggcatagtttgcatcgcgaccgtgaggtcttcaggtaagctagttgcagttaaaaaaatggacctgaggaaacagcagcggagggagctcctctttaatgaagtcgtcattatgcgagattaccagcatgagaacgtggttgagatgtacaactcttacctggtcggcgatgagctctgggtggtcatggagtttctcgagggtggcgcgctaaccgacattgtgacacatactcggatgaacgaagaacagatcgctgccgtctgcctggccgttttacaagcccttagcgttttacacgcacagggcgttatccaccgagacatcaagagcgattctattctgcttacccatgacgggcgggtgaaactctcagacttcggcttctgtgcccaggtttctaaggaggtgcccaggcggaaaagcctagtagggacaccatactggatggcgccagagctgatctctcggctcccttatggccccgaggtggatatctggagtttgggcatcatggtcatcgagatggtggacggggaacctccctactttaacgagccccctttgaaggccatgaagatgatacgggacaatctgccccctcgcctgaagaatctccataaggtctctccttccctcaagggattcctagataggctgcttgtgagggaccccgcccaaagggctactgctgcagagcttctgaaacacccctttctggcaaaagcgggacctccagccagcattgtgccccttatgcgacagaatcgcacccgctag

SEQ ID NO: 25473 - DNA, 1458 bp, Artificial Sequence
  Description of Artificial Sequence: Synthetic coding sequence
atggcccccaccatccagacccaggcccagcgggaggacggccaccgcagtggggtcgtatgcagagtgaaatactgtaactccctgcctgacattccgtttgaccccaagtttataacataccctttcgatcagaatcggttcgtgcagtacaaggccacctcactggagaagcagcataagcacgatctcttaacagaacccgacttgggcgtgaccatcgacctgattaatccagacacttaccggatagacccaaatgtgttgctggacccagctgatgaaaagcttctggaggaagaaatacaagctccgacctccagcaagaggagccaacagcacgcaaaagtggtgccctggatgagaaagacggagtacatcagcaccgaattcaacagatacgggatttctaacgagaaacccgaagtaaagatcggggtgtcagtcaagcagcaattcacagaggaggagatatataaggaccgcgactctcagattaccgccattgagaaaacgttcgaggacgcacagaagtccattagccagcactattcaaaaccccgagtgaccccagttgaggtaatgcctgtgttccctgactttaagatgtggatcaacccatgcgcccaagtgatcttcgactcagatcccgctcccaaggacacttccggggctgccgcactggaaatgatgtcccaggctatgattaggggcatgatggacgaggagggaaatcaattcgtggcatacttcttgcccgtggaagaaaccctaaaaaaaaggaagcgggaccaagaagaagagatggactatgcacccgacgacgtttatgattataagatcgctagagaatacaactggaacgtcaaaaacaaggcgagcaagggctatgaagaaaattattttttcattttccgagaaggcgacggagtctactataacgaactcgagacacgagtccgcctgtctaaacgcagggcaaaggcaggagtacagtcaggcaccaatgccctcctagttgtgaagcacagggacatgaacgaaaaagaattagaagcccaagaggcaagaaaagctcagctggaaaaccacgaacccgaagaggaagaagaggaagaaatggaaacagaggaaaaggaggccggcgggtcggtcatgctgatcctccgtacaatgccgactttgatgatgaggacggaggatcgccctaaggtcgcggtcactatgatccagactgccgctgccatgggagtagcatctggtgctggagcgaccgcagcagctccagtgccaagccctgttgccgcatcaactcggcctagacgaatggcggtgaaactccaattactcatacccgtgaaattgatagtcaccgtgacggagtctcaggggatccaggggtggttccgacaccactattgcgaacagcaaagcaccttcctggtggtgtgtctgtag

SEQ ID NO: 25474 - DNA, 873 bp, Artificial Sequence
  Description of Artificial Sequence: Synthetic coding sequence
atgggccacccccccctgctgcccctgctgctgctgctgcacacctgtgtcccggcatcttggggccttcgatgtatgcaatgtaagaccaatggagattgtcgggttgaggaatgcgccctggggcaggacctatgccgcaccacaattgtccggctttgggaggaaggcgaagagctggagctcgttgagaaaagctgcactcatagcgagaaaactaaccgaaccttaagttaccgcacagggctcaagattacaagcttgaccgaagtagtgtgtggcttagacctttgcaatcagggcaatagtggtcgggccgtgacctactctcggagccggtacctggaatgtatctcgtgtggttcttccgatatgtcgtgtgagagaggacgtcaccaaagtctgcagtgccgctcaccagaggagcagtgtctggatgtggtgacacattggatacaggagggggaggaggtcctggagctggaaaatttgccccaaaacgggcgccagtgttatagctgtaaaggaaacagcacccatggctgcagctctgaggagaccttccttatagattgtcgcggcccaatgaatcaatgcttggtcgctaccggaacacacgagcctaagaaccagtcctacatggtgaggggctgcgctaccgcaagcatgtgccagcacgcgcacctgggagacgcctttagcatgaaccacattgatgtaagttgttgtactaagtcaggatgcaaccacccagacctggatgtccaatatcgcagtggtgctgcccctcagcccgggcccgctcacctatccttgacaataactctgctgatgacagcacgcctgtggggcgggaccttgctctggacctag

SEQ ID NO: 25475 - DNA, 1596 bp, Artificial Sequence
  Description of Artificial Sequence: Synthetic coding sequence
atggcccccaccatccagacccaggcccagcgggaggacggccaccgtcccaacagccatcggaccctccctgagcgtagcggtgttgtttgccgggtcaagtactgtaacagcctgcctgacattcctttcgatccgaaattcattacctatcccttcgatcagaataggtttgttcagtacaaggcaactagcttagaaaaacaacataagcacgacctcttgaccgaacctgaccttggcgttacaatcgacctcattaaccctgacacttaccggattgatcccaatgtactgcttgacccagccgacgaaaaacttttggaggaggagatccaggcacccaccagttcgaaacgtagccagcaacacgcaaaagtcgttccttggatgcgcaaaaccgagtacatctcaacagaatttaatcggtatggtatcagcaacgagaagcctgaagtgaaaatcggagttagtgtaaaacagcagttcactgaagaagaaatctacaaggatagggactcccagattaccgctattgaaaaaaccttcgaagatgcacagaaatcaatttcacagcattactccaaaccaagggtcactcccgtcgaagtgatgcccgtgtttcccgactttaagatgtggatcaacccctgtgctcaagtgatcttcgacagcgatcccgcccctaaggacacatcgggagctgcagccttggaaatgatgagccaggctatgatccgtggcatgatggacgaagaagggaaccagtttgtggcttattttctgcctgtggaggaaacattaaagaaaagaaaacgggaccaggaggaggagatggactatgcccctgatgatgtctacgactacaagatagcccgcgagtataactggaatgttaagaataaagcaagcaaagggtatgaagaaaattatttctttattttcagggagggagatggagtgtactacaatgagctcgagacccgcgtgcggctgtcaaaaagaagagccaaggcaggggtacagagtgggacgaatgctctgttagttgtgaagcaccgtgacatgaatgagaaggagctggaggcccaagaggccaggaaagcccagttggagaatcatgagcccgaggaagaggaagaagaagagatggaaactgaggagaaggaagccggaggaagcgacgaagaacaggaaaagggatcaagtagcgaaaaagaggggagcgaggacgaacacagcgggagtgagagcgaaagggaggagggagaccgcgatgaggcctccgataagtctggtagcggcgaagatgagagctcagaggatgaggctcgggcggctagagacaaggaagaaatctttgggtctgatgcagactccgaagacgacgcggattcagacgacgaagatcggggccaggcacagggcggctcagacaacgactctgattctggttcaaatgggggaggacagcgctccagaagccactcgcggtcagccagtcctttcccgtctggcagcgagcacagcgctcaggaggatgggagcgaagctgccgcaagtgattcatctgaggctgactctgattccgattag

SEQ ID NO: 25476 - DNA, 867 bp, Artificial Sequence
  Description of Artificial Sequence: Synthetic coding sequence
atggccaccggccccatccccaccggcctgtgcctgcggggcctggaatggagcgctgagtcttccactgctattgctagtctgataagcccatccacgcccagctctagcccgactccctccacacgcaccgttctgctggaccctgcggacgaaaaattgttggaagaagaaattcaagcgccgactagcagcaaacgttctcagcagcatgcaaaggtcgtaccgtggatgaggaaaacagagtatataagcaccgagtttaataggtacggtatcagcaacgagaaacctgaagtgaagatcggcgtttcggtgaagcaacagtttactgaagaggaaatctacaaggatcgcgatagtcaaatcactgcaatcgagaaaacgtttgaggatgctcaaaagtccatttcacaacactactctaaacccagggttacacctgtcgaagtcatgcccgtgtttccggattttaagatgtggatcaacccctgcgcacaagtgatattcgactctgaccctgcgccaaaggacacctcaggcgctgccgctcttgaaatgatgtctcaggctatgatcaggggcatgatggacgaagaggggaaccagtttgtcgcctactttcttccggttgaggaaaccctcaagaagcgtaagagagaccaggaggaggagatggattacgcacctgacgatgtgtatgactataaaatcgctagagagtataattggaacgtcaaaaacaaggcttccaagggctatgaagagaactacttcttcatattcagagaaggggatggagtgtactacaatgaattagaaacctcgatacagtattcacatatgctgtacaatttggtggcctag

SEQ ID NO: 25477 - DNA, 1176 bp, Artificial Sequence
  Description of Artificial Sequence: Synthetic coding sequence
atggacctggagaagaactaccccaccccccggaccagccggaccgggcatggtggggttaaccagctaggcggtgttttcgtgaacgggagaccactgcccgatgtggtgaggcagaggatagtggaactcgcacaccagggcgtgcggccttgtgatatctccagacagctcagggtctctcatggttgtgtcagtaagatcttggggcgttactacgagacgggatcaattaaacccggggtgattggagggagcaagcctaaggttgcaacccctaaggtggttgaaaagattgctgagtataaacgccaaaatcccactatgtttgcctgggagattcgggataggttactggctgaacgggtctgcgacaatgatactgtgccaagcgtttcttctattaacagaattatacggacgaaggtgcagcagccacctaatcagcccgtgccagcgagttcgcattctatcgtcagcaccggaagcgttacacaggtctctagcgtgtccacagactcagcggggtcttcatattcaatctcaggcattttgggcatcacctccccgtcagcagataccaataagaggaagcgcgatgaaggaattcaggaatcccccgtccctaacgggcacagcctgcccggtcgggacttcctgaggaagcagatgcggggggacttgttcacacagcagcagctcgaggtcctggaccgcgttttcgagagacagcactattccgatatttttacaaccaccgagcccattaagcccgaacagactacagaatatagcgccatggcatccttagcgggcggactcgacgacatgaaggccaacctcgcctccccaactcccgccgatataggttcaagcgtccctggtccacaaagctatcccattgttaccggacgcgatctggccagcactactctccccggctatccaccacacgtaccccccgctgggcaaggaagttacagcgccccgacgttaaccggcatggtgcccgggagcgaattctcagggtcaccctacagccacccacagtacagcagttataacgactcatggcgttttccaaatccaggcttgcttgggtccccttactactactctgctgctgcccgaggagccgcgcctcctgctgcagccactgcttacgaccgccattag

SEQ ID NO: 25478 - DNA, 867 bp, Artificial Sequence
  Description of Artificial Sequence: Synthetic coding sequence
atggacctggagaagaactaccccaccccccggaccagccggaccggccacggcggcgtcaaccagctcggcggtgtttttgttaatgggagaccactgccagacgtcgtgcggcagagaattgtcgaactggcacatcagggtgtgagaccgtgtgacatcagcagacagctcagagtgagccacggttgtgtgagtaaaatcctggggaggtactacgagaccggcagtattaaacccggtgttatcggggggagcaagcccaaggtggccacccctaaggtcgtggaaaagatcgccgagtacaaaagacagaatcccaccatgttcgcctgggaaatccgcgatcgactgttagctgaacgggtgtgcgacaacgataccgtgccctcagtgtcaagtatcaatcgcatcatccggaccaaagtgcagcagcctccgaatcagcctgttccagcgagcagccattctattgtaagcactgggtctgtaacccaagtatcctccgtgtccaccgatagcgccgggtcatcctactctatcagtggcatcctggggataacttctccgtcagccgatacaaacaagagaaaacgggacgagggaatacaggaatctcctgttccaaatggacactcactccctggccgagacttcctgaggaaacagatgcgcggagacttgtttacacaacagcagctggaggtcctggatcgggtcttcgaacgccagcactatagcgatatctttaccacaaccgaacctattaagcccgagcaggcggtgacatggagagcacgtccctccccggggaccctgcataccagcccccctcttgaccgcgctgctacccagcatcgccggtag

SEQ ID NO: 25479 - DNA, 987 bp, Artificial Sequence
  Description of Artificial Sequence: Synthetic coding sequence
atggacctggagaagaactaccccaccccccggaccagccggaccggtcacggtggagtaaaccagcttggtggcgtctttgtaaatggcagaccactcccagacgtggttaggcagcgcattgtcgagcttgcccaccaaggggtcagaccttgtgatatcagtcgtcagctccgggtcagccatggatgcgtgagcaaaattcttggacgttattacgaaacaggctcgatcaagcccggagttatagggggcagtaaacctaaggttgctacgcctaaggtcgtcgagaagatcgccgagtacaagcgacagaatccaaccatgtttgcgtgggagattcgtgatcgattgctggcagagcgagtttgtgataacgacactgtgccaagcgtgtcttccattaatcggatcattcgaacaaaggtccagcagcccccaaaccagcctgttcccgcttcatcacactcaatcgtgtctactggcagcgtaacccaagtaagttccgttagtaccgattctgccggcagttcctactccatcagcggtatcctgggaataaccagccccagtgccgacaccaataaacgaaaacgggatgagggaatccaagaatcaccagtacccaacggccattctctgcccggccgagactttttgagaaagcaaatgagaggggatctattcactcagcagcaattagaggtccttgaccgcgtgttcgagcgacaacattattctgatatctttactaccacggaacctatcaaacccgaacagaccaccgagtactccgcaatggcttcactggctggtggactcgacgacatgaaggcgaatcttgcaagcccaacacctgcagacatagggagctccgtgccggggccccagagctaccctattgtgaccgggtccccctattattacagcgccgccgcccgcggagcagcccctccagccgctgctacagcgtacgacagacattag

SEQ ID NO: 25480 - DNA, 909 bp, Artificial Sequence
  Description of Artificial Sequence: Synthetic coding sequence
atgttcgcctgggagatccgggaccggctgctggccgagcgggtgtgcgacaacgatactgtgccgtccgtgtccagtatcaaccggattattaggacaaaggtccagcagccacccaaccaaccggttcccgcctcaagccatagcatagtctctacaggaagcgtgacacaggttagttcagtgagcactgacagcgccggcagttcatattctatctcaggcatcctgggcattaccagcccaagcgcagacaccaacaagaggaaacgggatgaaggtattcaggaatctccagttcctaatggtcattccctgccaggcagagactttctgcgcaaacaaatgagaggagacctcttcactcagcaacagctggaggtgcttgaccgagtgttcgaaaggcagcattactcagacatcttcaccactacagagcctattaagccagagcagtggtgtcccgtgctgatgaggcagtacttggtgcaacctcaagccgtcctgttccaaaccaccgaatactcggccatggcttcactggcaggcggcctggacgatatgaaggcaaatctcgctagccctacaccggcagacatcggctcgtcggtgcctggaccccaatcctatcccatagtaaccggcagggacctggcgtccactacactgcccggctatccccctcacgttcctcccgcagggcagggcagttacagcgctccgacacttacaggtatggtgcctggatccgagttcagtgggtctccttattcacatccacagtatagttcgtataatgatagttggagatttcctaaccccggactgctcggctccccttactattattcagctgccgcccgcggcgctgcaccacccgcagcggctaccgcctacgatcgccactag

SEQ ID NO: 25481 - DNA, 1074 bp, Artificial Sequence
  Description of Artificial Sequence: Synthetic coding sequence
atggacctggagaagaactaccccaccccccggaccagccggaccggtcacggcggtgtgaaccagcttgggggcgtatttgtcaacggccgccctctgccagacgtggtgcgccagaggatcgtcgaactcgcccaccagggggtccggccctgcgatattagcagacagcttcgcgtgagccatgggtgcgtgtctaagattctggggaggtattatgaaacaggaagcattaagcccggagtcattggcggttccaagcccaaggtggccacccctaaggtggtggagaaaatcgctgagtataagaggcagaatccaacaatgtttgcatgggaaatccgagatcggcttctggcagaacgggtctgtgataatgacactgtgccatcagttagctccattaatagaatcattaggaccaaggtgcagcagcctccaaaccagccagtcccagcatcctcccactccatcgtgtctacagggtctgtgactcaggtctcttccgttagtacagactccgctggaagttcctactcaatcagcggaatcctgggcatcaccagccccagtgcagacactaataaaaggaagagagatgaaggcatccaggagagcccagtgcccaacggccattccctgccagggagggacttcctgcggaagcagatgcgaggcgacctgttcacacagcaacagttagaagttctggaccgggtcttcgaaaggcagcattattcagacatttttaccactaccgagcccattaagcccgaacaaactaccgaatactccgctatggcctcgctggctgggggactagacgatatgaaggcaaatctggcctcaccgactcctgccgacataggaagcagcgtgcctggtccacagagttaccctatagttactggtagcgagttcagcgggtcgccctatagccacccccagtactcttcatataacgactcttggcggttcccaaaccccgggctgctggggtccccgtattattattccgcagccgctcgcggagctgctccccctgcagctgccacggcctacgatcgccattag

SEQ ID NO: 25482 - DNA, 1089 bp, Artificial Sequence
  Description of Artificial Sequence: Synthetic coding sequence
atggacctggagaagaactaccccaccccccggaccagccggaccggacacggcggtgtgaatcagctcggcggagttttcgtcaacggccgccctttaccggatgtggtgcgtcaacggatagtggaattggctcaccagggggtgcgaccgtgtgacatcagtcgtcagttacgagtgtcccatgggtgcgtctcgaagattcttggccgctattatgagaccggaagcatcaagccgggggtgatcggcgggtctaaacccaaggtcgccacgccaaaggtcgtcgagaaaattgctgagtacaagcggcagaaccctacaatgtttgcctgggagatccgagatcgcttgctggccgagcgcgtctgcgataacgacactgtgcccagcgtctccagcattaatagaatcatacgaacaaaggtgcagcagcctcctaaccagccagtacctgccagctctcactctattgtctctacgggatctgtgacccaggtgagttcagtctcaaccgatagcgctggatccagttatagcatatccggaattctgggcattaccagcccatctgcagataccaataagcgtaaacgcgacgaaggtatccaggagtctcctgtccctaacgggcactccctgccaggaagagacttccttaggaagcaaatgagaggggatctgttcacccagcaacagctggaagtcctggaccgggtctttgagagacagcactactctgacatctttacaacaaccgaacctattaaacctgaacagactacagagtactccgcaatggctagcctggcaggggggctggacgatatgaaagctaatctggcttcacctacgccagccgatatcggctcttctgttccaggacctcaatcttaccctatcgtcaccggtagggatcttgcatccacgactttgccgggttatccaccccacgtacctcccgcgggccaagggagctacagcgcgccaacattgactgggatggtccctggatctccttattactattccgcagccgcaagaggtgcagcccctcccgctgccgccactgcttatgacagacactag

SEQ ID NO: 25483 - DNA, 1047 bp, Artificial Sequence
  Description of Artificial Sequence: Synthetic coding sequence
atggacctggagaagaactaccccaccccccggaccagccggaccggccatgggggtgtcaatcagttggggggggtgttcgtcaacggccgccctctgcccgatgtggtgaggcagagaatcgttgagctggcccatcagggggtgaggccgtgcgatatctcgcgccagttgagggtgagtcacgggtgcgtgtctaaaattctaggtcgctactacgagacgggtagcatcaagccaggagtgataggaggaagtaagcccaaggtcgccaccccgaaggtggtagaaaaaattgccgagtacaaacgccagaaccccacaatgttcgcctgggagattagagataggctgctggcagaaagggtttgtgataatgacacagtgccttcagtctcgtcgatcaacaggatcattcggacaaaggttcagcagcctccgaatcagccagttccggcatcctcccattccattggaatccaggaaagccccgtgccaaacggccatagcctacccggccgggactttctacgtaaacagatgcggggcgatctgtttactcagcagcaactcgaagtgttggatcgcgtttttgagcgacagcactactctgatattttcacgacaacagaaccgatcaagcccgagcagacaacagagtattccgccatggcaagcctcgccggtggattggatgacatgaaagctaatctggcttcaccaacaccggcagacatcggcagcagtgtgcctggcccccagtcttatccaattgttaccgggcgggacctggcatcaacgacccttccgggatacccaccacacgtgccgccagcagggcagggaagctactcggctcccaccctgactgggatggttccgggttccgagttttctggttcgccatattctcacccccagtattcctcctacaatgattcttggagattccccaatcccggtctgctaggcagtccttattattattctgccgcggctagaggcgccgcgccaccagcagcagcaactgcgtatgaccgacactag

SEQ ID NO: 25484 - DNA, 876 bp, Artificial Sequence
  Description of Artificial Sequence: Synthetic coding sequence
atggacctggagaagaactaccccaccccccggaccagccggaccggccatgggggcgtgaatcaactgggaggggtgttcgtgaatggccgtccactgcctgacgtcgtacgacaacgtattgtagagctggctcaccagggcgtcagaccctgcgacatttcgagacagttgcgcgtatcacacgggtgcgtgtctaaaatactcggtaggatcatcaggacgaaagtgcaacagccacctaaccaacctgtccccgcatccagccactccattgtctccaccgggagtgtgacgcaggttagttctgtctccacggacagcgctgggagctcatattccatcagcggaatcctcggcatcacgtccccttcagcagataccaataagaggaagcgagatgaagggatccaagaaagccccgtccccaatggccattccctcccgggtcgcgatttcttaagaaagcaaatgcgcggcgatctctttactcagcagcagctcgaggtcttggaccgtgtctttgagaggcagcattactcagatatctttacaaccaccgagccaatcaagccagagcaaactacggaatactccgctatggctagtttggctggtggtctcgacgatatgaaagccaacttagcaagtcctacccccgccgacattggctctagcgtacctggtcctcagagctaccctatcgttacggggagtgagttttcggggtccccatactcacacccacagtactcatcttataacgacagttggaggttcccaaacccaggacttctgggatccccttactactattccgcagccgctaggggtgcagctcccccagctgctgctaccgcatacgaccggcactag

SEQ ID NO: 25485 - DNA, 960 bp, Artificial Sequence
  Description of Artificial Sequence: Synthetic coding sequence
atggacctggagaagaactaccccaccccccggaccagccggaccggccatgggggtgtgaatcaactgggaggggtgttcgtcaacggacgtcccctgcccgatgtcgtgcggcagcgaatagtggagcttgcccatcagggggttcggccctgcgatatctcccggcagctgcgggtgagtcatgggtgtgtgagcaagatcctggggcgctattatgaaacagggagtatcaagccaggcgtaattggcggttcgaagcctaaggtcgccacgccgaaggtggtcgagaagatcgccgaatacaaaagacagaacccaactatgtttgcctgggagatccgagaccggttgctggctgagcgcgtttgcgacaacgacactgtcccttccgtatcctctataaaccgcattattcgcaccaaggtacaacagccgcctaatcagccggttcccgccagtagccactccattggcatccaggagtcgcctgttccaaatgggcatagcttacctgggcgggattttctgagaaagcaaatgagaggcgatttgttcacccaacagcagttggaggtgctggacagggtctttgagaggcaacactactccgacatattcacgacgacagaacctataaaacctgaacagacaactgagtactccgctatggcctccctcgcaggaggactggatgatatgaaggccaatttggcctctcctacgccggcagacatcggctcttccgtaccaggacctcaatcttaccctattgtgaccggacgagacctcgccagcactacacttcccggctacccacctcatgtgccccccgctgggcagggaagctactcagcacctaccctgactggcatggtcccagggagcccctattattactcggccgcggccagaggcgctgctccacccgcagctgctactgcctatgatcggcattag

SEQ ID NO: 25486 - DNA, 852 bp, Artificial Sequence
  Description of Artificial Sequence: Synthetic coding sequence
atgttcgcctgggagatccgggaccggctgctggccgagcgggtgtgcgacaacgatactgtgccctctgtgtcctcaatcaatcgcatcatccggaccaaggtgcaacagccacccaatcaacctgtgcccgccagcagccactctattgtgagcacaggttcggtaacccaggtttccagcgtatccactgatagcgctggatcctcttactctatttctggaattttaggcattaccagcccgtccgctgatacaaataagcgcaagcgggacgagggtatccaggaaagccccgtgcccaatggccactccctgcccggtcgcgactttctgcgaaaacagatgaggggagacctgtttacccagcaacaattggaggtcttggaccgggtgttcgagaggcagcattattctgacatctttactacaacagaaccaatcaaaccagagcaaaccaccgagtattctgccatggccagtctcgcaggtggtcttgacgacatgaaggccaacctggcctcacccacaccagccgatataggctcctctgtgccaggcccccagagttaccctattgtgacagggcgcgacctggccagcactaccctgccaggataccccccgcacgttccacctgctggacagggttcctactcggctcccacactaactggcatggtgccgggatctgaattctccggaagtccctattcccatccgcagtatagctcttacaatgattcctggaggtttccgaaccccgggcttctcggcagcccttattactattccgccgccgcccggggggcagccccgccggccgctgccactgcatacgatcggcactag

SEQ ID NO: 25487 - DNA, 924 bp, Artificial Sequence
  Description of Artificial Sequence: Synthetic coding sequence
atggacctggagaagaactaccccaccccccggaccagccggaccggtcacggaggagttaaccagttgggcggtgttttcgtcaacggacggcccttgcccgatgtggtacggcagcgcatcgtggaactggcccaccaaggagttcggccctgcgacatttctagacagctgagagtgtctcacggttgcgttagcaagattcttggaagatactatgagacaggctcaatcaagccgggtgtcatcgggggctcaaaacccaaagtcgctacccccaaagttgtggagaagatagcagagtacaaacggcagaacccaaccatgtttgcctgggagattcgggatagattgctcgcagagagggtttgcgacaacgacacagtcccgagcgtctcctccatcaacaggatcattcggaccaaagtacaacaacctcccaaccagcccgtgccggcgtcgtctcatagcatcgtcagcactgggtcagtcacacaggtcagcagtgtgtcaacagatagcgccggaagtagctactcgatctccgggatccttggcatcacaagtccaagcgcagatacaaacaagaggaaaagagatgagggtatccaagaatcaccagtcccaaacggacacagcctgcctggccgggatttcctgagaaagcagatgcgcggcgacctatttactcaacaacaactcgaagtgctcgacagagtgttcgagagacaacactatagcgatatcttcactaccaccgaaccaatcaagcccgaacagtggtgccccgtcctcatgcggcaataccttgtgcagccacaggcagtactgtttcaggccgtgacctggagggcacggccttctcccggcaccctgcacacctcgcctccactggaccgggccgccacccagcacagacgttag

SEQ ID NO: 25488 - DNA, 1197 bp, Artificial Sequence
  Description of Artificial Sequence: Synthetic coding sequence
atgccccacaacagcatccggagcggccacggcggcctgaaccagctggggggggccttcgttaacggtaggcccttgccagaggtggtgagacagaggattgtggacctggcacatcagggcgttcggccctgcgacatctcaagacagctgcgcgtgagccacggctgcgtgtccaagatactggggcgctattacgagactggctcaatcaggccaggggtgattggcggttcaaaacccaaagtagccaccccaaaggttgttgaaaagatcggggattataagcgacagaaccccacaatgtttgcctgggagatccgggatcgactgctggctgaaggagtgtgcgataacgacacagtgccctctgtgtccagcattaatcggatcattaggaccaaggtgcagcaacccttcaacctgccgatggactcttgtgtggcaacaaaatcacttagtcccgggcacactctcataccgagctccgccgtaaccccccccgaatctccccaatccgacagcctaggctccacctacagcatcaacggtcttctgggcatcgcccaacctggaagtgacaagcggaagatggacgactccgatcaggattcatgcagactgagcatagatagccagtcttcatcgtccggcccgagaaagcacctacgtactgacgcattctcccagcatcatctcgagccgctagagtgtccattcgagcgtcaacattacccagaagcctacgcctcacccagccacactaaaggcgaacaaggcctatatccactcccgctgctgaattccaccttggatgatgggaaggccacactgaccccctccaacacacctctaggtcggaacctgagcacccatcaaacataccccgtggtagccgctccacccttttggatatgcagtaagagtgccccaggctcccgaccctcaatgccctttcccatgctaccaccttgcaccggatcctcccgcgcgaggccatccagccagggtgagcggtggtggggcccaagatgtccagatacccatccaacttcaccgcccgccgatcgagccgccatgcctcctcttccctctcaggcatggtggcaggaggttaatacactggctatgccaatggccacccccccaacccccccgacggcacgcccaggagctagcccgacaccagcatgttag

SEQ ID NO: 25489 - DNA, 966 bp, Artificial Sequence
  Description of Artificial Sequence: Synthetic coding sequence
atgccccacaacagcatccggagcggccacggcggcctgaaccagctggggggggctttcgtcaacggccggccactgccagaggtcgtcaggcagagaattgtggacctggcccaccagggggttagaccctgcgacattagtaggcagttgcgagttagccacggttgtgtgtccaaaatactgggaagatactacgaaaccgggtctattcgaccgggcgtcattggtgggtccaagcctaaagtagccacgccaaaagtcgtggaaaaaattggcgattacaagagacagaaccctactatgttcgcctgggagatcagagatcgtctgctagcagagggtgtgtgcgataatgacacagtgccaagcgtgtcgtcaatcaatcgcattatccggaccaaggtgcagcagccattcaatttgcccatggattcctgtgtggccacaaaatctctgtcccctgggcatactctgatcccctcttccgctgtaacgcccccagagtctccccagtcggactccctgggatccacatatagcattaatggcctgctgggtattgcccagccagggtccgacaaacgaaagatggatgattctgaccaggatagttgtagactctcaatcgacagtcaatcaagttcttctggcccacggaagcaccttagaacagatgcttttagtcagcatcacctcgaacccttggaatgtcccttcgaaagacagcattaccccgaagcgtatgcgagtcctagccacacaaaaggcgaacagggcgaacgatggtggggacccagatgccctgatacccatcctactagtccccccgccgacagggccgctatgccccccctgccatctcaggcatggtggcaggaagtgaatacactggccatgccaatggcgacacctcccaccccccccacagcgaggcccggggcatctccaacccccgcctgctag

SEQ ID NO: 25490 - DNA, 1197 bp, Artificial Sequence
  Description of Artificial Sequence: Synthetic coding sequence
atgccccacaacagcatccggagcggccacggcggcctgaaccagctggggggagcattcgttaacggacggcccctacctgaggtcgtccgacagcggattgtagacttggcccatcaaggagttagaccgtgtgacatctcacggcaactgagagtctcccacggctgcgttagcaaaattttgggcagatattatgagaccggttccatccgcccaggggtgattggtggaagcaaacccaaagtggctacgcccaaggtggtggagaagatcggcgactataaaagacagaaccctacgatgttcgcttgggagattcgggaccgtctgctggccgaaggggtgtgcgacaacgacactgtgccctctgtctcttcaataaacaggattatccggaccaaagtgcagcagcctttcaatctgccaatggatagctgcgttgccaccaagtctctgtcccctggccacactcttattccatcatctgctgtgaccccaccagaaagcccacaatctgactctctgggatccacttatagcattaacgggctgcttggcatcgcccagcccgggtccgacaaaagaaaaatggatgactctgaccaggattcctgcaggctgagcattgactcccagagcagttcttcagggcctaggaagcatctccgaactgacgcattcagccagcaccatctggagcctctggaatgtccttttgaacggcagcactaccccgaggcttatgccagccctagccacactaagggggaacaagggttgtatcctctccccctactcaattcaacactggacgacggaaaagcaacattgaccccctctaacaccccactcggacggaacctgtccacgcaccaaacataccccgtcgtggccgctccacctttctggatctgtagcaagtcggctcctggatcaaggcctagtatgccttttccgatgctgccgccatgcaccggttcctcccgggcacggccgtccagccagggagagcgctggtggggcccccggtgccctgacactcacccaaccagccccccagccgatagggctgcgatgccaccactgccatctcaagcgtggtggcaagaagttaacaccctcgctatgcctatggccacccccccaacccccccaaccgcaagacccggagccagccctacaccagcttgttag

SEQ ID NO: 25491 - DNA, 864 bp, Artificial Sequence
  Description of Artificial Sequence: Synthetic coding sequence
atgccccacaacagcatccggagcggccacggcggcctgaaccagttgggtggggcatttgtcaacgggcgacccctaccagaagtggtgcgccagcgcattgtggacctggcccatcagggagtccgaccttgtgatatatctaggcaacttagagtttcgcatgggtgtgtgagcaaaattttagggcggtattacgagaccggctcaatcaggccaggagtgatcggcggttctaagcccaaggtggctacccccaaggttgtggagaagatcggtgattacaagcggcagaaccccacaatgtttgcatgggaaatcagagacagactactggcagaaggagtctgcgacaacgacacagtgccctctgtgagcagcattaacaggattatccgcaccaaagtgcagcagccatttaacctaccaatggacagttgtgtcgcaaccaagtcgctgtccccaggacatacattgattccctcatctgccgtgactccccccgaaagcccacagagcgattcgctgggttccacttactccatcaatgggctgctcggcattgctcagccgggaagcgacaagcgcaaaatggacgattctgaccaagacagttgcaggctttctatcgacagccagtcttcctcaagcggaccaaggaagcatctgcggacggacgcttttagccagcaccacttggagcctttggaatgtccgttcgagcggcagcattacccggaggcctatgccagtccttcgcacaccaagggcgagcaggaggtgaataccctggcaatgcccatggccacaccccctactccccctaccgctagacccggtgctagccccacaccggcctgttag

SEQ ID NO: 25492 - DNA, 1353 bp, Artificial Sequence
  Description of Artificial Sequence: Synthetic coding sequence
atgccccacaacagcatccggagcggccacggcggcctgaaccagttagggggagcattcgtgaacggacgccccttgccagaagtggtacgacagagaatcgtggacttggctcaccagggggttcgcccatgcgacatttcgaggcagctaagggtgagccatggatgtgtctctaaaatcctcgggcgttactatgaaaccggttcaatccgacccggagttatcgggggaagtaaacccaaagtggccacaccaaaagtagtagagaagatcggcgactataagagacaaaacccgaccatgtttgcttgggagattagagaccggttgctagcggaaggagtatgcgacaacgacactgtcccatcggtctccagcataaacaggatcattcggacaaaggtgcagcagcccttcaaccttcccatggactcatgcgtggcaactaaatccttatctcccggccacactctcataccctctagcgccgtaaccccgcccgagtccccacagtccgactcccttggctccacctatagcatcaacggactgctaggaatcgctcagcccggcagtgataagcgcaagatggatgatagtgatcaggattcatgtcgcctgtcaatcgacagtcagtctagctcgagtggaccccgtaagcacctaagaactgacgccttttctcagcaccacctcgagcctctcgagtgcccgttcgaaagacagcattatccggaggcctacgcttcgcctagccacacaaaaggcgaacagggactgtatcccctgcccctactcaacagcaccctggacgacgggaaggctaccctcacaccatctaatacaccactggggcgcaacttgtctacacaccagacctatccagttgtggccgaccctcactccccattcgccattaagcaggaaactccagaggtgtccagcagctcttcaaccccaagcagcctgtcatcctcggcgttcctggatctgcagcaggtcggtagcggtgtgcccccatttaatgcctttcctcacgccgcgtcggtgtacggtcagttcaccggccaggctctcctctctggccgagagatggtgggcccgacactgcccgggtatcccccgcatattcccacgtcaggccaaggcagctacgcttccagcgctatagcagggatggtcgctgggagcgagtacagcgggaatgcctatggccataccccctacagctcttacagtgaagcctggaggttccctaattcttcattgctcagctcaccctactactattcttctacttcaagacctagcgccccccctaccacggcaaccgccttcgatcatctgtag

SEQ ID NO: 25493 - DNA, 570 bp, Artificial Sequence
  Description of Artificial Sequence: Synthetic coding sequence
atggccagcaagcgggccctggtgatcctggccaagggcgccgaggaaatggaaacagtgattcctgttgatgtgatgcgacgtgcaggaattaaggtcacggtagctggcctcgcggggaaagaccctgtccaatgcagcagggacgttgtgatttgccctgacgcttccctggaggacgctaagaaggagggcccgtatgacgtggtcgtcctacctgggggcaacctaggtgcccaaaacctatcagagagtgctgccgtgaaagagatcctcaaagagcaggagaatcgcaagggtctgatcgcagcaatttgtgcaggtcctaccgcactgcttgcacacgaaattggcttcggaagcaaagtgactacccatccgcttgcgaaggataaaatgatgaacggaggacactatacttactctgagaaccgcgtcgaaaaagacggactgatcttaaccagccgaggcccgggcactagctttgagttcgcccttgccattgtggaggctctcaatggcaaggaagtggctgctcaagtgaaagcgccgttggttctgaaggattag

SEQ ID NO: 25494 - DNA, 570 bp, Artificial Sequence
  Description of Artificial Sequence: Synthetic coding sequence
atggccagcaagcgggccctggtgatcctggccaagggcgccgaggagatggaaactgtcatccccgtagacgttatgagaagagcgggcattaaagtgaccgtcgctggcctggcagggaaggatcccgtgcaatgctcacgggacgtggtcatttgtccagacgcgtccttggaagacgccaaaaaagaaggaccgtatgatgttgtggttctacccggcggaaaccttggcgctcagaacttgagtgaatctgccgcagtaaaagaaatcctcaaggaacaagagaatagaaagggcctcattgctgcgatatgtgcgggtccaacggccttgctggcacacgagatcggcttcgggtctaaggtgaccacccaccctttagccaaggataagatgatgaacggcggtcattacacgtactcagagaatagagtggagaaggatgggctaattctgactagccgtggccctgggacatccttcgagttcgccctggcaattgtggaggccctcaatggaaaagaggttgccgcgcaggtcaaggccccattggtgttgaaagactag

SEQ ID NO: 25495 - DNA, 570 bp, Artificial Sequence
  Description of Artificial Sequence: Synthetic coding sequence
atggccagcaagcgggccctggtgatcctggccaagggcgccgaggaaatggagacagtgatccccgtcgacgtgatgcgtagagccgggataaaagtgacagtggctggccttgcaggaaaggaccccgtccagtgttctcgagacgtggtgatctgtcctgacgcatccctcgaggacgcaaaaaaagagggtccttatgatgtggtcgttttaccggggggtaacctcggagcccaaaaccttagtgaatcagctgccgtaaaagagatcctgaaggaacaggagaaccgtaaaggattaattgctgccatttgcgccggtcctacagcgcttcttgcccacgagattggcttcggcagtaaggtgacaacccacccccttgccaaggataaaatgatgaatgggggacattatacatactccgaaaacagggtcgagaaagacgggctgattctgacaagccgcgggcccggcacctctttcgaattcgccctggctatcgtcgaggcgctaaacggtaaggaagttgccgcgcaagtcaaggcccctctggtgctcaaggactag

SEQ ID NO: 25496 - DNA, 570 bp, Artificial Sequence
  Description of Artificial Sequence: Synthetic coding sequence
atggccagcaagcgggccctggtgatcctggccaagggcgccgaggagatggagactgtaattcctgtggatgtcatgagacgcgctggcattaaggtgactgtggcaggcctggctggtaaggacccggttcagtgttctcgcgatgttgtaatttgcccagatgcctctctcgaggacgccaaaaaggagggcccctatgacgtggttgtactccccggcggcaacctgggggcgcagaatctgtctgaatcggccgccgtgaaagagatattgaaggaacaggaaaacaggaaaggtttgatagctgccatttgcgcaggtccgaccgcactgttagcgcatgaaatcggctttggaagcaaggtgactacacacccccttgcaaaggacaaaatgatgaatggcggccactatacctatagtgagaatcgcgtggaaaaggacggcttgatcttgaccagcaggggtcccggaacaagctttgaattcgcactggctatagtcgaggccctcaacggcaaggaggttgccgcacaagttaaggcgcccctggtcctgaaagactag

SEQ ID NO: 25497 - DNA, 3561 bp, Artificial Sequence
  Description of Artificial Sequence: Synthetic coding sequence
atggacgagccccccggcaagcccctgagctgcgaggagaaggagaagctcaaggaaaagctggcattcctgaagcgcgaatacagcaaaacacttgctcgactacaaagggcacaacgggccgaaaaaatcaaacattctataaagaagaccgtggaggagcaggattgtctgagtcagcaggatctttcaccgcagttaaaacacagcgagccgaaaaataagatctgcgtctatgacaaacttcatattaaaacgcatttggacgaggaaacaggtgagaaaacaagcatcaccctagacgtggggccggagtctttcaatcccggcgacggacctggaggcctgccaattcaacggaccgatgacacgcaggagcattttcctcaccgcgtcagcgacccctctggcgaacagaaacagaagctgcccagtcgccggaaaaaacagcagaaaaggaccttcatctcccaagaacgcgactgtgtgtttgggaccgactctctccgactgtcagggaagcggctcaaagaacaggaggagattagttccaaaaatcccgctaggtctccagtcacagagattcgcacccatctgctgagtctcaaatccgaacttccagattcgcccgaacccgtgacagaaattaacgaagattccgtacttatcccccccaccgcccagccagagaagggcgtagatacattcctccgccgccctaacttcactcgggctacaaccgtcccactgcaaaccctctccgactctggttcaagccagcaccttgagcatattccaccaaaggggtccagtgagctgactacacacgaccttaagaatattagatttacctccccagtgtctcttgaagcccaggggaagaagatgaccgtgagcacagacaacctgcttgtgaataaggccatctccaaaagcggacagctgcccacctcttctaacctggaagccaatatctcctgcagcctcaatgagctgacttataacaatcttcctgctaacgaaaatcaaaatctcaaggagcaaaatcagactgagaagtccctgaaatcccccagcgatactctggacggaagaaacgaaaacttgcaagagtctgaaatcctgagccagcccaaatctttgagtctcgaagccacgtcaccactatcagcagaaaaacattcttgtaccgtaccagagggactcctgtttccagccgagtactatgtaaggactactcggagcatgtcgaactgtcagcgcaaagtggctgtcgaggccgttatccagtcacacctggacgtgaaaaagaagggattcaagaacaagaataaggacgcctctaagaacctgaacttgagcaacgaagagacggaccagtccgagattaggatgtccggcacctgtacaggccagccaagctcccgaacgtctcagaaacttctgagccttaccaaggtctcatccccagccgggcccaccgaggataacgacctctcacgaaaggcagtggcacaagcgccgggacgtcggtacacaggaaagagaaagagcgcttgcacccctgccagcgatcactgcgaaccactgttgccaacatctagcctgtccatcgttaaccgctcaaaggaggaggtgactagccacaagtatcagcatgagaaactgtttattcaggtgaaaggaaagaaaagccggcatcagaaagaagattccctgagctggtccaatagcgcttacctttcactcgatgacgatgccttcacggctcccttccaccgcgatggcatgttatcgttgaagcagctgctgtcatttctgagtatcacggacttccagctgcccgacgaagactttgggcccctgaaattggagaaggtcaagagctgtagcgagaagcctgtcgagccgttcgaaagcaaaatgtttggcgagcgccacctgaaagagggatcttgtatcttcccagaagagttgtcccctaagagaatggataccgaaatggaggatcttgaggaagatctgattgtactgcctggaaaatcacaccccaaacgacctaactcgcagtcgcaacacacgaagacaggtctgagcagttcgatccttctatatacaccacttaataccgtggccccagacgataacgacaggcccaccactgacatgtgttcacccgcttttccaatactggggacaacaccagcctttggcccacagggatcatacgagaaggcatccactgaggtggccggaagaacatgctgcactcctcagctggcacacctgaaggactcggtgtgcctggcttctgacacgaagcagtttgatagtagcggttcgcctgccaagccccacacaaccctgcaagtgtccgggagacagggccagcccacctgcgactgtgatagtgtgccaccagggacccctccccccatagagtcttttacattcaaagagaaccagctctgtcggaacacctgtcaggagctacataagcactccgtggagcagacggagaccgccgaactgccagccagcgattcaattaaccctgggaacctccagctagttagtgagctaaaaaacccgtctggctcctgttccgtggacgtgagcgctatgttctgggaaagggctgggtgcaaggagccttgtataattacggcctgcgaggacgtcgtgagcctttggaaagccctcgatgcctggcagtgggaaaaactgtacacctggcatttcgcggaggtgcctgtacttcaaatcgtgccagtacctgatgtttacaatctcgtttgtgtagctcttgggaacttggagattagggagatcagagctttgttctgcagcagtgacgatgaaagtgagaagcaggtactattgaaatctggcaatataaaggcagtactaggacttaccaagcggcgcctcgtgtcttcgtcaggtactctttcagatcagcaggtggaggtgatgacatttgccgaggatgggggagggaaagaaaaccagtttttaatgccccctgaggagacaattctgaccttcgccgaggtccagggcatgcaggaggcccttcttgggacaaccattatgaacaacatcgtgatctggaaccttaaaaccggacagttattaaaaaagatgcatatcgacgacagctatcaggcttcagtttgtcataaggcttactcagagatggggctgctgttcatcgttctttcccatccctgcgccaaggaaagcgagtccctgcgttcaccggttttccagttgatcgtcatcaaccccaaaactacgctgtcggtaggtgtgatgctctactgcctgccgccagggcaggccggtaggtttctagaaggggatgtaaaggaccactgtgctgccgccatcctgaccagtgggacaatagcgatttgggacctcctccttggacagtgtaccgccttattgccacccgtttccgatcaacactggtcattcgtgaaatggtccggcaccgactcccatttgctggccggccagaaggatggtaatatctttgtgtaccattacagttag

SEQ ID NO: 25498 - DNA, 4344 bp, Artificial Sequence
  Description of Artificial Sequence: Synthetic coding sequence
atggccagcgccggcaacgccgccgagccccaggaccggggcggcggcgggtccggatgtatcggcgccccgggccgacccgcaggcggtggacggaggcggaggaccgggggcctgagacgggcagccgcaccagatagggattatcttcaccggccatcctactgcgatgcggcatttgctctggagcagattagtaagggaaaagctaccgggcgaaaggcacccctctggctacgggctaagtttcagcgcctgttattcaaactcggatgctatattcagaaaaactgcggaaagtttctcgttgtggggctgctcatctttggcgcctttgctgtgggcttgaaggccgctaaccttgaaactaacgtggaggagctttgggttgaggtaggaggacgagtttcccgagagctgaactacacaaggcaaaagatcggcgaggaggccatgttcaatccccagctcatgatccaaactccaaaagaggagggtgctaatgtgttgaccactgaggcgctgctgcagcatttagactctgctctgcaggcctcccgggtgcatgtctacatgtacaatcgccagtggaagctagaacatttgtgctataagtcaggagagctaatcaccgaaactggatacatggatcagatcatcgaatacctgtatccttgcttaattataaccccactggactgcttttgggagggggccaagttacagagcgggaccgcttaccttttaggcaagccacctctcaggtggaccaacttcgatcctcttgagttcctcgaggaactcaaaaaaatcaattatcaggtggacagctgggaggagatgcttaataaggcagaggttggccacgggtacatggaccgaccctgcctaaatcctgctgatccggactgtccggctacggctccgaacaagaacagtaccaaacccttagatatggccctggtgctcaacggaggctgtcatggcctgagcaggaagtacatgcactggcaagaggaattgatcgtgggggggaccgtcaaaaattcaacggggaaactagtcagcgctcatgctctgcagaccatgtttcagttaatgacccccaagcagatgtatgaacattttaagggctacgagtacgtgagccatatcaattggaatgaggacaaggccgcggccatactggaggcctggcagcgcacatacgtggaggttgtgcatcagtccgtggcacaaaatagtacccagaaggtcctcagcttcacaaccacaacactggacgatatattgaagagctttagtgatgtgagcgtgattcgggtggcatccgggtacttgctgatgttagcttacgcctgtttaactatgcttagatgggactgctccaaatcccagggagccgtgggattagctggagtgcttctggtcgccttgagcgtggctgccgggttaggcctttgctcactgatcggtattagctttaacgctgccacgacgcaggtgcttccgtttctggcattgggcgtgggcgtagacgatgtgttccttctcgcccacgcttttagcgaaacagggcaaaacaagcgtatccctttcgaagatcggacaggagaatgtctgaaacggactggggccagcgtggcccttacttcgattagcaatgtcactgcattcttcatggctgctttgatcccaattccagcactacgtgcattttcccttcaggccgccgtggtcgtggtcttcaacttcgccatggtgttactgatatttccagcaattctatcaatggacctttatcgacgcgaagaccggaggctcgacatcttctgttgttttacctccccttgtgtttcccgcgtcattcaagtggagccgcaggcctacacagatacccacgataacacacgatatagtcctcctcctccatattcatcacattcttttgcccacgagacccagattacaatgcagtctaccgttcagctccggacggaatatgacccccatacccacgtctattacactactgcagagcccagaagtgaaatttctgtccaaccagtgaccgttacccaagatacgttgagttgtcagagccccgagtctacatcttctacacgggacctgctgtcacagtttagcgactcaagtttgcattgcctggaacccccatgcacaaagtggaccctctccagctttgccgagaagcattacgcaccttttctgctcaagcccaaggccaaggtggtcgtcatctttctgttcttaggccttttaggggtctctctctacggtaccacaagggtgagggacggccttgacctgaccgatattgttccaagggagacccgagaatacgactttatcgctgcacagtttaagtacttttccttctataacatgtatattgtaacacagaaagccgactatcctaacatccagcatttgttatacgaccttcatcgcagcttttcaaacgtaaaatatgtgatgctcgaagaaaataaacagctgcctaaaatgtggttacattattttcgggactggttgcaggggctccaagacgccttcgactccgactgggaaacagggaagattatgcccaacaattacaaaaatgggagcgatgacggggtactcgcctataaattattggttcagactggctctcgggataagcctattgatatttcgcagcttacgaaacagaggctggtggatgctgatggaatcattaacccatccgcattctacatctacctgaccgcatgggtgtctaatgatcccgtcgcctatgccgcatcgcaggccaacatcaggccccatcgaccggaatgggtgcacgataaggctgactatatgcctgaaacccgattgcgaattcccgcggctgagcccatcgaatacgcacagtttcctttttatttaaacggcctcagagatacttcggactttgtcgaggccattgagaaggtgcggactatatgttcgaactacacttcgctcggactctcctcttaccccaacggctacccgtttctcttctgggagcagtacatcggcctgcggcactggctgctgttgttcatttcagtcgtgttggcctgcacattcttggtgtgtgccgtgttccttctcaacccttggacagctggaattatcgtcatggtgttagccttgatgacggtcgaactgtttggtatgatgggtctgataggcattaaactatccgctgtcccggtggtaatactgattgcatctgtgggcataggcgtcgagtttacagtacacgtcgcgttggctttccttacggcgatcggcgacaagaaccgtcgggcagttcttgccttagaacacatgtttgcacccgtgcttgatggcgcagtgtccactctgctgggagtcctcatgctggctggtagcgagtttgattttatcgtaaggtacttctttgcagttctggcaatactaaccatactgggcgtgttgaatgggctagtactgctgcccgtgttgctgtccttttttggaccctaccccgaggtatccccagctaacgggctgaaccgcctgcccactccaagccctgagcccccaccatcagtggtccgctttgccatgccccctggccacactcacagcggatccgacagttctgacagtgaatacagttcacaaaccaccgtctcagggctcagcgaggagctgcgccactacgaggcccagcaaggcgctggtggtcccgctcatcaagtaatcgtggaagccacagagaaccctgtcttcgctcacagcacagtagtccatcctgagagtaggcaccacccaccttccaatccccgccaacagccacacctcgactcaggttctcttccaccgggacgacagggtcaacaaccgaggcgcgacccaccccgagagggattgtggccgcccccataccggccaaggagagacgctttcgagatctccacagagggacactctggccctagcaaccgcgcccgctggggcccccggggcgcacgttctcataatccacgtaaccctgcttcaacggccatgggctcttctgttccaggatactgccagcctattactactgtgactgccagtgctagtgttaccgtagctgtccacccaccgcctgtccctggcccaggacgaaatcctaggggcggcctgtgccctggttacccggaaaccgaccacggactgtttgaagaccctcacgtaccgtttcatgttaggtgtgaaaggagagactctaaagtggaggtcatcgagctgcaggatgtggagtgtgaagaacggcccagaggcagcagctccaactag

SEQ ID NO: 25499 - DNA, 1059 bp, Artificial Sequence
  Description of Artificial Sequence: Synthetic coding sequence
aaggccgaggtgggccacggctacatggaccggccctgcctgaaccctgccgatcctgattgtcccgcgacagcacccaataaaaacagcactaaacctctggacatggccctggtgttaaatggggggtgtcatggtttgtcccgcaagtatatgcattggcaggaggaattgatcgttggagggactgtgaaaaattcaactgggaaactagtgtctgctcatgccctccagacaatgttccagctgatgacacctaaacaaatgtacgagcacttcaagggctacgagtacgtgtctcatatcaactggaacgaagacaaagctgccgccattctggaggcctggcaaagaacatatgtcgaagttgtgcaccagagtgttgcccaaaatagcacccagaaggtgctgtctttcacgacaaccacactcgacgatatactgaagtccttttccgatgtgtccgttatacgggtggccagcggctacctgttgatggtgctcccattcctagccctgggcgtgggcgtggacgacgtttttctgcttgcgcatgcattctccgagacaggacaaaacaagcgcataccttttgaagaccggaccggtgagtgcctgaaacggaccggtgcctcagtggcccttacgagcatatccaacgtgaccgctttttttatggcagcgttgatccctatccctgcactacgcgcattttccctgcaagctgctgtggtggttgtcttcaatttcgccatggtgttattaatcttccccgcaattctgtccatggatctgtaccgaagagaagacagaaggctggacattttctgctgctttacctcgccttgtgtgtctagagtcatccaggtcgagccccaagcctacaccgacactcacgacaacacgaggtactcacccccgcctccatattccagtcacagctttgcccatgaaacccagatcaccatgcagtccactgtccagctaagaaccgagtatgaccctcatacccacgtgtattataccactgcagaacctcgctcagagatttcggtctag

SEQ ID NO: 25500 - DNA, 4341 bp, Artificial Sequence
  Description of Artificial Sequence: Synthetic coding sequence
atggagctgctgaaccggaaccggctggtgatcgtgagcccccggtgcacacctccaaaggccagtggagggcccgccagaagaggtttttacacattcaggtctttctgtaaggatggaggtgggggggaggaggaggaagaaaatggaggggaggaaaaggacgatcggggggacaaagagacacggtccgacaaagggaaggccacaggccgtaaggcccccctgtggctccgggcaaagttccaaaggttgctgttcaagctgggctgctacattcaaaaaaattgcggcaagtttctggtggtaggtctgctgatctttggggccttcgccgtgggtttgaaagctgccaatctggaaacaaacgttgaggagctctgggtggaggtgggcggccgtgtgagcagagagctgaattatacaagacaaaaaattggcgaagaggcaatgtttaaccctcagttgatgatccaaacacctaaggaagagggcgccaacgtactcactaccgaggcactgcttcagcacctggacagcgctctgcaagcatccagggtgcacgtttacatgtacaatcggcaatggaaacttgagcatctttgctacaagtctggagagctgatcaccgagaccgggtacatggaccagattatagaatacttgtacccttgcctgatcataacgccattggattgcttctgggaaggagcgaagcttcagagcggcacagcctacctgctgggtaaacctcccctgagatggacaaacttcgaccccctcgagtttctggaagagctgaagaagatcaactatcaggtggacagttgggaggagatgctgaataaagccgaggtgggccacgggtacatggaccgtccctgtctgaaccctgccgaccccgactgtccggccacagcaccaaacaagaatagcactaagcccttggacatggctttggtacttaatggaggttgccacggtctgagtagaaagtacatgcactggcaggaagaactgatcgttggcggcaccgtgaaaaacagcaccggcaaactcgtttccgcccatgctctgcagacgatgttccagctgatgacaccgaagcagatgtacgaacatttcaagggctacgagtacgtgtcccacattaactggaatgaggacaaagcagcagctattctagaagcatggcagaggacttatgtagaagttgtgcatcagtctgtcgctcagaactcaacacagaaagtgctatcattcaccactacaactctcgatgacatcctgaagtccttcagcgatgtgtcagttatcagggtcgcatccggatacctcctcatgcttgcctacgcctgtctgacaatgctcagatgggactgctctaagtcccagggagcggtcggcctggcaggagtgttgctggtggcactaagtgtggcggccggcctgggcctctgttccttgatcggaattagcttcaacgcggctactactcaggttctgccattcctagccttgggagtcggcgtggacgacgtgttcctcctagcccatgcgttctcagagaccggacaaaataaaaggatcccctttgaggatcgaaccggagaatgcctgaagagaacaggggcctccgtcgctctgacctcaatttctaacgtcaccgccttcttcatggctgcacttatacccatacccgcccttcgagctttctccctccaggccgccgtggttgtggtatttaacttcgctatggttttgctgattttccctgctattctgagcatggatctgtataggcgcgaggacaggcgcctggacatcttttgttgcttcactagtccttgcgtgtccagagtgatacaggttgagcctcaggcctacacagatacacatgacaatacgcggtactccccaccgcccccctactcaagccactcattcgctcatgaaacgcaaattaccatgcaaagcacggtccagctgaggaccgagtatgatcctcacacacatgtgtattatacaacagccgagcccaggagtgaaatttctgtccaaccagttaccgtaactcaagatactctttcctgtcagtcccctgagtcgacctccagtacacgcgacctgttgtcacagttcagtgactcatccctccactgcctcgaacccccttgtaccaaatggactctgagcagttttgcggaaaaacactacgccccatttcttctaaagccaaaggccaaagtcgtggtgatcttcttgttcctgggccttctcggcgtatcactgtacggaacaacaagagtgcgtgatggactggatctaaccgatatcgtgcccagagaaacgcgcgaatatgactttatagcggcgcaattcaaatactttagtttttacaacatgtatatcgtaacccaaaaagccgactacccgaatatccagcacctgctgtatgatctgcacagatcctttagtaacgttaaatacgtgatgctggaagagaacaaacagctccccaagatgtggctacattatttccgggactggctccaagggctccaggacgcattcgacagtgactgggagacgggaaagattatgccgaataactacaagaacggtagcgacgacggagtactagcctataagctcctcgtacaaactggaagtcgagacaaacccatagacattagccagctgacaaaacagaggctggtcgatgccgacgggataatcaaccccagcgccttttatatatatctaaccgcttgggtgtcgaatgacccagtggcctatgccgcgtcccaagcaaatattagaccacatcggccagagtgggtgcacgacaaggccgactacatgccagagaccagattgagaattccagcggcagagcctatcgagtatgctcaattccctttctatctcaacggcctgagagacaccagcgattttgtagaagcgatagagaaagtccgcaccatctgctccaattatacgtccctgggcttgtcatcctaccccaacggatacccctttctcttctgggagcagtatattggcctgagacattggctactactgttcatctccgtggtgctggcttgtaccttcctggtgtgcgctgtctttctcttaaacccatggaccgcagggattattgttatggtgcttgcgctgatgacggtggagctgtttggcatgatgggtcttatcggcattaagctgagtgccgtacccgtagtgatcctgattgctagcgtggggattggggttgaattcaccgtgcatgtggccctggcctttctcaccgcgataggtgacaagaacagacgagccgtccttgctttagagcacatgtttgccccagtgctggatggcgctgtctccacccttctgggcgtgctgatgttggcgggatccgaatttgatttcatcgtaagatacttcttcgccgttttagcgatcctcaccatactgggcgtgcttaacggacttgtattgctgcccgtgttgctgtctttcttcggcccatacccggaagtgtcccccgccaacgggctgaatagactgcccacgccaagtcccgagcccccacctagcgtggtcaggtttgccatgccacccgggcatacgcactctggctccgatagttcggactccgagtactccagccagaccactgtaagtggactgtctgaggagctgagacactatgaggcgcagcagggagccggaggcccagcacatcaggtcattgtggaggccaccgaaaatcccgtctttgcccatagtactgttgtacatcctgaatctaggcaccacccaccatcaaaccctagacagcagccgcacttggattctggcagcctgcccccgggccgacagggacagcaaccaaggcgcgatcctcccagggaggggctctggccacccccctacagaccgcgcagggacgcctttgagatctcaactgaaggtcacagcggaccctccaaccgagcgaggtggggaccacgcggagccaggtcccacaaccctcgaaatccggcgtccacagctatgggatcttccgtgcccggctactgccagccaatcaccactgttaccgcttctgcctccgtaactgtcgccgtgcaccctcctccagtgcctgggccaggccgaaatccccggggagggctttgcccaggctaccccgaaacggatcacggcttgttcgaggacccacatgtaccctttcatgtgcggtgtgaaagaagagatagtaaggtggaagtgatcgagctgcaggacgtcgagtgcgaggaacgccctaggggttccagtagtaactag

SEQ ID NO: 25501 - DNA, 1758 bp, Artificial Sequence
  Description of Artificial Sequence: Synthetic coding sequence
ccctgccggaagagcagcgccctgaacagccccaaggccgccgtggtggtggtctttaatttcgcgatggtgcttcttatctttcccgccattctgtccatggatctttatcgtcgggaagataggaggctggacattttctgctgcttcacgagtccgtgcgtttctcgggtcatccaggtggaaccgcaggcctatacagacactcacgacaacactcgatattccccaccacctccttactccagccacagcttcgcgcacgaaacacagatcactatgcaatctaccgtgcagctccggacagagtacgatccccacacccacgtgtattatacgaccgcagagcctcgtagtgaaatttcagtgcaacccgtgaccgtcacccaggatacattatcctgccaaagcccagaatctacgtcttccacccgggacctgctgtcgcagttttccgactcttccttacactgcctagagccaccatgcaccaaatggacacttagctcctttgcagagaaacactacgcaccttttctcttaaaacccaaggccaaggtggtggtgattttcctgtttctcggcctgctcggcgtgtccctgtatggcacaaccagggtcagagacggactcgatctgaccgacatcgtgcccagagaaacgagggagtacgacttcatcgcagcacagttcaagtacttctcattctataacatgtacatcgtgacacagaaggccgactaccccaatatccaacatctcctttacgatctgcatcggagcttttccaacgttaaatacgtcatgctagaagagaataaacaactcccaaaaatgtggctgcactatttcagggactggctgcagggactacaggatgcgttcgattctgactgggaaacaggaaaaattatgccaaataactataaaaacggatcagacgacggagttttggcgtataagcttcttgtccaaacagggagccgagacaagcccatcgacatcagtcagttgactaagcagcggctggtagacgccgatggaattatcaacccatctgcgttttacatctacttaacagcttgggttagcaatgatcctgtggcgtacgcagcttcccaggcaaacatcaggcctcatcgcccggaatgggtgcacgataaagcagactacatgcccgaaacacgcctgcgcatcccagccgcagaaccaattgagtacgcccagttccccttttacctcaacggcctgcgagacactagcgatttcgtggaggctattgagaaagtgcggaccatatgttccaattacacatcactgggactatcaagttatcccaacggctacccttttttgttttgggagcagtacataggtctcagacattggctactgcttttcatttctgtcgtgttggcttgtacctttctcgtgtgcgctgtgttccttctgaatccatggacagccgggataatcgtgatggtgttagctctgatgaccgtggaactttttgggatgatgggcttgattggcataaaactttctgccgtgcctgtcgtaatcctcattgcctcagttggcattggtgtagagttcactgtgcacgtagccttggctttcctgaccgcaattggcgataaaaataggagggcagtgcttgccctcgaacatatgtttgcgccggtactcgatggcgcggtcagcacattattgggagtcctgatgctcgccggttccgaatttgacttcatcgtgtag

SEQ ID NO: 25502 - DNA, 729 bp, Artificial Sequence
  Description of Artificial Sequence: Synthetic coding sequence
atgccccccggccacacccacagcggcagcgacagcagcgacagcgaatacagctctcaaactacagtgtctgggctctccgaggaactcagacactatgaggctcagcagggtgctgggggccccgcgcatcaggttatcgtggaagccaccgaaaaccctgtcttcgcccacagtaccgtggtgcaccccgaaagcagacaccatccaccatctaacccccggcagcagccacacctggacagcgggtcactgccaccaggaagacagggccagcagccacgtcgagatccgcctagagagggcttgtggcctccaccctaccgccccaggcgggacgcctttgagatctccactgaaggccacagtggcccatctaatagggccaggtgggggccaagaggagccaggtctcacaatcctcgtaatcctgctagcaccgctatgggctccagtgtgccaggctactgtcagcctattacaactgtgacagcatcagcaagcgttacggttgccgtccatccacctcccgtcccgggccccgggcgaaatcccagaggcgggctttgcccagggtaccccgagacagaccacggcctgtttgaggacccgacatgcctgtctacttccggggttcgtggaggcatcaggcgatggaaatccctcagctgtagaacttggaacgccaggaggggacccggcgaggccgctcctacagagggcgactag

SEQ ID NO: 25503 - DNA, 1461 bp, Artificial Sequence
  Description of Artificial Sequence: Synthetic coding sequence
ggcaaggccaccggccggaaggcccccctgtggctgcgggccaagttccagcggctgctgtttaagcttggctgctacattcagaagaattgcggaaagttcctggttgtaggcctgctgatatttggcgcgtttgccgtgggtctgaaggccgcaaacctggagaccaatgttgaggaactttgggtggaggttggaggcagggtaagccgggagctcaattatacccgacaaaagatcggtgaagaggcaatgttcaatcctcagctgatgatacagactccaaaggaagagggagccaacgttttgaccacagaagctctgttgcaacacttagactctgctctgcaggcttcccgcgtccacgtttacatgtacaatcgaggaaagccacccctcagatggaccaattttgatcctctggagtttttagaagagctgaagaagattaattatcaagtggatagctgggaggaaatgctaaataaagcagaggtgggccatggatacatggacagaccttgtttaaaccccgccgacccagactgtcctgctacagcccctaataagaactccaccaagcctttggatatggccctggtgctgaatggtgggtgtcacggcctctcaagaaaatatatgcactggcaggaagaactgatcgtgggaggtactgtgaagaactccacaggaaaactcgtcagcgcacacgctctgcagacaatgtttcagctcatgacaccaaagcagatgtacgaacatttcaagggatatgagtatgtcagtcacattaactggaatgaggacaaggcagccgctatcttagaggcctggcagaggacatacgttgaggtggtacaccagtcggttgcacagaacagcacacagaaagtcctgtcgttcacgaccaccactctggacgatattcttaaaagcttttctgatgtttctgtaatccgtgtagcctctgggtacctcctgatgctggcctacgcctgtctcaccatgttacggtgggattgctcaaaatctcagggggccgttggtctagccggtgtattactggtggctctcagtgtcgccgccgggctggggctgtgttccttgatcggtatctcatttaacgccgcaaccacccaggtgctaccctttctggctctgggagtgggtgtggacgacgtgttcttgctggcgcacgctttcagcgaaaccggtcaaaataagcgcattccattcgaagataggaccggcgaatgcttaaagaggactggggcttccgtggcactaaccagcatcagcaacgtgacggctttttttatggctgccctgatcccaattccagccctgcgggcgttttcactacagtacattctcatggcacatagagggcggttgagcttcaatgacaccctttggtgcggagggttaaagtcgtacatgagattcccttacgaggaatag

SEQ ID NO: 25504 - DNA, 3891 bp, Artificial Sequence
  Description of Artificial Sequence: Synthetic coding sequence
atgttcaacccccagctgatgatccagacccccaaggaggagggcgccaatgttctcaccaccgaggcactgcttcagcacctcgattctgccttacaagctagtagggtgcacgtgtacatgtacaatagacagtggaaacttgagcatctgtgttacaagtccggggagctgatcactgagaccggttatatggaccagatcattgagtatctttatccgtgtctcataatcactcccctggactgcttctgggagggagctaaattgcagtcaggaaccgcttacctgcttggcaagccccctctcaggtggacaaactttgatcccttggaatttcttgaggaactgaaaaagattaactatcaggtggatagttgggaggagatgctgaacaaagcggaggtagggcacgggtacatggacaggccctgtctgaacccagcagatccagactgccccgccaccgctccaaataagaacagcaccaagccattagatatggccctggtgctgaacgggggttgccacggcttgtcacggaagtatatgcattggcaagaagaattgatcgtcggtggcaccgtcaagaactcaactgggaagctagtctcagcgcatgcgctgcagacaatgttccaactgatgaccccaaagcagatgtacgagcactttaaggggtacgaatatgttagtcacatcaactggaacgaagacaaggctgcagcaattctggaagcttggcagagaacatacgtggaggttgtacatcagtctgtggctcagaatagcactcaaaaggtcctctcctttaccaccacaactttggatgacattctgaaatctttttctgatgtgtcagtcatccgcgtagcctctggctacctgttaatgctcgcatacgcttgcctgacaatgcttaggtgggattgtagtaagagccagggtgcagttggactggctggcgttctcctcgtggctctctcggtagcagcgggacttggactgtgctcacttattgggatctccttcaacgctgctacgactcaggtgttgccctttctcgccctgggagttggtgtggacgatgtgttccttttggcccatgccttttctgaaactggacagaataaaaggataccttttgaggacaggaccggggagtgcctcaaacggacaggagcctccgtggctctgacatctatttcaaacgttacagctttcttcatggctgcattgatacccataccagccctgcgggccttctccttacaggccgccgtagtggtggtgtttaatttcgccatggtgctgctcatttttcctgctatcctgtcaatggacctctatcgacgcgaggataggaggttggatatcttttgttgcttcacttcgccctgtgtgagtcgagtgatccaggtcgagcctcaggcttacaccgacacacatgacaataccagatacagccccccaccaccctattcttctcattccttcgcacacgaaacacagatcacaatgcagtccacagttcagctgaggaccgagtacgacccgcacacccatgtttactacaccacggcagagccaaggagcgagatctccgtacagcctgttacagtcacacaggatacattgtcttgtcagagtccagaaagcacgtctagcaccagagaccttttgagccagttctcagactccagtttgcactgcctcgaacctccttgcaccaagtggacactgtctagttttgcagaaaagcactatgcaccattcctgctcaaacccaaagccaaggtagtagtaatctttcttttcctgggtctgctcggcgtttccctctacggcacaaccagggttagggatggactggacctcaccgacattgtgccaagggagaccagagaatacgattttattgccgcccagtttaagtatttcagcttttacaacatgtatattgttacccagaaagctgattatcctaacattcaacatctgctctacgatttgcaccgttcttttagcaatgtaaagtacgttatgttggaagaaaacaaacagctgcctaagatgtggctgcactatttccgcgactggctgcaggggctgcaagacgcctttgatagcgactgggaaaccgggaagatcatgccgaataactacaagaatggatccgatgatggcgtgctggcctacaaactgttagtgcaaaccgggtctcgtgataagcccatagatattagccagctcaccaaacagaggctggtagatgctgacgggatcattaacccatccgccttctatatttatttgacggcatgggtgtcaaatgaccccgtggcttacgccgcctcccaggccaatattaggccacaccgtcccgaatgggttcacgacaaagccgattatatgcccgaaacgagactgagaatcccggcagccgaacctatcgaatatgcccagtttccgttctacctgaacgggctgcgggatacttccgacttcgtggaagccattgaaaaggtccgaactatctgcagcaactacacaagtctggggctgtcttcttatcctaacggataccccttcctcttctgggagcagtacatcggcctccggcattggctgctcctgttcatcagcgtggttctagcctgcacctttctcgtctgtgctgtatttctcttgaacccctggactgccggcattatcgtcatggttctggccctgatgactgtggagttgttcggtatgatgggacttatcggaatcaaacttagtgccgtgcccgtcgtgatcctgattgcaagtgtgggtatcggcgtggaattcacagtccacgtagcactcgcatttttgactgcaattggggacaagaatcgacgggcagttctcgccctagagcacatgtttgcaccagttttagatggggccgttagtactcttttgggggttctgatgctcgccggctctgagttcgactttattgtcagatatttttttgccgtgttagctattctgaccatattgggggtcctcaacggtctagtcttactgcctgtactgctctccttctttggaccttatcctgaggtgtcccccgcaaatggtctcaataggctaccaactccatctccagaacctccaccatcggttgtgcgtttcgcgatgccacccggccatacgcattccggcagcgactcttcggatagtgaatactcttctcagacaactgtttcaggactgagcgaagaattgcggcattacgaggcccagcagggtgccggtggccccgctcatcaggtcatcgtggaggctaccgagaacccagtgtttgcacacagtactgtggtccacccagaaagtcggcaccaccctccttccaatccccgtcagcagccgcatctggattccggcagccttccacccgggcgccagggacaacagccccgccgggatccacctcgcgagggcctgtggccacctccatatcgcccgcggcgcgacgcatttgaaatcagcaccgagggacattcaggacccagcaacagagccaggtggggccctcgaggtgcgcgttcacataaccccagaaatccggcctccacggccatggggagctccgtccccggctattgtcagcctataacgacggtgactgcgtcagcaagcgtgaccgtggccgtgcaccccccacccgtgcccggccctggtaggaacccccgaggcgggctgtgtcccggctatcccgagaccgaccacggactcttcgaagatccgcacgtgccattccacgtgaggtgtgaacgccgggatagtaaggtggaggtgatcgaactgcaggatgtcgagtgtgaagaaagaccaagaggcagttcttctaactag

SEQ ID NO: 25505 - DNA, 3891 bp, Artificial Sequence
  Description of Artificial Sequence: Synthetic coding sequence
atgttcaacccccagctgatgatccagacccccaaggaggagggcgctaatgtacttactaccgaagccctcctccagcatcttgacagcgcacttcaggccagccgagtgcatgtgtatatgtacaatagacagtggaagcttgaacacctgtgctataagtcaggcgagttgataactgagaccggctatatggaccaaatcatcgaatatctgtatccatgtttaattatcacaccgctcgactgcttttgggagggcgcaaaactgcagtccggtactgcctatctactcgggaagccccccttgaggtggaccaatttcgacccactcgaatttctcgaagagttgaaaaagattaattaccaagtagattcctgggaagagatgttaaacaaagcagaggtgggccacggatacatggaccggccgtgtctgaatcctgctgatcccgactgccccgcaaccgctccaaacaagaatagcactaagcctctggatatggcactggtgctgaatggtgggtgtcatggcctcagcagaaagtacatgcattggcaggaggagcttatagtaggaggaacagtgaagaatagcactggcaaattggtgtcagctcatgcgttacagaccatgtttcagttgatgaccccaaaacagatgtacgaacacttcaagggatacgaatacgtatcacatatcaattggaacgaagacaaggcagctgcaattctcgaggcttggcagcgtacctatgtcgaagtcgtacatcagtctgtagctcagaatagtactcaaaaggtcctgtcctttaccacaaccacactggatgacattctcaagtcttttagtgacgttagcgtgattcgggttgcttccggataccttctgatgctcgcttacgcctgtctgacaatgttgaggtgggattgcagcaagtcccagggcgccgtggggctggcaggcgttctcctggtggccctttctgtggcggccggacttgggctgtgttctttaattggcatcagttttaatgctgctacaacgcaagtcctgcccttccttgctcttggggtgggcgtagacgacgttttccttctggcacacgcattttctgaaaccggtcaaaacaaacgaattcctttcgaggatcgcacaggtgaatgtctcaaaagaactggtgcgtccgtcgcacttacgagtatttccaacgtgacggcattttttatggccgcgctgatccctattcccgccctgcgtgctttctccctccaggccgccgtggtcgttgtcttcaactttgccatggtcttgctgattttcccggccattctaagtatggacctgtacaggcgcgaggaccgacgactggacattttctgttgcttcacaagcccttgcgttagcagagtgatacaagtggagccgcaagcttacactgacacccacgacaacaccaggtacagtccaccccctccgtacagctcccacagcttcgcccacgagacccagatcaccatgcagagcaccgttcagctcaggacagagtatgacccccacactcatgtgtactacacgacggctgaacctcgatcagagatctctgtacaacctgtgacagtaacccaggatacactgtcctgtcagagtccagaaagcaccagttccactagagacctgctgagccagttctcagatagctccttgcattgtctggaacctccttgtacgaaatggactctgtcctccttcgccgagaagcactacgccccttttctattgaagcctaaagcaaaagtggtggtcatctttctgttcttagggctcctcggtgtttccctctacggcacaactagggtacgggacggactggacctcaccgacatagtcccccgggagactcgagagtacgatttcattgcagcccagtttaaatacttttctttctataatatgtacatcgtgactcagaaagccgattatcctaacatacagcatttgctatacgacctgcaccgctccttctccaacgttaagtatgtaatgctggaggaaaacaaacagctacccaaaatgtggcttcactactttcgcgactggctgcagggcctgcaggacgccttcgactcggactgggaaacaggcaagatcatgccaaataattacaagaacggctccgatgatggtgtgttagcgtacaagctcctcgtccagacaggcagtcgcgacaaacctatagatatcagccagctgactaagcaacgcctcgtggatgctgacggcatcatcaatcccagtgctttctacatctatcttactgcctgggtgagtaacgatccggtcgcatacgccgcctcccaggcgaacattaggccccaccgacctgaatgggtccatgataaagctgactacatgcccgagacccgacttcgtatcccagctgccgagcccatcgagtatgctcagtttccattttatcttaatggacttcgggacacctccgatttcgttgaggctatagagaaggtgagaactatttgtagtaattacactagtctcgggctctccagctaccccaacggttaccccttccttttttgggaacaatatatcggcctgcgccattggctgctactgttcatttctgttgttcttgcctgtaccttcctcgtgtgcgcagtatttctgctgaatccatggaccgcaggaatcatagttatggtcctggcactgatgactgtcgaactctttgggatgatgggtctcatcggcatcaagctgtcagctgtccccgtagtgattctgattgctagcgtcggtattggggttgaattcacggttcacgtggctctcgcatttctaaccgctatcggggacaagaataggagggcagtccttgctctggagcacatgtttgctcctgtacttgatggcgctgtgtcaacattgctgggcgtgctcatgttagccggttcagagttcgatttcattgtgagatacttctttgctgtgttggctatcctcacaattctgggagtcttaaatgggttagtcctgctgccagtgctgctgagctttttcgggccatacccagaagtgagccctgcaaatgggctcaaccgcctgcctacaccatctcccgaacctcccccgtcagtagtgcgattcgctatgccacccggtcatactcacagtggatcagactctagcgattccgaatattcctcacagaccaccgtgtccggcctgtccgaggagctgaggcattatgaggcgcagcaaggggctggtggtcctgctcaccaggtaattgttgaggcaaccgagaatcctgtgtttgctcactccaccgtggtgcaccccgagtccagacatcacccaccgtctaatcccagacaacagcctcacctcgattcaggctctctacccccaggacggcaaggccagcagccacgacgtgaccctcctcgcgaggggctgtggccacctccctaccggcccaggcgggacgccttcgaaattagcactgaaggccactcaggcccgtctaacagagcccgctggggacccagaggagctcgatcgcacaatcctcgaaacccagcttcgacagcgatgggcagttctgttccaggatattgccagccaatcaccactgtaactgccagcgcatccgtcaccgtagccgtgcatccccctccagttcctggtccagggcgtaatccgaggggtggactgtgcccaggctatcctgagacagaccacggtctgtttgaggacccacacgtgcctttccacgtgaggtgcgagcggagagattccaaagtggaagtgatcgaattgcaggacgtggagtgcgaagagaggccaagagggtcctcaagtaactag

SEQ ID NO: 25506 - DNA, 3891 bp, Artificial Sequence
  Description of Artificial Sequence: Synthetic coding sequence
atgttcaacccccagctgatgatccagacccccaaggaggagggcgcaaatgtcttgacaaccgaggcactgttgcagcacctggactctgcgttgcaggctagtcgtgtgcacgtgtatatgtacaatagacagtggaagctcgagcatctttgttacaaatccggagagctgataactgagaccggctacatggaccagatcatagagtacctgtacccttgcttaatcatcacacctctggactgtttctgggagggggccaagcttcagtctgggaccgcctaccttttgggcaagccacctctccgttggacaaactttgatcccctggagtttctggaagaattgaagaagattaactaccaagtggacagctgggaggaaatgctgaacaaggccgaggtgggccacggctatatggatcgcccatgtcttaaccctgccgatccagattgtccagccacggctccaaacaaaaattctaccaaacccttggacatggccctcgtcctcaatggcggatgccacgggctgagccggaagtacatgcactggcaggaggaactaattgtcgggggaactgtcaagaactctaccggaaagctggtgtctgcccatgccctccagaccatgtttcagctcatgactccaaagcaaatgtacgagcactttaaggggtacgagtatgtgagccatatcaattggaacgaagataaggcggccgccatcctggaggcctggcagagaacctatgtcgaggttgtgcaccagagcgtcgcgcagaactctacacagaaggtgctttcctttaccaccactactctggatgacattttgaaatcattctctgatgtctcagttatcagagtagcctcaggctatctcttgatgctcgcctatgcatgtctcaccatgctccggtgggattgcagtaagtcccagggagctgtcggactggccggggtgctgctggtcgccctcagcgtcgcagccggcctgggtctctgctccctaataggcatctctttcaatgccgcaaccactcaggttcttccctttctcgctcttggggtgggagtcgacgatgtgttccttctggcccatgcctttagtgagaccggacagaataagcggatcccatttgaggatcgcacaggcgagtgccttaagcgtaccggagctagcgtagccctgacctccatatctaatgtgactgcctttttcatggctgccctgatcccaatcccagctctcagggccttcagcctgcaagccgccgtggttgtggtgtttaattttgccatggttctcctcatcttccccgcaatccttagcatggacctctaccggcgggaggacaggcgactggatattttttgttgcttcactagtccttgcgtttccagagtaatccaggtcgaaccgcaagcgtataccgatactcacgacaatacaagatatagtcccccccctccttactcttcccacagtttcgcacatgagacacagatcaccatgcagtccactgtccagctgagaaccgaatatgatcctcacacacacgtctactataccacggctgaaccacgctctgagattagtgtgcagcctgtcaccgtgacccaagatactctctcctgccagagcccagagtcaacctccagcactcgggatttgctgagtcagttttccgatagctcactccattgcctggaacccccctgcacgaagtggacgctctccagcttcgccgagaaacattacgcaccgtttcttctgaaacctaaggctaaagttgttgtgatctttttattcttgggactcctgggcgtgagcctgtatggtactactcgcgtccgcgatgggctcgacctaaccgatatagtacctagagaaacaagagaatacgacttcatcgcagcccaatttaagtatttcagcttctacaacatgtatatcgtgacacagaaggcagattatcccaacattcagcacttactctacgatctgcacagatcttttagtaatgtcaagtatgtgatgctggaagagaacaagcaactacctaagatgtggctgcactatttcagggactggttgcaggggctacaggacgctttcgattctgactgggagaccggcaagattatgccaaataattacaaaaacgggtcagacgacggcgttttggcttacaagttgttggtgcagaccggtagccgcgacaaacccatcgacattagtcagctaacaaagcagcgccttgtggacgcagacgggattattaacccgagcgccttttatatctacctgacagcatgggtatctaatgaccctgtggcatacgcagccagccaggcaaacatcaggccacataggccggagtgggtgcacgacaaggccgattatatgcctgagactcggctgcgcattcctgccgcagagccaatagagtacgctcagttccccttttacttaaatggtctgcgcgatacatcagatttcgtggaagctatcgagaaagtccgcacaatctgcagcaattacacgtcgctggggctgtcctcttacccaaacggatacccatttctgttttgggaacagtacattgggctccggcattggttgctgctttttattagcgttgtcctggcctgcacatttttggtgtgcgcagtattcctgctgaacccctggacagccggaattatcgtgatggtactagctctgatgacagtcgagctgtttggaatgatgggtcttatcgggatcaaactgtccgctgtccctgttgtcatactgatagctagcgtagggatcggagtcgaattcaccgtgcacgtagcattggcctttctgactgccatcggagacaaaaatcgtcgcgcagttctcgcattggagcacatgtttgcccccgtgcttgacggagccgtgtccacactattaggggtcctgatgctcgctgggagtgaattcgatttcatagtgagatacttctttgcagtgttagccatcctgacaatactcggcgtattgaatggcctcgttctcctgccagtgttgctgtcttttttcggtccctacccagaggttagtcccgcaaacgggctaaaccgactacctaccccaagtcccgaaccgccaccatctgttgtgcgcttcgcaatgcctccaggccatactcattcaggttccgattcatccgacagcgaatattcgagccagactacagtgagcggcctctccgaggagttgcgtcattacgaggcccagcagggagccggaggtcctgcccatcaggtgatcgttgaggctactgagaatccagtattcgcacacagcacagtggtccatcctgagagcaggcatcacccaccctcaaatccaagacagcagcctcacctggattccgggagtctgcccccagggaggcagggccagcaaccccgccgtgaccctccccgcgaagggctgtggccccctccctataggcctcgcagagatgctttcgagatttccaccgagggtcacagcggaccatctaatcgtgcccggtggggaccccgaggagcaagatcccacaatcctagaaatcccgcatccacagctatgggaagcagtgtccccgggtactgtcaaccaatcaccacagtaacagccagtgcaagcgtgactgtggcagttcacccccctcccgtgcctgggccaggccgtaacccgagagggggcctctgtcctggataccctgagactgatcatggactgtttgaggatccacacgtgccgtttcacgtgcgctgcgaacgaagggacagtaaggtggaagttatagaactgcaggacgtggagtgcgaggaaaggcctcggggaagctcttctaactag

SEQ ID NO: 25507 - DNA, 4146 bp, Artificial Sequence
  Description of Artificial Sequence: Synthetic coding sequence
atgggcaaggccaccggccggaaggcccccctgtggctgcgggccaaatttcagcggctcctgttcaaactaggttgctacattcagaagaactgcggtaagttcttggtcgtgggattacttatcttcggtgcgtttgcagtcgggctgaaggcagcaaatctggagacaaacgtggaagagctgtgggtcgaggtagggggtcgagtatcacgggagctcaattacacccggcagaaaataggtgaggaagcaatgttcaatccgcagttgatgatccagaccccgaaggaggaaggcgctaatgtgctcactaccgaagcactgctgcaacatctggacagtgctctgcaggcgtctagagtgcacgtctacatgtacaaccgccagtggaagctcgagcacctgtgctacaagagtggggagctgatcactgaaaccggctacatggaccagatcattgagtacctctacccttgtcttatcatcactccgttggactgcttctgggaaggcgcgaagctgcagtcaggtactgcctaccttctgggaaagcctccgctgaggtggacaaacttcgaccccctggagtttctggaggagcttaagaagataaactaccaagtggatagttgggaggagatgctcaataaagccgaggtgggccacggatacatggatcggccctgcctgaacccagcggatcccgattgccccgccacagctccaaacaagaacagcaccaagcccctcgatatggcactggtcctcaacggcggctgtcatgggctgagtaggaagtatatgcactggcaggaagaactgatcgtcggaggcacggtcaaaaactcaaccggcaaactggtctctgcccacgcactgcagacgatgtttcagctcatgacccccaagcagatgtacgaacacttcaaaggctatgagtatgttagtcatatcaattggaatgaagataaggcggcagcaatcctggaagcgtggcagcggacctacgtcgaagtggttcatcagtctgttgcacagaattctacccagaaggtgctgagctttacaacaacaactcttgatgacatactcaaaagctttagcgacgtgagcgtgattagagtggccagcggctacctgctaatgctggcttacgcatgcctgactatgctcagatgggattgctctaagtcacaaggggcagtcggcttggccggcgtgttactggtagccctttctgtagcagctggactcggactctgctccctgataggaatttccttcaatgctgcaacaacccaggttctgccgtttctcgccctgggcgtgggagtggacgatgtgtttctgctggcccatgccttttcagagaccggccagaacaagagaattccattcgaagataggactggagagtgccttaagaggaccggcgcgtctgtggcattgacctcaatcagcaatgtgaccgccttctttatggctgctctgattcccatccccgccctgcgcgcctttagcttgcaggctgccgtggtggttgtgttcaatttcgccatggtcctgctgattttccccgctatactctccatggacctctaccgccgcgaagaccggcgtcttgatattttctgctgtttcacatcgccatgtgtttctagagttattcaggtggaaccacaagcttatacagatacccacgacaataccagatatagtcctccccccccgtattcctcccactctttcgcccatgagacacaaatcaccatgcagagcaccgttcagctcagaaccgaatacgatccccatacacatgtctactacactaccgctgagcctcggtcagaaattagcgtgcagcccgtgacggtcacccaggataccctttcttgccagagtccggagtcgaccagttcgactcgggacctactctcccaatttagtgatagctcattacactgtctggagccaccctgcacaaagtggacattgtcttcttttgctgagaaacattatgcgccattcctgttgaagccgaaggccaaggtggtggtgatcttcttatttcttggccttctgggtgtgagtctttacggcacaacaagggtaagagatggacttgacctgaccgacattgtgccccgggagacaagagaatacgacttcattgcagctcagtttaagtacttctccttctataatatgtatatagtgacccagaaggccgactaccctaatatccagcacttattgtacgacctacacaggagttttagcaatgtcaaatacgtaatgcttgaagaaaacaagcagctacctaagatgtggcttcattatttccgagattggctccaagggctgcaggacgcctttgattcagactgggaaacaggcaagatcatgccaaacaactacaaaaatggaagcgatgatggggtcctggcatataaactgctggtgcagactggcagtcgggataaaccgatcgacatctcccaactgacaaagcagcgcctcgtggacgccgacggcatcataaatccatccgcgttctacatctatttgaccgcttgggtgtctaatgatccagttgcatatgccgctagccaggctaacattcgtccacacaggccagaatgggtgcacgacaaggccgactacatgcccgaaaccaggcttcggatacctgccgccgaaccgatcgagtatgcccagtttccgttttatcttaacggacttagagacacctcagattttgtggaggcgattgagaaggtgaggacaatttgtagcaactatacttctctcggtctgagctcgtacccaaatgggtacccgtttttgttttgggaacagtacattgggctgcgtcattggctgctcctcttcatctccgttgtgctcgcctgtacctttctggtctgcgcggtgtttctgttgaatccgtggaccgccggcataattgtgatggtcctggcccttatgaccgttgagctcttcggcatgatgggtcttattggcattaagctgtcagctgtccctgtggtgattttgatcgcaagcgttggcatcggcgtcgagtttacagtgcacgtggcactcgcctttttaacggctataggagacaagaacagacgggctgtgttggcgcttgaacacatgttcgctccagttctagacggtgcagtgtcgaccctgctcggcgtcttaatgctggctggaagcgaattcgatttcatcgttcggtatttttttgccgtgctagccattcttaccatattgggcgtgctaaatgggctagtcttattgcccgtgctgctgagcttcttcggcccttatccagaggtgtctcccgccaatggtctcaacagacttccaacaccatctcccgagccacccccatctgtggtgcgcttcgctatgccccctggccacacacactcagggagtgactcttcagatagcgaatacagttctcagaccacagtgagcggcctgagtgaagagctcagacactacgaggcccagcaaggtgccggtggtcccgcgcatcaagtgatagtagaagctacagagaatccggtatttgcacatagcacggtggtacatcccgaatcccggcatcatccgccatctaatcctcggcagcagccccatctggattctgggagcctccccccagggaggcagggtcaacagccacgtcgagatcctcccagagagggcctgtggccacctccatataggccacggagagacgctttcgagatttccactgaaggacatagcggtcccagcaatagagctagatgggggccgagaggcgctcgctcacacaaccctagaaatccagcctccaccgccatgggctctagcgtacccgggtactgccaaccgatcacaacagttactgccagcgcctccgtgacagtcgctgtccatcctccgccggtgcctggcccaggaagaaaccctaggggcgggctttgccctggataccccgagacggaccacggattgttcgaagatccccacgtgccttttcacgtacggtgcgagagacgagatagtaaagtcgaagtcatcgaactgcaggacgtggaatgtgaagagagacctaggggctcctcgtcaaactag

SEQ ID NO: 25508 - DNA, 4146 bp, Artificial Sequence
  Description of Artificial Sequence: Synthetic coding sequence
atgggcaaggccaccggccggaaggcccccctgtggctgcgggccaaattccagagactgttgttcaaactcggctgttacattcaaaaaaattgtgggaaatttctcgtggtggggttgctcattttcggcgcctttgctgtgggcctcaaagcagcaaatctagagacaaatgtggaagagctgtgggtagaggtcggcggccgagtcagtcgcgagctgaattatacaaggcaaaaaatcggtgaggaggctatgtttaacccacaattgatgattcagacacctaaggaggaaggagctaatgtgctgacaactgaggccctattgcagcatctggactctgctctccaggcgagcagagtgcatgtctatatgtacaatcgccagtggaagcttgaacacctctgttataagagcggtgagctaatcacggagaccgggtacatggatcagattatcgagtatttatacccatgtctcatcataactcccttagattgcttctgggaaggggcgaaactccagtccggcaccgcttatctgctaggcaaaccacctttgcggtggactaattttgacccccttgagttcctcgaggagctgaagaaaattaattatcaggttgactcttgggaagagatgctgaataaggcggaagttgggcatggatacatggacagaccttgtctgaatccggctgaccccgattgcccggccacggcccccaataagaattctactaagcccctcgatatggctttagtgctcaacgggggctgtcatgggctaagccgaaaatacatgcattggcaggaagagctgattgtgggaggcaccgtgaaaaattcaacaggcaagctcgtgtcagcccatgctctgcagactatgtttcagctgatgacacccaaacaaatgtacgaacacttcaaaggttatgagtacgtgtcccacatcaactggaacgaagataaagctgctgccatactcgaagcatggcaacgcacttatgtagaggtggtacatcagagcgtcgcccagaactccactcagaaggtgctatcgtttaccaccacaactcttgatgacatcctgaaatcattctccgacgtcagtgtgatccgggtcgcgtccggatacttgcttatgctcgcgtatgcatgtctaactatgctgagatgggattgttctaagagtcaaggcgctgtcggcttagcgggagtcctcctagtcgctcttagtgttgccgcaggcttagggctgtgctcactgatcgggatttcttttaatgctgcaaccactcaggttctccctttcttagccctaggcgttggcgtcgacgacgtgtttctgctggcccatgccttctctgaaactggacagaacaagcgaatcccattcgaagaccggactggcgaatgtctgaaaagaaccggcgcgtctgtggcactcaccagtatatctaatgtcaccgcatttttcatggccgcattgatcccaatccctgcgctgagagccttctctctgcaggcagccgtggtggttgtctttaacttcgcaatggtcctcttgattttccctgccatcctgtccatggacctatatcggcgcgaggatcggagacttgacatcttttgttgtttcacatcgccttgtgtcagtcgggtaatccaggtggagccccaggcctatacagatacccatgacaacacccgctatagtccccctcctccatactcttcccacagcttcgcccacgaaacccagatcaccatgcagagcacggtgcagcttcgcactgaatacgacccccatacacacgtttattataccaccgcggagcctcggagtgagatttccgtgcagcctgtgaccgtgactcaggataccctttcatgccaatcccctgagtctacctcttcaaccagggaccttctgtcccagttctcagacagcagcctccactgtctggagcccccatgcactaagtggacgctctccagctttgccgagaaacactacgcgcctttcctcctgaaacccaaggccaaggtggtagtgattttcctcttcctgggactgttgggggttagcctgtacggcacaacacgggtccgagacggcctggatctcacagatatcgtgcccagggaaacccgcgagtatgacttcattgctgctcagttcaaatatttcagtttctacaacatgtatattgtcacccagaaggccgactatcctaatatccagcaccttctgtacgacctccaccgctcattctcaaacgttaaatacgtgatgctcgaggagaataagcagttgcctaaaatgtggctgcactactttcgggattggcttcaggggttacaggatgctttcgactctgactgggaaaccgggaagattatgccaaacaactataaaaatggctccgacgatggcgtcctcgcttataagctccttgtccaaacagggtcccgagataaacctatcgacatttctcagttgaccaaacaaaggttagtcgatgccgacggcattattaatccctcagccttttacatctacctgacagcatgggtgtcaaacgacccagtggcttacgctgccagccaagcgaatattagacctcacaggcccgagtgggtccacgacaaagctgattacatgcccgagacacgcctgcgaattcccgccgctgagcctatcgaatatgcccagttccccttctacctgaatggcctccgggatactagtgattttgtggaggcaatcgagaaagtgcgtacaatatgttccaactatacctctctggggctatcttcctacccaaacggttaccctttccttttttgggaacagtacatcggactccgccactggttgctccttttcatctctgtggtcctcgcttgcacattcctagtgtgcgccgtgtttcttctcaacccctggaccgctggcataattgtgatggttctggcgttgatgaccgtggagttgttcggaatgatggggctgattgggatcaagctcagcgctgtaccggttgtgatccttattgcctcagtgggtatcggcgttgaatttaccgtgcacgtggctttagcctttttgacagccataggcgacaagaatcgtagggccgtcctcgcactcgagcatatgttcgcacctgtgttggatggcgccgtctccactctgctcggggttctcatgctcgctggtagcgagtttgatttcatcgtgcgctatttctttgctgtcctcgcaatcctgaccatcctgggcgttctgaatggtttggtactcttgcctgtgctgcttagcttttttgggccttaccctgaggtaagccctgccaatggactaaaccgcttgcccacgccatctcctgagccccctccttcggtggtgagattcgccatgccccccgggcatactcattcaggaagcgacagttccgacagcgagtacagttcccagacgaccgtgtcggggttgtccgaggaactcaggcactatgaggcccaacagggtgccggcggtccagcccaccaagtgatcgtagaagcaaccgagaaccccgtgttcgcgcacagcacagttgtccacccagaatctcgccaccatcctccttctaaccctcggcagcagccacacctggactctgggtcccttcctcccggccgacagggacaacagccgagaagggaccccccccgcgagggattgtggccacccccttacagaccgcggcgggatgcctttgagatctctacagaagggcactctggtccttcgaatagagccaggtggggcccgcggggggcccgaagtcacaaccctagaaaccctgccagcaccgccatggggtcatccgtgcccggctactgccaaccaataacaacagtgaccgcgtctgccagcgttaccgtggctgtccatccaccaccagtgcctgggcccggtcggaatccacgaggcgggctgtgccccggatatcccgaaaccgaccacggactcttcgaggatcctcatgttccattccacgtgcgctgtgaacgcagagatagcaaagtagaagtgatcgagctgcaggacgtggagtgcgaagagcggccgcgaggtagtagctccaattag

SEQ ID NO: 25509 - DNA, 255 bp, Artificial Sequence
  Description of Artificial Sequence: Synthetic coding sequence
atgggcaaggccaccggccggaaggcccccctgtggctgcgggccaaatttcagcggttgctttttaaactcgggtgttacatccagaagaattgcggtaagttcttggtggttgggctgcttattttcggagcctttgcagtaggccttaaagccgcaaacctcgagaccaatgtggaggagctctgggtggaggaggtgaatctactttgcggaggacagaccagcactctctggaacagctggaagtcttag

SEQ ID NO: 25510 - DNA, 525 bp, Artificial Sequence
  Description of Artificial Sequence: Synthetic coding sequence
atgttcaacccccagctgatgatccagacccccaaggaggagggcgccaatgtacttacgacggaggccttactgcagcatctggactcagccttgcaggcctcacgtgtacacgtctacatgtacaacagacagtggaaactagagcacctatgctacaaatcaggggaactgatcacagagaccggctacatggatcagatcatagaatatctctacccgtgcctgataatcacaccactggactgcttctgggagggagccaagttacaaagtgggactgcttacctcctggggaaacctcctcttaggtggacaaattttgatccactggaatttttggaagagctgaaaaaaattaactatcaggtcgacagttgggaggaaatgctgaacaaggcggaagtgggtcatgggtacatggatcggccatgtctcaaccccgcggacccggattgtccggccactgctcccaacaagaattccaccaagcctctcgacatggcgctcgtgttgaatggctag

SEQ ID NO: 25511 - DNA, 525 bp, Artificial Sequence
  Description of Artificial Sequence: Synthetic coding sequence
atgttcaacccccagctgatgatccagacccccaaggaggagggcgcgaacgtgctgacaaccgaggccctccttcagcacctcgattcagctctccaggctagcagagttcacgtgtacatgtataatcgccagtggaagttagagcacctctgctataaaagtggtgaactgattacagaaacagggtatatggaccaaattatcgagtatctctatccctgtcttatcattacccccttggactgtttttgggaaggggcaaaactgcagtctggcaccgcctatctcctcggcaagcctcctctccggtggacgaacttcgatcccttggagtttctggaagaactgaagaaaataaactaccaggttgatagctgggaagagatgttgaataaggctgaagtgggccacggttatatggaccgaccatgtcttaacccagcagaccctgactgtccagctacggcccccaataaaaatagtaccaagcccctggacatggctttggtcttgaacggttag

SEQ ID NO: 25512 - DNA, 279 bp, Artificial Sequence
  Description of Artificial Sequence: Synthetic coding sequence
atgttcaacccccagctgatgatccagacccccaaggaggagggcgccaatgttctgaccaccgaggcacttctgcagcacctggatagtgctctgcaggcaagtagagtacatgtatacatgtacaacaggcaatggaagttggaacacttgtgttacaagagtggcgagctgataaccgagactggctacatggaccagatcattgaatatctgtacccttgtcttatcatcaccccacttgattgcttttgggaaggcgcaaaactgcaatcctag

SEQ ID NO: 25513 - DNA, 525 bp, Artificial Sequence
  Description of Artificial Sequence: Synthetic coding sequence
atgttcaacccccagctgatgatccagacccccaaggaggagggcgcgaacgtgttaacaaccgaggcacttcttcagcatctggactccgcgctccaagcaagccgagttcacgtgtacatgtacaatagacagtggaaactggagcacctgtgttacaagtctggggagctgatcaccgagacaggatacatggaccagatcattgagtatttgtacccctgcctaataataacacctctcgactgtttttgggagggagcaaaactacaatccgggacagcttacctcctgggcaaacctcctctgcgatggaccaattttgaccccttggagttccttgaggaactgaagaaaattaattatcaggtagacagctgggaggaaatgcttaacaaggccgaagtcggtcacgggtacatggatagaccttgcctgaatcccgcagacccagactgccccgcaaccgccccgaacaagaactcaactaagccactggacatggccttggtccttaacgggtag

SEQ ID NO: 25514 - DNA, 525 bp, Artificial Sequence
  Description of Artificial Sequence: Synthetic coding sequence
atgttcaacccccagctgatgatccagacccccaaggaggagggcgccaacgtcctgactacagaagccctgctccagcatcttgattccgctttgcaagccagcagggtgcacgtgtacatgtacaataggcaatggaagctggaacacctgtgctataagtcgggcgaacttatcacggagactggctacatggatcagatcattgagtacctgtatccgtgcctgattatcactcctcttgattgcttttgggagggggctaaattacagagcgggaccgcttatttgttgggtaagcctccactgcggtggaccaatttcgatcccctggagtttctggaagagctaaagaagatcaattaccaagtggacagctgggaggaaatgctgaacaaggccgaagtgggtcacgggtacatggacagaccgtgtcttaaccctgccgacccagattgccccgcaacagccccaaataaaaactccaccaagccccttgacatggccttggtgctgaacgggtag

SEQ ID NO: 25515 - DNA, 954 bp, Artificial Sequence
  Description of Artificial Sequence: Synthetic coding sequence
atgccccgggaggaccgggccacctggaagagcaactacttcctgaagatcatccagttactggacgattacccgaagtgcttcattgtgggcgccgataacgttggaagcaagcagatgcagcagatccgaatgagccttcggggcaaggccgtagttctgatgggaaagaacacaatgatgcggaaagctatccgcggacatctagagaacaatcccgcgctggaaaagttgttaccacacattcgtggtaacgtgggctttgtcttcaccaaagaagacctgaccgagattagggatatgctcctggctaacaaggtcccagctgcagcacgcgcaggggcaatcgctccctgcgaggttaccgtgccagctcagaatacaggcctcggccctgagaagacgtcttttttccaggccctgggcatcactactaaaatctcgcgaggaacgatagagatcctgtcagatgtccagttaatcaagacgggagataaagtcggggcaagtgaggcgacgctactaaacatgcttaatattagcccttttagcttcggactggtaatccagcaggtttttgacaacggcagcatatacaacccagaagtactcgacatcacagaggagaccctccattcacgttttctcgagggcgtgagaaatgtagcctccgtgtgtttacaaataggttatcctacggtcgcgagtgtaccccatagcatcattaacgggtacaagagagttctggctctgtcagttgaaacagactacactttcccgctcgctgagaaagtgaaggcttttctcgcggatcccagtgcttttgtggccgccgccccagtggccgctgccaccactgccgctcccgccgctgcagctgcccctgcaaaggtcgaagcaaaggaagagtcagaggagagtgatgaggatatgggattcggtctctttgactag

SEQ ID NO: 25516 - DNA, 1818 bp, Artificial Sequence
  Description of Artificial Sequence: Synthetic coding sequence
atggacgacctggacgccctgctggccgacctggagagcaccacctctcatataagtaaacgtcccgtgtttctaagcgaagaaacaccgtattcctatcccactgggaaccatacataccaggaaattgccgtcccaccacccgtgcccccgccaccttcaagcgaagctttaaatggcaccatcctggatcccctggaccagtggcaaccgtcctcgagccggtttattcatcagcaaccgcaaagttccagcccagtgtacggctccagcgccaagacttcctctgtgtcaaacccccaggacagcgtgggttcaccttgcagccgggtaggtgaagaggagcacgtgtactccttccctaacaaacagaagtccgctgagccatctcccacagttatgagtactagcctaggttccaacctgagtgaactggacagactcttgctggaactgaacgctgtccagcataacccccctggattccccgcagacgaggctaacagctcccctccattacccggagccctgagtccactgtacggcgtgccggagaccaacagccctctgggcggaaaggcgggaccactcaccaaggagaagccgaagcgcaacggtggccgcggcctggaggacgtgaggccatccgtggaaagtctgctggacgaactcgagtcctccgtgccctctccggtgccagctattaccgtgaatcagggagagatgtccagcccccagagggtaactagcacccaacagcaaacacgcatcagcgccagttctgcaacacgtgagttggatgaactcatggcctctttgtccgacttcaaaggttcttggccgctggaggaagtggtactcctcgtttcaattagcagcagtgtgcaggagggcgagaaatacccacacccgtgtgctgctcgtcaccgtaccccaagcctcagatctcccgatcagcctcctccttgcccacagttcatggcgcagggtaagaccggcagctcttctcctccgggagggcccccaaagccaggttcccaactggatagtatgctgggcagccttcaaagcgatctcaataaactcggcgtggccaccgtcgcaaagggcgtctgtggcgcatgcaaaaaacccatcgccggacaggtggtcacggccatgggaaaaacctggcatcccgaacacttcgtatgcactcactgccaggaagaaatcggctctaggaattttttcgaaagggacggtcagccctactgcgaaaaagactaccataatctgttttcaccccggtgctactactgtaatggtcctattctagataaggttgtgaccgctttagaccgcacctggcaccctgaacactttttctgcgcgcagtgcggcgcttttttcggaccagagggctttcacgagaaggacggcaaagcctattgccggaaggattacttcgacatgttcgcccctaagtgtgggggatgtgcacgcgcaatcttggagaattacatttcagcccttaataccctgtggcatcctgagtgtttcgtttgcagagagtgctttaccccctttgtgaatggttctttcttcgagcatgacggtcagccttattgcgaggtgcattaccacgaacggcgcggatcactctgttccggctgtcagaagccgattaccggtagatgcatcacggcgatggccaaaaaattccatccagagcacttcgtctgtgcattttgtcttaagcagctgaataagggcacttttaaagagcagaacgataaaccatactgccagaattgcttcctgaagttgttctgctag

SEQ ID NO: 25517 - DNA, 702 bp, Artificial Sequence
  Description of Artificial Sequence: Synthetic coding sequence
atgggcaagacctggcaccccgagcacttcgtgtgcacccactgccaagaggaaatcgggagcagaaacttcttcgagagggatggccagccctactgtgagaaggattaccataatttgttctcccctcgatgctattattgcaacggacccatcctcgataaggttgtcactgctctggaccgcacatggcatccggagcattttttctgtgcccaatgtggagccttctttgggcctgaaggcttccatgaaaaagatgggaaggcctattgtagaaaagattattttgacatgtttgcccctaagtgcgggggctgcgcccgggctatccttgagaactacatttccgcccttaataccctgtggcatccagaatgttttgtgtgtcgagagtgttttacacctttcgtcaacggatccttcttcgagcatgacgggcagccgtactgcgaagtccattatcatgaacggaggggctctctgtgttccggttgtcagaagcccatcaccggaagatgtattactgctatggccaaaaaattccaccctgacccgtgtacgagcccacgaaccgggctggcttccactccacactggtctcacttatttctcatattccaacaatgctctcgcggggccggaaagggacgacagggcctgctcggcagcctttttatcctaataccccccccaacatag

SEQ ID NO: 25518 - DNA, 1212 bp, Artificial Sequence
  Description of Artificial Sequence: Synthetic coding sequence
atgagcgcccccagcagcaccggcccccagtactgccccggcctgccctctcgcaaagaggcaacccccgaaggtcgaccagaaacttgtctgctgccaagttccccccaggctcagcgacccatacagggcctggaacagcgagcagatggtgaaaggtgctgggccgctggctggcctagagatggcggcaggtcctcaccaggtggccaggacgaaggcggcgggagctggccattggaagaagtggtgctgctcgtgtctatctcaagttcggtacaggagggggagaagtatccgcatccatgtgccgcccggcacaggactccaagtctcagatctccggatcaaccccctccgtgtcctcaattcatggcgcagggtaagaccggatcttctagccctccaggcggccctcctaaaccaggaagccaactcgacagcatgttaggttccctgcagagtgacttgaataaactgggagtggcaactgttgccaagggggtctgcggggcttgcaagaaacccatagcggggcaagttgtgacggctatgggcaaaacgtggcaccctgagcatttcgtctgtacgcactgtcaagaggagatcgggtctaggaacttttttgaacgcgatggacagccatactgtgaaaaggattaccataatttatttagtccaaggtgctactattgcaacgggcccattctcgacaaggtggtgactgcgctcgaccggacctggcatcctgaacattttttttgcgcccagtgtggcgcattcttcgggcccgagggtttccatgaaaaggatgggaaggcatattgtagaaaggactacttcgacatgttcgcccctaagtgcggtggctgcgctcgcgccatcttggaaaactacatctccgctctgaatacactatggcaccctgaatgtttcgtgtgtcgagaatgttttaccccctttgttaacggctcattcttcgagcacgacggtcaaccatactgcgaagtccactaccacgagcgccgtgggagcctatgttctggatgtcagaagcctatcacaggaaggtgcatcaccgctatggccaagaaattccaccctgagcactttgtttgtgccttctgtctgaaacagctcaacaaaggcaccttcaaggaacaaaacgataagccgtactgccagaactgtttccttaagctgttttgttag

SEQ ID NO: 25519 - DNA, 1674 bp, Artificial Sequence
  Description of Artificial Sequence: Synthetic coding sequence
atggacgacctggacgccctgctggccgacctggagagcaccacctcgcatatttccaagcggcctgtattcctcagcgaggagaccccttattcctatccaaccggcaaccatacctaccaggagatagctgtgccacctccagtgccccctccaccgagctcagaagccctaaatggcactatccttgatcccctggaccagtggcagcctagcagctcccgattcatacatcagcagccccagagctcaagccctgtttacggctccagtgcgaaaactagcagcgtcagtaaccctcaggatagcgtaggctcgccctgcagccgcgtaggggaggaagagcatgtatactcatttcccaataagcaaaaaagcgctgagccaagcccaacggtgatgtccacgtcactggggtccaacctctctgagttagaccggctgctgctggagctgaacgcagtgcaacataatccacccggattccccgcggacgaggcaaatagtagccctccgcttccaggggctctgagtcccctgtatggtgtcccagagacgaacagcccactcggcgggaaagctggcccattgacaaaagagaagcctaaaaggaatggcggaagggggttggaagacgtgcgtccttcagtggagagcttgctggatgaattagaatcctcagtccccagcccagtgccggctatcactgtgaaccagggggagatgtcttctcctcagagggtgacttcaacccaacagcaaacgcggatttctgcatcaagcgctaccagagaactggatgaattaatggcctcactcagcgattttaaatttatggcgcagggcaagacggggtcaagttctcctcccggtggccccccaaaaccagggtcccaattggattcaatgctggggagtctccagtccgacctcaacaagcttggtgtggctactgtggcgaagggtgtgtgtggcgcatgcaaaaaacctatcgctgggcaggtagtgacggctatgggcaagacatggcatcctgagcattttgtctgcacacattgtcaggaggaaatcggcagtaggaatttcttcgagcgggacggccagccatactgcgaaaaagattaccataatctgtttagcccccgctgttactactgcaatgggccaatcctggacaaagttgtgaccgccctggatcgcacatggcacccagagcacttcttttgcgcgcagtgtggagcattcttcggacccgagggattccatgagaaggacggcaaggcctattgtcgaaaagactatttcgatatgttcgcaccaaaatgcggcggttgcgccagagctatcctggaaaattacattagtgctttgaataccctgtggcatcctgaatgctttgtgtgccgcgagtgtttcacaccattcgtgaatgggtccttcttcgaacacgacggacagccatactgtgaagtacactatcatgagagacgcggatccctctgtagcggttgtcaaaagcccatcaccggtcggtgcatcaccgccatggccaaaaagtttcatcctgaacattttgtctgcgctttttgtttaaaacaactgaacaagggcacctttaaagaacagaacgataagccctattgccagaactgcttcctgaagctattctgttag

SEQ ID NO: 25520 - DNA, 1275 bp, Artificial Sequence
  Description of Artificial Sequence: Synthetic coding sequence
atgagcaccagcctgggcagcaacctgagcgagctggaccggctgctgctggaattaaacgccgtgcagcataacccacctggcttcccggctgacgaagctaacagctctccccctctgcctggcgccctgtcacccctgtacggggttcccgaaacaaatagcccactcggaggaaaggccgggccgttgacgaaggaaaaacccaaaagaaatggaggtaggggacttgaggacgtgcgtccatcagttgaatccttattggacgagctcgaatcgagcgtaccaagccctgtaccagcaatcaccgttaatcagggcgaaatgtcttccccccagcgcgtaacctctacccagcagcagacacgcatctccgcttctagtgctacccgtgagctggacgaactgatggcgtctctgtccgatttcaaatttatggcccaaggtaaaacaggttcctcgagtccccctggcgggcctcccaaaccaggatcacagctggacagtatgctgggaagtctacagtccgacctcaataagctcggtgttgcaaccgtggcaaaaggcgtgtgtggggcatgtaagaaacccatcgccggccaggtagtcacagcaatgggtaagacatggcatcctgagcactttgtctgcacccactgccaggaggagattggtagcaggaatttctttgaacgggacggacaaccctactgcgagaaggactaccataatctgtttagcccccgatgttactactgcaatgggccaatacttgataaagtcgtgacagcactagacaggacatggcacccggaacatttcttttgtgcacaatgcggcgccttttttgggccagagggttttcacgagaaagatgggaaggcctactgtaggaaggattatttcgacatgttcgcgcccaagtgcggtggttgcgcccgcgccatcctggaaaattatatcagtgccctcaatacactgtggcatccagaatgctttgtatgcagagagtgtttcacaccgtttgtcaatgggtcattcttcgagcatgacggccagccatattgcgaggtgcattaccatgaacggagagggtccctgtgttccggctgccagaaacccattaccggaaggtgcattaccgccatggcaaaaaagttccaccctgaacattttgtctgcgccttctgtctgaagcaattaaataaggggacgtttaaagagcagaacgacaaaccctactgccaaaattgtttccttaagctattctgttag

SEQ ID NO: 25521 - DNA, 951 bp, Artificial Sequence
  Description of Artificial Sequence: Synthetic coding sequence
atgagcagcccccagcgggtgaccagcacccagcagcagacccggattagcgcatctagtgcgactcgggaactagacgaactaatggcttccctatctgactttaaattcatggctcaggggaaaacaggctcttccagtcccccgggcggccctcctaaaccaggatctcagctcgatagcatgctcgggagtttacaatcggaccttaacaagctgggggttgctacggttgctaaaggggtttgtggcgcttgcaaaaagcctatagccggccaggtggtgactgctatgggcaagacttggcatcccgagcattttgtgtgtacccactgccaagaagaaataggctccaggaacttctttgagagagatggtcagccctactgtgagaaggactaccacaatctgtttagcccaaggtgttactactgcaatggaccaatcctggacaaagtcgtgaccgccctcgacaggacatggcatcctgaacatttcttctgcgctcaatgtggggccttctttggcccagaaggtttccatgaaaaagacggcaaggcctactgccggaaagactattttgatatgtttgcacctaagtgtggaggttgcgcgagggccatactggaaaactatatatccgcgctgaatacattatggcaccctgagtgctttgtctgcagggagtgcttcacaccattcgtgaacgggtcctttttcgaacatgacggtcagccgtattgcgaggtccactatcatgagaggaggggaagcctctgctccggctgtcaaaaacctattaccgggaggtgcattacagccatggcaaaaaagtttcacccagagcatttcgtgtgtgccttttgcctaaagcagttgaacaaaggtacgtttaaagagcagaacgataaaccctactgtcagaactgcttcctgaagctattttgctag

SEQ ID NO: 25522 - DNA, 993 bp, Artificial Sequence
  Description of Artificial Sequence: Synthetic coding sequence
atgccccacagcgtgaccctgcggggccccagcccctggggcttccgattggtgggaggccgagacttttctgccccactgacaatctccagggtgcacgcagggagtaaagccgccctggccgctctatgcccaggcgatttgatacaggccatcaacggtgagtccacagagctgatgacacacttggaagctcagaaccgaataaaagggtgtcacgatcacttgacacttagtgtttcgcgccccgaaggccgatcctggccctccgctccagatgattcaaaggcccaggcgcacaggattcatatcgacccagagattcaagacggctcccccactacctcaagaaggccaagtggcactgggacggggcccgaagatggccgcccctccctcggaagcccctatggacaacctcctagattccccgtgcctcataacggaagcagtgaagcaacgctacccgcacaaatgagcacgctccatgtgagtccaccaccaagtgctgaccccgccagagggctgccgcggtctagagactgcagagtcgatctgggatcagaggtctaccgaatgctgcgagaacctgccgaacctgtagccgctgaacctaaacaatccggttctttcagatatcttcaggggatgctggaggctggtgagggaggcgattggcccggtcctggaggcccacggaacctcaaacccaccgctagcaaattaggtgcgcccttgagtgggctccagggacttcctgagtgtacacgatgcgggcacggtattgttggcacaattgtgaaggcccgcgataagctctaccaccccgagtgtttcatgtgcagcgactgtggacttaatcttaagcagagaggttatttcttcctcgatgaacgtctttactgtgaatctcacgccaaagctagggtgaagcctccagagggctacgatgtcgtggctgtgtaccccaatgctaaggtggaactggtctag

SEQ ID NO: 25523 - DNA, 741 bp, Artificial Sequence
  Description of Artificial Sequence: Synthetic coding sequence
atgccccacagcgtgaccctgcggggccccagcccctggggcttcaggctcgtcggaggacgcgacttttcagctcctctcactatcagtcgggtgcatgctggatctaaagcagctttagccgcactgtgtcccggagacctcatccaggctataaacggtgaatctacagaactcatgacacatctcgaggcccagaatcggatcaaaggatgccacgatcacttgacactctcagttagccggcccgaaggcaggtcttggccctctgctccagacgatagtaaggcccaggcccacaggattcatatcgatccagagatacaggatggatctcccaccacctcccggagacctagcgggactggaacaggccccgaggacggaagaccttctctaggctctccttatggccagccccctcgatttcccgtcccccacaacgggtcttcggaagccaccctgccagcccagatgagtactctacatgtaagtccccccccttccgctgacccggccagaggccttcctagatcccgagactgcagggtcgatctgggctccgaagtgtatcgcatgttgcgggagcccgccgaaccagttgccgccgaacccaaacagtccgggtctttccggtatcttcagggcatgctcgaagcaggggagggcggcgccccatcatctcgacacggtactagcagcacaatacctagtgccagttgtgccgtcacagccgcctag

SEQ ID NO: 25524 - DNA, 1791 bp, Artificial Sequence
  Description of Artificial Sequence: Synthetic coding sequence
atgagcaactacagcgtgagcctggtgggccccgccccctggggcttccgactacagggtggcaaggacttcaatatgcccttaactatttcttccctgaaggacggtggcaaggccgctcaggctaatgtacgcatcggcgatgtggtgctgtcaatagacggaataaacgcccagggcatgacacatcttgaagcgcagaataagataaaaggatgtacaggttccttgaacatgacacttcagagggcatccgccgctcccaaacccgaaccggtccctgtgcagaagggtgaacctaaagaagtggtcaagccagtccccattacctcaccagctgtgagcaaggtgacatccaccaataacatggcttacaacaaagcacctaggccttttgggagcgtgtcctccccgaaggtaactagcatcccctcccctagcagtgcgtttacccctgcccacgcaaccacgagttctcatgcttccccatctcctgtcgccgcggtaacacctccgctcttcgctgcctctgggctacacgctaacgccaacctatccgcagaccagtctccatctgcactcagcgcaggaaagacggccgtcaacgtgccaaggcagcccaccgtgacttcagtgtgttccgaaacttcacaggaactggcagaaggccagcggcgaggctcgcagggcgacagcaaacagcagaacggaccacccagaaagcatatcgttgagaggtacactgagttctaccatgtgccgacacactccgacgcctcaaagaagaggctgattgaggataccgaagactggcggcctcgtaccggtaccacccagtcacggagctttcggatcttagcccagattacaggaacagagcacctgaaggaaagtgaagcagataatacaaagaaggcaaataacagtcaggaacccagcccccagctggcatcctccgtggcctccaccagaagtatgcccgagtctctggatagccccacatccggcagaccaggcgtcaccagtctgacggccgcagccgccttcaagccagtaggctcaacaggggtcattaaatctccttcttggcagagaccaaatcagggggtcccaagcaccggtaggatctctaactctgccacctactccggttcggtggcgccagccaattccgcactagggcagacgcagccatccgaccaggataccttggttcagcgcgcagaacacatccctgcaggcaaaagaacacccatgtgcgcacattgcaaccaggtaatccgtggtcctttcctcgtggctctgggtaaatcgtggcaccctgaggaattcaactgtgcacactgtaaaaataccatggcctacatcggattcgtcgaagagaaaggcgcattatactgcgagctctgctacgaaaagttctttgcccccgagtgtgggcgatgccagcgaaagattctgggggaggtgattagtgcgctcaagcaaacctggcacgtgtcttgcttcgtgtgtgtggcctgtggaaaaccaatacgtaacaatgtattccatcttgaggacggcgagccttattgcgaaacggattactatgcgctgtttggaaccatctgtcatgggtgcgagtttcccatcgaggcaggtgatatgtttctggaagccctcggttatacttggcacgacacctgcttcgtgtgctccgtctgctgtgaatcactggaaggtcagacttttttctccaaaaaggacaaaccgctgtgcaaaaaacacgcacacagtgtgaatttctag

SEQ ID NO: 25525 - DNA, 645 bp, Artificial Sequence
  Description of Artificial Sequence: Synthetic coding sequence
atgagcaactacagcgtgagcctggtgggccccgccccctggggcttcagattgcaagggggcaaagatttcaacatgcctcttactattagctctttgaaggacgggggtaaggccgctcaggcgaacgttcgcatcggtgatgttgttttgagtattgacggtatcaacgcacaagggatgactcatctcgaggcgcaaaataaaattaagggctgtaccgggagcctgaacatgacccttcagagggcgtccgccgcacctaagcccgaaccggtgccggttcagaagaagacacaggtgacgaataatcccggcactgttaagattcccccaaagcggcccccacgcaagcatattgtggagcgctacaccgagttctatcacgtgcctactcattccgatgctagcaagaaacggcttatagaggataccgaggattggaggcccagaacaggaaccacccagagccggtcatttagaatcctggcccagataacagggaccgagcatctgaaggagtccgaggcggataatactaaaaaggccaaggagaagattcccctgcacgtgttttcgcctaagtatacaaagctacgtgattggcaccatgaagttagtgcacgtgccctgaacgtgcagtag

SEQ ID NO: 25526 - DNA, 705 bp, Artificial Sequence
  Description of Artificial Sequence: Synthetic coding sequence
atgagcaactacagcgtgagcctggtgggccccgccccctggggctttagattgcaaggaggcaaggactttaacatgccacttactatctcatctctgaaagatggtgggaaggctgcgcaggccaatgttagaatcggagatgtggtgttgtctatagatggcataaatgcacagggtatgacccacctggaagcccagaataagatcaagggatgcacgggtagcctgaatatgacactacaaagggcaagcgccgcccccaaacctgagccggtcccagtacagaagcctacggtgacatctgtctgttcggaaacctcccaggagttggccgaaggacagcgccgcgggtcccagggggattccaaacaacaaaacggtaagatcccccctaaaaggcctcccagaaagcacattgtggaacggtataccgaattttatcatgtgccgacccacagtgatgcttccaaaaaacgcctgatcgaggacactgaggattggcgacccaggaccggtactacccaatctcgtagctttcgcattctagcgcagatcactgggaccgagcacctgaaggagtccgaggctgacaataccaaaaaagctaaggagaagatcccgctgcacgtgttcagcccaaagtacaccaaattgcgggactggcaccatgaggtgtcagcccgggctctcaatgtccagtag

SEQ ID NO: 25527 - DNA, 1464 bp, Artificial Sequence
  Description of Artificial Sequence: Synthetic coding sequence
atgagcaactacagcgtgagcctggtgggccccgccccctggggcttccggctgcagggcggcaaggattttaacatgcccttgacaattagtagcttgaaagacgggggtaaggcggcgcaggcaaacgtgcgaatcggagacgtggtcctgtctatagatgggatcaacgcccagggaatgacgcatctagaggcacagaacaagatcaagggttgcactggaagtctgaatatgactctgcagcgagctagcgcagctcccaagccagaaccagttcctgttcagaaacctacagttacatccgtgtgttctgagacatcgcaggagttagctgaaggccagagacgcggatcacagggagacagcaagcagcagaatggcccaccgcggaagcacattgtcgagcggtatacggaattctatcatgtccccacgcacagtgacgcttcaaagaaaaggttgattgaggacacggaggactggcggcctaggaccggaactacccagtctcgatcttttagaatcttggctcaaattacaggaaccgagcacctgaaagagtctgaggctgataatacaaagaaagctaataacagtcaagaaccatcgccacagctggcaagcagcgtcgcttcaacccgatccatgcccgagtccctggactcgccaacttccggccgacctggggtcaccagcctgaccgccgcagctgccttcaagcctgtcggctcgactggtgtgattaaatctccctcttggcagcgacccaaccaaggcgtgcctagcacgggccggatatcgaacagcgccacgtattctggcagtgtcgctcccgctaatagtgctctggggcagacacagccatccgaccaggacacgctggttcaaagagcggagcatatcccggctggcaagagaacacccatgtgcgcccactgtaaccaggtaatcagaggtccctttctcgtcgcactgggcaagagttggcatccagaagagttcaattgcgctcactgtaaaaatactatggcttatattgggtttgtggaagaaaagggggccctgtattgcgaactgtgctacgagaagttcttcgcgccagaatgcggccggtgccaaagaaagatactcggcgaggtcatttcagcccttaaacaaacctggcatgtgtcctgcttcgtgtgcgtcgcctgtgggaaaccaatccggaacaatgtttttcatctggaggatggagagccctactgtgagaccgactattacgctttgttcggcacgatctgccacgggtgtgaatttccaatcgaggctggagatatgtttctcgaggcgctgggatacacatggcacgatacatgtttcgtgtgctccgtctgttgtgaaagcctggagggccagacattcttcagtaaaaaggacaagccactgtgcaaaaaacatgcccactccgtaaacttttag

SEQ ID NO: 25528 - DNA, 705 bp, Artificial Sequence
  Description of Artificial Sequence: Synthetic coding sequence
atgagcaactacagcgtgagcctggtgggccccgccccctggggcttccggcttcagggcggaaaggatttcaacatgcccttgaccatcagtagtctaaaggacggtgggaaggccgcccaagccaatgtgcggattggtgatgtggtgctttccattgatgggatcaacgctcagggaatgacacacctagaggcccagaacaaaattaagggatgtacgggaagtctcaacatgacactgcagcgggccagtgctgctccaaagcctgagccggtccctgtgcagaagcctaccgtgacaagcgtgtgctccgagacgagccaggagctggccgagggacagaggcgtggaagccagggggatagcaaacaacagaatggtcctgtgcccaggaagatccctccgaggaagcacattgtggagaggtacacagagttctatcatgtgcccactcacagtgatgctagcaagaagcggttaatagaggatacagaggattggaggccccgcacaggaaccactcaaagccgttcttttcggatcctagcacagattaccggtactgagcatctgaaggagtctgaggcggacaatactaagaaggctaaggagaaaatccccctccatgtcttctccccgaaatacacaaaactgcgggactggcaccatgaggtttcagcccgagcactaaatgtgcagtag

SEQ ID NO: 25529 - DNA, 645 bp, Artificial Sequence
  Description of Artificial Sequence: Synthetic coding sequence
atgagcaactacagcgtgagcctggtgggccccgccccctggggctttagactgcagggcggaaaggattttaacatgcccctcacaatctcttctctcaaggacggtggaaaggcagcccaggccaacgtgcgcatcggtgacgttgtgctttcaattgacggcatcaacgcccagggcatgacacatctcgaagctcaaaacaagatcaaaggatgcacagggtccctgaatatgaccttgcaaagagcttccgccgccccaaaacccgagcctgtgcccgtgcagaaggtcactcaaaaacgcgagtcacgaagctctaggcgcactgcacccggcctgccgcccaggaaacacattgtggaaagatacaccgaattctaccatgtgccaacacactctgacgcatccaaaaagagactgatcgaggacactgaagattggagaccccggaccggaaccacccagagccggtctttccggattctggcgcagatcactggcactgaacatctcaaggagtctgaggccgataatactaaaaaggcaaaggagaagattcctctgcacgtattttctcctaaatacacgaagttacgggattggcatcatgaagtgtccgctcgggctctcaacgtgcagtag

SEQ ID NO: 25530 - DNA, 1425 bp, Artificial Sequence
  Description of Artificial Sequence: Synthetic coding sequence
atggcctacaacaaggccccccggcccttcggcagcgtgagcagcccgaaagtgaccagtattccctcaccctcaagtgctttcactcccgctcatgcaactacctcatctcacgccagtccctctccagtagcagctgtcactccacctttgttcgcggcctccggtctccacgccaacgccaacctatctgccgaccagtctccgtcagcattgagtgctgggaaaacagccgtcaatgtgcccagacaacccactgtaacatccgtctgctccgagaccagccaggagttagcagagggtcaacggcgcggctcccagggggattccaaacagcagaatggaccccctcgcaagcacatcgtggagcgctatactgaattctatcacgttcctacacactcagatgccagcaagaagcgccttatcgaagacaccgaggattggagacctaggacggggaccacacagagtcggtctttccggattctggcacaaatcacaggtaccgagcatcttaaagagtctgaggccgacaataccaaaaaggcaaacaatagccaggagccctccccccagctggcctccagcgtggcctccacccgttccatgcccgaatccctggactctcccacctcgggcagaccaggcgtgacaagcctgacagcagcagcggcatttaaaccagttggttccacaggcgtgataaagtctcccagctggcagcgccctaaccagggcgtcccaagcaccggtcgaataagtaattccgccacttattcgggtagcgttgcccccgccaactctgcactcgggcaaactcagccctctgatcaggacacgctcgtacagcgtgctgaacacattccagccggcaaaaggactcctatgtgcgcccactgtaaccaggtcattaggggaccctttctggtggccctaggcaagtcatggcaccccgaagaattcaattgtgcccattgcaagaatactatggcatatatcggcttcgtggaggagaaaggagccttgtactgcgagctgtgctatgagaaattttttgcgcccgagtgtggcaggtgtcagagaaagatcctcggcgaggtaattagcgcgctcaaacagacttggcatgtatcctgtttcgtgtgtgtcgcctgtggcaagcccattaggaacaatgtgtttcatctggaagacggtgagccttactgtgagactgactactacgctctctttggcacaatttgtcatggatgtgagttccctattgaggccggggatatgtttttggaggccctgggatacacatggcacgatacctgcttcgtctgttccgtgtgctgtgagagtctggagggtcagacttttttcagcaagaaagacaagccactatgcaagaaacacgcgcattctgttaacttttag

SEQ ID NO: 25531 - DNA, 411 bp, Artificial Sequence
  Description of Artificial Sequence: Synthetic coding sequence
atgagcaactacagcgtgagcctggtgggccccgccccctggggcttcagactgcagggggggaaggatttcaacatgccacttacaatatcctctgccggggtccagtggcgtaatttaggcagtccacaacctccgagtcccgagttcaagagattctcatgcttgtctcttccttcctcctgggattaccgccacgtgcctccgaggctggctaacttcgttttcctggttgagaccaagttcccctacgtaggtcaagccggcttagaactgcccacctctggcgacctgcctacttccgccagtcaatcggcgaagatcacaggagtgtctcaccgcgcatggccgacgctcttctatacactgcttttcttcgccactatttaccctgaaatcattctctactag

SEQ ID NO: 25532 - DNA, 669 bp, Artificial Sequence
  Description of Artificial Sequence: Synthetic coding sequence
atggacagcttcaaggtggtgctggagggccccgccccctggggctttcgactccaggggggcaaggacttcaatgttcccctgtcaatcagtcgactcacgccagggggcaaggcagcccaggccggagtggctgtcggcgactgggtgttatcaattgacggagagaatgcagggtcacttacgcacatcgaggctcagaacaaaattagagcctgcggcgaacgtttgtcactgggtcttagccgggcccaacctgtgcagtctaaacctcaaaaagcttcagctccggccgctgaccctcccaggtatacttttgccccatctgtatctcttaataaaaccgcgcgaccattcggggccccaccgcctgccgactctgctccacagcagaacggccagccacttcgccctctcgtgcctgatgccagcaaacagcgtctaatggagaataccgaagattggcgccctaggcccggaacaggacaaagtaggagtttccgtattctcgcccatctaaccgggacagagtttatgcaagatcccgacgaggagcacttaaagaaaagccgtgaaaagtacgtgctggaactccagagtccgaggtacacacggctgagagactggcatcaccagcgctcagctcacgtcctcaacgtccagagttag

SEQ ID NO: 25533 - DNA, 1374 bp, Artificial Sequence
  Description of Artificial Sequence: Synthetic coding sequence
atggacagcttcaaggtggtgctggagggccccgccccctggggctttcgtctgcaaggagggaaggactttaacgtgcccctgtcaattagccgcctgactcccggcggaaaagccgcacaggctggtgtggccgtgggtgattgggtgctcagtattgatggagagaacgctggcagcttaacccatatcgaggcacaaaataaaattcgcgcctgcggggagagactttcactgggactttcgagggcccaacctgtgcagtctaaacctcagaaagcttcggcacctgcggcagacccgccccggtatacctttgcccccagcgtctctctgaataaaactgcccgaccgttcggggcccctccacccgcagattccgccccccagcagaacggccagcccctgagacccctcgttcccgatgccagtaaacaacgcctgatggaaaatacagaagactggagaccacggcccggaaccggacagagcaggtctttcagaattctggcacatcttacaggtactgagtttatgcaggaccctgacgaagagcacctgaagaagtcgtcccaggtcccccgaaccgaggcccccgcccccgcttcatccacaccccaggagccctggcctgggcctaccgcaccctcccccacctcccgccctccatgggccgtcgaccctgcgttcgccgaacgctatgctccggacaagacgagcactgttctgactaggcattctcagcccgctacacctaccccgcttcagtcccggacaagcatcgtgcaagcggcagccggcggtgttcccggcggaggcagcaacaatggcaagaccccagtatgccaccaatgtcataaggtgattcggggacgttatcttgtggctctcggccacgcataccatccagaagagtttgtctgtagtcaatgcggaaaagtgctggaagagggaggctttttcgaagagaaaggggcaattttttgtcctccatgctatgatgtgagatacgcccctagttgcgccaaatgcaaaaaaaagatcacgggagaaattatgcacgcacttaagatgacctggcacgtgcactgttttacttgtgccgcatgcaagaccccaattcgtaatcgagctttctatatggaggaaggcgtgccctattgtgagcgggactatgagaagatgttcggaaccaagtgccacggttgtgatttcaaaattgatgctggggacagattcttggaagccctaggcttctcctggcatgacacatgttttgtatgcgcaatttgtcagatcaacctggaaggcaagactttctactcaaagaaggataggcccctatgtaagtctcacgccttctcccatgtttag

SEQ ID NO: 25534 - DNA, 864 bp, Artificial Sequence
  Description of Artificial Sequence: Synthetic coding sequence
atggacagcttcaaggtggtgctggagggccccgccccctggggctttagactgcaagggggtaaagatttcaatgtcccgctctctatatctcgccttacacccggtggtaaggcggcgcaagccggcgttgctgttggcgactgggtactctccatcgacggagagaacgcagggtctctgacacacattgaagcccagaacaagatcagagcctgcggagaaaggctgtccttgggcctgtctcgagcccaacccgtccagtcaaagccccaaaaagctagcgctccggcagccgacccacctagatatacctttgccccgtctgtgagcctcaataagacagcaagacctttcggcgccccacccccagcagattcggcgccccaacagaacggacagcctctgaggccactggttcccgatgcatccaagcagcggctgatggagaatacagaggactggcgccctcgccccggcacggggcagtcacggtccttcagaattttagcacacttgacgggcacagaattcatgcaggatcccgacgaggaacacctgaaaaaaagcaggccttaccgtccacagccataccagcccccagccctgggatgtggaccatgtgtttgtagggccctgtgtcccgggcaaaatgagcattccgccgaccccgcccaaccagccggacatgcccacgctgccgcagagccacacctgcactgcgctgggagttgcagaagaggagcccgccgggggcaacagcagaggcaggattcccgggtgtcccccgttccacaagggcacccaggaccgctgccaggtggcgccggccccagggtgccccctgggggggtgtgcgtgtag

SEQ ID NO: 25535 - DNA, 1272 bp, Artificial Sequence
  Description of Artificial Sequence: Synthetic coding sequence
atggacagcttcaaggtggtgctggagggccccgccccctggggcttcaggctgcagggaggcaaagactttaatgtacctctcagtattagcaggcttaccccagggggcaaggcagcacaggctggcgtggccgtgggggactgggtactgtcgattgatggagaaaacgcaggctccctgactcatattgaggctcaaaataagattcgggcttgtggtgaacggctatcacttggcctgagcagagcgcagccggtgcagagcaaacctcagaaggtccagacgccagacaaacaaccattgcgaccgctagtgcccgatgcgtcaaagcagcgtcttatggagaacacagaggactggagaccgcgacccgggactggccagtcacggtccttccgcattctggctcatctgaccgggactgagttcatgcaggatcccgatgaggagcacctcaaaaaatctagccaggtaccccgtacagaggcccctgccccagcaagtagtaccccgcaagaaccctggcccggccctacggccccatctcctacatccagacctccttgggcagtggatccagcctttgctgagcggtatgcccccgacaagacctctacagttcttacacggcacagccagccagccactcccacgcctctgcagagtcgcacaagtatcgtgcaggcagcagccggcggagtgcccggcggaggctctaacaatggaaagacgccggtttgtcaccagtgtcataaggtgattagagggcgctacctcgtcgcgctgggccatgcttatcacccagaagaattcgtgtgtagccaatgcggaaaagtgttggaagagggcggctttttcgaggagaaaggcgcaatcttctgccccccttgctatgacgtccgctacgcaccctcatgtgctaagtgcaagaagaagattaccggagaaatcatgcacgcattgaagatgacatggcacgtgcactgcttcacttgtgctgcatgtaaaaccccgattcggaacagagccttctacatggaagagggagtcccatattgcgaaagggactacgaaaaaatgttcgggaccaagtgtcatggatgcgattttaagattgacgctggagatcgcttcttggaggctcttggcttttcctggcacgacacttgctttgtttgcgcaatctgccaaatcaatcttgaaggtaagaccttctacagtaaaaaggacaggcctttgtgtaaaagccacgccttttctcacgtctag

SEQ ID NO: 25536 - DNA, 522 bp, Artificial Sequence
  Description of Artificial Sequence: Synthetic coding sequence
atggacagcttcaaggtggtgctggagggccccgccccctggggctttcgcctccaggggggcaaagatttcaatgtgcccttgtcgataagtagactcactcccggtgggaaggcggcgcaggccggggtggccgtaggggactgggtcctgagcattgacggtgagaacgcgggatccctcacccacattgaagcgcagaacaagataagggcctgcggcgagagactctccttgggcttgagtagggcacagcccgtgcaatccaagccgcagaaggcatctgctccagccgcggacccccctagatacaccttcgcaccttctgtgtccctgaacaagactgcaaggccttttggcgccccacctcccgctgactccgctccccagcaaaacggccagcccctgcggccccttgtccccgatgcatcgaagcagaggctgatggagaatacagaagactggcgtcccagacctggaacgggacaatccagatctttccggattctggctcacctctag

SEQ ID NO: 25537 - DNA, 273 bp, Artificial Sequence
  Description of Artificial Sequence: Synthetic coding sequence
atggacagcttcaaggtggtgctggagggccccgccccctggggctttcgattgcaaggagggaaggattttaatgtgcctcttagcattagccgcctcacgcctgggggaaaagccgcccaggctggtgtggccgtgggcgactgggtcctgtcaattgacggagagaacgcagggagcttgacgcacattgaagctcagaacaagattcgggcctgcggcgagcggttaagcctcgggctctctagggcccagcccgttcaaagcaagtag

SEQ ID NO: 25538 - DNA, 492 bp, Artificial Sequence
  Description of Artificial Sequence: Synthetic coding sequence
atggccgacgaggagaagctgccccccggctgggagaagcggatgagtcgctcctcaggcagggtatactattttaaccacatcaccaatgcctcacagtgggagcggccaagcggcaattcgtcctctggtggaaaaaatggccaaggggaaccagcacgggtaagatgcagtcaccttctggtgaaacactctcagagccgaaggccctcctcatggaggcaagaaaaaatcactcgaaccaaagaagaggccttagagctgattaatggatatatccagaaaatcaaaagcggggaggaggatttcgaaagtttagcaagccagttctctgactgctccagtgctaaggctcgcggtgatctaggcgccttttctcgcggtcagatgcaaaagccgtttgaggatgcctcttttgccctgcgaacaggtgaaatgagtgggccggtgttcaccgattccggcattcatataattttgcgcaccgagtag

SEQ ID NO: 25539 - DNA, 138 bp, Artificial Sequence
  Description of Artificial Sequence: Synthetic coding sequence
atgcagaagcccttcgaggacgccagcttcgccctgcggaccggcgaaatgtccggcccggttttcactgactccggcattcacatcatccttagaactgagtgctggagacagacccggggccctaactgcttttag

SEQ ID NO: 25540 - DNA, 438 bp, Artificial Sequence
  Description of Artificial Sequence: Synthetic coding sequence
atggccgacgaggagaagctgccccccggctgggagaagcggatgagcaggtcaagcggaagagtgtattactttaatcatatcacaaatgcttcacaatgggaacggccgagcggcaattcaagcagcggcgggaagaacggacaaggcgagcccgcccgcgttcgttgtagccacctgctggtgaagcattctcagagcagaagacctagttcctggaggcaagaaaaaatcactaggactaaagaagaagctctagaattgatcaatggctacatccagaagatcaagagcggtgaagaggatttcgagagcctggccagccagttcagcgactgcagttcagctaaggcccggggggatctaggtgccttttctcggggcgcacagggcatgggtctcactcgcctcggcgatccgtaccaccctgagggatag

SEQ ID NO: 25541 - DNA, 561 bp, Artificial Sequence
  Description of Artificial Sequence: Synthetic coding sequence
atgaccatggtggacaccgagatgcccttctggcccaccaacttcggcatatcctctgtggatttaagcgttatggaggatcattcccacagctttgacatcaaaccttttactaccgtagacttttcctctatcagcacaccacactacgaggacatcccatttacaagaactgatcccgtcgtggctgattataaatatgatctgaaactgcaggaataccagtctgcaatcaaggtagagcctgcgtcccctccgtattactcagagaagacccagctgtacaataagccccacgaggaaccatcaaacagtctaatggccatagagtgccgggtttgcggcgacaaggcctcaggctttcattacggtgttcacgcttgcgaaggttgcaaaggattttttcgtcgcaccattaggctgaagttgatctacgaccgctgcgacctgaattgtaggatacacaagaaaagtcgtaataagtgccagtactgcaggtttcagaaatgtctggccgtgggcatgtcccacaatgaggagttacagaaggactcctactag

SEQ ID NO: 25542 - DNA, 1752 bp, Artificial Sequence
  Description of Artificial Sequence: Synthetic coding sequence
atgggcggcctggagaagaagaagtacgagcggggcagcgccaccaattacattacccggaacaaagcacgcaagaaattacagctttcacttgcagacttccggcgattatgtatcctgaaagggatctacccacatgagccaaaacacaaaaaaaaggtaaataaaggtagcacagccgcgagaactttttatctaataaaggatattaggtttttgttacatgagcccatagtgaacaaattccgcgagtacaaagtgttcgtgaggaagcttaggaaggcatatggcaaaagtgaatggaacactgtggagagactcaaggataataagcctaactataagctcgaccacatcatcaaggaaagataccccaccttcatcgatgccctgagggatcttgatgatgcactgtcaatgtgctttttattctcaaccttcccaagaactggcaagtgccacgtacaaacaatacagttgtgccgtcgcctcactgtcgagttcatgcactacattatagcagctagggccttgaggaaggtcttccttagcatcaaaggaatttactatcaagccgaagtgctgggccaaccaatcgtatggatcacaccatatgcgtttagccatgatcatccgacagacgtggattatcgggtgatggcgacttttactgagttctatacaactctcctcggattcgtgaacttcaggctgtatcagctactaaacttacattatccccctaagctggagggtcaagcgcaggctgaagctaaagcgggggagggaacttatgcactggactccgagtcctgcatggagaaactcgcggcactatcagcttccttggcccgagtagtggtgcctgctaccgaggaagaagcagaagtggacgagtttcccactgacggcgaggaagaccgccgaaaggaattggaagcccaagagaagcacaagaaactcttcgagggtctaaagttcttcttaaatagggaagtgccccgtgaagctctggcattcattatcaggtcttttggtggcgaggtctcatgggacaagagcctgtgcattggtgcaacctacgacgtgaccgattcaaggattacccaccagattgtggaccggccaggccagcagaccagtgtgattgggcgatgctacgtgcagccccagtgggtgttcgatagcgttaatgcccggctccttctcccagtggctgaatatttctcgggcgtgcaactgcccccccacctatctccattcgtgaccgagaaggagggagattacgtcccgcccgagaagctgaagctgctcgccttgcagaggggagaggacccagggaacctcaatgaatcagaggaagaagaggaggaggatgacaataacgaaggcgatggggacgaagagggtgaaaacgaggaagaggaagaggatgccgaggcgggctcagaaaaggaagaagaggccagactcgcggcgctcgaagaacagagaatggagggtaaaaagcctagagtgatggctggcactttaaaattggaggataaacagagactcgctcaagaggaggaatccgaagctaagcgattggctattatgatgatgaagaagagggaaaagtacttgtatcaaaagatcatgttcgggaaaagacggaaaattcgggaagccaacaaactggccgagaagcgaaaagctcacgacgaagcagtccggtctgagaaaaaagcgaaaaaggcgagaccagaatag

SEQ ID NO: 25543 - DNA, 1767 bp, Artificial Sequence
  Description of Artificial Sequence: Synthetic coding sequence
atgggcggcctggagaagaagaagtacgagcggggcagcgccaccaactatattacaagaaataaagctaggaagaaactccagctgtctcttgccgattttaggcgcctgtgtattcttaaaggtatctatcctcatgagccaaaacacaaaaaaaaggttaacaaaggctccactgccgctcgcaccttctatttaattaaggacataaggtttttgttgcatgagcctatcgtaaacaaattccgggagtataaggtctttgtaagaaagctccggaaagcctacgggaaatctgaatggaacacagtggagaggctgaaggacaacaagccaaattacaaactcgatcatattattaaagagcggtatcctactttcatcgacgctctcagagatctggacgacgccctgtctatgtgctttcttttctcaacttttcctagaacagggaagtgtcacgtgcagacaatccaattatgccgccggttgactgtggaatttatgcactatatcatcgctgctcgggctctgagaaaagtttttctttccattaagggtatatactatcaggcagaagtccttggccagccaatcgtgtggattaccccctacgcgttctctcatgatcacccgaccgatgtggattacagagtcatggccactttcaccgaattttataccaccttgctcggatttgttaactttaggctttatcaattgcttaacctacactatcccccaaagctcgaggggcaggcccaggctgaggcgaaggctggcgagggcacttacgcacttgacagcgaatcctgcatggaaaagctcgcagccctctctgcctccctcgctcgcgtggtggtgcctgccactgaggaggaggctgaggttgatgagttcccaaccgacggtgagatgagcgcacaagaagaagatcgtcgcaaagagctagaagctcaggagaaacataagaagctgtttgaagggctgaagttcttcttgaatagggaggtccctcgtgaggcactggcctttatcatccgtagttttgggggagaagtgagctgggacaagtcgctctgtatcggagccacctatgatgtgacagattctagaatcacacaccagatagtggatcggccgggtcagcaaacatctgtgatcggcaggtgctacgttcagcctcagtgggtgtttgacagcgtaaatgcacgcctgctgttacccgtggcggaatacttttcgggcgttcagcttcctcctcatctgtccccgttcgtcacagaaaaagaaggagattatgttcctccggaaaagcttaaactcctcgcactgcaaagaggagaagaccctggcaacttgaatgagtcagaagaggaggaggaggaggatgataacaatgaaggagatggcgacgaggagggagagaacgaggaagaggaggaggatgcagaggctggctctgaaaaagaggaggaggcccgcttggccgccctcgaagaacagcggatggaagggaaaaagcctcgagtgatggccggcaccctgaagctcgaagacaaacagcgtcttgcacaggaggaagagtctgaggctaagaggctggccatcatgatgatgaaaaaacgtgaaaagtacttgtaccagaagatcatgtttgggaagaggcgaaaaatccgcgaggccaacaaactcgcagaaaagagaaaggcccacgacgaagccgtcaggtctgagaagaaggccaaaaaggcacggccagagtag

SEQ ID NO: 25544 - DNA, 1350 bp, Artificial Sequence
  Description of Artificial Sequence: Synthetic coding sequence
atgtgcttcctgttcagcaccttcccccggaccggcaagtgccacgtccaaaccattcagttgtgtcgacggctgacagtagaatttatgcactatataattgccgccagagccctgcgcaaggtgttcttatctatcaaggggatttactatcaggccgaggtgttaggccagcctatcgtttggattacaccttatgcatttagccatgaccacccaactgacgttgattacagagttatggccacttttacggagttctataccacacttcttggatttgtgaactttcggttgtaccagctactgaatttgcactacccgcccaagttggagggccaggctcaagccgaggctaaagcaggggaaggaacatacgccctagactccgagagctgtatggaaaaactggccgctttgtcagccagtctggccagagtcgtcgtgcctgccactgaggaggaagccgaggttgacgagtttccaaccgacggagagatgtcagcacaggaggaagatagacgcaaggaattggaggcccaggaaaagcataagaagctgttcgagggactgaaattctttctgaatcgcgaggtgccaagggaggctctggcgttcatcattcgtagttttggcggtgaggtgtcatgggacaaatctctctgtatcggggctacatacgatgtgacagacagccgcattacgcatcagatcgtggacaggccaggccagcagacgtctgttataggtcgctgttacgtgcagccccaatgggtctttgatagcgtgaatgctaggctgcttttgcccgtcgccgagtacttctcaggagtgcaactgcctcctcatcttagccctttcgtaaccgagaaagaaggcgactacgttccccccgaaaagctcaagcttcttgccctgcagagaggagaggatccaggcaacctgaatgaatccgaagaagaggaggaggaagacgataacaacgagggagacggcgatgaagagggggagaacgaagaagaagaagaggatgccgaggccggcagtgaaaaggaggaagaggcccgccttgctgccttggaagaacagagaatggaaggaaagaaacctcgcgtgatggcgggcaccttgaaattggaggataaacagcggctggcgcaagaagaagaatccgaagccaagaggctggccatcatgatgatgaagaagcgtgaaaaatacctttatcagaaaattatgttcgggaagcgtcggaaaatccgagaggccaataagctggcggaaaaaagaaaagcccacgacgaggcggtgcgtagtgagaaaaaggcaaagaaggcgaggcccgagtag

SEQ ID NO: 25545 - DNA, 1350 bp, Artificial Sequence
  Description of Artificial Sequence: Synthetic coding sequence
atgtgcttcctgttcagcaccttcccccggaccggcaagtgccacgtgcagactattcagctgtgcaggaggttaactgtggaattcatgcactatattattgcggcccgagcacttcgaaaggtgttcctctcaattaagggcatctattaccaagccgaggttctgggacagcccattgtgtggatcactccctatgcatttagccacgatcatcccacagatgtagactaccgagtgatggctacttttaccgaattttacacaactctgctcgggtttgtgaattttagactgtatcagttgttgaacctccattatccacccaaactggaaggccaagcccaagccgaagctaaggctggcgagggcacttatgcattagattctgaatcttgcatggagaaactagctgctctctctgcctcactcgcccgggtcgtcgtccctgcaactgaggaggaggccgaggttgacgaatttccgactgatggagaaatgagcgcacaggaagaggaccgtaggaaggagctggaggcacaggagaagcacaagaaactattcgaagggcttaagtttttcttgaatcgcgaagtcccacgggaagcactcgctttcattattaggtcattcggtggggaagtatcctgggataaatctctgtgcatcggagccacgtatgacgtgacagattcgaggataactcaccagattgtcgaccgccctgggcagcagacttccgtgattggccgctgttacgtacaaccccaatgggtctttgacagtgtgaacgccaggcttctgctcccagttgccgagtattttagtggcgttcagctgcccccccatctgagtccttttgtcactgaaaaagaaggtgattacgtgcctcccgaaaagctcaagttgctagccctccagcgcggtgaggatccaggaaatttgaacgagagcgaggaggaggaggaggaagacgacaacaacgaaggggatggggacgaggagggtgagaatgaagaagaagaagaggatgccgaggccggctccgaaaaagaagaggaggcgcggcttgccgccctagaggagcagcggatggagggcaaaaagccacgggtgatggccggcacgctcaagttggaagacaaacagaggctcgcccaggaggaggagtccgaagcgaaaaggttggccatcatgatgatgaagaagagagagaaatacttataccagaagatcatgttcggcaagagacgtaagatccgagaagctaataaattggccgaaaagaggaaagcccatgacgaagctgtccgatccgagaagaaagccaaaaaagccaggcccgagtag

SEQ ID NO: 25546 - DNA, 5154 bp, Artificial Sequence
  Description of Artificial Sequence: Synthetic coding sequence
atggagcccgccgccgccgccaccgtgcagcggctgcccgagctggggagggaggacagggccagtgcccctgccgcagctgccgcagctgccgctgccgccgccgcggccgccgccgctctagctgctgccgcaggagggggccggtcaccggagcccgctttaacacccgccgcaccatctggtggaaatggatctggctcaggagctcgagaggaggccccgggcgaggctccccccggaccactccctggtcgcgcgggtggagctggcagacgtcgtcgccggggcgcaccccagcccatcgcagggggagcagctcccgtgcccggggccggggggggggctaattcgttactgctgagacgaggtcgactgaaacgcaacctgtcggccgcggctgctgctgcgagcagtagctcatccagttctgccgctgctgcctctcactccccaggagccgccggcttgcccgccagctgcagcgccagtgcaagcctgtgtacccgctcgcttgaccgcaaaacattgctgctgaagcatcggcagacattacagctacagcccagtgatcgagattgggtccgtcaccaactccagcggggatgtgtccacgtgtttgacaggcatatggcgtcaacctatttgaggccagtgctgtgcacactggatacaaccgcgggtgaggtggccgcaaggctcttgcagcttggtcacaaaggggggggcgtggttaaagtgctgggccagggccccggggcagctgccgcacgcgaacctgcagagcctccaccagaagcaggaccccggcttgctccacctgagccccgcgacagcgaggttccaccggccagaagcgcccccggggcctttgggggacctccaagagctcctcccgccgacttacccctgcctgtgggcggcccaggagggtggtcacgacgagcatcaccagctccctctgactcctccccaggagagcctttcgtaggtggcccagtttccagccctcgagcgcctagacccgtggttagcgataccgaatcttttagtctgtcgccgagcgcggagtctgtctccgatcgcctggacccctattcgtcaggcggcggcagtagcagttcctcggaggagctcgaggccgacgcagccagcgcacctactggagtgcctggacagccccgcagaccaggtcaccctgcgcagcccttgccactgccccagacagcaagttcaccgcagccacaacagaaggcaccccgcgctatcgactctccagggggcgccgtcagggagggaagttgcgaagaaaaggccgcagcagcggtcgcacctggtggactacagtcaacacccggaaggtctggggtgactgcagaaaaggcccctcctcccccacctccacctacgctatacgtgcagctgcacggcgagacaacacggcgcctcgaggccgaagagaaaccactccaaatccaaaatgactacctgtttcaactcggattcggcgagctgtggcgggtccaggaggaagggatggatagcgagattgggtgtctgattcgattctacgctgggaaaccccacagtacagggagttcagagcgaattcagctctcgggcatgtataacgtgagaaagggcaaaatgcagttgccagtgaatcgatggacacgacggcaggtcattctttgtggcacctgccttatagtaagttcggttaaggactctttgactggcaaaatgcacgtccttcccctgatagggggaaaggtggaggaagtgaaaaaacaccagcattgtctcgcctttagcagttcaggaccacagagccagacatactatatatgcttcgacacttttaccgaatacctgagatggctacggcaggtgtccaaggtggcctcccagcggatcagctccgtcgacctttcatgttgttctctggagcatctgccggcaaatctgttttattcccaggatttaacacacctgaacctgaagcagaactttctgcggcaaaatccctctctccctgctgccagaggactgaacgagctgcaacggttcacaaaactaaagagtctgaacctctcaaacaaccatctgggggacttcccactagccgtatgctccatccccactctggccgaactgaacgtgagctgcaatgccctacgatccgtgccggctgctgtgggagttatgcataatctgcagaccttccttttggacggcaattttctccagtccttacccgccgagctggagaacatgaaacagctatcctacttaggcctgtctttcaatgagttcactgatattccggaagtgctggagaaattaacagccgtggacaagctgtgtatgtctgggaactgtgttgagaccctgcggctgcaggctttgaggaagatgccccatatcaagcacgtggatctacggctgaacgtcatacgaaaacttattgccgatgaagtcgactttctgcagcatgtcactcagttggatctccgagacaacaaactgggggatctggatgccatgatctttaacaatattgaggttcttcattgtgaaagaaatcaactggtgactcttgacatatgtggatacttcttgaaggctctgtacgcctctagcaatgagttggttcagctggatgtgtaccccgtgccgaattacttatcctatatggatgtgtctcggaataggttagagaacgttcccgagtgggtgtgtgaatcgagaaaacttgaagtgctcgacataggccacaatcagatatgtgagttgcctgcccgtctattctgcaacagcagtttacgaaagctgcttgctgggcataaccagctggcaagactgcccgagcgtcttgaacgaacctcagtggaagttctggacgtacagcacaatcaattactggagctgcctccaaacctgttaatgaaggctgatagtctgaggttcttgaatgcgagtgcgaacaaacttgaatcccttcctcctgctaccctaagcgaggaaaccaattcgatcttacaagagttatacttgactaataacagcctaacagacaagtgtgtacccctcctgaccggccatccacatttgaagattctgcatatggcgtataataggttgcagtctttccccgccagcaagatggccaagctggaggaacttgaggagattgacctctccggtaataagctaaaggcaatccctaccactattatgaattgcaggcgcatgcacaccgttattgcccattccaattgtattgaagtcttccctgaggttatgcagttaccagaaataaaatgtgtggatcttagctgtaacgagctctccgaagtaacattgcccgagaacctgccccccaagttgcaggagttggacctcaccggaaacccacgcctggttcttgatcacaaaacactggagttgctgaataacatacggtgcttcaaaatcgaccagccgtccaccggagacgcaagtggtgcacctgcagtgtggagtcacggctatacggaggccagcggggttaagaacaaactgtgtgtggcagctctttctgtgaacaacttctgcgacaaccgcgaggccctttacggcgtgttcgatggcgatcggaacgtggaagtgccatacctcctgcagtgcactatgtccgacatcctggccgaggagttacagaagactaaaaacgaggaggagtacatggtcaacacattcatcgttatgcaacgcaagctgggaactgctggacagaagttgggcggtgccgccgtcctgtgccatataaaacacgatcctgtggatcctggtggtagtttcacactgacttctgccaatgtcgggaagtgccagacggtgctgtgtaggaatggcaaacctctacctctgtccagaagttacatcatgtcttgcgaggaagagctgaaaaggatcaaacagcacaaggcaatcattacggaggacggaaaggttaacggtgtgacagaatcgacaagaattctggggtatacttttctacacccttccgtggtgccccgcccgcacgtgcagtctgttctcttaacaccccaggacgaattcttcatcctgggatccaagggcctgtgggattctctgtccgtagaggaggccgtggaagctgtccggaatgtccccgacgccctggcagccgcgaagaagctctgcactttggctcagagctatggctgccacgattctatcagtgctgttgtcgtccagctgtccgtaaccgaggacagtttttgttgttgtgagctaagtgcaggtggggctgtgcccccaccttcccccgggatttttccaccatccgttaatatggtaatcaaggaccggccctccgacggcctgggagtgcccagcagcagcagcggcatggccagcgagattagttcagaacttagcacctctgagatgtcatccgaggtgggctcaaccgctagcgatgagccccctccgggagccctctcagaaaactctcccgcttatccgtctgagcaacgctgcatgcttcatcccatctgcttgtctaactcgttccaacgacagctttcatcggcaacgttcagctcggcttttagtgacaatggtcttgattccgacgacgaagagccgatagagggggtatttacgaatggctctcgggtggaagtggaagttgacatccattgctcaagagccaaggagaaggagaagcagcagcacctgttgcaggttccggccgaggcgtccgacgagggaattgtcatttctgccaatgaagacgagcccggactgccccgaaaggctgacttttctgctgtggggacaataggacgccgccgtgctaatggttctgtcgccccgcaggagcgctcccacaatgtcattgaagtagctactgacgccccactgcgtaagcccggcgggtacttcgccgcaccagctcagcctgatcccgatgatcagtttatcatccctcccgaattagaggaggaggttaaagaaatcatgaagcaccaccaggagcaacagcagcaacaacagccccccccgccacctcagttgcagcctcagctgcctcgacactatcagttggaccagcttcctgactactacgacactccgctgtag

SEQ ID NO: 25547 - DNA, 3618 bp, Artificial Sequence
  Description of Artificial Sequence: Synthetic coding sequence
atggacagcgagatcggctgcctgatccggttctacgccggcaagccccatagcaccggcagctctgagagaattcagttgtccggaatgtataacgtgcgcaagggaaaaatgcagttgccagtgaaccgatggacccgccggcaagtgatcttgtgcggcacatgcttgatcgtgtcttcagtgaaagatagtctcacagggaaaatgcacgtgctgccactcattggtgggaaagtcgaggaagtgaaaaagcaccagcattgcttggccttttcgtcctctggaccccagagccagacctattatatttgtttcgacactttcactgagtatctaagatggcttcggcaggtgtcaaaagtcgcttcacagagaatttcctccgtggacctgagctgctgttcgttggaacacctgccagccaacctgttctattcccaggaccttacgcacctgaacttgaaacagaatttcctgagacaaaacccgtccctgcctgccgcccggggacttaatgagctccagagattcaccaaactcaagtccctgaatttgtccaacaaccaccttggcgactttcctctggccgtttgcagcatccctaccctggccgaactaaacgttagttgcaacgctcttcgatctgtgccagctgccgttggagttatgcacaacctccagaccttcctgcttgatgggaatttcctccagtccctgcccgccgaactggaaaacatgaaacaactctcctatctgggactatcctttaacgagttcacagatatccccgaggtcctggagaagctgaccgctgtcgacaagctatgcatgtccggcaattgcgtggagactcttagactgcaggcccttcggaagatgcctcacatcaagcacgtagatctgaggctgaatgttatccgcaagcttattgctgacgaggtagatttcttgcagcatgttactcagctcgacctacgagataataagctgggtgacctggatgccatgattttcaataacatcgaagtactgcactgcgaaagaaatcaactcgttacgttggacatctgcggctacttcctgaaggcgctgtacgcatcatctaatgaacttgttcagttggatgtttacccagttcctaattacttgagctacatggacgtgtcacggaataggctggagaacgtccctgagtgggtttgtgagagccggaaactcgaagtccttgatatcggacacaatcagatttgcgagcttccggccaggctcttctgcaatagctccttacggaaactgctggccggccataaccagttagccagactaccagagcgactggaacgcacttccgtggaagttctcgacgtccaacacaaccagctcctagagttgccgcccaacctccttatgaaagccgactcccttcggttcctaaacgcctccgccaacaagcttgagtcactccccccagctacactgtcagaagagaccaactctattttgcaggagctttatttaaccaataactcactgacggataagtgcgtaccgctgttgacgggccacccacacttgaaaatcctccacatggcttacaacaggctccaatcctttcccgcgtctaagatggccaaacttgaggagctggaagaaatcgatctatctggaaacaaattgaaagccattccaacaacgattatgaattgtcggagaatgcacactgtgatagcacattctaattgcattgaagtgtttccagaagtcatgcagctccccgaaatcaagtgcgtcgacctgtcctgcaatgaactcagtgaggtgacactccccgaaaacctgcctcctaaactccaggaactggatctgacagggaatcctaggctcgtgcttgatcacaagaccctggagttgctcaataacatcagatgctttaagattgatcagccgtcaacaggcgacgcaagcggcgccccggctgtatggtcccacggctatactgaagcatcaggcgtgaagaacaaactctgcgtggcagccttaagcgtgaataacttttgcgataaccgcgaggctctctacggggtgttcgatggagatcggaatgttgaggtgccctaccttcttcagtgcactatgtctgacatccttgccgaggaattacagaagacgaagaacgaggaagagtacatggttaataccttcatcgtcatgcagcgcaagctcggtacggccggacagaaactggggggcgctgctgtgttgtgtcacatcaagcatgatcctgttgaccctggtggctcatttaccctcacttcagcgaatgtgggaaagtgccaaacagtgttatgtcgcaacgggaaacccctgccattatccaggtcttacatcatgtcttgcgaggaggagctgaagcgtattaagcagcataaggctattatcacagaggacgggaaggtgaacggcgtgaccgaatcgacgcgcatcttgggctacactttcctgcatccaagtgttgtgccccgaccccatgtccagtccgtcctgctgaccccccaggacgagttttttatcctggggagcaagggattgtgggacagtctgtcagtggaagaggcggtggaagctgttcggaacgtgcccgatgccctcgccgcagcaaaaaaactgtgcacactggcacagagctacggatgccacgacagtattagcgcggtagttgtccagctgagtgtaaccgaagacagtttttgctgctgcgaactgtcagccgggggggcggtgccccctccttcccctggcatattcccaccaagcgttaacatggtgatcaaagacagaccctctgatgggctcggagtgccctccagctcatccggcatggcatctgagatcagttccgagctaagcacttcagagatgtcctctgaagtgggaagcaccgcaagtgacgaacctcctcctggagccctgagtgaaaatagccctgcttatccctccgaacagcggtgcatgctacatcccatttgtctttccaacagctttcaacggcaactgagcagcgcaaccttttcctctgcgttttccgataatggcctagattcagacgacgaagaacccatagaaggggtgtttacgaacggatctagagtcgaggtggaggttgatatccactgctcccgtgcaaaggaaaaggaaaagcagcagcaccttctccaagtgccggcagaagcaagcgatgaggggatcgttatctccgctaacgaagacgagccaggcctccccagaaaggccgactttagcgccgtcggtacgatcgggcgtcgccgtgccaacggcagcgtagctccccaggagcgttcgcataatgtgattgaggttgctacggatgctcccctgcggaaacctggagggtactttgctgctcctgctcagccagatcccgacgatcaatttataatcccgcctgaactggaggaggaagtcaaagagataatgaaacaccatcaggaacagcaacagcaacagcagcctcccccaccaccacagttgcagccacaactgccgaggcactaccagttagaccaacttcctgactattacgacactccactgtag

SEQ ID NO: 25548 - DNA, 2379 bp, Artificial Sequence
  Description of Artificial Sequence: Synthetic coding sequence
atgcacatcctgcccctggtgggcggcaagatcgaggaggtgaagcgacgccaatattccctggcatttagctctgccggtgcccaggcccagacataccatgtcagctttgagacgctggccgaataccaacgatggcagcgccaagcatctaaggtcgtctcccagcgtatcagcacagtggacctgagttgctatagcctggaggaagttcctgagcacttgttctattcccaagacattacttaccttaacttacgccataatttcatgcaattggagcggccaggagggctcgatacgctatataagtttagtcagctcaaaggcctcaaccttagccacaacaagctgggactgttcccaattctcctctgtgaaataagcaccctcaccgaattaaacctgtcctgtaacggatttcatgacctgccaagtcagattggcaacttgctgaacctgcagaccctctgtcttgacgggaacttcctcaccacactgcccgaggaactgggcaacctgcaacagctctcctctctgggaatttcatttaacaacttctctcagatccccgaggtgtacgaaaagctaacgatgctggatagagtggtgatggccgggaactgtctggaagtgctgaacttaggtgtcctcaatcgcatgaatcatattaaacacgtggacctgagaatgaatcaccttaaaactatggtgatcgaaaatcttgagggcaataagcacattactcatgtagacctgcgagataacagactgactgacctcgacctttcttcactgtgcagtctggagcaacttcactgtgggaggaatcaattacgggagctgaccctttctggcttttcccttagaaccctgtacgcctcctctaacagactgacagccgtgaacgtgtacccagtcccgtcgctgttaacttttctcgatctctcgagaaatctcctggagtgtgtccctgactgggcatgtgaagccaagaaaatagaagttctcgatgtctcctacaacctgctgacagaggtgcctgtaagaattctgagtagtctttcactccgcaagctgatgctgggacataatcacgtgcaaaatttacccaccctggtggaacacatcccgttggaagtactcgatttgcagcataatgccctgacccgcctccccgacaccctgttctcaaaggcccttaacttacggtatcttaacgccagtgccaatagcctcgaaagccttccatccgcttgtacgggagaggagtcattatctatgctgcagctactgtacctcacaaacaacctgttaactgatcagtgcatccctgtgttggtggggcacttgcatctcagaatcctgcatctcgccaacaaccagctgcagacatttcccgcctctaagcttaacaagcttgagcagctggaggagctcaacctgtctggcaacaaattgaagaccataccaactactattgccaattgcaagcgacttcacaccctggtcgcgcactcaaataatattagtatcttccctgaaatcctccaactcccgcaaatccagttcgtggaccttagctgtaatgatctgactgaaattctaattcctgaagcactaccagccacactccaggatctggaccttactggaaatacaaatctagttttggagcataaaacactggacatctttagccacattaccacactgaagatcgaccaaaaaccgctgcctaccaccgacagtactgtgacaagcaccttttggagtcacggtttagctgaaatggccggccagaggaataagctgtgtgtctcagccttagcgatggacagttttgctgagggggttggagcagtgtatggaatgttcgacggggacaggaatgaggaactcccccggctgctgcaatgtactatggcggacgtgctcctggaggaggtgcagcagagcacaaatgacactgtgttcatggcgaatacattcctggttagccaccggaaactaggaatggcaggacagaaactggggagttctgcattgttgtgttacattcgacctgacaccgctgatccagcgagttcattttcattaacagtagccaacgtggggacctgccaggctgtcctgtgtcggggggggaaacccgtgcctctgtccaaagtcttctccttagagcaggatccagaagaggctcagcgcgtcaaagaccagaaagccattattacagaggttcccgaggatttgaaggaatttcaaaccacagacataccggttcaccattgcaactttcgggcagtgctgggttgtttgtgcagcgcgagtgttctcggcagttacgccggtccggcgcctaggtggcgtcgcacttag

SEQ ID NO: 25549 - DNA, 3972 bp, Artificial Sequence
  Description of Artificial Sequence: Synthetic coding sequence
atgaagcggaacggcagccggaactgcctgaaccggcggagccggtttggatctagggagagggactggcttagagaagatgtgaagcgagggtgcgtgtacttatacggagcagataccacaactgcaacgacgacgaccaccactagctctagctccagtagcagttctagttcgtccgatcttcacctggtgctttgcactgtggagacacccgcctccgagatctgtgccggagagggacgcgaaagcctctaccttcagctccacggggatctagtgagacgtctcgagccaaccgaacgcccgctgcaaatagtttatgactacctgtctagacttggcttcgacgatcccgtacgaattcaagaagaagcgactaatcccgacctcgggtgtatgattcgcttctatggggagaagccttgtcacatggatcgacttgacagaatcctcctttctggtatctacaatgttagaaagggcaaaacgcagcttcacaagtgggctgagaggctggtggttctgtgcggtacctgcctaattgtttcatctgtaaaggattgccagactggcaagatgcatatattaccacttgtggggggcaagatcgaagaagtcaaaagacgtcagtatagtttagcatttagctctgcaggtgcccaggctcagacgtatcacgtttcctttgaaactctggccgaataccaaagatggcagagacaggcaagcaaagttgtcagccaacgaatctctacagtggacctgtcatgctatagcctagaggaggttccagaacatctgttttactcccaagatattacctacctgaacctgagacataactttatgcagctcgaacgtcccggaggcctcgacaccctgtacaaattttcccagctgaaaggactgaacttgtctcacaacaaactggggctttttcctatattactgtgcgaaatcagtaccctcactgagctgaacctgagctgcaacggtttccatgacctgccatcacagatcgggaatcttctcaatctgcagaccctgtgcctggatggtaatttcctgactaccttgccggaggaactgggaaatcttcaacaactgtcctcactcggcatcagctttaacaattttagccagattcccgaggtgtatgagaaactgacgatgctggaccgagtcgtaatggccggcaactgtttagaagtgttgaatctgggcgttctcaataggatgaatcatatcaagcatgtcgatctccggatgaaccatctcaagacaatggtaattgaaaacctggagggcaataagcacataactcatgttgacctgcgtgacaataggttgactgatctggacctctcaagcttgtgcagcctggaacagctgcattgtggaagaaaccagctgagagaactcaccttatccggattctctctccgaacgctttatgcctctagtaatcgtctcactgctgtgaacgtatacccggttccatcccttttgacctttctcgatctcagccgaaacctcctggagtgcgttcctgactgggcttgcgaggctaaaaaaatagaggtccttgatgtgtcttacaatctgttaacagaagtgcctgtgaggatcctgagctctctgtcactcaggaagctgatgctagggcataatcatgttcagaatttgccaaccctggtggaacatatcccccttgaggtcctggacctgcagcataatgccctcacccggcttccggacaccctcttctccaaggccctgaacctccgctatttgaacgctagtgcgaactctctggagagtctgccttcagcttgcactggcgaggagagtctcagtatgttacaactactttatctgactaataatctgcttaccgatcagtgcattcctgtgctggtcggacacctccaccttcgcattttgcacctggctaataaccaactgcaaacatttcccgcttctaaactgaacaaactggagcaacttgaagagctcaacctgagcgggaacaagctaaagactattccaaccaccattgctaattgcaaaagactacacacgctagtcgcacactccaacaatatttctatattccccgagattctgcaacttccccaaattcagtttgtggacctaagctgcaatgatctaactgaaattctgatcccagaggctctccctgcaaccctgcaggacctcgacctcacggggaacacaaatctggtgcttgagcacaagactctggatattttcagtcacatcaccaccctaaaaatcgaccaaaaacccctcccaactacagattctactgtgaccagcaccttctggtctcacggccttgctgagatggctgggcaacggaataaactatgcgttagcgccctggcaatggacagtttcgctgagggagtcggcgctgtgtatggaatgtttgatggtgacagaaacgaggagctgccacgactgctccagtgtactatggccgacgtgttgctggaggaagtccagcaatccactaacgataccgtgttcatggctaataccttcctggtgagtcatcggaagctggggatggctggacagaagcttggttcttcggcccttttgtgttacatccggcctgacaccgcagatccagcatctagtttttctctgaccgtggctaacgtaggcacgtgtcaggccgtgctttgcagggggggcaagccagttcccctgtcaaaagtgttttccttggaacaggaccccgaggaagcccagagagtcaaggaccagaaggcaatcattaccgaggataacaaggttaatggggttacctgctgtactcgcatgttaggttgcacatatctgtatccttggatcctgccaaaacctcacatcagctcgactcccctgacaatacaagacgagctgctgatcttgggcaacaaagcattatgggaacacctgtcttacaccgaggccgttaacgccgttaggcacgttcaagaccctctggcggctgccaaaaagctgtgtacgctggcacaaagctatggatgccaagataacgtgggtgctatggtggtgtatctgaacataggtgaggagggctgtacctgtgagatgaacggccttacgttacctggaccagtaggcttcgcatccaccactacaatcaaggatgcccccaaacccgctactccaagtagcagttccggcatagccagtgaattttcatctgagatgtccacaagcgaggtgtcctccgaagtgggaagcactgcttcagacgagcataacgccggcggcctggatactgcgctcctgccaaggcccgaacgccgttgctccctgcaccccactccaactagtggcttgttccaaaggcagccctcttcagcaacattctcctcgaatcaatctgataacgggttagatagtgacgacgatcagcctgtggaaggggtgattacgaatggttccaaagtggaggtggaagtggacatccactgctgccgcggccgcgatctcgagaattcgcctcctctgattgagagctccccgaccctctgtagtgaggagcatgcacgcggctcctgcttcggaattagacggcagaactccgtgaacagcggcatgctgctccctatgagcaaggaccgcatggagttacagaagtctccaagcacaagctgtctgtatgggaagaaactatcaaatgggagcattgtgcccctggaagactccctgaacctcatcgaggtggcaaccgaagttccaaaaagaaagacaggatacttcgcagccccaacccagatggaacccgaggaccagtttgtggtccctcacgatctggaagaggaggtgaaagagcagatgaaacaacatcaagactcccggttggaacctgagcctcacgaagaagaccgaaccgagcccccagaagaatttgacacagccctgtag

SEQ ID NO: 25550 - DNA, 2871 bp, Artificial Sequence
  Description of Artificial Sequence: Synthetic coding sequence
atgaagcggaacggcagccggaactgcctgaaccggcggagccggtttggctctcgtgaacgtgattggctgcgagaagatgttaaaagagggtgtgtgtatttatatggggctgacacaactacagcaaccacgaccactacaacttcctcctccagcagcagcagctcatcgagcagcgatctgcaccttgtgctatgcactgtcgagacccctgccagcgagatatgcgcaggcgagggtagggagtcactatatttgcaattgcacggggacctggtgaggcggctcgaaccaacggaaagacccctgcagattgtttacgattacctcagccgccttggcttcgatgatcctgttaggatccaggaggaagccacaaatcctgacctggggtgcatgatccgattttacggtgagaaaccatgtcacatggaccgcctggacaggattttgctgtccggcatttacaacgtgagaaagggcaagacacaactgcataagtgggccgaaaggctcgttgtcctctgtggaacctgcctcattgtgagcagcgtgaaagactgtcaaacgggcaagatgcacattctacccctggttggtggtaaaattgaagaggtaaagcgaagacagtatagtctggccttctccagtgcaggagcgcaggcccagacctatcacgtcagcttcgagacactcgctgagtaccagcgttggcagcgccaggcgtccaaggtcgtgtcccagcggattagtactgttgacctcagctgctattcactggaagaggtgcccgaacacctattttactcccaggacattacctacctgaaccttcgccataatttcatgcaactggaaagacctggggggctggacactttgtacaaattctcacaacttaagggcctgaatctgagtcataacaaactgggcctgtttcccattcttttatgcgagatctccacacttaccgagctaaacttgagctgcaatggcttccacgatcttccgtctcagatcggtaacctactaaatctccaaactctatgcctagatgggaatttcttgaccacactgcccgaagaacttgggaatctgcagcaacttagttcgctgggcatatcctttaataactttagccagattcctgaggtgtacgagaagctcaccatgctcgatcgagtcgtcatggccggcaattgcttggaggtccttaacctgggggtcctaaacagaatgaaccacataaagcacgttgatttgcggatgaatcacctgaaaactatggtgattgaaaatctggaaggaaacaaacacatcacacatgtcgatctgagagacaatcgccttacagacttggatctaagcagcctctgctccctggaacagctgcactgtggcaggaaccagctgcgagaactgaccttgagtgggttttctctgcgaaccctgtacgcctctagcaacaggctgaccgccgtgaacgtgtacccagttccttctctgttgaccttccttgatctttcccgcaacttgctggaatgtgtgcccgattgggcatgtgaggccaaaaagattgaggtcctcgatgtcagttataacctcctgaccgaggtgcccgtgcggatcctgagctctctctctcttagaaaactcatgctgggccacaaccacgtccagaacttacccactctggtagagcacatccccctggaagtgctggatttgcagcataacgcattgaccaggttgcctgataccctcttttctaaggctctcaacctccgttaccttaacgcctcagcaaacagcttagagtcattgcctagcgcctgtacaggtgaagaatccctcagcatgctccagttactgtacctgaccaataacttgctcaccgatcagtgtatccccgtgctagtcggccacctccatttgagaatcttacacctagctaataatcagttgcagactttcccagccagcaaactcaataaactggaacagctggaggagttgaacctgagcggaaacaaactcaagacaattcccactactatcgccaactgtaagcggctccacactctagttgcgcactctaacaatatatccatttttcctgagatcctacaactgccccagatccagtttgtagatctgagctgtaacgacctcaccgaaatactcatccctgaggccttgccagctaccctgcaggacttggatctgaccggcaataccaatctggtcttggaacacaaaaccttagatatcttctctcacattactacgcttaagatagatcagaagcctcttccaaccaccgacagtaccgtcacctcaacattctggagccacggtctggccgaaatggctggacagaggaataagctttgcgtgagcgctctggctatggatagcttcgcggaaggggtgggagccgtgtatggaatgttcgatggcgacagaaacgaggaactccccaggttgcttcaatgtaccatggctgatgtgttgctcgaggaggtgcagcaatctacaaatgacacagtttttatggccaacaccttcctcgtgtcacatcgcaagctgggaatggccggacagaagttggggtcttctgcactcttgtgctatattagacctgacaccgccgatccggcctcaagcttttccttgacggtggccaatgtagggacctgtcaggccgtgttgtgccgcggtggcaagccagtcccactgagcaaagttttttctctggagcaggaccctgaggaggcacaaagggtgaaagatcaaaaagctattattaccgagaactgggtgctgaaccagaagcatctgcaggacttccccggtgaagacaagtag

SEQ ID NO: 25551 - DNA, 3771 bp, Artificial Sequence
  Description of Artificial Sequence: Synthetic coding sequence
atgaagcggaacggcagccggaactgcctgaaccggcggagccggttcgggtccagggagcgggattggctgcgcgaggatgtgaagcgtgggtgcgtgtatttatacggcgcggacaccaccaccgctaccaccaccaccacgacctcttcgagttcaagttcctcatcttcgagttccgatctgcatctggtgctgtgcactgttgaaacccccgcctccgaaatctgcgccggggaaggccgcgagtcactctacctgcagctacatggagacttagttagaagactggagcccacagaaaggcccctgcagatcgtgtacgattacctgtcccggttgggctttgatgatccagtgagaatccaggaagaagccactaatcctgaccttggatgcatgataagattttatggcgagaagccatgccatatggaccggctcgatcgcatactgctaagcggtatttataatgttcggaaagggaagacccagctgcacaaatgggcagagcgcctcgtcgtattgtgcggcacctgcctaatcgtatctagtgttaaagattgtcagacaggcaagatgcatatcctgccacttgtcggcgggaaaattgaggaagtgaaaagacgtcaatattctttagccttttcatccgccggcgcacaggctcagacctatcatgtaagtttcgaaacgctggccgaatatcagagatggcaacggcaggccagcaaagtcgtttcgcaaagaattagcaccgtggatctaagctgttatagcctcgaagaagtacctgagcacctcttctactctcaagacatcacgtatttaaatctcagacacaattttatgcagctcgagaggccaggtgggctggacaccctatataaattttctcaattgaaaggactcaacctctctcataacaaactgggcttgtttcctatcctcctgtgtgagatcagcaccctgaccgagctgaacttgagttgtaatggctttcacgacttacctagccagataggcaatcttctcaatcttcaaaccctgtgtctggacggtaactttttgactacactgcctgaggagctgggtaatctgcagcaattgtcttctctgggcatctcatttaacaatttctcccagatacccgaggtctacgagaagctgacaatgctagatcgtgtggtaatggccggcaactgtttagaggtgctgaacctaggcgtactcaatcgtatgaaccacataaaacatgtggacctccggatgaatcatcttaagacaatggtgatagagaacctggaagggaacaagcacattacacatgtagatctgcgggacaacaggttgacagatctggacctgagctcactctgctcgcttgagcagctccactgtggccgaaaccagcttagagagctcacgctttctggtttttctctgcggacactctatgcttcatccaaccgtctcacagctgtgaatgtgtaccctgtccccagcttgctcacgtttttagatctctccaggaatctgttggagtgtgtcccagactgggcctgtgaagctaagaaaatcgaagtccttgacgtgtcatataacctcctcactgaggttcctgttcgcatcctcagtagcttaagtctgcgaaagctgatgctgggacataaccacgtgcagaatcttcccacactagtagaacacatccctctggaagtcctcgatctacagcacaacgctctgacgcggctccctgataccttgttctctaaggccttgaataagctgaataaattggagcagctagaggagcttaatctctcagggaacaagctaaagacaataccgactaccattgctaactgcaagagacttcacacgctggtggctcactcaaacaatataagcatcttccctgaaatacttcagctcccgcagattcaattcgtcgacttgtcttgcaatgacttgaccgagatcctcatacccgaagcactgccagcgaccctgcaggacttagacctaactggaaacacaaatctggttctggaacacaaaaccctcgacatcttcagccacatcaccaccttgaaaatagaccagaagccccttcccacaactgattccacggttacatctacattctggtcgcatggcctcgctgagatggctggacagagaaacaaactgtgcgttagtgctcttgccatggatagcttcgcagaaggcgtcggcgctgtgtatggaatgttcgacggagatagaaatgaagaacttccacggctcctgcagtgtaccatggccgacgtgctcctcgaagaggttcagcagagcaccaatgacaccgtctttatggcaaacacattcttggtgtctcaccggaagttgggtatggcgggccagaagttgggctcctcggccttactatgctatatccggcccgacaccgcggatcccgccagctcatttagtcttactgtagctaacgtaggaacatgccaagcagtcctatgtcgcggaggcaaacctgtgccactgtcaaaagtattcagtctggaacaagatcccgaggaagcccagagggttaaggaccaaaaagctattatcaccgaggacaataaagtgaatggtgtgacctgttgtacgcgcatgctgggatgcacctatctgtatccatggattctgccaaaacctcatatctctagtactccccttaccattcaggatgagttgctcatcttaggtaacaaagctctgtgggagcatctttcctacaccgaggctgtaaacgccgtccggcacgtgcaagatccgctcgccgccgctaagaagctgtgcacacttgcccagtcatacggctgccaggataatgtgggagctatggtcgtttacctgaacataggggaggaggggtgcacttgtgagatgaacgggctcaccctgcccgggcctgtggggttcgcgtccacaaccacgataaaagacgccccaaaacctgccacccccagctcctcctccggcatcgcgtcagaattttcgtctgaaatgtcgaccagtgaggtgagctcggaggtaggaagcaccgcgtcagacgagcataatgcagggggacttgacacagctctgcttccaaggcctgagagacgctgttctctccacccgactcccacaagtggtctctttcagcggcagcccagtagtgctacatttagtagcaatcagtcagacaatgggttggacagtgatgacgaccagcccgtagaaggcgtgattaccaatgggtccaaagtagaagtggaggtcgacatccactgttgtagaggcagagatctggagaactccccgcccctgatcgaatcaagccccacgctctgtagcgaagagcacgcccggggttcgtgcttcggtatccgcagacagaattctgttaattcagggatgttattaccaatgagcaaggacaggatggaacttcaaaaatctccatccacttcctgtctttacggcaagaagctctccaacgggagcatcgttcccctcgaagattcattgaatctaattgaggtggcaacggaggtgcctaagcggaagaccggatattttgcggctcccacgcagatggagccagaggaccagttcgtcgtgcctcacgacttagaggaagaggtcaaggaacaaatgaaacagcaccaggactctcgcctggagcccgagcctcatgaggaggacaggacagaacccccagaggagtttgataccgctttatag

SEQ ID NO: 25552 - DNA, 1272 bp, Artificial Sequence
  Description of Artificial Sequence: Synthetic coding sequence
atgaagcggaacggcagccggaactgcctgaaccggcggagccggtttggcagcagagagcgagactggctaagagaggacgtcaagcgaggttgtgtgtacctttatggcgcggatactaccactgcaaccacaactacaacaaccagctcatcgtcctctagctcctcctcttcgtcggacctgcatcttgtgctgtgcacggtggaaaccccagcctccgaaatttgcgctggggagggccgagaatccctttacttgcagctccacggagacctggttagaagattggagccaacagaaagacccctgcaaatcgtctacgactacctctctcgactgggctttgatgatcccgtgcgcatccaggaggaggctacgaaccctgacctcggctgcatgataaggttctatggagagaaaccatgccatatggaccggcttgaccggatcctgctgagtggtatttacaacgtacgaaagggaaaaacccaactgcacaagtgggccgagcgacttgtagtcctgtgcggaacctgcctgattgtgtcgtctgttaaagattgccaaactggcaaaatgcatattctccccctagtcgggggcaagatcgaggaggtgaagcgccgacagtactccctcgccttctcctctgccggagcgcaggcacagacatatcacgtgtcctttgagaccttggccgagtaccagcggtggcagaggcaggcctctaaagtcgtgagccagagaatctccaccgtggatctttcctgttactcccttgaggaagtccccgagcacctcttttattcccaggatattacttacttaaacctacggcacaacttcatgcagctggaaagacccgggggactcgacactctatataagttttcccagctcaaaggcctgaatctaagccacaacaagctggggctgttcccaatcctcctgtgtgaaatttcgactctcacagagctgaatctgtcttgtaacggattccacgacctgccctcacagattgggaaccttctgaaccttcagaccctctgcctagacggaaatttcctaaccacactcccagaagagttgggaaacttgcagcagctgtcgagtttagggatctcctttaacaacttcagtcagattcctgaggtctacgagaaactgaccatgctcgatcgcgtggtgatggccgggaactgtctggaagtgcttaatctcggtgttctgaacagaatgaatcacattaagcacgtggacttgaggtag

SEQ ID NO: 25553 - DNA, 501 bp, Artificial Sequence
  Description of Artificial Sequence: Synthetic coding sequence
atggccggccagcggaacaagctgtgcgtgagcgccctggccatggacagctttgcagagggcgtgggcgccgtatatgggatgtttgatggggatcgaaacgaggagctccccagactgttacagtgcactatggcagacgtcctgctcgaggaggttcagcagagcactaacgatacggtgtttatggcaaacaccttccttgttagccacagaaagctgggcatggctggtcaaaagctgggcagttcagccttactgtgctatatccgccccgataccgccgatccagcttcttccttctccttgactgtggcgaacgtaggtacctgccaggcagtactctgtcggggagggaaacctgtaccactcagcaaagtcttctccttagaacaagatccagaggaggcacagagggtgaaggaccaaaaggctatcattacagaaaactgggtgctgaaccagaaacatttgcaggatttccctggagaagataagtag

SEQ ID NO: 25554 - DNA, 3972 bp, Artificial Sequence
  Description of Artificial Sequence: Synthetic coding sequence
atgaagcggaacggcagccggaactgcctgaaccggcggagccggtttggctcacgcgagagggactggcttcgggaggacgtgaagcgcgggtgtgtgtatctttacggcgccgatacgactaccgcaaccactacgacaacaacctcatcatcttcgagctcatcctcctcatcttccgatctccatttggttctgtgtacggtagagacacccgcctcagagatttgcgcaggcgagggtcgggagtccctgtatctgcagttacacggagacctggtgaggcgccttgagccaaccgagcggccactccagattgtatatgattaccttagtagactggggtttgacgatcccgtgcgaatccaagaggaagctaccaatccagatctggggtgcatgattcgcttttacggggaaaaaccttgccacatggacagactggaccgcatactgctgtctggtatttacaatgtgcggaagggaaaaacccaactgcataaatgggccgagcgactggtggtgctctgtggcacttgtctgatcgtgtcttctgttaaagattgccagaccgggaagatgcatatcctgcctttagtaggagggaagatcgaagaggttaagcggaggcagtattccctggctttctcttccgccggtgcacaggctcagacttaccacgtgtccttcgagactctagcagagtaccaaagatggcaaagacaggcttcgaaagtggtaagccaaaggatcagtactgttgacctcagctgctattctttggaggaggtgccagaacatttgttttatagccaagatatcacctacctcaacctgagacataattttatgcagctagagcgtcccgggggacttgacactctctataagttcagtcagcttaaaggcttgaacctgtcacataacaagctgggtctttttccaattctgctttgcgaaatcagcactctgacagaattgaatctgagttgtaatggttttcatgacttgccttcacagatagggaatctactaaacctgcagacactgtgcctggacggcaatttcctcaccacccttccggaagagcttggcaacttgcagcagttaagctcactgggaatatcctttaataatttctctcagattcccgaagtgtacgaaaaactgactatgctggatcgggttgtgatggccgggaattgtttagaggtactcaatctgggggtgctgaacaggatgaaccacatcaagcacgttgatctccggatgaaccacctcaagactatggtcattgaaaacctggaaggaaataagcacattacccacgtggacctccgcgataacagactgacggacctcgaccttagttcattgtgctcccttgaacagttgcactgcgggagaaaccagttgagagagctgaccctttcaggattctccctgaggactctgtacgcctcttcaaataggctcacagcggtcaatgtttatcctgtgccaagtcttttaactttcctggatctcagtcgcaacctgttggagtgtgtgccagattgggcctgtgaagctaaaaagattgaagttttggatgtcagttacaacttattaacagaggtccctgtcagaattctgtcctcactttcacttcggaagctgatgttaggacacaaccacgtgcagaacctgcccactctagtggaacacatacctctggaagtattggatctgcagcacaacgctctcacccggctccccgacaccttgttctctaaggctctgaatctgaggtacctcaacgcttccgccaatagcctcgaatctctgcccagcgcttgtaccggcgaagaatcactctccatgctgcagctactgtaccttactaacaatctcctcactgaccagtgtattcccgtgctggtagggcacctacacctccggatactgcatctggctaacaatcaactacagacattcccagccagcaaactcaataagctggagcagctggaagagctgaatctgagcgggaacaagttgaaaaccatcccaaccaccattgccaactgcaagaggttacataccctggtagctcatagcaacaacatctccattttcccggagattctccagctgcctcagatccagttcgttgacctgagttgcaatgatcttacagaaattctcatcccagaggcccttcccgcgactttacaggacctcgacctgacaggcaacactaatctggtgctagaacataagacactggatattttctcccacatcaccacgttgaaaatcgatcagaaaccactccctacaacagatagcacggtgaccagtacattctggagtcacgggctggctgagatggcgggtcagcgcaacaagctttgcgtgtctgccctggccatggattcatttgccgaaggagtgggcgcggtctatggcatgtttgacggggaccgcaatgaggaacttccgcggttgctacagtgcaccatggccgacgtcctgctggaagaagtccagcaatccaccaacgatactgtgttcatggctaacaccttcttggtcagccaccggaagcttggtatggctggtcagaaactgggatcatctgctttgctgtgctacatacgcccggacaccgccgatcccgcctcgagcttctcacttacagtggctaacgtcggtacgtgccaggcagtgctttgccggggcggtaagcctgtacctctgtctaaagtgtttagcttggagcaagacccagaggaagcacagagagttaaagaccagaaagcaattattactgaggacaacaaggtgaatggtgtcacctgttgcacgaggatgctcgggtgcacgtatctgtacccctggatcttgcccaagcctcacattagcagtactcctctaaccatacaggacgaactcctcatcttggggaacaaagctctttgggaacacctgtcttacactgaggcagtaaatgctgtgcgccatgtgcaagacccactcgccgctgcaaagaagctttgcacacttgcacagtcgtacgggtgccaggataacgtcggggctatggtggtgtatctgaacatcggcgaggagggctgcacctgtgaaatgaatggtctgacccttcccggtcctgtcgggttcgcctctacaacgactataaaagatgcccctaagccagcaaccccaagtagtagttctggtattgcctctgagttctccagcgaaatgtcaacatccgaggtgtcatccgaagtcggttcgacagctagcgacgagcataacgcaggagggttggataccgctctcctgccacgccccgagaggcggtgctctctccacccaaccccgacttcgggtcttttccagagacagccgtcaagcgcgaccttctcctccaaccagagtgataacggcctcgacagcgacgatgatcagcccgtcgagggggtcatcacgaacggttcgaaggttgaagtcgaagtcgacatccattgctgtcgagggagggaccttgaaaatagcccgccactgatagagtcaagtccaactctttgctctgaagaacacgctcgcgggagctgcttcggaatcagaaggcagaattccgtgaacagtggtatgctgctgcccatgtctaaagaccgcatggagctacaaaagtctccctcgacaagttgtttatacgggaaaaagctctcaaacgggtctattgtgcctctggaagactcactgaatctcatcgaggtggctacagaagtccccaaacgcaaaactggctacttcgctgcaccaacccagatggagccagaagaccagtttgtggtaccccacgatctggaagaagaggtgaaagagcagatgaaacagcatcaggatagtcgactggagcctgagccacacgaggaggatcgcacagagccacccgaggaattcgacaccgccctctag

SEQ ID NO: 25555 - DNA, 1212 bp, Artificial Sequence
  Description of Artificial Sequence: Synthetic coding sequence
atgaccgccatcatcaaggagatcgtgagccggaacaagcggcggtaccaggaggatggctttgatctggatcttacctacatttatcccaatatcattgctatgggattcccggccgaacgcctggagggggtctaccgtaataatattgacgatgtggtgagatttctggactctaagcataaaaatcactacaagatttacaatctatgtgcggagcgacactatgataccgccaagtttaattgtagggtcgctcagtatcccttcgaggatcacaatccacctcaactcgagctgatcaaaccattctgtgaggatctggatcagtggctgagcgaggatgacaatcatgtggcggccattcactgtaaagcaggaaaaggacgcaccggcgttatgatctgcgcatacctccttcaccgtgggaagtttctaaaagctcaggaagcacttgacttttacggcgaagtgaggacacgtgataagaagggggtgaccatcccatctcaacggcgctacgtgtattattacagctatttgctgaaaaaccacctggactatagaccggtcgccctgctgtttcacaaaatgatgttcgaaactatcccaatgttttccggtggcacttgcaacccccagttcgtggtgtgccagctgaaagtgaagatctactcctccaacagcggtcccactcgcagggaagacaagtttatgtacttcgaatttccgcagccactccccgtgtgtggggacataaaggtcgagttcttccataagcaaaataagatgttaaaaaaagataaaatgttccacttttgggtcaacacgttctttattcccggcccagaggaaaccagcgagaaggtagaaaacgggtccctttgcgaccaagaaattgattccatttgctcaatcgagagggccgacaacgacaaagagtatttggttctgactctgaccaaaaatgatctcgataaggccaacaaggacaaagccaaccgctactttagtcctaatttcaaagtgaagctgtactttacaaagactgttgaggaaccctcaaacccagaagctagttctagcaccagcgtaacccctgatgtgtccgacaacgaacctgaccactacaggtactctgataccactgactccgatcctgaaaatgagccgtttgacgaggatcagcatacccaaatcacgaaggtttag

SEQ ID NO: 25556 - DNA, 531 bp, Artificial Sequence
  Description of Artificial Sequence: Synthetic coding sequence
atgggcaaggccgccgccgccgtggccttcggcgccgaggtgggcgttcgcctcgctttgttcgcagctttcctggttactgagctgctccctccatttcagcgcctcatccagccagaggaaatgtggctctatagaaatccctacgtcgaggcagaatacttccccactaagccaatgtttgtgatagcctttctcagtcccctttctctcattttcctggccaaattccttaaaaaggcagataccagggattcacggcaagcttgtttagctgcttctttggctctcgctctcaacggggtgttcaccaataccattaaactgatcgttggtcggccccggcctgatttcttttaccgatgtttcccggatggtttggctcatagtgatctcatgtgcaccggcgacaaagatgtggttaatgaaggcagaaagagcttcccttctggccacagctcttgcatgaacattatttggaccctgccgtatgcttgtttccacataatagaattcaatctggagtcctag

SEQ ID NO: 25557 - DNA, 651 bp, Artificial Sequence
  Description of Artificial Sequence: Synthetic coding sequence
atgggcaaggccgccgccgccgtggccttcggcgccgaggtgggcgtgcggcttgctttgttcgccgcctttttagtgactgaactcctgcctccgttccaaaggctcattcagcctgaggagatgtggctttacagaaatccttacgtggaggccgagtacttcccaacaaagccaatgttcgttatcgcctttctgtcacccctgtccctgattttcctggccaagttcctgaagaaggcggataccagggactcccggcaggcctgtctagcagcatccctggcactggcccttaatggcgttttcacgaataccatcaagctcatagtgggtcgcccgaggccagatttcttctaccgatgcttccccgacggcctcgcccacagcgaccttatgtgcacaggagacaaggatgtggtaaacgaagggaggaaaagtttcccatcaggacacagctcatttgccttcgccggactggcctttgcatctttctacctggcgggcaaactgcactgttttactccacagggtagaggtaaatcttggcgattttgtgcatttctgagtcctcttttgtttgcagccgtcattgctctcagtaggacctgcgattataagcatcactggcagggaccttttaagtggtag

SEQ ID NO: 25558 - DNA, 795 bp, Artificial Sequence
  Description of Artificial Sequence: Synthetic coding sequence
atgggcaaggccgccgccgccgtggccttcggcgccgaggtgggcgtgagactggcactttttgcagcatttttagtgacggagctactgcccccgtttcagcgattaatacagccggaagagatgtggctgtatagaaatccatatgtggaggccgaatatttccccacaaagccaatgtttgttattgcattcctgtcacctctgtccctcatttttcttgcaaaattcctaaagaaagctgatacacgagatagcagacaggcctgcctggccgcatccctggcgctggccctgaacggggtctttactaacacaatcaaactcatcgttggccgcccccggcccgattttttctaccgctgctttcccgacggccttgcccacagtgacctgatgtgtacaggagacaaggacgtagtcaatgaaggcaggaaatctttcccgagcgggcattcctcttttgcctttgctgggctggcctttgcaagcttctacctggccggaaaattacactgctttactcctcaaggcagaggcaagagctggaggttctgtgccttcctttcccctttgcttttcgctgccgttattgccctttctaggacctgcgattacaagcaccattggcaggatgtcctcgtcggctctatgatcggaatgacttttgcatatgtatgttacagacagtattatccacccctgactgacgccgagtgccacaagccctttcaggataagctggtgctgagtacggcacaaaagccaggtgattcttactgctttgatatctag

SEQ ID NO: 25559 - DNA, 1086 bp, Artificial Sequence
  Description of Artificial Sequence: Synthetic coding sequence
atgcacggcgactacaccctgaccctgcggaagggcggcaacaacaagctcatcaagatatttcatcgagatgggaagtacgggttctccgacccccttacttttagttcagtggtggagctcattaatcactaccgcaacgagagccttgctcagtataatccgaagttagatgtcaaactcctgtacccagtgtccaaatatcaacaggaccaggtagttaaagaagacaacatagaggctgtaggaaaaaagctgcatgaatacaacacccaattccaggagaaatctagggagtacgacaggctgtacgaagagtacactaggacaagtcaggaaattcagatgaagcggaccgccattgaggccttcaatgaaaccatcaagatctttgaggaacaatgtcaaacacaagagcgctattccaaggagtacatagagaaatttaagagggagggaaacgagaaggagatccaacgtatcatgcataattatgataaactgaaatccagaatatcagaaatcatcgacagcaggcggaggctcgaggaggacctaaagaagcaggctgcagaatatcgggagatagataagcggatgaatagcattaagccagaccttattcagctgcgcaaaacccgggaccaatacctgatgtggttaacccagaagggcgtgcggcaaaagaagttgaatgagtggctgggcaatgaaaatactgaggaccagtactccttggttgaggatgacgaggatctgccccaccacgacgaaaaaacctggaatgtgggatcttccaatcggaacaaggccgaaaacctgctgcgtggcaagcgagacggtactttcctggtacgtgaatcctcaaagcaggggtgttatgcttgctcagttgttgtggacggcgaggtgaaacactgcgtcatcaacaagaccgccaccgggtatggcttcgccgagccgtataacctctacagctccctcaaggagctggtactgcactatcagcacaccagccttgtgcagcataatgactccttaaacgtgactcttgcatatccagtatatgcccagcaaaggaggtag

SEQ ID NO: 25560 - DNA, 3207 bp, Artificial Sequence
  Description of Artificial Sequence: Synthetic coding sequence
atgcccccccggcccagcagcggcgagctgtggggcatccacctgatgcctcctagaattcttgttgaatgcttgttgccgaatggcatgatcgtgactcttgagtgcttaagagaggcaaccttaattaccattaagcacgagctgttcaaagaggctaggaagtaccctctccatcagctccttcaggatgagtcatcctatatttttgtgtccgttactcaagaggcagagcgcgaagagtttttcgatgagaccaggcgattgtgcgatctgagactcttccagccttttctgaaagtgattgaacctgtggggaacagagaggaaaagatactgaatcgtgagatagggtttgccatcggaatgccagtctgtgaattcgacatggtaaaagaccccgaagtgcaggacttccggcgcaatattcttaatgtgtgtaaggaagcagtcgacttgcgcgacttgaactcccctcatagcagagcaatgtacgtgtacccacccaatgtggagtctagccccgaactgcctaagcacatctataacaagctcgataagggccagataatcgtggtgatttgggtgattgtgagccccaacaacgataagcagaagtacactctgaaaataaatcatgattgcgtgcccgaacaggtcatcgccgaggctatccgaaagaagacacgctcaatgctactgtcgtccgagcagctcaagctctgtgttctggagtaccaggggaaatacattctgaaggtttgtggctgcgatgaatactttctcgagaagtaccccctgtcacagtataaatatataaggtcttgcatcatgctcggaaggatgcctaacttaatgctcatggcaaaggagagtctatactcacaactacctatggactgctttaccatgccttcctatagcagacggatttctactgccactccctacatgaatggcgagacaagcacaaaatccctctgggttatcaacagtgctctgagaatcaaaatcctctgtgccacttacgtgaatgtgaatattagagacattgacaaaatatatgtcaggacaggaatctatcacgggggcgagcccctgtgtgacaacgtcaatacccagcgagtgccttgcagcaaccccaggtggaacgagtggctcaattacgatatctatattcctgatctcccccgcgcagcccgcctgtgtctcagtatctgcagcgtgaaaggccgcaaaggagcaaaagaggagcattgcccactcgcctggggtaacatcaatttgttcgactacacagacactctggtctccggcaaaatggcattaaacttatggcctgtgccacacggtttagaggacttgctgaatcccatcggcgtcacaggcagcaatcctaacaaagagacaccatgcttggagctggagtttgattggttcagctctgtggtgaagttccctgacatgtccgttattgaggagcacgcaaactggagcgtatcaagagaagccggcttttcttactctcacgcaggcctcagcaacaggctggccagagataatgagctcagggagaacgacaaagagcagctgaaagcaatctccaccagggatcccctttctgagatcactgagcaagaaaaggactttctctggtcacaccgtcattactgtgtgacaatcccagaaatcttgcctaagctgctcctctctgtgaagtggaacagcagagatgaggtggcgcagatgtattgcttggtgaaagattggcccccaatcaagcctgaacaggctatggagctcctggactgcaattaccctgatcctatggtccgcggtttcgccgtgcggtgtctggaaaagtatctaaccgatgataagctgtcacagtatctgatccagcttgtacaggtgttaaagtatgaacagtatctggataacctgttggtcaggttcctgctcaagaaagcactgactaatcagagaatcggccacttcttcttttggcatctcaagagtgagatgcacaacaagaccgtgagccagagatttggcctgctgctggagtcctactgcagagcctgcggtatgtatctcaagcacctgaacagacaggttgaagctatggagaagttgattaatctgactgatattcttaaacaggagaagaaagacgaaactcagaaagtgcagatgaagtttctcgttgaacaaatgcggcggcctgacttcatggacgcactccaggggttcctctcaccccttaatcccgcccatcaactgggcaatctgagattggaagaatgccgtatcatgtctagcgcgaaaaggcctttgtggctaaactgggaaaacccagatatcatgtctgaactgttgtttcagaataatgagatcatctttaagaacggggatgacctgcggcaagacatgctcacgcttcaaattattcggattatggagaacatttggcaaaatcaaggcttagacttacggatgcttccatatggatgcctgtctatcggtgactgcgttgggctgattgaggtggtaaggaatagccacacaataatgcaaattcaatgcaaaggtgggctgaaaggagctcttcagttcaattctcacacgttgcatcagtggctgaaggacaaaaacaaaggtgagatctacgacgccgccattgatctgttcactcgtagttgtgctggttactgtgttgcaacttttatcctcgggattggggacagacataatagcaatattatggtgaaggatgacgggcagctgttccatatagactttggtcacttcctggatcacaagaaaaagaagtttgggtataaacgggagcgggtgccatttgttttgacgcaagattttttgatcgtgatctccaaaggggcacaggaatgcaccaagacgcgggagttcgagcgcttccaagaaatgtgctacaaggcttatttagctatccgccagcacgccaatctctttatcaacctctttagcatgatgctgggctctggcatgccagaattgcaaagctttgatgacatagcgtacatccgaaaaacgctggccttggacaagaccgaacaggaggccctggaatactttatgaagcagatgaatgatgcacatcacggaggctggacaaccaagatggactggatctttcatacaataaaacagcatgctctgaactag

SEQ ID NO: 25561 - DNA, 357 bp, Artificial Sequence
  Description of Artificial Sequence: Synthetic coding sequence
atgcccccccggcccagcagcggcgagctgtggggcatccacctgatgccgccaaggattcttgtggagtgcctattacctaacggtatgattgtaactcttgagtgtctcagggaggccactctcatcacgattaagcacgagctgtttaaggaggccaggaagtacccactgcaccagctcttgcaagatgagagtagctacatatttgtatccgttacccaggaagccgaaagggaggagttcttcgatgagactcggcgcctgtgcgatctgcggcttttccagccctttcttaaggtgattgagcccgtcggcaacagggaagagaagattctgaaccgtgaaatcggctag

SEQ ID NO: 25562 - DNA, 66 bp, Artificial Sequence
  Description of Artificial Sequence: Synthetic coding sequence
atgcccccccggcccagcagcggcgagctgtggggcatccacctgatgcctcctcgcattctgtag
